United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 183

SEQ ID NO: 7629140 - DNA, 22 bp, Homo sapiens
caaaggttggaaatgtttacca

SEQ ID NO: 7629141 - DNA, 22 bp, Homo sapiens
caaaggtttcacagtagcccat

SEQ ID NO: 7629142 - DNA, 22 bp, Homo sapiens
caaagtaaactaccactgtttc

SEQ ID NO: 7629143 - DNA, 22 bp, Homo sapiens
caaagtaaactaccactgtttc

SEQ ID NO: 7629144 - DNA, 22 bp, Homo sapiens
caaagtaaactaccactgtttc

SEQ ID NO: 7629145 - DNA, 22 bp, Homo sapiens
caaaggtttcacagtagcccat

SEQ ID NO: 7629146 - DNA, 22 bp, Homo sapiens
caaagtaatttggagatatata

SEQ ID NO: 7629147 - DNA, 22 bp, Homo sapiens
caaagtaatttggagatatata

SEQ ID NO: 7629148 - DNA, 22 bp, Homo sapiens
caaagtaatttggagatatata

SEQ ID NO: 7629149 - DNA, 22 bp, Homo sapiens
caaagtaattacggttttggcc

SEQ ID NO: 7629150 - DNA, 22 bp, Homo sapiens
caaagtaatatggtcccagtga

SEQ ID NO: 7629151 - DNA, 22 bp, Homo sapiens
caaagtaactgcctttccaatt

SEQ ID NO: 7629152 - DNA, 22 bp, Homo sapiens
caaagtaactgcctttccaatt

SEQ ID NO: 7629153 - DNA, 22 bp, Homo sapiens
caaagtaatatggtcccagtga

SEQ ID NO: 7629154 - DNA, 22 bp, Homo sapiens
caaagtaactgcctttccaatt

SEQ ID NO: 7629155 - DNA, 22 bp, Homo sapiens
caaagtacagtgcttcctggga

SEQ ID NO: 7629156 - DNA, 22 bp, Homo sapiens
caaagtaatttggagatatata

SEQ ID NO: 7629157 - DNA, 22 bp, Homo sapiens
caaagtaatttggagatatata

SEQ ID NO: 7629158 - DNA, 22 bp, Homo sapiens
caaagtatattggattgaatgg

SEQ ID NO: 7629159 - DNA, 22 bp, Homo sapiens
caaagtatagtgtaggatggca

SEQ ID NO: 7629160 - DNA, 22 bp, Homo sapiens
caaagtatagtgtaggatggca

SEQ ID NO: 7629161 - DNA, 19 bp, Homo sapiens
caaagtacctggcacagtg

SEQ ID NO: 7629162 - DNA, 22 bp, Homo sapiens
caaagtatattggattgaatgg

SEQ ID NO: 7629163 - DNA, 22 bp, Homo sapiens
caaagtatattggattgaatgg

SEQ ID NO: 7629164 - DNA, 22 bp, Homo sapiens
caaagtatattggattgaatgg

SEQ ID NO: 7629165 - DNA, 22 bp, Homo sapiens
caaagtaatttggagatatata

SEQ ID NO: 7629166 - DNA, 22 bp, Homo sapiens
caaagtatattggattgaatgg

SEQ ID NO: 7629167 - DNA, 22 bp, Homo sapiens
caaagtatattggattgaatgg

SEQ ID NO: 7629168 - DNA, 22 bp, Homo sapiens
caaagtatattggattgaatgg

SEQ ID NO: 7629169 - DNA, 22 bp, Homo sapiens
caaagtatatttcatagtctca

SEQ ID NO: 7629170 - DNA, 22 bp, Homo sapiens
caaagtatatttcatagtctca

SEQ ID NO: 7629171 - DNA, 22 bp, Homo sapiens
caaagtatattggattgaatgg

SEQ ID NO: 7629172 - DNA, 22 bp, Homo sapiens
caaagtatatttcatagtctca

SEQ ID NO: 7629173 - DNA, 22 bp, Homo sapiens
caaagtatgaaccagtttctct

SEQ ID NO: 7629174 - DNA, 22 bp, Homo sapiens
caaagtatgaaccagtttctct

SEQ ID NO: 7629175 - DNA, 22 bp, Homo sapiens
gctcctgaaggctctgcagggt

SEQ ID NO: 7629176 - DNA, 22 bp, Homo sapiens
gctcctgaaggctctgcagggt

SEQ ID NO: 7629177 - DNA, 22 bp, Homo sapiens
gctcctgaaggctctgcagggt

SEQ ID NO: 7629178 - DNA, 22 bp, Homo sapiens
gctcctgaaggctctgcagggt

SEQ ID NO: 7629179 - DNA, 22 bp, Homo sapiens
gctcctgaaggctctgcagggt

SEQ ID NO: 7629180 - DNA, 22 bp, Homo sapiens
gctcctgaaggctctgcagggt

SEQ ID NO: 7629181 - DNA, 22 bp, Homo sapiens
caaagtatatttcatagtctca

SEQ ID NO: 7629182 - DNA, 22 bp, Homo sapiens
caaagtatcaactcccacactg

SEQ ID NO: 7629183 - DNA, 22 bp, Homo sapiens
caaagtatcaactcccacactg

SEQ ID NO: 7629184 - DNA, 22 bp, Homo sapiens
caaagtatatttcatagtctca

SEQ ID NO: 7629185 - DNA, 22 bp, Homo sapiens
caaagtatatttcatagtctca

SEQ ID NO: 7629186 - DNA, 22 bp, Homo sapiens
caaagtatgaaccagtttctct

SEQ ID NO: 7629187 - DNA, 22 bp, Homo sapiens
caaagtatgaaccagtttctct

SEQ ID NO: 7629188 - DNA, 22 bp, Homo sapiens
caaagtatcaactcccacactg

SEQ ID NO: 7629189 - DNA, 22 bp, Homo sapiens
caaagtatatttcatagtctca

SEQ ID NO: 7629190 - DNA, 22 bp, Homo sapiens
caaagtatgaaccagtttctct

SEQ ID NO: 7629191 - DNA, 22 bp, Homo sapiens
gctcctgcaggacccaggagac

SEQ ID NO: 7629192 - DNA, 22 bp, Homo sapiens
gctcctgcaggacccaggagac

SEQ ID NO: 7629193 - DNA, 22 bp, Homo sapiens
gctcctgcaggacccaggagac

SEQ ID NO: 7629194 - DNA, 22 bp, Homo sapiens
gctcctgcaggacccaggagac

SEQ ID NO: 7629195 - DNA, 18 bp, Homo sapiens
gctcctggaccaggtcac

SEQ ID NO: 7629196 - DNA, 18 bp, Homo sapiens
gctcctggaccaggtcac

SEQ ID NO: 7629197 - DNA, 18 bp, Homo sapiens
gctcctggaccaggtcac

SEQ ID NO: 7629198 - DNA, 18 bp, Homo sapiens
gctcctggaccaggtcac

SEQ ID NO: 7629199 - DNA, 17 bp, Homo sapiens
gctcctgcaggtcagga

SEQ ID NO: 7629200 - DNA, 17 bp, Homo sapiens
gctcctgcaggtcagga

SEQ ID NO: 7629201 - DNA, 17 bp, Homo sapiens
gctcctgcaggtcagga

SEQ ID NO: 7629202 - DNA, 22 bp, Homo sapiens
gctcctgccctcttgcaattcc

SEQ ID NO: 7629203 - DNA, 22 bp, Homo sapiens
gctgaggtggaggaaggagacc

SEQ ID NO: 7629204 - DNA, 22 bp, Homo sapiens
gctgaggtggaggaaggagacc

SEQ ID NO: 7629205 - DNA, 22 bp, Homo sapiens
gctgcagacttctcatctcatt

SEQ ID NO: 7629206 - DNA, 22 bp, Homo sapiens
gctgcagactgggaggcaggtg

SEQ ID NO: 7629207 - DNA, 22 bp, Homo sapiens
gctgcagacttctcatctcatt

SEQ ID NO: 7629208 - DNA, 22 bp, Homo sapiens
gctgcagagacagctgccgatg

SEQ ID NO: 7629209 - DNA, 22 bp, Homo sapiens
gctgcagacttctcatctcatt

SEQ ID NO: 7629210 - DNA, 22 bp, Homo sapiens
gctgcagagacagctgccgatg

SEQ ID NO: 7629211 - DNA, 22 bp, Homo sapiens
gctgcagagacagctgccgatg

SEQ ID NO: 7629212 - DNA, 20 bp, Homo sapiens
gctgaggtggaggaaggaga

SEQ ID NO: 7629213 - DNA, 19 bp, Homo sapiens
gctcctggatgacctgtgg

SEQ ID NO: 7629214 - DNA, 20 bp, Homo sapiens
gctgaggtggaggaaggaga

SEQ ID NO: 7629215 - DNA, 22 bp, Homo sapiens
gctgaggtggaggaaggagacc

SEQ ID NO: 7629216 - DNA, 19 bp, Homo sapiens
gctcctggatgacctgtgg

SEQ ID NO: 7629217 - DNA, 19 bp, Homo sapiens
gctcctggatgacctgtgg

SEQ ID NO: 7629218 - DNA, 19 bp, Homo sapiens
gctcctggatgacctgtgg

SEQ ID NO: 7629219 - DNA, 22 bp, Homo sapiens
gctcctggagagattgagaaag

SEQ ID NO: 7629220 - DNA, 22 bp, Homo sapiens
gctcctggagagattgagaaag

SEQ ID NO: 7629221 - DNA, 22 bp, Homo sapiens
gctcctggagagattgagaaag

SEQ ID NO: 7629222 - DNA, 18 bp, Homo sapiens
gctcctggaccaggtcac

SEQ ID NO: 7629223 - DNA, 18 bp, Homo sapiens
gctcctggaccaggtcac

SEQ ID NO: 7629224 - DNA, 18 bp, Homo sapiens
gctcctggaccaggtcac

SEQ ID NO: 7629225 - DNA, 18 bp, Homo sapiens
gctcctggaccaggtcac

SEQ ID NO: 7629226 - DNA, 18 bp, Homo sapiens
gctcctggagtctgactc

SEQ ID NO: 7629227 - DNA, 18 bp, Homo sapiens
gctcctggagtctgactc

SEQ ID NO: 7629228 - DNA, 18 bp, Homo sapiens
gctcctggagtctgactc

SEQ ID NO: 7629229 - DNA, 18 bp, Homo sapiens
gctcctggagtctgactc

SEQ ID NO: 7629230 - DNA, 18 bp, Homo sapiens
gctcctggagtctgactc

SEQ ID NO: 7629231 - DNA, 18 bp, Homo sapiens
gctcctggagtctgactc

SEQ ID NO: 7629232 - DNA, 19 bp, Homo sapiens
gctcctggatgacctgtgg

SEQ ID NO: 7629233 - DNA, 19 bp, Homo sapiens
gctcctggatgacctgtgg

SEQ ID NO: 7629234 - DNA, 19 bp, Homo sapiens
gctcctggatgacctgtgg

SEQ ID NO: 7629235 - DNA, 18 bp, Homo sapiens
gctcctggagtctgactc

SEQ ID NO: 7629236 - DNA, 22 bp, Homo sapiens
gctgcagcccggcgcgcctgag

SEQ ID NO: 7629237 - DNA, 22 bp, Homo sapiens
gctgcagcccggcgcgcctgag

SEQ ID NO: 7629238 - DNA, 22 bp, Homo sapiens
gctgcagccaaattcattgtca

SEQ ID NO: 7629239 - DNA, 22 bp, Homo sapiens
gctgcagcccggcgcgcctgag

SEQ ID NO: 7629240 - DNA, 22 bp, Homo sapiens
gctgcagcccggcgcgcctgag

SEQ ID NO: 7629241 - DNA, 22 bp, Homo sapiens
gctgcagccaaattcattgtca

SEQ ID NO: 7629242 - DNA, 22 bp, Homo sapiens
gctgcagcagctgcagggttgt

SEQ ID NO: 7629243 - DNA, 19 bp, Homo sapiens
gctgcagcagagaaactgg

SEQ ID NO: 7629244 - DNA, 19 bp, Homo sapiens
gctgcagcagagaaactgg

SEQ ID NO: 7629245 - DNA, 22 bp, Homo sapiens
gctgcagcagctgcagggttgt

SEQ ID NO: 7629246 - DNA, 22 bp, Homo sapiens
gctgcagcaagccctccagggg

SEQ ID NO: 7629247 - DNA, 22 bp, Homo sapiens
gctgcagcaagccctccagggg

SEQ ID NO: 7629248 - DNA, 22 bp, Homo sapiens
gctgcagcaagccctccagggg

SEQ ID NO: 7629249 - DNA, 22 bp, Homo sapiens
gctgcagcagaagttctcagag

SEQ ID NO: 7629250 - DNA, 22 bp, Homo sapiens
gctgcagcagaagttctcagag

SEQ ID NO: 7629251 - DNA, 22 bp, Homo sapiens
gctgcagcagaagttctcagag

SEQ ID NO: 7629252 - DNA, 19 bp, Homo sapiens
gctgcagcagagaaactgg

SEQ ID NO: 7629253 - DNA, 19 bp, Homo sapiens
gctgcagcagagaaactgg

SEQ ID NO: 7629254 - DNA, 19 bp, Homo sapiens
gctgcagcagagaaactgg

SEQ ID NO: 7629255 - DNA, 22 bp, Homo sapiens
gctgcagagggaggggctcgca

SEQ ID NO: 7629256 - DNA, 22 bp, Homo sapiens
gctgcagagggaggggctcgca

SEQ ID NO: 7629257 - DNA, 19 bp, Homo sapiens
gctgcagaggtgaagaaga

SEQ ID NO: 7629258 - DNA, 22 bp, Homo sapiens
gctgcagagggtcttagagagg

SEQ ID NO: 7629259 - DNA, 22 bp, Homo sapiens
gctgcagagggaggggctcgca

SEQ ID NO: 7629260 - DNA, 22 bp, Homo sapiens
gctgcagagcctggagccctgg

SEQ ID NO: 7629261 - DNA, 22 bp, Homo sapiens
gctgcagagcctggagccctgg

SEQ ID NO: 7629262 - DNA, 22 bp, Homo sapiens
gctgcagagcctggagccctgg

SEQ ID NO: 7629263 - DNA, 22 bp, Homo sapiens
gctgcagagatgggtgcccttt

SEQ ID NO: 7629264 - DNA, 22 bp, Homo sapiens
gctgcagagacagctgccgatg

SEQ ID NO: 7629265 - DNA, 22 bp, Homo sapiens
gctgcagagatgggtgcccttt

SEQ ID NO: 7629266 - DNA, 22 bp, Homo sapiens
gctgcagagtgatgaagtgggg

SEQ ID NO: 7629267 - DNA, 19 bp, Homo sapiens
gctgcagagtattcttggg

SEQ ID NO: 7629268 - DNA, 19 bp, Homo sapiens
gctgcagagtattcttggg

SEQ ID NO: 7629269 - DNA, 22 bp, Homo sapiens
gctgcagatcccacccattccc

SEQ ID NO: 7629270 - DNA, 22 bp, Homo sapiens
gctgcagagtgatgaagtgggg

SEQ ID NO: 7629271 - DNA, 22 bp, Homo sapiens
gctgcagagtgatgaagtgggg

SEQ ID NO: 7629272 - DNA, 22 bp, Homo sapiens
gctgcagatcccacccattccc

SEQ ID NO: 7629273 - DNA, 22 bp, Homo sapiens
ggagggagtttcattcctgccc

SEQ ID NO: 7629274 - DNA, 22 bp, Homo sapiens
ggagggagtttcattcctgccc

SEQ ID NO: 7629275 - DNA, 22 bp, Homo sapiens
ggagggagtttcattcctgccc

SEQ ID NO: 7629276 - DNA, 22 bp, Homo sapiens
ggagggagtttcattcctgccc

SEQ ID NO: 7629277 - DNA, 22 bp, Homo sapiens
ggagggagtttcattcctgccc

SEQ ID NO: 7629278 - DNA, 22 bp, Homo sapiens
ggagggagtttcattcctgccc

SEQ ID NO: 7629279 - DNA, 22 bp, Homo sapiens
ggatccttctttgacctcacag

SEQ ID NO: 7629280 - DNA, 22 bp, Homo sapiens
ggagggagtttcattcctgccc

SEQ ID NO: 7629281 - DNA, 22 bp, Homo sapiens
ggagggagtttcattcctgccc

SEQ ID NO: 7629282 - DNA, 22 bp, Homo sapiens
ggatccttaactatcacagtga

SEQ ID NO: 7629283 - DNA, 22 bp, Homo sapiens
ggatcctgatatgtgtttctca

SEQ ID NO: 7629284 - DNA, 22 bp, Homo sapiens
ggagggagtcagctgattagaa

SEQ ID NO: 7629285 - DNA, 22 bp, Homo sapiens
ggagggagtcagctgattagaa

SEQ ID NO: 7629286 - DNA, 22 bp, Homo sapiens
ggagggagtcagctgattagaa

SEQ ID NO: 7629287 - DNA, 22 bp, Homo sapiens
ggagggagtcagctgattagaa

SEQ ID NO: 7629288 - DNA, 22 bp, Homo sapiens
ggagggagtcagctgattagaa

SEQ ID NO: 7629289 - DNA, 22 bp, Homo sapiens
ggagggagtcagctgattagaa

SEQ ID NO: 7629290 - DNA, 22 bp, Homo sapiens
ggagggagtcagctgattagaa

SEQ ID NO: 7629291 - DNA, 22 bp, Homo sapiens
ggagggagtcagctgattagaa

SEQ ID NO: 7629292 - DNA, 23 bp, Homo sapiens
ggatgggcaagcctagtgcctac

SEQ ID NO: 7629293 - DNA, 23 bp, Homo sapiens
ggatgggcaagcctagtgcctac

SEQ ID NO: 7629294 - DNA, 23 bp, Homo sapiens
ggatgggcaagcctagtgcctac

SEQ ID NO: 7629295 - DNA, 22 bp, Homo sapiens
ggatgggcagacaggacggcac

SEQ ID NO: 7629296 - DNA, 22 bp, Homo sapiens
ggatgggcagacaggacggcac

SEQ ID NO: 7629297 - DNA, 22 bp, Homo sapiens
ggatgggcagacaggacggcac

SEQ ID NO: 7629298 - DNA, 22 bp, Homo sapiens
ggatgggagcagaggacgacca

SEQ ID NO: 7629299 - DNA, 22 bp, Homo sapiens
ggatgggagcagaggacgacca

SEQ ID NO: 7629300 - DNA, 22 bp, Homo sapiens
ggatgggagcagaggacgacca

SEQ ID NO: 7629301 - DNA, 22 bp, Homo sapiens
ggatgggagcagaggacgacca

SEQ ID NO: 7629302 - DNA, 22 bp, Homo sapiens
ggatgggagcagaggacgacca

SEQ ID NO: 7629303 - DNA, 22 bp, Homo sapiens
ggatgggagcagaggacgacca

SEQ ID NO: 7629304 - DNA, 22 bp, Homo sapiens
ggatgggagcagaggacgacca

SEQ ID NO: 7629305 - DNA, 22 bp, Homo sapiens
ggatgggagcagaggacgacca

SEQ ID NO: 7629306 - DNA, 22 bp, Homo sapiens
ggatgggaacttggtagggcat

SEQ ID NO: 7629307 - DNA, 22 bp, Homo sapiens
ggatgggaacttggtagggcat

SEQ ID NO: 7629308 - DNA, 22 bp, Homo sapiens
ggatctgagagcaagcaggacc

SEQ ID NO: 7629309 - DNA, 22 bp, Homo sapiens
ggatctgattaataaggtggac

SEQ ID NO: 7629310 - DNA, 22 bp, Homo sapiens
ggatctggggctctgctgctca

SEQ ID NO: 7629311 - DNA, 22 bp, Homo sapiens
ggatgggaacttggtagggcat

SEQ ID NO: 7629312 - DNA, 22 bp, Homo sapiens
ggatgggaacttggtagggcat

SEQ ID NO: 7629313 - DNA, 22 bp, Homo sapiens
ggatgggaacttggtagggcat

SEQ ID NO: 7629314 - DNA, 22 bp, Homo sapiens
ggagggagcatccccttgctga

SEQ ID NO: 7629315 - DNA, 22 bp, Homo sapiens
ggagggagcatccccttgctga

SEQ ID NO: 7629316 - DNA, 22 bp, Homo sapiens
ggagggagcatccccttgctga

SEQ ID NO: 7629317 - DNA, 22 bp, Homo sapiens
ggagggagcatccccttgctga

SEQ ID NO: 7629318 - DNA, 22 bp, Homo sapiens
ggagggagcatccccttgctga

SEQ ID NO: 7629319 - DNA, 22 bp, Homo sapiens
ggagggagcatccccttgctga

SEQ ID NO: 7629320 - DNA, 22 bp, Homo sapiens
ggagggagcagagaacccaacc

SEQ ID NO: 7629321 - DNA, 22 bp, Homo sapiens
ggagggagcagagaacccaacc

SEQ ID NO: 7629322 - DNA, 22 bp, Homo sapiens
ggagggagcagagaacccaacc

SEQ ID NO: 7629323 - DNA, 22 bp, Homo sapiens
ggagggagcagagaacccaacc

SEQ ID NO: 7629324 - DNA, 22 bp, Homo sapiens
ggagggagcagagaacccaacc

SEQ ID NO: 7629325 - DNA, 22 bp, Homo sapiens
ggagggagcagagaacccaacc

SEQ ID NO: 7629326 - DNA, 22 bp, Homo sapiens
ggagggagcagagaacccaacc

SEQ ID NO: 7629327 - DNA, 22 bp, Homo sapiens
ggaggcggaggttgcagtgagc

SEQ ID NO: 7629328 - DNA, 22 bp, Homo sapiens
ggaggcggaggctgcagtgagc

SEQ ID NO: 7629329 - DNA, 22 bp, Homo sapiens
ggaggcggaggctgcagtgagc

SEQ ID NO: 7629330 - DNA, 22 bp, Homo sapiens
ggaggcggaggctgcagtgagc

SEQ ID NO: 7629331 - DNA, 22 bp, Homo sapiens
ggaggcggaggctgcagtgagc

SEQ ID NO: 7629332 - DNA, 22 bp, Homo sapiens
ggaggcggaggctgcagtgagc

SEQ ID NO: 7629333 - DNA, 22 bp, Homo sapiens
ggaggcggaggctgcagtgagc

SEQ ID NO: 7629334 - DNA, 22 bp, Homo sapiens
ggaggcggaggctgcagtgagc

SEQ ID NO: 7629335 - DNA, 22 bp, Homo sapiens
ggagggaggttagattcaagct

SEQ ID NO: 7629336 - DNA, 22 bp, Homo sapiens
ggagggaggttagattcaagct

SEQ ID NO: 7629337 - DNA, 22 bp, Homo sapiens
ggagggaggttagattcaagct

SEQ ID NO: 7629338 - DNA, 22 bp, Homo sapiens
ggagggaggttagattcaagct

SEQ ID NO: 7629339 - DNA, 22 bp, Homo sapiens
ggagggaggttagattcaagct

SEQ ID NO: 7629340 - DNA, 22 bp, Homo sapiens
ggagggaggttagattcaagct

SEQ ID NO: 7629341 - DNA, 22 bp, Homo sapiens
ggagggaggttagattcaagct

SEQ ID NO: 7629342 - DNA, 22 bp, Homo sapiens
ggagggaggttagattcaagct

SEQ ID NO: 7629343 - DNA, 22 bp, Homo sapiens
ggagggaggttagattcaagct

SEQ ID NO: 7629344 - DNA, 22 bp, Homo sapiens
ggagggagggctagaccaaaga

SEQ ID NO: 7629345 - DNA, 22 bp, Homo sapiens
ggagggagggctagaccaaaga

SEQ ID NO: 7629346 - DNA, 22 bp, Homo sapiens
ggagggagggctagaccaaaga

SEQ ID NO: 7629347 - DNA, 22 bp, Homo sapiens
ggagggagggctagaccaaaga

SEQ ID NO: 7629348 - DNA, 22 bp, Homo sapiens
ggagggagggctagaccaaaga

SEQ ID NO: 7629349 - DNA, 22 bp, Homo sapiens
ggagggagggctagaccaaaga

SEQ ID NO: 7629350 - DNA, 22 bp, Homo sapiens
ggagggagggctagaccaaaga

SEQ ID NO: 7629351 - DNA, 22 bp, Homo sapiens
ggagggagggctagaccaaaga

SEQ ID NO: 7629352 - DNA, 22 bp, Homo sapiens
ggagggagggctagaccaaaga

SEQ ID NO: 7629353 - DNA, 22 bp, Homo sapiens
ggagggagggctagaccaaaga

SEQ ID NO: 7629354 - DNA, 22 bp, Homo sapiens
ggagggagcatccccttgctga

SEQ ID NO: 7629355 - DNA, 22 bp, Homo sapiens
ggagggagcatccccttgctga

SEQ ID NO: 7629356 - DNA, 22 bp, Homo sapiens
ggagggagcatccccttgctga

SEQ ID NO: 7629357 - DNA, 22 bp, Homo sapiens
cacagggagttacagaagcact

SEQ ID NO: 7629358 - DNA, 22 bp, Homo sapiens
cacagggagttacagaagcact

SEQ ID NO: 7629359 - DNA, 22 bp, Homo sapiens
cacagggcaccagttggccatc

SEQ ID NO: 7629360 - DNA, 22 bp, Homo sapiens
cacagggcaccagttggccatc

SEQ ID NO: 7629361 - DNA, 22 bp, Homo sapiens
cacagggcaccagttggccatc

SEQ ID NO: 7629362 - DNA, 22 bp, Homo sapiens
cacagggcaccagttggccatc

SEQ ID NO: 7629363 - DNA, 22 bp, Homo sapiens
cacagggcagagacctgggtgc

SEQ ID NO: 7629364 - DNA, 22 bp, Homo sapiens
cacagggcagagacctgggtgc

SEQ ID NO: 7629365 - DNA, 22 bp, Homo sapiens
cacagggcagagacctgggtgc

SEQ ID NO: 7629366 - DNA, 22 bp, Homo sapiens
cacagggagttacagaagcact

SEQ ID NO: 7629367 - DNA, 22 bp, Homo sapiens
cacagggagttacagaagcact

SEQ ID NO: 7629368 - DNA, 22 bp, Homo sapiens
cacagggagttacagaagcact

SEQ ID NO: 7629369 - DNA, 22 bp, Homo sapiens
cacagggagttacagaagcact

SEQ ID NO: 7629370 - DNA, 22 bp, Homo sapiens
cacagggagttacagaagcact

SEQ ID NO: 7629371 - DNA, 23 bp, Homo sapiens
cacagggagggaaactctttcag

SEQ ID NO: 7629372 - DNA, 22 bp, Homo sapiens
cacagggaggcggtcactggct

SEQ ID NO: 7629373 - DNA, 22 bp, Homo sapiens
cacagggaggcggtcactggct

SEQ ID NO: 7629374 - DNA, 22 bp, Homo sapiens
cacagggaggcggtcactggct

SEQ ID NO: 7629375 - DNA, 22 bp, Homo sapiens
cacagggagaggaacagcgcag

SEQ ID NO: 7629376 - DNA, 22 bp, Homo sapiens
cacagggagaggaacagcgcag

SEQ ID NO: 7629377 - DNA, 22 bp, Homo sapiens
cacagggagaggaacagcgcag

SEQ ID NO: 7629378 - DNA, 22 bp, Homo sapiens
cacagggagaggaacagcgcag

SEQ ID NO: 7629379 - DNA, 22 bp, Homo sapiens
cacagggagaggaacagcgcag

SEQ ID NO: 7629380 - DNA, 19 bp, Homo sapiens
cacagggagaccacatgtc

SEQ ID NO: 7629381 - DNA, 22 bp, Homo sapiens
ggatgttgattgaatggccatt

SEQ ID NO: 7629382 - DNA, 19 bp, Homo sapiens
cacagggagaccacatgtc

SEQ ID NO: 7629383 - DNA, 19 bp, Homo sapiens
cacagggagaccacatgtc

SEQ ID NO: 7629384 - DNA, 19 bp, Homo sapiens
cacagggagaccacatgtc

SEQ ID NO: 7629385 - DNA, 22 bp, Homo sapiens
ggatgttgattgaatggccatt

SEQ ID NO: 7629386 - DNA, 22 bp, Homo sapiens
ggatgttctggggttctcttgt

SEQ ID NO: 7629387 - DNA, 22 bp, Homo sapiens
cacagggaggcagccatgctcc

SEQ ID NO: 7629388 - DNA, 22 bp, Homo sapiens
cacagggaggcagccatgctcc

SEQ ID NO: 7629389 - DNA, 22 bp, Homo sapiens
cacagggaggcagccatgctcc

SEQ ID NO: 7629390 - DNA, 22 bp, Homo sapiens
cacagggaggacatcaacagtg

SEQ ID NO: 7629391 - DNA, 22 bp, Homo sapiens
cacagggaggacatcaacagtg

SEQ ID NO: 7629392 - DNA, 22 bp, Homo sapiens
cacagggaggacatcaacagtg

SEQ ID NO: 7629393 - DNA, 22 bp, Homo sapiens
cacagggaggacatcaacagtg

SEQ ID NO: 7629394 - DNA, 22 bp, Homo sapiens
cacagggaggacatcaacagtg

SEQ ID NO: 7629395 - DNA, 22 bp, Homo sapiens
cacagggaggacatcaacagtg

SEQ ID NO: 7629396 - DNA, 22 bp, Homo sapiens
ggatgttctggggttctcttgt

SEQ ID NO: 7629397 - DNA, 22 bp, Homo sapiens
ggatgttctggggttctcttgt

SEQ ID NO: 7629398 - DNA, 22 bp, Homo sapiens
ggatgttctggggttctcttgt

SEQ ID NO: 7629399 - DNA, 22 bp, Homo sapiens
ggatgttctggggttctcttgt

SEQ ID NO: 7629400 - DNA, 22 bp, Homo sapiens
ggatgttctggggttctcttgt

SEQ ID NO: 7629401 - DNA, 22 bp, Homo sapiens
ggatgtggaccttgcctggtga

SEQ ID NO: 7629402 - DNA, 22 bp, Homo sapiens
ggatgtgaatctgggctgagac

SEQ ID NO: 7629403 - DNA, 22 bp, Homo sapiens
ggatgttctggggttctcttgt

SEQ ID NO: 7629404 - DNA, 22 bp, Homo sapiens
ggatgtgaatctgggctgagac

SEQ ID NO: 7629405 - DNA, 22 bp, Homo sapiens
ggatgtgaatctgggctgagac

SEQ ID NO: 7629406 - DNA, 22 bp, Homo sapiens
ggatgtgaatctgggctgagac

SEQ ID NO: 7629407 - DNA, 22 bp, Homo sapiens
ggatgggagcagaggacgacca

SEQ ID NO: 7629408 - DNA, 22 bp, Homo sapiens
ggatgtcgaggatggggtagca

SEQ ID NO: 7629409 - DNA, 22 bp, Homo sapiens
ggatgggcccgggacggcgctg

SEQ ID NO: 7629410 - DNA, 22 bp, Homo sapiens
ggatgggcagacaggacggcac

SEQ ID NO: 7629411 - DNA, 22 bp, Homo sapiens
ggatgggcagacaggacggcac

SEQ ID NO: 7629412 - DNA, 22 bp, Homo sapiens
ggatgggctgaaaggtagcccc

SEQ ID NO: 7629413 - DNA, 22 bp, Homo sapiens
ggatgggcccgggacggcgctg

SEQ ID NO: 7629414 - DNA, 22 bp, Homo sapiens
ggatgggcccgggacggcgctg

SEQ ID NO: 7629415 - DNA, 22 bp, Homo sapiens
ggatgtcgaggatggggtagca

SEQ ID NO: 7629416 - DNA, 22 bp, Homo sapiens
ggatgtagtgcaaggagtgaat

SEQ ID NO: 7629417 - DNA, 19 bp, Homo sapiens
ggatggtggggtgcccatc

SEQ ID NO: 7629418 - DNA, 22 bp, Homo sapiens
ggatgtaactttcctagtccat

SEQ ID NO: 7629419 - DNA, 19 bp, Homo sapiens
ggatggtggggtgcccatc

SEQ ID NO: 7629420 - DNA, 22 bp, Homo sapiens
ggatggtcagaggaccaaatac

SEQ ID NO: 7629421 - DNA, 22 bp, Homo sapiens
ggatgggttccgtgggcaaatg

SEQ ID NO: 7629422 - DNA, 22 bp, Homo sapiens
ggatgggtgactttgggcaatg

SEQ ID NO: 7629423 - DNA, 22 bp, Homo sapiens
ggatgggctgaaaggtagcccc

SEQ ID NO: 7629424 - DNA, 22 bp, Homo sapiens
ggatgggctgaaaggtagcccc

SEQ ID NO: 7629425 - DNA, 22 bp, Homo sapiens
cacactgccacattcactcttc

SEQ ID NO: 7629426 - DNA, 22 bp, Homo sapiens
cacactgccacattcactcttc

SEQ ID NO: 7629427 - DNA, 22 bp, Homo sapiens
cacactgccacattcactcttc

SEQ ID NO: 7629428 - DNA, 22 bp, Homo sapiens
cacactgccacattcactcttc

SEQ ID NO: 7629429 - DNA, 22 bp, Homo sapiens
cacactgccacattcactcttc

SEQ ID NO: 7629430 - DNA, 22 bp, Homo sapiens
cacactgtcaggtaaataacac

SEQ ID NO: 7629431 - DNA, 22 bp, Homo sapiens
cacactgtcaggtaaataacac

SEQ ID NO: 7629432 - DNA, 22 bp, Homo sapiens
cacactgataggcttgacaggc

SEQ ID NO: 7629433 - DNA, 22 bp, Homo sapiens
cacactgactggaatcaaggat

SEQ ID NO: 7629434 - DNA, 22 bp, Homo sapiens
cacactgataggcttgacaggc

SEQ ID NO: 7629435 - DNA, 22 bp, Homo sapiens
cacactatcttcctatcctggc

SEQ ID NO: 7629436 - DNA, 22 bp, Homo sapiens
cacactcattagtcatttctct

SEQ ID NO: 7629437 - DNA, 22 bp, Homo sapiens
cacactcattagtcatttctct

SEQ ID NO: 7629438 - DNA, 22 bp, Homo sapiens
cacactcattagtcatttctct

SEQ ID NO: 7629439 - DNA, 22 bp, Homo sapiens
cacactgactggaatcaaggat

SEQ ID NO: 7629440 - DNA, 22 bp, Homo sapiens
cacactgactggaatcaaggat

SEQ ID NO: 7629441 - DNA, 22 bp, Homo sapiens
cacagctgaagtagccatgtgg

SEQ ID NO: 7629442 - DNA, 22 bp, Homo sapiens
cacagctgaagtagccatgtgg

SEQ ID NO: 7629443 - DNA, 22 bp, Homo sapiens
cacagctgaagtagccatgtgg

SEQ ID NO: 7629444 - DNA, 22 bp, Homo sapiens
cacagctgaagtagccatgtgg

SEQ ID NO: 7629445 - DNA, 22 bp, Homo sapiens
cacagctgaagtagccatgtgg

SEQ ID NO: 7629446 - DNA, 22 bp, Homo sapiens
cacactgtcaggtaaataacac

SEQ ID NO: 7629447 - DNA, 22 bp, Homo sapiens
cacactgcttacacaaaatgat

SEQ ID NO: 7629448 - DNA, 22 bp, Homo sapiens
cacactgtccccttctccccag

SEQ ID NO: 7629449 - DNA, 22 bp, Homo sapiens
cacagctgaccaccctgctccc

SEQ ID NO: 7629450 - DNA, 22 bp, Homo sapiens
cacagctgaagtagccatgtgg

SEQ ID NO: 7629451 - DNA, 22 bp, Homo sapiens
cacagctgaccaccctgctccc

SEQ ID NO: 7629452 - DNA, 22 bp, Homo sapiens
cacagctggtgacagagcccag

SEQ ID NO: 7629453 - DNA, 22 bp, Homo sapiens
cacagctggtgacagagcccag

SEQ ID NO: 7629454 - DNA, 22 bp, Homo sapiens
cacagctggtgacagagcccag

SEQ ID NO: 7629455 - DNA, 22 bp, Homo sapiens
cacagctggtgacagagcccag

SEQ ID NO: 7629456 - DNA, 22 bp, Homo sapiens
cacagctggtgcactagctctg

SEQ ID NO: 7629457 - DNA, 22 bp, Homo sapiens
cacagctggtgcactagctctg

SEQ ID NO: 7629458 - DNA, 22 bp, Homo sapiens
cacagctggtgcactagctctg

SEQ ID NO: 7629459 - DNA, 22 bp, Homo sapiens
cacagctggtgcactagctctg

SEQ ID NO: 7629460 - DNA, 22 bp, Homo sapiens
cacagcttccattagaatgaga

SEQ ID NO: 7629461 - DNA, 22 bp, Homo sapiens
cacagcttccattagaatgaga

SEQ ID NO: 7629462 - DNA, 22 bp, Homo sapiens
cacagcttccattagaatgaga

SEQ ID NO: 7629463 - DNA, 22 bp, Homo sapiens
cacagcttccattagaatgaga

SEQ ID NO: 7629464 - DNA, 22 bp, Homo sapiens
cacagcttccattagaatgaga

SEQ ID NO: 7629465 - DNA, 22 bp, Homo sapiens
cacagcttcccaaagtggacct

SEQ ID NO: 7629466 - DNA, 22 bp, Homo sapiens
cacagcttcccgtgcatggaga

SEQ ID NO: 7629467 - DNA, 22 bp, Homo sapiens
cacagcttcccaaagtggacct

SEQ ID NO: 7629468 - DNA, 22 bp, Homo sapiens
cacagcttagaaaagaagccat

SEQ ID NO: 7629469 - DNA, 22 bp, Homo sapiens
cacagcttagaaaagaagccat

SEQ ID NO: 7629470 - DNA, 22 bp, Homo sapiens
cacagctgttttctccaggcag

SEQ ID NO: 7629471 - DNA, 22 bp, Homo sapiens
cacagctgttttctccaggcag

SEQ ID NO: 7629472 - DNA, 22 bp, Homo sapiens
cacagctgttttctccaggcag

SEQ ID NO: 7629473 - DNA, 22 bp, Homo sapiens
cacagcttatgccactgattgg

SEQ ID NO: 7629474 - DNA, 22 bp, Homo sapiens
cacagcttatgccactgattgg

SEQ ID NO: 7629475 - DNA, 22 bp, Homo sapiens
cacagcttcagtttctgacttg

SEQ ID NO: 7629476 - DNA, 22 bp, Homo sapiens
cacagcttcagtttctgacttg

SEQ ID NO: 7629477 - DNA, 22 bp, Homo sapiens
cacagctgtgagaagggagcct

SEQ ID NO: 7629478 - DNA, 22 bp, Homo sapiens
cacagctgtgagaagggagcct

SEQ ID NO: 7629479 - DNA, 22 bp, Homo sapiens
cacagctgtgagaagggagcct

SEQ ID NO: 7629480 - DNA, 22 bp, Homo sapiens
cacagctgtgagaagggagcct

SEQ ID NO: 7629481 - DNA, 22 bp, Homo sapiens
cacagctgtgagaagggagcct

SEQ ID NO: 7629482 - DNA, 22 bp, Homo sapiens
cacagctgttttctccaggcag

SEQ ID NO: 7629483 - DNA, 22 bp, Homo sapiens
cacagctgttttctccaggcag

SEQ ID NO: 7629484 - DNA, 22 bp, Homo sapiens
cacagctgttttctccaggcag

SEQ ID NO: 7629485 - DNA, 22 bp, Homo sapiens
cacagctgtgagaagggagcct

SEQ ID NO: 7629486 - DNA, 22 bp, Homo sapiens
cacagctgtgagaagggagcct

SEQ ID NO: 7629487 - DNA, 22 bp, Homo sapiens
cacagctgttttctccaggcag

SEQ ID NO: 7629488 - DNA, 22 bp, Homo sapiens
cacagctgtcagctgacctagg

SEQ ID NO: 7629489 - DNA, 22 bp, Homo sapiens
cacagctgtatccaggagatcc

SEQ ID NO: 7629490 - DNA, 22 bp, Homo sapiens
cacagctgtcagctgacctagg

SEQ ID NO: 7629491 - DNA, 22 bp, Homo sapiens
cacagctgtcagctgacctagg

SEQ ID NO: 7629492 - DNA, 22 bp, Homo sapiens
cacagctgtcagctgacctagg

SEQ ID NO: 7629493 - DNA, 22 bp, Homo sapiens
cacagctgtatccaggagatcc

SEQ ID NO: 7629494 - DNA, 22 bp, Homo sapiens
cacagctgtatccaggagatcc

SEQ ID NO: 7629495 - DNA, 22 bp, Homo sapiens
cacagctgtatccaggagatcc

SEQ ID NO: 7629496 - DNA, 22 bp, Homo sapiens
cacagctggtgcactagctctg

SEQ ID NO: 7629497 - DNA, 22 bp, Homo sapiens
cacagctggtgcactagctctg

SEQ ID NO: 7629498 - DNA, 22 bp, Homo sapiens
cacagctggtgcactagctctg

SEQ ID NO: 7629499 - DNA, 22 bp, Homo sapiens
ggaggccaaggcaggtggatcg

SEQ ID NO: 7629500 - DNA, 22 bp, Homo sapiens
ggaggccaaggcaggtggatcg

SEQ ID NO: 7629501 - DNA, 22 bp, Homo sapiens
cacagcttgtttagtgactcac

SEQ ID NO: 7629502 - DNA, 22 bp, Homo sapiens
ggaggccaaggcaggtggatca

SEQ ID NO: 7629503 - DNA, 22 bp, Homo sapiens
cacagcttgtttagtgactcac

SEQ ID NO: 7629504 - DNA, 22 bp, Homo sapiens
cacagcttgggctctgacaata

SEQ ID NO: 7629505 - DNA, 22 bp, Homo sapiens
cacagcttgggctctgacaata

SEQ ID NO: 7629506 - DNA, 22 bp, Homo sapiens
cacagcttgggctctgacaata

SEQ ID NO: 7629507 - DNA, 22 bp, Homo sapiens
cacagcttgggctctgacaata

SEQ ID NO: 7629508 - DNA, 22 bp, Homo sapiens
ggaggccaaggcgggcggatca

SEQ ID NO: 7629509 - DNA, 22 bp, Homo sapiens
ggaggccaaggcgggcggatca

SEQ ID NO: 7629510 - DNA, 22 bp, Homo sapiens
ggaggccaaggcaggtggatcg

SEQ ID NO: 7629511 - DNA, 22 bp, Homo sapiens
ggaggccttgcctgcaggcaca

SEQ ID NO: 7629512 - DNA, 22 bp, Homo sapiens
ggaggccttgcctgcaggcaca

SEQ ID NO: 7629513 - DNA, 22 bp, Homo sapiens
ggaggccttgcctgcaggcaca

SEQ ID NO: 7629514 - DNA, 22 bp, Homo sapiens
ggaggccttgcctgcaggcaca

SEQ ID NO: 7629515 - DNA, 22 bp, Homo sapiens
ggaggccttgaggccaggagct

SEQ ID NO: 7629516 - DNA, 22 bp, Homo sapiens
cacagcttctccccgctgcggc

SEQ ID NO: 7629517 - DNA, 22 bp, Homo sapiens
cacagcttcccaaagtggacct

SEQ ID NO: 7629518 - DNA, 22 bp, Homo sapiens
cacagcttctccttgatatcgc

SEQ ID NO: 7629519 - DNA, 22 bp, Homo sapiens
cacagcttctccccgctgcggc

SEQ ID NO: 7629520 - DNA, 22 bp, Homo sapiens
cacagcttctgagtgaggattt

SEQ ID NO: 7629521 - DNA, 22 bp, Homo sapiens
cacagcttctgagtgaggattt

SEQ ID NO: 7629522 - DNA, 22 bp, Homo sapiens
cacagcttctgagtgaggattt

SEQ ID NO: 7629523 - DNA, 22 bp, Homo sapiens
cacagcttctgtctgacccatg

SEQ ID NO: 7629524 - DNA, 22 bp, Homo sapiens
cacagcttctgtctgacccatg

SEQ ID NO: 7629525 - DNA, 22 bp, Homo sapiens
cacagcttctgtctgacccatg

SEQ ID NO: 7629526 - DNA, 22 bp, Homo sapiens
cacagcttcttccattccactc

SEQ ID NO: 7629527 - DNA, 20 bp, Homo sapiens
cacagcttgccttttatgac

SEQ ID NO: 7629528 - DNA, 20 bp, Homo sapiens
cacagcttgccttttatgac

SEQ ID NO: 7629529 - DNA, 22 bp, Homo sapiens
cacagcttgggctctgacaata

SEQ ID NO: 7629530 - DNA, 22 bp, Homo sapiens
ggaggcggacacaggtagtgtt

SEQ ID NO: 7629531 - DNA, 22 bp, Homo sapiens
ggaggcggacacaggtagtgtt

SEQ ID NO: 7629532 - DNA, 22 bp, Homo sapiens
ggaggcggacacaggtagtgtt

SEQ ID NO: 7629533 - DNA, 22 bp, Homo sapiens
ggaggcggacacaggtagtgtt

SEQ ID NO: 7629534 - DNA, 22 bp, Homo sapiens
ggaggcggacacaggtagtgtt

SEQ ID NO: 7629535 - DNA, 22 bp, Homo sapiens
ggaggcggacacaggtagtgtt

SEQ ID NO: 7629536 - DNA, 22 bp, Homo sapiens
ggaggcggacacaggtagtgtt

SEQ ID NO: 7629537 - DNA, 22 bp, Homo sapiens
ggaggcggagcttgcagtgagc

SEQ ID NO: 7629538 - DNA, 22 bp, Homo sapiens
ggaggcggagcttgcagtgagc

SEQ ID NO: 7629539 - DNA, 22 bp, Homo sapiens
ggaggcggagcttgcagtgagc

SEQ ID NO: 7629540 - DNA, 22 bp, Homo sapiens
ggaggcggagcttgcagtgagc

SEQ ID NO: 7629541 - DNA, 22 bp, Homo sapiens
ggaggcggacacaggtagtgtt

SEQ ID NO: 7629542 - DNA, 22 bp, Homo sapiens
ggaggcggagcttgcagtgagc

SEQ ID NO: 7629543 - DNA, 22 bp, Homo sapiens
ggaggcggagcttgcagtgagc

SEQ ID NO: 7629544 - DNA, 22 bp, Homo sapiens
ggaggcggaggctgcagtgagc

SEQ ID NO: 7629545 - DNA, 22 bp, Homo sapiens
ggaggcggaggctgcagtgagc

SEQ ID NO: 7629546 - DNA, 22 bp, Homo sapiens
ggaggcggagcttgcagtgagc

SEQ ID NO: 7629547 - DNA, 22 bp, Homo sapiens
ggaggcggagcttgcagtgagc

SEQ ID NO: 7629548 - DNA, 22 bp, Homo sapiens
ggaggcggagcttgcagtgagc

SEQ ID NO: 7629549 - DNA, 22 bp, Homo sapiens
ggaggcgcggctcggctgtgcc

SEQ ID NO: 7629550 - DNA, 20 bp, Homo sapiens
ggaggcgctgggctcgcgct

SEQ ID NO: 7629551 - DNA, 22 bp, Homo sapiens
ggaggcggaagttgcagtgagc

SEQ ID NO: 7629552 - DNA, 22 bp, Homo sapiens
ggaggcgatcctgggaaacacc

SEQ ID NO: 7629553 - DNA, 22 bp, Homo sapiens
ggaggcgatcctgggaaacacc

SEQ ID NO: 7629554 - DNA, 22 bp, Homo sapiens
ggaggccttgcctgcaggcaca

SEQ ID NO: 7629555 - DNA, 22 bp, Homo sapiens
ggaggcgcggctcggctgtgcc

SEQ ID NO: 7629556 - DNA, 22 bp, Homo sapiens
ggaggcgatcctgggaaacacc

SEQ ID NO: 7629557 - DNA, 22 bp, Homo sapiens
ggaggcgcggctcggctgtgcc

SEQ ID NO: 7629558 - DNA, 22 bp, Homo sapiens
ggaggcgcggctcggctgtgcc

SEQ ID NO: 7629559 - DNA, 22 bp, Homo sapiens
ggaggcggacacaggtagtgtt

SEQ ID NO: 7629560 - DNA, 22 bp, Homo sapiens
ggaggcggaagttgcagtgagc

SEQ ID NO: 7629561 - DNA, 22 bp, Homo sapiens
ggaggcggaagttgcagtgagc

SEQ ID NO: 7629562 - DNA, 22 bp, Homo sapiens
ggaggcggaagttgcagtgagc

SEQ ID NO: 7629563 - DNA, 22 bp, Homo sapiens
ggaggcggaagttgcagtgagc

SEQ ID NO: 7629564 - DNA, 22 bp, Homo sapiens
ggaggcggaagttgcagtgagc

SEQ ID NO: 7629565 - DNA, 22 bp, Homo sapiens
ggaggcggaagttgcagtgagc

SEQ ID NO: 7629566 - DNA, 22 bp, Homo sapiens
ggaggcggaagttgcagtgagc

SEQ ID NO: 7629567 - DNA, 22 bp, Homo sapiens
ggaggcggaagttgcagtgagc

SEQ ID NO: 7629568 - DNA, 22 bp, Homo sapiens
ggcagatggaagaggctgggtc

SEQ ID NO: 7629569 - DNA, 22 bp, Homo sapiens
ggcagatggaagaggctgggtc

SEQ ID NO: 7629570 - DNA, 22 bp, Homo sapiens
cacagtgtgactgaccttcagc

SEQ ID NO: 7629571 - DNA, 22 bp, Homo sapiens
cacagtgtggcaaatttcaact

SEQ ID NO: 7629572 - DNA, 22 bp, Homo sapiens
cacagtgtggcaaatttcaact

SEQ ID NO: 7629573 - DNA, 22 bp, Homo sapiens
cacagtgtagactaataataga

SEQ ID NO: 7629574 - DNA, 22 bp, Homo sapiens
cacagtgtagactaataataga

SEQ ID NO: 7629575 - DNA, 22 bp, Homo sapiens
cacagtgtagactaataataga

SEQ ID NO: 7629576 - DNA, 22 bp, Homo sapiens
cacagtgtctgtgcttcagtgt

SEQ ID NO: 7629577 - DNA, 22 bp, Homo sapiens
cacagtgtctgtgcttcagtgt

SEQ ID NO: 7629578 - DNA, 22 bp, Homo sapiens
cacagtgtctgtgcttcagtgt

SEQ ID NO: 7629579 - DNA, 22 bp, Homo sapiens
cacagtgtagttaatgtgacat

SEQ ID NO: 7629580 - DNA, 22 bp, Homo sapiens
ggcagcagtggctgctattgtc

SEQ ID NO: 7629581 - DNA, 22 bp, Homo sapiens
ggcagcagtggctgctattgtc

SEQ ID NO: 7629582 - DNA, 22 bp, Homo sapiens
ggcagcagtggctgctattgtc

SEQ ID NO: 7629583 - DNA, 22 bp, Homo sapiens
ggcagcagtggctgctattgtc

SEQ ID NO: 7629584 - DNA, 22 bp, Homo sapiens
ggcagcagttacaaatgtgcag

SEQ ID NO: 7629585 - DNA, 22 bp, Homo sapiens
ggcagcagttacaaatgtgcag

SEQ ID NO: 7629586 - DNA, 22 bp, Homo sapiens
ggcagcagttacaaatgtgcag

SEQ ID NO: 7629587 - DNA, 22 bp, Homo sapiens
ggcagcagttacaaatgtgcag

SEQ ID NO: 7629588 - DNA, 22 bp, Homo sapiens
ggcagcagttacaaatgtgcag

SEQ ID NO: 7629589 - DNA, 22 bp, Homo sapiens
ggcagcagtggctgctattgtc

SEQ ID NO: 7629590 - DNA, 22 bp, Homo sapiens
ggcagcagtggctgctattgtc

SEQ ID NO: 7629591 - DNA, 22 bp, Homo sapiens
ggcagatggaatgagctgtcta

SEQ ID NO: 7629592 - DNA, 22 bp, Homo sapiens
ggcagcagtggctgctattgtc

SEQ ID NO: 7629593 - DNA, 22 bp, Homo sapiens
ggcagcagtggctgctattgtc

SEQ ID NO: 7629594 - DNA, 22 bp, Homo sapiens
ggcagatggaaggacagacgga

SEQ ID NO: 7629595 - DNA, 22 bp, Homo sapiens
ggcagatggaaggacagacgga

SEQ ID NO: 7629596 - DNA, 22 bp, Homo sapiens
ggcagatggaatgagctgtcta

SEQ ID NO: 7629597 - DNA, 22 bp, Homo sapiens
ggcagcagtggctgctattgtc

SEQ ID NO: 7629598 - DNA, 22 bp, Homo sapiens
ggcagcatgggtgcctttgtga

SEQ ID NO: 7629599 - DNA, 22 bp, Homo sapiens
ggcagcatgagcctggtgaatt

SEQ ID NO: 7629600 - DNA, 22 bp, Homo sapiens
ggcagcatgtgtggtccgctgg

SEQ ID NO: 7629601 - DNA, 22 bp, Homo sapiens
ggcagcattgccaatccagaca

SEQ ID NO: 7629602 - DNA, 22 bp, Homo sapiens
ggcagcattgccaatccagaca

SEQ ID NO: 7629603 - DNA, 22 bp, Homo sapiens
ggcagcattgcctttgcagtga

SEQ ID NO: 7629604 - DNA, 22 bp, Homo sapiens
ggcagcattgcctttgcagtga

SEQ ID NO: 7629605 - DNA, 22 bp, Homo sapiens
ggcagcattgcctttgcagtga

SEQ ID NO: 7629606 - DNA, 22 bp, Homo sapiens
ggcagcatttagagcacagtgt

SEQ ID NO: 7629607 - DNA, 22 bp, Homo sapiens
ggcagcatttagagcacagtgt

SEQ ID NO: 7629608 - DNA, 22 bp, Homo sapiens
ggcagcatttagagcacagtgt

SEQ ID NO: 7629609 - DNA, 20 bp, Homo sapiens
ggcagccaatcagcgtgccg

SEQ ID NO: 7629610 - DNA, 20 bp, Homo sapiens
ggcagccaatcagcgtgccg

SEQ ID NO: 7629611 - DNA, 22 bp, Homo sapiens
ggcagccaccctgggaggcaga

SEQ ID NO: 7629612 - DNA, 22 bp, Homo sapiens
ggcagccaccctgggaggcaga

SEQ ID NO: 7629613 - DNA, 22 bp, Homo sapiens
ggcagccaccctgggaggcaga

SEQ ID NO: 7629614 - DNA, 22 bp, Homo sapiens
ggcagccaccctgggaggcaga

SEQ ID NO: 7629615 - DNA, 22 bp, Homo sapiens
ggcagccaccctgggaggcaga

SEQ ID NO: 7629616 - DNA, 20 bp, Homo sapiens
ggcagccaatcagcgtgccg

SEQ ID NO: 7629617 - DNA, 22 bp, Homo sapiens
ggcagcatatattcagtgggca

SEQ ID NO: 7629618 - DNA, 22 bp, Homo sapiens
ggcagcatatattcagtgggca

SEQ ID NO: 7629619 - DNA, 22 bp, Homo sapiens
ggcagcatatattcagtgggca

SEQ ID NO: 7629620 - DNA, 22 bp, Homo sapiens
ggcagcatcacttgtctccagc

SEQ ID NO: 7629621 - DNA, 22 bp, Homo sapiens
ggcagcatcacttgtctccagc

SEQ ID NO: 7629622 - DNA, 22 bp, Homo sapiens
ggcagcatcacttgtctccagc

SEQ ID NO: 7629623 - DNA, 22 bp, Homo sapiens
ggcagcatatattcagtgggca

SEQ ID NO: 7629624 - DNA, 22 bp, Homo sapiens
ggcagcatcccatggaccgcat

SEQ ID NO: 7629625 - DNA, 22 bp, Homo sapiens
ggcagcatatattcagtgggca

SEQ ID NO: 7629626 - DNA, 22 bp, Homo sapiens
ggcagcagttacaaatgtgcag

SEQ ID NO: 7629627 - DNA, 22 bp, Homo sapiens
ggcagcagttacaaatgtgcag

SEQ ID NO: 7629628 - DNA, 22 bp, Homo sapiens
ggcagcatcttgatattggttt

SEQ ID NO: 7629629 - DNA, 22 bp, Homo sapiens
ggcagcatcttgatattggttt

SEQ ID NO: 7629630 - DNA, 22 bp, Homo sapiens
ggcagcatgagcctggtgaatt

SEQ ID NO: 7629631 - DNA, 22 bp, Homo sapiens
ggcagcatgagcctggtgaatt

SEQ ID NO: 7629632 - DNA, 22 bp, Homo sapiens
ggcagcatctctggcagcagct

SEQ ID NO: 7629633 - DNA, 22 bp, Homo sapiens
ggcagcatctctggcagcagct

SEQ ID NO: 7629634 - DNA, 22 bp, Homo sapiens
ggcagcatctctggcagcagct

SEQ ID NO: 7629635 - DNA, 22 bp, Homo sapiens
ggcagcatccgcccggcaccct

SEQ ID NO: 7629636 - DNA, 22 bp, Homo sapiens
ggcagcatctcatatcttcagg

SEQ ID NO: 7629637 - DNA, 22 bp, Homo sapiens
ggcagcatcccatggaccgcat

SEQ ID NO: 7629638 - DNA, 22 bp, Homo sapiens
ggcagcatcccatggaccgcat

SEQ ID NO: 7629639 - DNA, 22 bp, Homo sapiens
ggcagcatccgcccggcaccct

SEQ ID NO: 7629640 - DNA, 22 bp, Homo sapiens
ggcagcatccgcccggcaccct

SEQ ID NO: 7629641 - DNA, 22 bp, Homo sapiens
ggcagagctctggactgagaac

SEQ ID NO: 7629642 - DNA, 17 bp, Homo sapiens
ggcagagctgacagggc

SEQ ID NO: 7629643 - DNA, 17 bp, Homo sapiens
ggcagagctgacagggc

SEQ ID NO: 7629644 - DNA, 17 bp, Homo sapiens
ggcagagctgacagggc

SEQ ID NO: 7629645 - DNA, 17 bp, Homo sapiens
ggcagagctgacagggc

SEQ ID NO: 7629646 - DNA, 17 bp, Homo sapiens
ggcagagctgacagggc

SEQ ID NO: 7629647 - DNA, 22 bp, Homo sapiens
ggcagagctgcatgagcactca

SEQ ID NO: 7629648 - DNA, 17 bp, Homo sapiens
ggcagagctgacagggc

SEQ ID NO: 7629649 - DNA, 21 bp, Homo sapiens
ggcagagctggggcctccagc

SEQ ID NO: 7629650 - DNA, 21 bp, Homo sapiens
ggcagagctggggcctccagc

SEQ ID NO: 7629651 - DNA, 21 bp, Homo sapiens
ggcagagctggggcctccagc

SEQ ID NO: 7629652 - DNA, 21 bp, Homo sapiens
ggcagagctggggcctccagc

SEQ ID NO: 7629653 - DNA, 22 bp, Homo sapiens
ggcagagctgcatgagcactca

SEQ ID NO: 7629654 - DNA, 22 bp, Homo sapiens
ggcagagctgcatgagcactca

SEQ ID NO: 7629655 - DNA, 22 bp, Homo sapiens
ggcagagctgcatgagcactca

SEQ ID NO: 7629656 - DNA, 22 bp, Homo sapiens
ggcagagctgcatgagcactca

SEQ ID NO: 7629657 - DNA, 22 bp, Homo sapiens
ggcagagctgcatgagcactca

SEQ ID NO: 7629658 - DNA, 22 bp, Homo sapiens
ggcagagccttctggagctcgc

SEQ ID NO: 7629659 - DNA, 22 bp, Homo sapiens
ggcagagccttctggagctcgc

SEQ ID NO: 7629660 - DNA, 22 bp, Homo sapiens
ggcagagcgcatgcgtcgcaga

SEQ ID NO: 7629661 - DNA, 22 bp, Homo sapiens
ggcagagcgcatgcgtcgcaga

SEQ ID NO: 7629662 - DNA, 22 bp, Homo sapiens
ggcagagctagtggcttctctt

SEQ ID NO: 7629663 - DNA, 22 bp, Homo sapiens
ggcagagctagtggcttctctt

SEQ ID NO: 7629664 - DNA, 22 bp, Homo sapiens
ggcagagctagtggcttctctt

SEQ ID NO: 7629665 - DNA, 22 bp, Homo sapiens
ggcagagctagtggcttctctt

SEQ ID NO: 7629666 - DNA, 22 bp, Homo sapiens
ggcagagcgcatgcgtcgcaga

SEQ ID NO: 7629667 - DNA, 19 bp, Homo sapiens
ggcagagctcctgctttct

SEQ ID NO: 7629668 - DNA, 22 bp, Homo sapiens
ggcagagctctggactgagaac

SEQ ID NO: 7629669 - DNA, 22 bp, Homo sapiens
ggcagagctctggactgagaac

SEQ ID NO: 7629670 - DNA, 19 bp, Homo sapiens
ggcagagctcctgctttct

SEQ ID NO: 7629671 - DNA, 19 bp, Homo sapiens
ggcagagctcctgctttct

SEQ ID NO: 7629672 - DNA, 19 bp, Homo sapiens
ggcagagctcctgctttct

SEQ ID NO: 7629673 - DNA, 19 bp, Homo sapiens
ggcagagctcctgctttct

SEQ ID NO: 7629674 - DNA, 22 bp, Homo sapiens
ggcagagctagtggcttctctt

SEQ ID NO: 7629675 - DNA, 22 bp, Homo sapiens
ggcagagctagtggcttctctt

SEQ ID NO: 7629676 - DNA, 20 bp, Homo sapiens
ggcagagctatgtctgttgc

SEQ ID NO: 7629677 - DNA, 20 bp, Homo sapiens
ggcagagctatgtctgttgc

SEQ ID NO: 7629678 - DNA, 20 bp, Homo sapiens
ggcagagctatgtctgttgc

SEQ ID NO: 7629679 - DNA, 16 bp, Homo sapiens
cacagtgctgctgctc

SEQ ID NO: 7629680 - DNA, 16 bp, Homo sapiens
cacagtgctgctgctc

SEQ ID NO: 7629681 - DNA, 22 bp, Homo sapiens
cacagtgctcgggttttatgtc

SEQ ID NO: 7629682 - DNA, 22 bp, Homo sapiens
cacagtgctcgggttttatgtc

SEQ ID NO: 7629683 - DNA, 22 bp, Homo sapiens
cacagtgctcgggttttatgtc

SEQ ID NO: 7629684 - DNA, 22 bp, Homo sapiens
cacagtgctttacatgttttct

SEQ ID NO: 7629685 - DNA, 22 bp, Homo sapiens
cacagtgctgtttgtaaagaga

SEQ ID NO: 7629686 - DNA, 22 bp, Homo sapiens
cacagtgctgtttgtaaagaga

SEQ ID NO: 7629687 - DNA, 22 bp, Homo sapiens
cacagtgctgtttgtaaagaga

SEQ ID NO: 7629688 - DNA, 22 bp, Homo sapiens
cacagtgctttatgagagatct

SEQ ID NO: 7629689 - DNA, 22 bp, Homo sapiens
cacagtgctttatgagagatct

SEQ ID NO: 7629690 - DNA, 22 bp, Homo sapiens
cacagtgctttatgagagatct

SEQ ID NO: 7629691 - DNA, 22 bp, Homo sapiens
cacagtgctttacatgttttct

SEQ ID NO: 7629692 - DNA, 22 bp, Homo sapiens
cacagtgctttacatgttttct

SEQ ID NO: 7629693 - DNA, 22 bp, Homo sapiens
cacagtgctcaaacacaagtgc

SEQ ID NO: 7629694 - DNA, 22 bp, Homo sapiens
cacagtgctcaaacacaagtgc

SEQ ID NO: 7629695 - DNA, 22 bp, Homo sapiens
ggcagagcttgcagtgagccga

SEQ ID NO: 7629696 - DNA, 22 bp, Homo sapiens
ggcagagcttgcagtgagccga

SEQ ID NO: 7629697 - DNA, 22 bp, Homo sapiens
ggcagagcttgcagtgagccga

SEQ ID NO: 7629698 - DNA, 22 bp, Homo sapiens
ggcagagcttgcagtgagccga

SEQ ID NO: 7629699 - DNA, 22 bp, Homo sapiens
ggcagagcttgcagtgagccga

SEQ ID NO: 7629700 - DNA, 22 bp, Homo sapiens
ggcagagcttgcagtgagccga

SEQ ID NO: 7629701 - DNA, 22 bp, Homo sapiens
cacagtggaagtccaggatccc

SEQ ID NO: 7629702 - DNA, 22 bp, Homo sapiens
cacagtggaagtccaggatccc

SEQ ID NO: 7629703 - DNA, 22 bp, Homo sapiens
cacagtggattgggtgatgccc

SEQ ID NO: 7629704 - DNA, 22 bp, Homo sapiens
cacagtggattgggtgatgccc

SEQ ID NO: 7629705 - DNA, 22 bp, Homo sapiens
cacagtggattgggtgatgccc

SEQ ID NO: 7629706 - DNA, 22 bp, Homo sapiens
cacagtggaagtccaggatccc

SEQ ID NO: 7629707 - DNA, 22 bp, Homo sapiens
cacagtggaagtccaggatccc

SEQ ID NO: 7629708 - DNA, 22 bp, Homo sapiens
cacagtggaaacagctaagcct

SEQ ID NO: 7629709 - DNA, 22 bp, Homo sapiens
cacagtggaaacagctaagcct

SEQ ID NO: 7629710 - DNA, 22 bp, Homo sapiens
cacagtgctttatgagagatct

SEQ ID NO: 7629711 - DNA, 22 bp, Homo sapiens
cacagtgctttatgagagatct

SEQ ID NO: 7629712 - DNA, 22 bp, Homo sapiens
cacagtggtttccgattcagac

SEQ ID NO: 7629713 - DNA, 22 bp, Homo sapiens
cacagtggtccccgaagcccct

SEQ ID NO: 7629714 - DNA, 22 bp, Homo sapiens
cacagtggtccccgaagcccct

SEQ ID NO: 7629715 - DNA, 22 bp, Homo sapiens
cacagtggtccccgaagcccct

SEQ ID NO: 7629716 - DNA, 22 bp, Homo sapiens
cacagtggctttgctggtctcg

SEQ ID NO: 7629717 - DNA, 22 bp, Homo sapiens
cacagtggctttgctggtctcg

SEQ ID NO: 7629718 - DNA, 22 bp, Homo sapiens
cacagtggcaggtgtgggttgt

SEQ ID NO: 7629719 - DNA, 22 bp, Homo sapiens
cacagtggcaaaggggcttggg

SEQ ID NO: 7629720 - DNA, 22 bp, Homo sapiens
cacagtggattgggtgatgccc

SEQ ID NO: 7629721 - DNA, 22 bp, Homo sapiens
cacagtggcaaaggggcttggg

SEQ ID NO: 7629722 - DNA, 22 bp, Homo sapiens
cacagtggcaaaggggcttggg

SEQ ID NO: 7629723 - DNA, 22 bp, Homo sapiens
cacagtggcaaaggggcttggg

SEQ ID NO: 7629724 - DNA, 22 bp, Homo sapiens
cacagtggcaaaggggcttggg

SEQ ID NO: 7629725 - DNA, 22 bp, Homo sapiens
ggcactggcaaagcaaagtctg

SEQ ID NO: 7629726 - DNA, 22 bp, Homo sapiens
ggcactggaaggatcatgtgag

SEQ ID NO: 7629727 - DNA, 22 bp, Homo sapiens
ggcactggcaaagcaaagtctg

SEQ ID NO: 7629728 - DNA, 22 bp, Homo sapiens
ggcactggcctggggccaagag

SEQ ID NO: 7629729 - DNA, 22 bp, Homo sapiens
ggcactggcctggggccaagag

SEQ ID NO: 7629730 - DNA, 22 bp, Homo sapiens
ggcactggcctggggccaagag

SEQ ID NO: 7629731 - DNA, 22 bp, Homo sapiens
ggcactgggaatgcagtgatga

SEQ ID NO: 7629732 - DNA, 22 bp, Homo sapiens
ggcactgggaatgcagtgatga

SEQ ID NO: 7629733 - DNA, 22 bp, Homo sapiens
ggcactggaaggatcatgtgag

SEQ ID NO: 7629734 - DNA, 22 bp, Homo sapiens
ggcactggaaggatcatgtgag

SEQ ID NO: 7629735 - DNA, 20 bp, Homo sapiens
ggcactggaagcacacagga

SEQ ID NO: 7629736 - DNA, 22 bp, Homo sapiens
ggcactgcttcctgagcctgag

SEQ ID NO: 7629737 - DNA, 20 bp, Homo sapiens
ggcactggaagcacacagga

SEQ ID NO: 7629738 - DNA, 20 bp, Homo sapiens
ggcactggaagcacacagga

SEQ ID NO: 7629739 - DNA, 20 bp, Homo sapiens
ggcactggaagcacacagga

SEQ ID NO: 7629740 - DNA, 20 bp, Homo sapiens
ggcactggaagcacacagga

SEQ ID NO: 7629741 - DNA, 22 bp, Homo sapiens
ggcactgcttcctgagcctgag

SEQ ID NO: 7629742 - DNA, 18 bp, Homo sapiens
ggcactgctgttcccctt

SEQ ID NO: 7629743 - DNA, 22 bp, Homo sapiens
ggcactgctgtaggcagtgagg

SEQ ID NO: 7629744 - DNA, 22 bp, Homo sapiens
ggcacatgtatgtgggagtgtg

SEQ ID NO: 7629745 - DNA, 22 bp, Homo sapiens
ggcacatgtatgtgggagtgtg

SEQ ID NO: 7629746 - DNA, 22 bp, Homo sapiens
ggcacatgtatgtgggagtgtg

SEQ ID NO: 7629747 - DNA, 22 bp, Homo sapiens
ggcacatgtatgtgggagtgtg

SEQ ID NO: 7629748 - DNA, 22 bp, Homo sapiens
ggcacatggagacttggcatca

SEQ ID NO: 7629749 - DNA, 22 bp, Homo sapiens
ggcactgggaatgcagtgatga

SEQ ID NO: 7629750 - DNA, 22 bp, Homo sapiens
ggcactgggagaggtgagacgg

SEQ ID NO: 7629751 - DNA, 22 bp, Homo sapiens
ggcactgggagaggtgagacgg

SEQ ID NO: 7629752 - DNA, 22 bp, Homo sapiens
ggcactgggagaggtgagacgg

SEQ ID NO: 7629753 - DNA, 22 bp, Homo sapiens
ggcactgggagaggtgagacgg

SEQ ID NO: 7629754 - DNA, 22 bp, Homo sapiens
ggcactgggcaccggctgaggg

SEQ ID NO: 7629755 - DNA, 22 bp, Homo sapiens
ggcactgggcaccggctgaggg

SEQ ID NO: 7629756 - DNA, 22 bp, Homo sapiens
ggcagagagttctccacctctc

SEQ ID NO: 7629757 - DNA, 22 bp, Homo sapiens
ggcagagagttctccacctctc

SEQ ID NO: 7629758 - DNA, 22 bp, Homo sapiens
ggcactgggcaccggctgaggg

SEQ ID NO: 7629759 - DNA, 22 bp, Homo sapiens
ggcactgggcaccggctgaggg

SEQ ID NO: 7629760 - DNA, 22 bp, Homo sapiens
ggcactgggcaccggctgaggg

SEQ ID NO: 7629761 - DNA, 22 bp, Homo sapiens
ggcagagcattcgatggacctg

SEQ ID NO: 7629762 - DNA, 22 bp, Homo sapiens
ggcagagcattcgatggacctg

SEQ ID NO: 7629763 - DNA, 22 bp, Homo sapiens
ggcagagcattcgatggacctg

SEQ ID NO: 7629764 - DNA, 22 bp, Homo sapiens
ggcagagcctcagccctccacc

SEQ ID NO: 7629765 - DNA, 22 bp, Homo sapiens
ggcagagccttctggagctcgc

SEQ ID NO: 7629766 - DNA, 22 bp, Homo sapiens
ggcagagccttctggagctcgc

SEQ ID NO: 7629767 - DNA, 22 bp, Homo sapiens
ggcagagccttctggagctcgc

SEQ ID NO: 7629768 - DNA, 22 bp, Homo sapiens
ggcagagccttctggagctcgc

SEQ ID NO: 7629769 - DNA, 22 bp, Homo sapiens
ggcagagccttctggagctcgc

SEQ ID NO: 7629770 - DNA, 22 bp, Homo sapiens
ggcagagatgtgggtcagaatc

SEQ ID NO: 7629771 - DNA, 22 bp, Homo sapiens
ggcagagatgtgggtcagaatc

SEQ ID NO: 7629772 - DNA, 22 bp, Homo sapiens
ggcagagatgtgggtcagaatc

SEQ ID NO: 7629773 - DNA, 22 bp, Homo sapiens
ggcagagagttctccacctctc

SEQ ID NO: 7629774 - DNA, 22 bp, Homo sapiens
ggcagagagttctccacctctc

SEQ ID NO: 7629775 - DNA, 22 bp, Homo sapiens
ggcagagagttctccacctctc

SEQ ID NO: 7629776 - DNA, 22 bp, Homo sapiens
ggcagagatgtgggtcagaatc

SEQ ID NO: 7629777 - DNA, 22 bp, Homo sapiens
ggcagagatgtgggtcagaatc

SEQ ID NO: 7629778 - DNA, 22 bp, Homo sapiens
ggcagagcagccccagggtttg

SEQ ID NO: 7629779 - DNA, 22 bp, Homo sapiens
ggcacagggtgatgttgcagtt

SEQ ID NO: 7629780 - DNA, 22 bp, Homo sapiens
ggcacagtccctggcacagagt

SEQ ID NO: 7629781 - DNA, 22 bp, Homo sapiens
ggcacagtccctggcacagagt

SEQ ID NO: 7629782 - DNA, 22 bp, Homo sapiens
ggcacagggtgatgttgcagtt

SEQ ID NO: 7629783 - DNA, 22 bp, Homo sapiens
ggcacagggtgatgttgcagtt

SEQ ID NO: 7629784 - DNA, 22 bp, Homo sapiens
ggcacagtgattaagagccagt

SEQ ID NO: 7629785 - DNA, 22 bp, Homo sapiens
ggcacagtgattaagagccagt

SEQ ID NO: 7629786 - DNA, 22 bp, Homo sapiens
ggcacagttttctacatatgct

SEQ ID NO: 7629787 - DNA, 22 bp, Homo sapiens
ggcacagttttctacatatgct

SEQ ID NO: 7629788 - DNA, 22 bp, Homo sapiens
ggcacagttttctacatatgct

SEQ ID NO: 7629789 - DNA, 22 bp, Homo sapiens
ggcacagggtgatgttgcagtt

SEQ ID NO: 7629790 - DNA, 22 bp, Homo sapiens
ggcacagggggctgaggactag

SEQ ID NO: 7629791 - DNA, 22 bp, Homo sapiens
ggcacagggtgatgttgcagtt

SEQ ID NO: 7629792 - DNA, 22 bp, Homo sapiens
ggcacagggtgatgttgcagtt

SEQ ID NO: 7629793 - DNA, 22 bp, Homo sapiens
ggcacagggtgatgttgcagtt

SEQ ID NO: 7629794 - DNA, 22 bp, Homo sapiens
ggcacagggggctgaggactag

SEQ ID NO: 7629795 - DNA, 22 bp, Homo sapiens
ggcacagggggctgaggactag

SEQ ID NO: 7629796 - DNA, 22 bp, Homo sapiens
ggcacagggggctgaggactag

SEQ ID NO: 7629797 - DNA, 22 bp, Homo sapiens
ggcacagggggctgaggactag

SEQ ID NO: 7629798 - DNA, 22 bp, Homo sapiens
ggcacagggggctgaggactag

SEQ ID NO: 7629799 - DNA, 22 bp, Homo sapiens
ggcacagggagccgcagttgca

SEQ ID NO: 7629800 - DNA, 22 bp, Homo sapiens
ggcacagggagccgcagttgca

SEQ ID NO: 7629801 - DNA, 22 bp, Homo sapiens
ggcacagggagccgcagttgca

SEQ ID NO: 7629802 - DNA, 22 bp, Homo sapiens
ggcacagggaggccctggtgtg

SEQ ID NO: 7629803 - DNA, 22 bp, Homo sapiens
ggcacagggaggccctggtgtg

SEQ ID NO: 7629804 - DNA, 22 bp, Homo sapiens
ggcacagggaggccctggtgtg

SEQ ID NO: 7629805 - DNA, 22 bp, Homo sapiens
ggcacagggggctgaggactag

SEQ ID NO: 7629806 - DNA, 22 bp, Homo sapiens
ggcacagggggctgaggactag

SEQ ID NO: 7629807 - DNA, 22 bp, Homo sapiens
ggcacagggggctgaggactag

SEQ ID NO: 7629808 - DNA, 22 bp, Homo sapiens
ggcacagggggctgaggactag

SEQ ID NO: 7629809 - DNA, 22 bp, Homo sapiens
ggcacagggggctgaggactag

SEQ ID NO: 7629810 - DNA, 22 bp, Homo sapiens
ggcacagggggctgaggactag

SEQ ID NO: 7629811 - DNA, 22 bp, Homo sapiens
ggcacagggggctgaggactag

SEQ ID NO: 7629812 - DNA, 22 bp, Homo sapiens
ggcacagggggctgaggactag

SEQ ID NO: 7629813 - DNA, 22 bp, Homo sapiens
ggcacagggggctgaggactag

SEQ ID NO: 7629814 - DNA, 22 bp, Homo sapiens
ggcacagggggctgaggactag

SEQ ID NO: 7629815 - DNA, 22 bp, Homo sapiens
ggcacagggaggccctggtgtg

SEQ ID NO: 7629816 - DNA, 22 bp, Homo sapiens
ggcacagggaggccctggtgtg

SEQ ID NO: 7629817 - DNA, 22 bp, Homo sapiens
cacagggcagagggtccgtggc

SEQ ID NO: 7629818 - DNA, 22 bp, Homo sapiens
cacagggcagagggtccgtggc

SEQ ID NO: 7629819 - DNA, 22 bp, Homo sapiens
cacagggcagagacctgggtgc

SEQ ID NO: 7629820 - DNA, 22 bp, Homo sapiens
cacagggcagagacctgggtgc

SEQ ID NO: 7629821 - DNA, 22 bp, Homo sapiens
cacagggcagagacctgggtgc

SEQ ID NO: 7629822 - DNA, 22 bp, Homo sapiens
cacagggcagagacctgggtgc

SEQ ID NO: 7629823 - DNA, 22 bp, Homo sapiens
cacagggcaggccccaggcctc

SEQ ID NO: 7629824 - DNA, 22 bp, Homo sapiens
cacagggcaggccccaggcctc

SEQ ID NO: 7629825 - DNA, 22 bp, Homo sapiens
cacagggcaggccccaggcctc

SEQ ID NO: 7629826 - DNA, 22 bp, Homo sapiens
cacagggcaggccccaggcctc

SEQ ID NO: 7629827 - DNA, 22 bp, Homo sapiens
cacagggcagagggtccgtggc

SEQ ID NO: 7629828 - DNA, 22 bp, Homo sapiens
cacagggcagagggtccgtggc

SEQ ID NO: 7629829 - DNA, 22 bp, Homo sapiens
ggcacaaggtttaaataacatc

SEQ ID NO: 7629830 - DNA, 22 bp, Homo sapiens
ggcacaagtttgatgtgagtta

SEQ ID NO: 7629831 - DNA, 22 bp, Homo sapiens
ggcacaagtttgatgtgagtta

SEQ ID NO: 7629832 - DNA, 22 bp, Homo sapiens
ggcacaaggtttaaataacatc

SEQ ID NO: 7629833 - DNA, 22 bp, Homo sapiens
cacagggcaggccccaggcctc

SEQ ID NO: 7629834 - DNA, 22 bp, Homo sapiens
ggcacagggagccgcagttgca

SEQ ID NO: 7629835 - DNA, 22 bp, Homo sapiens
ggcacagggagccgcagttgca

SEQ ID NO: 7629836 - DNA, 22 bp, Homo sapiens
ggcacagggagaggcggatttt

SEQ ID NO: 7629837 - DNA, 22 bp, Homo sapiens
ggcacagggagaggcggatttt

SEQ ID NO: 7629838 - DNA, 22 bp, Homo sapiens
ggcacagggagccgcagttgca

SEQ ID NO: 7629839 - DNA, 22 bp, Homo sapiens
ggcacagggagccgcagttgca

SEQ ID NO: 7629840 - DNA, 22 bp, Homo sapiens
ggcacagggagccgcagttgca

SEQ ID NO: 7629841 - DNA, 22 bp, Homo sapiens
ggcacagggagccgcagttgca

SEQ ID NO: 7629842 - DNA, 22 bp, Homo sapiens
ggcacagggagccgcagttgca

SEQ ID NO: 7629843 - DNA, 22 bp, Homo sapiens
ggcacagggagccgcagttgca

SEQ ID NO: 7629844 - DNA, 22 bp, Homo sapiens
ggcacaggagctagtcaaagcc

SEQ ID NO: 7629845 - DNA, 22 bp, Homo sapiens
ggcacacaaaggcagcatttga

SEQ ID NO: 7629846 - DNA, 22 bp, Homo sapiens
ggcacacaaaggcagcatttga

SEQ ID NO: 7629847 - DNA, 22 bp, Homo sapiens
ggcacaattgcagcaataaaca

SEQ ID NO: 7629848 - DNA, 22 bp, Homo sapiens
ggcacacaaaggcagcatttga

SEQ ID NO: 7629849 - DNA, 22 bp, Homo sapiens
ggcacaatcatgaagttgagtt

SEQ ID NO: 7629850 - DNA, 22 bp, Homo sapiens
ggcacaattgcagcaataaaca

SEQ ID NO: 7629851 - DNA, 22 bp, Homo sapiens
ggcacaggagtcacagcatttc

SEQ ID NO: 7629852 - DNA, 22 bp, Homo sapiens
ggcacaggagtcacagcatttc

SEQ ID NO: 7629853 - DNA, 22 bp, Homo sapiens
ggcacaggagtcacagcatttc

SEQ ID NO: 7629854 - DNA, 22 bp, Homo sapiens
ggcacaggagtcacagcatttc

SEQ ID NO: 7629855 - DNA, 22 bp, Homo sapiens
ggcacaggagtcacagcatttc

SEQ ID NO: 7629856 - DNA, 22 bp, Homo sapiens
cacccagagcagacactgtcca

SEQ ID NO: 7629857 - DNA, 22 bp, Homo sapiens
cacccagagcctgagagggata

SEQ ID NO: 7629858 - DNA, 22 bp, Homo sapiens
cacccagagcctgagagggata

SEQ ID NO: 7629859 - DNA, 22 bp, Homo sapiens
cacccagagcctgagagggata

SEQ ID NO: 7629860 - DNA, 22 bp, Homo sapiens
cacccagagcagacactgtcca

SEQ ID NO: 7629861 - DNA, 22 bp, Homo sapiens
cacccagagcagacactgtcca

SEQ ID NO: 7629862 - DNA, 22 bp, Homo sapiens
cacccactgagctcatgtccca

SEQ ID NO: 7629863 - DNA, 22 bp, Homo sapiens
cacccagagggcttgctgaaca

SEQ ID NO: 7629864 - DNA, 22 bp, Homo sapiens
cacccagagggcttgctgaaca

SEQ ID NO: 7629865 - DNA, 22 bp, Homo sapiens
cacccagagggcttgctgaaca

SEQ ID NO: 7629866 - DNA, 22 bp, Homo sapiens
cacccagcacagagggaggcga

SEQ ID NO: 7629867 - DNA, 22 bp, Homo sapiens
ggcagtgtccttgcagctctac

SEQ ID NO: 7629868 - DNA, 22 bp, Homo sapiens
ggcagtgtcaaaataggcagaa

SEQ ID NO: 7629869 - DNA, 22 bp, Homo sapiens
ggcagtgttccagaccttcacc

SEQ ID NO: 7629870 - DNA, 22 bp, Homo sapiens
ggcagtgtggcctgagtaagtc

SEQ ID NO: 7629871 - DNA, 22 bp, Homo sapiens
ggcagtgtggcctgagtaagtc

SEQ ID NO: 7629872 - DNA, 22 bp, Homo sapiens
ggcagtgtggcataacatgtag

SEQ ID NO: 7629873 - DNA, 22 bp, Homo sapiens
ggcagtgtggcataacatgtag

SEQ ID NO: 7629874 - DNA, 22 bp, Homo sapiens
ggcagtgtgcatctgtgtggcc

SEQ ID NO: 7629875 - DNA, 22 bp, Homo sapiens
ggcagtgtttatgggtaacaca

SEQ ID NO: 7629876 - DNA, 22 bp, Homo sapiens
ggcagtgtttatgggtaacaca

SEQ ID NO: 7629877 - DNA, 22 bp, Homo sapiens
ggcagtgtttatgggtaacaca

SEQ ID NO: 7629878 - DNA, 22 bp, Homo sapiens
ggcagttccagaatttcagtac

SEQ ID NO: 7629879 - DNA, 22 bp, Homo sapiens
ggcagttctcagccaaggcaat

SEQ ID NO: 7629880 - DNA, 22 bp, Homo sapiens
ggcagttctcagccaaggcaat

SEQ ID NO: 7629881 - DNA, 22 bp, Homo sapiens
ggcagttgctgtggatgaggtt

SEQ ID NO: 7629882 - DNA, 22 bp, Homo sapiens
ggcagttgctgtggatgaggtt

SEQ ID NO: 7629883 - DNA, 22 bp, Homo sapiens
ggcagttgcgtgcatcagtggt

SEQ ID NO: 7629884 - DNA, 22 bp, Homo sapiens
ggcagttctggatgcattgtca

SEQ ID NO: 7629885 - DNA, 22 bp, Homo sapiens
ggcagttgcgtgcatcagtggt

SEQ ID NO: 7629886 - DNA, 22 bp, Homo sapiens
caccatctggtaggcattagtg

SEQ ID NO: 7629887 - DNA, 22 bp, Homo sapiens
caccatctagcagagagatgga

SEQ ID NO: 7629888 - DNA, 22 bp, Homo sapiens
caccatctagcagagagatgga

SEQ ID NO: 7629889 - DNA, 22 bp, Homo sapiens
caccatgcttgatttgtaatgt

SEQ ID NO: 7629890 - DNA, 22 bp, Homo sapiens
caccatgactggttgagagagg

SEQ ID NO: 7629891 - DNA, 22 bp, Homo sapiens
caccatgactggttgagagagg

SEQ ID NO: 7629892 - DNA, 22 bp, Homo sapiens
caccatgcttgatttgtaatgt

SEQ ID NO: 7629893 - DNA, 22 bp, Homo sapiens
caccatgtattcagtttggcac

SEQ ID NO: 7629894 - DNA, 22 bp, Homo sapiens
caccattctgaggagagtggat

SEQ ID NO: 7629895 - DNA, 22 bp, Homo sapiens
caccatttaagaaagccaaatt

SEQ ID NO: 7629896 - DNA, 22 bp, Homo sapiens
caccatttaagaaagccaaatt

SEQ ID NO: 7629897 - DNA, 22 bp, Homo sapiens
caccatttagtagcaagagctc

SEQ ID NO: 7629898 - DNA, 22 bp, Homo sapiens
caccatttagtagcaagagctc

SEQ ID NO: 7629899 - DNA, 22 bp, Homo sapiens
caccattttctaaaaatatgac

SEQ ID NO: 7629900 - DNA, 22 bp, Homo sapiens
caccattttctaaaaatatgac

SEQ ID NO: 7629901 - DNA, 22 bp, Homo sapiens
caccattttctaaaaatatgac

SEQ ID NO: 7629902 - DNA, 22 bp, Homo sapiens
cacccacatggaaattcacagt

SEQ ID NO: 7629903 - DNA, 22 bp, Homo sapiens
cacccacatggaaattcacagt

SEQ ID NO: 7629904 - DNA, 22 bp, Homo sapiens
caccattttctaaaaatatgac

SEQ ID NO: 7629905 - DNA, 22 bp, Homo sapiens
cacccacattccatcactctgc

SEQ ID NO: 7629906 - DNA, 22 bp, Homo sapiens
cacccacattccatcactctgc

SEQ ID NO: 7629907 - DNA, 22 bp, Homo sapiens
cacccacattccatcactctgc

SEQ ID NO: 7629908 - DNA, 22 bp, Homo sapiens
cacccacattccatcactctgc

SEQ ID NO: 7629909 - DNA, 22 bp, Homo sapiens
cacccacatggaaattcacagt

SEQ ID NO: 7629910 - DNA, 22 bp, Homo sapiens
cacccacatggaaattcacagt

SEQ ID NO: 7629911 - DNA, 22 bp, Homo sapiens
cacccacattccatcactctgc

SEQ ID NO: 7629912 - DNA, 22 bp, Homo sapiens
cacccacattccatcactctgc

SEQ ID NO: 7629913 - DNA, 22 bp, Homo sapiens
cacccactgagctcatgtccca

SEQ ID NO: 7629914 - DNA, 22 bp, Homo sapiens
cacccactgagctcatgtccca

SEQ ID NO: 7629915 - DNA, 22 bp, Homo sapiens
cacccacccagaagatcctggc

SEQ ID NO: 7629916 - DNA, 22 bp, Homo sapiens
cacccagacatgtggtcccaga

SEQ ID NO: 7629917 - DNA, 22 bp, Homo sapiens
cacccagacatgtggtcccaga

SEQ ID NO: 7629918 - DNA, 22 bp, Homo sapiens
cacccacattcctctagtatgt

SEQ ID NO: 7629919 - DNA, 22 bp, Homo sapiens
cacccacccactgctcattggc

SEQ ID NO: 7629920 - DNA, 22 bp, Homo sapiens
cacccacccactgctcattggc

SEQ ID NO: 7629921 - DNA, 22 bp, Homo sapiens
cacccacccagaagatcctggc

SEQ ID NO: 7629922 - DNA, 22 bp, Homo sapiens
ggcagctgaagaggaactttgg

SEQ ID NO: 7629923 - DNA, 22 bp, Homo sapiens
ggcagctgaagaggaactttgg

SEQ ID NO: 7629924 - DNA, 22 bp, Homo sapiens
ggcagctgaagaggaactttgg

SEQ ID NO: 7629925 - DNA, 21 bp, Homo sapiens
ggcagctgaccgcgcggtgca

SEQ ID NO: 7629926 - DNA, 21 bp, Homo sapiens
ggcagctgaccgcgcggtgca

SEQ ID NO: 7629927 - DNA, 22 bp, Homo sapiens
ggcagctgaagaggaactttgg

SEQ ID NO: 7629928 - DNA, 21 bp, Homo sapiens
ggcagctgaccgcgcggtgca

SEQ ID NO: 7629929 - DNA, 21 bp, Homo sapiens
ggcagctgaccgcgcggtgca

SEQ ID NO: 7629930 - DNA, 21 bp, Homo sapiens
ggcagctgaccgcgcggtgca

SEQ ID NO: 7629931 - DNA, 21 bp, Homo sapiens
ggcagctgaccgcgcggtgca

SEQ ID NO: 7629932 - DNA, 22 bp, Homo sapiens
ggcagccagagggcagctggat

SEQ ID NO: 7629933 - DNA, 22 bp, Homo sapiens
ggcagccagagggcagctggat

SEQ ID NO: 7629934 - DNA, 22 bp, Homo sapiens
ggcagccagagggcagctggat

SEQ ID NO: 7629935 - DNA, 22 bp, Homo sapiens
ggcagccagagggcagctggat

SEQ ID NO: 7629936 - DNA, 22 bp, Homo sapiens
ggcagccagagggcagctggat

SEQ ID NO: 7629937 - DNA, 19 bp, Homo sapiens
ggcagctcttgtcttctgc

SEQ ID NO: 7629938 - DNA, 19 bp, Homo sapiens
ggcagctcttgtcttctgc

SEQ ID NO: 7629939 - DNA, 22 bp, Homo sapiens
ggcagccagagggcagctggat

SEQ ID NO: 7629940 - DNA, 22 bp, Homo sapiens
ggcagccagagggcagctggat

SEQ ID NO: 7629941 - DNA, 22 bp, Homo sapiens
ggcagctgagatcatgctgttg

SEQ ID NO: 7629942 - DNA, 22 bp, Homo sapiens
ggcagctgagatcatgctgttg

SEQ ID NO: 7629943 - DNA, 22 bp, Homo sapiens
ggcagctgagatcatgctgttg

SEQ ID NO: 7629944 - DNA, 22 bp, Homo sapiens
ggcagctgagatcatgctgttg

SEQ ID NO: 7629945 - DNA, 22 bp, Homo sapiens
ggcagctgagatcatgctgttg

SEQ ID NO: 7629946 - DNA, 22 bp, Homo sapiens
ggcagctgagatcatgctgttg

SEQ ID NO: 7629947 - DNA, 22 bp, Homo sapiens
ggcagctgagatcatgctgttg

SEQ ID NO: 7629948 - DNA, 22 bp, Homo sapiens
ggcagctgagatcatgctgttg

SEQ ID NO: 7629949 - DNA, 22 bp, Homo sapiens
ggcagctgagcatggctacctt

SEQ ID NO: 7629950 - DNA, 22 bp, Homo sapiens
ggcagctgagatcatgctgttg

SEQ ID NO: 7629951 - DNA, 22 bp, Homo sapiens
ggcagctgacctagcaccatcc

SEQ ID NO: 7629952 - DNA, 22 bp, Homo sapiens
ggcagctgacctagcaccatcc

SEQ ID NO: 7629953 - DNA, 22 bp, Homo sapiens
ggcagctgacctagcaccatcc

SEQ ID NO: 7629954 - DNA, 22 bp, Homo sapiens
ggcagctgacctagcaccatcc

SEQ ID NO: 7629955 - DNA, 22 bp, Homo sapiens
ggcagctgacctagcaccatcc

SEQ ID NO: 7629956 - DNA, 21 bp, Homo sapiens
ggcagctgaccgcgcggtgca

SEQ ID NO: 7629957 - DNA, 22 bp, Homo sapiens
ggcagctgacctagcaccatcc

SEQ ID NO: 7629958 - DNA, 22 bp, Homo sapiens
ggcagctgagcatggctacctt

SEQ ID NO: 7629959 - DNA, 22 bp, Homo sapiens
ggcagctgagcatggctacctt

SEQ ID NO: 7629960 - DNA, 22 bp, Homo sapiens
ggcagctgagcatggctacctt

SEQ ID NO: 7629961 - DNA, 22 bp, Homo sapiens
ggcagctgagcatggctacctt

SEQ ID NO: 7629962 - DNA, 22 bp, Homo sapiens
ggcagctgagcatggctacctt

SEQ ID NO: 7629963 - DNA, 22 bp, Homo sapiens
ggcagctgagcatggctacctt

SEQ ID NO: 7629964 - DNA, 22 bp, Homo sapiens
ggcagctgagcatggctacctt

SEQ ID NO: 7629965 - DNA, 22 bp, Homo sapiens
ggcagctgattagcatcaagga

SEQ ID NO: 7629966 - DNA, 22 bp, Homo sapiens
ggcagctgattagcatcaagga

SEQ ID NO: 7629967 - DNA, 22 bp, Homo sapiens
ggcagctgattagcatcaagga

SEQ ID NO: 7629968 - DNA, 22 bp, Homo sapiens
ggcagctgattagcatcaagga

SEQ ID NO: 7629969 - DNA, 22 bp, Homo sapiens
ggcagctgattagcatcaagga

SEQ ID NO: 7629970 - DNA, 22 bp, Homo sapiens
ggcagctgattagcatcaagga

SEQ ID NO: 7629971 - DNA, 22 bp, Homo sapiens
ggcagctgattagcatcaagga

SEQ ID NO: 7629972 - DNA, 22 bp, Homo sapiens
ggcagctgattagcatcaagga

SEQ ID NO: 7629973 - DNA, 22 bp, Homo sapiens
ggcagctgagcatggctacctt

SEQ ID NO: 7629974 - DNA, 22 bp, Homo sapiens
ggcagctgagcatggctacctt

SEQ ID NO: 7629975 - DNA, 22 bp, Homo sapiens
ggcagctgattagcatcaagga

SEQ ID NO: 7629976 - DNA, 22 bp, Homo sapiens
ggcagctgattagcatcaagga

SEQ ID NO: 7629977 - DNA, 22 bp, Homo sapiens
ggcagctgattagcatcaagga

SEQ ID NO: 7629978 - DNA, 22 bp, Homo sapiens
caccataaccaacatgtcagtt

SEQ ID NO: 7629979 - DNA, 22 bp, Homo sapiens
caccagtgtttacctgtgacaa

SEQ ID NO: 7629980 - DNA, 22 bp, Homo sapiens
caccagtgtttacctgtgacaa

SEQ ID NO: 7629981 - DNA, 20 bp, Homo sapiens
caccagtcatgagtcaatac

SEQ ID NO: 7629982 - DNA, 20 bp, Homo sapiens
caccagtcatgagtcaatac

SEQ ID NO: 7629983 - DNA, 22 bp, Homo sapiens
caccaggctggagtgcagtggc

SEQ ID NO: 7629984 - DNA, 16 bp, Homo sapiens
caccagtccttcctgc

SEQ ID NO: 7629985 - DNA, 22 bp, Homo sapiens
caccaggctggagtgcagtggc

SEQ ID NO: 7629986 - DNA, 22 bp, Homo sapiens
caccaggctggagtgcagtggc

SEQ ID NO: 7629987 - DNA, 22 bp, Homo sapiens
caccaggctggagtgcagtggc

SEQ ID NO: 7629988 - DNA, 22 bp, Homo sapiens
caccaggttccgggcagagctg

SEQ ID NO: 7629989 - DNA, 22 bp, Homo sapiens
caccaggctggagtgcagtggc

SEQ ID NO: 7629990 - DNA, 22 bp, Homo sapiens
ggcagctgattagcatcaagga

SEQ ID NO: 7629991 - DNA, 22 bp, Homo sapiens
caccaggctggagtgcagtggc

SEQ ID NO: 7629992 - DNA, 22 bp, Homo sapiens
ggcagctgcaaatctgctctgt

SEQ ID NO: 7629993 - DNA, 22 bp, Homo sapiens
ggcagctgcaaatctgctctgt

SEQ ID NO: 7629994 - DNA, 22 bp, Homo sapiens
cacccagtaagcatgaggccct

SEQ ID NO: 7629995 - DNA, 22 bp, Homo sapiens
cacccaggttggagtgcagtgg

SEQ ID NO: 7629996 - DNA, 22 bp, Homo sapiens
cacccaggttggagtgcagtgg

SEQ ID NO: 7629997 - DNA, 22 bp, Homo sapiens
cacccaggttggagtgcagtgg

SEQ ID NO: 7629998 - DNA, 22 bp, Homo sapiens
cacccaggttggagtgcagtgg

SEQ ID NO: 7629999 - DNA, 22 bp, Homo sapiens
cacccaggttggagtgcagtgg

SEQ ID NO: 7630000 - DNA, 22 bp, Homo sapiens
cacccaggttggagtgcagtgg

SEQ ID NO: 7630001 - DNA, 22 bp, Homo sapiens
cacccaggttggagtgcagtgg

SEQ ID NO: 7630002 - DNA, 22 bp, Homo sapiens
cacccaggttggagtgcagtgg

SEQ ID NO: 7630003 - DNA, 22 bp, Homo sapiens
cacccagtaagcatgaggccct

SEQ ID NO: 7630004 - DNA, 22 bp, Homo sapiens
cacccagtgaaggagcaagagg

SEQ ID NO: 7630005 - DNA, 22 bp, Homo sapiens
cacccagtaagcatgaggccct

SEQ ID NO: 7630006 - DNA, 22 bp, Homo sapiens
cacccagtgaaggagcaagagg

SEQ ID NO: 7630007 - DNA, 22 bp, Homo sapiens
cacccattaaccaaagagtgaa

SEQ ID NO: 7630008 - DNA, 22 bp, Homo sapiens
cacccatgtttccctctgtctt

SEQ ID NO: 7630009 - DNA, 22 bp, Homo sapiens
cacccagttgactacaaagggg

SEQ ID NO: 7630010 - DNA, 22 bp, Homo sapiens
cacccagttgactacaaagggg

SEQ ID NO: 7630011 - DNA, 22 bp, Homo sapiens
caccccagtctaaaaccagcct

SEQ ID NO: 7630012 - DNA, 22 bp, Homo sapiens
caccccagtctaaaaccagcct

SEQ ID NO: 7630013 - DNA, 22 bp, Homo sapiens
caccccagtctaaaaccagcct

SEQ ID NO: 7630014 - DNA, 22 bp, Homo sapiens
caccccagtctaaaaccagcct

SEQ ID NO: 7630015 - DNA, 22 bp, Homo sapiens
caccccatgtgcaggaagctgg

SEQ ID NO: 7630016 - DNA, 22 bp, Homo sapiens
caccccatgtgcaggaagctgg

SEQ ID NO: 7630017 - DNA, 22 bp, Homo sapiens
caccccagtctaaaaccagcct

SEQ ID NO: 7630018 - DNA, 22 bp, Homo sapiens
caccccagcttctcaggataga

SEQ ID NO: 7630019 - DNA, 22 bp, Homo sapiens
caccccaagttctgtccactgc

SEQ ID NO: 7630020 - DNA, 19 bp, Homo sapiens
caccccagtcctctttccc

SEQ ID NO: 7630021 - DNA, 19 bp, Homo sapiens
caccccagtcctctttccc

SEQ ID NO: 7630022 - DNA, 22 bp, Homo sapiens
caccccaagttctgtccactgc

SEQ ID NO: 7630023 - DNA, 22 bp, Homo sapiens
cacccatgtttccctctgtctt

SEQ ID NO: 7630024 - DNA, 22 bp, Homo sapiens
caccccaagttctgtccactgc

SEQ ID NO: 7630025 - DNA, 22 bp, Homo sapiens
caccccacatcaggcttctcca

SEQ ID NO: 7630026 - DNA, 22 bp, Homo sapiens
caccccacatcaggcttctcca

SEQ ID NO: 7630027 - DNA, 22 bp, Homo sapiens
caccccacatcaggcttctcca

SEQ ID NO: 7630028 - DNA, 22 bp, Homo sapiens
caccccaagttctgtccactgc

SEQ ID NO: 7630029 - DNA, 22 bp, Homo sapiens
caccccaagttctgtccactgc

SEQ ID NO: 7630030 - DNA, 22 bp, Homo sapiens
caccccagcttctcaggataga

SEQ ID NO: 7630031 - DNA, 22 bp, Homo sapiens
caccccagcttctcaggataga

SEQ ID NO: 7630032 - DNA, 22 bp, Homo sapiens
caccccagcttctcaggataga

SEQ ID NO: 7630033 - DNA, 23 bp, Homo sapiens
caccccaccctgaggaggaggga

SEQ ID NO: 7630034 - DNA, 23 bp, Homo sapiens
caccccaccctgaggaggaggga

SEQ ID NO: 7630035 - DNA, 22 bp, Homo sapiens
caccccagcttctcaggataga

SEQ ID NO: 7630036 - DNA, 22 bp, Homo sapiens
cacccaggctggaatgcaatgg

SEQ ID NO: 7630037 - DNA, 22 bp, Homo sapiens
cacccaggctggaatgcaatgg

SEQ ID NO: 7630038 - DNA, 22 bp, Homo sapiens
cacccaggctagagtgcagtgg

SEQ ID NO: 7630039 - DNA, 22 bp, Homo sapiens
cacccaggctagagtgcagtgg

SEQ ID NO: 7630040 - DNA, 22 bp, Homo sapiens
cacccaggctagagtgcagtgg

SEQ ID NO: 7630041 - DNA, 22 bp, Homo sapiens
ggcatcagcccggtcctgggct

SEQ ID NO: 7630042 - DNA, 22 bp, Homo sapiens
cacccaggctggaatgcagtgg

SEQ ID NO: 7630043 - DNA, 22 bp, Homo sapiens
cacccaggctggaatgcagtgg

SEQ ID NO: 7630044 - DNA, 22 bp, Homo sapiens
cacccaggctggaatgcagtgg

SEQ ID NO: 7630045 - DNA, 22 bp, Homo sapiens
cacccaggctggaatgcagtgg

SEQ ID NO: 7630046 - DNA, 22 bp, Homo sapiens
cacccaggttggagtgcagtgg

SEQ ID NO: 7630047 - DNA, 22 bp, Homo sapiens
ggcatatgtagcgtgtgttctg

SEQ ID NO: 7630048 - DNA, 22 bp, Homo sapiens
ggcatatttatgagaacttagt

SEQ ID NO: 7630049 - DNA, 22 bp, Homo sapiens
ggcatattcccagacctcatct

SEQ ID NO: 7630050 - DNA, 22 bp, Homo sapiens
ggcatatgtagcgtgtgttctg

SEQ ID NO: 7630051 - DNA, 22 bp, Homo sapiens
ggcatagcggctcagcgtccag

SEQ ID NO: 7630052 - DNA, 22 bp, Homo sapiens
ggcatagcggctcagcgtccag

SEQ ID NO: 7630053 - DNA, 22 bp, Homo sapiens
ggcatcagcccggtcctgggct

SEQ ID NO: 7630054 - DNA, 22 bp, Homo sapiens
ggcatcagaggtgtgttctgct

SEQ ID NO: 7630055 - DNA, 22 bp, Homo sapiens
ggcatatttatgagaacttagt

SEQ ID NO: 7630056 - DNA, 22 bp, Homo sapiens
ggcatcagaggtgtgttctgct

SEQ ID NO: 7630057 - DNA, 22 bp, Homo sapiens
ggcatcagaggtgtgttctgct

SEQ ID NO: 7630058 - DNA, 22 bp, Homo sapiens
ggcatagatttctttaggttta

SEQ ID NO: 7630059 - DNA, 22 bp, Homo sapiens
ggcatagaaaatgtgccctctg

SEQ ID NO: 7630060 - DNA, 22 bp, Homo sapiens
ggcatagaaaatgtgccctctg

SEQ ID NO: 7630061 - DNA, 22 bp, Homo sapiens
ggcatagatgcaggcaaagtgg

SEQ ID NO: 7630062 - DNA, 22 bp, Homo sapiens
ggcatacaagagaaatataaga

SEQ ID NO: 7630063 - DNA, 22 bp, Homo sapiens
ggcatagaatgtgctgtgacaa

SEQ ID NO: 7630064 - DNA, 22 bp, Homo sapiens
ggcatagaatgtgctgtgacaa

SEQ ID NO: 7630065 - DNA, 22 bp, Homo sapiens
ggcagttttctcagtggggtac

SEQ ID NO: 7630066 - DNA, 22 bp, Homo sapiens
ggcataaagttagagattaaga

SEQ ID NO: 7630067 - DNA, 22 bp, Homo sapiens
ggcagttttaacagaggtagta

SEQ ID NO: 7630068 - DNA, 22 bp, Homo sapiens
ggcatacaagagaaatataaga

SEQ ID NO: 7630069 - DNA, 22 bp, Homo sapiens
ggcataaagttagagattaaga

SEQ ID NO: 7630070 - DNA, 22 bp, Homo sapiens
ggcataaagttagagattaaga

SEQ ID NO: 7630071 - DNA, 22 bp, Homo sapiens
ggcagttttaacagaggtagta

SEQ ID NO: 7630072 - DNA, 22 bp, Homo sapiens
ggcagtttctcaggcaggggta

SEQ ID NO: 7630073 - DNA, 22 bp, Homo sapiens
ggcagtttggcaggatggaggg

SEQ ID NO: 7630074 - DNA, 18 bp, Homo sapiens
ggcagtttgtgtagggga

SEQ ID NO: 7630075 - DNA, 22 bp, Homo sapiens
ggcagtttcatcaggagaaaag

SEQ ID NO: 7630076 - DNA, 22 bp, Homo sapiens
ggcagtttctcaggcaggggta

SEQ ID NO: 7630077 - DNA, 22 bp, Homo sapiens
ggcagtttggcaggatggaggg

SEQ ID NO: 7630078 - DNA, 22 bp, Homo sapiens
ggcagttgttggccacgggtgg

SEQ ID NO: 7630079 - DNA, 22 bp, Homo sapiens
ggcagtttcatcaggagaaaag

SEQ ID NO: 7630080 - DNA, 22 bp, Homo sapiens
ggcagtttatattatgtgtgtg

SEQ ID NO: 7630081 - DNA, 22 bp, Homo sapiens
ggcagtttatattatgtgtgtg

SEQ ID NO: 7630082 - DNA, 22 bp, Homo sapiens
ggcagtttcatcaggagaaaag

SEQ ID NO: 7630083 - DNA, 22 bp, Homo sapiens
ggcagtttctcaggcaggggta

SEQ ID NO: 7630084 - DNA, 22 bp, Homo sapiens
caccctggcctcgctctctgca

SEQ ID NO: 7630085 - DNA, 17 bp, Homo sapiens
caccctggctagtctga

SEQ ID NO: 7630086 - DNA, 17 bp, Homo sapiens
caccctggctagtctga

SEQ ID NO: 7630087 - DNA, 22 bp, Homo sapiens
caccctggcctcgctctctgca

SEQ ID NO: 7630088 - DNA, 22 bp, Homo sapiens
caccctggaatagccccgggag

SEQ ID NO: 7630089 - DNA, 22 bp, Homo sapiens
caccctggaatagtagttctgc

SEQ ID NO: 7630090 - DNA, 22 bp, Homo sapiens
caccctggcctcgctctctgca

SEQ ID NO: 7630091 - DNA, 22 bp, Homo sapiens
caccctggctggaggtgcagtg

SEQ ID NO: 7630092 - DNA, 17 bp, Homo sapiens
caccctggctagtctga

SEQ ID NO: 7630093 - DNA, 22 bp, Homo sapiens
caccctggctggaggtgcagtg

SEQ ID NO: 7630094 - DNA, 22 bp, Homo sapiens
caccctggctggaggtgcagtg

SEQ ID NO: 7630095 - DNA, 22 bp, Homo sapiens
caccctggctggaggtgcagtg

SEQ ID NO: 7630096 - DNA, 22 bp, Homo sapiens
caccctggctggaggtgcagtg

SEQ ID NO: 7630097 - DNA, 20 bp, Homo sapiens
cactgaagacttcttgctca

SEQ ID NO: 7630098 - DNA, 22 bp, Homo sapiens
cactctgagaagtacaagctcc

SEQ ID NO: 7630099 - DNA, 22 bp, Homo sapiens
caccctggaaagaaggtctggg

SEQ ID NO: 7630100 - DNA, 22 bp, Homo sapiens
caccctgctctgctgtgcggcc

SEQ ID NO: 7630101 - DNA, 22 bp, Homo sapiens
caccctgctctgctgtgcggcc

SEQ ID NO: 7630102 - DNA, 22 bp, Homo sapiens
caccctgctctgctgtgcggcc

SEQ ID NO: 7630103 - DNA, 22 bp, Homo sapiens
caccctgctacaaagcctcctg

SEQ ID NO: 7630104 - DNA, 22 bp, Homo sapiens
caccctggaaagaaggtctggg

SEQ ID NO: 7630105 - DNA, 22 bp, Homo sapiens
caccctggaaagaaggtctggg

SEQ ID NO: 7630106 - DNA, 22 bp, Homo sapiens
caccctggaaagaaggtctggg

SEQ ID NO: 7630107 - DNA, 22 bp, Homo sapiens
caccctggaaagaaggtctggg

SEQ ID NO: 7630108 - DNA, 22 bp, Homo sapiens
caccctggaaagaaggtctggg

SEQ ID NO: 7630109 - DNA, 22 bp, Homo sapiens
caccctggaaagaaggtctggg

SEQ ID NO: 7630110 - DNA, 22 bp, Homo sapiens
caccctggaatagccccgggag

SEQ ID NO: 7630111 - DNA, 22 bp, Homo sapiens
caccctgaggccacccagacct

SEQ ID NO: 7630112 - DNA, 22 bp, Homo sapiens
caccctgcccactagcaatctg

SEQ ID NO: 7630113 - DNA, 22 bp, Homo sapiens
caccctgcccactagcaatctg

SEQ ID NO: 7630114 - DNA, 22 bp, Homo sapiens
caccctgcccactagcaatctg

SEQ ID NO: 7630115 - DNA, 22 bp, Homo sapiens
caccctgctacaaagcctcctg

SEQ ID NO: 7630116 - DNA, 22 bp, Homo sapiens
caccctgctacaaagcctcctg

SEQ ID NO: 7630117 - DNA, 22 bp, Homo sapiens
caccctgctacaaagcctcctg

SEQ ID NO: 7630118 - DNA, 22 bp, Homo sapiens
caccctgctacaaagcctcctg

SEQ ID NO: 7630119 - DNA, 18 bp, Homo sapiens
caccctccgcggctgccc

SEQ ID NO: 7630120 - DNA, 18 bp, Homo sapiens
caccctccgcggctgccc

SEQ ID NO: 7630121 - DNA, 18 bp, Homo sapiens
caccctccgcggctgccc

SEQ ID NO: 7630122 - DNA, 22 bp, Homo sapiens
caccctgactggccctgcagga

SEQ ID NO: 7630123 - DNA, 18 bp, Homo sapiens
caccctccgcggctgccc

SEQ ID NO: 7630124 - DNA, 22 bp, Homo sapiens
caccctgaaggctggccctgac

SEQ ID NO: 7630125 - DNA, 22 bp, Homo sapiens
cacccctacctgagtcaggagt

SEQ ID NO: 7630126 - DNA, 22 bp, Homo sapiens
caccccctccatggttgtgaca

SEQ ID NO: 7630127 - DNA, 22 bp, Homo sapiens
caccccccaattctgccagctg

SEQ ID NO: 7630128 - DNA, 22 bp, Homo sapiens
cacccccagcagggaaaggagg

SEQ ID NO: 7630129 - DNA, 22 bp, Homo sapiens
cacccccaggagctccagggac

SEQ ID NO: 7630130 - DNA, 22 bp, Homo sapiens
cacccccaggagctccagggac

SEQ ID NO: 7630131 - DNA, 22 bp, Homo sapiens
cacccccaggagctccagggac

SEQ ID NO: 7630132 - DNA, 22 bp, Homo sapiens
caccccccaattctgccagctg

SEQ ID NO: 7630133 - DNA, 22 bp, Homo sapiens
cacccccacctgtgggctcctg

SEQ ID NO: 7630134 - DNA, 22 bp, Homo sapiens
cacccccacctgtgggctcctg

SEQ ID NO: 7630135 - DNA, 22 bp, Homo sapiens
cacccccagcagggaaaggagg

SEQ ID NO: 7630136 - DNA, 22 bp, Homo sapiens
cacccccagcagggaaaggagg

SEQ ID NO: 7630137 - DNA, 22 bp, Homo sapiens
cacccctacctgagtcaggagt

SEQ ID NO: 7630138 - DNA, 22 bp, Homo sapiens
cacccctgggctgggcacacag

SEQ ID NO: 7630139 - DNA, 22 bp, Homo sapiens
cacccctgggctgggcacacag

SEQ ID NO: 7630140 - DNA, 22 bp, Homo sapiens
cacccctagtgtttgtgggccc

SEQ ID NO: 7630141 - DNA, 22 bp, Homo sapiens
cacccctcgccactgcccttgt

SEQ ID NO: 7630142 - DNA, 22 bp, Homo sapiens
cacccctgtggagcatggtggc

SEQ ID NO: 7630143 - DNA, 22 bp, Homo sapiens
cacccctgtggagcatggtggc

SEQ ID NO: 7630144 - DNA, 22 bp, Homo sapiens
cacccctgggctgggcacacag

SEQ ID NO: 7630145 - DNA, 22 bp, Homo sapiens
cacccctgtggagcatggtggc

SEQ ID NO: 7630146 - DNA, 22 bp, Homo sapiens
cacccctgtggagcatggtggc

SEQ ID NO: 7630147 - DNA, 22 bp, Homo sapiens
cacccctgtggagcatggtggc

SEQ ID NO: 7630148 - DNA, 22 bp, Homo sapiens
cacccctgtggagcatggtggc

SEQ ID NO: 7630149 - DNA, 22 bp, Homo sapiens
cacccctgtggagcatggtggc

SEQ ID NO: 7630150 - DNA, 22 bp, Homo sapiens
cacccctgtggagcatggtggc

SEQ ID NO: 7630151 - DNA, 22 bp, Homo sapiens
caccccttgtctttggggtcgt

SEQ ID NO: 7630152 - DNA, 20 bp, Homo sapiens
caccctacggcctcacctcc

SEQ ID NO: 7630153 - DNA, 20 bp, Homo sapiens
caccctacggcctcacctcc

SEQ ID NO: 7630154 - DNA, 20 bp, Homo sapiens
caccctacggcctcacctcc

SEQ ID NO: 7630155 - DNA, 20 bp, Homo sapiens
caccctcccagcacctatgc

SEQ ID NO: 7630156 - DNA, 20 bp, Homo sapiens
caccctcccagcacctatgc

SEQ ID NO: 7630157 - DNA, 22 bp, Homo sapiens
caccctccagctcccgggggct

SEQ ID NO: 7630158 - DNA, 20 bp, Homo sapiens
caccctcccagcacctatgc

SEQ ID NO: 7630159 - DNA, 18 bp, Homo sapiens
caccctccgcggctgccc

SEQ ID NO: 7630160 - DNA, 22 bp, Homo sapiens
caccctcccgtcagcccctggg

SEQ ID NO: 7630161 - DNA, 22 bp, Homo sapiens
caccctcccgtcagcccctggg

SEQ ID NO: 7630162 - DNA, 22 bp, Homo sapiens
caccctcccgtcagcccctggg

SEQ ID NO: 7630163 - DNA, 22 bp, Homo sapiens
caccctcccgtcagcccctggg

SEQ ID NO: 7630164 - DNA, 20 bp, Homo sapiens
caccctcccagcacctatgc

SEQ ID NO: 7630165 - DNA, 20 bp, Homo sapiens
caccctcccagcacctatgc

SEQ ID NO: 7630166 - DNA, 20 bp, Homo sapiens
caccctcccagcacctatgc

SEQ ID NO: 7630167 - DNA, 22 bp, Homo sapiens
cactgactaggtcggtgacctc

SEQ ID NO: 7630168 - DNA, 22 bp, Homo sapiens
cactgactaggtcggtgacctc

SEQ ID NO: 7630169 - DNA, 22 bp, Homo sapiens
cactgactgcccgctgtacatt

SEQ ID NO: 7630170 - DNA, 22 bp, Homo sapiens
cactgactccaaaaataaagaa

SEQ ID NO: 7630171 - DNA, 22 bp, Homo sapiens
cactgagaccagagtccctgac

SEQ ID NO: 7630172 - DNA, 17 bp, Homo sapiens
cactgacttaaaatctt

SEQ ID NO: 7630173 - DNA, 22 bp, Homo sapiens
cactgagaaagtgacctgccaa

SEQ ID NO: 7630174 - DNA, 22 bp, Homo sapiens
cactgagaaagtgacctgccaa

SEQ ID NO: 7630175 - DNA, 22 bp, Homo sapiens
cactgagaggtctcatttccaa

SEQ ID NO: 7630176 - DNA, 22 bp, Homo sapiens
cactgagagatgtgtcacagca

SEQ ID NO: 7630177 - DNA, 22 bp, Homo sapiens
cactgagagatgtgtcacagca

SEQ ID NO: 7630178 - DNA, 22 bp, Homo sapiens
cactgagagatgtgtcacagca

SEQ ID NO: 7630179 - DNA, 22 bp, Homo sapiens
cactgagagatgtgtcacagca

SEQ ID NO: 7630180 - DNA, 22 bp, Homo sapiens
cactgaagctttcattctcttg

SEQ ID NO: 7630181 - DNA, 22 bp, Homo sapiens
cactgaagcctgggagtaagac

SEQ ID NO: 7630182 - DNA, 22 bp, Homo sapiens
cactgaagccactggaagagga

SEQ ID NO: 7630183 - DNA, 22 bp, Homo sapiens
cactgaaggaaggactactgca

SEQ ID NO: 7630184 - DNA, 22 bp, Homo sapiens
cactgaaggaaggactactgca

SEQ ID NO: 7630185 - DNA, 22 bp, Homo sapiens
cactgaagccactggaagagga

SEQ ID NO: 7630186 - DNA, 22 bp, Homo sapiens
cactgaagatgcgactagtgct

SEQ ID NO: 7630187 - DNA, 22 bp, Homo sapiens
cactgaaggctaggattagatg

SEQ ID NO: 7630188 - DNA, 22 bp, Homo sapiens
cactgaaggacagtaggaaggg

SEQ ID NO: 7630189 - DNA, 22 bp, Homo sapiens
cactgaaggacagtaggaaggg

SEQ ID NO: 7630190 - DNA, 22 bp, Homo sapiens
cactgaaggctgcagctcagcc

SEQ ID NO: 7630191 - DNA, 22 bp, Homo sapiens
cactgaaggctaggattagatg

SEQ ID NO: 7630192 - DNA, 22 bp, Homo sapiens
cactgaaggctgcagctcagcc

SEQ ID NO: 7630193 - DNA, 22 bp, Homo sapiens
cactgaaggtaggaccaaggct

SEQ ID NO: 7630194 - DNA, 22 bp, Homo sapiens
cactgacagtatcagagctgtt

SEQ ID NO: 7630195 - DNA, 22 bp, Homo sapiens
cactgacagtatcagagctgtt

SEQ ID NO: 7630196 - DNA, 19 bp, Homo sapiens
cactgagctctgttcacta

SEQ ID NO: 7630197 - DNA, 19 bp, Homo sapiens
cactgagctctgttcacta

SEQ ID NO: 7630198 - DNA, 19 bp, Homo sapiens
cactgagctctgttcacta

SEQ ID NO: 7630199 - DNA, 22 bp, Homo sapiens
cactgagctgatttcaggtgcc

SEQ ID NO: 7630200 - DNA, 22 bp, Homo sapiens
cactgagctgatttcaggtgcc

SEQ ID NO: 7630201 - DNA, 22 bp, Homo sapiens
cactgagctgatttcaggtgcc

SEQ ID NO: 7630202 - DNA, 22 bp, Homo sapiens
cactgagctgatagaattccag

SEQ ID NO: 7630203 - DNA, 21 bp, Homo sapiens
cactgaggaggaaaaggagct

SEQ ID NO: 7630204 - DNA, 21 bp, Homo sapiens
cactgaggaggaaaaggagct

SEQ ID NO: 7630205 - DNA, 22 bp, Homo sapiens
cactgaggactcccacgtaggt

SEQ ID NO: 7630206 - DNA, 22 bp, Homo sapiens
cactgagcagtggtgaaaatct

SEQ ID NO: 7630207 - DNA, 22 bp, Homo sapiens
cactgagcatgagtgggctgtg

SEQ ID NO: 7630208 - DNA, 22 bp, Homo sapiens
cactgagcatgagtgggctgtg

SEQ ID NO: 7630209 - DNA, 22 bp, Homo sapiens
cactgagcaagtcagtacagca

SEQ ID NO: 7630210 - DNA, 22 bp, Homo sapiens
cactgagcaagtcagtacagca

SEQ ID NO: 7630211 - DNA, 22 bp, Homo sapiens
cactgagccaggagcaatatca

SEQ ID NO: 7630212 - DNA, 22 bp, Homo sapiens
cactgagccttgccagcttggt

SEQ ID NO: 7630213 - DNA, 22 bp, Homo sapiens
cactgagccttgccagcttggt

SEQ ID NO: 7630214 - DNA, 22 bp, Homo sapiens
cactgagagtagggcacaagtg

SEQ ID NO: 7630215 - DNA, 22 bp, Homo sapiens
cactgagagtagggcacaagtg

SEQ ID NO: 7630216 - DNA, 22 bp, Homo sapiens
cactgagagtagggcacaagtg

SEQ ID NO: 7630217 - DNA, 22 bp, Homo sapiens
cactgagcaagtcagtacagca

SEQ ID NO: 7630218 - DNA, 22 bp, Homo sapiens
cactgagcaagtcagtacagca

SEQ ID NO: 7630219 - DNA, 22 bp, Homo sapiens
ggcctcgcggcttctggtggct

SEQ ID NO: 7630220 - DNA, 22 bp, Homo sapiens
ggcctcgcggcttctggtggct

SEQ ID NO: 7630221 - DNA, 22 bp, Homo sapiens
ggcctcgcggcttctggtggct

SEQ ID NO: 7630222 - DNA, 22 bp, Homo sapiens
ggcctcgcggcttctggtggct

SEQ ID NO: 7630223 - DNA, 22 bp, Homo sapiens
ggcctcctgttggctagtgtga

SEQ ID NO: 7630224 - DNA, 22 bp, Homo sapiens
ggcctcctgttggctagtgtga

SEQ ID NO: 7630225 - DNA, 22 bp, Homo sapiens
ggcctcctgttggctagtgtga

SEQ ID NO: 7630226 - DNA, 22 bp, Homo sapiens
ggcctcctgttggctagtgtga

SEQ ID NO: 7630227 - DNA, 22 bp, Homo sapiens
cactgaggctgggggagaaggt

SEQ ID NO: 7630228 - DNA, 22 bp, Homo sapiens
cactgaggctgggggagaaggt

SEQ ID NO: 7630229 - DNA, 22 bp, Homo sapiens
cactgaggctgggggagaaggt

SEQ ID NO: 7630230 - DNA, 22 bp, Homo sapiens
cactgaggctgggggagaaggt

SEQ ID NO: 7630231 - DNA, 22 bp, Homo sapiens
ggcctcctcaccctgctcaggc

SEQ ID NO: 7630232 - DNA, 23 bp, Homo sapiens
ggcctcctggtctaggctagact

SEQ ID NO: 7630233 - DNA, 23 bp, Homo sapiens
ggcctcctggtctaggctagact

SEQ ID NO: 7630234 - DNA, 23 bp, Homo sapiens
ggcctcctggtctaggctagact

SEQ ID NO: 7630235 - DNA, 22 bp, Homo sapiens
ggcctcctcaccctgctcaggc

SEQ ID NO: 7630236 - DNA, 22 bp, Homo sapiens
ggcctcctcaccctgctcaggc

SEQ ID NO: 7630237 - DNA, 22 bp, Homo sapiens
ggcctcggcccactgctgcggt

SEQ ID NO: 7630238 - DNA, 22 bp, Homo sapiens
ggcctcgcggcttctggtggct

SEQ ID NO: 7630239 - DNA, 22 bp, Homo sapiens
ggcctcggcccactgctgcggt

SEQ ID NO: 7630240 - DNA, 22 bp, Homo sapiens
ggcctcgcggcttctggtggct

SEQ ID NO: 7630241 - DNA, 22 bp, Homo sapiens
ggcctcgcggcttctggtggct

SEQ ID NO: 7630242 - DNA, 22 bp, Homo sapiens
ggcctctcatgcccagagccaa

SEQ ID NO: 7630243 - DNA, 22 bp, Homo sapiens
ggcctctcagggcagagaccct

SEQ ID NO: 7630244 - DNA, 22 bp, Homo sapiens
ggcctcggcccactgctgcggt

SEQ ID NO: 7630245 - DNA, 23 bp, Homo sapiens
ggcctctcaccagggtcctttca

SEQ ID NO: 7630246 - DNA, 23 bp, Homo sapiens
ggcctctcaccagggtcctttca

SEQ ID NO: 7630247 - DNA, 22 bp, Homo sapiens
ggcctctctccagtcagtgcag

SEQ ID NO: 7630248 - DNA, 22 bp, Homo sapiens
cactgcactccagcttgggtga

SEQ ID NO: 7630249 - DNA, 22 bp, Homo sapiens
cactgcactccagcttgggtga

SEQ ID NO: 7630250 - DNA, 22 bp, Homo sapiens
cactgcactccagcttgggtga

SEQ ID NO: 7630251 - DNA, 22 bp, Homo sapiens
cactgcactccagcttgggtga

SEQ ID NO: 7630252 - DNA, 22 bp, Homo sapiens
ggcctctctagcatccagcctg

SEQ ID NO: 7630253 - DNA, 22 bp, Homo sapiens
ggcctctctagcatccagcctg

SEQ ID NO: 7630254 - DNA, 22 bp, Homo sapiens
ggcctctctagcatccagcctg

SEQ ID NO: 7630255 - DNA, 22 bp, Homo sapiens
ggcctctctagcatccagcctg

SEQ ID NO: 7630256 - DNA, 22 bp, Homo sapiens
ggcctctcgaagcttcagtcca

SEQ ID NO: 7630257 - DNA, 22 bp, Homo sapiens
ggcctctcgaagcttcagtcca

SEQ ID NO: 7630258 - DNA, 22 bp, Homo sapiens
ggcctctctagcatccagcctg

SEQ ID NO: 7630259 - DNA, 22 bp, Homo sapiens
ggcctctcattctccctggtcc

SEQ ID NO: 7630260 - DNA, 22 bp, Homo sapiens
ggcctctcgaagcttcagtcca

SEQ ID NO: 7630261 - DNA, 22 bp, Homo sapiens
ggcctctcattctccctggtcc

SEQ ID NO: 7630262 - DNA, 22 bp, Homo sapiens
ggcctctcatgcccagagccaa

SEQ ID NO: 7630263 - DNA, 22 bp, Homo sapiens
cactgcagtaactctaggactg

SEQ ID NO: 7630264 - DNA, 22 bp, Homo sapiens
cactgcagtaactctaggactg

SEQ ID NO: 7630265 - DNA, 22 bp, Homo sapiens
cactgcaggtctgagatggggg

SEQ ID NO: 7630266 - DNA, 22 bp, Homo sapiens
cactgcaggtctgagatggggg

SEQ ID NO: 7630267 - DNA, 22 bp, Homo sapiens
cactgcaggtctgagatggggg

SEQ ID NO: 7630268 - DNA, 23 bp, Homo sapiens
cactgcagcgtggtctggcagga

SEQ ID NO: 7630269 - DNA, 22 bp, Homo sapiens
cactgcaggtctgagatggggg

SEQ ID NO: 7630270 - DNA, 22 bp, Homo sapiens
cactgcaggtctgagatggggg

SEQ ID NO: 7630271 - DNA, 23 bp, Homo sapiens
cactgcagcgtggtctggcagga

SEQ ID NO: 7630272 - DNA, 23 bp, Homo sapiens
cactgcagcgtggtctggcagga

SEQ ID NO: 7630273 - DNA, 23 bp, Homo sapiens
cactgcagcgtggtctggcagga

SEQ ID NO: 7630274 - DNA, 23 bp, Homo sapiens
cactgcagcgtggtctggcagga

SEQ ID NO: 7630275 - DNA, 23 bp, Homo sapiens
cactgcagcgtggtctggcagga

SEQ ID NO: 7630276 - DNA, 23 bp, Homo sapiens
cactgcagcgtggtctggcagga

SEQ ID NO: 7630277 - DNA, 21 bp, Homo sapiens
cactgcagccttgacctgggc

SEQ ID NO: 7630278 - DNA, 23 bp, Homo sapiens
cactgcagcgtggtctggcagga

SEQ ID NO: 7630279 - DNA, 22 bp, Homo sapiens
cactgcagcctctgcctctcag

SEQ ID NO: 7630280 - DNA, 21 bp, Homo sapiens
cactgcagccttgacctgggc

SEQ ID NO: 7630281 - DNA, 21 bp, Homo sapiens
cactgcagccttgacctgggc

SEQ ID NO: 7630282 - DNA, 21 bp, Homo sapiens
cactgcagccttgacctgggc

SEQ ID NO: 7630283 - DNA, 22 bp, Homo sapiens
cactgcagcctcgctctcctga

SEQ ID NO: 7630284 - DNA, 22 bp, Homo sapiens
cactgcactccatcctgggaaa

SEQ ID NO: 7630285 - DNA, 22 bp, Homo sapiens
cactgcactccatcctgggaaa

SEQ ID NO: 7630286 - DNA, 22 bp, Homo sapiens
cactgcactccatcctgggaaa

SEQ ID NO: 7630287 - DNA, 22 bp, Homo sapiens
cactgcactccagcttgggtga

SEQ ID NO: 7630288 - DNA, 22 bp, Homo sapiens
cactgcagatcagaggctgaga

SEQ ID NO: 7630289 - DNA, 22 bp, Homo sapiens
cactgcagatcagaggctgaga

SEQ ID NO: 7630290 - DNA, 22 bp, Homo sapiens
cactgcagcaccatgcagggct

SEQ ID NO: 7630291 - DNA, 22 bp, Homo sapiens
cactgcagcaccatgcagggct

SEQ ID NO: 7630292 - DNA, 22 bp, Homo sapiens
cactgcagcaccatgcagggct

SEQ ID NO: 7630293 - DNA, 22 bp, Homo sapiens
cactgcagcaccatgcagggct

SEQ ID NO: 7630294 - DNA, 22 bp, Homo sapiens
cactgcagcctcgctctcctga

SEQ ID NO: 7630295 - DNA, 22 bp, Homo sapiens
cactgcagcctcgctctcctga

SEQ ID NO: 7630296 - DNA, 22 bp, Homo sapiens
cactgcagccacatagatgacg

SEQ ID NO: 7630297 - DNA, 22 bp, Homo sapiens
cactgcagcaccatgcagggct

SEQ ID NO: 7630298 - DNA, 22 bp, Homo sapiens
cactgcagccacatagatgacg

SEQ ID NO: 7630299 - DNA, 22 bp, Homo sapiens
cactgcagcaccatgcagggct

SEQ ID NO: 7630300 - DNA, 22 bp, Homo sapiens
cactgcagcaccatgcagggct

SEQ ID NO: 7630301 - DNA, 22 bp, Homo sapiens
cactgcagcaccatgcagggct

SEQ ID NO: 7630302 - DNA, 22 bp, Homo sapiens
cactgcagcaccatgcagggct

SEQ ID NO: 7630303 - DNA, 22 bp, Homo sapiens
ggctagttctcaaattcctgaa

SEQ ID NO: 7630304 - DNA, 22 bp, Homo sapiens
ggctatatcctcacaagatgga

SEQ ID NO: 7630305 - DNA, 22 bp, Homo sapiens
ggctaggggaataatctgtggt

SEQ ID NO: 7630306 - DNA, 22 bp, Homo sapiens
ggctaggggaataatctgtggt

SEQ ID NO: 7630307 - DNA, 22 bp, Homo sapiens
ggctaggggaataatctgtggt

SEQ ID NO: 7630308 - DNA, 22 bp, Homo sapiens
ggctagggatctagaccaggac

SEQ ID NO: 7630309 - DNA, 22 bp, Homo sapiens
ggctagggatctagaccaggac

SEQ ID NO: 7630310 - DNA, 22 bp, Homo sapiens
ggctagggatctagaccaggac

SEQ ID NO: 7630311 - DNA, 22 bp, Homo sapiens
ggctagggatctagaccaggac

SEQ ID NO: 7630312 - DNA, 22 bp, Homo sapiens
ggctagggatctagaccaggac

SEQ ID NO: 7630313 - DNA, 22 bp, Homo sapiens
ggctagggatctagaccaggac

SEQ ID NO: 7630314 - DNA, 22 bp, Homo sapiens
ggctagggatctagaccaggac

SEQ ID NO: 7630315 - DNA, 22 bp, Homo sapiens
ggctagggatctagaccaggac

SEQ ID NO: 7630316 - DNA, 22 bp, Homo sapiens
ggctagggatctagaccaggac

SEQ ID NO: 7630317 - DNA, 22 bp, Homo sapiens
ggctagggatctagaccaggac

SEQ ID NO: 7630318 - DNA, 22 bp, Homo sapiens
ggctagggatctagaccaggac

SEQ ID NO: 7630319 - DNA, 22 bp, Homo sapiens
ggctagggagacagagggcatg

SEQ ID NO: 7630320 - DNA, 22 bp, Homo sapiens
ggctagggagacagagggcatg

SEQ ID NO: 7630321 - DNA, 22 bp, Homo sapiens
ggctatgtctcataaatcgctg

SEQ ID NO: 7630322 - DNA, 22 bp, Homo sapiens
ggctatgtggtcatataagata

SEQ ID NO: 7630323 - DNA, 22 bp, Homo sapiens
ggctatgtggtcatataagata

SEQ ID NO: 7630324 - DNA, 22 bp, Homo sapiens
ggctatggcaaagaactcagat

SEQ ID NO: 7630325 - DNA, 22 bp, Homo sapiens
ggctatggaaatggcaggacat

SEQ ID NO: 7630326 - DNA, 18 bp, Homo sapiens
ggctcaagtgatcctcct

SEQ ID NO: 7630327 - DNA, 19 bp, Homo sapiens
ggctcaagcatccaggtag

SEQ ID NO: 7630328 - DNA, 22 bp, Homo sapiens
ggctcaatgcaacttctgcctc

SEQ ID NO: 7630329 - DNA, 22 bp, Homo sapiens
ggctcaatgcaacttctgcctc

SEQ ID NO: 7630330 - DNA, 22 bp, Homo sapiens
ggctcaatgcaacttctgcctc

SEQ ID NO: 7630331 - DNA, 22 bp, Homo sapiens
ggctcaatgcaacttctgcctc

SEQ ID NO: 7630332 - DNA, 22 bp, Homo sapiens
ggctcaagcagtctgcctgcct

SEQ ID NO: 7630333 - DNA, 22 bp, Homo sapiens
ggctcaagcagtctgcctgcct

SEQ ID NO: 7630334 - DNA, 19 bp, Homo sapiens
ggctcaagcatccaggtag

SEQ ID NO: 7630335 - DNA, 22 bp, Homo sapiens
ggctcaagcagtctgcctgcct

SEQ ID NO: 7630336 - DNA, 22 bp, Homo sapiens
ggctatttcatttagtactagg

SEQ ID NO: 7630337 - DNA, 22 bp, Homo sapiens
ggctatttcatttagtactagg

SEQ ID NO: 7630338 - DNA, 22 bp, Homo sapiens
cactgcccagagggcagcattg

SEQ ID NO: 7630339 - DNA, 22 bp, Homo sapiens
cactgcccagagggcagcattg

SEQ ID NO: 7630340 - DNA, 22 bp, Homo sapiens
cactgcccagagggcagcattg

SEQ ID NO: 7630341 - DNA, 22 bp, Homo sapiens
cactgcccagagggcagcattg

SEQ ID NO: 7630342 - DNA, 22 bp, Homo sapiens
cactgcccaccaagtggctggt

SEQ ID NO: 7630343 - DNA, 22 bp, Homo sapiens
cactgccatgttgatagatgtg

SEQ ID NO: 7630344 - DNA, 22 bp, Homo sapiens
cactgccatgttgatagatgtg

SEQ ID NO: 7630345 - DNA, 22 bp, Homo sapiens
ggctagggagacagagggcatg

SEQ ID NO: 7630346 - DNA, 22 bp, Homo sapiens
ggctagggagacagagggcatg

SEQ ID NO: 7630347 - DNA, 22 bp, Homo sapiens
ggctagggagacagagggcatg

SEQ ID NO: 7630348 - DNA, 22 bp, Homo sapiens
ggctagggagacagagggcatg

SEQ ID NO: 7630349 - DNA, 22 bp, Homo sapiens
ggctagggagacagagggcatg

SEQ ID NO: 7630350 - DNA, 22 bp, Homo sapiens
ggctagggagacagagggcatg

SEQ ID NO: 7630351 - DNA, 22 bp, Homo sapiens
ggctagggagacagagggcatg

SEQ ID NO: 7630352 - DNA, 22 bp, Homo sapiens
ggctagggagacagagggcatg

SEQ ID NO: 7630353 - DNA, 22 bp, Homo sapiens
ggctagggagacagagggcatg

SEQ ID NO: 7630354 - DNA, 20 bp, Homo sapiens
cactgccagaatacactgtc

SEQ ID NO: 7630355 - DNA, 20 bp, Homo sapiens
cactgccagaatacactgtc

SEQ ID NO: 7630356 - DNA, 20 bp, Homo sapiens
cactgccagaatacactgtc

SEQ ID NO: 7630357 - DNA, 20 bp, Homo sapiens
cactgcattgatggaaacag

SEQ ID NO: 7630358 - DNA, 22 bp, Homo sapiens
cactgccacctgcatgccctga

SEQ ID NO: 7630359 - DNA, 22 bp, Homo sapiens
cactgcatggatgatggctgta

SEQ ID NO: 7630360 - DNA, 22 bp, Homo sapiens
cactgcagttccccagtgcgca

SEQ ID NO: 7630361 - DNA, 22 bp, Homo sapiens
cactgcagttccccagtgcgca

SEQ ID NO: 7630362 - DNA, 22 bp, Homo sapiens
cactgcagttccccagtgcgca

SEQ ID NO: 7630363 - DNA, 22 bp, Homo sapiens
cactgcagttccccagtgcgca

SEQ ID NO: 7630364 - DNA, 22 bp, Homo sapiens
cactgcagttccccagtgcgca

SEQ ID NO: 7630365 - DNA, 22 bp, Homo sapiens
cactgcagttccccagtgcgca

SEQ ID NO: 7630366 - DNA, 22 bp, Homo sapiens
cactgcagtaactctaggactg

SEQ ID NO: 7630367 - DNA, 22 bp, Homo sapiens
cactgcagtcttcatcaaccaa

SEQ ID NO: 7630368 - DNA, 22 bp, Homo sapiens
cactgcagtcttcatcaaccaa

SEQ ID NO: 7630369 - DNA, 22 bp, Homo sapiens
cactgcagttccccagtgcgca

SEQ ID NO: 7630370 - DNA, 22 bp, Homo sapiens
cactgcagtaactctaggactg

SEQ ID NO: 7630371 - DNA, 22 bp, Homo sapiens
cactgcagtaactctaggactg

SEQ ID NO: 7630372 - DNA, 22 bp, Homo sapiens
cactgcagtaactctaggactg

SEQ ID NO: 7630373 - DNA, 22 bp, Homo sapiens
cactgcagtaactctaggactg

SEQ ID NO: 7630374 - DNA, 22 bp, Homo sapiens
cactgcagtaactctaggactg

SEQ ID NO: 7630375 - DNA, 22 bp, Homo sapiens
cactgcttttcagacagttatt

SEQ ID NO: 7630376 - DNA, 22 bp, Homo sapiens
cactgcttttcagacagttatt

SEQ ID NO: 7630377 - DNA, 22 bp, Homo sapiens
cactgctttgcccaagagggca

SEQ ID NO: 7630378 - DNA, 22 bp, Homo sapiens
cactgctttcacagtttgttcc

SEQ ID NO: 7630379 - DNA, 22 bp, Homo sapiens
cactgctttttctcctcactgg

SEQ ID NO: 7630380 - DNA, 22 bp, Homo sapiens
cactgctttttctcctcactgg

SEQ ID NO: 7630381 - DNA, 22 bp, Homo sapiens
cactgcctgctggctgtcactt

SEQ ID NO: 7630382 - DNA, 22 bp, Homo sapiens
cactgcctgctggctgtcactt

SEQ ID NO: 7630383 - DNA, 22 bp, Homo sapiens
cactgcctgctggctgtcactt

SEQ ID NO: 7630384 - DNA, 22 bp, Homo sapiens
cactgcctgctggctgtcactt

SEQ ID NO: 7630385 - DNA, 22 bp, Homo sapiens
ggctcaatgcaacttctgcctc

SEQ ID NO: 7630386 - DNA, 22 bp, Homo sapiens
ggctcaatgcaacttctgcctc

SEQ ID NO: 7630387 - DNA, 22 bp, Homo sapiens
cactgcctgctggctgtcactt

SEQ ID NO: 7630388 - DNA, 22 bp, Homo sapiens
cactgctttaaggctgagtaac

SEQ ID NO: 7630389 - DNA, 22 bp, Homo sapiens
cactgcctgtgagctgtgtgcc

SEQ ID NO: 7630390 - DNA, 22 bp, Homo sapiens
cactgcctggaaggagagacat

SEQ ID NO: 7630391 - DNA, 22 bp, Homo sapiens
cactggaagttcattctcagaa

SEQ ID NO: 7630392 - DNA, 22 bp, Homo sapiens
cactggaagttcattctcagaa

SEQ ID NO: 7630393 - DNA, 22 bp, Homo sapiens
cactggaatatggcgttgaacc

SEQ ID NO: 7630394 - DNA, 22 bp, Homo sapiens
cactggaatggatagagcagag

SEQ ID NO: 7630395 - DNA, 22 bp, Homo sapiens
cactggaatggatagagcagag

SEQ ID NO: 7630396 - DNA, 22 bp, Homo sapiens
cactggaatggatagagcagag

SEQ ID NO: 7630397 - DNA, 22 bp, Homo sapiens
cactggaatggatagagcagag

SEQ ID NO: 7630398 - DNA, 22 bp, Homo sapiens
cactggaatggattggccgtgg

SEQ ID NO: 7630399 - DNA, 22 bp, Homo sapiens
cactgcttttttggctatgtac

SEQ ID NO: 7630400 - DNA, 22 bp, Homo sapiens
cactgcttttttggctatgtac

SEQ ID NO: 7630401 - DNA, 22 bp, Homo sapiens
cactgcttttttggctatgtac

SEQ ID NO: 7630402 - DNA, 20 bp, Homo sapiens
cactggaaagcaggcgactc

SEQ ID NO: 7630403 - DNA, 22 bp, Homo sapiens
cactggaaccaagacccagggc

SEQ ID NO: 7630404 - DNA, 22 bp, Homo sapiens
cactggaaccaagacccagggc

SEQ ID NO: 7630405 - DNA, 22 bp, Homo sapiens
cactggaaccaagacccagggc

SEQ ID NO: 7630406 - DNA, 22 bp, Homo sapiens
cactggaaccatccacatagtg

SEQ ID NO: 7630407 - DNA, 22 bp, Homo sapiens
cactggaaccatccacatagtg

SEQ ID NO: 7630408 - DNA, 22 bp, Homo sapiens
cactggaagagcatctgagcca

SEQ ID NO: 7630409 - DNA, 22 bp, Homo sapiens
cactggaggtcagtggagcact

SEQ ID NO: 7630410 - DNA, 22 bp, Homo sapiens
cactggaggtcagtggagcact

SEQ ID NO: 7630411 - DNA, 22 bp, Homo sapiens
cactggaggtcagtggagcact

SEQ ID NO: 7630412 - DNA, 22 bp, Homo sapiens
cactggaggtcagtggagcact

SEQ ID NO: 7630413 - DNA, 22 bp, Homo sapiens
cactggaggtcagtggagcact

SEQ ID NO: 7630414 - DNA, 22 bp, Homo sapiens
cactggaggtcagtggagcact

SEQ ID NO: 7630415 - DNA, 22 bp, Homo sapiens
cactggaggtcagtggagcact

SEQ ID NO: 7630416 - DNA, 18 bp, Homo sapiens
cactggacctcatgagag

SEQ ID NO: 7630417 - DNA, 18 bp, Homo sapiens
cactggacctcatgagag

SEQ ID NO: 7630418 - DNA, 20 bp, Homo sapiens
cactggacctctctgagcct

SEQ ID NO: 7630419 - DNA, 18 bp, Homo sapiens
cactggacctcatgagag

SEQ ID NO: 7630420 - DNA, 22 bp, Homo sapiens
cactggaccaaggaaactcttc

SEQ ID NO: 7630421 - DNA, 22 bp, Homo sapiens
cactggacctgctttgatcctg

SEQ ID NO: 7630422 - DNA, 22 bp, Homo sapiens
cactggacttaaggcagagttt

SEQ ID NO: 7630423 - DNA, 22 bp, Homo sapiens
cactggacttggagtcagaagg

SEQ ID NO: 7630424 - DNA, 22 bp, Homo sapiens
cactggacttggagtcagaagg

SEQ ID NO: 7630425 - DNA, 22 bp, Homo sapiens
cactggaatgttgaggagacaa

SEQ ID NO: 7630426 - DNA, 22 bp, Homo sapiens
cactggaatgttgaggagacaa

SEQ ID NO: 7630427 - DNA, 22 bp, Homo sapiens
cactggaatgttgaggagacaa

SEQ ID NO: 7630428 - DNA, 22 bp, Homo sapiens
cactggacagagtggggttccc

SEQ ID NO: 7630429 - DNA, 21 bp, Homo sapiens
cactggaattttctgtgacat

SEQ ID NO: 7630430 - DNA, 22 bp, Homo sapiens
cactggaccaaggaaactcttc

SEQ ID NO: 7630431 - DNA, 22 bp, Homo sapiens
cactggcaaatggagagaatgt

SEQ ID NO: 7630432 - DNA, 22 bp, Homo sapiens
cactggcaaagcctgttcctta

SEQ ID NO: 7630433 - DNA, 17 bp, Homo sapiens
cactggattcgcagagc

SEQ ID NO: 7630434 - DNA, 22 bp, Homo sapiens
cactggaggtcagtggagcact

SEQ ID NO: 7630435 - DNA, 22 bp, Homo sapiens
cactggataaaaatttggaagt

SEQ ID NO: 7630436 - DNA, 22 bp, Homo sapiens
cactggcatgtgaggcggtggc

SEQ ID NO: 7630437 - DNA, 22 bp, Homo sapiens
cactggcattagtcacgaggca

SEQ ID NO: 7630438 - DNA, 22 bp, Homo sapiens
cactggcattagtcacgaggca

SEQ ID NO: 7630439 - DNA, 22 bp, Homo sapiens
cactggcattagtcacgaggca

SEQ ID NO: 7630440 - DNA, 22 bp, Homo sapiens
cactggcattagtcacgaggca

SEQ ID NO: 7630441 - DNA, 22 bp, Homo sapiens
gtaaaatagaataacgtggcta

SEQ ID NO: 7630442 - DNA, 19 bp, Homo sapiens
ggttggagaagagcggccc

SEQ ID NO: 7630443 - DNA, 19 bp, Homo sapiens
ggttggagaagagcggccc

SEQ ID NO: 7630444 - DNA, 19 bp, Homo sapiens
ggttggagaagagcggccc

SEQ ID NO: 7630445 - DNA, 19 bp, Homo sapiens
ggttggagaagagcggccc

SEQ ID NO: 7630446 - DNA, 20 bp, Homo sapiens
gtaaaatatggtctttgggt

SEQ ID NO: 7630447 - DNA, 20 bp, Homo sapiens
gtaaaatatggtctttgggt

SEQ ID NO: 7630448 - DNA, 20 bp, Homo sapiens
gtaaaatatggtctttgggt

SEQ ID NO: 7630449 - DNA, 20 bp, Homo sapiens
gtaaaatatggtctttgggt

SEQ ID NO: 7630450 - DNA, 20 bp, Homo sapiens
gtaaaatatggtctttgggt

SEQ ID NO: 7630451 - DNA, 20 bp, Homo sapiens
gtaaaatatggtctttgggt

SEQ ID NO: 7630452 - DNA, 22 bp, Homo sapiens
gtaaaatagaataacgtggcta

SEQ ID NO: 7630453 - DNA, 22 bp, Homo sapiens
gtaaaatagaataacgtggcta

SEQ ID NO: 7630454 - DNA, 20 bp, Homo sapiens
gtaaaatatggtctttgggt

SEQ ID NO: 7630455 - DNA, 22 bp, Homo sapiens
gtaaaatcatttagttacttaa

SEQ ID NO: 7630456 - DNA, 20 bp, Homo sapiens
gtaaaatatggtctttgggt

SEQ ID NO: 7630457 - DNA, 20 bp, Homo sapiens
gtaaaatatggtctttgggt

SEQ ID NO: 7630458 - DNA, 20 bp, Homo sapiens
gtaaaatatggtctttgggt

SEQ ID NO: 7630459 - DNA, 20 bp, Homo sapiens
gtaaaatatggtctttgggt

SEQ ID NO: 7630460 - DNA, 22 bp, Homo sapiens
ggttgctctttggaccctgctg

SEQ ID NO: 7630461 - DNA, 22 bp, Homo sapiens
ggttgcaaactcctgggatcaa

SEQ ID NO: 7630462 - DNA, 22 bp, Homo sapiens
ggttgcaaactcctgggatcaa

SEQ ID NO: 7630463 - DNA, 22 bp, Homo sapiens
ggttggacactaggtaggagcg

SEQ ID NO: 7630464 - DNA, 22 bp, Homo sapiens
ggttggacactaggtaggagcg

SEQ ID NO: 7630465 - DNA, 22 bp, Homo sapiens
ggttggacactaggtaggagcg

SEQ ID NO: 7630466 - DNA, 22 bp, Homo sapiens
ggttggacactaggtaggagcg

SEQ ID NO: 7630467 - DNA, 18 bp, Homo sapiens
ggttgataacttgtgatt

SEQ ID NO: 7630468 - DNA, 22 bp, Homo sapiens
ggttgcaaactcctgggatcaa

SEQ ID NO: 7630469 - DNA, 22 bp, Homo sapiens
ggttgaatatctttatgttggt

SEQ ID NO: 7630470 - DNA, 22 bp, Homo sapiens
ggttctttgtatatatcacttt

SEQ ID NO: 7630471 - DNA, 22 bp, Homo sapiens
ggttctttgtatatatcacttt

SEQ ID NO: 7630472 - DNA, 22 bp, Homo sapiens
ggttctttggcagtctgattga

SEQ ID NO: 7630473 - DNA, 22 bp, Homo sapiens
ggttctgctactctcttgctta

SEQ ID NO: 7630474 - DNA, 22 bp, Homo sapiens
cagcagagctgtgtgggaaggg

SEQ ID NO: 7630475 - DNA, 22 bp, Homo sapiens
cagcagagctgtgtgggaaggg

SEQ ID NO: 7630476 - DNA, 22 bp, Homo sapiens
gtaaacaggaatgtggtcatgg

SEQ ID NO: 7630477 - DNA, 22 bp, Homo sapiens
gtaaacaggaatgtggtcatgg

SEQ ID NO: 7630478 - DNA, 22 bp, Homo sapiens
gtaaacactacaaatcaaggct

SEQ ID NO: 7630479 - DNA, 22 bp, Homo sapiens
gtaaacaggaatgtggtcatgg

SEQ ID NO: 7630480 - DNA, 22 bp, Homo sapiens
gtaaacaagtctaccattagaa

SEQ ID NO: 7630481 - DNA, 22 bp, Homo sapiens
gtaaacaatagcattgcctgat

SEQ ID NO: 7630482 - DNA, 22 bp, Homo sapiens
gtaaacacctgttaaattcaga

SEQ ID NO: 7630483 - DNA, 22 bp, Homo sapiens
gtaaacactacaaatcaaggct

SEQ ID NO: 7630484 - DNA, 22 bp, Homo sapiens
gtaaacacctgttaaattcaga

SEQ ID NO: 7630485 - DNA, 22 bp, Homo sapiens
gtaaacaacacaaatcatttga

SEQ ID NO: 7630486 - DNA, 22 bp, Homo sapiens
gtaaacaacacaaatcatttga

SEQ ID NO: 7630487 - DNA, 22 bp, Homo sapiens
gtaaacaacacaaatcatttga

SEQ ID NO: 7630488 - DNA, 22 bp, Homo sapiens
gtaaacaagtctaccattagaa

SEQ ID NO: 7630489 - DNA, 22 bp, Homo sapiens
gtaaacaacacaaatcatttga

SEQ ID NO: 7630490 - DNA, 22 bp, Homo sapiens
gtaaacaacacaaatcatttga

SEQ ID NO: 7630491 - DNA, 22 bp, Homo sapiens
gtaaacaacacaaatcatttga

SEQ ID NO: 7630492 - DNA, 22 bp, Homo sapiens
gtaaaattgcaattacttttgc

SEQ ID NO: 7630493 - DNA, 22 bp, Homo sapiens
gtaaacaaactctcaggccagt

SEQ ID NO: 7630494 - DNA, 22 bp, Homo sapiens
gtaaaattgcaattacttttgc

SEQ ID NO: 7630495 - DNA, 22 bp, Homo sapiens
gtaaaattgcaattacttttgc

SEQ ID NO: 7630496 - DNA, 22 bp, Homo sapiens
gtaaaattgcaattacttttgc

SEQ ID NO: 7630497 - DNA, 22 bp, Homo sapiens
gtaaaattgcaattacttttgc

SEQ ID NO: 7630498 - DNA, 22 bp, Homo sapiens
gtaaaattgcaattacttttgc

SEQ ID NO: 7630499 - DNA, 22 bp, Homo sapiens
gtaaaattgcaattacttttgc

SEQ ID NO: 7630500 - DNA, 22 bp, Homo sapiens
gtaaaattgcaattacttttgc

SEQ ID NO: 7630501 - DNA, 22 bp, Homo sapiens
gtaaaattgcaattacttttgc

SEQ ID NO: 7630502 - DNA, 22 bp, Homo sapiens
gtaaaattgcaattacttttgc

SEQ ID NO: 7630503 - DNA, 22 bp, Homo sapiens
gtaaaattctagcatctgaaag

SEQ ID NO: 7630504 - DNA, 22 bp, Homo sapiens
gtaaaattctagcatctgaaag

SEQ ID NO: 7630505 - DNA, 22 bp, Homo sapiens
gtaaaattctagcatctgaaag

SEQ ID NO: 7630506 - DNA, 22 bp, Homo sapiens
gtaaaattctagcatctgaaag

SEQ ID NO: 7630507 - DNA, 22 bp, Homo sapiens
gtaaaattctagcatctgaaag

SEQ ID NO: 7630508 - DNA, 22 bp, Homo sapiens
gtaaaattctagcatctgaaag

SEQ ID NO: 7630509 - DNA, 22 bp, Homo sapiens
gtaaaatctttcctatttgcct

SEQ ID NO: 7630510 - DNA, 22 bp, Homo sapiens
gtaaaatctttattgctggtga

SEQ ID NO: 7630511 - DNA, 22 bp, Homo sapiens
gtaaaatctttattgctggtga

SEQ ID NO: 7630512 - DNA, 22 bp, Homo sapiens
ggttccagaccacgggtgttct

SEQ ID NO: 7630513 - DNA, 22 bp, Homo sapiens
ggttccagagtgggctgggaaa

SEQ ID NO: 7630514 - DNA, 22 bp, Homo sapiens
ggttccagagtgggctgggaaa

SEQ ID NO: 7630515 - DNA, 22 bp, Homo sapiens
ggttccagagtgggctgggaaa

SEQ ID NO: 7630516 - DNA, 23 bp, Homo sapiens
ggttccaggaacacagcctgatg

SEQ ID NO: 7630517 - DNA, 22 bp, Homo sapiens
ggttccaggcatggcaggatgt

SEQ ID NO: 7630518 - DNA, 22 bp, Homo sapiens
ggttccccaggcggcccttgga

SEQ ID NO: 7630519 - DNA, 22 bp, Homo sapiens
ggttccaggcatggcaggatgt

SEQ ID NO: 7630520 - DNA, 19 bp, Homo sapiens
ggttcctcacgctaagggc

SEQ ID NO: 7630521 - DNA, 23 bp, Homo sapiens
ggttcctgagcagggatctggaa

SEQ ID NO: 7630522 - DNA, 22 bp, Homo sapiens
ggttcctgatcgttgtctctct

SEQ ID NO: 7630523 - DNA, 22 bp, Homo sapiens
ggttccccaggcggcccttgga

SEQ ID NO: 7630524 - DNA, 22 bp, Homo sapiens
ggttcccggatctccgagtccc

SEQ ID NO: 7630525 - DNA, 22 bp, Homo sapiens
ggttcccggatctccgagtccc

SEQ ID NO: 7630526 - DNA, 19 bp, Homo sapiens
ggttcctcacgctaagggc

SEQ ID NO: 7630527 - DNA, 19 bp, Homo sapiens
ggttcctcacgctaagggc

SEQ ID NO: 7630528 - DNA, 22 bp, Homo sapiens
ggttccttcctgccttagccac

SEQ ID NO: 7630529 - DNA, 22 bp, Homo sapiens
ggttccttctgaggtccctgta

SEQ ID NO: 7630530 - DNA, 22 bp, Homo sapiens
ggttcctgtgcctctagctggc

SEQ ID NO: 7630531 - DNA, 22 bp, Homo sapiens
ggttcctgtgtactgtggctta

SEQ ID NO: 7630532 - DNA, 22 bp, Homo sapiens
ggttcctgtgcctctagctggc

SEQ ID NO: 7630533 - DNA, 22 bp, Homo sapiens
ggttcctgtgcctctagctggc

SEQ ID NO: 7630534 - DNA, 22 bp, Homo sapiens
ggttcctgtgcctctagctggc

SEQ ID NO: 7630535 - DNA, 22 bp, Homo sapiens
ggttcctgtacttagctatgta

SEQ ID NO: 7630536 - DNA, 22 bp, Homo sapiens
ggttcctgtacttagctatgta

SEQ ID NO: 7630537 - DNA, 22 bp, Homo sapiens
ggttcctggcagatgtagggct

SEQ ID NO: 7630538 - DNA, 23 bp, Homo sapiens
ggttctgccgcttactgctgtgc

SEQ ID NO: 7630539 - DNA, 23 bp, Homo sapiens
ggttctgccgcttactgctgtgc

SEQ ID NO: 7630540 - DNA, 22 bp, Homo sapiens
ggttctgacaagctgggatggt

SEQ ID NO: 7630541 - DNA, 22 bp, Homo sapiens
ggttctgagaaactctcaccat

SEQ ID NO: 7630542 - DNA, 22 bp, Homo sapiens
ggttctgagaaactctcaccat

SEQ ID NO: 7630543 - DNA, 22 bp, Homo sapiens
ggttctaggattaggaggccca

SEQ ID NO: 7630544 - DNA, 22 bp, Homo sapiens
ggttctaggtctggggataatg

SEQ ID NO: 7630545 - DNA, 22 bp, Homo sapiens
ggtgtgccacttcactgagcag

SEQ ID NO: 7630546 - DNA, 22 bp, Homo sapiens
cagcacaattttcaggagtcca

SEQ ID NO: 7630547 - DNA, 22 bp, Homo sapiens
ggtgtgcttgggcttcgcaggg

SEQ ID NO: 7630548 - DNA, 22 bp, Homo sapiens
ggtgtgctaagagcactttcaa

SEQ ID NO: 7630549 - DNA, 22 bp, Homo sapiens
ggtgtgctaagagcactttcaa

SEQ ID NO: 7630550 - DNA, 22 bp, Homo sapiens
ggtgtgccacttcactgagcag

SEQ ID NO: 7630551 - DNA, 22 bp, Homo sapiens
ggttccagaagggggcgaggtg

SEQ ID NO: 7630552 - DNA, 22 bp, Homo sapiens
ggtgtggatcatctgaggtcag

SEQ ID NO: 7630553 - DNA, 22 bp, Homo sapiens
ggttccacctggcgaggggtat

SEQ ID NO: 7630554 - DNA, 22 bp, Homo sapiens
cagcaatccaagctttctttaa

SEQ ID NO: 7630555 - DNA, 22 bp, Homo sapiens
cagcaatccaagctttctttaa

SEQ ID NO: 7630556 - DNA, 22 bp, Homo sapiens
cagcaatagtgtgtttgtttca

SEQ ID NO: 7630557 - DNA, 22 bp, Homo sapiens
cagcaatatacacagtctatgg

SEQ ID NO: 7630558 - DNA, 22 bp, Homo sapiens
cagcaatatacacagtctatgg

SEQ ID NO: 7630559 - DNA, 22 bp, Homo sapiens
cagcaatggcaggcggagagtg

SEQ ID NO: 7630560 - DNA, 22 bp, Homo sapiens
cagcaatctttcttggtcttct

SEQ ID NO: 7630561 - DNA, 22 bp, Homo sapiens
cagcaatggcaggcggagagtg

SEQ ID NO: 7630562 - DNA, 22 bp, Homo sapiens
cagcaatccaagctttctttaa

SEQ ID NO: 7630563 - DNA, 22 bp, Homo sapiens
cagcaatcgggtgatatgcaat

SEQ ID NO: 7630564 - DNA, 22 bp, Homo sapiens
cagcaatcgggtgatatgcaat

SEQ ID NO: 7630565 - DNA, 22 bp, Homo sapiens
cagcaatcgggtgatatgcaat

SEQ ID NO: 7630566 - DNA, 22 bp, Homo sapiens
cagcaatcgggtgatatgcaat

SEQ ID NO: 7630567 - DNA, 22 bp, Homo sapiens
cagcaatctttcttggtcttct

SEQ ID NO: 7630568 - DNA, 19 bp, Homo sapiens
cagcaataatgccagatgg

SEQ ID NO: 7630569 - DNA, 22 bp, Homo sapiens
cagcaataaggtaagcttctcc

SEQ ID NO: 7630570 - DNA, 22 bp, Homo sapiens
cagcaataaggtaagcttctcc

SEQ ID NO: 7630571 - DNA, 22 bp, Homo sapiens
cagcaataaggtaagcttctcc

SEQ ID NO: 7630572 - DNA, 22 bp, Homo sapiens
cagcaataatgtctacaaatct

SEQ ID NO: 7630573 - DNA, 22 bp, Homo sapiens
cagcaataatgtctacaaatct

SEQ ID NO: 7630574 - DNA, 22 bp, Homo sapiens
cagcaataatgtctacaaatct

SEQ ID NO: 7630575 - DNA, 22 bp, Homo sapiens
cagcaataatgtctacaaatct

SEQ ID NO: 7630576 - DNA, 22 bp, Homo sapiens
cagcaataagccaggttagaca

SEQ ID NO: 7630577 - DNA, 22 bp, Homo sapiens
cagcaataactcaaagccattt

SEQ ID NO: 7630578 - DNA, 22 bp, Homo sapiens
cagcaataactcaaagccattt

SEQ ID NO: 7630579 - DNA, 22 bp, Homo sapiens
cagcaagtgatggaaatcagag

SEQ ID NO: 7630580 - DNA, 22 bp, Homo sapiens
cagcaataactcaaagccattt

SEQ ID NO: 7630581 - DNA, 22 bp, Homo sapiens
cagcaataactcaaagccattt

SEQ ID NO: 7630582 - DNA, 22 bp, Homo sapiens
cagcaataactcaaagccattt

SEQ ID NO: 7630583 - DNA, 22 bp, Homo sapiens
cagcaataactcaaagccattt

SEQ ID NO: 7630584 - DNA, 22 bp, Homo sapiens
cagcaagtgatggaaatcagag

SEQ ID NO: 7630585 - DNA, 23 bp, Homo sapiens
cagcaagtgaattccaagagaga

SEQ ID NO: 7630586 - DNA, 23 bp, Homo sapiens
cagcaagtgaattccaagagaga

SEQ ID NO: 7630587 - DNA, 22 bp, Homo sapiens
cagcaagtcagtgagtagaaga

SEQ ID NO: 7630588 - DNA, 22 bp, Homo sapiens
cagcaagtcagtgagtagaaga

SEQ ID NO: 7630589 - DNA, 22 bp, Homo sapiens
cagcaagtcatccaggatgatg

SEQ ID NO: 7630590 - DNA, 22 bp, Homo sapiens
cagcaaggtctgtcaatagtgg

SEQ ID NO: 7630591 - DNA, 22 bp, Homo sapiens
cagcaagggttatatcaaagat

SEQ ID NO: 7630592 - DNA, 22 bp, Homo sapiens
cagcaaggtctgtcaatagtgg

SEQ ID NO: 7630593 - DNA, 22 bp, Homo sapiens
cagcaaggtctgtcaatagtgg

SEQ ID NO: 7630594 - DNA, 22 bp, Homo sapiens
cagcaagggataaacaaggacg

SEQ ID NO: 7630595 - DNA, 22 bp, Homo sapiens
cagcaagggataaacaaggacg

SEQ ID NO: 7630596 - DNA, 22 bp, Homo sapiens
cagcaagggataaacaaggacg

SEQ ID NO: 7630597 - DNA, 22 bp, Homo sapiens
cagcaaggccattggatgcagt

SEQ ID NO: 7630598 - DNA, 22 bp, Homo sapiens
cagcaaggccattggatgcagt

SEQ ID NO: 7630599 - DNA, 22 bp, Homo sapiens
cagcaaggccattggatgcagt

SEQ ID NO: 7630600 - DNA, 22 bp, Homo sapiens
cagcaaggccattggatgcagt

SEQ ID NO: 7630601 - DNA, 22 bp, Homo sapiens
cagcaaggccattggatgcagt

SEQ ID NO: 7630602 - DNA, 22 bp, Homo sapiens
cagcaaggccattggatgcagt

SEQ ID NO: 7630603 - DNA, 22 bp, Homo sapiens
cagcaaggccattggatgcagt

SEQ ID NO: 7630604 - DNA, 22 bp, Homo sapiens
cagcaagggataaagagttact

SEQ ID NO: 7630605 - DNA, 22 bp, Homo sapiens
cagcaagggataaacaaggacg

SEQ ID NO: 7630606 - DNA, 22 bp, Homo sapiens
cagcaagggttatatcaaagat

SEQ ID NO: 7630607 - DNA, 22 bp, Homo sapiens
cagcaagggttatatcaaagat

SEQ ID NO: 7630608 - DNA, 22 bp, Homo sapiens
cagcaagggttatatcaaagat

SEQ ID NO: 7630609 - DNA, 22 bp, Homo sapiens
cagcaagggttatatcaaagat

SEQ ID NO: 7630610 - DNA, 22 bp, Homo sapiens
cagcaaggtctgtcaatagtgg

SEQ ID NO: 7630611 - DNA, 22 bp, Homo sapiens
cagcaagggttatatcaaagat

SEQ ID NO: 7630612 - DNA, 22 bp, Homo sapiens
cagcaaggcattctgtggatta

SEQ ID NO: 7630613 - DNA, 19 bp, Homo sapiens
ggtgggtgacctccccacc

SEQ ID NO: 7630614 - DNA, 22 bp, Homo sapiens
cagcaaggactgggcatgtgaa

SEQ ID NO: 7630615 - DNA, 22 bp, Homo sapiens
ggtgggtgaaatctaggtgtgt

SEQ ID NO: 7630616 - DNA, 22 bp, Homo sapiens
ggtgggtgaaatctaggtgtgt

SEQ ID NO: 7630617 - DNA, 22 bp, Homo sapiens
ggtgggtgaaatctaggtgtgt

SEQ ID NO: 7630618 - DNA, 22 bp, Homo sapiens
ggtgggtgaaatctaggtgtgt

SEQ ID NO: 7630619 - DNA, 22 bp, Homo sapiens
cagcaaggccattggatgcagt

SEQ ID NO: 7630620 - DNA, 22 bp, Homo sapiens
cagcaaggccattggatgcagt

SEQ ID NO: 7630621 - DNA, 22 bp, Homo sapiens
cagcaaggccattggatgcagt

SEQ ID NO: 7630622 - DNA, 22 bp, Homo sapiens
cagcaaggcattctgtggatta

SEQ ID NO: 7630623 - DNA, 22 bp, Homo sapiens
cagcaaggcattctgtggatta

SEQ ID NO: 7630624 - DNA, 22 bp, Homo sapiens
ggtgggtgaaatctaggtgtgt

SEQ ID NO: 7630625 - DNA, 22 bp, Homo sapiens
ggtgggtgaaatctaggtgtgt

SEQ ID NO: 7630626 - DNA, 22 bp, Homo sapiens
ggtgggtcttgtggggcagctt

SEQ ID NO: 7630627 - DNA, 22 bp, Homo sapiens
ggtgggtcttgcggggcagctt

SEQ ID NO: 7630628 - DNA, 22 bp, Homo sapiens
ggtgggtaaaactgctggcact

SEQ ID NO: 7630629 - DNA, 22 bp, Homo sapiens
ggtgggtattgaatacaggtgt

SEQ ID NO: 7630630 - DNA, 22 bp, Homo sapiens
ggtgggtatagttagggcctct

SEQ ID NO: 7630631 - DNA, 22 bp, Homo sapiens
ggtggggtcacgacagagggaa

SEQ ID NO: 7630632 - DNA, 22 bp, Homo sapiens
ggtggggtcacgacagagggaa

SEQ ID NO: 7630633 - DNA, 22 bp, Homo sapiens
ggtggggtcacgacagagggaa

SEQ ID NO: 7630634 - DNA, 22 bp, Homo sapiens
ggtggggtcacgacagagggaa

SEQ ID NO: 7630635 - DNA, 22 bp, Homo sapiens
ggtggggtatttggtacttgta

SEQ ID NO: 7630636 - DNA, 22 bp, Homo sapiens
ggtggggtatttggtacttgta

SEQ ID NO: 7630637 - DNA, 22 bp, Homo sapiens
ggtggggtcacgacagagggaa

SEQ ID NO: 7630638 - DNA, 22 bp, Homo sapiens
ggtggggtcacgacagagggaa

SEQ ID NO: 7630639 - DNA, 22 bp, Homo sapiens
ggtggggtcacgacagagggaa

SEQ ID NO: 7630640 - DNA, 22 bp, Homo sapiens
ggtgggtaaaactgctggcact

SEQ ID NO: 7630641 - DNA, 22 bp, Homo sapiens
ggtgggtaaaactgctggcact

SEQ ID NO: 7630642 - DNA, 22 bp, Homo sapiens
ggtgggtatagttagggcctct

SEQ ID NO: 7630643 - DNA, 22 bp, Homo sapiens
ggtgggtatagttagggcctct

SEQ ID NO: 7630644 - DNA, 22 bp, Homo sapiens
ggtggggttttaggctgctgca

SEQ ID NO: 7630645 - DNA, 22 bp, Homo sapiens
ggtggggttttaggctgctgca

SEQ ID NO: 7630646 - DNA, 22 bp, Homo sapiens
ggtggggttttaggctgctgca

SEQ ID NO: 7630647 - DNA, 22 bp, Homo sapiens
ggtggggttttaggctgctgca

SEQ ID NO: 7630648 - DNA, 22 bp, Homo sapiens
ggtggggttttaggctgctgca

SEQ ID NO: 7630649 - DNA, 22 bp, Homo sapiens
ggtggggctaggacctcaggat

SEQ ID NO: 7630650 - DNA, 22 bp, Homo sapiens
ggtggggctcagcaatctgtgt

SEQ ID NO: 7630651 - DNA, 22 bp, Homo sapiens
ggtggggctgcaagcagttcgg

SEQ ID NO: 7630652 - DNA, 22 bp, Homo sapiens
ggtggggctgcaagcagttcgg

SEQ ID NO: 7630653 - DNA, 22 bp, Homo sapiens
ggtggggctcagcaatctgtgt

SEQ ID NO: 7630654 - DNA, 22 bp, Homo sapiens
ggtggggctgcaagcagttcgg

SEQ ID NO: 7630655 - DNA, 22 bp, Homo sapiens
ggtggggctgcaagcagttcgg

SEQ ID NO: 7630656 - DNA, 22 bp, Homo sapiens
ggtgggggagacttggtcaaga

SEQ ID NO: 7630657 - DNA, 22 bp, Homo sapiens
ggtgggggagacttggtcaaga

SEQ ID NO: 7630658 - DNA, 22 bp, Homo sapiens
ggtgggggagacttggtcaaga

SEQ ID NO: 7630659 - DNA, 22 bp, Homo sapiens
ggtgggggagacttggtcaaga

SEQ ID NO: 7630660 - DNA, 21 bp, Homo sapiens
ggtggggtacctaaggtagct

SEQ ID NO: 7630661 - DNA, 22 bp, Homo sapiens
ggtgggggagacttggtcaaga

SEQ ID NO: 7630662 - DNA, 22 bp, Homo sapiens
ggtgggggagacttggtcaaga

SEQ ID NO: 7630663 - DNA, 22 bp, Homo sapiens
ggtggggctgcaagcagttcgg

SEQ ID NO: 7630664 - DNA, 22 bp, Homo sapiens
ggtgggggagacttggtcaaga

SEQ ID NO: 7630665 - DNA, 22 bp, Homo sapiens
gggtgggactctttggcctgag

SEQ ID NO: 7630666 - DNA, 22 bp, Homo sapiens
gggtgggaaggctaagggattg

SEQ ID NO: 7630667 - DNA, 22 bp, Homo sapiens
gggtgggactctttggcctgag

SEQ ID NO: 7630668 - DNA, 22 bp, Homo sapiens
gggtgggactctttggcctgag

SEQ ID NO: 7630669 - DNA, 22 bp, Homo sapiens
gggtgggactctttggcctgag

SEQ ID NO: 7630670 - DNA, 22 bp, Homo sapiens
gggtgggaaggctaagggattg

SEQ ID NO: 7630671 - DNA, 22 bp, Homo sapiens
gggtgggaaggctaagggattg

SEQ ID NO: 7630672 - DNA, 22 bp, Homo sapiens
gggtgggactctttggcctgag

SEQ ID NO: 7630673 - DNA, 22 bp, Homo sapiens
gggtgggactctttggcctgag

SEQ ID NO: 7630674 - DNA, 22 bp, Homo sapiens
gggtgggactctttggcctgag

SEQ ID NO: 7630675 - DNA, 22 bp, Homo sapiens
gggtgggactctttggcctgag

SEQ ID NO: 7630676 - DNA, 22 bp, Homo sapiens
gggtgggactgaagtctgaggg

SEQ ID NO: 7630677 - DNA, 22 bp, Homo sapiens
gggtgggactgaagtctgaggg

SEQ ID NO: 7630678 - DNA, 22 bp, Homo sapiens
gggtgggactgaagtctgaggg

SEQ ID NO: 7630679 - DNA, 22 bp, Homo sapiens
gggtgggactgaagtctgaggg

SEQ ID NO: 7630680 - DNA, 22 bp, Homo sapiens
gggtgggagaaatgagtatcta

SEQ ID NO: 7630681 - DNA, 22 bp, Homo sapiens
gggtgggagaaatgagtatcta

SEQ ID NO: 7630682 - DNA, 22 bp, Homo sapiens
gggtgggagaaatgagtatcta

SEQ ID NO: 7630683 - DNA, 22 bp, Homo sapiens
gggtgggactgaagtctgaggg

SEQ ID NO: 7630684 - DNA, 22 bp, Homo sapiens
cagagtcagagcacctgggatt

SEQ ID NO: 7630685 - DNA, 22 bp, Homo sapiens
cagagtcaatgtccaagaagct

SEQ ID NO: 7630686 - DNA, 22 bp, Homo sapiens
cagagtcagagcacctgggatt

SEQ ID NO: 7630687 - DNA, 22 bp, Homo sapiens
cagagtcagagctccatggagt

SEQ ID NO: 7630688 - DNA, 22 bp, Homo sapiens
cagagtcagagctccatggagt

SEQ ID NO: 7630689 - DNA, 22 bp, Homo sapiens
cagagtcagctagtcttgggat

SEQ ID NO: 7630690 - DNA, 22 bp, Homo sapiens
cagagtcagctagtcttgggat

SEQ ID NO: 7630691 - DNA, 22 bp, Homo sapiens
cagagtcagctagtcttgggat

SEQ ID NO: 7630692 - DNA, 22 bp, Homo sapiens
cagagtcagagctccatggagt

SEQ ID NO: 7630693 - DNA, 22 bp, Homo sapiens
cagagtactgggagaacagaag

SEQ ID NO: 7630694 - DNA, 22 bp, Homo sapiens
cagagtatccctttagaattaa

SEQ ID NO: 7630695 - DNA, 22 bp, Homo sapiens
cagagtcaatgtccaagaagct

SEQ ID NO: 7630696 - DNA, 22 bp, Homo sapiens
cagagtcaatgtccaagaagct

SEQ ID NO: 7630697 - DNA, 20 bp, Homo sapiens
cagagtaattattacccttt

SEQ ID NO: 7630698 - DNA, 22 bp, Homo sapiens
gggtgggagtctggccctcaaa

SEQ ID NO: 7630699 - DNA, 21 bp, Homo sapiens
gggtgggaggacacagcaggc

SEQ ID NO: 7630700 - DNA, 22 bp, Homo sapiens
gggtgggagtctggccctcaaa

SEQ ID NO: 7630701 - DNA, 22 bp, Homo sapiens
gggtgggagtctggccctcaaa

SEQ ID NO: 7630702 - DNA, 22 bp, Homo sapiens
gggtgggagtctggccctcaaa

SEQ ID NO: 7630703 - DNA, 22 bp, Homo sapiens
gggtgggatctgtggagcctca

SEQ ID NO: 7630704 - DNA, 22 bp, Homo sapiens
gggtgggatctgtggagcctca

SEQ ID NO: 7630705 - DNA, 22 bp, Homo sapiens
gggtgggatctgtggagcctca

SEQ ID NO: 7630706 - DNA, 22 bp, Homo sapiens
ggtgggacaggtaggagtggct

SEQ ID NO: 7630707 - DNA, 22 bp, Homo sapiens
gggtgggatctgtggagcctca

SEQ ID NO: 7630708 - DNA, 22 bp, Homo sapiens
ggtggggctaggacctcaggat

SEQ ID NO: 7630709 - DNA, 22 bp, Homo sapiens
ggtggggctaggacctcaggat

SEQ ID NO: 7630710 - DNA, 22 bp, Homo sapiens
ggtggggctaggacctcaggat

SEQ ID NO: 7630711 - DNA, 22 bp, Homo sapiens
ggtgggagagctctgtctccag

SEQ ID NO: 7630712 - DNA, 22 bp, Homo sapiens
ggtggggctaggacctcaggat

SEQ ID NO: 7630713 - DNA, 22 bp, Homo sapiens
ggtgggagagctctgtctccag

SEQ ID NO: 7630714 - DNA, 22 bp, Homo sapiens
gggtgggatctgtggagcctca

SEQ ID NO: 7630715 - DNA, 22 bp, Homo sapiens
ggtgggagagctctgtctccag

SEQ ID NO: 7630716 - DNA, 22 bp, Homo sapiens
ggtgggagagctctgtctccag

SEQ ID NO: 7630717 - DNA, 22 bp, Homo sapiens
ggtgggagagctctgtctccag

SEQ ID NO: 7630718 - DNA, 21 bp, Homo sapiens
gggtgggaggacacagcaggc

SEQ ID NO: 7630719 - DNA, 21 bp, Homo sapiens
gggtgggaggacacagcaggc

SEQ ID NO: 7630720 - DNA, 21 bp, Homo sapiens
gggtgggaggacacagcaggc

SEQ ID NO: 7630721 - DNA, 21 bp, Homo sapiens
gggtgggaggacacagcaggc

SEQ ID NO: 7630722 - DNA, 21 bp, Homo sapiens
gggtgggaggacacagcaggc

SEQ ID NO: 7630723 - DNA, 21 bp, Homo sapiens
gggtgggaggacacagcaggc

SEQ ID NO: 7630724 - DNA, 21 bp, Homo sapiens
gggtgggaggacacagcaggc

SEQ ID NO: 7630725 - DNA, 21 bp, Homo sapiens
gggtgggaggacacagcaggc

SEQ ID NO: 7630726 - DNA, 20 bp, Homo sapiens
gggtgggagagtctgagggt

SEQ ID NO: 7630727 - DNA, 22 bp, Homo sapiens
gggtgggagaaatgagtatcta

SEQ ID NO: 7630728 - DNA, 20 bp, Homo sapiens
gggtgggagagtctgagggt

SEQ ID NO: 7630729 - DNA, 20 bp, Homo sapiens
gggtgggagagtctgagggt

SEQ ID NO: 7630730 - DNA, 20 bp, Homo sapiens
gggtgggagagtctgagggt

SEQ ID NO: 7630731 - DNA, 20 bp, Homo sapiens
gggtgggagagtctgagggt

SEQ ID NO: 7630732 - DNA, 20 bp, Homo sapiens
gggtgggagagtctgagggt

SEQ ID NO: 7630733 - DNA, 20 bp, Homo sapiens
gggtgggagagtctgagggt

SEQ ID NO: 7630734 - DNA, 22 bp, Homo sapiens
gtatgaaggcgagagcccacta

SEQ ID NO: 7630735 - DNA, 22 bp, Homo sapiens
gtatgagaatcagacacatatt

SEQ ID NO: 7630736 - DNA, 20 bp, Homo sapiens
gtatgacatgcgaaatgcat

SEQ ID NO: 7630737 - DNA, 20 bp, Homo sapiens
gtatgacatgcgaaatgcat

SEQ ID NO: 7630738 - DNA, 22 bp, Homo sapiens
gtatgaaagcatcattcctgct

SEQ ID NO: 7630739 - DNA, 22 bp, Homo sapiens
gtatgaaagcatcattcctgct

SEQ ID NO: 7630740 - DNA, 22 bp, Homo sapiens
gtatgaaagcatcattcctgct

SEQ ID NO: 7630741 - DNA, 22 bp, Homo sapiens
gtatcttttggtggaaaaataa

SEQ ID NO: 7630742 - DNA, 22 bp, Homo sapiens
gtatcttttggtggaaaaataa

SEQ ID NO: 7630743 - DNA, 22 bp, Homo sapiens
gtatcttttacaccaggaaatt

SEQ ID NO: 7630744 - DNA, 22 bp, Homo sapiens
gtatgaaaattgtaaagttctt

SEQ ID NO: 7630745 - DNA, 22 bp, Homo sapiens
gtatcttttggtggaaaaataa

SEQ ID NO: 7630746 - DNA, 22 bp, Homo sapiens
gtatgaaaattgtaaagttctt

SEQ ID NO: 7630747 - DNA, 22 bp, Homo sapiens
gtatcttttacaccaggaaatt

SEQ ID NO: 7630748 - DNA, 22 bp, Homo sapiens
gtatcttttacaccaggaaatt

SEQ ID NO: 7630749 - DNA, 22 bp, Homo sapiens
gtatctttccacatcttcagta

SEQ ID NO: 7630750 - DNA, 22 bp, Homo sapiens
gtatctttcccaccaatcacaa

SEQ ID NO: 7630751 - DNA, 22 bp, Homo sapiens
gtatctttgtcttcatgttgga

SEQ ID NO: 7630752 - DNA, 22 bp, Homo sapiens
cagcagcctcaagtttattttc

SEQ ID NO: 7630753 - DNA, 22 bp, Homo sapiens
cagcagcctcaagtttattttc

SEQ ID NO: 7630754 - DNA, 22 bp, Homo sapiens
cagcagcctagggttccatcat

SEQ ID NO: 7630755 - DNA, 22 bp, Homo sapiens
cagcagcctagggttccatcat

SEQ ID NO: 7630756 - DNA, 22 bp, Homo sapiens
cagcagcctccactcgccccac

SEQ ID NO: 7630757 - DNA, 22 bp, Homo sapiens
cagcagcctccactcgccccac

SEQ ID NO: 7630758 - DNA, 22 bp, Homo sapiens
cagcagcctagggttccatcat

SEQ ID NO: 7630759 - DNA, 22 bp, Homo sapiens
gtatgcatttggcatattgtcc

SEQ ID NO: 7630760 - DNA, 22 bp, Homo sapiens
gtatgctgcctacgaacatgca

SEQ ID NO: 7630761 - DNA, 22 bp, Homo sapiens
gtatgcatgcatgtgtatgtac

SEQ ID NO: 7630762 - DNA, 22 bp, Homo sapiens
gtatgcatttggcatattgtcc

SEQ ID NO: 7630763 - DNA, 22 bp, Homo sapiens
gtatgcatcgactcaagtctga

SEQ ID NO: 7630764 - DNA, 22 bp, Homo sapiens
cagcagcctcttgtgcctgtgg

SEQ ID NO: 7630765 - DNA, 22 bp, Homo sapiens
cagcagcctcttgtgcctgtgg

SEQ ID NO: 7630766 - DNA, 22 bp, Homo sapiens
cagcagcctcttgtgcctgtgg

SEQ ID NO: 7630767 - DNA, 22 bp, Homo sapiens
cagcagcctcttgtgcctgtgg

SEQ ID NO: 7630768 - DNA, 22 bp, Homo sapiens
cagcagcctccactcgccccac

SEQ ID NO: 7630769 - DNA, 22 bp, Homo sapiens
cagcagcctccactcgccccac

SEQ ID NO: 7630770 - DNA, 22 bp, Homo sapiens
cagcagcctgccttgggagctt

SEQ ID NO: 7630771 - DNA, 22 bp, Homo sapiens
cagcagcctgccttgggagctt

SEQ ID NO: 7630772 - DNA, 22 bp, Homo sapiens
cagcagcctgccttgggagctt

SEQ ID NO: 7630773 - DNA, 22 bp, Homo sapiens
cagcagcctgccttgggagctt

SEQ ID NO: 7630774 - DNA, 22 bp, Homo sapiens
cagcagcctgccttgggagctt

SEQ ID NO: 7630775 - DNA, 22 bp, Homo sapiens
cagcagcctcttgtgcctgtgg

SEQ ID NO: 7630776 - DNA, 22 bp, Homo sapiens
cagcaggaccattgaggcatca

SEQ ID NO: 7630777 - DNA, 22 bp, Homo sapiens
cagcaggacatggaggagtaaa

SEQ ID NO: 7630778 - DNA, 22 bp, Homo sapiens
cagcaggaccattgaggcatca

SEQ ID NO: 7630779 - DNA, 22 bp, Homo sapiens
cagcaggaccattgaggcatca

SEQ ID NO: 7630780 - DNA, 22 bp, Homo sapiens
cagcaggaccattgaggcatca

SEQ ID NO: 7630781 - DNA, 22 bp, Homo sapiens
cagcaggacatggaggagtaaa

SEQ ID NO: 7630782 - DNA, 22 bp, Homo sapiens
cagcaggacatggaggagtaaa

SEQ ID NO: 7630783 - DNA, 22 bp, Homo sapiens
cagcaggacatggaggagtaaa

SEQ ID NO: 7630784 - DNA, 22 bp, Homo sapiens
cagcagctacttggagcagcag

SEQ ID NO: 7630785 - DNA, 22 bp, Homo sapiens
cagcagctacttggagcagcag

SEQ ID NO: 7630786 - DNA, 22 bp, Homo sapiens
cagcagctacttggagcagcag

SEQ ID NO: 7630787 - DNA, 22 bp, Homo sapiens
cagcagctacctgctcttgtgg

SEQ ID NO: 7630788 - DNA, 22 bp, Homo sapiens
cagcagctacttggagcagcag

SEQ ID NO: 7630789 - DNA, 22 bp, Homo sapiens
cagcagctacctgctcttgtgg

SEQ ID NO: 7630790 - DNA, 22 bp, Homo sapiens
cagcagctacctgctcttgtgg

SEQ ID NO: 7630791 - DNA, 22 bp, Homo sapiens
cagcagctacctgctcttgtgg

SEQ ID NO: 7630792 - DNA, 22 bp, Homo sapiens
cagcagctacctgctcttgtgg

SEQ ID NO: 7630793 - DNA, 22 bp, Homo sapiens
cagcagctacctgctcttgtgg

SEQ ID NO: 7630794 - DNA, 22 bp, Homo sapiens
cagcagctacctgctcttgtgg

SEQ ID NO: 7630795 - DNA, 22 bp, Homo sapiens
cagcagcctgccttgggagctt

SEQ ID NO: 7630796 - DNA, 22 bp, Homo sapiens
cagcagcctgccttgggagctt

SEQ ID NO: 7630797 - DNA, 22 bp, Homo sapiens
cagcagcctggagggggccacg

SEQ ID NO: 7630798 - DNA, 22 bp, Homo sapiens
cagcagcctgccttgggagctt

SEQ ID NO: 7630799 - DNA, 22 bp, Homo sapiens
cagcagcctggagggggccacg

SEQ ID NO: 7630800 - DNA, 22 bp, Homo sapiens
cagcagcctggagggggccacg

SEQ ID NO: 7630801 - DNA, 22 bp, Homo sapiens
cagcagcctgccttgggagctt

SEQ ID NO: 7630802 - DNA, 22 bp, Homo sapiens
cagcagcctggagggggccacg

SEQ ID NO: 7630803 - DNA, 22 bp, Homo sapiens
cagcagcctggcccctcctcgg

SEQ ID NO: 7630804 - DNA, 22 bp, Homo sapiens
cagcagcctggcccctcctcgg

SEQ ID NO: 7630805 - DNA, 22 bp, Homo sapiens
cagcagcctggcccctcctcgg

SEQ ID NO: 7630806 - DNA, 22 bp, Homo sapiens
cagcagcctggcccctcctcgg

SEQ ID NO: 7630807 - DNA, 22 bp, Homo sapiens
cagcagctaaggcatgttcctg

SEQ ID NO: 7630808 - DNA, 22 bp, Homo sapiens
cagcagctaaggcatgttcctg

SEQ ID NO: 7630809 - DNA, 22 bp, Homo sapiens
cagcagctaaggcatgttcctg

SEQ ID NO: 7630810 - DNA, 22 bp, Homo sapiens
cagcagctaaggcatgttcctg

SEQ ID NO: 7630811 - DNA, 22 bp, Homo sapiens
cagcagcgcacactggtatgga

SEQ ID NO: 7630812 - DNA, 22 bp, Homo sapiens
cagcagcgcacactggtatgga

SEQ ID NO: 7630813 - DNA, 22 bp, Homo sapiens
cagcagcctggcccctcctcgg

SEQ ID NO: 7630814 - DNA, 22 bp, Homo sapiens
cagcagcctggcccctcctcgg

SEQ ID NO: 7630815 - DNA, 22 bp, Homo sapiens
cagcaggcccagagtttcatgg

SEQ ID NO: 7630816 - DNA, 22 bp, Homo sapiens
cagcaggcccaggtgctggtga

SEQ ID NO: 7630817 - DNA, 22 bp, Homo sapiens
cagcaggcccaggtgctggtga

SEQ ID NO: 7630818 - DNA, 22 bp, Homo sapiens
cagcaggcccaggtgctggtga

SEQ ID NO: 7630819 - DNA, 22 bp, Homo sapiens
cagcaggcccaggtgctggtga

SEQ ID NO: 7630820 - DNA, 22 bp, Homo sapiens
cagcaggcccaggtgctggtga

SEQ ID NO: 7630821 - DNA, 22 bp, Homo sapiens
cagcaggcccaggtgctggtga

SEQ ID NO: 7630822 - DNA, 22 bp, Homo sapiens
cagcaggcccaggtgctggtga

SEQ ID NO: 7630823 - DNA, 22 bp, Homo sapiens
cagcaggcccaggtgctggtga

SEQ ID NO: 7630824 - DNA, 22 bp, Homo sapiens
cagcaggcccaggtgctggtga

SEQ ID NO: 7630825 - DNA, 22 bp, Homo sapiens
cagcaggcccaggtgctggtga

SEQ ID NO: 7630826 - DNA, 22 bp, Homo sapiens
cagcaggcggcccgcgggcccg

SEQ ID NO: 7630827 - DNA, 22 bp, Homo sapiens
cagcaggcggcccgcgggcccg

SEQ ID NO: 7630828 - DNA, 22 bp, Homo sapiens
cagcaggcggcccgcgggcccg

SEQ ID NO: 7630829 - DNA, 22 bp, Homo sapiens
cagcaggcggcccgcgggcccg

SEQ ID NO: 7630830 - DNA, 22 bp, Homo sapiens
cagcaggcggcccgcgggcccg

SEQ ID NO: 7630831 - DNA, 22 bp, Homo sapiens
cagcaggcggcccgcgggcccg

SEQ ID NO: 7630832 - DNA, 22 bp, Homo sapiens
gtatttctagaaccaaaagcca

SEQ ID NO: 7630833 - DNA, 22 bp, Homo sapiens
gtatttctagaaccaaaagcca

SEQ ID NO: 7630834 - DNA, 22 bp, Homo sapiens
gtatttctagaaaatgcagatt

SEQ ID NO: 7630835 - DNA, 22 bp, Homo sapiens
gtatttctagaaaatgcagatt

SEQ ID NO: 7630836 - DNA, 22 bp, Homo sapiens
gtatttctagaaaatgcagatt

SEQ ID NO: 7630837 - DNA, 22 bp, Homo sapiens
gtatttctagaaaatgcagatt

SEQ ID NO: 7630838 - DNA, 22 bp, Homo sapiens
gtatttcttggaaatcctttta

SEQ ID NO: 7630839 - DNA, 22 bp, Homo sapiens
gtatttcttggaaatcctttta

SEQ ID NO: 7630840 - DNA, 22 bp, Homo sapiens
gtatttcttccacggtggattt

SEQ ID NO: 7630841 - DNA, 22 bp, Homo sapiens
gtatttctggttaaatgtgcta

SEQ ID NO: 7630842 - DNA, 22 bp, Homo sapiens
gtatttctggtaactgctgcta

SEQ ID NO: 7630843 - DNA, 22 bp, Homo sapiens
gtatttctggttaaatgtgcta

SEQ ID NO: 7630844 - DNA, 22 bp, Homo sapiens
gtatttctggttaaatgtgcta

SEQ ID NO: 7630845 - DNA, 22 bp, Homo sapiens
gtatttctggttaaatgtgcta

SEQ ID NO: 7630846 - DNA, 22 bp, Homo sapiens
gtatttctggtaactgctgcta

SEQ ID NO: 7630847 - DNA, 22 bp, Homo sapiens
gtatttctggtaactgctgcta

SEQ ID NO: 7630848 - DNA, 22 bp, Homo sapiens
gtatttctggtaactgctgcta

SEQ ID NO: 7630849 - DNA, 22 bp, Homo sapiens
gtatttctttacatatgctcat

SEQ ID NO: 7630850 - DNA, 22 bp, Homo sapiens
gtatttcttgtacttccttgtc

SEQ ID NO: 7630851 - DNA, 22 bp, Homo sapiens
gtatttcttgtacttccttgtc

SEQ ID NO: 7630852 - DNA, 22 bp, Homo sapiens
gtatttcttggaaatcctttta

SEQ ID NO: 7630853 - DNA, 22 bp, Homo sapiens
gtatttcttggaaatcctttta

SEQ ID NO: 7630854 - DNA, 15 bp, Homo sapiens
gtatttcttttatat

SEQ ID NO: 7630855 - DNA, 22 bp, Homo sapiens
gtatttctttccattatagtca

SEQ ID NO: 7630856 - DNA, 22 bp, Homo sapiens
gtatttctttccattatagtca

SEQ ID NO: 7630857 - DNA, 22 bp, Homo sapiens
gtatttctttccattatagtca

SEQ ID NO: 7630858 - DNA, 22 bp, Homo sapiens
gtatttctttccattatagtca

SEQ ID NO: 7630859 - DNA, 22 bp, Homo sapiens
cagcaggcagccatttcactgt

SEQ ID NO: 7630860 - DNA, 22 bp, Homo sapiens
cagcaggcaggtgggccaagtc

SEQ ID NO: 7630861 - DNA, 22 bp, Homo sapiens
cagcaggcaggtgggccaagtc

SEQ ID NO: 7630862 - DNA, 22 bp, Homo sapiens
cagcaggcaggtgggccaagtc

SEQ ID NO: 7630863 - DNA, 22 bp, Homo sapiens
cagcaggcaggtgggccaagtc

SEQ ID NO: 7630864 - DNA, 22 bp, Homo sapiens
cagcaggcagccatttcactgt

SEQ ID NO: 7630865 - DNA, 22 bp, Homo sapiens
cagcaggcaggtgggccaagtc

SEQ ID NO: 7630866 - DNA, 22 bp, Homo sapiens
cagcaggcaggtgggccaagtc

SEQ ID NO: 7630867 - DNA, 22 bp, Homo sapiens
cagcaggcaggtgggccaagtc

SEQ ID NO: 7630868 - DNA, 22 bp, Homo sapiens
cagcaggcaggtgggccaagtc

SEQ ID NO: 7630869 - DNA, 22 bp, Homo sapiens
cagcaggccatgctgcttttca

SEQ ID NO: 7630870 - DNA, 22 bp, Homo sapiens
cagcaggccatgctgcttttca

SEQ ID NO: 7630871 - DNA, 22 bp, Homo sapiens
cagcaggcaggtgggccaagtc

SEQ ID NO: 7630872 - DNA, 22 bp, Homo sapiens
cagcaggccatgctgcttttca

SEQ ID NO: 7630873 - DNA, 22 bp, Homo sapiens
cagcaggccatgctgcttttca

SEQ ID NO: 7630874 - DNA, 22 bp, Homo sapiens
cagcaggatttgaaaggaagag

SEQ ID NO: 7630875 - DNA, 22 bp, Homo sapiens
cagcaggatttgaaaggaagag

SEQ ID NO: 7630876 - DNA, 22 bp, Homo sapiens
cagcaggattggatacatctca

SEQ ID NO: 7630877 - DNA, 22 bp, Homo sapiens
cagcaggatatggtggagagag

SEQ ID NO: 7630878 - DNA, 22 bp, Homo sapiens
cagcaggattggatacatctca

SEQ ID NO: 7630879 - DNA, 22 bp, Homo sapiens
cagcaggattggatacatctca

SEQ ID NO: 7630880 - DNA, 22 bp, Homo sapiens
cagcaggatttgaaaggaagag

SEQ ID NO: 7630881 - DNA, 22 bp, Homo sapiens
cagcaggatttgaaaggaagag

SEQ ID NO: 7630882 - DNA, 22 bp, Homo sapiens
cagcaggatttgaaaggaagag

SEQ ID NO: 7630883 - DNA, 22 bp, Homo sapiens
cagcaggatttgaaaggaagag

SEQ ID NO: 7630884 - DNA, 22 bp, Homo sapiens
cagcaggatttgaaaggaagag

SEQ ID NO: 7630885 - DNA, 22 bp, Homo sapiens
cagcaggcaagaggttttatca

SEQ ID NO: 7630886 - DNA, 22 bp, Homo sapiens
cagcaggcagccatttcactgt

SEQ ID NO: 7630887 - DNA, 22 bp, Homo sapiens
cagcaggcagccatttcactgt

SEQ ID NO: 7630888 - DNA, 22 bp, Homo sapiens
gtatatgtgtgcaagtgcatgg

SEQ ID NO: 7630889 - DNA, 22 bp, Homo sapiens
gtatatgtatgcgtatacacac

SEQ ID NO: 7630890 - DNA, 21 bp, Homo sapiens
gtatatgcatcctcgcttttc

SEQ ID NO: 7630891 - DNA, 22 bp, Homo sapiens
gtatatgcatgtgtctgttcac

SEQ ID NO: 7630892 - DNA, 19 bp, Homo sapiens
gtatatggcttctacctac

SEQ ID NO: 7630893 - DNA, 19 bp, Homo sapiens
gtatatttatatggctgta

SEQ ID NO: 7630894 - DNA, 22 bp, Homo sapiens
gtatatgtgtgggcctgcatat

SEQ ID NO: 7630895 - DNA, 19 bp, Homo sapiens
gtatatttatatggctgta

SEQ ID NO: 7630896 - DNA, 22 bp, Homo sapiens
gtatcacttttgagagtgagaa

SEQ ID NO: 7630897 - DNA, 22 bp, Homo sapiens
gtatcacttttgagagtgagaa

SEQ ID NO: 7630898 - DNA, 22 bp, Homo sapiens
gtatcacttttgagagtgagaa

SEQ ID NO: 7630899 - DNA, 22 bp, Homo sapiens
gtatcacttttgagagtgagaa

SEQ ID NO: 7630900 - DNA, 21 bp, Homo sapiens
gtatcacatttgcatgcttat

SEQ ID NO: 7630901 - DNA, 22 bp, Homo sapiens
gtatattttgatcaccctctat

SEQ ID NO: 7630902 - DNA, 22 bp, Homo sapiens
gtatcacactagaatgcattca

SEQ ID NO: 7630903 - DNA, 22 bp, Homo sapiens
gtatcacactagaatgcattca

SEQ ID NO: 7630904 - DNA, 22 bp, Homo sapiens
gtatcatatgcatcaggcttgc

SEQ ID NO: 7630905 - DNA, 22 bp, Homo sapiens
gtatccatgggggattggttcc

SEQ ID NO: 7630906 - DNA, 22 bp, Homo sapiens
gtatccatgggggattggttcc

SEQ ID NO: 7630907 - DNA, 22 bp, Homo sapiens
gtatccatgggggattggttcc

SEQ ID NO: 7630908 - DNA, 22 bp, Homo sapiens
gtatcctccccgctggccttca

SEQ ID NO: 7630909 - DNA, 22 bp, Homo sapiens
gtatcctttgcggaaatttcta

SEQ ID NO: 7630910 - DNA, 22 bp, Homo sapiens
gtatcctcacctatacaatgga

SEQ ID NO: 7630911 - DNA, 20 bp, Homo sapiens
gtatccccgcgtggggaagg

SEQ ID NO: 7630912 - DNA, 22 bp, Homo sapiens
gtatctacgtttgtgtgtacct

SEQ ID NO: 7630913 - DNA, 22 bp, Homo sapiens
gtatctgtggattttggtatcc

SEQ ID NO: 7630914 - DNA, 22 bp, Homo sapiens
gtatctatgatcctttatatct

SEQ ID NO: 7630915 - DNA, 22 bp, Homo sapiens
gtatctttccacatcttcagta

SEQ ID NO: 7630916 - DNA, 22 bp, Homo sapiens
gtatctttcaccagctcccagg

SEQ ID NO: 7630917 - DNA, 22 bp, Homo sapiens
gtatctttccacatcttcagta

SEQ ID NO: 7630918 - DNA, 22 bp, Homo sapiens
gtatctttatccctcgttggag

SEQ ID NO: 7630919 - DNA, 22 bp, Homo sapiens
gtatctgtggattttggtatcc

SEQ ID NO: 7630920 - DNA, 22 bp, Homo sapiens
cagcagcacctattatagtgtt

SEQ ID NO: 7630921 - DNA, 22 bp, Homo sapiens
cagcagcacctattatagtgtt

SEQ ID NO: 7630922 - DNA, 22 bp, Homo sapiens
cagcagcacctattatagtgtt

SEQ ID NO: 7630923 - DNA, 22 bp, Homo sapiens
cagcagcaaggtgagggtggag

SEQ ID NO: 7630924 - DNA, 22 bp, Homo sapiens
cagcagcaaggtgagggtggag

SEQ ID NO: 7630925 - DNA, 22 bp, Homo sapiens
cagcagcaaggtgagggtggag

SEQ ID NO: 7630926 - DNA, 22 bp, Homo sapiens
cagcagcactctgcgggtcccc

SEQ ID NO: 7630927 - DNA, 22 bp, Homo sapiens
cagcagcactctgcgggtcccc

SEQ ID NO: 7630928 - DNA, 22 bp, Homo sapiens
cagcagcactctgcgggtcccc

SEQ ID NO: 7630929 - DNA, 22 bp, Homo sapiens
cagcagcacctattatagtgtt

SEQ ID NO: 7630930 - DNA, 22 bp, Homo sapiens
cagcagcacctattatagtgtt

SEQ ID NO: 7630931 - DNA, 22 bp, Homo sapiens
cagcagcagacatttgatcttc

SEQ ID NO: 7630932 - DNA, 22 bp, Homo sapiens
cagcagcagacatttgatcttc

SEQ ID NO: 7630933 - DNA, 22 bp, Homo sapiens
cagcagcactctgcgggtcccc

SEQ ID NO: 7630934 - DNA, 22 bp, Homo sapiens
cagcagcactctgcgggtcccc

SEQ ID NO: 7630935 - DNA, 22 bp, Homo sapiens
cagcagcagagatactggtttc

SEQ ID NO: 7630936 - DNA, 22 bp, Homo sapiens
cagcagcagagatactggtttc

SEQ ID NO: 7630937 - DNA, 22 bp, Homo sapiens
cagcagcagagatactggtttc

SEQ ID NO: 7630938 - DNA, 22 bp, Homo sapiens
cagcagcagattcagcgtctgg

SEQ ID NO: 7630939 - DNA, 22 bp, Homo sapiens
cagcagcagattcagcgtctgg

SEQ ID NO: 7630940 - DNA, 22 bp, Homo sapiens
cagcagcagagatactggtttc

SEQ ID NO: 7630941 - DNA, 22 bp, Homo sapiens
cagcagcagagatactggtttc

SEQ ID NO: 7630942 - DNA, 22 bp, Homo sapiens
cagcagcagacatttgatcttc

SEQ ID NO: 7630943 - DNA, 22 bp, Homo sapiens
cagcagcagacatttgatcttc

SEQ ID NO: 7630944 - DNA, 22 bp, Homo sapiens
cagcagcagacatttgatcttc

SEQ ID NO: 7630945 - DNA, 22 bp, Homo sapiens
gtagggatggaagccatgaaat

SEQ ID NO: 7630946 - DNA, 22 bp, Homo sapiens
gtagggataggtgtccagagac

SEQ ID NO: 7630947 - DNA, 22 bp, Homo sapiens
gtagggatgaggccctcattcc

SEQ ID NO: 7630948 - DNA, 22 bp, Homo sapiens
gtagggattcttctcactgagc

SEQ ID NO: 7630949 - DNA, 22 bp, Homo sapiens
gtagggattcttctcactgagc

SEQ ID NO: 7630950 - DNA, 22 bp, Homo sapiens
gtagggcaacatgggcactagg

SEQ ID NO: 7630951 - DNA, 22 bp, Homo sapiens
gtagggcaacatgggcactagg

SEQ ID NO: 7630952 - DNA, 22 bp, Homo sapiens
gtagggataggtgtccagagac

SEQ ID NO: 7630953 - DNA, 22 bp, Homo sapiens
cagcagcagattcagcgtctgg

SEQ ID NO: 7630954 - DNA, 22 bp, Homo sapiens
cagcagcagattcagcgtctgg

SEQ ID NO: 7630955 - DNA, 22 bp, Homo sapiens
cagcagagtatggcactcaact

SEQ ID NO: 7630956 - DNA, 22 bp, Homo sapiens
cagcagagtatggcactcaact

SEQ ID NO: 7630957 - DNA, 22 bp, Homo sapiens
cagcagagtatggcactcaact

SEQ ID NO: 7630958 - DNA, 22 bp, Homo sapiens
cagcagagtatggcactcaact

SEQ ID NO: 7630959 - DNA, 22 bp, Homo sapiens
cagcagagtatggcactcaact

SEQ ID NO: 7630960 - DNA, 22 bp, Homo sapiens
cagcagagtttggcttctaatg

SEQ ID NO: 7630961 - DNA, 22 bp, Homo sapiens
cagcagagtttggcttctaatg

SEQ ID NO: 7630962 - DNA, 22 bp, Homo sapiens
cagcagagtttggcttctaatg

SEQ ID NO: 7630963 - DNA, 22 bp, Homo sapiens
cagcagagtttggcttctaatg

SEQ ID NO: 7630964 - DNA, 22 bp, Homo sapiens
cagcagagtttggcttctaatg

SEQ ID NO: 7630965 - DNA, 22 bp, Homo sapiens
cagcagagtttggcttctaatg

SEQ ID NO: 7630966 - DNA, 22 bp, Homo sapiens
cagcagagtaggtgctacttct

SEQ ID NO: 7630967 - DNA, 22 bp, Homo sapiens
cagcagagtaggtgctacttct

SEQ ID NO: 7630968 - DNA, 22 bp, Homo sapiens
cagcagagtaggtgctacttct

SEQ ID NO: 7630969 - DNA, 22 bp, Homo sapiens
cagcagagtaggtgctacttct

SEQ ID NO: 7630970 - DNA, 22 bp, Homo sapiens
cagcagagtaggtgctacttct

SEQ ID NO: 7630971 - DNA, 22 bp, Homo sapiens
cagcagagtaggtgctacttct

SEQ ID NO: 7630972 - DNA, 22 bp, Homo sapiens
cagcagagtaggtgctacttct

SEQ ID NO: 7630973 - DNA, 22 bp, Homo sapiens
cagcagagtaggtgctacttct

SEQ ID NO: 7630974 - DNA, 22 bp, Homo sapiens
cagcagagtaggtgctacttct

SEQ ID NO: 7630975 - DNA, 22 bp, Homo sapiens
cagcagagtatggcactcaact

SEQ ID NO: 7630976 - DNA, 22 bp, Homo sapiens
cagcagagtatggcactcaact

SEQ ID NO: 7630977 - DNA, 22 bp, Homo sapiens
cagcagagtatggcactcaact

SEQ ID NO: 7630978 - DNA, 22 bp, Homo sapiens
cagcagagtatggcactcaact

SEQ ID NO: 7630979 - DNA, 21 bp, Homo sapiens
cagcagagtaatgcattcgta

SEQ ID NO: 7630980 - DNA, 21 bp, Homo sapiens
cagcagagtaatgcattcgta

SEQ ID NO: 7630981 - DNA, 21 bp, Homo sapiens
cagcagagtaatgcattcgta

SEQ ID NO: 7630982 - DNA, 21 bp, Homo sapiens
cagcagagtaatgcattcgta

SEQ ID NO: 7630983 - DNA, 21 bp, Homo sapiens
cagcagagtaatgcattcgta

SEQ ID NO: 7630984 - DNA, 22 bp, Homo sapiens
cagcagagcttatgttgggtca

SEQ ID NO: 7630985 - DNA, 22 bp, Homo sapiens
cagcagagctgtgtgggaaggg

SEQ ID NO: 7630986 - DNA, 22 bp, Homo sapiens
cagcagagctgtgtgggaaggg

SEQ ID NO: 7630987 - DNA, 22 bp, Homo sapiens
cagcagagctgtgtgggaaggg

SEQ ID NO: 7630988 - DNA, 22 bp, Homo sapiens
cagcagagctgtgtgggaaggg

SEQ ID NO: 7630989 - DNA, 22 bp, Homo sapiens
cagcagagtaattctcacctct

SEQ ID NO: 7630990 - DNA, 22 bp, Homo sapiens
cagcagagtaattctcacctct

SEQ ID NO: 7630991 - DNA, 22 bp, Homo sapiens
cagcagagtaattctcacctct

SEQ ID NO: 7630992 - DNA, 22 bp, Homo sapiens
cagcagagtaattctcacctct

SEQ ID NO: 7630993 - DNA, 22 bp, Homo sapiens
cagcagagtaattctcacctct

SEQ ID NO: 7630994 - DNA, 22 bp, Homo sapiens
cagcagagtaattctcacctct

SEQ ID NO: 7630995 - DNA, 22 bp, Homo sapiens
cagcagagtaattctcacctct

SEQ ID NO: 7630996 - DNA, 22 bp, Homo sapiens
cagcagagtaattctcacctct

SEQ ID NO: 7630997 - DNA, 22 bp, Homo sapiens
cagcagagtaattctcacctct

SEQ ID NO: 7630998 - DNA, 21 bp, Homo sapiens
cagcagagtaatgcattcgta

SEQ ID NO: 7630999 - DNA, 21 bp, Homo sapiens
cagcagagtaatgcattcgta

SEQ ID NO: 7631000 - DNA, 21 bp, Homo sapiens
cagcagagtaatgcattcgta

SEQ ID NO: 7631001 - DNA, 22 bp, Homo sapiens
cagcagcaacaacggaagcctt

SEQ ID NO: 7631002 - DNA, 22 bp, Homo sapiens
cagcagcaacaacggaagcctt

SEQ ID NO: 7631003 - DNA, 22 bp, Homo sapiens
cagcagcaacaacggaagcctt

SEQ ID NO: 7631004 - DNA, 22 bp, Homo sapiens
cagcagcaacaacggaagcctt

SEQ ID NO: 7631005 - DNA, 22 bp, Homo sapiens
cagcagcaacaacggaagcctt

SEQ ID NO: 7631006 - DNA, 22 bp, Homo sapiens
cagcagcaacaacggaagcctt

SEQ ID NO: 7631007 - DNA, 22 bp, Homo sapiens
cagcagcaacaacggaagcctt

SEQ ID NO: 7631008 - DNA, 22 bp, Homo sapiens
cagcagcaacaacggaagcctt

SEQ ID NO: 7631009 - DNA, 22 bp, Homo sapiens
cagcagcaacaatagcggtcac

SEQ ID NO: 7631010 - DNA, 22 bp, Homo sapiens
cagcagcaacaatagcggtcac

SEQ ID NO: 7631011 - DNA, 22 bp, Homo sapiens
cagcagcaacaatagcggtcac

SEQ ID NO: 7631012 - DNA, 22 bp, Homo sapiens
cagcagcaaggtgagggtggag

SEQ ID NO: 7631013 - DNA, 22 bp, Homo sapiens
cagcagcaaggtgagggtggag

SEQ ID NO: 7631014 - DNA, 22 bp, Homo sapiens
cagcagcaaggtgagggtggag

SEQ ID NO: 7631015 - DNA, 22 bp, Homo sapiens
cagcagcaaggtgagggtggag

SEQ ID NO: 7631016 - DNA, 22 bp, Homo sapiens
cagcagcaacaatagcggtcac

SEQ ID NO: 7631017 - DNA, 22 bp, Homo sapiens
cagcagcaaatctagaagagga

SEQ ID NO: 7631018 - DNA, 22 bp, Homo sapiens
cagcagcaaatctagaagagga

SEQ ID NO: 7631019 - DNA, 22 bp, Homo sapiens
cagcagatttgggaaacactgt

SEQ ID NO: 7631020 - DNA, 22 bp, Homo sapiens
cagcagagtttggcttctaatg

SEQ ID NO: 7631021 - DNA, 22 bp, Homo sapiens
cagcagcaaatctagaagagga

SEQ ID NO: 7631022 - DNA, 22 bp, Homo sapiens
cagcagatttgggaaacactgt

SEQ ID NO: 7631023 - DNA, 22 bp, Homo sapiens
cagcagatttgggaaacactgt

SEQ ID NO: 7631024 - DNA, 22 bp, Homo sapiens
cagcagatcaatgtagaatatt

SEQ ID NO: 7631025 - DNA, 22 bp, Homo sapiens
cagcagatcaatgtagaatatt

SEQ ID NO: 7631026 - DNA, 22 bp, Homo sapiens
cagcagcaacaacggaagcctt

SEQ ID NO: 7631027 - DNA, 22 bp, Homo sapiens
cagcagcaacaacggaagcctt

SEQ ID NO: 7631028 - DNA, 22 bp, Homo sapiens
cagcagcaacaacggaagcctt

SEQ ID NO: 7631029 - DNA, 22 bp, Homo sapiens
cagcagcaaatctagaagagga

SEQ ID NO: 7631030 - DNA, 22 bp, Homo sapiens
cagcagcaaatctagaagagga

SEQ ID NO: 7631031 - DNA, 22 bp, Homo sapiens
cagcagcaaatctagaagagga

SEQ ID NO: 7631032 - DNA, 22 bp, Homo sapiens
cagcagcaaatctagaagagga

SEQ ID NO: 7631033 - DNA, 22 bp, Homo sapiens
cagcagcaaatctagaagagga

SEQ ID NO: 7631034 - DNA, 22 bp, Homo sapiens
cagcagcaaatctagaagagga

SEQ ID NO: 7631035 - DNA, 22 bp, Homo sapiens
cagccactgaactcctggctat

SEQ ID NO: 7631036 - DNA, 22 bp, Homo sapiens
cagccactgaactcctggctat

SEQ ID NO: 7631037 - DNA, 22 bp, Homo sapiens
cagccactgaactcctggctat

SEQ ID NO: 7631038 - DNA, 22 bp, Homo sapiens
cagccactgaactcctggctat

SEQ ID NO: 7631039 - DNA, 22 bp, Homo sapiens
cagccactgaactcctggctat

SEQ ID NO: 7631040 - DNA, 22 bp, Homo sapiens
cagccactgacaggaatggtcc

SEQ ID NO: 7631041 - DNA, 22 bp, Homo sapiens
cagccactcggccataaaggct

SEQ ID NO: 7631042 - DNA, 22 bp, Homo sapiens
cagccactctcagacagtccca

SEQ ID NO: 7631043 - DNA, 22 bp, Homo sapiens
cagccactctcagacagtccca

SEQ ID NO: 7631044 - DNA, 22 bp, Homo sapiens
cagccactgaactcctggctat

SEQ ID NO: 7631045 - DNA, 22 bp, Homo sapiens
cagccactctcagacagtccca

SEQ ID NO: 7631046 - DNA, 22 bp, Homo sapiens
cagccactctcagacagtccca

SEQ ID NO: 7631047 - DNA, 22 bp, Homo sapiens
cagccaccatacagcagaagct

SEQ ID NO: 7631048 - DNA, 22 bp, Homo sapiens
cagccactacaattggttccat

SEQ ID NO: 7631049 - DNA, 22 bp, Homo sapiens
cagccactacaattggttccat

SEQ ID NO: 7631050 - DNA, 22 bp, Homo sapiens
cagccactcggccataaaggct

SEQ ID NO: 7631051 - DNA, 22 bp, Homo sapiens
cagccactctcagacagtccca

SEQ ID NO: 7631052 - DNA, 22 bp, Homo sapiens
cagccacgtagcccttggccgt

SEQ ID NO: 7631053 - DNA, 22 bp, Homo sapiens
cagccactcggccataaaggct

SEQ ID NO: 7631054 - DNA, 22 bp, Homo sapiens
cagccaaatgagtcataaatgt

SEQ ID NO: 7631055 - DNA, 22 bp, Homo sapiens
cagccaaatgagtcataaatgt

SEQ ID NO: 7631056 - DNA, 22 bp, Homo sapiens
cagccaaatgagtcataaatgt

SEQ ID NO: 7631057 - DNA, 22 bp, Homo sapiens
cagcattttcttaatgtaggtg

SEQ ID NO: 7631058 - DNA, 22 bp, Homo sapiens
cagcattttcttaatgtaggtg

SEQ ID NO: 7631059 - DNA, 22 bp, Homo sapiens
cagccaagaaagcagtgctcca

SEQ ID NO: 7631060 - DNA, 22 bp, Homo sapiens
cagccaagaaagcagtgctcca

SEQ ID NO: 7631061 - DNA, 22 bp, Homo sapiens
cagccaagaaagcagtgctcca

SEQ ID NO: 7631062 - DNA, 22 bp, Homo sapiens
cagccaagaaagcagtgctcca

SEQ ID NO: 7631063 - DNA, 22 bp, Homo sapiens
cagccacagctgggtgcctgac

SEQ ID NO: 7631064 - DNA, 22 bp, Homo sapiens
cagccacagctgggtgcctgac

SEQ ID NO: 7631065 - DNA, 22 bp, Homo sapiens
cagccacagctgggtgcctgac

SEQ ID NO: 7631066 - DNA, 22 bp, Homo sapiens
cagccaatcctgggaaagtgca

SEQ ID NO: 7631067 - DNA, 22 bp, Homo sapiens
cagccaatctgcatatttcttt

SEQ ID NO: 7631068 - DNA, 22 bp, Homo sapiens
cagccaatctgcatatttcttt

SEQ ID NO: 7631069 - DNA, 22 bp, Homo sapiens
cagccaatgggggacttggcca

SEQ ID NO: 7631070 - DNA, 22 bp, Homo sapiens
cagccaatgggggacttggcca

SEQ ID NO: 7631071 - DNA, 22 bp, Homo sapiens
cagccaattctagcttgtgaat

SEQ ID NO: 7631072 - DNA, 22 bp, Homo sapiens
cagccaattctagcttgtgaat

SEQ ID NO: 7631073 - DNA, 22 bp, Homo sapiens
cagccaagaaccacagacccag

SEQ ID NO: 7631074 - DNA, 22 bp, Homo sapiens
cagccaagaaccacagacccag

SEQ ID NO: 7631075 - DNA, 22 bp, Homo sapiens
cagccaagaaccacagacccag

SEQ ID NO: 7631076 - DNA, 22 bp, Homo sapiens
cagccaatagcaagggaagctg

SEQ ID NO: 7631077 - DNA, 22 bp, Homo sapiens
cagccacttcccctctatgggt

SEQ ID NO: 7631078 - DNA, 22 bp, Homo sapiens
cagccacttcccctctatgggt

SEQ ID NO: 7631079 - DNA, 22 bp, Homo sapiens
cagccactgtggtctagctgca

SEQ ID NO: 7631080 - DNA, 22 bp, Homo sapiens
cagccacttcccctctatgggt

SEQ ID NO: 7631081 - DNA, 22 bp, Homo sapiens
cagccacttcccctctatgggt

SEQ ID NO: 7631082 - DNA, 22 bp, Homo sapiens
cagccacttcccctctatgggt

SEQ ID NO: 7631083 - DNA, 22 bp, Homo sapiens
cagccacttcgagcttcctgat

SEQ ID NO: 7631084 - DNA, 22 bp, Homo sapiens
cagccacttcgagcttcctgat

SEQ ID NO: 7631085 - DNA, 22 bp, Homo sapiens
cagccacttcgagcttcctgat

SEQ ID NO: 7631086 - DNA, 22 bp, Homo sapiens
cagccactgtggtctagctgca

SEQ ID NO: 7631087 - DNA, 22 bp, Homo sapiens
cagccactgtggaatagccccc

SEQ ID NO: 7631088 - DNA, 22 bp, Homo sapiens
cagccactgtggaatagccccc

SEQ ID NO: 7631089 - DNA, 22 bp, Homo sapiens
cagccactgtggaatagccccc

SEQ ID NO: 7631090 - DNA, 22 bp, Homo sapiens
cagccactgtggaatagccccc

SEQ ID NO: 7631091 - DNA, 22 bp, Homo sapiens
cagccactgtggtctagctgca

SEQ ID NO: 7631092 - DNA, 22 bp, Homo sapiens
cagccactggtgccaggctgtt

SEQ ID NO: 7631093 - DNA, 22 bp, Homo sapiens
cagccactggtgccaggctgtt

SEQ ID NO: 7631094 - DNA, 22 bp, Homo sapiens
cagccactggtgccaggctgtt

SEQ ID NO: 7631095 - DNA, 22 bp, Homo sapiens
cagccactgacaggaatggtcc

SEQ ID NO: 7631096 - DNA, 22 bp, Homo sapiens
cagccactgacaggaatggtcc

SEQ ID NO: 7631097 - DNA, 22 bp, Homo sapiens
cagccactgacaggaatggtcc

SEQ ID NO: 7631098 - DNA, 22 bp, Homo sapiens
cagccactggtgccaggctgtt

SEQ ID NO: 7631099 - DNA, 22 bp, Homo sapiens
cagccactggtgccaggctgtt

SEQ ID NO: 7631100 - DNA, 22 bp, Homo sapiens
cagccaggttcaagtccttata

SEQ ID NO: 7631101 - DNA, 22 bp, Homo sapiens
cagccacttgtgatgctgggga

SEQ ID NO: 7631102 - DNA, 22 bp, Homo sapiens
cagccaggttcaagtccttata

SEQ ID NO: 7631103 - DNA, 22 bp, Homo sapiens
cagccaggttcaagtccttata

SEQ ID NO: 7631104 - DNA, 22 bp, Homo sapiens
cagccagaaagtatgttaggga

SEQ ID NO: 7631105 - DNA, 22 bp, Homo sapiens
cagccacttcgagcttcctgat

SEQ ID NO: 7631106 - DNA, 22 bp, Homo sapiens
cagccacttgtgatgctgggga

SEQ ID NO: 7631107 - DNA, 22 bp, Homo sapiens
cagccacttgtgatgctgggga

SEQ ID NO: 7631108 - DNA, 22 bp, Homo sapiens
cagccacttgtgatgctgggga

SEQ ID NO: 7631109 - DNA, 22 bp, Homo sapiens
cagccacttcccctctatgggt

SEQ ID NO: 7631110 - DNA, 22 bp, Homo sapiens
cagccacttcgagcttcctgat

SEQ ID NO: 7631111 - DNA, 22 bp, Homo sapiens
cagccacttcgagcttcctgat

SEQ ID NO: 7631112 - DNA, 21 bp, Homo sapiens
cagcccagagcagtggggcca

SEQ ID NO: 7631113 - DNA, 21 bp, Homo sapiens
cagcccagagcagtggggcca

SEQ ID NO: 7631114 - DNA, 21 bp, Homo sapiens
cagcccagagcagtggggcca

SEQ ID NO: 7631115 - DNA, 21 bp, Homo sapiens
cagcccagagcagtggggcca

SEQ ID NO: 7631116 - DNA, 22 bp, Homo sapiens
cagccagtggttgaagatgcag

SEQ ID NO: 7631117 - DNA, 21 bp, Homo sapiens
cagcccagagcagtggggcca

SEQ ID NO: 7631118 - DNA, 22 bp, Homo sapiens
cagccaggttcaagtccttata

SEQ ID NO: 7631119 - DNA, 22 bp, Homo sapiens
gtattttactgctcaaagctct

SEQ ID NO: 7631120 - DNA, 22 bp, Homo sapiens
gtattttactgctcaaagctct

SEQ ID NO: 7631121 - DNA, 22 bp, Homo sapiens
gtattttactgctcaaagctct

SEQ ID NO: 7631122 - DNA, 22 bp, Homo sapiens
gtattttactgctcaaagctct

SEQ ID NO: 7631123 - DNA, 22 bp, Homo sapiens
cagcatgcctgggctgcctgcc

SEQ ID NO: 7631124 - DNA, 22 bp, Homo sapiens
cagcatgcctgggctgcctgcc

SEQ ID NO: 7631125 - DNA, 22 bp, Homo sapiens
cagcatgcctgggctgcctgcc

SEQ ID NO: 7631126 - DNA, 22 bp, Homo sapiens
cagcatgcctgggctgcctgcc

SEQ ID NO: 7631127 - DNA, 22 bp, Homo sapiens
cagcatgcccagactgagctaa

SEQ ID NO: 7631128 - DNA, 22 bp, Homo sapiens
gtattttacttacgcatgactt

SEQ ID NO: 7631129 - DNA, 22 bp, Homo sapiens
gtattttacttacgcatgactt

SEQ ID NO: 7631130 - DNA, 22 bp, Homo sapiens
gtattttacttacgcatgactt

SEQ ID NO: 7631131 - DNA, 22 bp, Homo sapiens
gtattttaagtgactactaggt

SEQ ID NO: 7631132 - DNA, 22 bp, Homo sapiens
gtattttaagtgactactaggt

SEQ ID NO: 7631133 - DNA, 22 bp, Homo sapiens
gtattttaagtgactactaggt

SEQ ID NO: 7631134 - DNA, 22 bp, Homo sapiens
gtattttactgctcaaagctct

SEQ ID NO: 7631135 - DNA, 22 bp, Homo sapiens
gtattttactgctcaaagctct

SEQ ID NO: 7631136 - DNA, 22 bp, Homo sapiens
gtattttactgctcaaagctct

SEQ ID NO: 7631137 - DNA, 22 bp, Homo sapiens
gtattttactgctcaaagctct

SEQ ID NO: 7631138 - DNA, 22 bp, Homo sapiens
gtattttaagtgactactaggt

SEQ ID NO: 7631139 - DNA, 22 bp, Homo sapiens
gtattttaagtgactactaggt

SEQ ID NO: 7631140 - DNA, 22 bp, Homo sapiens
gtattttaagtgactactaggt

SEQ ID NO: 7631141 - DNA, 22 bp, Homo sapiens
gtatttgtcttgttggtctcca

SEQ ID NO: 7631142 - DNA, 22 bp, Homo sapiens
gtatttgtagtagcatagaatt

SEQ ID NO: 7631143 - DNA, 22 bp, Homo sapiens
gtatttgtagtagcatagaatt

SEQ ID NO: 7631144 - DNA, 22 bp, Homo sapiens
gtatttgctcatacagtgatac

SEQ ID NO: 7631145 - DNA, 22 bp, Homo sapiens
gtatttgatcattagaatgatt

SEQ ID NO: 7631146 - DNA, 22 bp, Homo sapiens
gtatttgatagatttcaaagga

SEQ ID NO: 7631147 - DNA, 22 bp, Homo sapiens
gtatttgacaccagtgaatggt

SEQ ID NO: 7631148 - DNA, 22 bp, Homo sapiens
gtatttgatacatgaaatggtg

SEQ ID NO: 7631149 - DNA, 22 bp, Homo sapiens
gtatttgatagatttcaaagga

SEQ ID NO: 7631150 - DNA, 22 bp, Homo sapiens
gtatttgagggagaaaaggaag

SEQ ID NO: 7631151 - DNA, 22 bp, Homo sapiens
gtatttgagctttatgtatatt

SEQ ID NO: 7631152 - DNA, 22 bp, Homo sapiens
gtatttgagctttatgtatatt

SEQ ID NO: 7631153 - DNA, 22 bp, Homo sapiens
gtatttgatacatgaaatggtg

SEQ ID NO: 7631154 - DNA, 22 bp, Homo sapiens
cagcatttatcttgtagcagga

SEQ ID NO: 7631155 - DNA, 22 bp, Homo sapiens
cagcatttatcttgtagcagga

SEQ ID NO: 7631156 - DNA, 22 bp, Homo sapiens
cagcatttatcttgtagcagga

SEQ ID NO: 7631157 - DNA, 22 bp, Homo sapiens
cagcatttatcttgtagcagga

SEQ ID NO: 7631158 - DNA, 22 bp, Homo sapiens
cagcatttcaggaggctgaggt

SEQ ID NO: 7631159 - DNA, 22 bp, Homo sapiens
cagcatttcaggaggctgaggt

SEQ ID NO: 7631160 - DNA, 22 bp, Homo sapiens
cagcatttcaggaggctgaggt

SEQ ID NO: 7631161 - DNA, 22 bp, Homo sapiens
cagcattttccatagaaagaag

SEQ ID NO: 7631162 - DNA, 22 bp, Homo sapiens
cagcattttccatagaaagaag

SEQ ID NO: 7631163 - DNA, 22 bp, Homo sapiens
cagcatttggtgatcatcttaa

SEQ ID NO: 7631164 - DNA, 22 bp, Homo sapiens
cagcatttggtgatcatcttaa

SEQ ID NO: 7631165 - DNA, 22 bp, Homo sapiens
cagcatttggtgatcatcttaa

SEQ ID NO: 7631166 - DNA, 22 bp, Homo sapiens
cagcatttggaggagaggcttt

SEQ ID NO: 7631167 - DNA, 22 bp, Homo sapiens
cagcatgcttgggggagggagc

SEQ ID NO: 7631168 - DNA, 22 bp, Homo sapiens
cagcatgcttgggggagggagc

SEQ ID NO: 7631169 - DNA, 22 bp, Homo sapiens
cagcatgcttgggggagggagc

SEQ ID NO: 7631170 - DNA, 22 bp, Homo sapiens
cagcatgcttgggggagggagc

SEQ ID NO: 7631171 - DNA, 22 bp, Homo sapiens
cagcattgatcccaggctgtgg

SEQ ID NO: 7631172 - DNA, 22 bp, Homo sapiens
cagcattgagcacagaaggaaa

SEQ ID NO: 7631173 - DNA, 22 bp, Homo sapiens
cagcattctactttgtgaactg

SEQ ID NO: 7631174 - DNA, 22 bp, Homo sapiens
cagcattctactttgtgaactg

SEQ ID NO: 7631175 - DNA, 18 bp, Homo sapiens
cagcattagcagcttcca

SEQ ID NO: 7631176 - DNA, 22 bp, Homo sapiens
cagcattgtaagaatgaagacc

SEQ ID NO: 7631177 - DNA, 22 bp, Homo sapiens
cagcattgatcccaggctgtgg

SEQ ID NO: 7631178 - DNA, 22 bp, Homo sapiens
cagcatttagaatttgaagtgt

SEQ ID NO: 7631179 - DNA, 22 bp, Homo sapiens
cagcatttagaatttgaagtgt

SEQ ID NO: 7631180 - DNA, 22 bp, Homo sapiens
cagcatttagaatttgaagtgt

SEQ ID NO: 7631181 - DNA, 22 bp, Homo sapiens
cagcatttaatgcagtgcttcc

SEQ ID NO: 7631182 - DNA, 22 bp, Homo sapiens
cagcatttaatgcagtgcttcc

SEQ ID NO: 7631183 - DNA, 22 bp, Homo sapiens
cagcatttaatgcagtgcttcc

SEQ ID NO: 7631184 - DNA, 21 bp, Homo sapiens
cagcccagcccattgacagtg

SEQ ID NO: 7631185 - DNA, 21 bp, Homo sapiens
cagcccagcccattgacagtg

SEQ ID NO: 7631186 - DNA, 21 bp, Homo sapiens
cagcccagcccattgacagtg

SEQ ID NO: 7631187 - DNA, 21 bp, Homo sapiens
cagcccagcccattgacagtg

SEQ ID NO: 7631188 - DNA, 21 bp, Homo sapiens
cagcccagcccattgacagtg

SEQ ID NO: 7631189 - DNA, 21 bp, Homo sapiens
cagcccagcccattgacagtg

SEQ ID NO: 7631190 - DNA, 22 bp, Homo sapiens
cagcccagcagtcttagcctgc

SEQ ID NO: 7631191 - DNA, 22 bp, Homo sapiens
cagcccagcagtcttagcctgc

SEQ ID NO: 7631192 - DNA, 22 bp, Homo sapiens
cagcccagcagtcttagcctgc

SEQ ID NO: 7631193 - DNA, 22 bp, Homo sapiens
cagcccagcagtcttagcctgc

SEQ ID NO: 7631194 - DNA, 22 bp, Homo sapiens
cagcccagcagtcttagcctgc

SEQ ID NO: 7631195 - DNA, 22 bp, Homo sapiens
cagcccagcagactgttaccac

SEQ ID NO: 7631196 - DNA, 22 bp, Homo sapiens
cagcccagcagggtctggccct

SEQ ID NO: 7631197 - DNA, 22 bp, Homo sapiens
cagcccagcagggtctggccct

SEQ ID NO: 7631198 - DNA, 22 bp, Homo sapiens
cagcccagcagggtctggccct

SEQ ID NO: 7631199 - DNA, 22 bp, Homo sapiens
cagcccagcagggtctggccct

SEQ ID NO: 7631200 - DNA, 22 bp, Homo sapiens
cagcccagcagggtctggccct

SEQ ID NO: 7631201 - DNA, 22 bp, Homo sapiens
cagcccagcagggtctggccct

SEQ ID NO: 7631202 - DNA, 22 bp, Homo sapiens
cagcccagcagggtctggccct

SEQ ID NO: 7631203 - DNA, 22 bp, Homo sapiens
cagcccagcagggtctggccct

SEQ ID NO: 7631204 - DNA, 22 bp, Homo sapiens
cagcccagcagggtctggccct

SEQ ID NO: 7631205 - DNA, 22 bp, Homo sapiens
cagcccagcagggtctggccct

SEQ ID NO: 7631206 - DNA, 22 bp, Homo sapiens
cagcccagcagggtctggccct

SEQ ID NO: 7631207 - DNA, 22 bp, Homo sapiens
cagcccagcactaagtagattt

SEQ ID NO: 7631208 - DNA, 22 bp, Homo sapiens
cagcccagcactaagtagattt

SEQ ID NO: 7631209 - DNA, 22 bp, Homo sapiens
cagcccagcactaagtagattt

SEQ ID NO: 7631210 - DNA, 22 bp, Homo sapiens
cagcccagcactaagtagattt

SEQ ID NO: 7631211 - DNA, 22 bp, Homo sapiens
cagcccagcagggtctggccct

SEQ ID NO: 7631212 - DNA, 22 bp, Homo sapiens
cagcccagcagactgttaccac

SEQ ID NO: 7631213 - DNA, 22 bp, Homo sapiens
cagcccagcagactgttaccac

SEQ ID NO: 7631214 - DNA, 22 bp, Homo sapiens
cagcccagcagactgttaccac

SEQ ID NO: 7631215 - DNA, 22 bp, Homo sapiens
cagcccagcagactgttaccac

SEQ ID NO: 7631216 - DNA, 22 bp, Homo sapiens
cagcccagcactaagtagattt

SEQ ID NO: 7631217 - DNA, 22 bp, Homo sapiens
cagcccagcactaagtagattt

SEQ ID NO: 7631218 - DNA, 22 bp, Homo sapiens
cagcccagcactaagtagattt

SEQ ID NO: 7631219 - DNA, 22 bp, Homo sapiens
cagcccagcactaagtagattt

SEQ ID NO: 7631220 - DNA, 22 bp, Homo sapiens
cagcccagagccagttcccgct

SEQ ID NO: 7631221 - DNA, 22 bp, Homo sapiens
cagcccagagccagttcccgct

SEQ ID NO: 7631222 - DNA, 22 bp, Homo sapiens
cagcccagagccagttcccgct

SEQ ID NO: 7631223 - DNA, 22 bp, Homo sapiens
cagcccagagccagttcccgct

SEQ ID NO: 7631224 - DNA, 22 bp, Homo sapiens
cagcccagagccagttcccgct

SEQ ID NO: 7631225 - DNA, 22 bp, Homo sapiens
cagcccagagccagttcccgct

SEQ ID NO: 7631226 - DNA, 22 bp, Homo sapiens
cagcccagagccagttcccgct

SEQ ID NO: 7631227 - DNA, 22 bp, Homo sapiens
cagcccagagccagttcccgct

SEQ ID NO: 7631228 - DNA, 22 bp, Homo sapiens
cagcccagagccagttcccgct

SEQ ID NO: 7631229 - DNA, 21 bp, Homo sapiens
cagcccagcccattgacagtg

SEQ ID NO: 7631230 - DNA, 21 bp, Homo sapiens
cagcccagcccattgacagtg

SEQ ID NO: 7631231 - DNA, 21 bp, Homo sapiens
cagcccagcccattgacagtg

SEQ ID NO: 7631232 - DNA, 21 bp, Homo sapiens
cagcccagcccattgacagtg

SEQ ID NO: 7631233 - DNA, 22 bp, Homo sapiens
ggggaaagtgaattgtgtagtg

SEQ ID NO: 7631234 - DNA, 22 bp, Homo sapiens
ggggaaattgtggctgacagtg

SEQ ID NO: 7631235 - DNA, 22 bp, Homo sapiens
ggggaacaccgggcagaggcgc

SEQ ID NO: 7631236 - DNA, 22 bp, Homo sapiens
ggggaacaccgggcagaggcgc

SEQ ID NO: 7631237 - DNA, 20 bp, Homo sapiens
ggggaagaaaaggatgtgat

SEQ ID NO: 7631238 - DNA, 20 bp, Homo sapiens
ggggaagaaaaggatgtgat

SEQ ID NO: 7631239 - DNA, 20 bp, Homo sapiens
ggggaagaaaaggatgtgat

SEQ ID NO: 7631240 - DNA, 20 bp, Homo sapiens
ggggaagaaaaggatgtgat

SEQ ID NO: 7631241 - DNA, 20 bp, Homo sapiens
ggggaagaaaaggatgtgat

SEQ ID NO: 7631242 - DNA, 22 bp, Homo sapiens
ggggaaaggccatggcaagaac

SEQ ID NO: 7631243 - DNA, 22 bp, Homo sapiens
ggggaaaggccatggcaagaac

SEQ ID NO: 7631244 - DNA, 22 bp, Homo sapiens
ggggaaaggccatggcaagaac

SEQ ID NO: 7631245 - DNA, 22 bp, Homo sapiens
ggggaaaggccatggcaagaac

SEQ ID NO: 7631246 - DNA, 22 bp, Homo sapiens
ggggaaaggccatggcaagaac

SEQ ID NO: 7631247 - DNA, 22 bp, Homo sapiens
ggggaaagtgaattgtgtagtg

SEQ ID NO: 7631248 - DNA, 22 bp, Homo sapiens
ggggaaagtgaattgtgtagtg

SEQ ID NO: 7631249 - DNA, 21 bp, Homo sapiens
gggctttttatttagcactgt

SEQ ID NO: 7631250 - DNA, 18 bp, Homo sapiens
ggggaaaagccaggtgtc

SEQ ID NO: 7631251 - DNA, 22 bp, Homo sapiens
gggctttttacattgaacattt

SEQ ID NO: 7631252 - DNA, 22 bp, Homo sapiens
gggctgtgtatcagttatctat

SEQ ID NO: 7631253 - DNA, 22 bp, Homo sapiens
gggctgtgtactatgaggaggg

SEQ ID NO: 7631254 - DNA, 23 bp, Homo sapiens
ggggaaagaccatgcttgaggac

SEQ ID NO: 7631255 - DNA, 23 bp, Homo sapiens
ggggaaagaccatgcttgaggac

SEQ ID NO: 7631256 - DNA, 23 bp, Homo sapiens
ggggaaagaccatgcttgaggac

SEQ ID NO: 7631257 - DNA, 23 bp, Homo sapiens
ggggaaagaccatgcttgaggac

SEQ ID NO: 7631258 - DNA, 22 bp, Homo sapiens
ggggaaactgaggcacagacag

SEQ ID NO: 7631259 - DNA, 22 bp, Homo sapiens
ggggaaacatgttgttcagacc

SEQ ID NO: 7631260 - DNA, 22 bp, Homo sapiens
ggggaaagccagccctgcttcc

SEQ ID NO: 7631261 - DNA, 23 bp, Homo sapiens
ggggaaagaccatgcttgaggac

SEQ ID NO: 7631262 - DNA, 23 bp, Homo sapiens
ggggaaagaccatgcttgaggac

SEQ ID NO: 7631263 - DNA, 22 bp, Homo sapiens
cagagctgctcatggtggccag

SEQ ID NO: 7631264 - DNA, 22 bp, Homo sapiens
cagagctgctcatggtggccag

SEQ ID NO: 7631265 - DNA, 22 bp, Homo sapiens
cagagctgctcatggtggccag

SEQ ID NO: 7631266 - DNA, 19 bp, Homo sapiens
cagagctgctggcctcgtc

SEQ ID NO: 7631267 - DNA, 19 bp, Homo sapiens
cagagctgctggcctcgtc

SEQ ID NO: 7631268 - DNA, 19 bp, Homo sapiens
cagagctgctggcctcgtc

SEQ ID NO: 7631269 - DNA, 19 bp, Homo sapiens
cagagctgctggcctcgtc

SEQ ID NO: 7631270 - DNA, 22 bp, Homo sapiens
cagagctgctcatggtggccag

SEQ ID NO: 7631271 - DNA, 22 bp, Homo sapiens
gggctgtgtactatgaggaggg

SEQ ID NO: 7631272 - DNA, 19 bp, Homo sapiens
cagagctgctggcctcgtc

SEQ ID NO: 7631273 - DNA, 19 bp, Homo sapiens
cagagctgctggcctcgtc

SEQ ID NO: 7631274 - DNA, 19 bp, Homo sapiens
cagagctgctggcctcgtc

SEQ ID NO: 7631275 - DNA, 19 bp, Homo sapiens
cagagctgctggcctcgtc

SEQ ID NO: 7631276 - DNA, 22 bp, Homo sapiens
cagagctgcgctttttcctggt

SEQ ID NO: 7631277 - DNA, 22 bp, Homo sapiens
cagagctgcgctttttcctggt

SEQ ID NO: 7631278 - DNA, 22 bp, Homo sapiens
cagagctgctcatggtggccag

SEQ ID NO: 7631279 - DNA, 22 bp, Homo sapiens
cagagctgctcatggtggccag

SEQ ID NO: 7631280 - DNA, 22 bp, Homo sapiens
cagagctgcgctttttcctggt

SEQ ID NO: 7631281 - DNA, 22 bp, Homo sapiens
cagagctgcgctttttcctggt

SEQ ID NO: 7631282 - DNA, 22 bp, Homo sapiens
cagagctgcgctttttcctggt

SEQ ID NO: 7631283 - DNA, 22 bp, Homo sapiens
cagagctgcagattgaaggcat

SEQ ID NO: 7631284 - DNA, 22 bp, Homo sapiens
cagagctgcagattgaaggcat

SEQ ID NO: 7631285 - DNA, 22 bp, Homo sapiens
cagagctgcagattgaaggcat

SEQ ID NO: 7631286 - DNA, 22 bp, Homo sapiens
cagagctgcagattgaaggcat

SEQ ID NO: 7631287 - DNA, 22 bp, Homo sapiens
cagagctgcagattgaaggcat

SEQ ID NO: 7631288 - DNA, 22 bp, Homo sapiens
gggcgcatcacctgaggtcagg

SEQ ID NO: 7631289 - DNA, 22 bp, Homo sapiens
gggcgcatcacctgaggtcagg

SEQ ID NO: 7631290 - DNA, 22 bp, Homo sapiens
gggcgcatcacctgaggtcagg

SEQ ID NO: 7631291 - DNA, 22 bp, Homo sapiens
gggcgcatcacctgaggtcagg

SEQ ID NO: 7631292 - DNA, 22 bp, Homo sapiens
gggcgcagccaatcctggccct

SEQ ID NO: 7631293 - DNA, 22 bp, Homo sapiens
gggcgcagccaatcctggccct

SEQ ID NO: 7631294 - DNA, 22 bp, Homo sapiens
gggcgcagccaatcctggccct

SEQ ID NO: 7631295 - DNA, 22 bp, Homo sapiens
gggcgcagccaatcctggccct

SEQ ID NO: 7631296 - DNA, 22 bp, Homo sapiens
cagagcctgctgccttctgaag

SEQ ID NO: 7631297 - DNA, 22 bp, Homo sapiens
cagagcctgctgccttctgaag

SEQ ID NO: 7631298 - DNA, 22 bp, Homo sapiens
gggcgccgtgggaaacagccgg

SEQ ID NO: 7631299 - DNA, 22 bp, Homo sapiens
gggcgccgtgggaaacagccgg

SEQ ID NO: 7631300 - DNA, 22 bp, Homo sapiens
gggcgccgtgggaaacagccgg

SEQ ID NO: 7631301 - DNA, 22 bp, Homo sapiens
cagagcctgctcacgtctctgt

SEQ ID NO: 7631302 - DNA, 22 bp, Homo sapiens
gggcgccgtgggaaacagccgg

SEQ ID NO: 7631303 - DNA, 22 bp, Homo sapiens
cagagctgagaatgttgatgct

SEQ ID NO: 7631304 - DNA, 22 bp, Homo sapiens
cagagctgagaatgttgatgct

SEQ ID NO: 7631305 - DNA, 22 bp, Homo sapiens
cagagctgacccaaggattgaa

SEQ ID NO: 7631306 - DNA, 22 bp, Homo sapiens
cagagctgacccaaggattgaa

SEQ ID NO: 7631307 - DNA, 22 bp, Homo sapiens
cagagctgacccaaggattgaa

SEQ ID NO: 7631308 - DNA, 22 bp, Homo sapiens
cagagctgacccaaggattgaa

SEQ ID NO: 7631309 - DNA, 22 bp, Homo sapiens
cagagctgacccaaggattgaa

SEQ ID NO: 7631310 - DNA, 21 bp, Homo sapiens
cagagctgaagggtgtagtgt

SEQ ID NO: 7631311 - DNA, 21 bp, Homo sapiens
cagagctgaagggtgtagtgt

SEQ ID NO: 7631312 - DNA, 21 bp, Homo sapiens
cagagctctttctgcttgctg

SEQ ID NO: 7631313 - DNA, 21 bp, Homo sapiens
cagagctctttctgcttgctg

SEQ ID NO: 7631314 - DNA, 21 bp, Homo sapiens
cagagctgaagggtgtagtgt

SEQ ID NO: 7631315 - DNA, 21 bp, Homo sapiens
cagagctgaagggtgtagtgt

SEQ ID NO: 7631316 - DNA, 21 bp, Homo sapiens
cagagctgaagggtgtagtgt

SEQ ID NO: 7631317 - DNA, 22 bp, Homo sapiens
cagagctgcagattgaaggcat

SEQ ID NO: 7631318 - DNA, 22 bp, Homo sapiens
cagagctgcagattgaaggcat

SEQ ID NO: 7631319 - DNA, 22 bp, Homo sapiens
cagagctgcagattgaaggcat

SEQ ID NO: 7631320 - DNA, 22 bp, Homo sapiens
cagagctgcacattctatgatg

SEQ ID NO: 7631321 - DNA, 22 bp, Homo sapiens
cagagctgcacattctatgatg

SEQ ID NO: 7631322 - DNA, 22 bp, Homo sapiens
cagagctgcacattctatgatg

SEQ ID NO: 7631323 - DNA, 22 bp, Homo sapiens
cagagctgcacattctatgatg

SEQ ID NO: 7631324 - DNA, 22 bp, Homo sapiens
cagagctgcacattctatgatg

SEQ ID NO: 7631325 - DNA, 22 bp, Homo sapiens
cagagctgcacattctatgatg

SEQ ID NO: 7631326 - DNA, 22 bp, Homo sapiens
cagagctgcaaatgcccctccg

SEQ ID NO: 7631327 - DNA, 22 bp, Homo sapiens
cagagctgcaaatgcccctccg

SEQ ID NO: 7631328 - DNA, 22 bp, Homo sapiens
cagagctgcaaatgcccctccg

SEQ ID NO: 7631329 - DNA, 22 bp, Homo sapiens
cagagctgcaaatgcccctccg

SEQ ID NO: 7631330 - DNA, 22 bp, Homo sapiens
cagagctgagtcttcaaggttg

SEQ ID NO: 7631331 - DNA, 22 bp, Homo sapiens
cagagctgagaatgttgatgct

SEQ ID NO: 7631332 - DNA, 22 bp, Homo sapiens
cagagctgagaatgttgatgct

SEQ ID NO: 7631333 - DNA, 22 bp, Homo sapiens
cagagctgagaatgttgatgct

SEQ ID NO: 7631334 - DNA, 22 bp, Homo sapiens
cagagctgagtcttcaaggttg

SEQ ID NO: 7631335 - DNA, 22 bp, Homo sapiens
cagagctgagtcttcaaggttg

SEQ ID NO: 7631336 - DNA, 22 bp, Homo sapiens
cagagctgagtcttcaaggttg

SEQ ID NO: 7631337 - DNA, 22 bp, Homo sapiens
cagagctgagtcttcaaggttg

SEQ ID NO: 7631338 - DNA, 22 bp, Homo sapiens
cagagctgattggatccagaga

SEQ ID NO: 7631339 - DNA, 22 bp, Homo sapiens
cagagctgattggatccagaga

SEQ ID NO: 7631340 - DNA, 22 bp, Homo sapiens
cagagctgattggatccagaga

SEQ ID NO: 7631341 - DNA, 23 bp, Homo sapiens
cagagctgattaaacttaatctc

SEQ ID NO: 7631342 - DNA, 22 bp, Homo sapiens
cagagctgattggatccagaga

SEQ ID NO: 7631343 - DNA, 23 bp, Homo sapiens
cagagctgattaaacttaatctc

SEQ ID NO: 7631344 - DNA, 23 bp, Homo sapiens
cagagctgattaaacttaatctc

SEQ ID NO: 7631345 - DNA, 22 bp, Homo sapiens
cagagcccatcctatactctcc

SEQ ID NO: 7631346 - DNA, 22 bp, Homo sapiens
cagagcccatcctatactctcc

SEQ ID NO: 7631347 - DNA, 22 bp, Homo sapiens
cagagcccagggcctacgtccc

SEQ ID NO: 7631348 - DNA, 22 bp, Homo sapiens
cagagcccatcctatactctcc

SEQ ID NO: 7631349 - DNA, 22 bp, Homo sapiens
cagagcccatcctatactctcc

SEQ ID NO: 7631350 - DNA, 22 bp, Homo sapiens
cagagcccagggcctacgtccc

SEQ ID NO: 7631351 - DNA, 22 bp, Homo sapiens
cagagcccatggcacatgtgga

SEQ ID NO: 7631352 - DNA, 22 bp, Homo sapiens
cagagcccagggcctacgtccc

SEQ ID NO: 7631353 - DNA, 22 bp, Homo sapiens
cagagcccatcctatactctcc

SEQ ID NO: 7631354 - DNA, 22 bp, Homo sapiens
cagagcccatggcacatgtgga

SEQ ID NO: 7631355 - DNA, 22 bp, Homo sapiens
cagagccccccttctgatcaca

SEQ ID NO: 7631356 - DNA, 22 bp, Homo sapiens
cagagcccatggcacatgtgga

SEQ ID NO: 7631357 - DNA, 22 bp, Homo sapiens
cagagcccatttctttgttcct

SEQ ID NO: 7631358 - DNA, 22 bp, Homo sapiens
cagagcccagggcctacgtccc

SEQ ID NO: 7631359 - DNA, 22 bp, Homo sapiens
cagagccaggcctgccctcttt

SEQ ID NO: 7631360 - DNA, 22 bp, Homo sapiens
cagagccagctgtccttggcat

SEQ ID NO: 7631361 - DNA, 22 bp, Homo sapiens
gggcagagaaatggacagttgg

SEQ ID NO: 7631362 - DNA, 22 bp, Homo sapiens
gggcagaatttgtagatgacat

SEQ ID NO: 7631363 - DNA, 22 bp, Homo sapiens
gggcagaatttgtagatgacat

SEQ ID NO: 7631364 - DNA, 22 bp, Homo sapiens
gggcagagaaatggacagttgg

SEQ ID NO: 7631365 - DNA, 22 bp, Homo sapiens
gggcagagaaatggacagttgg

SEQ ID NO: 7631366 - DNA, 22 bp, Homo sapiens
gggcagagaaatggacagttgg

SEQ ID NO: 7631367 - DNA, 22 bp, Homo sapiens
gggcagactggttatacacggg

SEQ ID NO: 7631368 - DNA, 22 bp, Homo sapiens
gggcagagaaatggacagttgg

SEQ ID NO: 7631369 - DNA, 22 bp, Homo sapiens
gggcagagaaatggacagttgg

SEQ ID NO: 7631370 - DNA, 22 bp, Homo sapiens
gggcagagaaatggacagttgg

SEQ ID NO: 7631371 - DNA, 22 bp, Homo sapiens
gggcagagaaatggacagttgg

SEQ ID NO: 7631372 - DNA, 22 bp, Homo sapiens
gggcagaatttgtagatgacat

SEQ ID NO: 7631373 - DNA, 22 bp, Homo sapiens
gggcagaatttgtagatgacat

SEQ ID NO: 7631374 - DNA, 19 bp, Homo sapiens
gggcagaatggcatctcag

SEQ ID NO: 7631375 - DNA, 22 bp, Homo sapiens
gggcactttgtgcctcactgtg

SEQ ID NO: 7631376 - DNA, 22 bp, Homo sapiens
gggcactttgtgcctcactgtg

SEQ ID NO: 7631377 - DNA, 22 bp, Homo sapiens
gggcacttgtgttcttcacttt

SEQ ID NO: 7631378 - DNA, 19 bp, Homo sapiens
gggcagaatggcatctcag

SEQ ID NO: 7631379 - DNA, 22 bp, Homo sapiens
gggcacttactgccaaggcgag

SEQ ID NO: 7631380 - DNA, 22 bp, Homo sapiens
gggcactgtgttcagagtgcag

SEQ ID NO: 7631381 - DNA, 22 bp, Homo sapiens
gggcactgtgttcagagtgcag

SEQ ID NO: 7631382 - DNA, 22 bp, Homo sapiens
gggcactgtgttcagagtgcag

SEQ ID NO: 7631383 - DNA, 22 bp, Homo sapiens
gggcactgtgttcagagtgcag

SEQ ID NO: 7631384 - DNA, 22 bp, Homo sapiens
gggcactgtgttcagagtgcag

SEQ ID NO: 7631385 - DNA, 22 bp, Homo sapiens
gggcactgtgttcagagtgcag

SEQ ID NO: 7631386 - DNA, 22 bp, Homo sapiens
gggcactgtggggcccatgctg

SEQ ID NO: 7631387 - DNA, 22 bp, Homo sapiens
gggcactgtggggcccatgctg

SEQ ID NO: 7631388 - DNA, 22 bp, Homo sapiens
gggcactgtggggcccatgctg

SEQ ID NO: 7631389 - DNA, 22 bp, Homo sapiens
gggcactgtgctgggtgcttta

SEQ ID NO: 7631390 - DNA, 22 bp, Homo sapiens
gggcactgtgctgggtgcttta

SEQ ID NO: 7631391 - DNA, 22 bp, Homo sapiens
gggcactgtgctgggtgcttta

SEQ ID NO: 7631392 - DNA, 22 bp, Homo sapiens
gggcactgtgctgggtgcttta

SEQ ID NO: 7631393 - DNA, 22 bp, Homo sapiens
gggcactgtgctgggtgcttta

SEQ ID NO: 7631394 - DNA, 22 bp, Homo sapiens
gggcactgtgctgggtgcttta

SEQ ID NO: 7631395 - DNA, 22 bp, Homo sapiens
gggcactgtgctgggtgcttta

SEQ ID NO: 7631396 - DNA, 22 bp, Homo sapiens
gggcactgtggggcccatgctg

SEQ ID NO: 7631397 - DNA, 22 bp, Homo sapiens
gggcacagagggtcttgaagaa

SEQ ID NO: 7631398 - DNA, 22 bp, Homo sapiens
gggcacagcccagtggggtccc

SEQ ID NO: 7631399 - DNA, 22 bp, Homo sapiens
gggcacagcccagtggggtccc

SEQ ID NO: 7631400 - DNA, 22 bp, Homo sapiens
gggcacagcccagtggggtccc

SEQ ID NO: 7631401 - DNA, 22 bp, Homo sapiens
gggcacagagggtcttgaagaa

SEQ ID NO: 7631402 - DNA, 22 bp, Homo sapiens
gggcacagagggtcttgaagaa

SEQ ID NO: 7631403 - DNA, 22 bp, Homo sapiens
gggcacagagggtcttgaagaa

SEQ ID NO: 7631404 - DNA, 22 bp, Homo sapiens
gggcacagagggtcttgaagaa

SEQ ID NO: 7631405 - DNA, 22 bp, Homo sapiens
gggcacagagggtcttgaagaa

SEQ ID NO: 7631406 - DNA, 22 bp, Homo sapiens
gggcacagagggtcttgaagaa

SEQ ID NO: 7631407 - DNA, 22 bp, Homo sapiens
gggcacagagggtcttgaagaa

SEQ ID NO: 7631408 - DNA, 22 bp, Homo sapiens
gggcacagagaaggttttagtg

SEQ ID NO: 7631409 - DNA, 22 bp, Homo sapiens
gggcacagagaaggttttagtg

SEQ ID NO: 7631410 - DNA, 22 bp, Homo sapiens
gggcacagaagtctaagacatc

SEQ ID NO: 7631411 - DNA, 22 bp, Homo sapiens
gggcacagagaaggttttagtg

SEQ ID NO: 7631412 - DNA, 22 bp, Homo sapiens
gggcacagaagtctaagacatc

SEQ ID NO: 7631413 - DNA, 22 bp, Homo sapiens
gggcacaaaatttcagaaagct

SEQ ID NO: 7631414 - DNA, 22 bp, Homo sapiens
gggcacagaagtctaagacatc

SEQ ID NO: 7631415 - DNA, 22 bp, Homo sapiens
gggccttcagccttggactgag

SEQ ID NO: 7631416 - DNA, 22 bp, Homo sapiens
gggccttccgactcccaaggcc

SEQ ID NO: 7631417 - DNA, 22 bp, Homo sapiens
cagagcccttcctcccacgggg

SEQ ID NO: 7631418 - DNA, 22 bp, Homo sapiens
cagagcccttggctggagccca

SEQ ID NO: 7631419 - DNA, 22 bp, Homo sapiens
cagagcccttcctcccacgggg

SEQ ID NO: 7631420 - DNA, 22 bp, Homo sapiens
gggccttctagttagccccaat

SEQ ID NO: 7631421 - DNA, 22 bp, Homo sapiens
gggccttctagttagccccaat

SEQ ID NO: 7631422 - DNA, 22 bp, Homo sapiens
gggccttgccatggagcctgag

SEQ ID NO: 7631423 - DNA, 22 bp, Homo sapiens
gggccttgccatggagcctgag

SEQ ID NO: 7631424 - DNA, 22 bp, Homo sapiens
gggccttgccatggagcctgag

SEQ ID NO: 7631425 - DNA, 21 bp, Homo sapiens
gggccttgagtgtgcggtggg

SEQ ID NO: 7631426 - DNA, 22 bp, Homo sapiens
gggccttgatcccctatatggc

SEQ ID NO: 7631427 - DNA, 22 bp, Homo sapiens
gggcgaggactgactctgggca

SEQ ID NO: 7631428 - DNA, 22 bp, Homo sapiens
gggcgaggactgactctgggca

SEQ ID NO: 7631429 - DNA, 22 bp, Homo sapiens
gggcgaggactgactctgggca

SEQ ID NO: 7631430 - DNA, 22 bp, Homo sapiens
gggcgaggactgactctgggca

SEQ ID NO: 7631431 - DNA, 22 bp, Homo sapiens
gggccttggcgaagtgtggtgg

SEQ ID NO: 7631432 - DNA, 22 bp, Homo sapiens
gggcgaggactgactctgggca

SEQ ID NO: 7631433 - DNA, 22 bp, Homo sapiens
gggcgagggcgaaagcgagagc

SEQ ID NO: 7631434 - DNA, 22 bp, Homo sapiens
gggcgagggcgaaagcgagagc

SEQ ID NO: 7631435 - DNA, 22 bp, Homo sapiens
gggcgagggcgaaagcgagagc

SEQ ID NO: 7631436 - DNA, 22 bp, Homo sapiens
gggcgagggcgaaagcgagagc

SEQ ID NO: 7631437 - DNA, 22 bp, Homo sapiens
gggcgagggcgaaagcgagagc

SEQ ID NO: 7631438 - DNA, 22 bp, Homo sapiens
gggcgagggcgaaagcgagagc

SEQ ID NO: 7631439 - DNA, 22 bp, Homo sapiens
gggcgagggcgaaagcgagagc

SEQ ID NO: 7631440 - DNA, 21 bp, Homo sapiens
gggcgaggcctgatgtggctc

SEQ ID NO: 7631441 - DNA, 22 bp, Homo sapiens
gggcgaggactgactctgggca

SEQ ID NO: 7631442 - DNA, 21 bp, Homo sapiens
gggcgaggcctgatgtggctc

SEQ ID NO: 7631443 - DNA, 21 bp, Homo sapiens
gggcgaggcctgatgtggctc

SEQ ID NO: 7631444 - DNA, 21 bp, Homo sapiens
gggcgaggcctgatgtggctc

SEQ ID NO: 7631445 - DNA, 21 bp, Homo sapiens
gggcgaggcctgatgtggctc

SEQ ID NO: 7631446 - DNA, 21 bp, Homo sapiens
gggcgaggcctgatgtggctc

SEQ ID NO: 7631447 - DNA, 22 bp, Homo sapiens
gggcgagggcgaaagcgagagc

SEQ ID NO: 7631448 - DNA, 22 bp, Homo sapiens
gggcgagggcgaaagcgagagc

SEQ ID NO: 7631449 - DNA, 22 bp, Homo sapiens
gggcgagggcgaaagcgagagc

SEQ ID NO: 7631450 - DNA, 22 bp, Homo sapiens
gggcgagggcgaaagcgagagc

SEQ ID NO: 7631451 - DNA, 22 bp, Homo sapiens
cagagccctcaaggccgatgca

SEQ ID NO: 7631452 - DNA, 22 bp, Homo sapiens
cagagccctcaaggccgatgca

SEQ ID NO: 7631453 - DNA, 22 bp, Homo sapiens
cagagccctagtcctgatggcc

SEQ ID NO: 7631454 - DNA, 22 bp, Homo sapiens
cagagccctgcatgctccatct

SEQ ID NO: 7631455 - DNA, 22 bp, Homo sapiens
cagagccctcaaggccgatgca

SEQ ID NO: 7631456 - DNA, 22 bp, Homo sapiens
cagagccctgcatgctccatct

SEQ ID NO: 7631457 - DNA, 22 bp, Homo sapiens
cagagccctgcatgctccatct

SEQ ID NO: 7631458 - DNA, 22 bp, Homo sapiens
cagagccctccgctccccggct

SEQ ID NO: 7631459 - DNA, 22 bp, Homo sapiens
cagagccctcaaggccgatgca

SEQ ID NO: 7631460 - DNA, 22 bp, Homo sapiens
cagagccctccgctccccggct

SEQ ID NO: 7631461 - DNA, 22 bp, Homo sapiens
cagagccctccgctccccggct

SEQ ID NO: 7631462 - DNA, 22 bp, Homo sapiens
cagagccctgggcacatggtag

SEQ ID NO: 7631463 - DNA, 22 bp, Homo sapiens
cagagccctgggcacatggtag

SEQ ID NO: 7631464 - DNA, 22 bp, Homo sapiens
cagagccctgggcacatggtag

SEQ ID NO: 7631465 - DNA, 22 bp, Homo sapiens
cagagccctgtgtgccatgtga

SEQ ID NO: 7631466 - DNA, 22 bp, Homo sapiens
cagagccctgtgtgccatgtga

SEQ ID NO: 7631467 - DNA, 22 bp, Homo sapiens
cagagccctgtgtgccatgtga

SEQ ID NO: 7631468 - DNA, 22 bp, Homo sapiens
cagagccctgtgtgccatgtga

SEQ ID NO: 7631469 - DNA, 22 bp, Homo sapiens
cagagccccccttctgatcaca

SEQ ID NO: 7631470 - DNA, 22 bp, Homo sapiens
cagagccccccttctgatcaca

SEQ ID NO: 7631471 - DNA, 22 bp, Homo sapiens
cagagccccccttctgatcaca

SEQ ID NO: 7631472 - DNA, 22 bp, Homo sapiens
cagagcccctcagctctctccc

SEQ ID NO: 7631473 - DNA, 22 bp, Homo sapiens
cagagcccctcagctctctccc

SEQ ID NO: 7631474 - DNA, 22 bp, Homo sapiens
cagagcccctcagctctctccc

SEQ ID NO: 7631475 - DNA, 22 bp, Homo sapiens
cagagcccctcagctctctccc

SEQ ID NO: 7631476 - DNA, 22 bp, Homo sapiens
cagagccctagtcctgatggcc

SEQ ID NO: 7631477 - DNA, 22 bp, Homo sapiens
cagagccctagtcctgatggcc

SEQ ID NO: 7631478 - DNA, 22 bp, Homo sapiens
cagagccctagtcctgatggcc

SEQ ID NO: 7631479 - DNA, 22 bp, Homo sapiens
cagagccctagtcctgatggcc

SEQ ID NO: 7631480 - DNA, 22 bp, Homo sapiens
cagagccctagtcctgatggcc

SEQ ID NO: 7631481 - DNA, 22 bp, Homo sapiens
cagagcccctgggttgggagct

SEQ ID NO: 7631482 - DNA, 22 bp, Homo sapiens
cagagcccctgggttgggagct

SEQ ID NO: 7631483 - DNA, 22 bp, Homo sapiens
cagagcccctgggttgggagct

SEQ ID NO: 7631484 - DNA, 22 bp, Homo sapiens
cagagcccctgggttgggagct

SEQ ID NO: 7631485 - DNA, 22 bp, Homo sapiens
cagagcccctcgtctccaccac

SEQ ID NO: 7631486 - DNA, 20 bp, Homo sapiens
cagaggcattttcagactct

SEQ ID NO: 7631487 - DNA, 21 bp, Homo sapiens
cagaggcaggctctgtgtgtg

SEQ ID NO: 7631488 - DNA, 21 bp, Homo sapiens
cagaggcaggctctgtgtgtg

SEQ ID NO: 7631489 - DNA, 20 bp, Homo sapiens
cagaggcattttcagactct

SEQ ID NO: 7631490 - DNA, 21 bp, Homo sapiens
cagaggcaggctctgtgtgtg

SEQ ID NO: 7631491 - DNA, 21 bp, Homo sapiens
cagaggcaggctctgtgtgtg

SEQ ID NO: 7631492 - DNA, 21 bp, Homo sapiens
cagaggcaggctctgtgtgtg

SEQ ID NO: 7631493 - DNA, 22 bp, Homo sapiens
cagaggcaggataagaactgcg

SEQ ID NO: 7631494 - DNA, 22 bp, Homo sapiens
cagaggcaggataagaactgcg

SEQ ID NO: 7631495 - DNA, 20 bp, Homo sapiens
cagaggcattttcagactct

SEQ ID NO: 7631496 - DNA, 22 bp, Homo sapiens
cagaggccacctgtggccactg

SEQ ID NO: 7631497 - DNA, 22 bp, Homo sapiens
cagaggccacctgtggccactg

SEQ ID NO: 7631498 - DNA, 20 bp, Homo sapiens
cagaggcattttcagactct

SEQ ID NO: 7631499 - DNA, 20 bp, Homo sapiens
cagaggcattttcagactct

SEQ ID NO: 7631500 - DNA, 22 bp, Homo sapiens
cagaggccacctgtggccactg

SEQ ID NO: 7631501 - DNA, 22 bp, Homo sapiens
cagaggccacctgtggccactg

SEQ ID NO: 7631502 - DNA, 22 bp, Homo sapiens
cagaggccacctgtggccactg

SEQ ID NO: 7631503 - DNA, 22 bp, Homo sapiens
cagaggccacctgtggccactg

SEQ ID NO: 7631504 - DNA, 22 bp, Homo sapiens
cagagctgtcatttgccagtga

SEQ ID NO: 7631505 - DNA, 22 bp, Homo sapiens
cagagctgtcatttgccagtga

SEQ ID NO: 7631506 - DNA, 22 bp, Homo sapiens
cagagctgtcatttgccagtga

SEQ ID NO: 7631507 - DNA, 22 bp, Homo sapiens
cagagctgtcatttgccagtga

SEQ ID NO: 7631508 - DNA, 22 bp, Homo sapiens
cagagctgtcatttgccagtga

SEQ ID NO: 7631509 - DNA, 22 bp, Homo sapiens
cagagctgtatttatctttcca

SEQ ID NO: 7631510 - DNA, 22 bp, Homo sapiens
cagagctggtgttacaagtcca

SEQ ID NO: 7631511 - DNA, 22 bp, Homo sapiens
cagagctggtgttacaagtcca

SEQ ID NO: 7631512 - DNA, 22 bp, Homo sapiens
cagagctgtatttatctttcca

SEQ ID NO: 7631513 - DNA, 22 bp, Homo sapiens
cagagctggtgttacaagtcca

SEQ ID NO: 7631514 - DNA, 22 bp, Homo sapiens
cagagctggtgttacaagtcca

SEQ ID NO: 7631515 - DNA, 22 bp, Homo sapiens
cagagctggtgttacaagtcca

SEQ ID NO: 7631516 - DNA, 22 bp, Homo sapiens
cagagctggtgttacaagtcca

SEQ ID NO: 7631517 - DNA, 22 bp, Homo sapiens
cagagctggtgttacaagtcca

SEQ ID NO: 7631518 - DNA, 22 bp, Homo sapiens
cagagctggtgttacaagtcca

SEQ ID NO: 7631519 - DNA, 20 bp, Homo sapiens
ggggaagaaaaggatgtgat

SEQ ID NO: 7631520 - DNA, 20 bp, Homo sapiens
ggggaagaaaaggatgtgat

SEQ ID NO: 7631521 - DNA, 20 bp, Homo sapiens
ggggaagaaaaggatgtgat

SEQ ID NO: 7631522 - DNA, 22 bp, Homo sapiens
ggggaagaaatagaacattttg

SEQ ID NO: 7631523 - DNA, 20 bp, Homo sapiens
ggggaagaaaaggatgtgat

SEQ ID NO: 7631524 - DNA, 22 bp, Homo sapiens
ggggaagaaatagaacattttg

SEQ ID NO: 7631525 - DNA, 22 bp, Homo sapiens
ggggaagaaatctgggttcttc

SEQ ID NO: 7631526 - DNA, 22 bp, Homo sapiens
ggggaagaaatctgggttcttc

SEQ ID NO: 7631527 - DNA, 22 bp, Homo sapiens
ggggaagaaatctgggttcttc

SEQ ID NO: 7631528 - DNA, 22 bp, Homo sapiens
ggggaagaaatctgggttcttc

SEQ ID NO: 7631529 - DNA, 22 bp, Homo sapiens
ggggaagaaccgggattcccat

SEQ ID NO: 7631530 - DNA, 22 bp, Homo sapiens
ggggaagaaccgggattcccat

SEQ ID NO: 7631531 - DNA, 22 bp, Homo sapiens
ggggaagaaccgggattcccat

SEQ ID NO: 7631532 - DNA, 22 bp, Homo sapiens
ggggaagaaccgggattcccat

SEQ ID NO: 7631533 - DNA, 22 bp, Homo sapiens
ggggaagaaatctgggttcttc

SEQ ID NO: 7631534 - DNA, 22 bp, Homo sapiens
ggggaagaaatctgggttcttc

SEQ ID NO: 7631535 - DNA, 22 bp, Homo sapiens
ggggaagaaatctgggttcttc

SEQ ID NO: 7631536 - DNA, 22 bp, Homo sapiens
ggggaagaatgctctctagaga

SEQ ID NO: 7631537 - DNA, 22 bp, Homo sapiens
ggggaagaatgctctctagaga

SEQ ID NO: 7631538 - DNA, 22 bp, Homo sapiens
ggggaagaatgctctctagaga

SEQ ID NO: 7631539 - DNA, 22 bp, Homo sapiens
ggggaagaatgctctctagaga

SEQ ID NO: 7631540 - DNA, 22 bp, Homo sapiens
ggggaagaatgctctctagaga

SEQ ID NO: 7631541 - DNA, 22 bp, Homo sapiens
ggggaagaatgctctctagaga

SEQ ID NO: 7631542 - DNA, 22 bp, Homo sapiens
cagagctggtaagtggtagagg

SEQ ID NO: 7631543 - DNA, 22 bp, Homo sapiens
cagagctggtgtgtcctggcat

SEQ ID NO: 7631544 - DNA, 22 bp, Homo sapiens
cagagctggtaagtggtagagg

SEQ ID NO: 7631545 - DNA, 22 bp, Homo sapiens
cagagctggtaagtggtagagg

SEQ ID NO: 7631546 - DNA, 22 bp, Homo sapiens
cagagctggtaagtggtagagg

SEQ ID NO: 7631547 - DNA, 22 bp, Homo sapiens
cagagctggtaagtggtagagg

SEQ ID NO: 7631548 - DNA, 22 bp, Homo sapiens
cagagctggtgtgtcctggcat

SEQ ID NO: 7631549 - DNA, 22 bp, Homo sapiens
cagagctggtgtgtcctggcat

SEQ ID NO: 7631550 - DNA, 22 bp, Homo sapiens
cagagctggtgtgtcctggcat

SEQ ID NO: 7631551 - DNA, 22 bp, Homo sapiens
cagagctggtgtgtcctggcat

SEQ ID NO: 7631552 - DNA, 22 bp, Homo sapiens
cagagctggtgtgtcctggcat

SEQ ID NO: 7631553 - DNA, 22 bp, Homo sapiens
cagagctggtgtgtcctggcat

SEQ ID NO: 7631554 - DNA, 22 bp, Homo sapiens
cagagctggtgtgtcctggcat

SEQ ID NO: 7631555 - DNA, 21 bp, Homo sapiens
cagaggcctcatgctctgtgc

SEQ ID NO: 7631556 - DNA, 21 bp, Homo sapiens
cagaggcctcatgctctgtgc

SEQ ID NO: 7631557 - DNA, 21 bp, Homo sapiens
cagaggcctcatgctctgtgc

SEQ ID NO: 7631558 - DNA, 21 bp, Homo sapiens
cagaggcctcatgctctgtgc

SEQ ID NO: 7631559 - DNA, 21 bp, Homo sapiens
cagaggcctcatgctctgtgc

SEQ ID NO: 7631560 - DNA, 21 bp, Homo sapiens
cagaggcctcatgctctgtgc

SEQ ID NO: 7631561 - DNA, 21 bp, Homo sapiens
cagaggcctcatgctctgtgc

SEQ ID NO: 7631562 - DNA, 21 bp, Homo sapiens
cagaggcctcatgctctgtgc

SEQ ID NO: 7631563 - DNA, 22 bp, Homo sapiens
cagaggcctcacttccagccag

SEQ ID NO: 7631564 - DNA, 22 bp, Homo sapiens
cagaggcctcacttccagccag

SEQ ID NO: 7631565 - DNA, 22 bp, Homo sapiens
cagaggcctcacttccagccag

SEQ ID NO: 7631566 - DNA, 22 bp, Homo sapiens
cagaggcctatccagtgtccat

SEQ ID NO: 7631567 - DNA, 22 bp, Homo sapiens
cagaggcctatccagtgtccat

SEQ ID NO: 7631568 - DNA, 22 bp, Homo sapiens
cagaggccccagaactagctct

SEQ ID NO: 7631569 - DNA, 22 bp, Homo sapiens
cagaggccccagaactagctct

SEQ ID NO: 7631570 - DNA, 22 bp, Homo sapiens
cagaggccccagaactagctct

SEQ ID NO: 7631571 - DNA, 22 bp, Homo sapiens
cagaggcccagtgagagggctg

SEQ ID NO: 7631572 - DNA, 22 bp, Homo sapiens
cagaggcccagtgagagggctg

SEQ ID NO: 7631573 - DNA, 22 bp, Homo sapiens
cagaggcccagtgagagggctg

SEQ ID NO: 7631574 - DNA, 22 bp, Homo sapiens
cagaggcccagtgagagggctg

SEQ ID NO: 7631575 - DNA, 22 bp, Homo sapiens
cagaggcctatccagtgtccat

SEQ ID NO: 7631576 - DNA, 22 bp, Homo sapiens
cagaggcctatccagtgtccat

SEQ ID NO: 7631577 - DNA, 21 bp, Homo sapiens
cagaggcctatcacagactcc

SEQ ID NO: 7631578 - DNA, 21 bp, Homo sapiens
cagaggcctatcacagactcc

SEQ ID NO: 7631579 - DNA, 21 bp, Homo sapiens
cagaggcctatcacagactcc

SEQ ID NO: 7631580 - DNA, 21 bp, Homo sapiens
cagaggcctatcacagactcc

SEQ ID NO: 7631581 - DNA, 21 bp, Homo sapiens
cagaggcctatcacagactcc

SEQ ID NO: 7631582 - DNA, 22 bp, Homo sapiens
cagaggccccagaactagctct

SEQ ID NO: 7631583 - DNA, 21 bp, Homo sapiens
cagaggcctatcacagactcc

SEQ ID NO: 7631584 - DNA, 22 bp, Homo sapiens
cagaggccacctgtggccactg

SEQ ID NO: 7631585 - DNA, 19 bp, Homo sapiens
cagaggccagaagcacagg

SEQ ID NO: 7631586 - DNA, 19 bp, Homo sapiens
cagaggccagaagcacagg

SEQ ID NO: 7631587 - DNA, 19 bp, Homo sapiens
cagaggccagaagcacagg

SEQ ID NO: 7631588 - DNA, 22 bp, Homo sapiens
cagaggccaggctgcctgactg

SEQ ID NO: 7631589 - DNA, 19 bp, Homo sapiens
cagaggccagaagcacagg

SEQ ID NO: 7631590 - DNA, 19 bp, Homo sapiens
cagaggccagaagcacagg

SEQ ID NO: 7631591 - DNA, 22 bp, Homo sapiens
cagaggccaggctgcctgactg

SEQ ID NO: 7631592 - DNA, 22 bp, Homo sapiens
cagaggccaggctgcctgactg

SEQ ID NO: 7631593 - DNA, 22 bp, Homo sapiens
cagaggccaggctgcctgactg

SEQ ID NO: 7631594 - DNA, 22 bp, Homo sapiens
cagaggccaggctgcctgactg

SEQ ID NO: 7631595 - DNA, 22 bp, Homo sapiens
cagaggccaggctgcctgactg

SEQ ID NO: 7631596 - DNA, 22 bp, Homo sapiens
cagaggccaggctgcctgactg

SEQ ID NO: 7631597 - DNA, 22 bp, Homo sapiens
cagaggccaggctgcctgactg

SEQ ID NO: 7631598 - DNA, 22 bp, Homo sapiens
cagaggccagggggctcacaaa

SEQ ID NO: 7631599 - DNA, 22 bp, Homo sapiens
cagaggccagggggctcacaaa

SEQ ID NO: 7631600 - DNA, 22 bp, Homo sapiens
cagaggccagggggctcacaaa

SEQ ID NO: 7631601 - DNA, 22 bp, Homo sapiens
cagaggccagggggctcacaaa

SEQ ID NO: 7631602 - DNA, 22 bp, Homo sapiens
cagaggccagggggctcacaaa

SEQ ID NO: 7631603 - DNA, 22 bp, Homo sapiens
cagaggccagtggacaagggcc

SEQ ID NO: 7631604 - DNA, 22 bp, Homo sapiens
cagaggccagtggacaagggcc

SEQ ID NO: 7631605 - DNA, 22 bp, Homo sapiens
cagaggccagtggacaagggcc

SEQ ID NO: 7631606 - DNA, 22 bp, Homo sapiens
cagaggccagtggacaagggcc

SEQ ID NO: 7631607 - DNA, 22 bp, Homo sapiens
cagaggccagtggacaagggcc

SEQ ID NO: 7631608 - DNA, 22 bp, Homo sapiens
cagaggcccagtgagagggctg

SEQ ID NO: 7631609 - DNA, 22 bp, Homo sapiens
cagaggcccagtgagagggctg

SEQ ID NO: 7631610 - DNA, 22 bp, Homo sapiens
cagaggcccagtgagagggctg

SEQ ID NO: 7631611 - DNA, 22 bp, Homo sapiens
cagaggcccagtgagagggctg

SEQ ID NO: 7631612 - DNA, 22 bp, Homo sapiens
cagaggcccagtgagagggctg

SEQ ID NO: 7631613 - DNA, 22 bp, Homo sapiens
cagaggccatatttcttcactc

SEQ ID NO: 7631614 - DNA, 22 bp, Homo sapiens
cagaggccatatttcttcactc

SEQ ID NO: 7631615 - DNA, 22 bp, Homo sapiens
cagaggtggggagtatttcaag

SEQ ID NO: 7631616 - DNA, 22 bp, Homo sapiens
cagaggtggggagtatttcaag

SEQ ID NO: 7631617 - DNA, 21 bp, Homo sapiens
cagaggtggcctgacctctga

SEQ ID NO: 7631618 - DNA, 22 bp, Homo sapiens
cagaggtgtacagagggaggcc

SEQ ID NO: 7631619 - DNA, 22 bp, Homo sapiens
cagaggtgtacagagggaggcc

SEQ ID NO: 7631620 - DNA, 22 bp, Homo sapiens
cagaggtgtacagagggaggcc

SEQ ID NO: 7631621 - DNA, 22 bp, Homo sapiens
cagaggtagggagctatgttat

SEQ ID NO: 7631622 - DNA, 22 bp, Homo sapiens
cagaggtagccgagtgcaatcg

SEQ ID NO: 7631623 - DNA, 21 bp, Homo sapiens
cagaggtggcctgacctctga

SEQ ID NO: 7631624 - DNA, 23 bp, Homo sapiens
cagaggtgtcagtgcccagtgtc

SEQ ID NO: 7631625 - DNA, 23 bp, Homo sapiens
cagaggtgtcagtgcccagtgtc

SEQ ID NO: 7631626 - DNA, 22 bp, Homo sapiens
cagaggtgtacagagggaggcc

SEQ ID NO: 7631627 - DNA, 22 bp, Homo sapiens
cagaggtgtacagagggaggcc

SEQ ID NO: 7631628 - DNA, 22 bp, Homo sapiens
cagaggtgtacagagggaggcc

SEQ ID NO: 7631629 - DNA, 22 bp, Homo sapiens
cagaggtgtacagagggaggcc

SEQ ID NO: 7631630 - DNA, 22 bp, Homo sapiens
cagaggtgtacagagggaggcc

SEQ ID NO: 7631631 - DNA, 22 bp, Homo sapiens
cagaggtgtacagagggaggcc

SEQ ID NO: 7631632 - DNA, 22 bp, Homo sapiens
cagagtaaacctgtcatcaaga

SEQ ID NO: 7631633 - DNA, 22 bp, Homo sapiens
cagagtaaggagctgtcaaacg

SEQ ID NO: 7631634 - DNA, 22 bp, Homo sapiens
cagagtaaggagctgtcaaacg

SEQ ID NO: 7631635 - DNA, 22 bp, Homo sapiens
cagaggttgagcaaaaatgata

SEQ ID NO: 7631636 - DNA, 22 bp, Homo sapiens
cagagtaaacctgtcatcaaga

SEQ ID NO: 7631637 - DNA, 22 bp, Homo sapiens
cagaggtgttggtgaatggaga

SEQ ID NO: 7631638 - DNA, 23 bp, Homo sapiens
cagaggtgtcagtgcccagtgtc

SEQ ID NO: 7631639 - DNA, 23 bp, Homo sapiens
cagaggtgtcagtgcccagtgtc

SEQ ID NO: 7631640 - DNA, 22 bp, Homo sapiens
cagaggtgttggtgaatggaga

SEQ ID NO: 7631641 - DNA, 22 bp, Homo sapiens
cagaggtgttggtgaatggaga

SEQ ID NO: 7631642 - DNA, 22 bp, Homo sapiens
cagaggtgttggtgaatggaga

SEQ ID NO: 7631643 - DNA, 22 bp, Homo sapiens
cagaggttacctagagcaagaa

SEQ ID NO: 7631644 - DNA, 22 bp, Homo sapiens
cagaggttacctagagcaagaa

SEQ ID NO: 7631645 - DNA, 22 bp, Homo sapiens
cagaggttgagcaaaaatgata

SEQ ID NO: 7631646 - DNA, 22 bp, Homo sapiens
cagaggcttatacctgattagg

SEQ ID NO: 7631647 - DNA, 22 bp, Homo sapiens
cagaggcttatacctgattagg

SEQ ID NO: 7631648 - DNA, 22 bp, Homo sapiens
cagaggcttatacctgattagg

SEQ ID NO: 7631649 - DNA, 22 bp, Homo sapiens
cagaggcttcaagtcattctcc

SEQ ID NO: 7631650 - DNA, 22 bp, Homo sapiens
cagaggcttcaagtcattctcc

SEQ ID NO: 7631651 - DNA, 22 bp, Homo sapiens
cagaggcttcaagtcattctcc

SEQ ID NO: 7631652 - DNA, 22 bp, Homo sapiens
cagaggcttcaagtcattctcc

SEQ ID NO: 7631653 - DNA, 22 bp, Homo sapiens
cagaggctgtgtaggcagactg

SEQ ID NO: 7631654 - DNA, 22 bp, Homo sapiens
cagaggctgtgtaggcagactg

SEQ ID NO: 7631655 - DNA, 22 bp, Homo sapiens
cagaggcttggcattatcatgc

SEQ ID NO: 7631656 - DNA, 22 bp, Homo sapiens
cagaggcttggcattatcatgc

SEQ ID NO: 7631657 - DNA, 22 bp, Homo sapiens
cagaggcttggcattatcatgc

SEQ ID NO: 7631658 - DNA, 22 bp, Homo sapiens
cagaggctttgccctggaaacc

SEQ ID NO: 7631659 - DNA, 22 bp, Homo sapiens
cagaggcttggcattatcatgc

SEQ ID NO: 7631660 - DNA, 22 bp, Homo sapiens
cagaggctttgccctggaaacc

SEQ ID NO: 7631661 - DNA, 22 bp, Homo sapiens
cagaggtagccgagtgcaatcg

SEQ ID NO: 7631662 - DNA, 22 bp, Homo sapiens
cagaggcttcaagtcattctcc

SEQ ID NO: 7631663 - DNA, 22 bp, Homo sapiens
cagaggcttatacctgattagg

SEQ ID NO: 7631664 - DNA, 22 bp, Homo sapiens
cagaggcttcaagtcattctcc

SEQ ID NO: 7631665 - DNA, 22 bp, Homo sapiens
cagaggcttggcattatcatgc

SEQ ID NO: 7631666 - DNA, 22 bp, Homo sapiens
cagaggcttcaagtcattctcc

SEQ ID NO: 7631667 - DNA, 22 bp, Homo sapiens
cagaggctggatggacttgcct

SEQ ID NO: 7631668 - DNA, 22 bp, Homo sapiens
cagaggctggcggccgccccga

SEQ ID NO: 7631669 - DNA, 22 bp, Homo sapiens
cagaggctggcggccgccccga

SEQ ID NO: 7631670 - DNA, 22 bp, Homo sapiens
cagaggctgggacctcaggcat

SEQ ID NO: 7631671 - DNA, 22 bp, Homo sapiens
cagaggctgggacctcaggcat

SEQ ID NO: 7631672 - DNA, 22 bp, Homo sapiens
cagaggctgggacctcaggcat

SEQ ID NO: 7631673 - DNA, 22 bp, Homo sapiens
cagaggctgggacctcaggcat

SEQ ID NO: 7631674 - DNA, 22 bp, Homo sapiens
cagaggctgggacctcaggcat

SEQ ID NO: 7631675 - DNA, 22 bp, Homo sapiens
cagaggctgggacctcaggcat

SEQ ID NO: 7631676 - DNA, 22 bp, Homo sapiens
cagaggctgtgtaggcagactg

SEQ ID NO: 7631677 - DNA, 22 bp, Homo sapiens
cagaggctgtgtaggcagactg

SEQ ID NO: 7631678 - DNA, 22 bp, Homo sapiens
cagaggctgtgtaggcagactg

SEQ ID NO: 7631679 - DNA, 22 bp, Homo sapiens
cagaggctgggacctcaggcat

SEQ ID NO: 7631680 - DNA, 22 bp, Homo sapiens
cagaggctgggacctcaggcat

SEQ ID NO: 7631681 - DNA, 22 bp, Homo sapiens
cagaggctgggacctcaggcat

SEQ ID NO: 7631682 - DNA, 22 bp, Homo sapiens
cagaggctgggacctcaggcat

SEQ ID NO: 7631683 - DNA, 22 bp, Homo sapiens
cagaggctgggacctcaggcat

SEQ ID NO: 7631684 - DNA, 22 bp, Homo sapiens
gggtgcagtggttcacgcctgt

SEQ ID NO: 7631685 - DNA, 22 bp, Homo sapiens
gggtgcagtggttcacgcctgt

SEQ ID NO: 7631686 - DNA, 22 bp, Homo sapiens
gggtgcagtggttcacgcctgt

SEQ ID NO: 7631687 - DNA, 22 bp, Homo sapiens
gggtgcatggtgtatgactgga

SEQ ID NO: 7631688 - DNA, 22 bp, Homo sapiens
gggtgcagggtctccagcagct

SEQ ID NO: 7631689 - DNA, 22 bp, Homo sapiens
gggtgcagtggttcacgcctgt

SEQ ID NO: 7631690 - DNA, 22 bp, Homo sapiens
gggtgcagtggttcacgcctgt

SEQ ID NO: 7631691 - DNA, 22 bp, Homo sapiens
gggtgccacagagcttccactt

SEQ ID NO: 7631692 - DNA, 22 bp, Homo sapiens
gggtgccacagagcttccactt

SEQ ID NO: 7631693 - DNA, 22 bp, Homo sapiens
gggtgccacagagcttccactt

SEQ ID NO: 7631694 - DNA, 22 bp, Homo sapiens
gggtgccctgggtaggtcagtt

SEQ ID NO: 7631695 - DNA, 22 bp, Homo sapiens
gggtgccctgggtaggtcagtt

SEQ ID NO: 7631696 - DNA, 22 bp, Homo sapiens
gggtgctcctggcggcctcttt

SEQ ID NO: 7631697 - DNA, 22 bp, Homo sapiens
gggtgcggtccccacagcccgt

SEQ ID NO: 7631698 - DNA, 22 bp, Homo sapiens
gggtgcctgcctcaggcagtgt

SEQ ID NO: 7631699 - DNA, 22 bp, Homo sapiens
gggtgcctgcctcaggcagtgt

SEQ ID NO: 7631700 - DNA, 22 bp, Homo sapiens
gggtgcctgagttagggcagaa

SEQ ID NO: 7631701 - DNA, 22 bp, Homo sapiens
gggtgcctgagttagggcagaa

SEQ ID NO: 7631702 - DNA, 22 bp, Homo sapiens
gggtgcctgagttagggcagaa

SEQ ID NO: 7631703 - DNA, 22 bp, Homo sapiens
gggtgctgactggggcctgaaa

SEQ ID NO: 7631704 - DNA, 22 bp, Homo sapiens
gggtgctcctggcggcctcttt

SEQ ID NO: 7631705 - DNA, 22 bp, Homo sapiens
gggtgctgactggggcctgaaa

SEQ ID NO: 7631706 - DNA, 22 bp, Homo sapiens
gggtgctgactggggcctgaaa

SEQ ID NO: 7631707 - DNA, 22 bp, Homo sapiens
gggtgctgaggaagacagcagg

SEQ ID NO: 7631708 - DNA, 22 bp, Homo sapiens
gggtgctgaggaagacagcagg

SEQ ID NO: 7631709 - DNA, 22 bp, Homo sapiens
gggtgctgactggggcctgaaa

SEQ ID NO: 7631710 - DNA, 22 bp, Homo sapiens
gggtgctgactggggcctgaaa

SEQ ID NO: 7631711 - DNA, 22 bp, Homo sapiens
cagaggctggatggacttgcct

SEQ ID NO: 7631712 - DNA, 22 bp, Homo sapiens
cagaggctggatggacttgcct

SEQ ID NO: 7631713 - DNA, 22 bp, Homo sapiens
cagaggctgctctgggtggcat

SEQ ID NO: 7631714 - DNA, 22 bp, Homo sapiens
gggtgctgaggaagacagcagg

SEQ ID NO: 7631715 - DNA, 23 bp, Homo sapiens
gggtgctgcctgtagtcatgctg

SEQ ID NO: 7631716 - DNA, 23 bp, Homo sapiens
gggtgctgcctgtagtcatgctg

SEQ ID NO: 7631717 - DNA, 22 bp, Homo sapiens
cagaggccttgtcttctttgct

SEQ ID NO: 7631718 - DNA, 22 bp, Homo sapiens
cagaggccttgtcttctttgct

SEQ ID NO: 7631719 - DNA, 22 bp, Homo sapiens
cagaggccttcaatactcattt

SEQ ID NO: 7631720 - DNA, 19 bp, Homo sapiens
gggtcgggaagttgagaat

SEQ ID NO: 7631721 - DNA, 22 bp, Homo sapiens
gggtcgcttaatatatgtttaa

SEQ ID NO: 7631722 - DNA, 22 bp, Homo sapiens
gggtcgcttggagaggcttcct

SEQ ID NO: 7631723 - DNA, 20 bp, Homo sapiens
gggtcgctctgagcccatcc

SEQ ID NO: 7631724 - DNA, 22 bp, Homo sapiens
gggtcgctgccgctgctggacc

SEQ ID NO: 7631725 - DNA, 22 bp, Homo sapiens
gggtcgggcaggcgccctcgtc

SEQ ID NO: 7631726 - DNA, 22 bp, Homo sapiens
gggtctaggagacatgggcaag

SEQ ID NO: 7631727 - DNA, 19 bp, Homo sapiens
gggtcgggaagttgagaat

SEQ ID NO: 7631728 - DNA, 22 bp, Homo sapiens
gggtctccatgttaacatcact

SEQ ID NO: 7631729 - DNA, 22 bp, Homo sapiens
gggtcgggcaggcgccctcgtc

SEQ ID NO: 7631730 - DNA, 22 bp, Homo sapiens
gggtctaggagacatgggcaag

SEQ ID NO: 7631731 - DNA, 22 bp, Homo sapiens
cagaggcctggcttggacacct

SEQ ID NO: 7631732 - DNA, 22 bp, Homo sapiens
cagaggcctggcttggacacct

SEQ ID NO: 7631733 - DNA, 22 bp, Homo sapiens
cagaggcctggcttggacacct

SEQ ID NO: 7631734 - DNA, 22 bp, Homo sapiens
cagaggcctggcttggacacct

SEQ ID NO: 7631735 - DNA, 22 bp, Homo sapiens
cagaggcctggcttggacacct

SEQ ID NO: 7631736 - DNA, 22 bp, Homo sapiens
cagaggcctggcttggacacct

SEQ ID NO: 7631737 - DNA, 22 bp, Homo sapiens
cagaggcctggcttggacacct

SEQ ID NO: 7631738 - DNA, 22 bp, Homo sapiens
cagaggcctggcttggacacct

SEQ ID NO: 7631739 - DNA, 22 bp, Homo sapiens
cagaggcctggcttggacacct

SEQ ID NO: 7631740 - DNA, 22 bp, Homo sapiens
gggtgcagggtctccagcagct

SEQ ID NO: 7631741 - DNA, 22 bp, Homo sapiens
gggtgcagggtctccagcagct

SEQ ID NO: 7631742 - DNA, 22 bp, Homo sapiens
gggtgcagggtctccagcagct

SEQ ID NO: 7631743 - DNA, 22 bp, Homo sapiens
gggtgcagggtctccagcagct

SEQ ID NO: 7631744 - DNA, 22 bp, Homo sapiens
gggtgcagggtctccagcagct

SEQ ID NO: 7631745 - DNA, 22 bp, Homo sapiens
gggtgcagggtctccagcagct

SEQ ID NO: 7631746 - DNA, 22 bp, Homo sapiens
gggtgcagtggttcacgcctgt

SEQ ID NO: 7631747 - DNA, 22 bp, Homo sapiens
gggtgcagtggttcacgcctgt

SEQ ID NO: 7631748 - DNA, 22 bp, Homo sapiens
gggtgcagtggttcacgcctgt

SEQ ID NO: 7631749 - DNA, 22 bp, Homo sapiens
gggtgcagggtctccagcagct

SEQ ID NO: 7631750 - DNA, 22 bp, Homo sapiens
gggtgcagggtctccagcagct

SEQ ID NO: 7631751 - DNA, 22 bp, Homo sapiens
gggtgcagggtctccagcagct

SEQ ID NO: 7631752 - DNA, 22 bp, Homo sapiens
gggtgcaggggaccctagggac

SEQ ID NO: 7631753 - DNA, 22 bp, Homo sapiens
gggtgcaggcagcccaggcagg

SEQ ID NO: 7631754 - DNA, 22 bp, Homo sapiens
gggtgcaggggaccctagggac

SEQ ID NO: 7631755 - DNA, 22 bp, Homo sapiens
gggtgcaggggaccctagggac

SEQ ID NO: 7631756 - DNA, 22 bp, Homo sapiens
gggtgcaggggaccctagggac

SEQ ID NO: 7631757 - DNA, 22 bp, Homo sapiens
gggtgcaggggaccctagggac

SEQ ID NO: 7631758 - DNA, 22 bp, Homo sapiens
gggtgcaggggaccctagggac

SEQ ID NO: 7631759 - DNA, 22 bp, Homo sapiens
gggtgcaggggaccctagggac

SEQ ID NO: 7631760 - DNA, 22 bp, Homo sapiens
gggtcgggcaggcgccctcgtc

SEQ ID NO: 7631761 - DNA, 22 bp, Homo sapiens
gggtgcaggggaccctagggac

SEQ ID NO: 7631762 - DNA, 22 bp, Homo sapiens
cagaagttagacttcaactaat

SEQ ID NO: 7631763 - DNA, 22 bp, Homo sapiens
cagaagttagacttcaactaat

SEQ ID NO: 7631764 - DNA, 22 bp, Homo sapiens
cagaagttagacttcaactaat

SEQ ID NO: 7631765 - DNA, 22 bp, Homo sapiens
cagaagtggtattaattagatt

SEQ ID NO: 7631766 - DNA, 22 bp, Homo sapiens
cagaagtggtattaattagatt

SEQ ID NO: 7631767 - DNA, 22 bp, Homo sapiens
cagaagtggtattaattagatt

SEQ ID NO: 7631768 - DNA, 22 bp, Homo sapiens
cagaagtggcctcagagggagt

SEQ ID NO: 7631769 - DNA, 22 bp, Homo sapiens
cagaagtggcatcattcaagag

SEQ ID NO: 7631770 - DNA, 22 bp, Homo sapiens
cagaagtggcatcattcaagag

SEQ ID NO: 7631771 - DNA, 22 bp, Homo sapiens
cagaagtggcctcagagggagt

SEQ ID NO: 7631772 - DNA, 22 bp, Homo sapiens
cagaagtggcctcagagggagt

SEQ ID NO: 7631773 - DNA, 22 bp, Homo sapiens
cagaagtggcctcagagggagt

SEQ ID NO: 7631774 - DNA, 22 bp, Homo sapiens
cagaagtgcaatttaaattagg

SEQ ID NO: 7631775 - DNA, 22 bp, Homo sapiens
cagaagtgcaatttaaattagg

SEQ ID NO: 7631776 - DNA, 22 bp, Homo sapiens
cagaagtgatgttgagctagtc

SEQ ID NO: 7631777 - DNA, 22 bp, Homo sapiens
cagaagtggatattagagtaat

SEQ ID NO: 7631778 - DNA, 22 bp, Homo sapiens
cagaagtggatattagagtaat

SEQ ID NO: 7631779 - DNA, 22 bp, Homo sapiens
cagaagtggcatcattcaagag

SEQ ID NO: 7631780 - DNA, 22 bp, Homo sapiens
cagaagtggcatcattcaagag

SEQ ID NO: 7631781 - DNA, 22 bp, Homo sapiens
cagaagtggcatcattcaagag

SEQ ID NO: 7631782 - DNA, 22 bp, Homo sapiens
gggactgtcctctgtgtctgtg

SEQ ID NO: 7631783 - DNA, 22 bp, Homo sapiens
gggactgtcctctgtgtctgtg

SEQ ID NO: 7631784 - DNA, 22 bp, Homo sapiens
gggactgtcctacatggagagg

SEQ ID NO: 7631785 - DNA, 22 bp, Homo sapiens
gggactgtcctacatggagagg

SEQ ID NO: 7631786 - DNA, 20 bp, Homo sapiens
gggactgtcccatcctcatc

SEQ ID NO: 7631787 - DNA, 22 bp, Homo sapiens
gggactgtccggcagaaggtac

SEQ ID NO: 7631788 - DNA, 22 bp, Homo sapiens
gggactgggagatcctcctggc

SEQ ID NO: 7631789 - DNA, 22 bp, Homo sapiens
gggactgggagatcctcctggc

SEQ ID NO: 7631790 - DNA, 22 bp, Homo sapiens
gggactgtccggcagaaggtac

SEQ ID NO: 7631791 - DNA, 22 bp, Homo sapiens
gggactgtaaattcatatggcc

SEQ ID NO: 7631792 - DNA, 22 bp, Homo sapiens
gggactgtgaggcctaactggg

SEQ ID NO: 7631793 - DNA, 22 bp, Homo sapiens
gggactgtgaggcctaactggg

SEQ ID NO: 7631794 - DNA, 22 bp, Homo sapiens
gggacttcatagctaggcactt

SEQ ID NO: 7631795 - DNA, 22 bp, Homo sapiens
gggacttaatgcagagagggac

SEQ ID NO: 7631796 - DNA, 22 bp, Homo sapiens
gggacttaatgcagagagggac

SEQ ID NO: 7631797 - DNA, 22 bp, Homo sapiens
cagaagtgatgttgagctagtc

SEQ ID NO: 7631798 - DNA, 22 bp, Homo sapiens
cagaagtgatgttgagctagtc

SEQ ID NO: 7631799 - DNA, 22 bp, Homo sapiens
cagaagtgatgttgagctagtc

SEQ ID NO: 7631800 - DNA, 22 bp, Homo sapiens
cagaagtgaatgtgataaacca

SEQ ID NO: 7631801 - DNA, 22 bp, Homo sapiens
cagaagtgaatgtgataaacca

SEQ ID NO: 7631802 - DNA, 22 bp, Homo sapiens
cagaagtgaatgtgataaacca

SEQ ID NO: 7631803 - DNA, 22 bp, Homo sapiens
cagaagtgaatgtgataaacca

SEQ ID NO: 7631804 - DNA, 22 bp, Homo sapiens
cagaataaaaactcctatgtct

SEQ ID NO: 7631805 - DNA, 22 bp, Homo sapiens
cagacaggaagttcagaagaaa

SEQ ID NO: 7631806 - DNA, 22 bp, Homo sapiens
cagacagaaggctccttgaggt

SEQ ID NO: 7631807 - DNA, 22 bp, Homo sapiens
cagacagaaggctccttgaggt

SEQ ID NO: 7631808 - DNA, 22 bp, Homo sapiens
cagacaggaagttcagaagaaa

SEQ ID NO: 7631809 - DNA, 22 bp, Homo sapiens
cagacaggaattctggcgtggt

SEQ ID NO: 7631810 - DNA, 22 bp, Homo sapiens
cagacaggaattctggcgtggt

SEQ ID NO: 7631811 - DNA, 22 bp, Homo sapiens
cagaataaaaactcctatgtct

SEQ ID NO: 7631812 - DNA, 22 bp, Homo sapiens
cagacagaaggctccttgaggt

SEQ ID NO: 7631813 - DNA, 22 bp, Homo sapiens
cagaataaaaactcctatgtct

SEQ ID NO: 7631814 - DNA, 22 bp, Homo sapiens
cagaagttttgctctcttgggt

SEQ ID NO: 7631815 - DNA, 22 bp, Homo sapiens
cagaagtttgacatgtttagct

SEQ ID NO: 7631816 - DNA, 22 bp, Homo sapiens
cagaagtttgacatgtttagct

SEQ ID NO: 7631817 - DNA, 22 bp, Homo sapiens
cagaagtttgaccttggtgggt

SEQ ID NO: 7631818 - DNA, 22 bp, Homo sapiens
cagaagtttgcaattgtttatt

SEQ ID NO: 7631819 - DNA, 22 bp, Homo sapiens
cagaagtttgcaattgtttatt

SEQ ID NO: 7631820 - DNA, 22 bp, Homo sapiens
cagaagtttgcaattgtttatt

SEQ ID NO: 7631821 - DNA, 20 bp, Homo sapiens
cagaagtttgcattggtata

SEQ ID NO: 7631822 - DNA, 22 bp, Homo sapiens
cagaagttatgtcaatggtcat

SEQ ID NO: 7631823 - DNA, 22 bp, Homo sapiens
cagaagttcatttagcctctct

SEQ ID NO: 7631824 - DNA, 22 bp, Homo sapiens
cagaagttcatttagcctctct

SEQ ID NO: 7631825 - DNA, 22 bp, Homo sapiens
cagaagttagtgtctgccagta

SEQ ID NO: 7631826 - DNA, 22 bp, Homo sapiens
cagaagttagacttcaactaat

SEQ ID NO: 7631827 - DNA, 22 bp, Homo sapiens
cagaagttagtcttaattataa

SEQ ID NO: 7631828 - DNA, 22 bp, Homo sapiens
cagaagttagtcttaattataa

SEQ ID NO: 7631829 - DNA, 22 bp, Homo sapiens
cagaagttagtcttaattataa

SEQ ID NO: 7631830 - DNA, 22 bp, Homo sapiens
cagaagttctttcatataggct

SEQ ID NO: 7631831 - DNA, 22 bp, Homo sapiens
cagaagttctagatttgagtcc

SEQ ID NO: 7631832 - DNA, 22 bp, Homo sapiens
cagaagttctagatttgagtcc

SEQ ID NO: 7631833 - DNA, 22 bp, Homo sapiens
cagaagttcatttagcctctct

SEQ ID NO: 7631834 - DNA, 22 bp, Homo sapiens
cagaagttcctatttacctcct

SEQ ID NO: 7631835 - DNA, 22 bp, Homo sapiens
cagaagttcctatttacctcct

SEQ ID NO: 7631836 - DNA, 22 bp, Homo sapiens
cagaagttggagctttccatca

SEQ ID NO: 7631837 - DNA, 22 bp, Homo sapiens
cagaagtttgaatgagagcctg

SEQ ID NO: 7631838 - DNA, 22 bp, Homo sapiens
cagaagtttgaatgagagcctg

SEQ ID NO: 7631839 - DNA, 22 bp, Homo sapiens
cagaagtttgacatgtttagct

SEQ ID NO: 7631840 - DNA, 22 bp, Homo sapiens
cagaagttggagctttccatca

SEQ ID NO: 7631841 - DNA, 22 bp, Homo sapiens
cagaagttggagctttccatca

SEQ ID NO: 7631842 - DNA, 22 bp, Homo sapiens
cagaagttggagctttccatca

SEQ ID NO: 7631843 - DNA, 22 bp, Homo sapiens
cagaagttgccacatgaccctt

SEQ ID NO: 7631844 - DNA, 22 bp, Homo sapiens
cagaagttgatcctgcgtttcc

SEQ ID NO: 7631845 - DNA, 22 bp, Homo sapiens
cagaagttgatcctgcgtttcc

SEQ ID NO: 7631846 - DNA, 22 bp, Homo sapiens
cagaagttgatcctgcgtttcc

SEQ ID NO: 7631847 - DNA, 22 bp, Homo sapiens
gggagcagcctgcctcccacct

SEQ ID NO: 7631848 - DNA, 22 bp, Homo sapiens
gggagcactgagaggcaggtag

SEQ ID NO: 7631849 - DNA, 22 bp, Homo sapiens
gggagcactgagaggcaggtag

SEQ ID NO: 7631850 - DNA, 22 bp, Homo sapiens
gggagcagcctgcctcccacct

SEQ ID NO: 7631851 - DNA, 22 bp, Homo sapiens
gggagcagcctgcctcccacct

SEQ ID NO: 7631852 - DNA, 22 bp, Homo sapiens
gggagcacatctgagcacccgg

SEQ ID NO: 7631853 - DNA, 22 bp, Homo sapiens
gggagcacatctgagcacccgg

SEQ ID NO: 7631854 - DNA, 22 bp, Homo sapiens
gggagcacccgtggcctcaagg

SEQ ID NO: 7631855 - DNA, 22 bp, Homo sapiens
gggagcacccgtggcctcaagg

SEQ ID NO: 7631856 - DNA, 22 bp, Homo sapiens
gggagcactaaggcagtcgctt

SEQ ID NO: 7631857 - DNA, 22 bp, Homo sapiens
gggagcactaaggcagtcgctt

SEQ ID NO: 7631858 - DNA, 22 bp, Homo sapiens
gggagcacccgtggcctcaagg

SEQ ID NO: 7631859 - DNA, 22 bp, Homo sapiens
gggagcactgagaggcaggtag

SEQ ID NO: 7631860 - DNA, 22 bp, Homo sapiens
gggagcactgagaggcaggtag

SEQ ID NO: 7631861 - DNA, 19 bp, Homo sapiens
gggagcaggaaagctgtgg

SEQ ID NO: 7631862 - DNA, 19 bp, Homo sapiens
gggagcaggaaagctgtgg

SEQ ID NO: 7631863 - DNA, 19 bp, Homo sapiens
gggagcaggaaagctgtgg

SEQ ID NO: 7631864 - DNA, 19 bp, Homo sapiens
gggagcaggaaagctgtgg

SEQ ID NO: 7631865 - DNA, 22 bp, Homo sapiens
gggagcagcctgcctcccacct

SEQ ID NO: 7631866 - DNA, 22 bp, Homo sapiens
gggagcagcctgcctcccacct

SEQ ID NO: 7631867 - DNA, 22 bp, Homo sapiens
gggagcagcctgcctcccacct

SEQ ID NO: 7631868 - DNA, 19 bp, Homo sapiens
gggagcaggaaagctgtgg

SEQ ID NO: 7631869 - DNA, 19 bp, Homo sapiens
gggagcaggaaagctgtgg

SEQ ID NO: 7631870 - DNA, 19 bp, Homo sapiens
gggagcaggaaagctgtgg

SEQ ID NO: 7631871 - DNA, 22 bp, Homo sapiens
gggagcagcctgcctcccacct

SEQ ID NO: 7631872 - DNA, 22 bp, Homo sapiens
gggagcaggagcctgcctgcca

SEQ ID NO: 7631873 - DNA, 22 bp, Homo sapiens
gggagcaggagcctgcctgcca

SEQ ID NO: 7631874 - DNA, 22 bp, Homo sapiens
gggagcaggagcctgcctgcca

SEQ ID NO: 7631875 - DNA, 22 bp, Homo sapiens
gggagcaggagcctgcctgcca

SEQ ID NO: 7631876 - DNA, 22 bp, Homo sapiens
gggagcaggagcctgcctgcca

SEQ ID NO: 7631877 - DNA, 22 bp, Homo sapiens
gggagcaggagcctgcctgcca

SEQ ID NO: 7631878 - DNA, 22 bp, Homo sapiens
gggagcaggagcctgcctgcca

SEQ ID NO: 7631879 - DNA, 22 bp, Homo sapiens
gggagcaggagcctgcctgcca

SEQ ID NO: 7631880 - DNA, 22 bp, Homo sapiens
gggagcaggagcctgcctgcca

SEQ ID NO: 7631881 - DNA, 22 bp, Homo sapiens
gggagcaggagcctgcctgcca

SEQ ID NO: 7631882 - DNA, 22 bp, Homo sapiens
gggagcaggacataatagcaat

SEQ ID NO: 7631883 - DNA, 22 bp, Homo sapiens
gggagcaggacataatagcaat

SEQ ID NO: 7631884 - DNA, 22 bp, Homo sapiens
gggagcaggacataatagcaat

SEQ ID NO: 7631885 - DNA, 22 bp, Homo sapiens
gggagcaggacataatagcaat

SEQ ID NO: 7631886 - DNA, 22 bp, Homo sapiens
gggagcaggacataatagcaat

SEQ ID NO: 7631887 - DNA, 22 bp, Homo sapiens
gggagcaggacataatagcaat

SEQ ID NO: 7631888 - DNA, 22 bp, Homo sapiens
gggagcaggacataatagcaat

SEQ ID NO: 7631889 - DNA, 22 bp, Homo sapiens
gggagcaggacataatagcaat

SEQ ID NO: 7631890 - DNA, 22 bp, Homo sapiens
gggagcaggacataatagcaat

SEQ ID NO: 7631891 - DNA, 22 bp, Homo sapiens
gggagcaggacataatagcaat

SEQ ID NO: 7631892 - DNA, 22 bp, Homo sapiens
gggagcaggacataatagcaat

SEQ ID NO: 7631893 - DNA, 22 bp, Homo sapiens
gggagcaggacataatagcaat

SEQ ID NO: 7631894 - DNA, 22 bp, Homo sapiens
gggagcaggacataatagcaat

SEQ ID NO: 7631895 - DNA, 19 bp, Homo sapiens
gggagcaggaaagctgtgg

SEQ ID NO: 7631896 - DNA, 19 bp, Homo sapiens
gggagcaggaaagctgtgg

SEQ ID NO: 7631897 - DNA, 22 bp, Homo sapiens
gggagcacacagaggtgccctt

SEQ ID NO: 7631898 - DNA, 22 bp, Homo sapiens
gggagcacacagaggtgccctt

SEQ ID NO: 7631899 - DNA, 23 bp, Homo sapiens
gggagcacagcctggtgggcgcg

SEQ ID NO: 7631900 - DNA, 22 bp, Homo sapiens
gggagcaagccggaggtactgt

SEQ ID NO: 7631901 - DNA, 23 bp, Homo sapiens
gggagatgggaaatgaaggctct

SEQ ID NO: 7631902 - DNA, 19 bp, Homo sapiens
gggagcacaagcgttaaga

SEQ ID NO: 7631903 - DNA, 22 bp, Homo sapiens
cagacaggcaggtgctgctttg

SEQ ID NO: 7631904 - DNA, 22 bp, Homo sapiens
cagacaggcaggtgctgctttg

SEQ ID NO: 7631905 - DNA, 22 bp, Homo sapiens
cagacaggcaggtgctgctttg

SEQ ID NO: 7631906 - DNA, 22 bp, Homo sapiens
cagacaggctagccagactcac

SEQ ID NO: 7631907 - DNA, 22 bp, Homo sapiens
cagacaggcaggtgagagctcc

SEQ ID NO: 7631908 - DNA, 22 bp, Homo sapiens
cagacaggcaggtgagagctcc

SEQ ID NO: 7631909 - DNA, 22 bp, Homo sapiens
cagacaggcaggtgctgctttg

SEQ ID NO: 7631910 - DNA, 22 bp, Homo sapiens
cagacaggcaggtgctgctttg

SEQ ID NO: 7631911 - DNA, 22 bp, Homo sapiens
cagacaggcaggtgctgctttg

SEQ ID NO: 7631912 - DNA, 22 bp, Homo sapiens
cagacaggcaggtgctgctttg

SEQ ID NO: 7631913 - DNA, 22 bp, Homo sapiens
cagacaggcaggtgagagctcc

SEQ ID NO: 7631914 - DNA, 22 bp, Homo sapiens
cagacaggcaggtgagagctcc

SEQ ID NO: 7631915 - DNA, 22 bp, Homo sapiens
cagacaggcaggtgagagctcc

SEQ ID NO: 7631916 - DNA, 22 bp, Homo sapiens
cagacaggcaggtgagagctcc

SEQ ID NO: 7631917 - DNA, 22 bp, Homo sapiens
cagacaggcaggtgagagctcc

SEQ ID NO: 7631918 - DNA, 22 bp, Homo sapiens
cagacaggcaggtgagagctcc

SEQ ID NO: 7631919 - DNA, 22 bp, Homo sapiens
cagacaggcaggtgagagctcc

SEQ ID NO: 7631920 - DNA, 22 bp, Homo sapiens
cagacaggagactggatcatgg

SEQ ID NO: 7631921 - DNA, 22 bp, Homo sapiens
cagacaggagactggatcatgg

SEQ ID NO: 7631922 - DNA, 22 bp, Homo sapiens
cagacaggagactggatcatgg

SEQ ID NO: 7631923 - DNA, 22 bp, Homo sapiens
cagacaggcaggtgagagctcc

SEQ ID NO: 7631924 - DNA, 22 bp, Homo sapiens
cagacaggagactggatcatgg

SEQ ID NO: 7631925 - DNA, 22 bp, Homo sapiens
cagacaggaattctggcgtggt

SEQ ID NO: 7631926 - DNA, 22 bp, Homo sapiens
cagacaggaagttcagaagaaa

SEQ ID NO: 7631927 - DNA, 22 bp, Homo sapiens
cagacaggaattctggcgtggt

SEQ ID NO: 7631928 - DNA, 22 bp, Homo sapiens
cagacaggaattctggcgtggt

SEQ ID NO: 7631929 - DNA, 22 bp, Homo sapiens
cagacaggaattctggcgtggt

SEQ ID NO: 7631930 - DNA, 22 bp, Homo sapiens
cagacaggaattctggcgtggt

SEQ ID NO: 7631931 - DNA, 22 bp, Homo sapiens
cagacaggagactggatcatgg

SEQ ID NO: 7631932 - DNA, 22 bp, Homo sapiens
cagacaggaattctggcgtggt

SEQ ID NO: 7631933 - DNA, 22 bp, Homo sapiens
gggagcagttaaaatgattcct

SEQ ID NO: 7631934 - DNA, 22 bp, Homo sapiens
gggagcagttaaaatgattcct

SEQ ID NO: 7631935 - DNA, 22 bp, Homo sapiens
gggagcaggagcctgcctgcca

SEQ ID NO: 7631936 - DNA, 22 bp, Homo sapiens
gggagcaggagcctgcctgcca

SEQ ID NO: 7631937 - DNA, 22 bp, Homo sapiens
gggagcaggagcctgcctgcca

SEQ ID NO: 7631938 - DNA, 22 bp, Homo sapiens
gggagcagttaaaatgattcct

SEQ ID NO: 7631939 - DNA, 22 bp, Homo sapiens
gggagcagttaaaatgattcct

SEQ ID NO: 7631940 - DNA, 22 bp, Homo sapiens
gggagcagttaaaatgattcct

SEQ ID NO: 7631941 - DNA, 22 bp, Homo sapiens
gggagcagttaaaatgattcct

SEQ ID NO: 7631942 - DNA, 20 bp, Homo sapiens
gggaggccagcctcagagaa

SEQ ID NO: 7631943 - DNA, 20 bp, Homo sapiens
gggaggccagcctcagagaa

SEQ ID NO: 7631944 - DNA, 22 bp, Homo sapiens
gggagggccagtgctctctaga

SEQ ID NO: 7631945 - DNA, 22 bp, Homo sapiens
gggagggccagtgctctctaga

SEQ ID NO: 7631946 - DNA, 22 bp, Homo sapiens
gggagggccaggctcacccagg

SEQ ID NO: 7631947 - DNA, 22 bp, Homo sapiens
gggagggccaggctcacccagg

SEQ ID NO: 7631948 - DNA, 20 bp, Homo sapiens
gggaggccagcctcagagaa

SEQ ID NO: 7631949 - DNA, 20 bp, Homo sapiens
gggaggccagcctcagagaa

SEQ ID NO: 7631950 - DNA, 20 bp, Homo sapiens
gggaggccccagagtccagg

SEQ ID NO: 7631951 - DNA, 20 bp, Homo sapiens
gggaggccccagagtccagg

SEQ ID NO: 7631952 - DNA, 20 bp, Homo sapiens
gggaggccagcctcagagaa

SEQ ID NO: 7631953 - DNA, 22 bp, Homo sapiens
gggagggcttggacccagatgt

SEQ ID NO: 7631954 - DNA, 22 bp, Homo sapiens
gggagggcttggacccagatgt

SEQ ID NO: 7631955 - DNA, 22 bp, Homo sapiens
gggagggccagtgctctctaga

SEQ ID NO: 7631956 - DNA, 22 bp, Homo sapiens
gggagggccagtgctctctaga

SEQ ID NO: 7631957 - DNA, 22 bp, Homo sapiens
gggagggcttggacccagatgt

SEQ ID NO: 7631958 - DNA, 22 bp, Homo sapiens
gggaggggttgcatgtttgagt

SEQ ID NO: 7631959 - DNA, 22 bp, Homo sapiens
gggagggcttggacccagatgt

SEQ ID NO: 7631960 - DNA, 22 bp, Homo sapiens
gggagggcttggacccagatgt

SEQ ID NO: 7631961 - DNA, 22 bp, Homo sapiens
gggaggggttgcatgtttgagt

SEQ ID NO: 7631962 - DNA, 22 bp, Homo sapiens
gggaggggttgcatgtttgagt

SEQ ID NO: 7631963 - DNA, 22 bp, Homo sapiens
gggaggggttgcatgtttgagt

SEQ ID NO: 7631964 - DNA, 22 bp, Homo sapiens
gggaggggttgcatgtttgagt

SEQ ID NO: 7631965 - DNA, 22 bp, Homo sapiens
gggaggggttgcatgtttgagt

SEQ ID NO: 7631966 - DNA, 22 bp, Homo sapiens
gggaggggttgcatgtttgagt

SEQ ID NO: 7631967 - DNA, 22 bp, Homo sapiens
gggaggggttgcatgtttgagt

SEQ ID NO: 7631968 - DNA, 22 bp, Homo sapiens
gggaggggttgcatgtttgagt

SEQ ID NO: 7631969 - DNA, 22 bp, Homo sapiens
gggaggggttgcatgtttgagt

SEQ ID NO: 7631970 - DNA, 22 bp, Homo sapiens
gggaggggttgcatgtttgagt

SEQ ID NO: 7631971 - DNA, 22 bp, Homo sapiens
gggaggggttgcatgtttgagt

SEQ ID NO: 7631972 - DNA, 22 bp, Homo sapiens
gggaggggttgcatgtttgagt

SEQ ID NO: 7631973 - DNA, 22 bp, Homo sapiens
gggaggggttgcatgtttgagt

SEQ ID NO: 7631974 - DNA, 22 bp, Homo sapiens
gggaggtcctaaaggggaccag

SEQ ID NO: 7631975 - DNA, 22 bp, Homo sapiens
gggaggtcagggtgcctgctgg

SEQ ID NO: 7631976 - DNA, 22 bp, Homo sapiens
gggaggtcagggtgcctgctgg

SEQ ID NO: 7631977 - DNA, 22 bp, Homo sapiens
gggaggtgaaaggtcatgtgtg

SEQ ID NO: 7631978 - DNA, 22 bp, Homo sapiens
gggaggtgaaaggtcatgtgtg

SEQ ID NO: 7631979 - DNA, 22 bp, Homo sapiens
gggaggtgaaaggtcatgtgtg

SEQ ID NO: 7631980 - DNA, 22 bp, Homo sapiens
gggaggtgaaaggtcatgtgtg

SEQ ID NO: 7631981 - DNA, 22 bp, Homo sapiens
gggaggtgaaaggtcatgtgtg

SEQ ID NO: 7631982 - DNA, 22 bp, Homo sapiens
gggaggtgaaaggtcatgtgtg

SEQ ID NO: 7631983 - DNA, 22 bp, Homo sapiens
gggaggtgaaaggttgctgcag

SEQ ID NO: 7631984 - DNA, 22 bp, Homo sapiens
gggaggtgaaaggttgctgcag

SEQ ID NO: 7631985 - DNA, 22 bp, Homo sapiens
gggaggtgaaaggtcatgtgtg

SEQ ID NO: 7631986 - DNA, 22 bp, Homo sapiens
gggaggtgaaaggtcatgtgtg

SEQ ID NO: 7631987 - DNA, 22 bp, Homo sapiens
cagacaggctagccagactcac

SEQ ID NO: 7631988 - DNA, 22 bp, Homo sapiens
gggaggtgaaaggttgctgcag

SEQ ID NO: 7631989 - DNA, 22 bp, Homo sapiens
cagacaggctagccagactcac

SEQ ID NO: 7631990 - DNA, 22 bp, Homo sapiens
cagacaggctagccagactcac

SEQ ID NO: 7631991 - DNA, 22 bp, Homo sapiens
cagacaggctagccagactcac

SEQ ID NO: 7631992 - DNA, 22 bp, Homo sapiens
gggagggtgttctcccaagaac

SEQ ID NO: 7631993 - DNA, 22 bp, Homo sapiens
gggagggtgttctcccaagaac

SEQ ID NO: 7631994 - DNA, 22 bp, Homo sapiens
gggaggtaaagatgagctcagt

SEQ ID NO: 7631995 - DNA, 22 bp, Homo sapiens
gggaggtaaagatgagctcagt

SEQ ID NO: 7631996 - DNA, 22 bp, Homo sapiens
gggaggtaaagatgagctcagt

SEQ ID NO: 7631997 - DNA, 22 bp, Homo sapiens
gggagggtgttctcccaagaac

SEQ ID NO: 7631998 - DNA, 22 bp, Homo sapiens
gggaggtagcaagcctgcagct

SEQ ID NO: 7631999 - DNA, 22 bp, Homo sapiens
gggaggtagcaagcctgcagct

SEQ ID NO: 7632000 - DNA, 22 bp, Homo sapiens
gggaggtaaagatgagctcagt

SEQ ID NO: 7632001 - DNA, 22 bp, Homo sapiens
gggaggtaaagatgagctcagt

SEQ ID NO: 7632002 - DNA, 22 bp, Homo sapiens
gggaggtagcaagcctgcagct

SEQ ID NO: 7632003 - DNA, 22 bp, Homo sapiens
gggaggtagcaagcctgcagct

SEQ ID NO: 7632004 - DNA, 22 bp, Homo sapiens
gggagggtctgagagctgcacc

SEQ ID NO: 7632005 - DNA, 22 bp, Homo sapiens
gggagggtctgagagctgcacc

SEQ ID NO: 7632006 - DNA, 22 bp, Homo sapiens
gggagggtctgagagctgcacc

SEQ ID NO: 7632007 - DNA, 22 bp, Homo sapiens
gggagggtctgagagctgcacc

SEQ ID NO: 7632008 - DNA, 22 bp, Homo sapiens
gggagggtctgccatgctccct

SEQ ID NO: 7632009 - DNA, 22 bp, Homo sapiens
gggagggtctgagagctgcacc

SEQ ID NO: 7632010 - DNA, 22 bp, Homo sapiens
gggagggtctgagagctgcacc

SEQ ID NO: 7632011 - DNA, 22 bp, Homo sapiens
gggcaatgtggcaaaaccctgt

SEQ ID NO: 7632012 - DNA, 22 bp, Homo sapiens
gggcacaccttgtctgagcaca

SEQ ID NO: 7632013 - DNA, 22 bp, Homo sapiens
gggcacaccttgtctgagcaca

SEQ ID NO: 7632014 - DNA, 22 bp, Homo sapiens
gggcacagaagtctaagacatc

SEQ ID NO: 7632015 - DNA, 22 bp, Homo sapiens
gggcaatgctatgaagagctaa

SEQ ID NO: 7632016 - DNA, 22 bp, Homo sapiens
gggcaagttgagaagaatgcta

SEQ ID NO: 7632017 - DNA, 22 bp, Homo sapiens
gggcaagttacttaatctctct

SEQ ID NO: 7632018 - DNA, 22 bp, Homo sapiens
gggcaagtgtcaagcatgtcat

SEQ ID NO: 7632019 - DNA, 22 bp, Homo sapiens
gggcaagttgagaagaatgcta

SEQ ID NO: 7632020 - DNA, 22 bp, Homo sapiens
gggcaatggatgtgatgactcc

SEQ ID NO: 7632021 - DNA, 22 bp, Homo sapiens
gggcaatgggcttttctgtaag

SEQ ID NO: 7632022 - DNA, 22 bp, Homo sapiens
gggcaagtgttttgtctgcctg

SEQ ID NO: 7632023 - DNA, 22 bp, Homo sapiens
gggcaagtgttttgtctgcctg

SEQ ID NO: 7632024 - DNA, 22 bp, Homo sapiens
gggcaagtgtcaagcatgtcat

SEQ ID NO: 7632025 - DNA, 22 bp, Homo sapiens
gggcaagtgtcaagcatgtcat

SEQ ID NO: 7632026 - DNA, 22 bp, Homo sapiens
gggcaagtaactctcgtgcggg

SEQ ID NO: 7632027 - DNA, 22 bp, Homo sapiens
gggcaagtccggtgcccagagc

SEQ ID NO: 7632028 - DNA, 22 bp, Homo sapiens
gggcaagtaactctcgtgcggg

SEQ ID NO: 7632029 - DNA, 22 bp, Homo sapiens
gggcaagtccggtgcccagagc

SEQ ID NO: 7632030 - DNA, 20 bp, Homo sapiens
gggcaaggaaacagccccca

SEQ ID NO: 7632031 - DNA, 22 bp, Homo sapiens
gggcaaggcagaagagttggag

SEQ ID NO: 7632032 - DNA, 22 bp, Homo sapiens
gggcaaggcagaagagttggag

SEQ ID NO: 7632033 - DNA, 22 bp, Homo sapiens
gggcaaggcagaagagttggag

SEQ ID NO: 7632034 - DNA, 22 bp, Homo sapiens
gggcaaggcagaagagttggag

SEQ ID NO: 7632035 - DNA, 22 bp, Homo sapiens
gggcaaggcagaagagttggag

SEQ ID NO: 7632036 - DNA, 20 bp, Homo sapiens
gggcaaggaaacagccccca

SEQ ID NO: 7632037 - DNA, 22 bp, Homo sapiens
gggcaagctttgaacatcagca

SEQ ID NO: 7632038 - DNA, 20 bp, Homo sapiens
gggcaaggaaacagccccca

SEQ ID NO: 7632039 - DNA, 20 bp, Homo sapiens
gggcaaggaaacagccccca

SEQ ID NO: 7632040 - DNA, 22 bp, Homo sapiens
gggcaagcagtggctaccagta

SEQ ID NO: 7632041 - DNA, 22 bp, Homo sapiens
gggcaagcagtggctaccagta

SEQ ID NO: 7632042 - DNA, 18 bp, Homo sapiens
gggcaagcggctgtcacc

SEQ ID NO: 7632043 - DNA, 17 bp, Homo sapiens
cagacaggctgtcaccc

SEQ ID NO: 7632044 - DNA, 17 bp, Homo sapiens
cagacaggctgtcaccc

SEQ ID NO: 7632045 - DNA, 17 bp, Homo sapiens
cagacaggctgtcaccc

SEQ ID NO: 7632046 - DNA, 17 bp, Homo sapiens
cagacaggctgtcaccc

SEQ ID NO: 7632047 - DNA, 17 bp, Homo sapiens
cagacaggctgtcaccc

SEQ ID NO: 7632048 - DNA, 22 bp, Homo sapiens
cagacaggctagccagactcac

SEQ ID NO: 7632049 - DNA, 22 bp, Homo sapiens
cagacagggacctcgctccaga

SEQ ID NO: 7632050 - DNA, 22 bp, Homo sapiens
cagacagggacctcgctccaga

SEQ ID NO: 7632051 - DNA, 22 bp, Homo sapiens
cagacagggccctgtgatggta

SEQ ID NO: 7632052 - DNA, 22 bp, Homo sapiens
cagacagggacctcgctccaga

SEQ ID NO: 7632053 - DNA, 22 bp, Homo sapiens
cagacagggacctcgctccaga

SEQ ID NO: 7632054 - DNA, 22 bp, Homo sapiens
cagacagggacctcgctccaga

SEQ ID NO: 7632055 - DNA, 22 bp, Homo sapiens
gggatgagagtagggtgtgaaa

SEQ ID NO: 7632056 - DNA, 22 bp, Homo sapiens
cagacaggggtaaccttcctca

SEQ ID NO: 7632057 - DNA, 22 bp, Homo sapiens
cagacagggtcctgtccgtcac

SEQ ID NO: 7632058 - DNA, 22 bp, Homo sapiens
gggatgagagtagggtgtgaaa

SEQ ID NO: 7632059 - DNA, 20 bp, Homo sapiens
gggatgagagtcctagctct

SEQ ID NO: 7632060 - DNA, 20 bp, Homo sapiens
gggatgagagtcctagctct

SEQ ID NO: 7632061 - DNA, 20 bp, Homo sapiens
gggatgagagtcctagctct

SEQ ID NO: 7632062 - DNA, 20 bp, Homo sapiens
gggatgagagtcctagctct

SEQ ID NO: 7632063 - DNA, 22 bp, Homo sapiens
cagacaggggtaaccttcctca

SEQ ID NO: 7632064 - DNA, 22 bp, Homo sapiens
cagacaggggtaaccttcctca

SEQ ID NO: 7632065 - DNA, 22 bp, Homo sapiens
cagacagggccctgtgatggta

SEQ ID NO: 7632066 - DNA, 22 bp, Homo sapiens
cagacagggccctgtgatggta

SEQ ID NO: 7632067 - DNA, 22 bp, Homo sapiens
cagacagggccctgtgatggta

SEQ ID NO: 7632068 - DNA, 22 bp, Homo sapiens
gggaaggaaagttattagcaga

SEQ ID NO: 7632069 - DNA, 22 bp, Homo sapiens
gggaaggaaagttattagcaga

SEQ ID NO: 7632070 - DNA, 22 bp, Homo sapiens
gggaaggaaatcttgcttgtga

SEQ ID NO: 7632071 - DNA, 22 bp, Homo sapiens
gggaaggaaatcttgcttgtga

SEQ ID NO: 7632072 - DNA, 22 bp, Homo sapiens
gggaaggacacagccatgactg

SEQ ID NO: 7632073 - DNA, 22 bp, Homo sapiens
gggaaggacacagccatgactg

SEQ ID NO: 7632074 - DNA, 22 bp, Homo sapiens
gggaaggacacagccatgactg

SEQ ID NO: 7632075 - DNA, 22 bp, Homo sapiens
gggaaggacacagccatgactg

SEQ ID NO: 7632076 - DNA, 22 bp, Homo sapiens
gggaaggaaatcttgcttgtga

SEQ ID NO: 7632077 - DNA, 22 bp, Homo sapiens
gggaaggacattctgggctcag

SEQ ID NO: 7632078 - DNA, 22 bp, Homo sapiens
gggaaggacattctgggctcag

SEQ ID NO: 7632079 - DNA, 22 bp, Homo sapiens
gggaaggacattctgggctcag

SEQ ID NO: 7632080 - DNA, 22 bp, Homo sapiens
gggaaggacacagccatgactg

SEQ ID NO: 7632081 - DNA, 22 bp, Homo sapiens
gggaaggacacagccatgactg

SEQ ID NO: 7632082 - DNA, 22 bp, Homo sapiens
gggaaggacacagccatgactg

SEQ ID NO: 7632083 - DNA, 22 bp, Homo sapiens
gggaaggacacagccatgactg

SEQ ID NO: 7632084 - DNA, 22 bp, Homo sapiens
gggaaggacacagccatgactg

SEQ ID NO: 7632085 - DNA, 22 bp, Homo sapiens
gggaaggacacagccatgactg

SEQ ID NO: 7632086 - DNA, 22 bp, Homo sapiens
gggaaggacacagccatgactg

SEQ ID NO: 7632087 - DNA, 23 bp, Homo sapiens
gggaaaggatatgatcctagggg

SEQ ID NO: 7632088 - DNA, 22 bp, Homo sapiens
gggaaagagtgcttgtccagag

SEQ ID NO: 7632089 - DNA, 23 bp, Homo sapiens
gggaaaggatatgatcctagggg

SEQ ID NO: 7632090 - DNA, 18 bp, Homo sapiens
gggaagccgggaagccgg

SEQ ID NO: 7632091 - DNA, 23 bp, Homo sapiens
gggaaaggatatgatcctagggg

SEQ ID NO: 7632092 - DNA, 22 bp, Homo sapiens
gggaaaggatcagtgggaggct

SEQ ID NO: 7632093 - DNA, 22 bp, Homo sapiens
gggaaaggatcagtgggaggct

SEQ ID NO: 7632094 - DNA, 22 bp, Homo sapiens
gggaaaggatcagtgggaggct

SEQ ID NO: 7632095 - DNA, 22 bp, Homo sapiens
gggaaggaaagttattagcaga

SEQ ID NO: 7632096 - DNA, 22 bp, Homo sapiens
gggaaggaaagttattagcaga

SEQ ID NO: 7632097 - DNA, 22 bp, Homo sapiens
gggaaggaaagttattagcaga

SEQ ID NO: 7632098 - DNA, 22 bp, Homo sapiens
gggaagctgcgtggtctagggc

SEQ ID NO: 7632099 - DNA, 22 bp, Homo sapiens
gggaagctgcgtggtctagggc

SEQ ID NO: 7632100 - DNA, 23 bp, Homo sapiens
gggaagctccatggaggtgctgg

SEQ ID NO: 7632101 - DNA, 23 bp, Homo sapiens
gggaagctccatggaggtgctgg

SEQ ID NO: 7632102 - DNA, 23 bp, Homo sapiens
gggaagctccatggaggtgctgg

SEQ ID NO: 7632103 - DNA, 23 bp, Homo sapiens
gggaagctccatggaggtgctgg

SEQ ID NO: 7632104 - DNA, 22 bp, Homo sapiens
gggaagctgaagctagagaaaa

SEQ ID NO: 7632105 - DNA, 22 bp, Homo sapiens
gggaagctgaagctagagaaaa

SEQ ID NO: 7632106 - DNA, 22 bp, Homo sapiens
gggaaggacattctgggctcag

SEQ ID NO: 7632107 - DNA, 22 bp, Homo sapiens
gggaaggacattctgggctcag

SEQ ID NO: 7632108 - DNA, 22 bp, Homo sapiens
gggaaggagcctgcttgctaga

SEQ ID NO: 7632109 - DNA, 22 bp, Homo sapiens
gggaaggagcctgcttgctaga

SEQ ID NO: 7632110 - DNA, 22 bp, Homo sapiens
gggaaggacattctgggctcag

SEQ ID NO: 7632111 - DNA, 22 bp, Homo sapiens
gggaaggacattctgggctcag

SEQ ID NO: 7632112 - DNA, 22 bp, Homo sapiens
gggaaggacattctgggctcag

SEQ ID NO: 7632113 - DNA, 22 bp, Homo sapiens
gggaaggaggtggacctgcccc

SEQ ID NO: 7632114 - DNA, 22 bp, Homo sapiens
gggaaggaggtggacctgcccc

SEQ ID NO: 7632115 - DNA, 22 bp, Homo sapiens
gggaaggaggtggacctgcccc

SEQ ID NO: 7632116 - DNA, 22 bp, Homo sapiens
gggaaggaggtggacctgcccc

SEQ ID NO: 7632117 - DNA, 22 bp, Homo sapiens
gggaaggaggtggcttgaagtg

SEQ ID NO: 7632118 - DNA, 22 bp, Homo sapiens
gggaaggaggtggacctgcccc

SEQ ID NO: 7632119 - DNA, 22 bp, Homo sapiens
gggaaggaggtggacctgcccc

SEQ ID NO: 7632120 - DNA, 22 bp, Homo sapiens
gggaaggaggtggcttgaagtg

SEQ ID NO: 7632121 - DNA, 22 bp, Homo sapiens
gggaattatagctgtcacaggc

SEQ ID NO: 7632122 - DNA, 22 bp, Homo sapiens
gggacaatggaggcctctctcc

SEQ ID NO: 7632123 - DNA, 22 bp, Homo sapiens
gggacaatggaggcctctctcc

SEQ ID NO: 7632124 - DNA, 22 bp, Homo sapiens
gggacaatggaggcctctctcc

SEQ ID NO: 7632125 - DNA, 22 bp, Homo sapiens
gggacaatggaggcctctctcc

SEQ ID NO: 7632126 - DNA, 22 bp, Homo sapiens
gggacacagagaaactggagaa

SEQ ID NO: 7632127 - DNA, 22 bp, Homo sapiens
gggacacagagaaactggagaa

SEQ ID NO: 7632128 - DNA, 15 bp, Homo sapiens
gggaatgttttacaa

SEQ ID NO: 7632129 - DNA, 22 bp, Homo sapiens
gggaatgttgactgagagcagg

SEQ ID NO: 7632130 - DNA, 22 bp, Homo sapiens
gggaatgttgactgagagcagg

SEQ ID NO: 7632131 - DNA, 16 bp, Homo sapiens
gggaatgtgtcttctc

SEQ ID NO: 7632132 - DNA, 22 bp, Homo sapiens
gggaatgtggtgatagtctata

SEQ ID NO: 7632133 - DNA, 22 bp, Homo sapiens
gggaatgtgtctgatggaaaga

SEQ ID NO: 7632134 - DNA, 22 bp, Homo sapiens
gggaatgtggtgatagtctata

SEQ ID NO: 7632135 - DNA, 22 bp, Homo sapiens
gggaatgtggcaggcagcagtt

SEQ ID NO: 7632136 - DNA, 22 bp, Homo sapiens
gggaatgtggccctggggctcc

SEQ ID NO: 7632137 - DNA, 22 bp, Homo sapiens
gggaatgtggcaggcagcagtt

SEQ ID NO: 7632138 - DNA, 22 bp, Homo sapiens
gggaaggaggtggcttgaagtg

SEQ ID NO: 7632139 - DNA, 22 bp, Homo sapiens
gggaaggaggtggcttgaagtg

SEQ ID NO: 7632140 - DNA, 22 bp, Homo sapiens
gggaaggaggtggcttgaagtg

SEQ ID NO: 7632141 - DNA, 22 bp, Homo sapiens
gggacagacccatgggccaggt

SEQ ID NO: 7632142 - DNA, 22 bp, Homo sapiens
gggacagacccatgggccaggt

SEQ ID NO: 7632143 - DNA, 22 bp, Homo sapiens
gggacagacccatgggccaggt

SEQ ID NO: 7632144 - DNA, 22 bp, Homo sapiens
gggacagacccatgggccaggt

SEQ ID NO: 7632145 - DNA, 22 bp, Homo sapiens
gggacagacccatgggccaggt

SEQ ID NO: 7632146 - DNA, 22 bp, Homo sapiens
gggacagacccatgggccaggt

SEQ ID NO: 7632147 - DNA, 22 bp, Homo sapiens
gggacagacccatgggccaggt

SEQ ID NO: 7632148 - DNA, 22 bp, Homo sapiens
gggacagagcaacttgggatgg

SEQ ID NO: 7632149 - DNA, 22 bp, Homo sapiens
gggacagacccatgggccaggt

SEQ ID NO: 7632150 - DNA, 22 bp, Homo sapiens
gggacagacccatgggccaggt

SEQ ID NO: 7632151 - DNA, 22 bp, Homo sapiens
gggacagacccatgggccaggt

SEQ ID NO: 7632152 - DNA, 22 bp, Homo sapiens
gggactcctttaaggagggtga

SEQ ID NO: 7632153 - DNA, 22 bp, Homo sapiens
gggactcctgcatttcaagtcc

SEQ ID NO: 7632154 - DNA, 22 bp, Homo sapiens
gggacagaggcaaactagcaga

SEQ ID NO: 7632155 - DNA, 22 bp, Homo sapiens
gggacagagcaacttgggatgg

SEQ ID NO: 7632156 - DNA, 22 bp, Homo sapiens
gggacagaggcaaactagcaga

SEQ ID NO: 7632157 - DNA, 22 bp, Homo sapiens
gggacagagcaacttgggatgg

SEQ ID NO: 7632158 - DNA, 22 bp, Homo sapiens
gggacagaggcaaactagcaga

SEQ ID NO: 7632159 - DNA, 22 bp, Homo sapiens
gggacagaggcaaactagcaga

SEQ ID NO: 7632160 - DNA, 22 bp, Homo sapiens
gggacagaggcaaactagcaga

SEQ ID NO: 7632161 - DNA, 22 bp, Homo sapiens
gggacagaaggaagtgagcaca

SEQ ID NO: 7632162 - DNA, 22 bp, Homo sapiens
gggacagaaggaagtgagcaca

SEQ ID NO: 7632163 - DNA, 22 bp, Homo sapiens
gggacagaaggaagtgagcaca

SEQ ID NO: 7632164 - DNA, 22 bp, Homo sapiens
gggacagaaggaagtgagcaca

SEQ ID NO: 7632165 - DNA, 22 bp, Homo sapiens
gggacagaaggaagtgagcaca

SEQ ID NO: 7632166 - DNA, 22 bp, Homo sapiens
gggacagaaggaagtgagcaca

SEQ ID NO: 7632167 - DNA, 22 bp, Homo sapiens
gggacacgggctgagcagagcc

SEQ ID NO: 7632168 - DNA, 17 bp, Homo sapiens
gggacaccccagtttgt

SEQ ID NO: 7632169 - DNA, 22 bp, Homo sapiens
gggacactggacccagtgtcca

SEQ ID NO: 7632170 - DNA, 19 bp, Homo sapiens
gggacaccagaagaacaag

SEQ ID NO: 7632171 - DNA, 21 bp, Homo sapiens
gggacaccaactccagggctt

SEQ ID NO: 7632172 - DNA, 21 bp, Homo sapiens
gggacaccaactccagggctt

SEQ ID NO: 7632173 - DNA, 22 bp, Homo sapiens
gggacacaggtatctcaaatga

SEQ ID NO: 7632174 - DNA, 22 bp, Homo sapiens
gggacacaggtatctcaaatga

SEQ ID NO: 7632175 - DNA, 22 bp, Homo sapiens
gggacacagccatctgtgtttt

SEQ ID NO: 7632176 - DNA, 22 bp, Homo sapiens
gggacacaggtatctcaaatga

SEQ ID NO: 7632177 - DNA, 22 bp, Homo sapiens
gggacacagagaaactggagaa

SEQ ID NO: 7632178 - DNA, 22 bp, Homo sapiens
gggactggaactactggtgcag

SEQ ID NO: 7632179 - DNA, 22 bp, Homo sapiens
gggactggaactactggtgcag

SEQ ID NO: 7632180 - DNA, 22 bp, Homo sapiens
gggactggaactactggtgcag

SEQ ID NO: 7632181 - DNA, 22 bp, Homo sapiens
gggactggaactactggtgcag

SEQ ID NO: 7632182 - DNA, 22 bp, Homo sapiens
gggactggaactactggtgcag

SEQ ID NO: 7632183 - DNA, 22 bp, Homo sapiens
gggactggaactactggtgcag

SEQ ID NO: 7632184 - DNA, 22 bp, Homo sapiens
gggactggaactactggtgcag

SEQ ID NO: 7632185 - DNA, 19 bp, Homo sapiens
gggactggaggatgtggag

SEQ ID NO: 7632186 - DNA, 19 bp, Homo sapiens
gggactggaggatgtggag

SEQ ID NO: 7632187 - DNA, 19 bp, Homo sapiens
gggactggaggatgtggag

SEQ ID NO: 7632188 - DNA, 19 bp, Homo sapiens
gggactggaggatgtggag

SEQ ID NO: 7632189 - DNA, 19 bp, Homo sapiens
gggactggaggatgtggag

SEQ ID NO: 7632190 - DNA, 19 bp, Homo sapiens
gggactggaggatgtggag

SEQ ID NO: 7632191 - DNA, 22 bp, Homo sapiens
gggactggagtagaggccggtg

SEQ ID NO: 7632192 - DNA, 19 bp, Homo sapiens
gggactggaggatgtggag

SEQ ID NO: 7632193 - DNA, 22 bp, Homo sapiens
gggactggagtagaggccggtg

SEQ ID NO: 7632194 - DNA, 22 bp, Homo sapiens
gggactggcacagggctgggag

SEQ ID NO: 7632195 - DNA, 22 bp, Homo sapiens
gggactggcacagggctgggag

SEQ ID NO: 7632196 - DNA, 22 bp, Homo sapiens
gggactggcacagggctgggag

SEQ ID NO: 7632197 - DNA, 22 bp, Homo sapiens
gggactggcacagggctgggag

SEQ ID NO: 7632198 - DNA, 22 bp, Homo sapiens
gggactgggagatcctcctggc

SEQ ID NO: 7632199 - DNA, 22 bp, Homo sapiens
gggactggccagggtttggaat

SEQ ID NO: 7632200 - DNA, 22 bp, Homo sapiens
gggactggagtagaggccggtg

SEQ ID NO: 7632201 - DNA, 22 bp, Homo sapiens
gggactggatagatgtgggtga

SEQ ID NO: 7632202 - DNA, 22 bp, Homo sapiens
gggactggatagatgtgggtga

SEQ ID NO: 7632203 - DNA, 22 bp, Homo sapiens
gggactggatagatgtgggtga

SEQ ID NO: 7632204 - DNA, 22 bp, Homo sapiens
gggactggagtagaggccggtg

SEQ ID NO: 7632205 - DNA, 22 bp, Homo sapiens
gggactggatagatgtgggtga

SEQ ID NO: 7632206 - DNA, 22 bp, Homo sapiens
gggactggatagatgtgggtga

SEQ ID NO: 7632207 - DNA, 22 bp, Homo sapiens
gggactggcacagggctgggag

SEQ ID NO: 7632208 - DNA, 22 bp, Homo sapiens
gggactggcacagggctgggag

SEQ ID NO: 7632209 - DNA, 22 bp, Homo sapiens
gggactggcacagggctgggag

SEQ ID NO: 7632210 - DNA, 22 bp, Homo sapiens
cactgggaatctgggaaagaga

SEQ ID NO: 7632211 - DNA, 22 bp, Homo sapiens
cactgggacctaggactgagct

SEQ ID NO: 7632212 - DNA, 22 bp, Homo sapiens
cactgggacctaggactgagct

SEQ ID NO: 7632213 - DNA, 22 bp, Homo sapiens
cactggcttgatgggtaatgcc

SEQ ID NO: 7632214 - DNA, 22 bp, Homo sapiens
cactggcttgatgggtaatgcc

SEQ ID NO: 7632215 - DNA, 22 bp, Homo sapiens
cactggcttgatgggtaatgcc

SEQ ID NO: 7632216 - DNA, 22 bp, Homo sapiens
cactggctgggccagcactcct

SEQ ID NO: 7632217 - DNA, 22 bp, Homo sapiens
cactggctgggccagcactcct

SEQ ID NO: 7632218 - DNA, 22 bp, Homo sapiens
cactgggaatctgggaaagaga

SEQ ID NO: 7632219 - DNA, 22 bp, Homo sapiens
cactgggaatctgggaaagaga

SEQ ID NO: 7632220 - DNA, 22 bp, Homo sapiens
cactggctccctgatttgaagc

SEQ ID NO: 7632221 - DNA, 22 bp, Homo sapiens
cactggctgagcttctctaggg

SEQ ID NO: 7632222 - DNA, 22 bp, Homo sapiens
cactggctccctgatttgaagc

SEQ ID NO: 7632223 - DNA, 22 bp, Homo sapiens
cactggctccctgatttgaagc

SEQ ID NO: 7632224 - DNA, 22 bp, Homo sapiens
cactggctaaagataagctcaa

SEQ ID NO: 7632225 - DNA, 22 bp, Homo sapiens
cactggctatgagggagatggg

SEQ ID NO: 7632226 - DNA, 22 bp, Homo sapiens
cactggctatgagggagatggg

SEQ ID NO: 7632227 - DNA, 22 bp, Homo sapiens
cactggctatgagggagatggg

SEQ ID NO: 7632228 - DNA, 22 bp, Homo sapiens
cactggctgagcttctctaggg

SEQ ID NO: 7632229 - DNA, 22 bp, Homo sapiens
cactggctgagcttctctaggg

SEQ ID NO: 7632230 - DNA, 22 bp, Homo sapiens
cactggctgagcttctctaggg

SEQ ID NO: 7632231 - DNA, 22 bp, Homo sapiens
cactggctgagcttctctaggg

SEQ ID NO: 7632232 - DNA, 22 bp, Homo sapiens
cactggctgagcttctctaggg

SEQ ID NO: 7632233 - DNA, 22 bp, Homo sapiens
cactggctgggccagcactcct

SEQ ID NO: 7632234 - DNA, 22 bp, Homo sapiens
cactggctgggccagcactcct

SEQ ID NO: 7632235 - DNA, 22 bp, Homo sapiens
cactggctgggccagcactcct

SEQ ID NO: 7632236 - DNA, 22 bp, Homo sapiens
cactggctaaagataagctcaa

SEQ ID NO: 7632237 - DNA, 22 bp, Homo sapiens
cactggctaaagataagctcaa

SEQ ID NO: 7632238 - DNA, 22 bp, Homo sapiens
cactggctaaaaaagaggcaga

SEQ ID NO: 7632239 - DNA, 22 bp, Homo sapiens
cactggctaaaaaagaggcaga

SEQ ID NO: 7632240 - DNA, 22 bp, Homo sapiens
cactggcctaagcgcctcagcc

SEQ ID NO: 7632241 - DNA, 22 bp, Homo sapiens
cactggctaaaaaagaggcaga

SEQ ID NO: 7632242 - DNA, 22 bp, Homo sapiens
cactggcctaagcgcctcagcc

SEQ ID NO: 7632243 - DNA, 22 bp, Homo sapiens
cactggcccattcctgtctggc

SEQ ID NO: 7632244 - DNA, 22 bp, Homo sapiens
cactggcctaagcgcctcagcc

SEQ ID NO: 7632245 - DNA, 22 bp, Homo sapiens
cactggcctaagcgcctcagcc

SEQ ID NO: 7632246 - DNA, 22 bp, Homo sapiens
cactggcccataaaggcctggg

SEQ ID NO: 7632247 - DNA, 22 bp, Homo sapiens
cactggcccattcctgtctggc

SEQ ID NO: 7632248 - DNA, 22 bp, Homo sapiens
cactggcccataaaggcctggg

SEQ ID NO: 7632249 - DNA, 22 bp, Homo sapiens
cactggcccataaaggcctggg

SEQ ID NO: 7632250 - DNA, 22 bp, Homo sapiens
cactggcccagccaggcctgtt

SEQ ID NO: 7632251 - DNA, 22 bp, Homo sapiens
cactggcccataaaggcctggg

SEQ ID NO: 7632252 - DNA, 22 bp, Homo sapiens
cactggcccagccaggcctgtt

SEQ ID NO: 7632253 - DNA, 22 bp, Homo sapiens
cactggcccagccaggcctgtt

SEQ ID NO: 7632254 - DNA, 22 bp, Homo sapiens
cactggcccagccaggcctgtt

SEQ ID NO: 7632255 - DNA, 22 bp, Homo sapiens
cagaaggcatagatgaaggcct

SEQ ID NO: 7632256 - DNA, 22 bp, Homo sapiens
cagaaggcatagatgaaggcct

SEQ ID NO: 7632257 - DNA, 22 bp, Homo sapiens
cagaaggcatagatgaaggcct

SEQ ID NO: 7632258 - DNA, 22 bp, Homo sapiens
cagaaggcatagatgaaggcct

SEQ ID NO: 7632259 - DNA, 22 bp, Homo sapiens
cagaaggcaaggcctgccacgc

SEQ ID NO: 7632260 - DNA, 22 bp, Homo sapiens
cagaaggcaaggcctgccacgc

SEQ ID NO: 7632261 - DNA, 22 bp, Homo sapiens
cagaaggcaaggcctgccacgc

SEQ ID NO: 7632262 - DNA, 22 bp, Homo sapiens
cagaaggcaaggcctgccacgc

SEQ ID NO: 7632263 - DNA, 22 bp, Homo sapiens
cagaaggcagcaaatgaaaacc

SEQ ID NO: 7632264 - DNA, 22 bp, Homo sapiens
cagaaggcagcaaatgaaaacc

SEQ ID NO: 7632265 - DNA, 22 bp, Homo sapiens
cagaaggcagcaaatgaaaacc

SEQ ID NO: 7632266 - DNA, 22 bp, Homo sapiens
cagaaggcaaacaaaaggattt

SEQ ID NO: 7632267 - DNA, 22 bp, Homo sapiens
cagaaggcaaacaaaaggattt

SEQ ID NO: 7632268 - DNA, 22 bp, Homo sapiens
cagaaggcaaacaaaaggattt

SEQ ID NO: 7632269 - DNA, 22 bp, Homo sapiens
cagaaggcaaacaaaaggattt

SEQ ID NO: 7632270 - DNA, 22 bp, Homo sapiens
cagaagcagtgagagatgtgca

SEQ ID NO: 7632271 - DNA, 22 bp, Homo sapiens
cagaagcagtgagagatgtgca

SEQ ID NO: 7632272 - DNA, 22 bp, Homo sapiens
cagaagcagtgagagatgtgca

SEQ ID NO: 7632273 - DNA, 22 bp, Homo sapiens
cagaagcagtgagagatgtgca

SEQ ID NO: 7632274 - DNA, 22 bp, Homo sapiens
cactgggagagctggacttggg

SEQ ID NO: 7632275 - DNA, 22 bp, Homo sapiens
cagaaggctggcagattgagat

SEQ ID NO: 7632276 - DNA, 22 bp, Homo sapiens
cagaaggctggcagattgagat

SEQ ID NO: 7632277 - DNA, 22 bp, Homo sapiens
cagaaggctggcagattgagat

SEQ ID NO: 7632278 - DNA, 22 bp, Homo sapiens
cagaaggctttgtggagtagac

SEQ ID NO: 7632279 - DNA, 22 bp, Homo sapiens
cagaaggctggcagattgagat

SEQ ID NO: 7632280 - DNA, 22 bp, Homo sapiens
cagaaggctttgtggagtagac

SEQ ID NO: 7632281 - DNA, 22 bp, Homo sapiens
cagaaggctttgtggagtagac

SEQ ID NO: 7632282 - DNA, 22 bp, Homo sapiens
cagaaggcctgaatctttgttc

SEQ ID NO: 7632283 - DNA, 22 bp, Homo sapiens
cagaaggctgcaggtttgctgt

SEQ ID NO: 7632284 - DNA, 22 bp, Homo sapiens
cagaaggctgcaggtttgctgt

SEQ ID NO: 7632285 - DNA, 22 bp, Homo sapiens
cagaaggcctgaatctttgttc

SEQ ID NO: 7632286 - DNA, 22 bp, Homo sapiens
cagaaggctttgtggagtagac

SEQ ID NO: 7632287 - DNA, 22 bp, Homo sapiens
cagaagggacagggtttgtaga

SEQ ID NO: 7632288 - DNA, 22 bp, Homo sapiens
cagaagggacagggtttgtaga

SEQ ID NO: 7632289 - DNA, 22 bp, Homo sapiens
cagaaggctttgtggagtagac

SEQ ID NO: 7632290 - DNA, 22 bp, Homo sapiens
cagaaggctttgtggagtagac

SEQ ID NO: 7632291 - DNA, 22 bp, Homo sapiens
cagaagggcagcactgggaagg

SEQ ID NO: 7632292 - DNA, 22 bp, Homo sapiens
cagaagggcagcactgggaagg

SEQ ID NO: 7632293 - DNA, 22 bp, Homo sapiens
cagaagggcagcactgggaagg

SEQ ID NO: 7632294 - DNA, 22 bp, Homo sapiens
cagaagggcagcactgggaagg

SEQ ID NO: 7632295 - DNA, 22 bp, Homo sapiens
cagaagggcagcactgggaagg

SEQ ID NO: 7632296 - DNA, 22 bp, Homo sapiens
cagaagggacagggtttgtaga

SEQ ID NO: 7632297 - DNA, 22 bp, Homo sapiens
gggaaactgtccagttctcccc

SEQ ID NO: 7632298 - DNA, 22 bp, Homo sapiens
gggaaactggggactgaatctg

SEQ ID NO: 7632299 - DNA, 21 bp, Homo sapiens
gggaaactctgcttaacagag

SEQ ID NO: 7632300 - DNA, 22 bp, Homo sapiens
gggaaactgcaactcagagagg

SEQ ID NO: 7632301 - DNA, 22 bp, Homo sapiens
gggaaactgaattcaggactct

SEQ ID NO: 7632302 - DNA, 22 bp, Homo sapiens
gggaaactgaattcaggactct

SEQ ID NO: 7632303 - DNA, 22 bp, Homo sapiens
gggaaagaagaagagccatttt

SEQ ID NO: 7632304 - DNA, 22 bp, Homo sapiens
gggaaagaagaagagccatttt

SEQ ID NO: 7632305 - DNA, 22 bp, Homo sapiens
gggaaactttcacaatgtccag

SEQ ID NO: 7632306 - DNA, 22 bp, Homo sapiens
gggaaacttctgctaaaaccag

SEQ ID NO: 7632307 - DNA, 22 bp, Homo sapiens
gggaaagaagatctagatactg

SEQ ID NO: 7632308 - DNA, 22 bp, Homo sapiens
gggaaagaagatctagatactg

SEQ ID NO: 7632309 - DNA, 22 bp, Homo sapiens
gggaaagaccctgagtcttatt

SEQ ID NO: 7632310 - DNA, 22 bp, Homo sapiens
gggaaagaagatctagatactg

SEQ ID NO: 7632311 - DNA, 22 bp, Homo sapiens
gggaaagaagatctagatactg

SEQ ID NO: 7632312 - DNA, 22 bp, Homo sapiens
gggaaagaagatctagatactg

SEQ ID NO: 7632313 - DNA, 22 bp, Homo sapiens
gggaaagaagaagagccatttt

SEQ ID NO: 7632314 - DNA, 22 bp, Homo sapiens
gggaaagaagaagagccatttt

SEQ ID NO: 7632315 - DNA, 22 bp, Homo sapiens
cagaagtaagattactgtgagt

SEQ ID NO: 7632316 - DNA, 22 bp, Homo sapiens
gggaaagagaggtggacgcagg

SEQ ID NO: 7632317 - DNA, 22 bp, Homo sapiens
gggaaagagaggtggacgcagg

SEQ ID NO: 7632318 - DNA, 22 bp, Homo sapiens
gggaaagagaggtggacgcagg

SEQ ID NO: 7632319 - DNA, 22 bp, Homo sapiens
gggaaagagtgcttgtccagag

SEQ ID NO: 7632320 - DNA, 22 bp, Homo sapiens
gggaaagagtgcttgtccagag

SEQ ID NO: 7632321 - DNA, 22 bp, Homo sapiens
gggaaagagtgcttgtccagag

SEQ ID NO: 7632322 - DNA, 22 bp, Homo sapiens
gggaaagagtgcttgtccagag

SEQ ID NO: 7632323 - DNA, 22 bp, Homo sapiens
gggaaagagtgcttgtccagag

SEQ ID NO: 7632324 - DNA, 22 bp, Homo sapiens
gggaaagagaggtggacgcagg

SEQ ID NO: 7632325 - DNA, 22 bp, Homo sapiens
gggaaagagaggtggacgcagg

SEQ ID NO: 7632326 - DNA, 22 bp, Homo sapiens
gggaaagagaggtggacgcagg

SEQ ID NO: 7632327 - DNA, 22 bp, Homo sapiens
gggaaagagaggtggacgcagg

SEQ ID NO: 7632328 - DNA, 22 bp, Homo sapiens
gggaaagagtgcttgtccagag

SEQ ID NO: 7632329 - DNA, 22 bp, Homo sapiens
gggaaagacttattttgacttc

SEQ ID NO: 7632330 - DNA, 22 bp, Homo sapiens
gggaaagacttattttgacttc

SEQ ID NO: 7632331 - DNA, 22 bp, Homo sapiens
gggaaagacttattttgacttc

SEQ ID NO: 7632332 - DNA, 22 bp, Homo sapiens
gggaaagagaggtggacgcagg

SEQ ID NO: 7632333 - DNA, 22 bp, Homo sapiens
gggaaagagaggtggacgcagg

SEQ ID NO: 7632334 - DNA, 22 bp, Homo sapiens
gggaaagagaggtggacgcagg

SEQ ID NO: 7632335 - DNA, 22 bp, Homo sapiens
gggaaagagaggtggacgcagg

SEQ ID NO: 7632336 - DNA, 22 bp, Homo sapiens
gggaaagaccctgagtcttatt

SEQ ID NO: 7632337 - DNA, 22 bp, Homo sapiens
gggaaagaccctgagtcttatt

SEQ ID NO: 7632338 - DNA, 22 bp, Homo sapiens
gggaaagaccttcctggggtgt

SEQ ID NO: 7632339 - DNA, 22 bp, Homo sapiens
gggaaagaccttcctggggtgt

SEQ ID NO: 7632340 - DNA, 22 bp, Homo sapiens
gggaaagaccttcctggggtgt

SEQ ID NO: 7632341 - DNA, 22 bp, Homo sapiens
gggaaagaccttcctggggtgt

SEQ ID NO: 7632342 - DNA, 22 bp, Homo sapiens
gggaaagaccttcctggggtgt

SEQ ID NO: 7632343 - DNA, 22 bp, Homo sapiens
gggaaagacttattttgacttc

SEQ ID NO: 7632344 - DNA, 20 bp, Homo sapiens
cagaaggtctaagctttaga

SEQ ID NO: 7632345 - DNA, 22 bp, Homo sapiens
cagaaggtattgtaattatgac

SEQ ID NO: 7632346 - DNA, 22 bp, Homo sapiens
cagaaggtattgtaattatgac

SEQ ID NO: 7632347 - DNA, 22 bp, Homo sapiens
cagaaggttccacaagatagaa

SEQ ID NO: 7632348 - DNA, 22 bp, Homo sapiens
cagaaggtttacactggactgt

SEQ ID NO: 7632349 - DNA, 21 bp, Homo sapiens
cagaagtaagggtaacttctc

SEQ ID NO: 7632350 - DNA, 22 bp, Homo sapiens
cagaagtaagattactgtgaga

SEQ ID NO: 7632351 - DNA, 22 bp, Homo sapiens
cagaagtcaccctcagaataac

SEQ ID NO: 7632352 - DNA, 22 bp, Homo sapiens
cagaagtaagattactgtgagt

SEQ ID NO: 7632353 - DNA, 21 bp, Homo sapiens
cagaagtaagggtaacttctc

SEQ ID NO: 7632354 - DNA, 22 bp, Homo sapiens
cagaagtaagattactgtgagt

SEQ ID NO: 7632355 - DNA, 22 bp, Homo sapiens
cagaagtaagattactgtgaga

SEQ ID NO: 7632356 - DNA, 22 bp, Homo sapiens
cagaagtaagattactgtgaga

SEQ ID NO: 7632357 - DNA, 22 bp, Homo sapiens
cagaaggtttgaaagatgtctt

SEQ ID NO: 7632358 - DNA, 22 bp, Homo sapiens
cagaagtctttctgtttcacct

SEQ ID NO: 7632359 - DNA, 22 bp, Homo sapiens
cagaagtctttctgtttcacct

SEQ ID NO: 7632360 - DNA, 22 bp, Homo sapiens
cagaagtcaccctcagaataac

SEQ ID NO: 7632361 - DNA, 22 bp, Homo sapiens
cagaagtcaccctcagaataac

SEQ ID NO: 7632362 - DNA, 18 bp, Homo sapiens
cagaagtccttcaaggcc

SEQ ID NO: 7632363 - DNA, 18 bp, Homo sapiens
cagaagtccttcaaggcc

SEQ ID NO: 7632364 - DNA, 22 bp, Homo sapiens
ggcttttgaattccaaggcatt

SEQ ID NO: 7632365 - DNA, 22 bp, Homo sapiens
ggcttttgctgtgttttccaga

SEQ ID NO: 7632366 - DNA, 22 bp, Homo sapiens
gggaaaaataatgcacagatat

SEQ ID NO: 7632367 - DNA, 22 bp, Homo sapiens
gggaaaaataatgcacagatat

SEQ ID NO: 7632368 - DNA, 22 bp, Homo sapiens
gggaaaaataatgcacagatat

SEQ ID NO: 7632369 - DNA, 22 bp, Homo sapiens
gggaaactcaggcatttccact

SEQ ID NO: 7632370 - DNA, 22 bp, Homo sapiens
gggaaactcacaggtgcagggg

SEQ ID NO: 7632371 - DNA, 22 bp, Homo sapiens
gggaaactcacaggtgcagggg

SEQ ID NO: 7632372 - DNA, 22 bp, Homo sapiens
gggaaacaacaaagtatctatg

SEQ ID NO: 7632373 - DNA, 22 bp, Homo sapiens
gggaaactagaagcagggttat

SEQ ID NO: 7632374 - DNA, 22 bp, Homo sapiens
atatgtatgtacgcacatattc

SEQ ID NO: 7632375 - DNA, 22 bp, Homo sapiens
atatgtattttaacgtgtaagg

SEQ ID NO: 7632376 - DNA, 22 bp, Homo sapiens
atatgtattttaacgtgtaagg

SEQ ID NO: 7632377 - DNA, 22 bp, Homo sapiens
atatgtattttaacgtgtaagg

SEQ ID NO: 7632378 - DNA, 22 bp, Homo sapiens
atatgtattttaacgtgtaagg

SEQ ID NO: 7632379 - DNA, 22 bp, Homo sapiens
atatgtatgtgttttctttgga

SEQ ID NO: 7632380 - DNA, 22 bp, Homo sapiens
atatgtatgtacgcacatattc

SEQ ID NO: 7632381 - DNA, 22 bp, Homo sapiens
atatgtatgtacgcacatattc

SEQ ID NO: 7632382 - DNA, 22 bp, Homo sapiens
atatgtatgtacgcacatattc

SEQ ID NO: 7632383 - DNA, 22 bp, Homo sapiens
atatgtatagccagtctttagg

SEQ ID NO: 7632384 - DNA, 22 bp, Homo sapiens
atatgtatagccagtctttagg

SEQ ID NO: 7632385 - DNA, 22 bp, Homo sapiens
atatgtactgaaactgcttttc

SEQ ID NO: 7632386 - DNA, 22 bp, Homo sapiens
atatgtatagccagtctttagg

SEQ ID NO: 7632387 - DNA, 22 bp, Homo sapiens
atatgggtcatgtgatgttcaa

SEQ ID NO: 7632388 - DNA, 20 bp, Homo sapiens
atatgggtgatgatgtctgt

SEQ ID NO: 7632389 - DNA, 22 bp, Homo sapiens
atatggtaagagtatatttact

SEQ ID NO: 7632390 - DNA, 22 bp, Homo sapiens
atatgtacacttacgttacaaa

SEQ ID NO: 7632391 - DNA, 22 bp, Homo sapiens
atatgtacacttacgttacaaa

SEQ ID NO: 7632392 - DNA, 22 bp, Homo sapiens
atatgtacacttacgttacaaa

SEQ ID NO: 7632393 - DNA, 22 bp, Homo sapiens
atatgtacacttacgttacaaa

SEQ ID NO: 7632394 - DNA, 22 bp, Homo sapiens
atatgggggggcgtgcagagga

SEQ ID NO: 7632395 - DNA, 22 bp, Homo sapiens
atatgggggggcgtgcagagga

SEQ ID NO: 7632396 - DNA, 22 bp, Homo sapiens
atatgggggggcgtgcagagga

SEQ ID NO: 7632397 - DNA, 22 bp, Homo sapiens
atatgggggggcgtgcagagga

SEQ ID NO: 7632398 - DNA, 22 bp, Homo sapiens
atatgggggggcgtgcagagga

SEQ ID NO: 7632399 - DNA, 22 bp, Homo sapiens
atatgggggggcgtgcagagga

SEQ ID NO: 7632400 - DNA, 22 bp, Homo sapiens
atatgggggggcgtgcagagga

SEQ ID NO: 7632401 - DNA, 22 bp, Homo sapiens
atatgggggggcgtgcagagga

SEQ ID NO: 7632402 - DNA, 22 bp, Homo sapiens
atatggcttgtagcatgaataa

SEQ ID NO: 7632403 - DNA, 22 bp, Homo sapiens
atatggcttatttatagagcaa

SEQ ID NO: 7632404 - DNA, 22 bp, Homo sapiens
atatggctgtttcactagctga

SEQ ID NO: 7632405 - DNA, 22 bp, Homo sapiens
atatggcttttctgtagtagtt

SEQ ID NO: 7632406 - DNA, 22 bp, Homo sapiens
atatgggggggcgtgcagagga

SEQ ID NO: 7632407 - DNA, 22 bp, Homo sapiens
atatgggggggcgtgcagagga

SEQ ID NO: 7632408 - DNA, 22 bp, Homo sapiens
atatggctgttggtagccaaca

SEQ ID NO: 7632409 - DNA, 23 bp, Homo sapiens
atatggctgttgtgtgttaacat

SEQ ID NO: 7632410 - DNA, 22 bp, Homo sapiens
atatggctgttgcacatctaag

SEQ ID NO: 7632411 - DNA, 22 bp, Homo sapiens
atatgtctctgtacaacagtct

SEQ ID NO: 7632412 - DNA, 23 bp, Homo sapiens
atatgtcatgcaccagcacttta

SEQ ID NO: 7632413 - DNA, 22 bp, Homo sapiens
atatgtcataattgtgtctgta

SEQ ID NO: 7632414 - DNA, 22 bp, Homo sapiens
atatgtcaagattttgagcaga

SEQ ID NO: 7632415 - DNA, 23 bp, Homo sapiens
atatgtcatgcaccagcacttta

SEQ ID NO: 7632416 - DNA, 22 bp, Homo sapiens
atatgtgtacgtgcagtatata

SEQ ID NO: 7632417 - DNA, 22 bp, Homo sapiens
atatgtgtaaatgcatttgttt

SEQ ID NO: 7632418 - DNA, 22 bp, Homo sapiens
atatgtgtaaatgcatttgttt

SEQ ID NO: 7632419 - DNA, 22 bp, Homo sapiens
atatgtggcattatttctgagg

SEQ ID NO: 7632420 - DNA, 22 bp, Homo sapiens
atatgtgatttgacttctggca

SEQ ID NO: 7632421 - DNA, 22 bp, Homo sapiens
atatgtgaatgatatcactttg

SEQ ID NO: 7632422 - DNA, 22 bp, Homo sapiens
atatgtgtgtgtgagaaaagct

SEQ ID NO: 7632423 - DNA, 22 bp, Homo sapiens
atatgtgtgccatttcagcagt

SEQ ID NO: 7632424 - DNA, 22 bp, Homo sapiens
atatgtgtgccatttcagcagt

SEQ ID NO: 7632425 - DNA, 22 bp, Homo sapiens
atatgtgtgtgtgagaaaagct

SEQ ID NO: 7632426 - DNA, 22 bp, Homo sapiens
atatgtgtgcacatatgtattt

SEQ ID NO: 7632427 - DNA, 22 bp, Homo sapiens
atatgtgtgcacatatgtattt

SEQ ID NO: 7632428 - DNA, 22 bp, Homo sapiens
atatgtgtgatgcatggactaa

SEQ ID NO: 7632429 - DNA, 22 bp, Homo sapiens
atatgtgtgatgcatggactaa

SEQ ID NO: 7632430 - DNA, 22 bp, Homo sapiens
atatgtgtgcacatatgtattt

SEQ ID NO: 7632431 - DNA, 22 bp, Homo sapiens
atatgtgtgccatttcagcagt

SEQ ID NO: 7632432 - DNA, 22 bp, Homo sapiens
atatgtgtgccatttcagcagt

SEQ ID NO: 7632433 - DNA, 22 bp, Homo sapiens
atatgtgtatggatttctatct

SEQ ID NO: 7632434 - DNA, 22 bp, Homo sapiens
atatgtgtatttggttagccta

SEQ ID NO: 7632435 - DNA, 20 bp, Homo sapiens
atatgtgtacgtgtatacat

SEQ ID NO: 7632436 - DNA, 20 bp, Homo sapiens
atatgtgtacgtgtatacat

SEQ ID NO: 7632437 - DNA, 20 bp, Homo sapiens
atatgtgtacgtgtatacat

SEQ ID NO: 7632438 - DNA, 20 bp, Homo sapiens
atatgtgtacgtgtatacat

SEQ ID NO: 7632439 - DNA, 22 bp, Homo sapiens
atatgtgtacgtgcagtatata

SEQ ID NO: 7632440 - DNA, 20 bp, Homo sapiens
atatgtgtacgtgtatacat

SEQ ID NO: 7632441 - DNA, 22 bp, Homo sapiens
atatgtttttggaaagaacaca

SEQ ID NO: 7632442 - DNA, 22 bp, Homo sapiens
atatgtttttggaaagaacaca

SEQ ID NO: 7632443 - DNA, 22 bp, Homo sapiens
atatttactgctgtggtgaagg

SEQ ID NO: 7632444 - DNA, 22 bp, Homo sapiens
atatgtttttcacaggtttaag

SEQ ID NO: 7632445 - DNA, 22 bp, Homo sapiens
atatgtttttcacaggtttaag

SEQ ID NO: 7632446 - DNA, 22 bp, Homo sapiens
atatgtttttggaaagaacaca

SEQ ID NO: 7632447 - DNA, 22 bp, Homo sapiens
atatgtttttggaaagaacaca

SEQ ID NO: 7632448 - DNA, 22 bp, Homo sapiens
atatgtttttcacaggtttaag

SEQ ID NO: 7632449 - DNA, 22 bp, Homo sapiens
atatgtttttcacaggtttaag

SEQ ID NO: 7632450 - DNA, 22 bp, Homo sapiens
atatttctctcagacatggaag

SEQ ID NO: 7632451 - DNA, 22 bp, Homo sapiens
atatttctctcagacatggaag

SEQ ID NO: 7632452 - DNA, 22 bp, Homo sapiens
atatttctctcagacatggaag

SEQ ID NO: 7632453 - DNA, 22 bp, Homo sapiens
atatttagctcatttccagtgc

SEQ ID NO: 7632454 - DNA, 22 bp, Homo sapiens
atatttagctcatttccagtgc

SEQ ID NO: 7632455 - DNA, 22 bp, Homo sapiens
atatgtttcagtattcaagtca

SEQ ID NO: 7632456 - DNA, 22 bp, Homo sapiens
atatgtttcagtattcaagtca

SEQ ID NO: 7632457 - DNA, 22 bp, Homo sapiens
atatgtttcagtattcaagtca

SEQ ID NO: 7632458 - DNA, 22 bp, Homo sapiens
atatgtttcagtattcaagtca

SEQ ID NO: 7632459 - DNA, 22 bp, Homo sapiens
atatgtttcagtattcaagtca

SEQ ID NO: 7632460 - DNA, 22 bp, Homo sapiens
atatgtttcagtattcaagtca

SEQ ID NO: 7632461 - DNA, 22 bp, Homo sapiens
atatgtttcagtattcaagtca

SEQ ID NO: 7632462 - DNA, 22 bp, Homo sapiens
atatgtttcagtattcaagtca

SEQ ID NO: 7632463 - DNA, 22 bp, Homo sapiens
atatgttttgtgcttcattggt

SEQ ID NO: 7632464 - DNA, 22 bp, Homo sapiens
atatgttttgtgcttcattggt

SEQ ID NO: 7632465 - DNA, 22 bp, Homo sapiens
atatgttttgtgcttcattggt

SEQ ID NO: 7632466 - DNA, 22 bp, Homo sapiens
atatgttactctttcaagcaga

SEQ ID NO: 7632467 - DNA, 22 bp, Homo sapiens
atatgttactctttcaagcaga

SEQ ID NO: 7632468 - DNA, 22 bp, Homo sapiens
atatgttactctttcaagcaga

SEQ ID NO: 7632469 - DNA, 22 bp, Homo sapiens
atatgttactctttcaagcaga

SEQ ID NO: 7632470 - DNA, 22 bp, Homo sapiens
atatgttactctttcaagcaga

SEQ ID NO: 7632471 - DNA, 20 bp, Homo sapiens
atatttcttaagaactttca

SEQ ID NO: 7632472 - DNA, 20 bp, Homo sapiens
atatttcttaagaactttca

SEQ ID NO: 7632473 - DNA, 20 bp, Homo sapiens
atatttcttaagaactttca

SEQ ID NO: 7632474 - DNA, 20 bp, Homo sapiens
atatttcttaagaactttca

SEQ ID NO: 7632475 - DNA, 20 bp, Homo sapiens
atatttcttaagaactttca

SEQ ID NO: 7632476 - DNA, 22 bp, Homo sapiens
atatttctgggggtgtgtttct

SEQ ID NO: 7632477 - DNA, 22 bp, Homo sapiens
atatttctgggggtgtgtttct

SEQ ID NO: 7632478 - DNA, 20 bp, Homo sapiens
atatttcttaagaactttca

SEQ ID NO: 7632479 - DNA, 22 bp, Homo sapiens
atatttctgggggtgtgtttct

SEQ ID NO: 7632480 - DNA, 22 bp, Homo sapiens
atatttctgggggtgtgtttct

SEQ ID NO: 7632481 - DNA, 22 bp, Homo sapiens
atatttctctcagacatggaag

SEQ ID NO: 7632482 - DNA, 22 bp, Homo sapiens
atatttctctcagacatggaag

SEQ ID NO: 7632483 - DNA, 22 bp, Homo sapiens
atatttctgggggtgtgtttct

SEQ ID NO: 7632484 - DNA, 22 bp, Homo sapiens
atatttctctcagacatggaag

SEQ ID NO: 7632485 - DNA, 22 bp, Homo sapiens
atatttctctcagacatggaag

SEQ ID NO: 7632486 - DNA, 22 bp, Homo sapiens
atatttgcaggaaactagtttt

SEQ ID NO: 7632487 - DNA, 22 bp, Homo sapiens
atatttgcaggaaactagtttt

SEQ ID NO: 7632488 - DNA, 22 bp, Homo sapiens
atatttggaaagaaaatcattg

SEQ ID NO: 7632489 - DNA, 22 bp, Homo sapiens
atatttgctgagaaggagggag

SEQ ID NO: 7632490 - DNA, 22 bp, Homo sapiens
atatttgcaggaaactagtttt

SEQ ID NO: 7632491 - DNA, 22 bp, Homo sapiens
atatttgcaggaaactagtttt

SEQ ID NO: 7632492 - DNA, 22 bp, Homo sapiens
atatttgagggcaatagggtgg

SEQ ID NO: 7632493 - DNA, 22 bp, Homo sapiens
atatttcttgagcacctggtat

SEQ ID NO: 7632494 - DNA, 22 bp, Homo sapiens
atatttcttgagcacctggtat

SEQ ID NO: 7632495 - DNA, 22 bp, Homo sapiens
atatttgtaaaattctgtgtct

SEQ ID NO: 7632496 - DNA, 22 bp, Homo sapiens
atatttgtaaaattctgtgtct

SEQ ID NO: 7632497 - DNA, 22 bp, Homo sapiens
atatttgtaaaattctgtgtct

SEQ ID NO: 7632498 - DNA, 22 bp, Homo sapiens
atatttggaaagaaaatcattg

SEQ ID NO: 7632499 - DNA, 22 bp, Homo sapiens
atatttgtaaaattctgtgtct

SEQ ID NO: 7632500 - DNA, 22 bp, Homo sapiens
atatttgtagtgggtaagaagt

SEQ ID NO: 7632501 - DNA, 22 bp, Homo sapiens
atatttgtagtgggtaagaagt

SEQ ID NO: 7632502 - DNA, 22 bp, Homo sapiens
atatttgtatttcgtgtgtgta

SEQ ID NO: 7632503 - DNA, 22 bp, Homo sapiens
atatttgtagtgggtaagaagt

SEQ ID NO: 7632504 - DNA, 22 bp, Homo sapiens
atatatgcatgtgtacttatgt

SEQ ID NO: 7632505 - DNA, 22 bp, Homo sapiens
atatatgcatgtgtacttatgt

SEQ ID NO: 7632506 - DNA, 19 bp, Homo sapiens
atatatgtatacaatgtgg

SEQ ID NO: 7632507 - DNA, 22 bp, Homo sapiens
atatcattctgatgtatatctt

SEQ ID NO: 7632508 - DNA, 22 bp, Homo sapiens
atatatgaagaagtcttgatta

SEQ ID NO: 7632509 - DNA, 22 bp, Homo sapiens
atatatcttcattaggtcgaga

SEQ ID NO: 7632510 - DNA, 22 bp, Homo sapiens
atatatctgcagtactgaagaa

SEQ ID NO: 7632511 - DNA, 22 bp, Homo sapiens
atatccaccattctgcaccttc

SEQ ID NO: 7632512 - DNA, 22 bp, Homo sapiens
atatgaaagtaagcatgtgtgt

SEQ ID NO: 7632513 - DNA, 18 bp, Homo sapiens
atatccaataatgaacac

SEQ ID NO: 7632514 - DNA, 18 bp, Homo sapiens
atatccaataatgaacac

SEQ ID NO: 7632515 - DNA, 21 bp, Homo sapiens
atatgaactgtggactttgga

SEQ ID NO: 7632516 - DNA, 22 bp, Homo sapiens
atatgaaagtaagcatgtgtgt

SEQ ID NO: 7632517 - DNA, 22 bp, Homo sapiens
atatgaaagtaagcatgtgtgt

SEQ ID NO: 7632518 - DNA, 18 bp, Homo sapiens
atatccaataatgaacac

SEQ ID NO: 7632519 - DNA, 22 bp, Homo sapiens
atatccaagaaacaattaattc

SEQ ID NO: 7632520 - DNA, 22 bp, Homo sapiens
atatccaagaaacaattaattc

SEQ ID NO: 7632521 - DNA, 22 bp, Homo sapiens
atatcattctgatgtatatctt

SEQ ID NO: 7632522 - DNA, 22 bp, Homo sapiens
atatcattctgatgtatatctt

SEQ ID NO: 7632523 - DNA, 22 bp, Homo sapiens
atatatattgcccaggctggtt

SEQ ID NO: 7632524 - DNA, 22 bp, Homo sapiens
atatatattgcccaggctggtt

SEQ ID NO: 7632525 - DNA, 22 bp, Homo sapiens
atatatattgcccaggctggtt

SEQ ID NO: 7632526 - DNA, 22 bp, Homo sapiens
atatatattgcccaggctggtt

SEQ ID NO: 7632527 - DNA, 22 bp, Homo sapiens
atatatattgcccaggctggtt

SEQ ID NO: 7632528 - DNA, 22 bp, Homo sapiens
atatatattgcccaggctggtt

SEQ ID NO: 7632529 - DNA, 22 bp, Homo sapiens
atatatcatgagtaaaacttga

SEQ ID NO: 7632530 - DNA, 22 bp, Homo sapiens
atatatcatgagtaaaacttga

SEQ ID NO: 7632531 - DNA, 22 bp, Homo sapiens
atatatcatgagtaaaacttga

SEQ ID NO: 7632532 - DNA, 22 bp, Homo sapiens
atatatcatgagtaaaacttga

SEQ ID NO: 7632533 - DNA, 22 bp, Homo sapiens
atatatcatgagtaaaacttga

SEQ ID NO: 7632534 - DNA, 22 bp, Homo sapiens
atatatcatgagtaaaacttga

SEQ ID NO: 7632535 - DNA, 22 bp, Homo sapiens
atatatctgcagtactgaagaa

SEQ ID NO: 7632536 - DNA, 22 bp, Homo sapiens
atatatctgcagtactgaagaa

SEQ ID NO: 7632537 - DNA, 22 bp, Homo sapiens
atatatcatgagtaaaacttga

SEQ ID NO: 7632538 - DNA, 22 bp, Homo sapiens
atatatcatgagtaaaacttga

SEQ ID NO: 7632539 - DNA, 22 bp, Homo sapiens
atatgattccactattgtatgg

SEQ ID NO: 7632540 - DNA, 22 bp, Homo sapiens
atatgattccactattgtatgg

SEQ ID NO: 7632541 - DNA, 22 bp, Homo sapiens
atatgagtttcccacttctgga

SEQ ID NO: 7632542 - DNA, 21 bp, Homo sapiens
atatgagtttcagatgttgct

SEQ ID NO: 7632543 - DNA, 22 bp, Homo sapiens
atatgagagtaaatgccgatct

SEQ ID NO: 7632544 - DNA, 22 bp, Homo sapiens
atatgagagaggaaagatttta

SEQ ID NO: 7632545 - DNA, 22 bp, Homo sapiens
atatgagagaggaaagatttta

SEQ ID NO: 7632546 - DNA, 22 bp, Homo sapiens
atatgacagcggattcacatat

SEQ ID NO: 7632547 - DNA, 22 bp, Homo sapiens
atatgacataaaatcatttttg

SEQ ID NO: 7632548 - DNA, 22 bp, Homo sapiens
atatgacataaaatcatttttg

SEQ ID NO: 7632549 - DNA, 22 bp, Homo sapiens
atatgacataaaatcatttttg

SEQ ID NO: 7632550 - DNA, 22 bp, Homo sapiens
atatgacataaaatcatttttg

SEQ ID NO: 7632551 - DNA, 22 bp, Homo sapiens
atatgagaattggaaaatatca

SEQ ID NO: 7632552 - DNA, 22 bp, Homo sapiens
atatgagaattggaaaatatca

SEQ ID NO: 7632553 - DNA, 22 bp, Homo sapiens
atatgaatttggctggaaaggt

SEQ ID NO: 7632554 - DNA, 22 bp, Homo sapiens
atatgaagttacaggtaagaaa

SEQ ID NO: 7632555 - DNA, 22 bp, Homo sapiens
atatgaagttacaggtaagaaa

SEQ ID NO: 7632556 - DNA, 22 bp, Homo sapiens
atatgaagtcagacaaactggg

SEQ ID NO: 7632557 - DNA, 22 bp, Homo sapiens
atatgaagaattccaatttgga

SEQ ID NO: 7632558 - DNA, 22 bp, Homo sapiens
atatgaagaattccaatttgga

SEQ ID NO: 7632559 - DNA, 22 bp, Homo sapiens
atatgaatttggggaggacaca

SEQ ID NO: 7632560 - DNA, 22 bp, Homo sapiens
atatgaatttggctggaaaggt

SEQ ID NO: 7632561 - DNA, 22 bp, Homo sapiens
atatgaatttggctggaaaggt

SEQ ID NO: 7632562 - DNA, 22 bp, Homo sapiens
atatgaatttggctggaaaggt

SEQ ID NO: 7632563 - DNA, 22 bp, Homo sapiens
atatgacagcggattcacatat

SEQ ID NO: 7632564 - DNA, 22 bp, Homo sapiens
atatgacagcggattcacatat

SEQ ID NO: 7632565 - DNA, 22 bp, Homo sapiens
atatgacagcggattcacatat

SEQ ID NO: 7632566 - DNA, 22 bp, Homo sapiens
atatgacagcggattcacatat

SEQ ID NO: 7632567 - DNA, 22 bp, Homo sapiens
atatggcagaccaattagaagc

SEQ ID NO: 7632568 - DNA, 22 bp, Homo sapiens
atatgctggagtacaggaaata

SEQ ID NO: 7632569 - DNA, 22 bp, Homo sapiens
atatgctggagtacaggaaata

SEQ ID NO: 7632570 - DNA, 22 bp, Homo sapiens
atatgcttacactacaagatga

SEQ ID NO: 7632571 - DNA, 22 bp, Homo sapiens
atatgcttacactacaagatga

SEQ ID NO: 7632572 - DNA, 21 bp, Homo sapiens
atatggctcagagctggtact

SEQ ID NO: 7632573 - DNA, 22 bp, Homo sapiens
atatggcattttaatgtatgag

SEQ ID NO: 7632574 - DNA, 22 bp, Homo sapiens
atatggctaggttactaaactg

SEQ ID NO: 7632575 - DNA, 22 bp, Homo sapiens
atatggcattttaatgtatgag

SEQ ID NO: 7632576 - DNA, 22 bp, Homo sapiens
atatggcattttaatgtatgag

SEQ ID NO: 7632577 - DNA, 22 bp, Homo sapiens
atatggcattacattgttaaat

SEQ ID NO: 7632578 - DNA, 22 bp, Homo sapiens
atatggcattacattgttaaat

SEQ ID NO: 7632579 - DNA, 22 bp, Homo sapiens
atatggctggagcctctgcctt

SEQ ID NO: 7632580 - DNA, 20 bp, Homo sapiens
atatggctgtgtgttgggag

SEQ ID NO: 7632581 - DNA, 22 bp, Homo sapiens
atatggctgtgtttatagccat

SEQ ID NO: 7632582 - DNA, 22 bp, Homo sapiens
atatggctcttccaaactgaga

SEQ ID NO: 7632583 - DNA, 22 bp, Homo sapiens
atatggctctggctctgccttg

SEQ ID NO: 7632584 - DNA, 22 bp, Homo sapiens
atatggctctggctctgccttg

SEQ ID NO: 7632585 - DNA, 20 bp, Homo sapiens
atatggctccgttcagtcgg

SEQ ID NO: 7632586 - DNA, 22 bp, Homo sapiens
ctgggcagtggtggcccttccc

SEQ ID NO: 7632587 - DNA, 22 bp, Homo sapiens
ctgggcagtggtggcccttccc

SEQ ID NO: 7632588 - DNA, 22 bp, Homo sapiens
ctgggcagtggtggcccttccc

SEQ ID NO: 7632589 - DNA, 22 bp, Homo sapiens
ctgggcagtggtggcccttccc

SEQ ID NO: 7632590 - DNA, 22 bp, Homo sapiens
ctgggcagtggtggcccttccc

SEQ ID NO: 7632591 - DNA, 22 bp, Homo sapiens
ctgggcagtggtggcccttccc

SEQ ID NO: 7632592 - DNA, 22 bp, Homo sapiens
ctgggcagttcgctttcgtttt

SEQ ID NO: 7632593 - DNA, 22 bp, Homo sapiens
ctgggcagtgggcaagttgtat

SEQ ID NO: 7632594 - DNA, 22 bp, Homo sapiens
ctgggcagtggtggcatctttg

SEQ ID NO: 7632595 - DNA, 22 bp, Homo sapiens
ctgggcagtggtggcatctttg

SEQ ID NO: 7632596 - DNA, 22 bp, Homo sapiens
ctgggcagtggtggcatctttg

SEQ ID NO: 7632597 - DNA, 22 bp, Homo sapiens
ctgggcagtggtggcccttccc

SEQ ID NO: 7632598 - DNA, 22 bp, Homo sapiens
ctgggcagtggtggcatctttg

SEQ ID NO: 7632599 - DNA, 22 bp, Homo sapiens
ctgggcagtggtggcatctttg

SEQ ID NO: 7632600 - DNA, 22 bp, Homo sapiens
ctgggcaggatacttcatggga

SEQ ID NO: 7632601 - DNA, 22 bp, Homo sapiens
ctgggcaggatacttcatggga

SEQ ID NO: 7632602 - DNA, 22 bp, Homo sapiens
ctgggcaggtatacaaaaaatg

SEQ ID NO: 7632603 - DNA, 22 bp, Homo sapiens
ctgggcaggtatacaaaaaatg

SEQ ID NO: 7632604 - DNA, 22 bp, Homo sapiens
ctgggcaggtatacaaaaaatg

SEQ ID NO: 7632605 - DNA, 20 bp, Homo sapiens
ctgggcaggtgtttgatctc

SEQ ID NO: 7632606 - DNA, 22 bp, Homo sapiens
ctgggcagtgggcaagttgtat

SEQ ID NO: 7632607 - DNA, 22 bp, Homo sapiens
ctgggcagtgcagctatagaac

SEQ ID NO: 7632608 - DNA, 22 bp, Homo sapiens
ctgggcagtgcagctatagaac

SEQ ID NO: 7632609 - DNA, 22 bp, Homo sapiens
ctgggcagtatgaatattcaaa

SEQ ID NO: 7632610 - DNA, 22 bp, Homo sapiens
ctgggcagtgcagctatagaac

SEQ ID NO: 7632611 - DNA, 22 bp, Homo sapiens
ctgggcagtatgaatattcaaa

SEQ ID NO: 7632612 - DNA, 22 bp, Homo sapiens
ctgggcagtatgaatattcaaa

SEQ ID NO: 7632613 - DNA, 22 bp, Homo sapiens
ctgggcaggatacttcatggga

SEQ ID NO: 7632614 - DNA, 22 bp, Homo sapiens
ctgggcaggagggctctatgga

SEQ ID NO: 7632615 - DNA, 22 bp, Homo sapiens
atatgcaagcacatagaatact

SEQ ID NO: 7632616 - DNA, 22 bp, Homo sapiens
atatgcaagcacatagaatact

SEQ ID NO: 7632617 - DNA, 22 bp, Homo sapiens
ctgggcaggagggctctatgga

SEQ ID NO: 7632618 - DNA, 22 bp, Homo sapiens
ctgggcaggagggctctatgga

SEQ ID NO: 7632619 - DNA, 22 bp, Homo sapiens
atatgattccactattgtatgg

SEQ ID NO: 7632620 - DNA, 22 bp, Homo sapiens
atatgatgtgctatgtcactag

SEQ ID NO: 7632621 - DNA, 22 bp, Homo sapiens
atatgattgtccttagcaaatt

SEQ ID NO: 7632622 - DNA, 22 bp, Homo sapiens
atatgattgtccttagcaaatt

SEQ ID NO: 7632623 - DNA, 22 bp, Homo sapiens
atatgattccactattgtatgg

SEQ ID NO: 7632624 - DNA, 22 bp, Homo sapiens
atatgattgtccttagcaaatt

SEQ ID NO: 7632625 - DNA, 22 bp, Homo sapiens
atatacttggagactatcattg

SEQ ID NO: 7632626 - DNA, 22 bp, Homo sapiens
atatacttggagactatcattg

SEQ ID NO: 7632627 - DNA, 22 bp, Homo sapiens
atatacttggagactatcattg

SEQ ID NO: 7632628 - DNA, 22 bp, Homo sapiens
atataatacaacctgctaagtg

SEQ ID NO: 7632629 - DNA, 22 bp, Homo sapiens
atataatacaacctgctaagtg

SEQ ID NO: 7632630 - DNA, 22 bp, Homo sapiens
atatacttttcactaatggcta

SEQ ID NO: 7632631 - DNA, 22 bp, Homo sapiens
atatacttttcactaatggcta

SEQ ID NO: 7632632 - DNA, 22 bp, Homo sapiens
atatacttttcactaatggcta

SEQ ID NO: 7632633 - DNA, 22 bp, Homo sapiens
atatataacctggataaggctt

SEQ ID NO: 7632634 - DNA, 22 bp, Homo sapiens
atataatacaacctgctaagtg

SEQ ID NO: 7632635 - DNA, 22 bp, Homo sapiens
atataatacaacctgctaagtg

SEQ ID NO: 7632636 - DNA, 22 bp, Homo sapiens
atataatacaacctgctaagtg

SEQ ID NO: 7632637 - DNA, 22 bp, Homo sapiens
atataatacaacctgctaagtg

SEQ ID NO: 7632638 - DNA, 22 bp, Homo sapiens
atataatacaacctgctaagtg

SEQ ID NO: 7632639 - DNA, 22 bp, Homo sapiens
atatatacaactagattaaaag

SEQ ID NO: 7632640 - DNA, 22 bp, Homo sapiens
atatatacaactagattaaaag

SEQ ID NO: 7632641 - DNA, 22 bp, Homo sapiens
atatatacaactagattaaaag

SEQ ID NO: 7632642 - DNA, 22 bp, Homo sapiens
atatatacaactagattaaaag

SEQ ID NO: 7632643 - DNA, 22 bp, Homo sapiens
atatataatacttgctgtgggc

SEQ ID NO: 7632644 - DNA, 22 bp, Homo sapiens
atatataatacttgctgtgggc

SEQ ID NO: 7632645 - DNA, 22 bp, Homo sapiens
atatataagctgatgagccaca

SEQ ID NO: 7632646 - DNA, 22 bp, Homo sapiens
atatataatacttgctgtgggc

SEQ ID NO: 7632647 - DNA, 22 bp, Homo sapiens
atatataatacttgctgtgggc

SEQ ID NO: 7632648 - DNA, 22 bp, Homo sapiens
atatataacctggataaggctt

SEQ ID NO: 7632649 - DNA, 22 bp, Homo sapiens
atatataacctggataaggctt

SEQ ID NO: 7632650 - DNA, 22 bp, Homo sapiens
atatataagctgatgagccaca

SEQ ID NO: 7632651 - DNA, 22 bp, Homo sapiens
atatataagctgatgagccaca

SEQ ID NO: 7632652 - DNA, 22 bp, Homo sapiens
atataacatacatacagaaaag

SEQ ID NO: 7632653 - DNA, 22 bp, Homo sapiens
atataacatacatacagaaaag

SEQ ID NO: 7632654 - DNA, 22 bp, Homo sapiens
atataacatacatacagaaaag

SEQ ID NO: 7632655 - DNA, 22 bp, Homo sapiens
atataaagtgtttagaaagctg

SEQ ID NO: 7632656 - DNA, 22 bp, Homo sapiens
ctgggacacccaaggaaagagc

SEQ ID NO: 7632657 - DNA, 22 bp, Homo sapiens
atataacatacatacagaaaag

SEQ ID NO: 7632658 - DNA, 22 bp, Homo sapiens
atataacatacatacagaaaag

SEQ ID NO: 7632659 - DNA, 22 bp, Homo sapiens
atataacatacatacagaaaag

SEQ ID NO: 7632660 - DNA, 22 bp, Homo sapiens
atataacatacatacagaaaag

SEQ ID NO: 7632661 - DNA, 19 bp, Homo sapiens
ctgggacaatgaaagcatc

SEQ ID NO: 7632662 - DNA, 19 bp, Homo sapiens
ctgggacaatgaaagcatc

SEQ ID NO: 7632663 - DNA, 19 bp, Homo sapiens
ctgggacaatgaaagcatc

SEQ ID NO: 7632664 - DNA, 22 bp, Homo sapiens
ctgggacacagccttacctggg

SEQ ID NO: 7632665 - DNA, 22 bp, Homo sapiens
ctgggacacagccttacctggg

SEQ ID NO: 7632666 - DNA, 22 bp, Homo sapiens
atataagttagtggtcatgttt

SEQ ID NO: 7632667 - DNA, 22 bp, Homo sapiens
atataagtgtgtggctgttagt

SEQ ID NO: 7632668 - DNA, 22 bp, Homo sapiens
atataagtgtgtggctgttagt

SEQ ID NO: 7632669 - DNA, 22 bp, Homo sapiens
atataagttagtggtcatgttt

SEQ ID NO: 7632670 - DNA, 20 bp, Homo sapiens
atataataaattttggttac

SEQ ID NO: 7632671 - DNA, 20 bp, Homo sapiens
atataataaattttggttac

SEQ ID NO: 7632672 - DNA, 22 bp, Homo sapiens
atataagttagtggtcatgttt

SEQ ID NO: 7632673 - DNA, 22 bp, Homo sapiens
atataagttagtggtcatgttt

SEQ ID NO: 7632674 - DNA, 20 bp, Homo sapiens
atataataaattttggttac

SEQ ID NO: 7632675 - DNA, 20 bp, Homo sapiens
atataataaattttggttac

SEQ ID NO: 7632676 - DNA, 20 bp, Homo sapiens
atataataaattttggttac

SEQ ID NO: 7632677 - DNA, 22 bp, Homo sapiens
atataactcttgttcttatagt

SEQ ID NO: 7632678 - DNA, 22 bp, Homo sapiens
atataactcttgttcttatagt

SEQ ID NO: 7632679 - DNA, 22 bp, Homo sapiens
atataactcttgttcttatagt

SEQ ID NO: 7632680 - DNA, 22 bp, Homo sapiens
atataactcttgttcttatagt

SEQ ID NO: 7632681 - DNA, 22 bp, Homo sapiens
atataactcttgttcttatagt

SEQ ID NO: 7632682 - DNA, 22 bp, Homo sapiens
atataactctccattaagggcc

SEQ ID NO: 7632683 - DNA, 22 bp, Homo sapiens
atataactcttgttcttatagt

SEQ ID NO: 7632684 - DNA, 22 bp, Homo sapiens
atataactcttgttcttatagt

SEQ ID NO: 7632685 - DNA, 22 bp, Homo sapiens
atataactcttgttcttatagt

SEQ ID NO: 7632686 - DNA, 22 bp, Homo sapiens
atataacatacatacagaaaag

SEQ ID NO: 7632687 - DNA, 22 bp, Homo sapiens
atataacatacatacagaaaag

SEQ ID NO: 7632688 - DNA, 22 bp, Homo sapiens
atataacatacatacagaaaag

SEQ ID NO: 7632689 - DNA, 22 bp, Homo sapiens
ctgggaagggagtcaagatact

SEQ ID NO: 7632690 - DNA, 22 bp, Homo sapiens
ctgggaagggagtcaagatact

SEQ ID NO: 7632691 - DNA, 22 bp, Homo sapiens
ctgggaagggagtcaagatact

SEQ ID NO: 7632692 - DNA, 22 bp, Homo sapiens
ctgggaagggacgccagtgcct

SEQ ID NO: 7632693 - DNA, 22 bp, Homo sapiens
ctgggaaggagggttgcgaagg

SEQ ID NO: 7632694 - DNA, 22 bp, Homo sapiens
ctgggaagggacgccagtgcct

SEQ ID NO: 7632695 - DNA, 22 bp, Homo sapiens
ctgggaagggacgccagtgcct

SEQ ID NO: 7632696 - DNA, 22 bp, Homo sapiens
ctgggaagggacgccagtgcct

SEQ ID NO: 7632697 - DNA, 22 bp, Homo sapiens
ctgggaagggacgccagtgcct

SEQ ID NO: 7632698 - DNA, 22 bp, Homo sapiens
ctgggaagggacgccagtgcct

SEQ ID NO: 7632699 - DNA, 22 bp, Homo sapiens
ctgggaagccatgtttctagga

SEQ ID NO: 7632700 - DNA, 22 bp, Homo sapiens
ctgggaagcttcgagcaggaaa

SEQ ID NO: 7632701 - DNA, 22 bp, Homo sapiens
ctgggaagcttcgagcaggaaa

SEQ ID NO: 7632702 - DNA, 22 bp, Homo sapiens
ctgggaagcttcgagcaggaaa

SEQ ID NO: 7632703 - DNA, 22 bp, Homo sapiens
ctgggaagcttcgagcaggaaa

SEQ ID NO: 7632704 - DNA, 22 bp, Homo sapiens
ctgggaagcttcgagcaggaaa

SEQ ID NO: 7632705 - DNA, 22 bp, Homo sapiens
ctgggaagcttcgagcaggaaa

SEQ ID NO: 7632706 - DNA, 22 bp, Homo sapiens
ctgggaagcttcgagcaggaaa

SEQ ID NO: 7632707 - DNA, 22 bp, Homo sapiens
ctgggaaggggaaggtcctctc

SEQ ID NO: 7632708 - DNA, 22 bp, Homo sapiens
ctgggaaggggaaggtcctctc

SEQ ID NO: 7632709 - DNA, 22 bp, Homo sapiens
ctgggaaggggaaggtcctctc

SEQ ID NO: 7632710 - DNA, 22 bp, Homo sapiens
ctgggaagtagaatcagatgag

SEQ ID NO: 7632711 - DNA, 22 bp, Homo sapiens
ctgggaagtagaatcagatgag

SEQ ID NO: 7632712 - DNA, 22 bp, Homo sapiens
ctgggaagtggtgagggcctga

SEQ ID NO: 7632713 - DNA, 22 bp, Homo sapiens
ctgggaagtggtgagggcctga

SEQ ID NO: 7632714 - DNA, 22 bp, Homo sapiens
ctgggaagtagaatcagatgag

SEQ ID NO: 7632715 - DNA, 22 bp, Homo sapiens
ctgggaagtagaatcagatgag

SEQ ID NO: 7632716 - DNA, 22 bp, Homo sapiens
ctgggacaagctctgtctagct

SEQ ID NO: 7632717 - DNA, 22 bp, Homo sapiens
ctgggaatgagcaggtggctcc

SEQ ID NO: 7632718 - DNA, 22 bp, Homo sapiens
ctgggaatgagcaggtggctcc

SEQ ID NO: 7632719 - DNA, 22 bp, Homo sapiens
ctgggaatcagaatgaacgtct

SEQ ID NO: 7632720 - DNA, 22 bp, Homo sapiens
ctgggaagtggtgagggcctga

SEQ ID NO: 7632721 - DNA, 22 bp, Homo sapiens
ctgggaagtggtgagggcctga

SEQ ID NO: 7632722 - DNA, 22 bp, Homo sapiens
ctgggaagtggtgagggcctga

SEQ ID NO: 7632723 - DNA, 22 bp, Homo sapiens
ctgggaagcatggtgatggtat

SEQ ID NO: 7632724 - DNA, 22 bp, Homo sapiens
ctgggaagcatggtgatggtat

SEQ ID NO: 7632725 - DNA, 22 bp, Homo sapiens
ctgggaagcatggtgatggtat

SEQ ID NO: 7632726 - DNA, 22 bp, Homo sapiens
ctgggaagcatggtgatggtat

SEQ ID NO: 7632727 - DNA, 22 bp, Homo sapiens
ctgggaagcatggtgatggtat

SEQ ID NO: 7632728 - DNA, 22 bp, Homo sapiens
ctgggaagccacagggtgtggg

SEQ ID NO: 7632729 - DNA, 22 bp, Homo sapiens
ctgggaagccacagggtgtggg

SEQ ID NO: 7632730 - DNA, 22 bp, Homo sapiens
ctgggaagccacagggtgtggg

SEQ ID NO: 7632731 - DNA, 22 bp, Homo sapiens
ctgggaagccacagggtgtggg

SEQ ID NO: 7632732 - DNA, 22 bp, Homo sapiens
ctggcttgaagttatgcaccag

SEQ ID NO: 7632733 - DNA, 22 bp, Homo sapiens
ctggcttgaagttatgcaccag

SEQ ID NO: 7632734 - DNA, 23 bp, Homo sapiens
ctggcttctggggcctctgtttc

SEQ ID NO: 7632735 - DNA, 23 bp, Homo sapiens
ctggcttctggggcctctgtttc

SEQ ID NO: 7632736 - DNA, 22 bp, Homo sapiens
ctggcttctgggccagggcaga

SEQ ID NO: 7632737 - DNA, 22 bp, Homo sapiens
ctggcttctgggccagggcaga

SEQ ID NO: 7632738 - DNA, 22 bp, Homo sapiens
ctgggaagcatggtgatggtat

SEQ ID NO: 7632739 - DNA, 22 bp, Homo sapiens
ctggcttgcagctcatcataaa

SEQ ID NO: 7632740 - DNA, 22 bp, Homo sapiens
ctggcagcttagcactctggtt

SEQ ID NO: 7632741 - DNA, 22 bp, Homo sapiens
ctggcagcttagcactctggtt

SEQ ID NO: 7632742 - DNA, 22 bp, Homo sapiens
ctggcttctgggccagggcaga

SEQ ID NO: 7632743 - DNA, 22 bp, Homo sapiens
ctggcagcttagcactctggtt

SEQ ID NO: 7632744 - DNA, 22 bp, Homo sapiens
ctggcagctgtgtgaagaactg

SEQ ID NO: 7632745 - DNA, 22 bp, Homo sapiens
ctggcagctggaggctagaggc

SEQ ID NO: 7632746 - DNA, 22 bp, Homo sapiens
ctggcagctggaggctagaggc

SEQ ID NO: 7632747 - DNA, 22 bp, Homo sapiens
ctggcagctggaggctagaggc

SEQ ID NO: 7632748 - DNA, 22 bp, Homo sapiens
ctggcagctggaggctagaggc

SEQ ID NO: 7632749 - DNA, 22 bp, Homo sapiens
ctggcagctgcccgagatgccc

SEQ ID NO: 7632750 - DNA, 22 bp, Homo sapiens
ctggcagctgcccgagatgccc

SEQ ID NO: 7632751 - DNA, 22 bp, Homo sapiens
ctggcagctggaggctagaggc

SEQ ID NO: 7632752 - DNA, 22 bp, Homo sapiens
ctggcagctggaggctagaggc

SEQ ID NO: 7632753 - DNA, 20 bp, Homo sapiens
ctgggcacctgtctgcagtt

SEQ ID NO: 7632754 - DNA, 22 bp, Homo sapiens
ctgggcacctttgcagcaggct

SEQ ID NO: 7632755 - DNA, 22 bp, Homo sapiens
ctgggcacctttgcagcaggct

SEQ ID NO: 7632756 - DNA, 22 bp, Homo sapiens
ctgggcacctttgcagcaggct

SEQ ID NO: 7632757 - DNA, 22 bp, Homo sapiens
atatatatcgagttcatgtctc

SEQ ID NO: 7632758 - DNA, 22 bp, Homo sapiens
atatatatcgagttcatgtctc

SEQ ID NO: 7632759 - DNA, 22 bp, Homo sapiens
atatatatcgagttcatgtctc

SEQ ID NO: 7632760 - DNA, 22 bp, Homo sapiens
atatatatcgagttcatgtctc

SEQ ID NO: 7632761 - DNA, 22 bp, Homo sapiens
atatatatcgagttcatgtctc

SEQ ID NO: 7632762 - DNA, 22 bp, Homo sapiens
atatatatgctgatggctgcca

SEQ ID NO: 7632763 - DNA, 22 bp, Homo sapiens
atatatatgctgatggctgcca

SEQ ID NO: 7632764 - DNA, 22 bp, Homo sapiens
atatatatgctgatggctgcca

SEQ ID NO: 7632765 - DNA, 22 bp, Homo sapiens
atatatatgctgatggctgcca

SEQ ID NO: 7632766 - DNA, 22 bp, Homo sapiens
atatatatgctgatggctgcca

SEQ ID NO: 7632767 - DNA, 22 bp, Homo sapiens
atatatatcgagttcatgtctc

SEQ ID NO: 7632768 - DNA, 22 bp, Homo sapiens
ctgggcacattttgactagtgt

SEQ ID NO: 7632769 - DNA, 22 bp, Homo sapiens
ctgggcacattttgactagtgt

SEQ ID NO: 7632770 - DNA, 22 bp, Homo sapiens
ctgggcacagtggctcacgcct

SEQ ID NO: 7632771 - DNA, 22 bp, Homo sapiens
ctgggcacagtggctcacgcct

SEQ ID NO: 7632772 - DNA, 22 bp, Homo sapiens
ctgggcacagtggctcacgcct

SEQ ID NO: 7632773 - DNA, 22 bp, Homo sapiens
ctgggcacagtggctcacgcct

SEQ ID NO: 7632774 - DNA, 22 bp, Homo sapiens
ctgggcacaggggagcagagtc

SEQ ID NO: 7632775 - DNA, 22 bp, Homo sapiens
ctgggcacaggggagcagagtc

SEQ ID NO: 7632776 - DNA, 22 bp, Homo sapiens
ctgggcacagtggctcacgcct

SEQ ID NO: 7632777 - DNA, 22 bp, Homo sapiens
ctgggcacagtggctcacgcct

SEQ ID NO: 7632778 - DNA, 22 bp, Homo sapiens
ctgggcacagtggctcacgcct

SEQ ID NO: 7632779 - DNA, 23 bp, Homo sapiens
ctgggcacccagtacctaggccc

SEQ ID NO: 7632780 - DNA, 23 bp, Homo sapiens
ctgggcacccagtacctaggccc

SEQ ID NO: 7632781 - DNA, 22 bp, Homo sapiens
ctgggcaccaggcatgacaggg

SEQ ID NO: 7632782 - DNA, 23 bp, Homo sapiens
ctgggcacccagtacctaggccc

SEQ ID NO: 7632783 - DNA, 22 bp, Homo sapiens
ctgggcaccaggcatgacaggg

SEQ ID NO: 7632784 - DNA, 22 bp, Homo sapiens
ctgggcaccaggcatgacaggg

SEQ ID NO: 7632785 - DNA, 22 bp, Homo sapiens
ctgggcaccaggcatgacaggg

SEQ ID NO: 7632786 - DNA, 22 bp, Homo sapiens
ctgggcaccaggcatgacaggg

SEQ ID NO: 7632787 - DNA, 20 bp, Homo sapiens
ctgggcacctgtctgcagtt

SEQ ID NO: 7632788 - DNA, 20 bp, Homo sapiens
ctgggcacctgtctgcagtt

SEQ ID NO: 7632789 - DNA, 23 bp, Homo sapiens
ctgggcacccagtacctaggccc

SEQ ID NO: 7632790 - DNA, 23 bp, Homo sapiens
ctgggcacccagtacctaggccc

SEQ ID NO: 7632791 - DNA, 20 bp, Homo sapiens
ctgggcacctgtctgcagtt

SEQ ID NO: 7632792 - DNA, 22 bp, Homo sapiens
ctgggagtactgggggatgtca

SEQ ID NO: 7632793 - DNA, 19 bp, Homo sapiens
ctgggaggtgttcagagaa

SEQ ID NO: 7632794 - DNA, 22 bp, Homo sapiens
ctgggcacaagtggccctggat

SEQ ID NO: 7632795 - DNA, 19 bp, Homo sapiens
ctgggaggtgttcagagaa

SEQ ID NO: 7632796 - DNA, 19 bp, Homo sapiens
ctgggaggtgttcagagaa

SEQ ID NO: 7632797 - DNA, 22 bp, Homo sapiens
ctgggcacaagtggccctggat

SEQ ID NO: 7632798 - DNA, 22 bp, Homo sapiens
ctgggcacaagtggccctggat

SEQ ID NO: 7632799 - DNA, 22 bp, Homo sapiens
ctgggcacaagtggccctggat

SEQ ID NO: 7632800 - DNA, 22 bp, Homo sapiens
ctgggcacacagtgactctgca

SEQ ID NO: 7632801 - DNA, 22 bp, Homo sapiens
ctgggcacacagtgactctgca

SEQ ID NO: 7632802 - DNA, 22 bp, Homo sapiens
ctgggcacacagtgactctgca

SEQ ID NO: 7632803 - DNA, 22 bp, Homo sapiens
ctgggcacacagtgactctgca

SEQ ID NO: 7632804 - DNA, 22 bp, Homo sapiens
ctgggcacacagtgactctgca

SEQ ID NO: 7632805 - DNA, 22 bp, Homo sapiens
ctgggcacactctgctccagct

SEQ ID NO: 7632806 - DNA, 22 bp, Homo sapiens
ctgggcacactctgctccagct

SEQ ID NO: 7632807 - DNA, 22 bp, Homo sapiens
ctgggcacactctgctccagct

SEQ ID NO: 7632808 - DNA, 22 bp, Homo sapiens
ctgggcacactctgctccagct

SEQ ID NO: 7632809 - DNA, 22 bp, Homo sapiens
ctgggcacactctgctccagct

SEQ ID NO: 7632810 - DNA, 22 bp, Homo sapiens
ctgggcacacagtgactctgca

SEQ ID NO: 7632811 - DNA, 22 bp, Homo sapiens
ctgggcacagcgttgggctctt

SEQ ID NO: 7632812 - DNA, 22 bp, Homo sapiens
ctgggcacagcgttgggctctt

SEQ ID NO: 7632813 - DNA, 22 bp, Homo sapiens
ctgggcacagcgttgggctctt

SEQ ID NO: 7632814 - DNA, 22 bp, Homo sapiens
ctgggcacactctgctccagct

SEQ ID NO: 7632815 - DNA, 22 bp, Homo sapiens
ctgggcacagaccccctgggcc

SEQ ID NO: 7632816 - DNA, 22 bp, Homo sapiens
ctgggcacagaccccctgggcc

SEQ ID NO: 7632817 - DNA, 22 bp, Homo sapiens
ctgggcacagaccccctgggcc

SEQ ID NO: 7632818 - DNA, 22 bp, Homo sapiens
ctgggcacaggggagcagagtc

SEQ ID NO: 7632819 - DNA, 22 bp, Homo sapiens
ctgggcacaggggagcagagtc

SEQ ID NO: 7632820 - DNA, 22 bp, Homo sapiens
ctgggcacagcgttgggctctt

SEQ ID NO: 7632821 - DNA, 22 bp, Homo sapiens
ctgggcacaggggagcagagtc

SEQ ID NO: 7632822 - DNA, 22 bp, Homo sapiens
ctgggcacagcgttgggctctt

SEQ ID NO: 7632823 - DNA, 22 bp, Homo sapiens
ctgggcacagcgttgggctctt

SEQ ID NO: 7632824 - DNA, 22 bp, Homo sapiens
ctgggcacagcgttgggctctt

SEQ ID NO: 7632825 - DNA, 22 bp, Homo sapiens
ctgggagagcctttcctgagtc

SEQ ID NO: 7632826 - DNA, 22 bp, Homo sapiens
ctgggagagcctttcctgagtc

SEQ ID NO: 7632827 - DNA, 22 bp, Homo sapiens
ctgggagagcctttcctgagtc

SEQ ID NO: 7632828 - DNA, 22 bp, Homo sapiens
ctgggagagcctttcctgagtc

SEQ ID NO: 7632829 - DNA, 22 bp, Homo sapiens
ctgggagaggaacctcgagggt

SEQ ID NO: 7632830 - DNA, 22 bp, Homo sapiens
ctgggagaggaacctcgagggt

SEQ ID NO: 7632831 - DNA, 22 bp, Homo sapiens
ctgggagaggaacctcgagggt

SEQ ID NO: 7632832 - DNA, 22 bp, Homo sapiens
ctgggagaggaacctcgagggt

SEQ ID NO: 7632833 - DNA, 22 bp, Homo sapiens
ctgggagaggaacctcgagggt

SEQ ID NO: 7632834 - DNA, 22 bp, Homo sapiens
ctgggagagaagcgaagctggg

SEQ ID NO: 7632835 - DNA, 22 bp, Homo sapiens
ctgggagagaagcgaagctggg

SEQ ID NO: 7632836 - DNA, 22 bp, Homo sapiens
ctgggagagaagcgaagctggg

SEQ ID NO: 7632837 - DNA, 22 bp, Homo sapiens
ctgggagagacacttctgatta

SEQ ID NO: 7632838 - DNA, 22 bp, Homo sapiens
ctgggagagacacttctgatta

SEQ ID NO: 7632839 - DNA, 22 bp, Homo sapiens
ctgggagagaagcgaagctggg

SEQ ID NO: 7632840 - DNA, 22 bp, Homo sapiens
ctgggagagaagcgaagctggg

SEQ ID NO: 7632841 - DNA, 22 bp, Homo sapiens
ctgggagagaagcgaagctggg

SEQ ID NO: 7632842 - DNA, 22 bp, Homo sapiens
ctgggagagaagcgaagctggg

SEQ ID NO: 7632843 - DNA, 22 bp, Homo sapiens
ctgggagagaagcgaagctggg

SEQ ID NO: 7632844 - DNA, 22 bp, Homo sapiens
ctgggagacaagagagggctga

SEQ ID NO: 7632845 - DNA, 22 bp, Homo sapiens
ctgggagacaagagagggctga

SEQ ID NO: 7632846 - DNA, 22 bp, Homo sapiens
ctgggagacaagagagggctga

SEQ ID NO: 7632847 - DNA, 22 bp, Homo sapiens
ctgggagacaagagagggctga

SEQ ID NO: 7632848 - DNA, 22 bp, Homo sapiens
ctgggagacaagagagggctga

SEQ ID NO: 7632849 - DNA, 22 bp, Homo sapiens
ctgggagacaagagagggctga

SEQ ID NO: 7632850 - DNA, 22 bp, Homo sapiens
ctgggagaatttgttgaaggat

SEQ ID NO: 7632851 - DNA, 22 bp, Homo sapiens
ctgggagaatttgttgaaggat

SEQ ID NO: 7632852 - DNA, 22 bp, Homo sapiens
ctgggagaatttgttgaaggat

SEQ ID NO: 7632853 - DNA, 22 bp, Homo sapiens
ctgggagaatttgttgaaggat

SEQ ID NO: 7632854 - DNA, 22 bp, Homo sapiens
ctgggagacgcagctggggatc

SEQ ID NO: 7632855 - DNA, 22 bp, Homo sapiens
ctgggagacaagagagggctga

SEQ ID NO: 7632856 - DNA, 22 bp, Homo sapiens
ctgggagacgcagctggggatc

SEQ ID NO: 7632857 - DNA, 22 bp, Homo sapiens
ctgggagacgcagctggggatc

SEQ ID NO: 7632858 - DNA, 22 bp, Homo sapiens
ctgggagacgcagctggggatc

SEQ ID NO: 7632859 - DNA, 22 bp, Homo sapiens
ctgggagacgcagctggggatc

SEQ ID NO: 7632860 - DNA, 22 bp, Homo sapiens
ctgggagacgcagctggggatc

SEQ ID NO: 7632861 - DNA, 22 bp, Homo sapiens
atatatacaactagattaaaag

SEQ ID NO: 7632862 - DNA, 22 bp, Homo sapiens
atatatacaactagattaaaag

SEQ ID NO: 7632863 - DNA, 22 bp, Homo sapiens
atatatactttgacacattctg

SEQ ID NO: 7632864 - DNA, 22 bp, Homo sapiens
atatatactttgacacattctg

SEQ ID NO: 7632865 - DNA, 22 bp, Homo sapiens
atatatacaactagattaaaag

SEQ ID NO: 7632866 - DNA, 22 bp, Homo sapiens
atatatacaactagattaaaag

SEQ ID NO: 7632867 - DNA, 22 bp, Homo sapiens
atatatacaactagattaaaag

SEQ ID NO: 7632868 - DNA, 22 bp, Homo sapiens
atatatacaactagattaaaag

SEQ ID NO: 7632869 - DNA, 22 bp, Homo sapiens
atatatacaactagattaaaag

SEQ ID NO: 7632870 - DNA, 22 bp, Homo sapiens
atatatacaactagattaaaag

SEQ ID NO: 7632871 - DNA, 22 bp, Homo sapiens
atatatacaactagattaaaag

SEQ ID NO: 7632872 - DNA, 22 bp, Homo sapiens
atatatagagctagatgttaaa

SEQ ID NO: 7632873 - DNA, 22 bp, Homo sapiens
atatatactttgacacattctg

SEQ ID NO: 7632874 - DNA, 22 bp, Homo sapiens
atatatactttgacacattctg

SEQ ID NO: 7632875 - DNA, 22 bp, Homo sapiens
atatatactttgacacattctg

SEQ ID NO: 7632876 - DNA, 22 bp, Homo sapiens
atatatactttgacacattctg

SEQ ID NO: 7632877 - DNA, 22 bp, Homo sapiens
atatatactttgacacattctg

SEQ ID NO: 7632878 - DNA, 22 bp, Homo sapiens
atatatactttgacacattctg

SEQ ID NO: 7632879 - DNA, 22 bp, Homo sapiens
atatatactttgacacattctg

SEQ ID NO: 7632880 - DNA, 22 bp, Homo sapiens
atatatactttgacacattctg

SEQ ID NO: 7632881 - DNA, 22 bp, Homo sapiens
atatatatcgagttcatgtctc

SEQ ID NO: 7632882 - DNA, 22 bp, Homo sapiens
atatatatcgagttcatgtctc

SEQ ID NO: 7632883 - DNA, 22 bp, Homo sapiens
ctgggactttaccctgtggccc

SEQ ID NO: 7632884 - DNA, 22 bp, Homo sapiens
ctgggactttaccctgtggccc

SEQ ID NO: 7632885 - DNA, 22 bp, Homo sapiens
atatatatcgagttcatgtctc

SEQ ID NO: 7632886 - DNA, 22 bp, Homo sapiens
atatatatcgagttcatgtctc

SEQ ID NO: 7632887 - DNA, 22 bp, Homo sapiens
atatatagagctagatgttaaa

SEQ ID NO: 7632888 - DNA, 22 bp, Homo sapiens
atatatagagctagatgttaaa

SEQ ID NO: 7632889 - DNA, 22 bp, Homo sapiens
ctgggactttgtaggccagttg

SEQ ID NO: 7632890 - DNA, 22 bp, Homo sapiens
ctgggactttgtaggccagttg

SEQ ID NO: 7632891 - DNA, 22 bp, Homo sapiens
ctgggactttgtaggccagttg

SEQ ID NO: 7632892 - DNA, 22 bp, Homo sapiens
ctgggactttgtaggccagttg

SEQ ID NO: 7632893 - DNA, 22 bp, Homo sapiens
ctgggactttgtaggccagttg

SEQ ID NO: 7632894 - DNA, 22 bp, Homo sapiens
ctgggactttaccctgtggccc

SEQ ID NO: 7632895 - DNA, 22 bp, Homo sapiens
ctgggactttaccctgtggccc

SEQ ID NO: 7632896 - DNA, 22 bp, Homo sapiens
atcatcatgcactctcaggttt

SEQ ID NO: 7632897 - DNA, 22 bp, Homo sapiens
atcatgctgacacagtttatct

SEQ ID NO: 7632898 - DNA, 22 bp, Homo sapiens
atcatggaaaggttcagcaagc

SEQ ID NO: 7632899 - DNA, 22 bp, Homo sapiens
atcatggaagcctatcttgaga

SEQ ID NO: 7632900 - DNA, 22 bp, Homo sapiens
atcatggaaaggttcagcaagc

SEQ ID NO: 7632901 - DNA, 22 bp, Homo sapiens
atcatgtaccctaaaaatggaa

SEQ ID NO: 7632902 - DNA, 22 bp, Homo sapiens
atcatgtacttgacaaatatgt

SEQ ID NO: 7632903 - DNA, 22 bp, Homo sapiens
atcatgtacttgacaaatatgt

SEQ ID NO: 7632904 - DNA, 22 bp, Homo sapiens
atcatgtaccctaaaaatggaa

SEQ ID NO: 7632905 - DNA, 22 bp, Homo sapiens
atcatgtcttcagctatttgta

SEQ ID NO: 7632906 - DNA, 22 bp, Homo sapiens
atcatgttcatcgtatttaggc

SEQ ID NO: 7632907 - DNA, 22 bp, Homo sapiens
atcatgttcatcgtatttaggc

SEQ ID NO: 7632908 - DNA, 22 bp, Homo sapiens
atcatgttcatcgtatttaggc

SEQ ID NO: 7632909 - DNA, 22 bp, Homo sapiens
atcatgttcatcgtatttaggc

SEQ ID NO: 7632910 - DNA, 22 bp, Homo sapiens
atcatgttaaatatttcaatct

SEQ ID NO: 7632911 - DNA, 22 bp, Homo sapiens
atcatgttcatcgtatttaggc

SEQ ID NO: 7632912 - DNA, 18 bp, Homo sapiens
atcatgctgaattaaaga

SEQ ID NO: 7632913 - DNA, 22 bp, Homo sapiens
atcatgcattgtattgagttga

SEQ ID NO: 7632914 - DNA, 22 bp, Homo sapiens
atcatgcattgtattgagttga

SEQ ID NO: 7632915 - DNA, 22 bp, Homo sapiens
atcatgcatggtactcttgtgc

SEQ ID NO: 7632916 - DNA, 22 bp, Homo sapiens
atcatgcagctaatccaattca

SEQ ID NO: 7632917 - DNA, 22 bp, Homo sapiens
atcatgcaggtttctcctttct

SEQ ID NO: 7632918 - DNA, 22 bp, Homo sapiens
atcatgcagcaacaagcaaggc

SEQ ID NO: 7632919 - DNA, 22 bp, Homo sapiens
atcatgcagcaacaagcaaggc

SEQ ID NO: 7632920 - DNA, 22 bp, Homo sapiens
atcatgcaataaggtgaggcct

SEQ ID NO: 7632921 - DNA, 22 bp, Homo sapiens
atcatgcagagtctgggcttca

SEQ ID NO: 7632922 - DNA, 22 bp, Homo sapiens
atcatgcagagtctgggcttca

SEQ ID NO: 7632923 - DNA, 22 bp, Homo sapiens
atcatcatgcactctcaggttt

SEQ ID NO: 7632924 - DNA, 22 bp, Homo sapiens
atcatcattcttggataaagca

SEQ ID NO: 7632925 - DNA, 22 bp, Homo sapiens
atcatcatgctacaatcagcaa

SEQ ID NO: 7632926 - DNA, 22 bp, Homo sapiens
atcatgacatctgagtttaagt

SEQ ID NO: 7632927 - DNA, 22 bp, Homo sapiens
atcatgacatacttttgagaag

SEQ ID NO: 7632928 - DNA, 22 bp, Homo sapiens
atcatgacagagtctgccatcc

SEQ ID NO: 7632929 - DNA, 22 bp, Homo sapiens
atcatgaatcttgtgttctatg

SEQ ID NO: 7632930 - DNA, 22 bp, Homo sapiens
atcatgaatcttgtgttctatg

SEQ ID NO: 7632931 - DNA, 22 bp, Homo sapiens
atcatgacagagtctgccatcc

SEQ ID NO: 7632932 - DNA, 22 bp, Homo sapiens
atcatgacagagtctgccatcc

SEQ ID NO: 7632933 - DNA, 22 bp, Homo sapiens
ctgtgcaagcccaagataaaac

SEQ ID NO: 7632934 - DNA, 22 bp, Homo sapiens
ctgtgcaaggcccatgctcaga

SEQ ID NO: 7632935 - DNA, 22 bp, Homo sapiens
ctgtgcaagacttactttaata

SEQ ID NO: 7632936 - DNA, 22 bp, Homo sapiens
ctgtgcaagcccaagataaaac

SEQ ID NO: 7632937 - DNA, 22 bp, Homo sapiens
ctgtgcaagcccaagataaaac

SEQ ID NO: 7632938 - DNA, 22 bp, Homo sapiens
ctgtgcaaataaagagcaacat

SEQ ID NO: 7632939 - DNA, 22 bp, Homo sapiens
ctgtgatttctaaagagtagca

SEQ ID NO: 7632940 - DNA, 22 bp, Homo sapiens
ctgtgatgacaggcagggccaa

SEQ ID NO: 7632941 - DNA, 22 bp, Homo sapiens
ctgtgatgttagctctgtgtta

SEQ ID NO: 7632942 - DNA, 22 bp, Homo sapiens
ctgtgcactaaccacacccacg

SEQ ID NO: 7632943 - DNA, 22 bp, Homo sapiens
ctgtgcactaaccacacccacg

SEQ ID NO: 7632944 - DNA, 22 bp, Homo sapiens
ctgtgcacacgtgcccaacagt

SEQ ID NO: 7632945 - DNA, 22 bp, Homo sapiens
ctgtgcacacgtgcccaacagt

SEQ ID NO: 7632946 - DNA, 22 bp, Homo sapiens
ctgtgcaatgcctaatcacaaa

SEQ ID NO: 7632947 - DNA, 22 bp, Homo sapiens
ctgtgcaatattataaaggcca

SEQ ID NO: 7632948 - DNA, 22 bp, Homo sapiens
ctgtgcaatattataaaggcca

SEQ ID NO: 7632949 - DNA, 22 bp, Homo sapiens
ctgtgcacacgtgcccaacagt

SEQ ID NO: 7632950 - DNA, 18 bp, Homo sapiens
ctgtgcagcaaactgagc

SEQ ID NO: 7632951 - DNA, 18 bp, Homo sapiens
ctgtgcagcaaactgagc

SEQ ID NO: 7632952 - DNA, 18 bp, Homo sapiens
ctgtgcagcaaactgagc

SEQ ID NO: 7632953 - DNA, 18 bp, Homo sapiens
ctgtgcagcaaactgagc

SEQ ID NO: 7632954 - DNA, 22 bp, Homo sapiens
ctgtgcacttctctttatttgt

SEQ ID NO: 7632955 - DNA, 22 bp, Homo sapiens
ctgtgcacttctctttatttgt

SEQ ID NO: 7632956 - DNA, 22 bp, Homo sapiens
ctgtgcagctggcttcctggaa

SEQ ID NO: 7632957 - DNA, 22 bp, Homo sapiens
ctgtgcagctggcttcctggaa

SEQ ID NO: 7632958 - DNA, 22 bp, Homo sapiens
ctgtgcagctggcttcctggaa

SEQ ID NO: 7632959 - DNA, 19 bp, Homo sapiens
ctgtgcaggccgggctgag

SEQ ID NO: 7632960 - DNA, 22 bp, Homo sapiens
ctgtgcagcttggcttcaggcc

SEQ ID NO: 7632961 - DNA, 22 bp, Homo sapiens
ctgtgcagcttggcttcaggcc

SEQ ID NO: 7632962 - DNA, 22 bp, Homo sapiens
ctgtgcagcttggcttcaggcc

SEQ ID NO: 7632963 - DNA, 19 bp, Homo sapiens
ctgtgcaggccgggctgag

SEQ ID NO: 7632964 - DNA, 22 bp, Homo sapiens
atcatcatctaaattgtgtcgc

SEQ ID NO: 7632965 - DNA, 22 bp, Homo sapiens
ctgtgcactaaccacacccacg

SEQ ID NO: 7632966 - DNA, 19 bp, Homo sapiens
ctgtgcaggccgggctgag

SEQ ID NO: 7632967 - DNA, 22 bp, Homo sapiens
ctgtcttttcttctcattgatg

SEQ ID NO: 7632968 - DNA, 18 bp, Homo sapiens
ctgtcttttttctctcca

SEQ ID NO: 7632969 - DNA, 22 bp, Homo sapiens
ctgtctttttagagagtaggat

SEQ ID NO: 7632970 - DNA, 18 bp, Homo sapiens
ctgtcttttttctctcca

SEQ ID NO: 7632971 - DNA, 18 bp, Homo sapiens
ctgtcttttttctctcca

SEQ ID NO: 7632972 - DNA, 18 bp, Homo sapiens
ctgtcttttttctctcca

SEQ ID NO: 7632973 - DNA, 18 bp, Homo sapiens
ctgtcttttttctctcca

SEQ ID NO: 7632974 - DNA, 18 bp, Homo sapiens
ctgtcttttttctctcca

SEQ ID NO: 7632975 - DNA, 18 bp, Homo sapiens
ctgtcttttttctctcca

SEQ ID NO: 7632976 - DNA, 22 bp, Homo sapiens
ctgtgagttcattgtgccacct

SEQ ID NO: 7632977 - DNA, 22 bp, Homo sapiens
ctgtgatgacaggcagggccaa

SEQ ID NO: 7632978 - DNA, 22 bp, Homo sapiens
ctgtgatcattcttgatttaag

SEQ ID NO: 7632979 - DNA, 22 bp, Homo sapiens
ctgtgatcattcttgatttaag

SEQ ID NO: 7632980 - DNA, 22 bp, Homo sapiens
ctgtgataggtcatactgtctc

SEQ ID NO: 7632981 - DNA, 22 bp, Homo sapiens
ctgtgatatactcccaagagga

SEQ ID NO: 7632982 - DNA, 22 bp, Homo sapiens
ctgtcttttcttctcattgatg

SEQ ID NO: 7632983 - DNA, 22 bp, Homo sapiens
ctgtcttttcttctcattgatg

SEQ ID NO: 7632984 - DNA, 22 bp, Homo sapiens
ctgtcttttcttctcattgatg

SEQ ID NO: 7632985 - DNA, 22 bp, Homo sapiens
ctgtcttttcttctcattgatg

SEQ ID NO: 7632986 - DNA, 22 bp, Homo sapiens
ctgtcttttcttctcattgatg

SEQ ID NO: 7632987 - DNA, 22 bp, Homo sapiens
ctgtcttttcatactttccctc

SEQ ID NO: 7632988 - DNA, 22 bp, Homo sapiens
ctgtcttttcatactttccctc

SEQ ID NO: 7632989 - DNA, 22 bp, Homo sapiens
ctgtcttttcatactttccctc

SEQ ID NO: 7632990 - DNA, 22 bp, Homo sapiens
ctgtcttttcatactttccctc

SEQ ID NO: 7632991 - DNA, 22 bp, Homo sapiens
ctgtcttttcatactttccctc

SEQ ID NO: 7632992 - DNA, 22 bp, Homo sapiens
ctgtcttttcatactttccctc

SEQ ID NO: 7632993 - DNA, 22 bp, Homo sapiens
ctgtcttttactatcatttact

SEQ ID NO: 7632994 - DNA, 22 bp, Homo sapiens
ctgtctttggtcctgtctgtta

SEQ ID NO: 7632995 - DNA, 22 bp, Homo sapiens
ctgtctttggtcctgtctgtta

SEQ ID NO: 7632996 - DNA, 22 bp, Homo sapiens
ctgtctttggtcctgtctgtta

SEQ ID NO: 7632997 - DNA, 22 bp, Homo sapiens
ctgtcttttactatcatttact

SEQ ID NO: 7632998 - DNA, 22 bp, Homo sapiens
ctgtcttttactatcatttact

SEQ ID NO: 7632999 - DNA, 22 bp, Homo sapiens
ctgtcttttactatcatttact

SEQ ID NO: 7633000 - DNA, 22 bp, Homo sapiens
ctgtcttttactatcatttact

SEQ ID NO: 7633001 - DNA, 19 bp, Homo sapiens
atcacatgtcaagagcagg

SEQ ID NO: 7633002 - DNA, 19 bp, Homo sapiens
atcacatgtcaagagcagg

SEQ ID NO: 7633003 - DNA, 19 bp, Homo sapiens
atcacatgtcaagagcagg

SEQ ID NO: 7633004 - DNA, 22 bp, Homo sapiens
atcacatggaatgattttagac

SEQ ID NO: 7633005 - DNA, 19 bp, Homo sapiens
atcacatgtcaagagcagg

SEQ ID NO: 7633006 - DNA, 19 bp, Homo sapiens
atcacatgtcaagagcagg

SEQ ID NO: 7633007 - DNA, 22 bp, Homo sapiens
atcacattatgtagtgaaaagg

SEQ ID NO: 7633008 - DNA, 22 bp, Homo sapiens
atcacattatgtagtgaaaagg

SEQ ID NO: 7633009 - DNA, 22 bp, Homo sapiens
atcacattacaaaggactccag

SEQ ID NO: 7633010 - DNA, 22 bp, Homo sapiens
atcacattatgtagtgaaaagg

SEQ ID NO: 7633011 - DNA, 22 bp, Homo sapiens
ctgtctctgttgcctgtaggtg

SEQ ID NO: 7633012 - DNA, 22 bp, Homo sapiens
ctgtctctgtcttaactcccag

SEQ ID NO: 7633013 - DNA, 22 bp, Homo sapiens
ctgtctgtttctgattcaacct

SEQ ID NO: 7633014 - DNA, 22 bp, Homo sapiens
ctgtctctgttgcctgtaggtg

SEQ ID NO: 7633015 - DNA, 22 bp, Homo sapiens
ctgtctgtttcaaaagtggtta

SEQ ID NO: 7633016 - DNA, 22 bp, Homo sapiens
ctgtctgtttctgattcaacct

SEQ ID NO: 7633017 - DNA, 22 bp, Homo sapiens
ctgtctgttttaccttctccag

SEQ ID NO: 7633018 - DNA, 22 bp, Homo sapiens
ctgtctgtttctgattcaacct

SEQ ID NO: 7633019 - DNA, 22 bp, Homo sapiens
ctgtctgttttaccttctccag

SEQ ID NO: 7633020 - DNA, 22 bp, Homo sapiens
ctgtctgttttgtatacaggcc

SEQ ID NO: 7633021 - DNA, 22 bp, Homo sapiens
ctgtctgttttgtatacaggcc

SEQ ID NO: 7633022 - DNA, 22 bp, Homo sapiens
ctgtctgttttgtatacaggcc

SEQ ID NO: 7633023 - DNA, 22 bp, Homo sapiens
ctgtctgttttgtatacaggcc

SEQ ID NO: 7633024 - DNA, 22 bp, Homo sapiens
ctgtcttctaccttcaacctcc

SEQ ID NO: 7633025 - DNA, 22 bp, Homo sapiens
ctgtcttctaccttcaacctcc

SEQ ID NO: 7633026 - DNA, 22 bp, Homo sapiens
ctgtcttcccgaggccctggag

SEQ ID NO: 7633027 - DNA, 22 bp, Homo sapiens
ctgtcttcccgaggccctggag

SEQ ID NO: 7633028 - DNA, 20 bp, Homo sapiens
ctgtcttgtgggcttcccct

SEQ ID NO: 7633029 - DNA, 22 bp, Homo sapiens
ctgtcttctcctttgtttcagg

SEQ ID NO: 7633030 - DNA, 22 bp, Homo sapiens
ctgtcttctcctttgtttcagg

SEQ ID NO: 7633031 - DNA, 22 bp, Homo sapiens
ctgtctttggtcctgtctgtta

SEQ ID NO: 7633032 - DNA, 22 bp, Homo sapiens
ctgtctttagtacaaaaaatgt

SEQ ID NO: 7633033 - DNA, 22 bp, Homo sapiens
ctgtctttagtacaaaaaatgt

SEQ ID NO: 7633034 - DNA, 22 bp, Homo sapiens
ctgtctttagtacaaaaaatgt

SEQ ID NO: 7633035 - DNA, 22 bp, Homo sapiens
ctgtctttagtacaaaaaatgt

SEQ ID NO: 7633036 - DNA, 22 bp, Homo sapiens
ctgtcctccggccacctacagt

SEQ ID NO: 7633037 - DNA, 22 bp, Homo sapiens
ctgtcctccggccacctacagt

SEQ ID NO: 7633038 - DNA, 22 bp, Homo sapiens
ctgtcctctgtcctcagcagga

SEQ ID NO: 7633039 - DNA, 22 bp, Homo sapiens
ctgtcctctgtcctcagcagga

SEQ ID NO: 7633040 - DNA, 22 bp, Homo sapiens
atcacagctcccttatacacag

SEQ ID NO: 7633041 - DNA, 22 bp, Homo sapiens
atcacagctcccttatacacag

SEQ ID NO: 7633042 - DNA, 22 bp, Homo sapiens
ctgtcctccagacgacagtccc

SEQ ID NO: 7633043 - DNA, 22 bp, Homo sapiens
ctgtcctccagacgacagtccc

SEQ ID NO: 7633044 - DNA, 22 bp, Homo sapiens
ctgtcccttcccaagcccagcc

SEQ ID NO: 7633045 - DNA, 22 bp, Homo sapiens
ctgtcctccagacgacagtccc

SEQ ID NO: 7633046 - DNA, 22 bp, Homo sapiens
ctgtcctccagacgacagtccc

SEQ ID NO: 7633047 - DNA, 22 bp, Homo sapiens
ctgtcctccagacgacagtccc

SEQ ID NO: 7633048 - DNA, 22 bp, Homo sapiens
ctgtcctccggccacctacagt

SEQ ID NO: 7633049 - DNA, 22 bp, Homo sapiens
ctgtcctcaccttggcaggggg

SEQ ID NO: 7633050 - DNA, 22 bp, Homo sapiens
ctgtcctcatctgccccaaggg

SEQ ID NO: 7633051 - DNA, 22 bp, Homo sapiens
ctgtcctcatctgccccaaggg

SEQ ID NO: 7633052 - DNA, 22 bp, Homo sapiens
ctgtcctcatctgccccaaggg

SEQ ID NO: 7633053 - DNA, 21 bp, Homo sapiens
ctgtcctcagatgtggacgag

SEQ ID NO: 7633054 - DNA, 22 bp, Homo sapiens
ctgtcctcaacccatccttctc

SEQ ID NO: 7633055 - DNA, 22 bp, Homo sapiens
ctgtcctcaacccatccttctc

SEQ ID NO: 7633056 - DNA, 22 bp, Homo sapiens
ctgtcctcaacccatccttctc

SEQ ID NO: 7633057 - DNA, 22 bp, Homo sapiens
ctgtcctcaacccatccttctc

SEQ ID NO: 7633058 - DNA, 22 bp, Homo sapiens
ctgtcctcaacccatccttctc

SEQ ID NO: 7633059 - DNA, 22 bp, Homo sapiens
ctgtcctcaacccatccttctc

SEQ ID NO: 7633060 - DNA, 22 bp, Homo sapiens
ctgtcctcaacccatccttctc

SEQ ID NO: 7633061 - DNA, 22 bp, Homo sapiens
ctgtcctcaccttggcaggggg

SEQ ID NO: 7633062 - DNA, 22 bp, Homo sapiens
ctgtcctcaccttggcaggggg

SEQ ID NO: 7633063 - DNA, 22 bp, Homo sapiens
ctgtcctcaccttggcaggggg

SEQ ID NO: 7633064 - DNA, 22 bp, Homo sapiens
ctgtcctcaccttggcaggggg

SEQ ID NO: 7633065 - DNA, 22 bp, Homo sapiens
atcacagttactcaaataatga

SEQ ID NO: 7633066 - DNA, 22 bp, Homo sapiens
atcacagttactcaaataatga

SEQ ID NO: 7633067 - DNA, 22 bp, Homo sapiens
atcacagtggctacctctggat

SEQ ID NO: 7633068 - DNA, 22 bp, Homo sapiens
atcacagtgtagaccttttaaa

SEQ ID NO: 7633069 - DNA, 22 bp, Homo sapiens
atcacagtgtagaccttttaaa

SEQ ID NO: 7633070 - DNA, 22 bp, Homo sapiens
atcacagtgtagaccttttaaa

SEQ ID NO: 7633071 - DNA, 22 bp, Homo sapiens
atcacagtctttttcttaagta

SEQ ID NO: 7633072 - DNA, 22 bp, Homo sapiens
atcacagtctttttcttaagta

SEQ ID NO: 7633073 - DNA, 22 bp, Homo sapiens
atcacagtgccttcgtaaattt

SEQ ID NO: 7633074 - DNA, 22 bp, Homo sapiens
atcacagtctttttcttaagta

SEQ ID NO: 7633075 - DNA, 22 bp, Homo sapiens
atcacagtctttttcttaagta

SEQ ID NO: 7633076 - DNA, 22 bp, Homo sapiens
atcacaggtggtaggaaaagaa

SEQ ID NO: 7633077 - DNA, 22 bp, Homo sapiens
atcacagggtgaggattagacc

SEQ ID NO: 7633078 - DNA, 22 bp, Homo sapiens
atcacaggtggtaggaaaagaa

SEQ ID NO: 7633079 - DNA, 22 bp, Homo sapiens
atcacagtctttttcttaagta

SEQ ID NO: 7633080 - DNA, 22 bp, Homo sapiens
atcacatatttaagaaacatgt

SEQ ID NO: 7633081 - DNA, 22 bp, Homo sapiens
atcacatcacaggttgagctag

SEQ ID NO: 7633082 - DNA, 22 bp, Homo sapiens
atcacatatttaagaaacatgt

SEQ ID NO: 7633083 - DNA, 22 bp, Homo sapiens
atcacatggaatgattttagac

SEQ ID NO: 7633084 - DNA, 22 bp, Homo sapiens
atcacatctcaccactgcaacc

SEQ ID NO: 7633085 - DNA, 22 bp, Homo sapiens
atcacatctcaccactgcaacc

SEQ ID NO: 7633086 - DNA, 22 bp, Homo sapiens
atcacagttttgtgccttgtgg

SEQ ID NO: 7633087 - DNA, 22 bp, Homo sapiens
atcacagttttgtgccttgtgg

SEQ ID NO: 7633088 - DNA, 22 bp, Homo sapiens
atcacagtttacaaacctgctg

SEQ ID NO: 7633089 - DNA, 22 bp, Homo sapiens
atcacagtttacaaacctgctg

SEQ ID NO: 7633090 - DNA, 22 bp, Homo sapiens
atcacatatttaagaaacatgt

SEQ ID NO: 7633091 - DNA, 22 bp, Homo sapiens
atcacatatttaagaaacatgt

SEQ ID NO: 7633092 - DNA, 22 bp, Homo sapiens
atcacatatatgcaccaagaca

SEQ ID NO: 7633093 - DNA, 22 bp, Homo sapiens
atcacagttttgtgccttgtgg

SEQ ID NO: 7633094 - DNA, 22 bp, Homo sapiens
atcacatatatgcaccaagaca

SEQ ID NO: 7633095 - DNA, 22 bp, Homo sapiens
ctgtcctcaacccatccttctc

SEQ ID NO: 7633096 - DNA, 22 bp, Homo sapiens
ctgtccgccgacttggccaggc

SEQ ID NO: 7633097 - DNA, 22 bp, Homo sapiens
ctgtcccttcccaagcccagcc

SEQ ID NO: 7633098 - DNA, 22 bp, Homo sapiens
ctgtcccttcattattcactac

SEQ ID NO: 7633099 - DNA, 22 bp, Homo sapiens
ctgtccagtgactttgggccat

SEQ ID NO: 7633100 - DNA, 22 bp, Homo sapiens
ctgtcccttcccaagcccagcc

SEQ ID NO: 7633101 - DNA, 22 bp, Homo sapiens
ctgtcccttcccaagcccagcc

SEQ ID NO: 7633102 - DNA, 22 bp, Homo sapiens
ctgtcccttcccaagcccagcc

SEQ ID NO: 7633103 - DNA, 22 bp, Homo sapiens
ctgtccagtcagaacgtcatta

SEQ ID NO: 7633104 - DNA, 22 bp, Homo sapiens
ctgtccagtcagaacgtcatta

SEQ ID NO: 7633105 - DNA, 18 bp, Homo sapiens
ctgggtctccaggctgcc

SEQ ID NO: 7633106 - DNA, 18 bp, Homo sapiens
ctgggtctccaggctgcc

SEQ ID NO: 7633107 - DNA, 18 bp, Homo sapiens
ctgggtctccaggctgcc

SEQ ID NO: 7633108 - DNA, 18 bp, Homo sapiens
ctgggtctccaggctgcc

SEQ ID NO: 7633109 - DNA, 18 bp, Homo sapiens
ctgggtctccaggctgcc

SEQ ID NO: 7633110 - DNA, 22 bp, Homo sapiens
ctgtccagtctttagcaagctg

SEQ ID NO: 7633111 - DNA, 22 bp, Homo sapiens
ctgtccagtctttagcaagctg

SEQ ID NO: 7633112 - DNA, 22 bp, Homo sapiens
ctgtccagtcagaacgtcatta

SEQ ID NO: 7633113 - DNA, 22 bp, Homo sapiens
ctgtccagtctttagcaagctg

SEQ ID NO: 7633114 - DNA, 22 bp, Homo sapiens
ctgtccagtctttagcaagctg

SEQ ID NO: 7633115 - DNA, 22 bp, Homo sapiens
ctgtccagtgactttgggccat

SEQ ID NO: 7633116 - DNA, 22 bp, Homo sapiens
ctgtccagtgactttgggccat

SEQ ID NO: 7633117 - DNA, 22 bp, Homo sapiens
ctgtccagtctttagcaagctg

SEQ ID NO: 7633118 - DNA, 22 bp, Homo sapiens
ctgggtcctggtgctgagttct

SEQ ID NO: 7633119 - DNA, 22 bp, Homo sapiens
ctgggtcctggtgctgagttct

SEQ ID NO: 7633120 - DNA, 22 bp, Homo sapiens
ctgggtcctgctctccctaaga

SEQ ID NO: 7633121 - DNA, 22 bp, Homo sapiens
ctgggtctaaaaattctcagat

SEQ ID NO: 7633122 - DNA, 22 bp, Homo sapiens
ctgggtctaaaaattctcagat

SEQ ID NO: 7633123 - DNA, 19 bp, Homo sapiens
ctgggtcctgttcttttac

SEQ ID NO: 7633124 - DNA, 22 bp, Homo sapiens
ctgggtctaaaaattctcagat

SEQ ID NO: 7633125 - DNA, 22 bp, Homo sapiens
ctgggtctcaggagttctgagg

SEQ ID NO: 7633126 - DNA, 22 bp, Homo sapiens
ctgggtcccctcagtgacactg

SEQ ID NO: 7633127 - DNA, 22 bp, Homo sapiens
ctgggtcccacagcctgctggg

SEQ ID NO: 7633128 - DNA, 22 bp, Homo sapiens
ctgggtcccctcagtgacactg

SEQ ID NO: 7633129 - DNA, 22 bp, Homo sapiens
ctgggtcccctcagtgacactg

SEQ ID NO: 7633130 - DNA, 22 bp, Homo sapiens
ctgggtcccctcagtgacactg

SEQ ID NO: 7633131 - DNA, 22 bp, Homo sapiens
ctgggtcctgctctccctaaga

SEQ ID NO: 7633132 - DNA, 22 bp, Homo sapiens
ctgggtcctgctctccctaaga

SEQ ID NO: 7633133 - DNA, 22 bp, Homo sapiens
atatttgtcaattcactgttca

SEQ ID NO: 7633134 - DNA, 22 bp, Homo sapiens
atatttgtcaattcactgttca

SEQ ID NO: 7633135 - DNA, 22 bp, Homo sapiens
atatttgtatttcgtgtgtgta

SEQ ID NO: 7633136 - DNA, 22 bp, Homo sapiens
atatttgtggtaaaggtaagaa

SEQ ID NO: 7633137 - DNA, 22 bp, Homo sapiens
atatttgtggtaaaggtaagaa

SEQ ID NO: 7633138 - DNA, 22 bp, Homo sapiens
atatttgtcatctgccttagtt

SEQ ID NO: 7633139 - DNA, 22 bp, Homo sapiens
atatttgttagagtctatgtgt

SEQ ID NO: 7633140 - DNA, 22 bp, Homo sapiens
atatttgttagagtctatgtgt

SEQ ID NO: 7633141 - DNA, 22 bp, Homo sapiens
atatttgttagagtctatgtgt

SEQ ID NO: 7633142 - DNA, 22 bp, Homo sapiens
atatttgttagagtctatgtgt

SEQ ID NO: 7633143 - DNA, 22 bp, Homo sapiens
ctgggtagaagattcctcagga

SEQ ID NO: 7633144 - DNA, 22 bp, Homo sapiens
ctgggtagaagattcctcagga

SEQ ID NO: 7633145 - DNA, 22 bp, Homo sapiens
ctgggtagggcaaggaactggc

SEQ ID NO: 7633146 - DNA, 22 bp, Homo sapiens
ctgggtagggcaaggaactggc

SEQ ID NO: 7633147 - DNA, 22 bp, Homo sapiens
ctgggtagggcaaggaactggc

SEQ ID NO: 7633148 - DNA, 22 bp, Homo sapiens
ctgggtagggcaaggaactggc

SEQ ID NO: 7633149 - DNA, 22 bp, Homo sapiens
ctgggtcaggagcggctgcccg

SEQ ID NO: 7633150 - DNA, 22 bp, Homo sapiens
ctgggtcagtctgtccctaggg

SEQ ID NO: 7633151 - DNA, 22 bp, Homo sapiens
ctgggtcagtggcaagctgggt

SEQ ID NO: 7633152 - DNA, 22 bp, Homo sapiens
ctgggtcagtctgtccctaggg

SEQ ID NO: 7633153 - DNA, 22 bp, Homo sapiens
ctgggtcagtggcaagctgggt

SEQ ID NO: 7633154 - DNA, 22 bp, Homo sapiens
ctgggtcataaacaatgcgtgt

SEQ ID NO: 7633155 - DNA, 22 bp, Homo sapiens
ctgggtcccacagcctgctggg

SEQ ID NO: 7633156 - DNA, 22 bp, Homo sapiens
ctgggtcccacagcctgctggg

SEQ ID NO: 7633157 - DNA, 22 bp, Homo sapiens
ctgggtcccacagcctgctggg

SEQ ID NO: 7633158 - DNA, 22 bp, Homo sapiens
ctgggtcccacagcctgctggg

SEQ ID NO: 7633159 - DNA, 22 bp, Homo sapiens
ctgggtcccaatagcttttgtt

SEQ ID NO: 7633160 - DNA, 20 bp, Homo sapiens
ctgggtcacttggctgctct

SEQ ID NO: 7633161 - DNA, 20 bp, Homo sapiens
ctgggtcacttggctgctct

SEQ ID NO: 7633162 - DNA, 22 bp, Homo sapiens
ctgggtcaggagcggctgcccg

SEQ ID NO: 7633163 - DNA, 20 bp, Homo sapiens
ctgggtcacttggctgctct

SEQ ID NO: 7633164 - DNA, 22 bp, Homo sapiens
ctgggtcacccaaaagggccag

SEQ ID NO: 7633165 - DNA, 20 bp, Homo sapiens
ctgggtcacttggctgctct

SEQ ID NO: 7633166 - DNA, 22 bp, Homo sapiens
ctgggtagggcaaggaactggc

SEQ ID NO: 7633167 - DNA, 22 bp, Homo sapiens
ctgggtagggtgatatcccaca

SEQ ID NO: 7633168 - DNA, 22 bp, Homo sapiens
ctgggtagggtgatatcccaca

SEQ ID NO: 7633169 - DNA, 22 bp, Homo sapiens
ctgggtataggaaacagttaag

SEQ ID NO: 7633170 - DNA, 22 bp, Homo sapiens
ctgggtataggaaacagttaag

SEQ ID NO: 7633171 - DNA, 22 bp, Homo sapiens
ctgggtcaaggaatgctggtgg

SEQ ID NO: 7633172 - DNA, 22 bp, Homo sapiens
ctgggtcaaggaatgctggtgg

SEQ ID NO: 7633173 - DNA, 22 bp, Homo sapiens
ctgggtcaaggaatgctggtgg

SEQ ID NO: 7633174 - DNA, 22 bp, Homo sapiens
ctgggtcacccaaaagggccag

SEQ ID NO: 7633175 - DNA, 22 bp, Homo sapiens
ctgggtcacccaaaagggccag

SEQ ID NO: 7633176 - DNA, 17 bp, Homo sapiens
atccccagcatctagaa

SEQ ID NO: 7633177 - DNA, 17 bp, Homo sapiens
atccccagcatctagaa

SEQ ID NO: 7633178 - DNA, 17 bp, Homo sapiens
atccccagcatctagaa

SEQ ID NO: 7633179 - DNA, 17 bp, Homo sapiens
atccccagcatctagaa

SEQ ID NO: 7633180 - DNA, 17 bp, Homo sapiens
atccccagcatctagaa

SEQ ID NO: 7633181 - DNA, 22 bp, Homo sapiens
atccatttgtaaatgttagagt

SEQ ID NO: 7633182 - DNA, 22 bp, Homo sapiens
atccccagactttagatttctc

SEQ ID NO: 7633183 - DNA, 22 bp, Homo sapiens
atccaccctgtggtggctttct

SEQ ID NO: 7633184 - DNA, 22 bp, Homo sapiens
atccatttgccgtgctatgtgc

SEQ ID NO: 7633185 - DNA, 22 bp, Homo sapiens
atccatttgccgtgctatgtgc

SEQ ID NO: 7633186 - DNA, 22 bp, Homo sapiens
atccatttgccgtgctatgtgc

SEQ ID NO: 7633187 - DNA, 22 bp, Homo sapiens
atccatttgtaaatgttagagt

SEQ ID NO: 7633188 - DNA, 22 bp, Homo sapiens
atccacatttaggtctctaaaa

SEQ ID NO: 7633189 - DNA, 23 bp, Homo sapiens
atccacattacagtatcatacaa

SEQ ID NO: 7633190 - DNA, 22 bp, Homo sapiens
atccacagtgcagcaagggccc

SEQ ID NO: 7633191 - DNA, 22 bp, Homo sapiens
atccacagtgcagcaagggccc

SEQ ID NO: 7633192 - DNA, 22 bp, Homo sapiens
atccacagtgggggtggcggaa

SEQ ID NO: 7633193 - DNA, 23 bp, Homo sapiens
atccacattacagtatcatacaa

SEQ ID NO: 7633194 - DNA, 23 bp, Homo sapiens
atccacattacagtatcatacaa

SEQ ID NO: 7633195 - DNA, 23 bp, Homo sapiens
atccacattacagtatcatacaa

SEQ ID NO: 7633196 - DNA, 22 bp, Homo sapiens
atccacagtgggggtggcggaa

SEQ ID NO: 7633197 - DNA, 22 bp, Homo sapiens
atccacagtgcagcaagggccc

SEQ ID NO: 7633198 - DNA, 22 bp, Homo sapiens
atccacagtcttagccatcaaa

SEQ ID NO: 7633199 - DNA, 22 bp, Homo sapiens
atccacagtcttagccatcaaa

SEQ ID NO: 7633200 - DNA, 22 bp, Homo sapiens
atccacaggtcatgtaatgtgg

SEQ ID NO: 7633201 - DNA, 22 bp, Homo sapiens
atccacagtcttagccatcaaa

SEQ ID NO: 7633202 - DNA, 22 bp, Homo sapiens
atccacagtcttagccatcaaa

SEQ ID NO: 7633203 - DNA, 22 bp, Homo sapiens
atccacagggtgtgttaagatg

SEQ ID NO: 7633204 - DNA, 22 bp, Homo sapiens
atccacagggtgtgttaagatg

SEQ ID NO: 7633205 - DNA, 22 bp, Homo sapiens
atccacaggagggtttggaaaa

SEQ ID NO: 7633206 - DNA, 22 bp, Homo sapiens
atccacagggtgtgttaagatg

SEQ ID NO: 7633207 - DNA, 22 bp, Homo sapiens
atccacagggtgtgttaagatg

SEQ ID NO: 7633208 - DNA, 22 bp, Homo sapiens
atccacaggtcatgtaatgtgg

SEQ ID NO: 7633209 - DNA, 22 bp, Homo sapiens
atccacagggtgtgttaagatg

SEQ ID NO: 7633210 - DNA, 22 bp, Homo sapiens
atccacaggagggtttggaaaa

SEQ ID NO: 7633211 - DNA, 22 bp, Homo sapiens
atccacaggagggtttggaaaa

SEQ ID NO: 7633212 - DNA, 22 bp, Homo sapiens
atccacaggagggtttggaaaa

SEQ ID NO: 7633213 - DNA, 22 bp, Homo sapiens
atccacagagaggaagaatagt

SEQ ID NO: 7633214 - DNA, 22 bp, Homo sapiens
atccacagagaggaagaatagt

SEQ ID NO: 7633215 - DNA, 22 bp, Homo sapiens
atccacagaaggaacttgaaag

SEQ ID NO: 7633216 - DNA, 22 bp, Homo sapiens
atccacagaaggaacttgaaag

SEQ ID NO: 7633217 - DNA, 22 bp, Homo sapiens
atccacagaaggaacttgaaag

SEQ ID NO: 7633218 - DNA, 22 bp, Homo sapiens
atccacagagaggaagaatagt

SEQ ID NO: 7633219 - DNA, 22 bp, Homo sapiens
atccacagagaggaagaatagt

SEQ ID NO: 7633220 - DNA, 22 bp, Homo sapiens
atccacagagaggaagaatagt

SEQ ID NO: 7633221 - DNA, 22 bp, Homo sapiens
atccacagagaggaagaatagt

SEQ ID NO: 7633222 - DNA, 22 bp, Homo sapiens
atccacagagaggaagaatagt

SEQ ID NO: 7633223 - DNA, 22 bp, Homo sapiens
atccccctcttggatggcggca

SEQ ID NO: 7633224 - DNA, 22 bp, Homo sapiens
atccccctgtatctggaagaat

SEQ ID NO: 7633225 - DNA, 22 bp, Homo sapiens
atccccctgtatctggaagaat

SEQ ID NO: 7633226 - DNA, 22 bp, Homo sapiens
atccccctgtatctggaagaat

SEQ ID NO: 7633227 - DNA, 23 bp, Homo sapiens
atcccctgccttgggtgagtccc

SEQ ID NO: 7633228 - DNA, 23 bp, Homo sapiens
atcccctgccttgggtgagtccc

SEQ ID NO: 7633229 - DNA, 22 bp, Homo sapiens
atccccctgtatctggaagaat

SEQ ID NO: 7633230 - DNA, 22 bp, Homo sapiens
atccccctgtatctggaagaat

SEQ ID NO: 7633231 - DNA, 22 bp, Homo sapiens
atccccctcttggatggcggca

SEQ ID NO: 7633232 - DNA, 22 bp, Homo sapiens
atccccctcttggatggcggca

SEQ ID NO: 7633233 - DNA, 22 bp, Homo sapiens
atccccctcttggatggcggca

SEQ ID NO: 7633234 - DNA, 22 bp, Homo sapiens
atccccctcttggatggcggca

SEQ ID NO: 7633235 - DNA, 22 bp, Homo sapiens
atccccctcttggatggcggca

SEQ ID NO: 7633236 - DNA, 22 bp, Homo sapiens
atccccaggggcattcaagctt

SEQ ID NO: 7633237 - DNA, 22 bp, Homo sapiens
atccccaggggcattcaagctt

SEQ ID NO: 7633238 - DNA, 22 bp, Homo sapiens
atccccagggagtgagctgtct

SEQ ID NO: 7633239 - DNA, 22 bp, Homo sapiens
atccccaggggcattcaagctt

SEQ ID NO: 7633240 - DNA, 22 bp, Homo sapiens
atccccaggggcattcaagctt

SEQ ID NO: 7633241 - DNA, 22 bp, Homo sapiens
atccccagggaggcctgacctg

SEQ ID NO: 7633242 - DNA, 22 bp, Homo sapiens
atccccagggagtgagctgtct

SEQ ID NO: 7633243 - DNA, 22 bp, Homo sapiens
atccccagggaggcctgacctg

SEQ ID NO: 7633244 - DNA, 22 bp, Homo sapiens
atccccagggaggcctgacctg

SEQ ID NO: 7633245 - DNA, 22 bp, Homo sapiens
atccccagggagtgagctgtct

SEQ ID NO: 7633246 - DNA, 22 bp, Homo sapiens
atccccttcacaccctctgcat

SEQ ID NO: 7633247 - DNA, 22 bp, Homo sapiens
atccccttcacaccctctgcat

SEQ ID NO: 7633248 - DNA, 22 bp, Homo sapiens
atccctcagcagacagcaaaat

SEQ ID NO: 7633249 - DNA, 22 bp, Homo sapiens
atccctcagccacctttgagga

SEQ ID NO: 7633250 - DNA, 22 bp, Homo sapiens
atccctcagcagacagcaaaat

SEQ ID NO: 7633251 - DNA, 22 bp, Homo sapiens
atccccttgtgggctggcagca

SEQ ID NO: 7633252 - DNA, 21 bp, Homo sapiens
atcccggctttgaggcagatg

SEQ ID NO: 7633253 - DNA, 23 bp, Homo sapiens
atccctagaagggaaatatagtg

SEQ ID NO: 7633254 - DNA, 22 bp, Homo sapiens
atccctctctgcatgactgtgt

SEQ ID NO: 7633255 - DNA, 22 bp, Homo sapiens
atccctctctgcatgactgtgt

SEQ ID NO: 7633256 - DNA, 22 bp, Homo sapiens
atccctcagccacctttgagga

SEQ ID NO: 7633257 - DNA, 22 bp, Homo sapiens
atccctcccagagcaagccatt

SEQ ID NO: 7633258 - DNA, 22 bp, Homo sapiens
atccctctctgcatgactgtgt

SEQ ID NO: 7633259 - DNA, 20 bp, Homo sapiens
atccctcttcctagagtccc

SEQ ID NO: 7633260 - DNA, 22 bp, Homo sapiens
atccctgccctcatggagctta

SEQ ID NO: 7633261 - DNA, 20 bp, Homo sapiens
atccctcttcctagagtccc

SEQ ID NO: 7633262 - DNA, 22 bp, Homo sapiens
atctaattttcactcatttgct

SEQ ID NO: 7633263 - DNA, 22 bp, Homo sapiens
atctaattttcactcatttgct

SEQ ID NO: 7633264 - DNA, 22 bp, Homo sapiens
atctacaacatcacatggcatt

SEQ ID NO: 7633265 - DNA, 22 bp, Homo sapiens
atctacaacatcacatggcatt

SEQ ID NO: 7633266 - DNA, 22 bp, Homo sapiens
atctacaacatcacatggcatt

SEQ ID NO: 7633267 - DNA, 22 bp, Homo sapiens
atctacaatgtctggctgcact

SEQ ID NO: 7633268 - DNA, 22 bp, Homo sapiens
atctacaatgtctggctgcact

SEQ ID NO: 7633269 - DNA, 22 bp, Homo sapiens
atctacaacccctcaaactgtg

SEQ ID NO: 7633270 - DNA, 22 bp, Homo sapiens
atctacaacccctcaaactgtg

SEQ ID NO: 7633271 - DNA, 22 bp, Homo sapiens
atctacaacccctcaaactgtg

SEQ ID NO: 7633272 - DNA, 22 bp, Homo sapiens
atcctctgaccgctgcagggag

SEQ ID NO: 7633273 - DNA, 22 bp, Homo sapiens
atcctttataagacttgtattc

SEQ ID NO: 7633274 - DNA, 22 bp, Homo sapiens
atcctttaagttaataaaattc

SEQ ID NO: 7633275 - DNA, 22 bp, Homo sapiens
atcctttagtcctacaactcga

SEQ ID NO: 7633276 - DNA, 22 bp, Homo sapiens
atcctcagcatctagcatgaag

SEQ ID NO: 7633277 - DNA, 22 bp, Homo sapiens
atcctcagtgtttctgacatct

SEQ ID NO: 7633278 - DNA, 22 bp, Homo sapiens
atcctcagcatctagcatgaag

SEQ ID NO: 7633279 - DNA, 22 bp, Homo sapiens
atcctcagcatctagcatgaag

SEQ ID NO: 7633280 - DNA, 22 bp, Homo sapiens
atcctcagtgtttctgacatct

SEQ ID NO: 7633281 - DNA, 22 bp, Homo sapiens
atcctcagtgtttctgacatct

SEQ ID NO: 7633282 - DNA, 22 bp, Homo sapiens
atcctcagtgtttctgacatct

SEQ ID NO: 7633283 - DNA, 22 bp, Homo sapiens
atcctccagctcctgcttctgc

SEQ ID NO: 7633284 - DNA, 22 bp, Homo sapiens
atcctctctgttttcgtgtatg

SEQ ID NO: 7633285 - DNA, 22 bp, Homo sapiens
atcctctctgtgacagggaacg

SEQ ID NO: 7633286 - DNA, 22 bp, Homo sapiens
atcctctctcccataccagtct

SEQ ID NO: 7633287 - DNA, 23 bp, Homo sapiens
atcctctctccatcccactgtgc

SEQ ID NO: 7633288 - DNA, 22 bp, Homo sapiens
atcctcagacctcagcaaagcc

SEQ ID NO: 7633289 - DNA, 22 bp, Homo sapiens
atcctcagacctcagcaaagcc

SEQ ID NO: 7633290 - DNA, 22 bp, Homo sapiens
atcctcagacctcagcaaagcc

SEQ ID NO: 7633291 - DNA, 22 bp, Homo sapiens
atcctcagacttcacgttccat

SEQ ID NO: 7633292 - DNA, 22 bp, Homo sapiens
atcctcagagaacgaacacaat

SEQ ID NO: 7633293 - DNA, 22 bp, Homo sapiens
atcctcagacctcagcaaagcc

SEQ ID NO: 7633294 - DNA, 22 bp, Homo sapiens
atcctcagacctcagcaaagcc

SEQ ID NO: 7633295 - DNA, 20 bp, Homo sapiens
atcctcaccctcagtcctag

SEQ ID NO: 7633296 - DNA, 22 bp, Homo sapiens
atcctatggctagcagatgctg

SEQ ID NO: 7633297 - DNA, 23 bp, Homo sapiens
atcctatataaccttggaggctg

SEQ ID NO: 7633298 - DNA, 22 bp, Homo sapiens
atcctatggctagcagatgctg

SEQ ID NO: 7633299 - DNA, 22 bp, Homo sapiens
atcctcacaataaaatcagcct

SEQ ID NO: 7633300 - DNA, 22 bp, Homo sapiens
atcctacaaagcagggctatgg

SEQ ID NO: 7633301 - DNA, 22 bp, Homo sapiens
atcctagaatcagcccttgctg

SEQ ID NO: 7633302 - DNA, 22 bp, Homo sapiens
atcctagaatcagcccttgctg

SEQ ID NO: 7633303 - DNA, 22 bp, Homo sapiens
atcctagaatcagcccttgctg

SEQ ID NO: 7633304 - DNA, 22 bp, Homo sapiens
atccctggaagcaatgtttatt

SEQ ID NO: 7633305 - DNA, 22 bp, Homo sapiens
atccctggctaattttttgtgt

SEQ ID NO: 7633306 - DNA, 20 bp, Homo sapiens
atccctggccttaaggagtg

SEQ ID NO: 7633307 - DNA, 22 bp, Homo sapiens
atccctgggcctcaccacctga

SEQ ID NO: 7633308 - DNA, 20 bp, Homo sapiens
atccctggtcagtaccaaag

SEQ ID NO: 7633309 - DNA, 22 bp, Homo sapiens
atccctggacggcgcctcccca

SEQ ID NO: 7633310 - DNA, 22 bp, Homo sapiens
atccctggacggcgcctcccca

SEQ ID NO: 7633311 - DNA, 22 bp, Homo sapiens
atccctggccacgaagctgccc

SEQ ID NO: 7633312 - DNA, 22 bp, Homo sapiens
atccctggccacgaagctgccc

SEQ ID NO: 7633313 - DNA, 22 bp, Homo sapiens
atccctgccctcatggagctta

SEQ ID NO: 7633314 - DNA, 22 bp, Homo sapiens
atccaaaggtgacacagaatac

SEQ ID NO: 7633315 - DNA, 22 bp, Homo sapiens
atccaaagccctaagttaactg

SEQ ID NO: 7633316 - DNA, 22 bp, Homo sapiens
atccaaagccctaagttaactg

SEQ ID NO: 7633317 - DNA, 22 bp, Homo sapiens
atccaaagccctaagttaactg

SEQ ID NO: 7633318 - DNA, 22 bp, Homo sapiens
atccaaaggtgacacagaatac

SEQ ID NO: 7633319 - DNA, 22 bp, Homo sapiens
atccaaaggtgacacagaatac

SEQ ID NO: 7633320 - DNA, 22 bp, Homo sapiens
atccaaagatggaaagaacttt

SEQ ID NO: 7633321 - DNA, 22 bp, Homo sapiens
atccaaagaatgcttagacctg

SEQ ID NO: 7633322 - DNA, 22 bp, Homo sapiens
atccaaacctggacatgagtgg

SEQ ID NO: 7633323 - DNA, 22 bp, Homo sapiens
atccaaactatgactagtgttc

SEQ ID NO: 7633324 - DNA, 22 bp, Homo sapiens
atccaaatcttcacacataaca

SEQ ID NO: 7633325 - DNA, 22 bp, Homo sapiens
atccaaatcatgtcagaagaac

SEQ ID NO: 7633326 - DNA, 22 bp, Homo sapiens
atccaaatatattttattcact

SEQ ID NO: 7633327 - DNA, 22 bp, Homo sapiens
atccaaatatattttattcact

SEQ ID NO: 7633328 - DNA, 22 bp, Homo sapiens
atccaaatatattttattcact

SEQ ID NO: 7633329 - DNA, 22 bp, Homo sapiens
atccaaagtagattaagtcaca

SEQ ID NO: 7633330 - DNA, 22 bp, Homo sapiens
atccaaggcgcaagatggcgct

SEQ ID NO: 7633331 - DNA, 22 bp, Homo sapiens
atccaagctgactcaagataaa

SEQ ID NO: 7633332 - DNA, 22 bp, Homo sapiens
atccaagatccaggaacttgga

SEQ ID NO: 7633333 - DNA, 22 bp, Homo sapiens
atccaagcagaatcacgtgaga

SEQ ID NO: 7633334 - DNA, 22 bp, Homo sapiens
atccaagagacatttgtgaatg

SEQ ID NO: 7633335 - DNA, 22 bp, Homo sapiens
atccaacaggacaaagaaagga

SEQ ID NO: 7633336 - DNA, 22 bp, Homo sapiens
atccaaatcttcacacataaca

SEQ ID NO: 7633337 - DNA, 22 bp, Homo sapiens
atccaaatcttcacacataaca

SEQ ID NO: 7633338 - DNA, 22 bp, Homo sapiens
atccaacacgtatttgctggcc

SEQ ID NO: 7633339 - DNA, 22 bp, Homo sapiens
atccaacaggacaaagaaagga

SEQ ID NO: 7633340 - DNA, 20 bp, Homo sapiens
atccaagaaaggatgcaggt

SEQ ID NO: 7633341 - DNA, 22 bp, Homo sapiens
atccaagaatttgcactcctaa

SEQ ID NO: 7633342 - DNA, 22 bp, Homo sapiens
atccaagaatttgcactcctaa

SEQ ID NO: 7633343 - DNA, 22 bp, Homo sapiens
atccaaggggaaagacgtctgg

SEQ ID NO: 7633344 - DNA, 22 bp, Homo sapiens
atccaagtcagggatagtttga

SEQ ID NO: 7633345 - DNA, 22 bp, Homo sapiens
atccaagtcagggatagtttga

SEQ ID NO: 7633346 - DNA, 22 bp, Homo sapiens
atccaatggggagtgagttctt

SEQ ID NO: 7633347 - DNA, 22 bp, Homo sapiens
atccaaggggaaagacgtctgg

SEQ ID NO: 7633348 - DNA, 22 bp, Homo sapiens
atccaattacgttttttgtcat

SEQ ID NO: 7633349 - DNA, 22 bp, Homo sapiens
atccacagaaggaacttgaaag

SEQ ID NO: 7633350 - DNA, 22 bp, Homo sapiens
atccacagaaggaacttgaaag

SEQ ID NO: 7633351 - DNA, 22 bp, Homo sapiens
atccacaagaccccttttcact

SEQ ID NO: 7633352 - DNA, 22 bp, Homo sapiens
atccaattacgttttttgtcat

SEQ ID NO: 7633353 - DNA, 22 bp, Homo sapiens
atccaattctaatattgtgttt

SEQ ID NO: 7633354 - DNA, 22 bp, Homo sapiens
atccaattacgttttttgtcat

SEQ ID NO: 7633355 - DNA, 22 bp, Homo sapiens
atccaattctaatattgtgttt

SEQ ID NO: 7633356 - DNA, 22 bp, Homo sapiens
atccaaaatttactgtagcatt

SEQ ID NO: 7633357 - DNA, 22 bp, Homo sapiens
atccaaaatttactgtagcatt

SEQ ID NO: 7633358 - DNA, 22 bp, Homo sapiens
atccaaaaccagtgcattttcc

SEQ ID NO: 7633359 - DNA, 22 bp, Homo sapiens
atccaaactatgactagtgttc

SEQ ID NO: 7633360 - DNA, 22 bp, Homo sapiens
atccaaacctggacatgagtgg

SEQ ID NO: 7633361 - DNA, 22 bp, Homo sapiens
atccaaacatgtaccacactaa

SEQ ID NO: 7633362 - DNA, 22 bp, Homo sapiens
atccaaacatgtaccacactaa

SEQ ID NO: 7633363 - DNA, 22 bp, Homo sapiens
atccaaacctggacatgagtgg

SEQ ID NO: 7633364 - DNA, 18 bp, Homo sapiens
atccaaaaagatggaagt

SEQ ID NO: 7633365 - DNA, 22 bp, Homo sapiens
atccaaaaccagtgcattttcc

SEQ ID NO: 7633366 - DNA, 22 bp, Homo sapiens
atcatttttaagagactcttct

SEQ ID NO: 7633367 - DNA, 22 bp, Homo sapiens
atcatttttaagagactcttct

SEQ ID NO: 7633368 - DNA, 22 bp, Homo sapiens
atcatttttaagagactcttct

SEQ ID NO: 7633369 - DNA, 22 bp, Homo sapiens
atcatttttaagagactcttct

SEQ ID NO: 7633370 - DNA, 22 bp, Homo sapiens
atcattttatggctgagaggac

SEQ ID NO: 7633371 - DNA, 22 bp, Homo sapiens
atcattttgtgacaatgcctgt

SEQ ID NO: 7633372 - DNA, 22 bp, Homo sapiens
atcattttgtgacaatgcctgt

SEQ ID NO: 7633373 - DNA, 22 bp, Homo sapiens
atcattttgtgacaatgcctgt

SEQ ID NO: 7633374 - DNA, 22 bp, Homo sapiens
atcattttgtgacaatgcctgt

SEQ ID NO: 7633375 - DNA, 22 bp, Homo sapiens
atcattctattgttgagctgcc

SEQ ID NO: 7633376 - DNA, 22 bp, Homo sapiens
atcattctattgttgagctgcc

SEQ ID NO: 7633377 - DNA, 22 bp, Homo sapiens
atcattttatggctgagaggac

SEQ ID NO: 7633378 - DNA, 22 bp, Homo sapiens
atcattttatggctgagaggac

SEQ ID NO: 7633379 - DNA, 22 bp, Homo sapiens
atcatttttaagagactcttct

SEQ ID NO: 7633380 - DNA, 22 bp, Homo sapiens
atcatttttaagagactcttct

SEQ ID NO: 7633381 - DNA, 22 bp, Homo sapiens
atcatttttaagagactcttct

SEQ ID NO: 7633382 - DNA, 22 bp, Homo sapiens
atcatttttaagagactcttct

SEQ ID NO: 7633383 - DNA, 22 bp, Homo sapiens
atcattttgtgacaatgcctgt

SEQ ID NO: 7633384 - DNA, 22 bp, Homo sapiens
atcattttgtgacaatgcctgt

SEQ ID NO: 7633385 - DNA, 22 bp, Homo sapiens
atcattttgtgacaatgcctgt

SEQ ID NO: 7633386 - DNA, 22 bp, Homo sapiens
atcattttgtgacaatgcctgt

SEQ ID NO: 7633387 - DNA, 22 bp, Homo sapiens
atcatgttttaattagcaaact

SEQ ID NO: 7633388 - DNA, 22 bp, Homo sapiens
atcatgttgtatgtaatctttt

SEQ ID NO: 7633389 - DNA, 22 bp, Homo sapiens
atcatgtttagttttaagggct

SEQ ID NO: 7633390 - DNA, 22 bp, Homo sapiens
atcatgttttaattagcaaact

SEQ ID NO: 7633391 - DNA, 22 bp, Homo sapiens
atcatgttttaattagcaaact

SEQ ID NO: 7633392 - DNA, 22 bp, Homo sapiens
atcatgttggctctgacaaaaa

SEQ ID NO: 7633393 - DNA, 22 bp, Homo sapiens
atcatgttgtatgtaatctttt

SEQ ID NO: 7633394 - DNA, 22 bp, Homo sapiens
atcatgttgtatgtaatctttt

SEQ ID NO: 7633395 - DNA, 22 bp, Homo sapiens
atcatgttgtatgtaatctttt

SEQ ID NO: 7633396 - DNA, 22 bp, Homo sapiens
atcatgttggctctgacaaaaa

SEQ ID NO: 7633397 - DNA, 22 bp, Homo sapiens
atcatgttgctcaaaattaaac

SEQ ID NO: 7633398 - DNA, 22 bp, Homo sapiens
atcatgttccagaaacagtgat

SEQ ID NO: 7633399 - DNA, 22 bp, Homo sapiens
atcatgttgctcaaaattaaac

SEQ ID NO: 7633400 - DNA, 22 bp, Homo sapiens
atcatgttgctcaaaattaaac

SEQ ID NO: 7633401 - DNA, 22 bp, Homo sapiens
atcatgttccagaaacagtgat

SEQ ID NO: 7633402 - DNA, 22 bp, Homo sapiens
atcatgttccagaaacagtgat

SEQ ID NO: 7633403 - DNA, 22 bp, Homo sapiens
atcatgttccagaaacagtgat

SEQ ID NO: 7633404 - DNA, 22 bp, Homo sapiens
atcatgttgctcaaaattaaac

SEQ ID NO: 7633405 - DNA, 22 bp, Homo sapiens
atcatgttgctcaaaattaaac

SEQ ID NO: 7633406 - DNA, 22 bp, Homo sapiens
atcatgttggctctgacaaaaa

SEQ ID NO: 7633407 - DNA, 22 bp, Homo sapiens
atcatgttggctctgacaaaaa

SEQ ID NO: 7633408 - DNA, 22 bp, Homo sapiens
atcatgttgctcaaaattaaac

SEQ ID NO: 7633409 - DNA, 22 bp, Homo sapiens
ctgtggagcagggcagggtcac

SEQ ID NO: 7633410 - DNA, 23 bp, Homo sapiens
ctgtggagccctttgttgggaga

SEQ ID NO: 7633411 - DNA, 22 bp, Homo sapiens
ctgtggagcagggcagggtcac

SEQ ID NO: 7633412 - DNA, 23 bp, Homo sapiens
ctgtggagccctttgttgggaga

SEQ ID NO: 7633413 - DNA, 23 bp, Homo sapiens
ctgtggagccctttgttgggaga

SEQ ID NO: 7633414 - DNA, 23 bp, Homo sapiens
ctgtggagccctttgttgggaga

SEQ ID NO: 7633415 - DNA, 22 bp, Homo sapiens
ctgtggagcttgtggcagtggg

SEQ ID NO: 7633416 - DNA, 22 bp, Homo sapiens
ctgtggagcttgtggcagtggg

SEQ ID NO: 7633417 - DNA, 23 bp, Homo sapiens
ctgtggagccctttgttgggaga

SEQ ID NO: 7633418 - DNA, 22 bp, Homo sapiens
ctgtggagcttgtggcagtggg

SEQ ID NO: 7633419 - DNA, 22 bp, Homo sapiens
ctgtggagatgcagaccaggcc

SEQ ID NO: 7633420 - DNA, 23 bp, Homo sapiens
ctgtggacttccttcattctact

SEQ ID NO: 7633421 - DNA, 22 bp, Homo sapiens
ctgtggagatgcagaccaggcc

SEQ ID NO: 7633422 - DNA, 22 bp, Homo sapiens
ctgtggagatgcagaccaggcc

SEQ ID NO: 7633423 - DNA, 22 bp, Homo sapiens
atcattaaatataagcttcaca

SEQ ID NO: 7633424 - DNA, 22 bp, Homo sapiens
ctgtggagcagggcagggtcac

SEQ ID NO: 7633425 - DNA, 22 bp, Homo sapiens
ctgtggagcagggcagggtcac

SEQ ID NO: 7633426 - DNA, 22 bp, Homo sapiens
ctgtggagatgcagaccaggcc

SEQ ID NO: 7633427 - DNA, 22 bp, Homo sapiens
ctgtggagtggggagtactggt

SEQ ID NO: 7633428 - DNA, 22 bp, Homo sapiens
ctgtggagtggggagtactggt

SEQ ID NO: 7633429 - DNA, 22 bp, Homo sapiens
ctgtggagtgcttggctcagtg

SEQ ID NO: 7633430 - DNA, 22 bp, Homo sapiens
ctgtggagtggggagtactggt

SEQ ID NO: 7633431 - DNA, 22 bp, Homo sapiens
ctgtggagtgcttggctcagtg

SEQ ID NO: 7633432 - DNA, 22 bp, Homo sapiens
ctgtggagtgcttggctcagtg

SEQ ID NO: 7633433 - DNA, 22 bp, Homo sapiens
ctgtggagtgcttggctcagtg

SEQ ID NO: 7633434 - DNA, 22 bp, Homo sapiens
ctgtggagtgcttggctcagtg

SEQ ID NO: 7633435 - DNA, 22 bp, Homo sapiens
ctgtggagtgcttggctcagtg

SEQ ID NO: 7633436 - DNA, 22 bp, Homo sapiens
ctgtggagtgcttggctcagtg

SEQ ID NO: 7633437 - DNA, 22 bp, Homo sapiens
ctgtggagtgcttggctcagtg

SEQ ID NO: 7633438 - DNA, 22 bp, Homo sapiens
ctgtggagtgcttggctcagtg

SEQ ID NO: 7633439 - DNA, 22 bp, Homo sapiens
ctgtggagtgcttggctcagtg

SEQ ID NO: 7633440 - DNA, 22 bp, Homo sapiens
ctgtggagtgcttggctcagtg

SEQ ID NO: 7633441 - DNA, 22 bp, Homo sapiens
ctgtggaggtaggagcaggaca

SEQ ID NO: 7633442 - DNA, 22 bp, Homo sapiens
ctgtggaggtaggagcaggaca

SEQ ID NO: 7633443 - DNA, 22 bp, Homo sapiens
ctgtggagtcctggggaatgga

SEQ ID NO: 7633444 - DNA, 22 bp, Homo sapiens
ctgtggagtcctggggaatgga

SEQ ID NO: 7633445 - DNA, 22 bp, Homo sapiens
ctgtggagtcctggggaatgga

SEQ ID NO: 7633446 - DNA, 22 bp, Homo sapiens
ctgtggagtcctggggaatgga

SEQ ID NO: 7633447 - DNA, 22 bp, Homo sapiens
ctgtggagtcctggggaatgga

SEQ ID NO: 7633448 - DNA, 22 bp, Homo sapiens
ctgtggagtcctggggaatgga

SEQ ID NO: 7633449 - DNA, 22 bp, Homo sapiens
ctgtggagtcctggggaatgga

SEQ ID NO: 7633450 - DNA, 22 bp, Homo sapiens
ctgtggaggtaggagcaggaca

SEQ ID NO: 7633451 - DNA, 22 bp, Homo sapiens
ctgtggagcttgtggcagtggg

SEQ ID NO: 7633452 - DNA, 22 bp, Homo sapiens
ctgtggagcttgtggcagtggg

SEQ ID NO: 7633453 - DNA, 22 bp, Homo sapiens
ctgtggagcttgtggcagtggg

SEQ ID NO: 7633454 - DNA, 22 bp, Homo sapiens
ctgtggagcttgtggcagtggg

SEQ ID NO: 7633455 - DNA, 22 bp, Homo sapiens
ctgtggagcttgtggcagtggg

SEQ ID NO: 7633456 - DNA, 22 bp, Homo sapiens
ctgtggagcttgtggcagtggg

SEQ ID NO: 7633457 - DNA, 22 bp, Homo sapiens
agttgctgattctgtctgtgat

SEQ ID NO: 7633458 - DNA, 22 bp, Homo sapiens
agttgctgattctgtctgtgat

SEQ ID NO: 7633459 - DNA, 22 bp, Homo sapiens
agttgctctaggtgaggtcttt

SEQ ID NO: 7633460 - DNA, 23 bp, Homo sapiens
agttgctctcaagaatatcttgt

SEQ ID NO: 7633461 - DNA, 22 bp, Homo sapiens
agttgctgattctgtctgtgat

SEQ ID NO: 7633462 - DNA, 22 bp, Homo sapiens
agttctttctagacacgtagac

SEQ ID NO: 7633463 - DNA, 22 bp, Homo sapiens
agttctttctagacacgtagac

SEQ ID NO: 7633464 - DNA, 22 bp, Homo sapiens
agttgctcagtaagtcctgagc

SEQ ID NO: 7633465 - DNA, 22 bp, Homo sapiens
agttctttctagacacgtagac

SEQ ID NO: 7633466 - DNA, 22 bp, Homo sapiens
agttgctgcttctctctagaga

SEQ ID NO: 7633467 - DNA, 22 bp, Homo sapiens
agttgctgcttctctctagaga

SEQ ID NO: 7633468 - DNA, 22 bp, Homo sapiens
agttgctggcacctgtgagtat

SEQ ID NO: 7633469 - DNA, 21 bp, Homo sapiens
agttgctgctgctgcaggtga

SEQ ID NO: 7633470 - DNA, 21 bp, Homo sapiens
agttgctgctgctgcaggtga

SEQ ID NO: 7633471 - DNA, 21 bp, Homo sapiens
agttgctgctgctgcaggtga

SEQ ID NO: 7633472 - DNA, 22 bp, Homo sapiens
ctctttggtgcaccttgcagtc

SEQ ID NO: 7633473 - DNA, 22 bp, Homo sapiens
ctctttggtgcaccttgcagtc

SEQ ID NO: 7633474 - DNA, 22 bp, Homo sapiens
ctctttggtcgcatcatccatt

SEQ ID NO: 7633475 - DNA, 22 bp, Homo sapiens
agttcttcccttttctatggag

SEQ ID NO: 7633476 - DNA, 22 bp, Homo sapiens
agttcttcttgttaacacataa

SEQ ID NO: 7633477 - DNA, 22 bp, Homo sapiens
agttctttatatattagggata

SEQ ID NO: 7633478 - DNA, 22 bp, Homo sapiens
agttctttaacctttctgggca

SEQ ID NO: 7633479 - DNA, 22 bp, Homo sapiens
agttctttaacctttctgggca

SEQ ID NO: 7633480 - DNA, 22 bp, Homo sapiens
agttcttgctataaaaacaaat

SEQ ID NO: 7633481 - DNA, 22 bp, Homo sapiens
agttcttcccttttctatggag

SEQ ID NO: 7633482 - DNA, 21 bp, Homo sapiens
ctctttgggatctttggaaag

SEQ ID NO: 7633483 - DNA, 21 bp, Homo sapiens
ctctttgggatctttggaaag

SEQ ID NO: 7633484 - DNA, 22 bp, Homo sapiens
ctctttggctttgactcccatt

SEQ ID NO: 7633485 - DNA, 21 bp, Homo sapiens
ctctttgggatctttggaaag

SEQ ID NO: 7633486 - DNA, 22 bp, Homo sapiens
ctctttgggatgggctctgctg

SEQ ID NO: 7633487 - DNA, 22 bp, Homo sapiens
ctctttgggatgggctctgctg

SEQ ID NO: 7633488 - DNA, 22 bp, Homo sapiens
ctctttgggatgggctctgctg

SEQ ID NO: 7633489 - DNA, 16 bp, Homo sapiens
ctctttgggcttccag

SEQ ID NO: 7633490 - DNA, 16 bp, Homo sapiens
ctctttgggcttccag

SEQ ID NO: 7633491 - DNA, 22 bp, Homo sapiens
ctctttgggatgggctctgctg

SEQ ID NO: 7633492 - DNA, 22 bp, Homo sapiens
ctctttggggctggaagcctag

SEQ ID NO: 7633493 - DNA, 16 bp, Homo sapiens
ctctttgggcttccag

SEQ ID NO: 7633494 - DNA, 22 bp, Homo sapiens
ctctttggggtgccccactggt

SEQ ID NO: 7633495 - DNA, 22 bp, Homo sapiens
ctctttggggctggaagcctag

SEQ ID NO: 7633496 - DNA, 22 bp, Homo sapiens
ctctttggggtgccccactggt

SEQ ID NO: 7633497 - DNA, 22 bp, Homo sapiens
ctctttggggtgccccactggt

SEQ ID NO: 7633498 - DNA, 22 bp, Homo sapiens
ctctttggggtgccccactggt

SEQ ID NO: 7633499 - DNA, 22 bp, Homo sapiens
ctctttggtcgcatcatccatt

SEQ ID NO: 7633500 - DNA, 22 bp, Homo sapiens
ctctttggtcgcatcatccatt

SEQ ID NO: 7633501 - DNA, 22 bp, Homo sapiens
agttgctggcacctgtgagtat

SEQ ID NO: 7633502 - DNA, 22 bp, Homo sapiens
agttgctggcacctgtgagtat

SEQ ID NO: 7633503 - DNA, 22 bp, Homo sapiens
agttgctgggaaagatttcagt

SEQ ID NO: 7633504 - DNA, 22 bp, Homo sapiens
agttgctggtaaatgttatcaa

SEQ ID NO: 7633505 - DNA, 22 bp, Homo sapiens
agttggaagacaccctgaaatc

SEQ ID NO: 7633506 - DNA, 23 bp, Homo sapiens
agttggacctgggtaagaaaatg

SEQ ID NO: 7633507 - DNA, 23 bp, Homo sapiens
agttggacctgggtaagaaaatg

SEQ ID NO: 7633508 - DNA, 22 bp, Homo sapiens
agttggaccttgggaaaaggta

SEQ ID NO: 7633509 - DNA, 22 bp, Homo sapiens
agttggagaagaggtcgggaat

SEQ ID NO: 7633510 - DNA, 22 bp, Homo sapiens
agttggagaagaggtcgggaat

SEQ ID NO: 7633511 - DNA, 22 bp, Homo sapiens
agttggcaaggtctggccagcg

SEQ ID NO: 7633512 - DNA, 22 bp, Homo sapiens
agttggatggattggaatgaag

SEQ ID NO: 7633513 - DNA, 22 bp, Homo sapiens
agttggagtgaacatgagattg

SEQ ID NO: 7633514 - DNA, 21 bp, Homo sapiens
agttggaggcagtttggcaat

SEQ ID NO: 7633515 - DNA, 22 bp, Homo sapiens
agttggagtgaacatgagattg

SEQ ID NO: 7633516 - DNA, 22 bp, Homo sapiens
agttggagtgaacatgagattg

SEQ ID NO: 7633517 - DNA, 22 bp, Homo sapiens
agttggagtgaacatgagattg

SEQ ID NO: 7633518 - DNA, 23 bp, Homo sapiens
agttggcatattcaagcacagtc

SEQ ID NO: 7633519 - DNA, 23 bp, Homo sapiens
agttggcatattcaagcacagtc

SEQ ID NO: 7633520 - DNA, 22 bp, Homo sapiens
agttggcagtctgcaacctgga

SEQ ID NO: 7633521 - DNA, 22 bp, Homo sapiens
agttggcaaaggtaggtattct

SEQ ID NO: 7633522 - DNA, 22 bp, Homo sapiens
agttggcaaggtctggccagcg

SEQ ID NO: 7633523 - DNA, 22 bp, Homo sapiens
agttggcactgagctgtgattg

SEQ ID NO: 7633524 - DNA, 22 bp, Homo sapiens
agttggcattcctgcatcctat

SEQ ID NO: 7633525 - DNA, 22 bp, Homo sapiens
agttggcgggacatgtggaaag

SEQ ID NO: 7633526 - DNA, 22 bp, Homo sapiens
agttggcttcaaaggcagagag

SEQ ID NO: 7633527 - DNA, 19 bp, Homo sapiens
agttggggcagggaagaga

SEQ ID NO: 7633528 - DNA, 19 bp, Homo sapiens
agttggggcagggaagaga

SEQ ID NO: 7633529 - DNA, 22 bp, Homo sapiens
agttgggattcttggttctggg

SEQ ID NO: 7633530 - DNA, 19 bp, Homo sapiens
agttggggcagggaagaga

SEQ ID NO: 7633531 - DNA, 19 bp, Homo sapiens
agttggggcagggaagaga

SEQ ID NO: 7633532 - DNA, 22 bp, Homo sapiens
agttgggagttatagactctat

SEQ ID NO: 7633533 - DNA, 22 bp, Homo sapiens
agttgggattcttggttctggg

SEQ ID NO: 7633534 - DNA, 22 bp, Homo sapiens
agttgggagttatagactctat

SEQ ID NO: 7633535 - DNA, 22 bp, Homo sapiens
agttggtgagcgtgtggtaatc

SEQ ID NO: 7633536 - DNA, 22 bp, Homo sapiens
agttggtgagcgtgtggtaatc

SEQ ID NO: 7633537 - DNA, 22 bp, Homo sapiens
agttggtgggtgtgagctggac

SEQ ID NO: 7633538 - DNA, 22 bp, Homo sapiens
agttgggtttgtgtcagttgca

SEQ ID NO: 7633539 - DNA, 22 bp, Homo sapiens
agttgggtttgtgtcagttgca

SEQ ID NO: 7633540 - DNA, 22 bp, Homo sapiens
agttgggtttgtgtcagttgca

SEQ ID NO: 7633541 - DNA, 22 bp, Homo sapiens
agttgggtttgtgtcagttgca

SEQ ID NO: 7633542 - DNA, 22 bp, Homo sapiens
agttgtaacagattctaacata

SEQ ID NO: 7633543 - DNA, 22 bp, Homo sapiens
agttgtaacagattctaacata

SEQ ID NO: 7633544 - DNA, 22 bp, Homo sapiens
agttgtaagagacagatataaa

SEQ ID NO: 7633545 - DNA, 22 bp, Homo sapiens
agttggtgggtgtgagctggac

SEQ ID NO: 7633546 - DNA, 22 bp, Homo sapiens
agttggtgggtgtgagctggac

SEQ ID NO: 7633547 - DNA, 22 bp, Homo sapiens
agttggttcactccttcatgcc

SEQ ID NO: 7633548 - DNA, 22 bp, Homo sapiens
agttggttggacccaagtaagg

SEQ ID NO: 7633549 - DNA, 22 bp, Homo sapiens
ctgaggcaggagaattgctgga

SEQ ID NO: 7633550 - DNA, 22 bp, Homo sapiens
ctgaggcaggagaattgctgga

SEQ ID NO: 7633551 - DNA, 22 bp, Homo sapiens
ctgaggcaggagaattgctgga

SEQ ID NO: 7633552 - DNA, 22 bp, Homo sapiens
ctgaggcaggagaattgctgga

SEQ ID NO: 7633553 - DNA, 21 bp, Homo sapiens
ctgaggcagcacagctagtca

SEQ ID NO: 7633554 - DNA, 22 bp, Homo sapiens
agttgtaataacaataccaaaa

SEQ ID NO: 7633555 - DNA, 22 bp, Homo sapiens
agttgtaagaggcacaaggaag

SEQ ID NO: 7633556 - DNA, 22 bp, Homo sapiens
agttgtaagagacagatataaa

SEQ ID NO: 7633557 - DNA, 22 bp, Homo sapiens
agttgtaagagacagatataaa

SEQ ID NO: 7633558 - DNA, 22 bp, Homo sapiens
ctgaggcaggatggcctggctg

SEQ ID NO: 7633559 - DNA, 22 bp, Homo sapiens
ctgaggcaggcagatcacttga

SEQ ID NO: 7633560 - DNA, 22 bp, Homo sapiens
ctgaggcaggcagatcacttga

SEQ ID NO: 7633561 - DNA, 22 bp, Homo sapiens
ctgaggcaggcagatcacttga

SEQ ID NO: 7633562 - DNA, 22 bp, Homo sapiens
ctgaggcaggggcagctggaga

SEQ ID NO: 7633563 - DNA, 22 bp, Homo sapiens
ctgaggcaggggcagctggaga

SEQ ID NO: 7633564 - DNA, 22 bp, Homo sapiens
ctgaggcaggggcagctggaga

SEQ ID NO: 7633565 - DNA, 22 bp, Homo sapiens
ctgaggcaggggcagctggaga

SEQ ID NO: 7633566 - DNA, 22 bp, Homo sapiens
ctgaggcaggggcagctggaga

SEQ ID NO: 7633567 - DNA, 22 bp, Homo sapiens
ctgaggcaggagagttgcttga

SEQ ID NO: 7633568 - DNA, 22 bp, Homo sapiens
ctgaggcaggatggcctggctg

SEQ ID NO: 7633569 - DNA, 22 bp, Homo sapiens
ctgaggcaggatggcctggctg

SEQ ID NO: 7633570 - DNA, 22 bp, Homo sapiens
agttgtaagaggcacaaggaag

SEQ ID NO: 7633571 - DNA, 22 bp, Homo sapiens
ctgaggcaggagagttgcttga

SEQ ID NO: 7633572 - DNA, 22 bp, Homo sapiens
ctgaggcaggatggcctggctg

SEQ ID NO: 7633573 - DNA, 22 bp, Homo sapiens
ctgaggcaggatggcctggctg

SEQ ID NO: 7633574 - DNA, 22 bp, Homo sapiens
ctgaggcaggagaattgctgga

SEQ ID NO: 7633575 - DNA, 22 bp, Homo sapiens
ctgaggcaggagaattgctgga

SEQ ID NO: 7633576 - DNA, 22 bp, Homo sapiens
ctgaggcaggagagttgcttga

SEQ ID NO: 7633577 - DNA, 22 bp, Homo sapiens
ctgaggcaggagagttgcttga

SEQ ID NO: 7633578 - DNA, 22 bp, Homo sapiens
ctgaggcctaagacatgaatga

SEQ ID NO: 7633579 - DNA, 22 bp, Homo sapiens
ctgaggcctaagacatgaatga

SEQ ID NO: 7633580 - DNA, 22 bp, Homo sapiens
ctgaggcctcactgtagtccct

SEQ ID NO: 7633581 - DNA, 22 bp, Homo sapiens
ctgaggcctcactgtagtccct

SEQ ID NO: 7633582 - DNA, 22 bp, Homo sapiens
ctgaggcctaagacatgaatga

SEQ ID NO: 7633583 - DNA, 22 bp, Homo sapiens
ctgaggcctcgttggctggaac

SEQ ID NO: 7633584 - DNA, 22 bp, Homo sapiens
ctgaggcctcgttggctggaac

SEQ ID NO: 7633585 - DNA, 22 bp, Homo sapiens
ctgaggcctcgttggctggaac

SEQ ID NO: 7633586 - DNA, 22 bp, Homo sapiens
ctgaggcctcactgtagtccct

SEQ ID NO: 7633587 - DNA, 22 bp, Homo sapiens
ctgaggcctaagacatgaatga

SEQ ID NO: 7633588 - DNA, 22 bp, Homo sapiens
ctgaggccgttggtgggcctta

SEQ ID NO: 7633589 - DNA, 21 bp, Homo sapiens
ctgaggcatgcaggcctgggc

SEQ ID NO: 7633590 - DNA, 21 bp, Homo sapiens
ctgaggcatgcaggcctgggc

SEQ ID NO: 7633591 - DNA, 21 bp, Homo sapiens
ctgaggcatgcaggcctgggc

SEQ ID NO: 7633592 - DNA, 21 bp, Homo sapiens
ctgaggcatgcaggcctgggc

SEQ ID NO: 7633593 - DNA, 22 bp, Homo sapiens
ctgaggcatgaatgtgggcttt

SEQ ID NO: 7633594 - DNA, 21 bp, Homo sapiens
ctgaggcatgcaggcctgggc

SEQ ID NO: 7633595 - DNA, 22 bp, Homo sapiens
ctgaggcatgaatgtgggcttt

SEQ ID NO: 7633596 - DNA, 22 bp, Homo sapiens
ctgaggcatgaatgtgggcttt

SEQ ID NO: 7633597 - DNA, 22 bp, Homo sapiens
ctgaggcagtttaatttttgaa

SEQ ID NO: 7633598 - DNA, 22 bp, Homo sapiens
ctgaggcatcatggagaacagt

SEQ ID NO: 7633599 - DNA, 22 bp, Homo sapiens
ctgaggcatcatggagaacagt

SEQ ID NO: 7633600 - DNA, 22 bp, Homo sapiens
ctgaggcatcatggagaacagt

SEQ ID NO: 7633601 - DNA, 22 bp, Homo sapiens
ctgaggcagtttaatttttgaa

SEQ ID NO: 7633602 - DNA, 22 bp, Homo sapiens
ctgaggcaggggcagctggaga

SEQ ID NO: 7633603 - DNA, 22 bp, Homo sapiens
ctgaggcagtttaatttttgaa

SEQ ID NO: 7633604 - DNA, 22 bp, Homo sapiens
ctgaggcaggggcagctggaga

SEQ ID NO: 7633605 - DNA, 22 bp, Homo sapiens
ctgaggcatgaatgtgggcttt

SEQ ID NO: 7633606 - DNA, 22 bp, Homo sapiens
ctgaggcatgaatgtgggcttt

SEQ ID NO: 7633607 - DNA, 22 bp, Homo sapiens
ctgaggcatcatggagaacagt

SEQ ID NO: 7633608 - DNA, 22 bp, Homo sapiens
ctgaggcatgaatgtgggcttt

SEQ ID NO: 7633609 - DNA, 22 bp, Homo sapiens
ctgaggcatgaatgtgggcttt

SEQ ID NO: 7633610 - DNA, 22 bp, Homo sapiens
ctgaggcatgaatgtgggcttt

SEQ ID NO: 7633611 - DNA, 22 bp, Homo sapiens
ctgaggcctctcccactccagc

SEQ ID NO: 7633612 - DNA, 22 bp, Homo sapiens
ctgaggcctcgttggctggaac

SEQ ID NO: 7633613 - DNA, 22 bp, Homo sapiens
ctgaggcctcgttggctggaac

SEQ ID NO: 7633614 - DNA, 22 bp, Homo sapiens
ctgaggcctcgttggctggaac

SEQ ID NO: 7633615 - DNA, 22 bp, Homo sapiens
ctgaggcctctccttggcttgt

SEQ ID NO: 7633616 - DNA, 22 bp, Homo sapiens
ctgaggcctctcccactccagc

SEQ ID NO: 7633617 - DNA, 22 bp, Homo sapiens
ctgaggcctctcccactccagc

SEQ ID NO: 7633618 - DNA, 22 bp, Homo sapiens
ctgaggcctctcccactccagc

SEQ ID NO: 7633619 - DNA, 22 bp, Homo sapiens
ctgaggcctctctcctgggctt

SEQ ID NO: 7633620 - DNA, 22 bp, Homo sapiens
ctgaggcctctctcctgggctt

SEQ ID NO: 7633621 - DNA, 22 bp, Homo sapiens
ctgaggcctctctcctgggctt

SEQ ID NO: 7633622 - DNA, 22 bp, Homo sapiens
ctgaggcctctctccttggctt

SEQ ID NO: 7633623 - DNA, 22 bp, Homo sapiens
ctgaggcctctctccttggctt

SEQ ID NO: 7633624 - DNA, 22 bp, Homo sapiens
ctgaggcctctctcctgggctt

SEQ ID NO: 7633625 - DNA, 22 bp, Homo sapiens
ctgaggcctctctcctgggctt

SEQ ID NO: 7633626 - DNA, 22 bp, Homo sapiens
ctgaggcctctctcctgggctt

SEQ ID NO: 7633627 - DNA, 22 bp, Homo sapiens
ctgaggcctctttccttggctt

SEQ ID NO: 7633628 - DNA, 22 bp, Homo sapiens
ctgaggcctctttccttggctt

SEQ ID NO: 7633629 - DNA, 23 bp, Homo sapiens
ctgaggcctgctgcgttcaggtt

SEQ ID NO: 7633630 - DNA, 23 bp, Homo sapiens
ctgaggcctgctgcgttcaggtt

SEQ ID NO: 7633631 - DNA, 22 bp, Homo sapiens
ctgaggcctctttccttggctt

SEQ ID NO: 7633632 - DNA, 23 bp, Homo sapiens
ctgaggcctgctgcgttcaggtt

SEQ ID NO: 7633633 - DNA, 23 bp, Homo sapiens
ctgaggcctgctgcgttcaggtt

SEQ ID NO: 7633634 - DNA, 22 bp, Homo sapiens
ctgaggctgggctgagggtata

SEQ ID NO: 7633635 - DNA, 22 bp, Homo sapiens
ctgaggctgggctgagggtata

SEQ ID NO: 7633636 - DNA, 22 bp, Homo sapiens
ctgaggcctctgttcaccagaa

SEQ ID NO: 7633637 - DNA, 22 bp, Homo sapiens
ctgaggcctctgttcaccagaa

SEQ ID NO: 7633638 - DNA, 22 bp, Homo sapiens
ctgaggcctctgttcaccagaa

SEQ ID NO: 7633639 - DNA, 22 bp, Homo sapiens
ctgaggcctctgttcaccagaa

SEQ ID NO: 7633640 - DNA, 22 bp, Homo sapiens
ctgaggcctctgttcaccagaa

SEQ ID NO: 7633641 - DNA, 22 bp, Homo sapiens
ctgaggcctctgttcaccagaa

SEQ ID NO: 7633642 - DNA, 22 bp, Homo sapiens
ctgaggcctctctccttggctt

SEQ ID NO: 7633643 - DNA, 22 bp, Homo sapiens
ctgaggcttggaggggtctggt

SEQ ID NO: 7633644 - DNA, 22 bp, Homo sapiens
ctgaggcttgtcctctcagctt

SEQ ID NO: 7633645 - DNA, 22 bp, Homo sapiens
ctgaggcttgtcctctcagctt

SEQ ID NO: 7633646 - DNA, 22 bp, Homo sapiens
ctgaggcttgtcctctcagctt

SEQ ID NO: 7633647 - DNA, 22 bp, Homo sapiens
ctgaggcttgtcctctcagctt

SEQ ID NO: 7633648 - DNA, 22 bp, Homo sapiens
ctgaggcttgtcctctcagctt

SEQ ID NO: 7633649 - DNA, 22 bp, Homo sapiens
ctgaggcttgtcctctcagctt

SEQ ID NO: 7633650 - DNA, 22 bp, Homo sapiens
ctgaggcttgtcctctcagctt

SEQ ID NO: 7633651 - DNA, 22 bp, Homo sapiens
ctgaggcttgtcctctcagctt

SEQ ID NO: 7633652 - DNA, 22 bp, Homo sapiens
ctgaggcttctctagttcagct

SEQ ID NO: 7633653 - DNA, 22 bp, Homo sapiens
ctgaggcttctctagttcagct

SEQ ID NO: 7633654 - DNA, 22 bp, Homo sapiens
ctgaggcttctctagttcagct

SEQ ID NO: 7633655 - DNA, 22 bp, Homo sapiens
ctgaggcttctctagttcagct

SEQ ID NO: 7633656 - DNA, 22 bp, Homo sapiens
ctgaggcttctctagttcagct

SEQ ID NO: 7633657 - DNA, 18 bp, Homo sapiens
ctgaggcttagagaggtt

SEQ ID NO: 7633658 - DNA, 22 bp, Homo sapiens
ctgaggcttggaggggtctggt

SEQ ID NO: 7633659 - DNA, 22 bp, Homo sapiens
ctgaggcttggaggggtctggt

SEQ ID NO: 7633660 - DNA, 22 bp, Homo sapiens
ctgaggcttggaggggtctggt

SEQ ID NO: 7633661 - DNA, 22 bp, Homo sapiens
ctgaggctgggcttgccttctt

SEQ ID NO: 7633662 - DNA, 22 bp, Homo sapiens
ctgaggctgggcttgccttctt

SEQ ID NO: 7633663 - DNA, 22 bp, Homo sapiens
ctgaggctgggcttgccttctt

SEQ ID NO: 7633664 - DNA, 22 bp, Homo sapiens
ctgaggctgggctgagggtata

SEQ ID NO: 7633665 - DNA, 22 bp, Homo sapiens
ctgaggctgggctgagggtata

SEQ ID NO: 7633666 - DNA, 22 bp, Homo sapiens
ctgaggctggggaagggaagtg

SEQ ID NO: 7633667 - DNA, 22 bp, Homo sapiens
ctgaggctggggaagggaagtg

SEQ ID NO: 7633668 - DNA, 22 bp, Homo sapiens
ctgaggctggggaagggaagtg

SEQ ID NO: 7633669 - DNA, 22 bp, Homo sapiens
ctgaggctggggaagggaagtg

SEQ ID NO: 7633670 - DNA, 22 bp, Homo sapiens
ctgaggctggggaagggaagtg

SEQ ID NO: 7633671 - DNA, 18 bp, Homo sapiens
ctgaggcttagagaggtt

SEQ ID NO: 7633672 - DNA, 18 bp, Homo sapiens
ctgaggcttagagaggtt

SEQ ID NO: 7633673 - DNA, 18 bp, Homo sapiens
ctgaggcttagagaggtt

SEQ ID NO: 7633674 - DNA, 18 bp, Homo sapiens
ctgaggcttagagaggtt

SEQ ID NO: 7633675 - DNA, 18 bp, Homo sapiens
ctgaggcttagagaggtt

SEQ ID NO: 7633676 - DNA, 18 bp, Homo sapiens
ctgaggcttagagaggtt

SEQ ID NO: 7633677 - DNA, 22 bp, Homo sapiens
ctgaggctggggaagggaagtg

SEQ ID NO: 7633678 - DNA, 18 bp, Homo sapiens
ctgaggcttagagaggtt

SEQ ID NO: 7633679 - DNA, 22 bp, Homo sapiens
ctgagggaacttgggcaagtct

SEQ ID NO: 7633680 - DNA, 22 bp, Homo sapiens
ctgagggaacttgggcaagtct

SEQ ID NO: 7633681 - DNA, 22 bp, Homo sapiens
ctgaggctttgtgtgcatgcct

SEQ ID NO: 7633682 - DNA, 22 bp, Homo sapiens
ctgagggaacttgggcaagtct

SEQ ID NO: 7633683 - DNA, 22 bp, Homo sapiens
ctgaggggataaaggtttgggt

SEQ ID NO: 7633684 - DNA, 22 bp, Homo sapiens
ctgaggggataaaggtttgggt

SEQ ID NO: 7633685 - DNA, 22 bp, Homo sapiens
ctgaggggataaaggtttgggt

SEQ ID NO: 7633686 - DNA, 22 bp, Homo sapiens
ctgaggggataaaggtttgggt

SEQ ID NO: 7633687 - DNA, 22 bp, Homo sapiens
ctgaggggtatccaaggggtaa

SEQ ID NO: 7633688 - DNA, 22 bp, Homo sapiens
ctgaggggatgtttttgacgga

SEQ ID NO: 7633689 - DNA, 22 bp, Homo sapiens
ctgaggggtatccaaggggtaa

SEQ ID NO: 7633690 - DNA, 22 bp, Homo sapiens
ctgaggggtatccaaggggtaa

SEQ ID NO: 7633691 - DNA, 22 bp, Homo sapiens
ctgaggggtatccaaggggtaa

SEQ ID NO: 7633692 - DNA, 22 bp, Homo sapiens
ctgaggggtatccaaggggtaa

SEQ ID NO: 7633693 - DNA, 22 bp, Homo sapiens
ctgagggaacttgggcaagtct

SEQ ID NO: 7633694 - DNA, 22 bp, Homo sapiens
ctgaggctttgtgtgcatgcct

SEQ ID NO: 7633695 - DNA, 22 bp, Homo sapiens
ctgaggctttgtgtgcatgcct

SEQ ID NO: 7633696 - DNA, 22 bp, Homo sapiens
ctgaggctttgtgtgcatgcct

SEQ ID NO: 7633697 - DNA, 22 bp, Homo sapiens
ctgaggctttgtgtgcatgcct

SEQ ID NO: 7633698 - DNA, 22 bp, Homo sapiens
ctgaggctttgtgtgcatgcct

SEQ ID NO: 7633699 - DNA, 22 bp, Homo sapiens
ctgaggctttgtgtgcatgcct

SEQ ID NO: 7633700 - DNA, 22 bp, Homo sapiens
ctgaggctttgtgtgcatgcct

SEQ ID NO: 7633701 - DNA, 22 bp, Homo sapiens
ctgaggggtcgtgggagcccag

SEQ ID NO: 7633702 - DNA, 22 bp, Homo sapiens
ctgaggggtatccaaggggtaa

SEQ ID NO: 7633703 - DNA, 22 bp, Homo sapiens
ctgaggggtcgtgggagcccag

SEQ ID NO: 7633704 - DNA, 22 bp, Homo sapiens
ctgaggggtcgtgggagcccag

SEQ ID NO: 7633705 - DNA, 20 bp, Homo sapiens
ctgaggggtctgacttggac

SEQ ID NO: 7633706 - DNA, 22 bp, Homo sapiens
ctgaggggtcgtgggagcccag

SEQ ID NO: 7633707 - DNA, 20 bp, Homo sapiens
ctgaggggtctgacttggac

SEQ ID NO: 7633708 - DNA, 20 bp, Homo sapiens
ctgaggggtctgacttggac

SEQ ID NO: 7633709 - DNA, 20 bp, Homo sapiens
ctgaggggtctgacttggac

SEQ ID NO: 7633710 - DNA, 22 bp, Homo sapiens
ctgagggtcaacttgattgtat

SEQ ID NO: 7633711 - DNA, 22 bp, Homo sapiens
ctgagggtcaacttgattgtat

SEQ ID NO: 7633712 - DNA, 22 bp, Homo sapiens
ctgagggtcaacttgattgtat

SEQ ID NO: 7633713 - DNA, 22 bp, Homo sapiens
ctgagggtcaacttgattgtat

SEQ ID NO: 7633714 - DNA, 22 bp, Homo sapiens
ctgagggtcaacttgattgtat

SEQ ID NO: 7633715 - DNA, 22 bp, Homo sapiens
ctgagggtcaacttgattgtat

SEQ ID NO: 7633716 - DNA, 22 bp, Homo sapiens
ctgagggtcaacttgattgtat

SEQ ID NO: 7633717 - DNA, 22 bp, Homo sapiens
agttgtacattgtgaacattca

SEQ ID NO: 7633718 - DNA, 22 bp, Homo sapiens
ctgaggtcaccccactggctgt

SEQ ID NO: 7633719 - DNA, 22 bp, Homo sapiens
agttgtatctgaatgcatgtag

SEQ ID NO: 7633720 - DNA, 22 bp, Homo sapiens
agttgtatctgaatgcatgtag

SEQ ID NO: 7633721 - DNA, 22 bp, Homo sapiens
agttgtatctgaatgcatgtag

SEQ ID NO: 7633722 - DNA, 22 bp, Homo sapiens
agttgtacattgtgaacattca

SEQ ID NO: 7633723 - DNA, 22 bp, Homo sapiens
agttgtatacacttaggcagat

SEQ ID NO: 7633724 - DNA, 22 bp, Homo sapiens
agttgtatacacttaggcagat

SEQ ID NO: 7633725 - DNA, 22 bp, Homo sapiens
agttgtattagagaacacaaac

SEQ ID NO: 7633726 - DNA, 22 bp, Homo sapiens
agttgtattagagaacacaaac

SEQ ID NO: 7633727 - DNA, 22 bp, Homo sapiens
agttgtcacctctattcaaatc

SEQ ID NO: 7633728 - DNA, 22 bp, Homo sapiens
ctgaggtcaattaatcaacaac

SEQ ID NO: 7633729 - DNA, 22 bp, Homo sapiens
ctgaggtcaattaatcaacaac

SEQ ID NO: 7633730 - DNA, 22 bp, Homo sapiens
ctgaggtcaccccactggctgt

SEQ ID NO: 7633731 - DNA, 22 bp, Homo sapiens
ctgaggtcaccccactggctgt

SEQ ID NO: 7633732 - DNA, 22 bp, Homo sapiens
ctgaggtcagagtttagtctgg

SEQ ID NO: 7633733 - DNA, 22 bp, Homo sapiens
ctgaggtcagagtttagtctgg

SEQ ID NO: 7633734 - DNA, 23 bp, Homo sapiens
ctgaggtaaaatattctgaagga

SEQ ID NO: 7633735 - DNA, 22 bp, Homo sapiens
ctgagggtgctattcttgcctt

SEQ ID NO: 7633736 - DNA, 22 bp, Homo sapiens
ctgaggtaattttccagataat

SEQ ID NO: 7633737 - DNA, 22 bp, Homo sapiens
ctgaggtacctggagcaggtcc

SEQ ID NO: 7633738 - DNA, 22 bp, Homo sapiens
ctgaggtacctggagcaggtcc

SEQ ID NO: 7633739 - DNA, 22 bp, Homo sapiens
ctgaggtatgtgggactagcct

SEQ ID NO: 7633740 - DNA, 22 bp, Homo sapiens
ctgaggtatgtgggactagcct

SEQ ID NO: 7633741 - DNA, 22 bp, Homo sapiens
ctgaggtatgtgggactagcct

SEQ ID NO: 7633742 - DNA, 22 bp, Homo sapiens
ctgaggtagctgtgaatgttct

SEQ ID NO: 7633743 - DNA, 22 bp, Homo sapiens
ctgcagctggctcatgggatat

SEQ ID NO: 7633744 - DNA, 22 bp, Homo sapiens
ctgcagctgggccagggccacc

SEQ ID NO: 7633745 - DNA, 23 bp, Homo sapiens
agtttctttgagacttgccctgt

SEQ ID NO: 7633746 - DNA, 22 bp, Homo sapiens
ctgcagctggctcatgggatat

SEQ ID NO: 7633747 - DNA, 22 bp, Homo sapiens
ctgcagctggctcatgggatat

SEQ ID NO: 7633748 - DNA, 22 bp, Homo sapiens
ctgcagctggctcatgggatat

SEQ ID NO: 7633749 - DNA, 22 bp, Homo sapiens
agtttgaaagcttaacagtaca

SEQ ID NO: 7633750 - DNA, 22 bp, Homo sapiens
agtttgaaagcttaacagtaca

SEQ ID NO: 7633751 - DNA, 22 bp, Homo sapiens
agtttgaaagcttaacagtaca

SEQ ID NO: 7633752 - DNA, 22 bp, Homo sapiens
agtttgaaagtattgacagaag

SEQ ID NO: 7633753 - DNA, 22 bp, Homo sapiens
agtttgaaagtattgacagaag

SEQ ID NO: 7633754 - DNA, 22 bp, Homo sapiens
agtttgaaagtattgacagaag

SEQ ID NO: 7633755 - DNA, 22 bp, Homo sapiens
agtttgaaggagttgaatcacc

SEQ ID NO: 7633756 - DNA, 22 bp, Homo sapiens
agtttgaagcacatgaatggca

SEQ ID NO: 7633757 - DNA, 22 bp, Homo sapiens
agtttgaagcaaaattgaggaa

SEQ ID NO: 7633758 - DNA, 22 bp, Homo sapiens
agtttgaattgaaatgcagatg

SEQ ID NO: 7633759 - DNA, 22 bp, Homo sapiens
agtttgaaatgttggcaatatt

SEQ ID NO: 7633760 - DNA, 18 bp, Homo sapiens
agtttgaacaaggaagaa

SEQ ID NO: 7633761 - DNA, 22 bp, Homo sapiens
agtttgaagaaggatctatgaa

SEQ ID NO: 7633762 - DNA, 22 bp, Homo sapiens
agtttgaagaaggtgagatgca

SEQ ID NO: 7633763 - DNA, 22 bp, Homo sapiens
ctgcagctgcagttctgagaga

SEQ ID NO: 7633764 - DNA, 22 bp, Homo sapiens
ctgcagctgcagttctgagaga

SEQ ID NO: 7633765 - DNA, 22 bp, Homo sapiens
ctgcagctgcagttctgagaga

SEQ ID NO: 7633766 - DNA, 22 bp, Homo sapiens
ctgcagctgcagttctgagaga

SEQ ID NO: 7633767 - DNA, 19 bp, Homo sapiens
ctgcagctgcaccatccca

SEQ ID NO: 7633768 - DNA, 19 bp, Homo sapiens
ctgcagctgcaccatccca

SEQ ID NO: 7633769 - DNA, 22 bp, Homo sapiens
ctgcagctgcagttctgagaga

SEQ ID NO: 7633770 - DNA, 22 bp, Homo sapiens
ctgcagctgcagttctgagaga

SEQ ID NO: 7633771 - DNA, 22 bp, Homo sapiens
ctgcagctgccagtgatttcag

SEQ ID NO: 7633772 - DNA, 22 bp, Homo sapiens
ctgcagctgccagtgatttcag

SEQ ID NO: 7633773 - DNA, 22 bp, Homo sapiens
ctgcagctgccagtgatttcag

SEQ ID NO: 7633774 - DNA, 22 bp, Homo sapiens
ctgcagctgctcatgttacttg

SEQ ID NO: 7633775 - DNA, 22 bp, Homo sapiens
ctgcagctgcgggaccggagcg

SEQ ID NO: 7633776 - DNA, 22 bp, Homo sapiens
ctgcagctgctcatgttacttg

SEQ ID NO: 7633777 - DNA, 22 bp, Homo sapiens
ctgcagctgctcatgttacttg

SEQ ID NO: 7633778 - DNA, 22 bp, Homo sapiens
ctgcagctgcgggaccggagcg

SEQ ID NO: 7633779 - DNA, 22 bp, Homo sapiens
ctgcagctgcgggaccggagcg

SEQ ID NO: 7633780 - DNA, 22 bp, Homo sapiens
ctgcagctgccagtgatttcag

SEQ ID NO: 7633781 - DNA, 17 bp, Homo sapiens
ctgcagctggagggcca

SEQ ID NO: 7633782 - DNA, 17 bp, Homo sapiens
ctgcagctggagggcca

SEQ ID NO: 7633783 - DNA, 22 bp, Homo sapiens
ctgcagctggagcatcttctca

SEQ ID NO: 7633784 - DNA, 22 bp, Homo sapiens
ctgcagctggagcatcttctca

SEQ ID NO: 7633785 - DNA, 22 bp, Homo sapiens
agtttggaaaatgagacaagga

SEQ ID NO: 7633786 - DNA, 22 bp, Homo sapiens
agtttggaaaatgagacaagga

SEQ ID NO: 7633787 - DNA, 22 bp, Homo sapiens
agtttggaagaatttggtctgt

SEQ ID NO: 7633788 - DNA, 22 bp, Homo sapiens
agtttgctgatgaagaaaattt

SEQ ID NO: 7633789 - DNA, 22 bp, Homo sapiens
agtttgctgatgaagaaaattt

SEQ ID NO: 7633790 - DNA, 22 bp, Homo sapiens
agtttgctcagctgtcaaatgg

SEQ ID NO: 7633791 - DNA, 22 bp, Homo sapiens
agtttgctcagctgtcaaatgg

SEQ ID NO: 7633792 - DNA, 22 bp, Homo sapiens
agtttggaaaatgagacaagga

SEQ ID NO: 7633793 - DNA, 22 bp, Homo sapiens
agtttgctcagaaatttgaaat

SEQ ID NO: 7633794 - DNA, 22 bp, Homo sapiens
agtttgctcagaaatttgaaat

SEQ ID NO: 7633795 - DNA, 19 bp, Homo sapiens
agtttgcagaaggatatgg

SEQ ID NO: 7633796 - DNA, 22 bp, Homo sapiens
agtttgcagtcaagatgttgga

SEQ ID NO: 7633797 - DNA, 22 bp, Homo sapiens
agtttgcagattatattagtgt

SEQ ID NO: 7633798 - DNA, 22 bp, Homo sapiens
agtttgcagattatattagtgt

SEQ ID NO: 7633799 - DNA, 22 bp, Homo sapiens
agtttgcagattatattagtgt

SEQ ID NO: 7633800 - DNA, 22 bp, Homo sapiens
agtttgatttgtctatcttcat

SEQ ID NO: 7633801 - DNA, 22 bp, Homo sapiens
agtttgatttgtctatcttcat

SEQ ID NO: 7633802 - DNA, 22 bp, Homo sapiens
agtttgattgtatgggttttaa

SEQ ID NO: 7633803 - DNA, 22 bp, Homo sapiens
agtttgatggcttaatagtaga

SEQ ID NO: 7633804 - DNA, 22 bp, Homo sapiens
agtttgatggcttaatagtaga

SEQ ID NO: 7633805 - DNA, 22 bp, Homo sapiens
agtttgagatgacatgttataa

SEQ ID NO: 7633806 - DNA, 22 bp, Homo sapiens
agtttgatctgacagattttaa

SEQ ID NO: 7633807 - DNA, 22 bp, Homo sapiens
agtttgaattttaatctcggtg

SEQ ID NO: 7633808 - DNA, 22 bp, Homo sapiens
agtttgacaaagtaaaatgaca

SEQ ID NO: 7633809 - DNA, 22 bp, Homo sapiens
agtttggaagagaaaaatattt

SEQ ID NO: 7633810 - DNA, 22 bp, Homo sapiens
agtttggaagagaaaaatattt

SEQ ID NO: 7633811 - DNA, 22 bp, Homo sapiens
agtttggacaaaagactcctta

SEQ ID NO: 7633812 - DNA, 22 bp, Homo sapiens
agtttggaagtcaggcttttct

SEQ ID NO: 7633813 - DNA, 22 bp, Homo sapiens
agtttggggcaagaggacagat

SEQ ID NO: 7633814 - DNA, 22 bp, Homo sapiens
agtttggggcaagaggacagat

SEQ ID NO: 7633815 - DNA, 22 bp, Homo sapiens
agtttggagtgtggtctttgag

SEQ ID NO: 7633816 - DNA, 22 bp, Homo sapiens
agtttggaatatggtgaatttt

SEQ ID NO: 7633817 - DNA, 22 bp, Homo sapiens
agtttggaggcagggttgatga

SEQ ID NO: 7633818 - DNA, 22 bp, Homo sapiens
agtttggaggcagggttgatga

SEQ ID NO: 7633819 - DNA, 22 bp, Homo sapiens
agtttggagtgtggtctttgag

SEQ ID NO: 7633820 - DNA, 22 bp, Homo sapiens
agtttgtaagttcattatgagt

SEQ ID NO: 7633821 - DNA, 22 bp, Homo sapiens
agtttgtaagttcattatgagt

SEQ ID NO: 7633822 - DNA, 22 bp, Homo sapiens
agtttgtaacctaagattcagg

SEQ ID NO: 7633823 - DNA, 22 bp, Homo sapiens
agtttgtaacctaagattcagg

SEQ ID NO: 7633824 - DNA, 22 bp, Homo sapiens
agtttgtactgaattcaattta

SEQ ID NO: 7633825 - DNA, 22 bp, Homo sapiens
agtttgtactgaattcaattta

SEQ ID NO: 7633826 - DNA, 22 bp, Homo sapiens
agtttgtactgaattcaattta

SEQ ID NO: 7633827 - DNA, 22 bp, Homo sapiens
agtttgtaataatgaaggaagt

SEQ ID NO: 7633828 - DNA, 22 bp, Homo sapiens
agtttgtaagttcattatgagt

SEQ ID NO: 7633829 - DNA, 23 bp, Homo sapiens
agtttgtaaagaaatatttgcac

SEQ ID NO: 7633830 - DNA, 23 bp, Homo sapiens
agtttgtaaagaaatatttgcac

SEQ ID NO: 7633831 - DNA, 22 bp, Homo sapiens
agtttgtaaaatgtggcctgga

SEQ ID NO: 7633832 - DNA, 22 bp, Homo sapiens
agtttgtaaacttgagctagcc

SEQ ID NO: 7633833 - DNA, 22 bp, Homo sapiens
agtttaagctggttataggcaa

SEQ ID NO: 7633834 - DNA, 22 bp, Homo sapiens
agtttaagggattttcaatggt

SEQ ID NO: 7633835 - DNA, 22 bp, Homo sapiens
agtttaatatccttcaactttc

SEQ ID NO: 7633836 - DNA, 20 bp, Homo sapiens
agtttaagaaaaagctccag

SEQ ID NO: 7633837 - DNA, 20 bp, Homo sapiens
agtttaagaaaaagctccag

SEQ ID NO: 7633838 - DNA, 22 bp, Homo sapiens
agtttaactttgtaaacgtgag

SEQ ID NO: 7633839 - DNA, 22 bp, Homo sapiens
agtttaatatccttcaactttc

SEQ ID NO: 7633840 - DNA, 22 bp, Homo sapiens
agtttaatcctccagcccaact

SEQ ID NO: 7633841 - DNA, 22 bp, Homo sapiens
agtttaatatccttcaactttc

SEQ ID NO: 7633842 - DNA, 22 bp, Homo sapiens
ctgcagagcaagttctctgttg

SEQ ID NO: 7633843 - DNA, 22 bp, Homo sapiens
agtttacaacagtagctatgga

SEQ ID NO: 7633844 - DNA, 22 bp, Homo sapiens
agtttacaaagtttcactgttc

SEQ ID NO: 7633845 - DNA, 22 bp, Homo sapiens
agtttacaaagtttcactgttc

SEQ ID NO: 7633846 - DNA, 22 bp, Homo sapiens
agtttacaaagtttcactgttc

SEQ ID NO: 7633847 - DNA, 22 bp, Homo sapiens
agtttaattggaggcgtggctc

SEQ ID NO: 7633848 - DNA, 22 bp, Homo sapiens
agtttacaaagtttcactgttc

SEQ ID NO: 7633849 - DNA, 22 bp, Homo sapiens
agtttacaaagtttcactgttc

SEQ ID NO: 7633850 - DNA, 22 bp, Homo sapiens
agttgttcgtggtggattcgct

SEQ ID NO: 7633851 - DNA, 22 bp, Homo sapiens
agttgttcgtggtggattcgct

SEQ ID NO: 7633852 - DNA, 22 bp, Homo sapiens
agttgttcgtggtggattcgct

SEQ ID NO: 7633853 - DNA, 22 bp, Homo sapiens
agttgtgagaaacagaatgagc

SEQ ID NO: 7633854 - DNA, 22 bp, Homo sapiens
agttgtgtccaagggagagcag

SEQ ID NO: 7633855 - DNA, 22 bp, Homo sapiens
agttgtgctgtgatgcaggata

SEQ ID NO: 7633856 - DNA, 22 bp, Homo sapiens
agttgtgaatagatctgattgg

SEQ ID NO: 7633857 - DNA, 22 bp, Homo sapiens
agttgtcagtcaaagacatttg

SEQ ID NO: 7633858 - DNA, 22 bp, Homo sapiens
agttgtcagtcaaagacatttg

SEQ ID NO: 7633859 - DNA, 22 bp, Homo sapiens
agttgtcacctctattcaaatc

SEQ ID NO: 7633860 - DNA, 22 bp, Homo sapiens
agttgtcacttcaagcaagtgt

SEQ ID NO: 7633861 - DNA, 22 bp, Homo sapiens
agtttaaatcatgttttgtaac

SEQ ID NO: 7633862 - DNA, 22 bp, Homo sapiens
agtttaaatcatgttttgtaac

SEQ ID NO: 7633863 - DNA, 22 bp, Homo sapiens
agttgttcgtggtggattcgct

SEQ ID NO: 7633864 - DNA, 22 bp, Homo sapiens
agttgttctaaagagattttaa

SEQ ID NO: 7633865 - DNA, 22 bp, Homo sapiens
agtttaactttggaaaactata

SEQ ID NO: 7633866 - DNA, 22 bp, Homo sapiens
agtttaactttggaaaactata

SEQ ID NO: 7633867 - DNA, 22 bp, Homo sapiens
agtttaaatcatgttttgtaac

SEQ ID NO: 7633868 - DNA, 22 bp, Homo sapiens
agtttaaatcatgttttgtaac

SEQ ID NO: 7633869 - DNA, 22 bp, Homo sapiens
agtttaaatcatgttttgtaac

SEQ ID NO: 7633870 - DNA, 22 bp, Homo sapiens
ctgcagcctccaccttttgggt

SEQ ID NO: 7633871 - DNA, 22 bp, Homo sapiens
ctgcagagcagccagtccccca

SEQ ID NO: 7633872 - DNA, 22 bp, Homo sapiens
ctgcagcctccaccttttgggt

SEQ ID NO: 7633873 - DNA, 22 bp, Homo sapiens
ctgcagagcagccagtccccca

SEQ ID NO: 7633874 - DNA, 22 bp, Homo sapiens
ctgcagagcagccagtccccca

SEQ ID NO: 7633875 - DNA, 22 bp, Homo sapiens
ctgcagagcagccagtccccca

SEQ ID NO: 7633876 - DNA, 22 bp, Homo sapiens
ctgcagagcagccagtccccca

SEQ ID NO: 7633877 - DNA, 22 bp, Homo sapiens
ctgcagagcaagttctctgttg

SEQ ID NO: 7633878 - DNA, 22 bp, Homo sapiens
ctgcagagcaagttctctgttg

SEQ ID NO: 7633879 - DNA, 22 bp, Homo sapiens
ctgcagcctcctggggtacatg

SEQ ID NO: 7633880 - DNA, 22 bp, Homo sapiens
ctgcagcctcctggggtacatg

SEQ ID NO: 7633881 - DNA, 22 bp, Homo sapiens
ctgcagcctcctggggtacatg

SEQ ID NO: 7633882 - DNA, 22 bp, Homo sapiens
ctgcagcctcctggggtacatg

SEQ ID NO: 7633883 - DNA, 22 bp, Homo sapiens
ctgcagcctcctccagctacgt

SEQ ID NO: 7633884 - DNA, 22 bp, Homo sapiens
ctgcagcctcctccagctacgt

SEQ ID NO: 7633885 - DNA, 22 bp, Homo sapiens
ctgcagctaaggaatgtggttg

SEQ ID NO: 7633886 - DNA, 22 bp, Homo sapiens
ctgcagctaaggaatgtggttg

SEQ ID NO: 7633887 - DNA, 22 bp, Homo sapiens
ctgcagctcctgagctcagaga

SEQ ID NO: 7633888 - DNA, 22 bp, Homo sapiens
ctgcagctcctgagctcagaga

SEQ ID NO: 7633889 - DNA, 22 bp, Homo sapiens
ctgcagctcctgagctcagaga

SEQ ID NO: 7633890 - DNA, 22 bp, Homo sapiens
ctgcagctctagcttttgacct

SEQ ID NO: 7633891 - DNA, 22 bp, Homo sapiens
ctgcagctctagcttttgacct

SEQ ID NO: 7633892 - DNA, 22 bp, Homo sapiens
ctgcagctccttctggcatgtg

SEQ ID NO: 7633893 - DNA, 22 bp, Homo sapiens
ctgcagctccttctggcatgtg

SEQ ID NO: 7633894 - DNA, 22 bp, Homo sapiens
ctgcagctccttctggcatgtg

SEQ ID NO: 7633895 - DNA, 22 bp, Homo sapiens
ctgcagctcccctgagatcaag

SEQ ID NO: 7633896 - DNA, 22 bp, Homo sapiens
ctgcagctcccctgagatcaag

SEQ ID NO: 7633897 - DNA, 22 bp, Homo sapiens
ctgcagctcctctctgtgcccc

SEQ ID NO: 7633898 - DNA, 22 bp, Homo sapiens
ctgcagctcctctctgtgcccc

SEQ ID NO: 7633899 - DNA, 22 bp, Homo sapiens
ctgcagctcctctctgtgcccc

SEQ ID NO: 7633900 - DNA, 22 bp, Homo sapiens
ctgcagctcccctgagatcaag

SEQ ID NO: 7633901 - DNA, 22 bp, Homo sapiens
ctgcagctatattttcccacag

SEQ ID NO: 7633902 - DNA, 22 bp, Homo sapiens
ctgcagctatattttcccacag

SEQ ID NO: 7633903 - DNA, 22 bp, Homo sapiens
ctgcagctatattttcccacag

SEQ ID NO: 7633904 - DNA, 22 bp, Homo sapiens
ctgccaggcactgggctctgca

SEQ ID NO: 7633905 - DNA, 22 bp, Homo sapiens
ctgccaggcacgtgcagcatca

SEQ ID NO: 7633906 - DNA, 22 bp, Homo sapiens
ctgccaggcactgggctctgca

SEQ ID NO: 7633907 - DNA, 22 bp, Homo sapiens
ctgccaggcactgggctctgca

SEQ ID NO: 7633908 - DNA, 22 bp, Homo sapiens
ctgccaggcactgggctctgca

SEQ ID NO: 7633909 - DNA, 22 bp, Homo sapiens
ctgccaggcagcagagggagaa

SEQ ID NO: 7633910 - DNA, 22 bp, Homo sapiens
ctgccaggcactgggctctgca

SEQ ID NO: 7633911 - DNA, 22 bp, Homo sapiens
ctgccaggattctgtgaacccc

SEQ ID NO: 7633912 - DNA, 22 bp, Homo sapiens
ctgccaggcacgtgcagcatca

SEQ ID NO: 7633913 - DNA, 22 bp, Homo sapiens
ctgccaggattctgtgaacccc

SEQ ID NO: 7633914 - DNA, 22 bp, Homo sapiens
ctgccaggcacgtgcagcatca

SEQ ID NO: 7633915 - DNA, 22 bp, Homo sapiens
ctgccaggcacgtgcagcatca

SEQ ID NO: 7633916 - DNA, 22 bp, Homo sapiens
ctgccaggcacgtgcagcatca

SEQ ID NO: 7633917 - DNA, 22 bp, Homo sapiens
ctgccaggcacgtgcagcatca

SEQ ID NO: 7633918 - DNA, 22 bp, Homo sapiens
ctgccaggcactgggctctgca

SEQ ID NO: 7633919 - DNA, 22 bp, Homo sapiens
agtttgtatgccaacagcaaag

SEQ ID NO: 7633920 - DNA, 22 bp, Homo sapiens
ctgcatttccacctggccacag

SEQ ID NO: 7633921 - DNA, 22 bp, Homo sapiens
ctgcatttccacctggccacag

SEQ ID NO: 7633922 - DNA, 22 bp, Homo sapiens
ctgccaaaaggtgcacctgctg

SEQ ID NO: 7633923 - DNA, 22 bp, Homo sapiens
agtttgtatcaatttgctttat

SEQ ID NO: 7633924 - DNA, 22 bp, Homo sapiens
agtttgtaataatgaaggaagt

SEQ ID NO: 7633925 - DNA, 22 bp, Homo sapiens
agtttgtatcaatttgctttat

SEQ ID NO: 7633926 - DNA, 22 bp, Homo sapiens
agtttgtatgccaacagcaaag

SEQ ID NO: 7633927 - DNA, 22 bp, Homo sapiens
agtttgtatcaatttgctttat

SEQ ID NO: 7633928 - DNA, 21 bp, Homo sapiens
ctgccaggatagcatgcaggc

SEQ ID NO: 7633929 - DNA, 21 bp, Homo sapiens
ctgccaggatagcatgcaggc

SEQ ID NO: 7633930 - DNA, 21 bp, Homo sapiens
ctgccaggatagcatgcaggc

SEQ ID NO: 7633931 - DNA, 21 bp, Homo sapiens
ctgccaggatagcatgcaggc

SEQ ID NO: 7633932 - DNA, 21 bp, Homo sapiens
ctgccaggatagcatgcaggc

SEQ ID NO: 7633933 - DNA, 22 bp, Homo sapiens
ctgccaaaaggtgcacctgctg

SEQ ID NO: 7633934 - DNA, 22 bp, Homo sapiens
ctgccaggactgacgtcttcag

SEQ ID NO: 7633935 - DNA, 22 bp, Homo sapiens
ataaaagtaggaccaacttaca

SEQ ID NO: 7633936 - DNA, 22 bp, Homo sapiens
ataaaagtaggaccaacttaca

SEQ ID NO: 7633937 - DNA, 22 bp, Homo sapiens
ataaaagtaggaccaacttaca

SEQ ID NO: 7633938 - DNA, 22 bp, Homo sapiens
ataaaagtaggaccaacttaca

SEQ ID NO: 7633939 - DNA, 22 bp, Homo sapiens
ataaaagtaggaccaacttaca

SEQ ID NO: 7633940 - DNA, 22 bp, Homo sapiens
ataaaagtaggaccaacttaca

SEQ ID NO: 7633941 - DNA, 22 bp, Homo sapiens
ataaaagtaggaccaacttaca

SEQ ID NO: 7633942 - DNA, 22 bp, Homo sapiens
ataaaagtaggaccaacttaca

SEQ ID NO: 7633943 - DNA, 22 bp, Homo sapiens
ataaaagtaggaccaacttaca

SEQ ID NO: 7633944 - DNA, 22 bp, Homo sapiens
ctgccaggcctccgctgtcccc

SEQ ID NO: 7633945 - DNA, 22 bp, Homo sapiens
ataaaagtaggaccaacttaca

SEQ ID NO: 7633946 - DNA, 22 bp, Homo sapiens
ataaaagtaggaccaacttaca

SEQ ID NO: 7633947 - DNA, 22 bp, Homo sapiens
ataaaagtaggaccaacttaca

SEQ ID NO: 7633948 - DNA, 22 bp, Homo sapiens
ataaaagtctgcttatttgggc

SEQ ID NO: 7633949 - DNA, 22 bp, Homo sapiens
ataaaagtctgcttatttgggc

SEQ ID NO: 7633950 - DNA, 22 bp, Homo sapiens
ataaaagtctgcttatttgggc

SEQ ID NO: 7633951 - DNA, 22 bp, Homo sapiens
ataaaagtctgcttatttgggc

SEQ ID NO: 7633952 - DNA, 22 bp, Homo sapiens
ctgccaggcagcagagggagaa

SEQ ID NO: 7633953 - DNA, 22 bp, Homo sapiens
ctgccaggcagcagagggagaa

SEQ ID NO: 7633954 - DNA, 22 bp, Homo sapiens
ctgccaggcagcagagggagaa

SEQ ID NO: 7633955 - DNA, 22 bp, Homo sapiens
ctgccaggcagcagagggagaa

SEQ ID NO: 7633956 - DNA, 22 bp, Homo sapiens
ctgccaggcagcagagggagaa

SEQ ID NO: 7633957 - DNA, 22 bp, Homo sapiens
ctgccaggcagggagatggctg

SEQ ID NO: 7633958 - DNA, 22 bp, Homo sapiens
ctgccaggcagggagatggctg

SEQ ID NO: 7633959 - DNA, 22 bp, Homo sapiens
ctgccaggcagggagatggctg

SEQ ID NO: 7633960 - DNA, 22 bp, Homo sapiens
ctgccaggcagggagatggctg

SEQ ID NO: 7633961 - DNA, 22 bp, Homo sapiens
ctgccaggcagggagatggctg

SEQ ID NO: 7633962 - DNA, 22 bp, Homo sapiens
ctgccaggcctcatcccagcca

SEQ ID NO: 7633963 - DNA, 22 bp, Homo sapiens
ctgccaggcctcatcccagcca

SEQ ID NO: 7633964 - DNA, 22 bp, Homo sapiens
ctgccaggcctcatcccagcca

SEQ ID NO: 7633965 - DNA, 22 bp, Homo sapiens
ctgccaggcagggagatggctg

SEQ ID NO: 7633966 - DNA, 22 bp, Homo sapiens
ctgccaggcagggagatggctg

SEQ ID NO: 7633967 - DNA, 20 bp, Homo sapiens
ataaaataactgccacaaga

SEQ ID NO: 7633968 - DNA, 20 bp, Homo sapiens
ataaaataactgccacaaga

SEQ ID NO: 7633969 - DNA, 20 bp, Homo sapiens
ataaaataactgccacaaga

SEQ ID NO: 7633970 - DNA, 20 bp, Homo sapiens
ataaaataactgccacaaga

SEQ ID NO: 7633971 - DNA, 20 bp, Homo sapiens
ataaaataactgccacaaga

SEQ ID NO: 7633972 - DNA, 20 bp, Homo sapiens
ataaaataactgccacaaga

SEQ ID NO: 7633973 - DNA, 20 bp, Homo sapiens
ataaaataactgccacaaga

SEQ ID NO: 7633974 - DNA, 20 bp, Homo sapiens
ataaaataactgccacaaga

SEQ ID NO: 7633975 - DNA, 20 bp, Homo sapiens
ataaaataactgccacaaga

SEQ ID NO: 7633976 - DNA, 20 bp, Homo sapiens
ataaaataactgccacaaga

SEQ ID NO: 7633977 - DNA, 20 bp, Homo sapiens
ataaaataactgccacaaga

SEQ ID NO: 7633978 - DNA, 20 bp, Homo sapiens
ataaaataactgccacaaga

SEQ ID NO: 7633979 - DNA, 20 bp, Homo sapiens
ataaaataactgccacaaga

SEQ ID NO: 7633980 - DNA, 20 bp, Homo sapiens
ataaaataactgccacaaga

SEQ ID NO: 7633981 - DNA, 22 bp, Homo sapiens
ataaaagtttccaatcatgcct

SEQ ID NO: 7633982 - DNA, 22 bp, Homo sapiens
ataaaagtttccaatcatgcct

SEQ ID NO: 7633983 - DNA, 22 bp, Homo sapiens
ataaaagtttccaatcatgcct

SEQ ID NO: 7633984 - DNA, 20 bp, Homo sapiens
ataaaataactgccacaaga

SEQ ID NO: 7633985 - DNA, 22 bp, Homo sapiens
ataaaagtttccaatcatgcct

SEQ ID NO: 7633986 - DNA, 22 bp, Homo sapiens
ataaaagtttccaatcatgcct

SEQ ID NO: 7633987 - DNA, 20 bp, Homo sapiens
ataaaataactgccacaaga

SEQ ID NO: 7633988 - DNA, 20 bp, Homo sapiens
ataaaataactgccacaaga

SEQ ID NO: 7633989 - DNA, 20 bp, Homo sapiens
ataaaataactgccacaaga

SEQ ID NO: 7633990 - DNA, 20 bp, Homo sapiens
ataaaataactgccacaaga

SEQ ID NO: 7633991 - DNA, 20 bp, Homo sapiens
ataaaataactgccacaaga

SEQ ID NO: 7633992 - DNA, 20 bp, Homo sapiens
ataaaataactgccacaaga

SEQ ID NO: 7633993 - DNA, 20 bp, Homo sapiens
ataaaataactgccacaaga

SEQ ID NO: 7633994 - DNA, 20 bp, Homo sapiens
ataaaataactgccacaaga

SEQ ID NO: 7633995 - DNA, 20 bp, Homo sapiens
ataaaataactgccacaaga

SEQ ID NO: 7633996 - DNA, 20 bp, Homo sapiens
ataaaataactgccacaaga

SEQ ID NO: 7633997 - DNA, 22 bp, Homo sapiens
ataaaagttcaagagagtacag

SEQ ID NO: 7633998 - DNA, 22 bp, Homo sapiens
ataaaagttcaagagagtacag

SEQ ID NO: 7633999 - DNA, 22 bp, Homo sapiens
ataaaagttcaagagagtacag

SEQ ID NO: 7634000 - DNA, 22 bp, Homo sapiens
ataaaagtctgcttatttgggc

SEQ ID NO: 7634001 - DNA, 22 bp, Homo sapiens
ataaaagtctgcttatttgggc

SEQ ID NO: 7634002 - DNA, 22 bp, Homo sapiens
ataaaagtttccaatcatgcct

SEQ ID NO: 7634003 - DNA, 22 bp, Homo sapiens
ataaaagttcaagagagtacag

SEQ ID NO: 7634004 - DNA, 22 bp, Homo sapiens
ataaaagtttccaatcatgcct

SEQ ID NO: 7634005 - DNA, 22 bp, Homo sapiens
ataaaagtttccaatcatgcct

SEQ ID NO: 7634006 - DNA, 19 bp, Homo sapiens
ataaataaaaagtgggaga

SEQ ID NO: 7634007 - DNA, 22 bp, Homo sapiens
ataaaggccaaaatttgcattt

SEQ ID NO: 7634008 - DNA, 22 bp, Homo sapiens
ataaaggccaaaatttgcattt

SEQ ID NO: 7634009 - DNA, 17 bp, Homo sapiens
ataaaggcaagtattat

SEQ ID NO: 7634010 - DNA, 22 bp, Homo sapiens
ataaaggcaacaccagggtatg

SEQ ID NO: 7634011 - DNA, 17 bp, Homo sapiens
ataaaggcaagtattat

SEQ ID NO: 7634012 - DNA, 22 bp, Homo sapiens
ataaaggataatccattagact

SEQ ID NO: 7634013 - DNA, 22 bp, Homo sapiens
ataaatagtgtgtcataaagtc

SEQ ID NO: 7634014 - DNA, 22 bp, Homo sapiens
ataaatagtgtgtcataaagtc

SEQ ID NO: 7634015 - DNA, 22 bp, Homo sapiens
ataaatagtgctgccatgagta

SEQ ID NO: 7634016 - DNA, 22 bp, Homo sapiens
ataaatagtgtgtcataaagtc

SEQ ID NO: 7634017 - DNA, 22 bp, Homo sapiens
ataaatagtgctgccatgagta

SEQ ID NO: 7634018 - DNA, 22 bp, Homo sapiens
ataaatagtgctgccatgagta

SEQ ID NO: 7634019 - DNA, 22 bp, Homo sapiens
ataaatagtgctgccatgagta

SEQ ID NO: 7634020 - DNA, 22 bp, Homo sapiens
ataaatagtgctgccatgagta

SEQ ID NO: 7634021 - DNA, 22 bp, Homo sapiens
ataaatagtgaagggagccggt

SEQ ID NO: 7634022 - DNA, 22 bp, Homo sapiens
ataaatagtgtgtcataaagtc

SEQ ID NO: 7634023 - DNA, 22 bp, Homo sapiens
ataaatagtgtgtcataaagtc

SEQ ID NO: 7634024 - DNA, 22 bp, Homo sapiens
ataaatagtgtgtcataaagtc

SEQ ID NO: 7634025 - DNA, 22 bp, Homo sapiens
ataaatagtgtgtcataaagtc

SEQ ID NO: 7634026 - DNA, 22 bp, Homo sapiens
ataaatagtgtgtcataaagtc

SEQ ID NO: 7634027 - DNA, 22 bp, Homo sapiens
ataaatagtgtgtcataaagtc

SEQ ID NO: 7634028 - DNA, 22 bp, Homo sapiens
ataaatagtgtgtcataaagtc

SEQ ID NO: 7634029 - DNA, 22 bp, Homo sapiens
ataaatagtgtgtcataaagtc

SEQ ID NO: 7634030 - DNA, 22 bp, Homo sapiens
ataaatagtgtgtcataaagtc

SEQ ID NO: 7634031 - DNA, 22 bp, Homo sapiens
ataaatatcactgttgtccctc

SEQ ID NO: 7634032 - DNA, 22 bp, Homo sapiens
ataaatatcactgttgtccctc

SEQ ID NO: 7634033 - DNA, 22 bp, Homo sapiens
ataaatatcactgttgtccctc

SEQ ID NO: 7634034 - DNA, 22 bp, Homo sapiens
ataaatatcactgttgtccctc

SEQ ID NO: 7634035 - DNA, 22 bp, Homo sapiens
ataaatatcactgttgtccctc

SEQ ID NO: 7634036 - DNA, 22 bp, Homo sapiens
ataaatatcactgttgtccctc

SEQ ID NO: 7634037 - DNA, 18 bp, Homo sapiens
ctgcccagagcacttgtg

SEQ ID NO: 7634038 - DNA, 18 bp, Homo sapiens
ctgcccagagcacttgtg

SEQ ID NO: 7634039 - DNA, 18 bp, Homo sapiens
ctgcccagagcacttgtg

SEQ ID NO: 7634040 - DNA, 18 bp, Homo sapiens
ctgcccagagcacttgtg

SEQ ID NO: 7634041 - DNA, 22 bp, Homo sapiens
ctgcccagaatcactcactcga

SEQ ID NO: 7634042 - DNA, 22 bp, Homo sapiens
ctgcccagaatcactcactcga

SEQ ID NO: 7634043 - DNA, 22 bp, Homo sapiens
ctgcccagaatcactcactcga

SEQ ID NO: 7634044 - DNA, 22 bp, Homo sapiens
ctgctccaagccagccctgcag

SEQ ID NO: 7634045 - DNA, 22 bp, Homo sapiens
ctgctccaagccagccctgcag

SEQ ID NO: 7634046 - DNA, 22 bp, Homo sapiens
ctgctccaagccagccctgcag

SEQ ID NO: 7634047 - DNA, 22 bp, Homo sapiens
ctgctccaagccagccctgcag

SEQ ID NO: 7634048 - DNA, 22 bp, Homo sapiens
ctgctcagtcatgttggattgt

SEQ ID NO: 7634049 - DNA, 22 bp, Homo sapiens
ctgctcagtaatagtcctatct

SEQ ID NO: 7634050 - DNA, 22 bp, Homo sapiens
ctgctcagtaatagtcctatct

SEQ ID NO: 7634051 - DNA, 22 bp, Homo sapiens
ctgcccagaagcttagagctta

SEQ ID NO: 7634052 - DNA, 22 bp, Homo sapiens
ctgcccagaagcttagagctta

SEQ ID NO: 7634053 - DNA, 22 bp, Homo sapiens
ctgcccagaagcttagagctta

SEQ ID NO: 7634054 - DNA, 22 bp, Homo sapiens
ctgcccagaagcttagagctta

SEQ ID NO: 7634055 - DNA, 22 bp, Homo sapiens
ctgcccagaagcttagagctta

SEQ ID NO: 7634056 - DNA, 22 bp, Homo sapiens
ctgcccagaagcttagagctta

SEQ ID NO: 7634057 - DNA, 22 bp, Homo sapiens
ctgcccagaagccagatgggca

SEQ ID NO: 7634058 - DNA, 22 bp, Homo sapiens
ctgcccagaagccagatgggca

SEQ ID NO: 7634059 - DNA, 22 bp, Homo sapiens
ctgcccagaatcactcactcga

SEQ ID NO: 7634060 - DNA, 22 bp, Homo sapiens
ctgcccagaagcttagagctta

SEQ ID NO: 7634061 - DNA, 22 bp, Homo sapiens
ctgcccagaatcactcactcga

SEQ ID NO: 7634062 - DNA, 22 bp, Homo sapiens
ctgcccagaatcactcactcga

SEQ ID NO: 7634063 - DNA, 22 bp, Homo sapiens
ctgcccagaatcactcactcga

SEQ ID NO: 7634064 - DNA, 22 bp, Homo sapiens
ctgcccagaagcttagagctta

SEQ ID NO: 7634065 - DNA, 22 bp, Homo sapiens
ctgcccacttggccaccttcta

SEQ ID NO: 7634066 - DNA, 22 bp, Homo sapiens
ctgcccacttggccaccttcta

SEQ ID NO: 7634067 - DNA, 22 bp, Homo sapiens
ctgcccacttggccaccttcta

SEQ ID NO: 7634068 - DNA, 22 bp, Homo sapiens
ctgcccacttggccaccttcta

SEQ ID NO: 7634069 - DNA, 22 bp, Homo sapiens
ctgcccagaagccagatgggca

SEQ ID NO: 7634070 - DNA, 22 bp, Homo sapiens
ctgcccagaagccagatgggca

SEQ ID NO: 7634071 - DNA, 22 bp, Homo sapiens
ctgcccagaagccagatgggca

SEQ ID NO: 7634072 - DNA, 22 bp, Homo sapiens
ctgcccagaagccagatgggca

SEQ ID NO: 7634073 - DNA, 22 bp, Homo sapiens
ctgcccagaagccagatgggca

SEQ ID NO: 7634074 - DNA, 22 bp, Homo sapiens
ctgcccagaagccagatgggca

SEQ ID NO: 7634075 - DNA, 22 bp, Homo sapiens
ctgcccacagttctctgccatg

SEQ ID NO: 7634076 - DNA, 22 bp, Homo sapiens
ataaatctattggacatgtgtg

SEQ ID NO: 7634077 - DNA, 22 bp, Homo sapiens
ataaatctattggacatgtgtg

SEQ ID NO: 7634078 - DNA, 22 bp, Homo sapiens
ataaatctattggacatgtgtg

SEQ ID NO: 7634079 - DNA, 22 bp, Homo sapiens
ctgcccaccacacctgctcctg

SEQ ID NO: 7634080 - DNA, 22 bp, Homo sapiens
ctgcccacagttctctgccatg

SEQ ID NO: 7634081 - DNA, 22 bp, Homo sapiens
ctgcccacagttctctgccatg

SEQ ID NO: 7634082 - DNA, 22 bp, Homo sapiens
ataaatctattggacatgtgtg

SEQ ID NO: 7634083 - DNA, 22 bp, Homo sapiens
ataaatctattggacatgtgtg

SEQ ID NO: 7634084 - DNA, 22 bp, Homo sapiens
ataaatcagttagtgccccact

SEQ ID NO: 7634085 - DNA, 22 bp, Homo sapiens
ataaatccaaggcggccatcat

SEQ ID NO: 7634086 - DNA, 22 bp, Homo sapiens
ataaatatcactgttgtccctc

SEQ ID NO: 7634087 - DNA, 22 bp, Homo sapiens
ataaatatcactgttgtccctc

SEQ ID NO: 7634088 - DNA, 22 bp, Homo sapiens
ataaatatcactgttgtccctc

SEQ ID NO: 7634089 - DNA, 22 bp, Homo sapiens
ataaatatcactgttgtccctc

SEQ ID NO: 7634090 - DNA, 22 bp, Homo sapiens
ataaatatcactgttgtccctc

SEQ ID NO: 7634091 - DNA, 22 bp, Homo sapiens
ataaatatcactgttgtccctc

SEQ ID NO: 7634092 - DNA, 22 bp, Homo sapiens
ataaatatcactgttgtccctc

SEQ ID NO: 7634093 - DNA, 22 bp, Homo sapiens
ctgcccaccgtgtgcacgtgcg

SEQ ID NO: 7634094 - DNA, 22 bp, Homo sapiens
ctgcccaccgtgtgcacgtgcg

SEQ ID NO: 7634095 - DNA, 22 bp, Homo sapiens
ctgcccaccgtgtgcacgtgcg

SEQ ID NO: 7634096 - DNA, 22 bp, Homo sapiens
ctgcccaccccgaggcaggaag

SEQ ID NO: 7634097 - DNA, 22 bp, Homo sapiens
ctgcccaccacacctgctcctg

SEQ ID NO: 7634098 - DNA, 22 bp, Homo sapiens
ctgcccaccacacctgctcctg

SEQ ID NO: 7634099 - DNA, 22 bp, Homo sapiens
ctgcccaccacacctgctcctg

SEQ ID NO: 7634100 - DNA, 22 bp, Homo sapiens
ctgcccaccacacctgctcctg

SEQ ID NO: 7634101 - DNA, 22 bp, Homo sapiens
ctgcccaccgtgtgcacgtgcg

SEQ ID NO: 7634102 - DNA, 20 bp, Homo sapiens
ctgcccactagaactacctg

SEQ ID NO: 7634103 - DNA, 20 bp, Homo sapiens
ctgcccactagaactacctg

SEQ ID NO: 7634104 - DNA, 22 bp, Homo sapiens
ctgcccaccgtgtgcacgtgcg

SEQ ID NO: 7634105 - DNA, 22 bp, Homo sapiens
ctgcccactatgttgtcatggg

SEQ ID NO: 7634106 - DNA, 20 bp, Homo sapiens
ctgcccactagaactacctg

SEQ ID NO: 7634107 - DNA, 22 bp, Homo sapiens
ctgcccactatgttgtcatggg

SEQ ID NO: 7634108 - DNA, 22 bp, Homo sapiens
ctgcccactatgttgtcatggg

SEQ ID NO: 7634109 - DNA, 22 bp, Homo sapiens
ataatacatggttaacctcttt

SEQ ID NO: 7634110 - DNA, 22 bp, Homo sapiens
ataatacatggttaacctcttt

SEQ ID NO: 7634111 - DNA, 22 bp, Homo sapiens
ataatacatggttaacctcttt

SEQ ID NO: 7634112 - DNA, 22 bp, Homo sapiens
ataatacatggttaacctcttt

SEQ ID NO: 7634113 - DNA, 22 bp, Homo sapiens
ataatacatggttaacctcttt

SEQ ID NO: 7634114 - DNA, 22 bp, Homo sapiens
ctgctctgtatatgagcaggaa

SEQ ID NO: 7634115 - DNA, 22 bp, Homo sapiens
ctgctctggtctcttcatgttt

SEQ ID NO: 7634116 - DNA, 22 bp, Homo sapiens
ctgctctgtatatgagcaggaa

SEQ ID NO: 7634117 - DNA, 22 bp, Homo sapiens
ctgctctgtatatgagcaggaa

SEQ ID NO: 7634118 - DNA, 22 bp, Homo sapiens
ctgctctgtatatgagcaggaa

SEQ ID NO: 7634119 - DNA, 22 bp, Homo sapiens
ataatacatggttgatcttttc

SEQ ID NO: 7634120 - DNA, 22 bp, Homo sapiens
ataatacatggttgatcttttc

SEQ ID NO: 7634121 - DNA, 22 bp, Homo sapiens
ataatacatggttgatcttttc

SEQ ID NO: 7634122 - DNA, 22 bp, Homo sapiens
ataatacatggttgatcttttc

SEQ ID NO: 7634123 - DNA, 22 bp, Homo sapiens
ataatacatggttgatcttttc

SEQ ID NO: 7634124 - DNA, 22 bp, Homo sapiens
ataatacatggttgatcttttc

SEQ ID NO: 7634125 - DNA, 22 bp, Homo sapiens
ataatacatggttgatcttttc

SEQ ID NO: 7634126 - DNA, 22 bp, Homo sapiens
ataatacatggttgatcttttc

SEQ ID NO: 7634127 - DNA, 21 bp, Homo sapiens
ctgctctggggaccggctgtg

SEQ ID NO: 7634128 - DNA, 21 bp, Homo sapiens
ctgctctggggaccggctgtg

SEQ ID NO: 7634129 - DNA, 22 bp, Homo sapiens
ctgctctggtctcttcatgttt

SEQ ID NO: 7634130 - DNA, 21 bp, Homo sapiens
ctgctctggggaccggctgtg

SEQ ID NO: 7634131 - DNA, 21 bp, Homo sapiens
ctgctctggggaccggctgtg

SEQ ID NO: 7634132 - DNA, 22 bp, Homo sapiens
ctgctctggggaagccagatgt

SEQ ID NO: 7634133 - DNA, 22 bp, Homo sapiens
ctgctctggggaagccagatgt

SEQ ID NO: 7634134 - DNA, 22 bp, Homo sapiens
ctgctctggcgtactcggcatc

SEQ ID NO: 7634135 - DNA, 22 bp, Homo sapiens
ctgctctggctgtgtacttcag

SEQ ID NO: 7634136 - DNA, 22 bp, Homo sapiens
ctgctctggggaagccagatgt

SEQ ID NO: 7634137 - DNA, 22 bp, Homo sapiens
ctgctctggggaagccagatgt

SEQ ID NO: 7634138 - DNA, 22 bp, Homo sapiens
ctgctctggctgtgtacttcag

SEQ ID NO: 7634139 - DNA, 22 bp, Homo sapiens
ctgctctggctgtgtacttcag

SEQ ID NO: 7634140 - DNA, 22 bp, Homo sapiens
ctgctctggcgtactcggcatc

SEQ ID NO: 7634141 - DNA, 22 bp, Homo sapiens
ctgctctgctgatcagtgtctc

SEQ ID NO: 7634142 - DNA, 22 bp, Homo sapiens
ctgctctgcagcttggactccc

SEQ ID NO: 7634143 - DNA, 22 bp, Homo sapiens
ctgctctgctgatcagtgtctc

SEQ ID NO: 7634144 - DNA, 22 bp, Homo sapiens
ctgctctgcagcttggactccc

SEQ ID NO: 7634145 - DNA, 22 bp, Homo sapiens
ctgctctgcagcttggactccc

SEQ ID NO: 7634146 - DNA, 22 bp, Homo sapiens
ctgctctgcagcttggactccc

SEQ ID NO: 7634147 - DNA, 22 bp, Homo sapiens
ctgctctgagtattaacggagg

SEQ ID NO: 7634148 - DNA, 22 bp, Homo sapiens
ctgctctgagtattaacggagg

SEQ ID NO: 7634149 - DNA, 22 bp, Homo sapiens
ctgctctgagtattaacggagg

SEQ ID NO: 7634150 - DNA, 22 bp, Homo sapiens
ctgctctgcaaggcacagtgat

SEQ ID NO: 7634151 - DNA, 22 bp, Homo sapiens
ctgctctgcaaggcacagtgat

SEQ ID NO: 7634152 - DNA, 22 bp, Homo sapiens
ctgctctgcaaggcacagtgat

SEQ ID NO: 7634153 - DNA, 22 bp, Homo sapiens
ctgctctgcaaggcacagtgat

SEQ ID NO: 7634154 - DNA, 22 bp, Homo sapiens
ctgctctgcaaggcacagtgat

SEQ ID NO: 7634155 - DNA, 22 bp, Homo sapiens
ctgctctgcaaggcacagtgat

SEQ ID NO: 7634156 - DNA, 22 bp, Homo sapiens
ctgctctgctgatcagtgtctc

SEQ ID NO: 7634157 - DNA, 22 bp, Homo sapiens
ctgctctgctgatcagtgtctc

SEQ ID NO: 7634158 - DNA, 22 bp, Homo sapiens
ctgctctgctgatcagtgtctc

SEQ ID NO: 7634159 - DNA, 22 bp, Homo sapiens
ctgctctgctgatcagtgtctc

SEQ ID NO: 7634160 - DNA, 22 bp, Homo sapiens
ctgctctgctgatcagtgtctc

SEQ ID NO: 7634161 - DNA, 20 bp, Homo sapiens
ctgctctgctttgcaggtgg

SEQ ID NO: 7634162 - DNA, 20 bp, Homo sapiens
ctgctctgctttgcaggtgg

SEQ ID NO: 7634163 - DNA, 20 bp, Homo sapiens
ctgctctgctttgcaggtgg

SEQ ID NO: 7634164 - DNA, 20 bp, Homo sapiens
ctgctctgctttgcaggtgg

SEQ ID NO: 7634165 - DNA, 22 bp, Homo sapiens
ctgctctggcgtactcggcatc

SEQ ID NO: 7634166 - DNA, 22 bp, Homo sapiens
ctgctctggcgtactcggcatc

SEQ ID NO: 7634167 - DNA, 20 bp, Homo sapiens
ctgctctgctttgcaggtgg

SEQ ID NO: 7634168 - DNA, 22 bp, Homo sapiens
ctgctctggcgtactcggcatc

SEQ ID NO: 7634169 - DNA, 22 bp, Homo sapiens
ctgctttaatttagacaaggca

SEQ ID NO: 7634170 - DNA, 22 bp, Homo sapiens
ctgctttaatttagacaaggca

SEQ ID NO: 7634171 - DNA, 22 bp, Homo sapiens
ctgctttaatttagacaaggca

SEQ ID NO: 7634172 - DNA, 22 bp, Homo sapiens
ctgctttaatgtaagatatacc

SEQ ID NO: 7634173 - DNA, 22 bp, Homo sapiens
ctgctttaatgtaagatatacc

SEQ ID NO: 7634174 - DNA, 22 bp, Homo sapiens
ctgctttaatgtaagatatacc

SEQ ID NO: 7634175 - DNA, 22 bp, Homo sapiens
ctgctttaatgtaagatatacc

SEQ ID NO: 7634176 - DNA, 22 bp, Homo sapiens
ctgctttaatccctgcctggaa

SEQ ID NO: 7634177 - DNA, 22 bp, Homo sapiens
ctgctttaatccctgcctggaa

SEQ ID NO: 7634178 - DNA, 22 bp, Homo sapiens
ctgctttaatccctgcctggaa

SEQ ID NO: 7634179 - DNA, 22 bp, Homo sapiens
ctgctttaatggaaagtgtttt

SEQ ID NO: 7634180 - DNA, 22 bp, Homo sapiens
ctgctttaatggaaagtgtttt

SEQ ID NO: 7634181 - DNA, 22 bp, Homo sapiens
ctgctttaatgtaagatatacc

SEQ ID NO: 7634182 - DNA, 22 bp, Homo sapiens
ctgctttaatgtaagatatacc

SEQ ID NO: 7634183 - DNA, 22 bp, Homo sapiens
ctgctttaatggaaagtgtttt

SEQ ID NO: 7634184 - DNA, 22 bp, Homo sapiens
ctgctttaatggaaagtgtttt

SEQ ID NO: 7634185 - DNA, 19 bp, Homo sapiens
atacaagactagcatttac

SEQ ID NO: 7634186 - DNA, 19 bp, Homo sapiens
atacaagactagcatttac

SEQ ID NO: 7634187 - DNA, 19 bp, Homo sapiens
atacaagactagcatttac

SEQ ID NO: 7634188 - DNA, 19 bp, Homo sapiens
atacaagactagcatttac

SEQ ID NO: 7634189 - DNA, 22 bp, Homo sapiens
atacaagacagtaggaaactga

SEQ ID NO: 7634190 - DNA, 22 bp, Homo sapiens
ctgctttaccaaactcttggat

SEQ ID NO: 7634191 - DNA, 22 bp, Homo sapiens
ctgctttaatttagacaaggca

SEQ ID NO: 7634192 - DNA, 22 bp, Homo sapiens
ctgctttaatttagacaaggca

SEQ ID NO: 7634193 - DNA, 22 bp, Homo sapiens
ctgctttaccaaactcttggat

SEQ ID NO: 7634194 - DNA, 22 bp, Homo sapiens
atacaagacagtaggaaactga

SEQ ID NO: 7634195 - DNA, 22 bp, Homo sapiens
atacaactttatctgtaatgag

SEQ ID NO: 7634196 - DNA, 22 bp, Homo sapiens
ctgctttaactctgggaagcca

SEQ ID NO: 7634197 - DNA, 22 bp, Homo sapiens
ctgctttaactctgggaagcca

SEQ ID NO: 7634198 - DNA, 22 bp, Homo sapiens
ctgctttaactctgggaagcca

SEQ ID NO: 7634199 - DNA, 22 bp, Homo sapiens
ctgctttaactctgggaagcca

SEQ ID NO: 7634200 - DNA, 22 bp, Homo sapiens
ctgctttaagaatgagtgtaag

SEQ ID NO: 7634201 - DNA, 22 bp, Homo sapiens
ctgctttaagaatgagtgtaag

SEQ ID NO: 7634202 - DNA, 22 bp, Homo sapiens
ctgctttaagaatgagtgtaag

SEQ ID NO: 7634203 - DNA, 22 bp, Homo sapiens
ctgctttaagtattcaacaaag

SEQ ID NO: 7634204 - DNA, 22 bp, Homo sapiens
ctgctttaagtattcaacaaag

SEQ ID NO: 7634205 - DNA, 22 bp, Homo sapiens
ctgctttaagtattcaacaaag

SEQ ID NO: 7634206 - DNA, 22 bp, Homo sapiens
ctgctttaagtattcaacaaag

SEQ ID NO: 7634207 - DNA, 22 bp, Homo sapiens
ctgctttaagtattcaacaaag

SEQ ID NO: 7634208 - DNA, 22 bp, Homo sapiens
ctgctttaaaaccctcagctgg

SEQ ID NO: 7634209 - DNA, 22 bp, Homo sapiens
ctgctttaaaaccctcagctgg

SEQ ID NO: 7634210 - DNA, 22 bp, Homo sapiens
ctgctttaaaactgatacatga

SEQ ID NO: 7634211 - DNA, 22 bp, Homo sapiens
ctgctttaaaactgatacatga

SEQ ID NO: 7634212 - DNA, 22 bp, Homo sapiens
ctgctttaaaactgatacatga

SEQ ID NO: 7634213 - DNA, 22 bp, Homo sapiens
ctgctttaaaactgatacatga

SEQ ID NO: 7634214 - DNA, 22 bp, Homo sapiens
ctgctttaaaactgatacatga

SEQ ID NO: 7634215 - DNA, 22 bp, Homo sapiens
ctgctttaaaactgatacatga

SEQ ID NO: 7634216 - DNA, 22 bp, Homo sapiens
ctgctttaacagatgatggtgt

SEQ ID NO: 7634217 - DNA, 22 bp, Homo sapiens
ctgctttaacaaggctgatcag

SEQ ID NO: 7634218 - DNA, 22 bp, Homo sapiens
ctgctttaacagatgatggtgt

SEQ ID NO: 7634219 - DNA, 22 bp, Homo sapiens
ctgctttaacagatgatggtgt

SEQ ID NO: 7634220 - DNA, 22 bp, Homo sapiens
ctgctttaacagatgatggtgt

SEQ ID NO: 7634221 - DNA, 22 bp, Homo sapiens
ctgctttaacaaggctgatcag

SEQ ID NO: 7634222 - DNA, 22 bp, Homo sapiens
atacaagtgagaaaactgaaga

SEQ ID NO: 7634223 - DNA, 22 bp, Homo sapiens
atacaagtgagaaaactgaaga

SEQ ID NO: 7634224 - DNA, 22 bp, Homo sapiens
atacaagtgagaaaactgaaga

SEQ ID NO: 7634225 - DNA, 22 bp, Homo sapiens
atacaagtcaatccatgtgatt

SEQ ID NO: 7634226 - DNA, 22 bp, Homo sapiens
atacaagtcaatccatgtgatt

SEQ ID NO: 7634227 - DNA, 22 bp, Homo sapiens
atacaagtgatataattgtttc

SEQ ID NO: 7634228 - DNA, 22 bp, Homo sapiens
atacaagtgatataattgtttc

SEQ ID NO: 7634229 - DNA, 22 bp, Homo sapiens
atacaagtgctgaccctgggat

SEQ ID NO: 7634230 - DNA, 22 bp, Homo sapiens
atacaagtgatataattgtttc

SEQ ID NO: 7634231 - DNA, 22 bp, Homo sapiens
atacaagtgatataattgtttc

SEQ ID NO: 7634232 - DNA, 22 bp, Homo sapiens
atacaagtgatataattgtttc

SEQ ID NO: 7634233 - DNA, 18 bp, Homo sapiens
atacaagcagcagagatt

SEQ ID NO: 7634234 - DNA, 18 bp, Homo sapiens
atacaagctctgttactt

SEQ ID NO: 7634235 - DNA, 22 bp, Homo sapiens
atacaaggtcatgaaggtttac

SEQ ID NO: 7634236 - DNA, 22 bp, Homo sapiens
atacaaggtcatgaaggtttac

SEQ ID NO: 7634237 - DNA, 22 bp, Homo sapiens
atacaaggtggagtcaggaaaa

SEQ ID NO: 7634238 - DNA, 22 bp, Homo sapiens
atacaagatcactccagaaaat

SEQ ID NO: 7634239 - DNA, 20 bp, Homo sapiens
atacaagatgagtaatttct

SEQ ID NO: 7634240 - DNA, 20 bp, Homo sapiens
atacaagatgagtaatttct

SEQ ID NO: 7634241 - DNA, 20 bp, Homo sapiens
atacaagatgagtaatttct

SEQ ID NO: 7634242 - DNA, 19 bp, Homo sapiens
atacaagactagcatttac

SEQ ID NO: 7634243 - DNA, 19 bp, Homo sapiens
atacaagactagcatttac

SEQ ID NO: 7634244 - DNA, 19 bp, Homo sapiens
atacaagactagcatttac

SEQ ID NO: 7634245 - DNA, 22 bp, Homo sapiens
atacaagactcagcacagacgg

SEQ ID NO: 7634246 - DNA, 22 bp, Homo sapiens
atacaagactcagcacagacgg

SEQ ID NO: 7634247 - DNA, 22 bp, Homo sapiens
atacaagactcagcacagacgg

SEQ ID NO: 7634248 - DNA, 22 bp, Homo sapiens
atacaagactcagcacagacgg

SEQ ID NO: 7634249 - DNA, 22 bp, Homo sapiens
atacaagactcagcacagacgg

SEQ ID NO: 7634250 - DNA, 22 bp, Homo sapiens
atacaagactcagcacagacgg

SEQ ID NO: 7634251 - DNA, 22 bp, Homo sapiens
atacaagactcagcacagacgg

SEQ ID NO: 7634252 - DNA, 22 bp, Homo sapiens
atacaagatcactccagaaaat

SEQ ID NO: 7634253 - DNA, 22 bp, Homo sapiens
atacaagatcactccagaaaat

SEQ ID NO: 7634254 - DNA, 22 bp, Homo sapiens
atacaagatcactccagaaaat

SEQ ID NO: 7634255 - DNA, 22 bp, Homo sapiens
atacaagatcactccagaaaat

SEQ ID NO: 7634256 - DNA, 18 bp, Homo sapiens
atacaagatcaagtgttc

SEQ ID NO: 7634257 - DNA, 19 bp, Homo sapiens
atacaagagagcagttgag

SEQ ID NO: 7634258 - DNA, 19 bp, Homo sapiens
atacaagagagcagttgag

SEQ ID NO: 7634259 - DNA, 19 bp, Homo sapiens
atacaagagagcagttgag

SEQ ID NO: 7634260 - DNA, 19 bp, Homo sapiens
atacaagagagcagttgag

SEQ ID NO: 7634261 - DNA, 18 bp, Homo sapiens
atacaagatcaagtgttc

SEQ ID NO: 7634262 - DNA, 18 bp, Homo sapiens
atacaagatcaagtgttc

SEQ ID NO: 7634263 - DNA, 18 bp, Homo sapiens
atacaagatcaagtgttc

SEQ ID NO: 7634264 - DNA, 18 bp, Homo sapiens
atacaagatcaagtgttc

SEQ ID NO: 7634265 - DNA, 22 bp, Homo sapiens
ataatatttgcattactgtgat

SEQ ID NO: 7634266 - DNA, 22 bp, Homo sapiens
ataatatttgcattactgtgat

SEQ ID NO: 7634267 - DNA, 22 bp, Homo sapiens
ataatatttgcattactgtgat

SEQ ID NO: 7634268 - DNA, 22 bp, Homo sapiens
ataatatttgcattactgtgat

SEQ ID NO: 7634269 - DNA, 22 bp, Homo sapiens
ataatatttgcattactgtgat

SEQ ID NO: 7634270 - DNA, 22 bp, Homo sapiens
ataatatttgcattactgtgat

SEQ ID NO: 7634271 - DNA, 22 bp, Homo sapiens
ataatatttgcattactgtgat

SEQ ID NO: 7634272 - DNA, 22 bp, Homo sapiens
ataatatttgcattactgtgat

SEQ ID NO: 7634273 - DNA, 22 bp, Homo sapiens
ataatattgagtcaggacctga

SEQ ID NO: 7634274 - DNA, 22 bp, Homo sapiens
ataatataatcctacttcccat

SEQ ID NO: 7634275 - DNA, 22 bp, Homo sapiens
ataatatcgctcctttttttga

SEQ ID NO: 7634276 - DNA, 22 bp, Homo sapiens
ataatatttggataggacagta

SEQ ID NO: 7634277 - DNA, 22 bp, Homo sapiens
ataatatttgcattactgtgat

SEQ ID NO: 7634278 - DNA, 22 bp, Homo sapiens
ataatatttggataggacagta

SEQ ID NO: 7634279 - DNA, 22 bp, Homo sapiens
ataatatttgcattactgtgat

SEQ ID NO: 7634280 - DNA, 22 bp, Homo sapiens
ataatcaaagtcctatgacatc

SEQ ID NO: 7634281 - DNA, 22 bp, Homo sapiens
ataatatttggataggacagta

SEQ ID NO: 7634282 - DNA, 22 bp, Homo sapiens
ataatatttggataggacagta

SEQ ID NO: 7634283 - DNA, 22 bp, Homo sapiens
ataatcaaagtcctatgacatc

SEQ ID NO: 7634284 - DNA, 22 bp, Homo sapiens
ataatcagaattcatgaaagat

SEQ ID NO: 7634285 - DNA, 18 bp, Homo sapiens
ctgctgtgtcgtctgggc

SEQ ID NO: 7634286 - DNA, 22 bp, Homo sapiens
ctgctgtgtgaccatggacagg

SEQ ID NO: 7634287 - DNA, 22 bp, Homo sapiens
ataatcaaagtcctatgacatc

SEQ ID NO: 7634288 - DNA, 22 bp, Homo sapiens
ataatcaaagtcctatgacatc

SEQ ID NO: 7634289 - DNA, 22 bp, Homo sapiens
ataatcaaagtcctatgacatc

SEQ ID NO: 7634290 - DNA, 22 bp, Homo sapiens
ataatcaaagtcctatgacatc

SEQ ID NO: 7634291 - DNA, 22 bp, Homo sapiens
ataatcagaattcatgaaagat

SEQ ID NO: 7634292 - DNA, 22 bp, Homo sapiens
ctgcttggcttataacctcagg

SEQ ID NO: 7634293 - DNA, 22 bp, Homo sapiens
ctgcttggcttataacctcagg

SEQ ID NO: 7634294 - DNA, 17 bp, Homo sapiens
ctgcttggcctctgggg

SEQ ID NO: 7634295 - DNA, 17 bp, Homo sapiens
ctgcttggcctctgggg

SEQ ID NO: 7634296 - DNA, 22 bp, Homo sapiens
ctgcttggagtcctccagcacc

SEQ ID NO: 7634297 - DNA, 22 bp, Homo sapiens
ctgcttggagtcctccagcacc

SEQ ID NO: 7634298 - DNA, 22 bp, Homo sapiens
ctgcttgcaaagtgttggtgat

SEQ ID NO: 7634299 - DNA, 22 bp, Homo sapiens
ctgcttggaggcctgggtgcta

SEQ ID NO: 7634300 - DNA, 22 bp, Homo sapiens
ctgcttgcctggacagcgttag

SEQ ID NO: 7634301 - DNA, 20 bp, Homo sapiens
ctgcttgggacactgccaga

SEQ ID NO: 7634302 - DNA, 18 bp, Homo sapiens
ctgcttgggagacgtcag

SEQ ID NO: 7634303 - DNA, 20 bp, Homo sapiens
ctgcttgggcccctctggcc

SEQ ID NO: 7634304 - DNA, 22 bp, Homo sapiens
ctgcttgggtcctggcatgggt

SEQ ID NO: 7634305 - DNA, 22 bp, Homo sapiens
ctgcttgggtcctggcatgggt

SEQ ID NO: 7634306 - DNA, 22 bp, Homo sapiens
ctgcttgggtcctggcatgggt

SEQ ID NO: 7634307 - DNA, 20 bp, Homo sapiens
ctgcttgggcccctctggcc

SEQ ID NO: 7634308 - DNA, 22 bp, Homo sapiens
ctgcttggggttagggtgtcct

SEQ ID NO: 7634309 - DNA, 22 bp, Homo sapiens
ctgcttgggtcctggcatgggt

SEQ ID NO: 7634310 - DNA, 22 bp, Homo sapiens
ctgcttctagcaccaagtccct

SEQ ID NO: 7634311 - DNA, 22 bp, Homo sapiens
ctgcttctagcaccaagtccct

SEQ ID NO: 7634312 - DNA, 22 bp, Homo sapiens
ctgcttctccaaagtaggactt

SEQ ID NO: 7634313 - DNA, 22 bp, Homo sapiens
ctgcttctccaaagtaggactt

SEQ ID NO: 7634314 - DNA, 22 bp, Homo sapiens
ctgctgtgtgcttacttgggtt

SEQ ID NO: 7634315 - DNA, 22 bp, Homo sapiens
ctgctgtgtgcttacttgggtt

SEQ ID NO: 7634316 - DNA, 22 bp, Homo sapiens
ctgctgtgtgaccatggacagg

SEQ ID NO: 7634317 - DNA, 22 bp, Homo sapiens
ctgcttctagcaccaagtccct

SEQ ID NO: 7634318 - DNA, 18 bp, Homo sapiens
ctgcttctgtctgccagt

SEQ ID NO: 7634319 - DNA, 22 bp, Homo sapiens
ctgcttctccctgagatagtgt

SEQ ID NO: 7634320 - DNA, 22 bp, Homo sapiens
atacagaattcactacagtttc

SEQ ID NO: 7634321 - DNA, 22 bp, Homo sapiens
atacagaattcactacagtttc

SEQ ID NO: 7634322 - DNA, 22 bp, Homo sapiens
atacagaatttgcccttttcat

SEQ ID NO: 7634323 - DNA, 22 bp, Homo sapiens
atacagaatttgcccttttcat

SEQ ID NO: 7634324 - DNA, 22 bp, Homo sapiens
atacagaatttgcccttttcat

SEQ ID NO: 7634325 - DNA, 22 bp, Homo sapiens
atacagaatttgcccttttcat

SEQ ID NO: 7634326 - DNA, 22 bp, Homo sapiens
atacagaattcactacagtttc

SEQ ID NO: 7634327 - DNA, 22 bp, Homo sapiens
atacagaattcactacagtttc

SEQ ID NO: 7634328 - DNA, 22 bp, Homo sapiens
atacagaattcactacagtttc

SEQ ID NO: 7634329 - DNA, 22 bp, Homo sapiens
atacagaattcactacagtttc

SEQ ID NO: 7634330 - DNA, 22 bp, Homo sapiens
atacagaattcactacagtttc

SEQ ID NO: 7634331 - DNA, 22 bp, Homo sapiens
atacagaattcactacagtttc

SEQ ID NO: 7634332 - DNA, 22 bp, Homo sapiens
atacagagaaggggtagaggat

SEQ ID NO: 7634333 - DNA, 22 bp, Homo sapiens
atacagagaaggggtagaggat

SEQ ID NO: 7634334 - DNA, 22 bp, Homo sapiens
atacagaatttgcccttttcat

SEQ ID NO: 7634335 - DNA, 22 bp, Homo sapiens
atacagagaagggaggcaaaat

SEQ ID NO: 7634336 - DNA, 22 bp, Homo sapiens
atacagagaagggaggcaaaat

SEQ ID NO: 7634337 - DNA, 22 bp, Homo sapiens
atacagagcagtaatagaggag

SEQ ID NO: 7634338 - DNA, 22 bp, Homo sapiens
atacagagcagtaatagaggag

SEQ ID NO: 7634339 - DNA, 22 bp, Homo sapiens
atacagagacacttgagactgg

SEQ ID NO: 7634340 - DNA, 22 bp, Homo sapiens
atacagagacacttgagactgg

SEQ ID NO: 7634341 - DNA, 22 bp, Homo sapiens
atacagagacacttgagactgg

SEQ ID NO: 7634342 - DNA, 18 bp, Homo sapiens
atacagagacctcaagga

SEQ ID NO: 7634343 - DNA, 18 bp, Homo sapiens
atacagagacctcaagga

SEQ ID NO: 7634344 - DNA, 22 bp, Homo sapiens
atacagatcccacagcatgtga

SEQ ID NO: 7634345 - DNA, 22 bp, Homo sapiens
atacagatcccacagcatgtga

SEQ ID NO: 7634346 - DNA, 22 bp, Homo sapiens
atacagatcccacagcatgtga

SEQ ID NO: 7634347 - DNA, 22 bp, Homo sapiens
atacagatcccacagcatgtga

SEQ ID NO: 7634348 - DNA, 19 bp, Homo sapiens
atacagagcttcctaattt

SEQ ID NO: 7634349 - DNA, 22 bp, Homo sapiens
atacagataatgattgtatgtg

SEQ ID NO: 7634350 - DNA, 22 bp, Homo sapiens
atacagatgagatcaggcataa

SEQ ID NO: 7634351 - DNA, 22 bp, Homo sapiens
atacagatcccacagcatgtga

SEQ ID NO: 7634352 - DNA, 22 bp, Homo sapiens
atacagatgaaatactaagcta

SEQ ID NO: 7634353 - DNA, 22 bp, Homo sapiens
atacagatgagatcaggcataa

SEQ ID NO: 7634354 - DNA, 22 bp, Homo sapiens
atacagatgctcatatgcccca

SEQ ID NO: 7634355 - DNA, 22 bp, Homo sapiens
atacagatgagatcaggcataa

SEQ ID NO: 7634356 - DNA, 22 bp, Homo sapiens
atacagatgcttgctcgtgact

SEQ ID NO: 7634357 - DNA, 22 bp, Homo sapiens
atacagatgcttgctcgtgact

SEQ ID NO: 7634358 - DNA, 22 bp, Homo sapiens
ctggagggagttaggacccgga

SEQ ID NO: 7634359 - DNA, 22 bp, Homo sapiens
ctggagggagttaggacccgga

SEQ ID NO: 7634360 - DNA, 22 bp, Homo sapiens
ctggagggagttaggacccgga

SEQ ID NO: 7634361 - DNA, 22 bp, Homo sapiens
ctggagggagttaggacccgga

SEQ ID NO: 7634362 - DNA, 22 bp, Homo sapiens
ctggagggatgtagggtgtatt

SEQ ID NO: 7634363 - DNA, 22 bp, Homo sapiens
ctggagggatgtagggtgtatt

SEQ ID NO: 7634364 - DNA, 22 bp, Homo sapiens
ctggagggatgtagggtgtatt

SEQ ID NO: 7634365 - DNA, 22 bp, Homo sapiens
ctggagggatgtagggtgtatt

SEQ ID NO: 7634366 - DNA, 22 bp, Homo sapiens
ctggagggatgtagggtgtatt

SEQ ID NO: 7634367 - DNA, 22 bp, Homo sapiens
ctggagggatgtagggtgtatt

SEQ ID NO: 7634368 - DNA, 22 bp, Homo sapiens
ctggagggatgtagggtgtatt

SEQ ID NO: 7634369 - DNA, 22 bp, Homo sapiens
ctggagggaggaggctgctatt

SEQ ID NO: 7634370 - DNA, 22 bp, Homo sapiens
ctggagggaggaggctgctatt

SEQ ID NO: 7634371 - DNA, 22 bp, Homo sapiens
ctggagggaggaggctgctatt

SEQ ID NO: 7634372 - DNA, 22 bp, Homo sapiens
ctggagggaggaggctgctatt

SEQ ID NO: 7634373 - DNA, 22 bp, Homo sapiens
ctggagggaggaggctgctatt

SEQ ID NO: 7634374 - DNA, 22 bp, Homo sapiens
ctggagggaggaggctgctatt

SEQ ID NO: 7634375 - DNA, 22 bp, Homo sapiens
ctggagggagttaggacccgga

SEQ ID NO: 7634376 - DNA, 22 bp, Homo sapiens
ctggagggagttaggacccgga

SEQ ID NO: 7634377 - DNA, 22 bp, Homo sapiens
ctggagggaggaggctgctatt

SEQ ID NO: 7634378 - DNA, 22 bp, Homo sapiens
ctggagggaggaggctgctatt

SEQ ID NO: 7634379 - DNA, 22 bp, Homo sapiens
ctggagggagattcaaaggagg

SEQ ID NO: 7634380 - DNA, 22 bp, Homo sapiens
ctggagggagattcaaaggagg

SEQ ID NO: 7634381 - DNA, 22 bp, Homo sapiens
ctggagggagattcaaaggagg

SEQ ID NO: 7634382 - DNA, 22 bp, Homo sapiens
ctggaggaaaacaactgcagac

SEQ ID NO: 7634383 - DNA, 22 bp, Homo sapiens
ctggaggaaaacaactgcagac

SEQ ID NO: 7634384 - DNA, 22 bp, Homo sapiens
atacagatgcttgctcgtgact

SEQ ID NO: 7634385 - DNA, 22 bp, Homo sapiens
ctggaggaataatctcctaccc

SEQ ID NO: 7634386 - DNA, 22 bp, Homo sapiens
atacagatgcttgctcgtgact

SEQ ID NO: 7634387 - DNA, 22 bp, Homo sapiens
atacagatgggtcagatttcat

SEQ ID NO: 7634388 - DNA, 22 bp, Homo sapiens
atacagatgggtcagatttcat

SEQ ID NO: 7634389 - DNA, 20 bp, Homo sapiens
atacagatggttccagctgg

SEQ ID NO: 7634390 - DNA, 22 bp, Homo sapiens
ctggaggaaaacaactgcagac

SEQ ID NO: 7634391 - DNA, 22 bp, Homo sapiens
ctggaggaaaacaactgcagac

SEQ ID NO: 7634392 - DNA, 22 bp, Homo sapiens
ctggaggaaaacaactgcagac

SEQ ID NO: 7634393 - DNA, 22 bp, Homo sapiens
ctggaggaaaacaactgcagac

SEQ ID NO: 7634394 - DNA, 22 bp, Homo sapiens
ctggaggaaaacaactgcagac

SEQ ID NO: 7634395 - DNA, 22 bp, Homo sapiens
atacaagtggccacttgaattc

SEQ ID NO: 7634396 - DNA, 22 bp, Homo sapiens
atacaagtggccacttgaattc

SEQ ID NO: 7634397 - DNA, 22 bp, Homo sapiens
atacaagtgctgaccctgggat

SEQ ID NO: 7634398 - DNA, 22 bp, Homo sapiens
atacaagtggccacttgaattc

SEQ ID NO: 7634399 - DNA, 22 bp, Homo sapiens
atacaagtggccacttgaattc

SEQ ID NO: 7634400 - DNA, 22 bp, Homo sapiens
atacaagtgttgtgcctcatca

SEQ ID NO: 7634401 - DNA, 22 bp, Homo sapiens
atacaagttaaatgcagtgccc

SEQ ID NO: 7634402 - DNA, 22 bp, Homo sapiens
atacaagttaaatgcagtgccc

SEQ ID NO: 7634403 - DNA, 22 bp, Homo sapiens
atacaagttaaatgcagtgccc

SEQ ID NO: 7634404 - DNA, 22 bp, Homo sapiens
atacaagtgttgtgcctcatca

SEQ ID NO: 7634405 - DNA, 22 bp, Homo sapiens
atacaagttaatgagaatgaca

SEQ ID NO: 7634406 - DNA, 22 bp, Homo sapiens
atacaagttaatgagaatgaca

SEQ ID NO: 7634407 - DNA, 22 bp, Homo sapiens
atacaagttaatgagaatgaca

SEQ ID NO: 7634408 - DNA, 22 bp, Homo sapiens
ctggagagaccgaaagaggctg

SEQ ID NO: 7634409 - DNA, 22 bp, Homo sapiens
ctggagcatccatgcccagggt

SEQ ID NO: 7634410 - DNA, 22 bp, Homo sapiens
ctggagcatccatgcccagggt

SEQ ID NO: 7634411 - DNA, 22 bp, Homo sapiens
ctggagagaccgaaagaggctg

SEQ ID NO: 7634412 - DNA, 22 bp, Homo sapiens
atacaagttaatgagaatgaca

SEQ ID NO: 7634413 - DNA, 22 bp, Homo sapiens
atacaagttaatgagaatgaca

SEQ ID NO: 7634414 - DNA, 22 bp, Homo sapiens
ctggagagaccgaaagaggctg

SEQ ID NO: 7634415 - DNA, 22 bp, Homo sapiens
ctggagagaccgaaagaggctg

SEQ ID NO: 7634416 - DNA, 22 bp, Homo sapiens
ctggagagaccgaaagaggctg

SEQ ID NO: 7634417 - DNA, 22 bp, Homo sapiens
ctggagagaccgaaagaggctg

SEQ ID NO: 7634418 - DNA, 22 bp, Homo sapiens
ctggagccactgggtcttgtat

SEQ ID NO: 7634419 - DNA, 22 bp, Homo sapiens
ctggagccactttttatccttt

SEQ ID NO: 7634420 - DNA, 22 bp, Homo sapiens
ctggagccactgggtcttgtat

SEQ ID NO: 7634421 - DNA, 22 bp, Homo sapiens
ctggagccactgggtcttgtat

SEQ ID NO: 7634422 - DNA, 22 bp, Homo sapiens
ctggagccagccagggccctct

SEQ ID NO: 7634423 - DNA, 22 bp, Homo sapiens
ctggagccagccagggccctct

SEQ ID NO: 7634424 - DNA, 22 bp, Homo sapiens
ctggagccactttttatccttt

SEQ ID NO: 7634425 - DNA, 22 bp, Homo sapiens
ctggagccagccagggccctct

SEQ ID NO: 7634426 - DNA, 22 bp, Homo sapiens
ctggagcatccatgcccagggt

SEQ ID NO: 7634427 - DNA, 22 bp, Homo sapiens
ctggagcatccatgcccagggt

SEQ ID NO: 7634428 - DNA, 17 bp, Homo sapiens
ctggagccaagagggcc

SEQ ID NO: 7634429 - DNA, 17 bp, Homo sapiens
ctggagccaagagggcc

SEQ ID NO: 7634430 - DNA, 22 bp, Homo sapiens
ctggagcattttctgcttctgc

SEQ ID NO: 7634431 - DNA, 22 bp, Homo sapiens
ctggagcattttctgcttctgc

SEQ ID NO: 7634432 - DNA, 17 bp, Homo sapiens
ctggagccaagagggcc

SEQ ID NO: 7634433 - DNA, 17 bp, Homo sapiens
ctggagccaagagggcc

SEQ ID NO: 7634434 - DNA, 22 bp, Homo sapiens
atacagaatactaattcctgag

SEQ ID NO: 7634435 - DNA, 22 bp, Homo sapiens
atacagaatactaattcctgag

SEQ ID NO: 7634436 - DNA, 22 bp, Homo sapiens
atacagaatactaattcctgag

SEQ ID NO: 7634437 - DNA, 22 bp, Homo sapiens
atacagaagttttccacttatt

SEQ ID NO: 7634438 - DNA, 22 bp, Homo sapiens
atacagaagttttccacttatt

SEQ ID NO: 7634439 - DNA, 22 bp, Homo sapiens
atacagaatactaattcctgag

SEQ ID NO: 7634440 - DNA, 22 bp, Homo sapiens
atacagaatactaattcctgag

SEQ ID NO: 7634441 - DNA, 22 bp, Homo sapiens
atacagaatactaattcctgag

SEQ ID NO: 7634442 - DNA, 22 bp, Homo sapiens
atacagaattcactacagtttc

SEQ ID NO: 7634443 - DNA, 22 bp, Homo sapiens
atacagaattcactacagtttc

SEQ ID NO: 7634444 - DNA, 22 bp, Homo sapiens
atacagaattcactacagtttc

SEQ ID NO: 7634445 - DNA, 22 bp, Homo sapiens
ctggagccccaggctgtgcaga

SEQ ID NO: 7634446 - DNA, 22 bp, Homo sapiens
ctggagccccaggctgtgcaga

SEQ ID NO: 7634447 - DNA, 22 bp, Homo sapiens
ctggagccccaggctgtgcaga

SEQ ID NO: 7634448 - DNA, 22 bp, Homo sapiens
atacagaagttttccacttatt

SEQ ID NO: 7634449 - DNA, 22 bp, Homo sapiens
atacagaagttttccacttatt

SEQ ID NO: 7634450 - DNA, 22 bp, Homo sapiens
ctggagccccaggctgtgcaga

SEQ ID NO: 7634451 - DNA, 22 bp, Homo sapiens
ctggagccccaggctgtgcaga

SEQ ID NO: 7634452 - DNA, 22 bp, Homo sapiens
ctggagccccagacagggagag

SEQ ID NO: 7634453 - DNA, 22 bp, Homo sapiens
ctggagccccagacagggagag

SEQ ID NO: 7634454 - DNA, 22 bp, Homo sapiens
ctggagccccagacagggagag

SEQ ID NO: 7634455 - DNA, 22 bp, Homo sapiens
ctggagccccagacagggagag

SEQ ID NO: 7634456 - DNA, 22 bp, Homo sapiens
ctggagccccagacagggagag

SEQ ID NO: 7634457 - DNA, 22 bp, Homo sapiens
ctggagccccagacagggagag

SEQ ID NO: 7634458 - DNA, 22 bp, Homo sapiens
ctggagcccaggcctggtgtct

SEQ ID NO: 7634459 - DNA, 22 bp, Homo sapiens
ctggagccccagacagggagag

SEQ ID NO: 7634460 - DNA, 22 bp, Homo sapiens
ctggagccccagacagggagag

SEQ ID NO: 7634461 - DNA, 22 bp, Homo sapiens
ctggagccccagacagggagag

SEQ ID NO: 7634462 - DNA, 22 bp, Homo sapiens
ctggagcccaggcctggtgtct

SEQ ID NO: 7634463 - DNA, 22 bp, Homo sapiens
ctggagccatgtcttgactgct

SEQ ID NO: 7634464 - DNA, 22 bp, Homo sapiens
ctggagcccaggcctggtgtct

SEQ ID NO: 7634465 - DNA, 22 bp, Homo sapiens
ctggagccatgtatagcctatg

SEQ ID NO: 7634466 - DNA, 22 bp, Homo sapiens
ctggagccatgtatagcctatg

SEQ ID NO: 7634467 - DNA, 22 bp, Homo sapiens
ctggagccagccagggccctct

SEQ ID NO: 7634468 - DNA, 22 bp, Homo sapiens
ctggagccatgtatagcctatg

SEQ ID NO: 7634469 - DNA, 22 bp, Homo sapiens
ctggagccatgtcttgactgct

SEQ ID NO: 7634470 - DNA, 22 bp, Homo sapiens
ctggagcccaggcctggtgtct

SEQ ID NO: 7634471 - DNA, 22 bp, Homo sapiens
ctggagccatgtcttgactgct

SEQ ID NO: 7634472 - DNA, 22 bp, Homo sapiens
atacttgttcctgttgctatag

SEQ ID NO: 7634473 - DNA, 22 bp, Homo sapiens
atactttaacgtggcgaacctt

SEQ ID NO: 7634474 - DNA, 22 bp, Homo sapiens
atactttagagctagattgcct

SEQ ID NO: 7634475 - DNA, 22 bp, Homo sapiens
atactttagagctagattgcct

SEQ ID NO: 7634476 - DNA, 22 bp, Homo sapiens
atactttagagctagattgcct

SEQ ID NO: 7634477 - DNA, 22 bp, Homo sapiens
atactttagagctagattgcct

SEQ ID NO: 7634478 - DNA, 22 bp, Homo sapiens
atactttagagctagattgcct

SEQ ID NO: 7634479 - DNA, 22 bp, Homo sapiens
atacttctttgatgttcacagg

SEQ ID NO: 7634480 - DNA, 22 bp, Homo sapiens
atacttgatggtgtctgtcaaa

SEQ ID NO: 7634481 - DNA, 22 bp, Homo sapiens
atacttgatggtgtctgtcaaa

SEQ ID NO: 7634482 - DNA, 22 bp, Homo sapiens
atacttgtcaacattttatcca

SEQ ID NO: 7634483 - DNA, 22 bp, Homo sapiens
atacttgaggttgtataaatat

SEQ ID NO: 7634484 - DNA, 22 bp, Homo sapiens
atacttgaggttgtataaatat

SEQ ID NO: 7634485 - DNA, 22 bp, Homo sapiens
atacttgaggttgtataaatat

SEQ ID NO: 7634486 - DNA, 22 bp, Homo sapiens
atacttctcatgggctctgagc

SEQ ID NO: 7634487 - DNA, 22 bp, Homo sapiens
atacttctcatgggctctgagc

SEQ ID NO: 7634488 - DNA, 22 bp, Homo sapiens
atacttctcatgggctctgagc

SEQ ID NO: 7634489 - DNA, 22 bp, Homo sapiens
atacttctagaaatactatgca

SEQ ID NO: 7634490 - DNA, 22 bp, Homo sapiens
atacttccctgttttttcctga

SEQ ID NO: 7634491 - DNA, 22 bp, Homo sapiens
atacttctagaaatactatgca

SEQ ID NO: 7634492 - DNA, 22 bp, Homo sapiens
atacttctagaaatactatgca

SEQ ID NO: 7634493 - DNA, 22 bp, Homo sapiens
atacttcatgcttcatgtctgt

SEQ ID NO: 7634494 - DNA, 22 bp, Homo sapiens
atacttctttaagagtaagtct

SEQ ID NO: 7634495 - DNA, 22 bp, Homo sapiens
atacttctttagcatattgaac

SEQ ID NO: 7634496 - DNA, 22 bp, Homo sapiens
atacttctttagcatattgaac

SEQ ID NO: 7634497 - DNA, 22 bp, Homo sapiens
atacttctttagcatattgaac

SEQ ID NO: 7634498 - DNA, 22 bp, Homo sapiens
atacttctcatgggctctgagc

SEQ ID NO: 7634499 - DNA, 22 bp, Homo sapiens
atacttctttaagagtaagtct

SEQ ID NO: 7634500 - DNA, 22 bp, Homo sapiens
atacttctggtgacaaagtctt

SEQ ID NO: 7634501 - DNA, 22 bp, Homo sapiens
ctggcagcggtttgcagcctgg

SEQ ID NO: 7634502 - DNA, 22 bp, Homo sapiens
ctggcagcggtttgcagcctgg

SEQ ID NO: 7634503 - DNA, 22 bp, Homo sapiens
ctggcagcgtgagcagcatcca

SEQ ID NO: 7634504 - DNA, 22 bp, Homo sapiens
ctggcagcggtttgcagcctgg

SEQ ID NO: 7634505 - DNA, 22 bp, Homo sapiens
ctggcagcggtttgcagcctgg

SEQ ID NO: 7634506 - DNA, 22 bp, Homo sapiens
ctggcagcggtttgcagcctgg

SEQ ID NO: 7634507 - DNA, 22 bp, Homo sapiens
ctggcagcggtttgcagcctgg

SEQ ID NO: 7634508 - DNA, 22 bp, Homo sapiens
ctggcagcggtttgcagcctgg

SEQ ID NO: 7634509 - DNA, 22 bp, Homo sapiens
ctggcagcggtttgcagcctgg

SEQ ID NO: 7634510 - DNA, 22 bp, Homo sapiens
ctggcagcggtttgcagcctgg

SEQ ID NO: 7634511 - DNA, 22 bp, Homo sapiens
ctggcagcgcagcatgaagtcg

SEQ ID NO: 7634512 - DNA, 19 bp, Homo sapiens
ctggcagcctgtctgtgtc

SEQ ID NO: 7634513 - DNA, 19 bp, Homo sapiens
ctggcagcctgtctgtgtc

SEQ ID NO: 7634514 - DNA, 19 bp, Homo sapiens
ctggcagcctgtctgtgtc

SEQ ID NO: 7634515 - DNA, 22 bp, Homo sapiens
ctggcagcgcagcatgaagtcg

SEQ ID NO: 7634516 - DNA, 22 bp, Homo sapiens
atactttctgaccaattaattg

SEQ ID NO: 7634517 - DNA, 22 bp, Homo sapiens
atactttagagctagattgcct

SEQ ID NO: 7634518 - DNA, 22 bp, Homo sapiens
atactttagagctagattgcct

SEQ ID NO: 7634519 - DNA, 22 bp, Homo sapiens
ctggcagctctactcagagcct

SEQ ID NO: 7634520 - DNA, 22 bp, Homo sapiens
ctggcagctctactcagagcct

SEQ ID NO: 7634521 - DNA, 22 bp, Homo sapiens
ctggcagctctactcagagcct

SEQ ID NO: 7634522 - DNA, 22 bp, Homo sapiens
ctggcagctgcccgagatgccc

SEQ ID NO: 7634523 - DNA, 22 bp, Homo sapiens
ctggcagctgcccgagatgccc

SEQ ID NO: 7634524 - DNA, 22 bp, Homo sapiens
ctggcagctgcccgagatgccc

SEQ ID NO: 7634525 - DNA, 22 bp, Homo sapiens
ctggcagctgcccgagatgccc

SEQ ID NO: 7634526 - DNA, 22 bp, Homo sapiens
ctggcagctgcccgagatgccc

SEQ ID NO: 7634527 - DNA, 22 bp, Homo sapiens
ctggcagctctgagtcccttct

SEQ ID NO: 7634528 - DNA, 22 bp, Homo sapiens
ctggcagctctactcagagcct

SEQ ID NO: 7634529 - DNA, 22 bp, Homo sapiens
ctggcagcgtgagcagcatcca

SEQ ID NO: 7634530 - DNA, 22 bp, Homo sapiens
ctggcagcgtgagcagcatcca

SEQ ID NO: 7634531 - DNA, 22 bp, Homo sapiens
ctggcagcgtgagcagcatcca

SEQ ID NO: 7634532 - DNA, 22 bp, Homo sapiens
ctggcagcgtgagcagcatcca

SEQ ID NO: 7634533 - DNA, 22 bp, Homo sapiens
ctggcagcgtgagcagcatcca

SEQ ID NO: 7634534 - DNA, 22 bp, Homo sapiens
ctggcagcgtgagcagcatcca

SEQ ID NO: 7634535 - DNA, 22 bp, Homo sapiens
ctggcagcgtgtttatgaacat

SEQ ID NO: 7634536 - DNA, 22 bp, Homo sapiens
ctggcagctctactcagagcct

SEQ ID NO: 7634537 - DNA, 22 bp, Homo sapiens
ctggcagctctactcagagcct

SEQ ID NO: 7634538 - DNA, 22 bp, Homo sapiens
ctggcagctctactcagagcct

SEQ ID NO: 7634539 - DNA, 22 bp, Homo sapiens
ctggagtgcagtggcatgatca

SEQ ID NO: 7634540 - DNA, 22 bp, Homo sapiens
atactctttatgacattccagc

SEQ ID NO: 7634541 - DNA, 22 bp, Homo sapiens
atactcagctgctagacagaag

SEQ ID NO: 7634542 - DNA, 22 bp, Homo sapiens
atactcagctgctagacagaag

SEQ ID NO: 7634543 - DNA, 22 bp, Homo sapiens
atactgaaaaagaagtgttgaa

SEQ ID NO: 7634544 - DNA, 22 bp, Homo sapiens
atactgaaaaagaagtgttgaa

SEQ ID NO: 7634545 - DNA, 22 bp, Homo sapiens
atactgaaaaatgatttgctgt

SEQ ID NO: 7634546 - DNA, 22 bp, Homo sapiens
atactgaaaaatgatttgctgt

SEQ ID NO: 7634547 - DNA, 22 bp, Homo sapiens
atacttatactaagaatgtact

SEQ ID NO: 7634548 - DNA, 22 bp, Homo sapiens
atacttcaacatatcagtcaga

SEQ ID NO: 7634549 - DNA, 22 bp, Homo sapiens
atacttatgataaataattgct

SEQ ID NO: 7634550 - DNA, 22 bp, Homo sapiens
atacttatgataaataattgct

SEQ ID NO: 7634551 - DNA, 22 bp, Homo sapiens
atacttcaacatatcagtcaga

SEQ ID NO: 7634552 - DNA, 22 bp, Homo sapiens
atacttcaacatatcagtcaga

SEQ ID NO: 7634553 - DNA, 22 bp, Homo sapiens
atacttatgataaataattgct

SEQ ID NO: 7634554 - DNA, 22 bp, Homo sapiens
atacttatgataaataattgct

SEQ ID NO: 7634555 - DNA, 22 bp, Homo sapiens
atacttatgataaataattgct

SEQ ID NO: 7634556 - DNA, 22 bp, Homo sapiens
atacttatgataaataattgct

SEQ ID NO: 7634557 - DNA, 22 bp, Homo sapiens
atacttatgataaataattgct

SEQ ID NO: 7634558 - DNA, 22 bp, Homo sapiens
ctggagtgcaatgaacaaggtc

SEQ ID NO: 7634559 - DNA, 22 bp, Homo sapiens
ctggagtgcagtggcatgatca

SEQ ID NO: 7634560 - DNA, 22 bp, Homo sapiens
ctggagtgatactcagaatgtg

SEQ ID NO: 7634561 - DNA, 22 bp, Homo sapiens
ctggagtgatactcagaatgtg

SEQ ID NO: 7634562 - DNA, 22 bp, Homo sapiens
ctggagtgcaacctctgcctcc

SEQ ID NO: 7634563 - DNA, 22 bp, Homo sapiens
ctggagtgcaacctctgcctcc

SEQ ID NO: 7634564 - DNA, 22 bp, Homo sapiens
ctggagtgaggtctgggagcct

SEQ ID NO: 7634565 - DNA, 22 bp, Homo sapiens
ctggagtgaggtctgggagcct

SEQ ID NO: 7634566 - DNA, 22 bp, Homo sapiens
ctggagtgaggtctgggagcct

SEQ ID NO: 7634567 - DNA, 22 bp, Homo sapiens
ctggagtgaggtctgggagcct

SEQ ID NO: 7634568 - DNA, 22 bp, Homo sapiens
ctggagtgactttgttcctttt

SEQ ID NO: 7634569 - DNA, 22 bp, Homo sapiens
ctggagtgaggtctgggagcct

SEQ ID NO: 7634570 - DNA, 22 bp, Homo sapiens
ctggagtgaggtctgggagcct

SEQ ID NO: 7634571 - DNA, 22 bp, Homo sapiens
ctggagtgatactcagaatgtg

SEQ ID NO: 7634572 - DNA, 22 bp, Homo sapiens
ctggagtgatactcagaatgtg

SEQ ID NO: 7634573 - DNA, 22 bp, Homo sapiens
ctggagtgaggtctgggagcct

SEQ ID NO: 7634574 - DNA, 22 bp, Homo sapiens
ctggagtgatactcagaatgtg

SEQ ID NO: 7634575 - DNA, 22 bp, Homo sapiens
ctggagtgatactcagaatgtg

SEQ ID NO: 7634576 - DNA, 22 bp, Homo sapiens
ctggagggctgcagcgaggctg

SEQ ID NO: 7634577 - DNA, 22 bp, Homo sapiens
ctggagggctggactaaggaaa

SEQ ID NO: 7634578 - DNA, 22 bp, Homo sapiens
ctggagtctcttctgtagctac

SEQ ID NO: 7634579 - DNA, 22 bp, Homo sapiens
ctggagggctggactaaggaaa

SEQ ID NO: 7634580 - DNA, 22 bp, Homo sapiens
ctggagggctggactaaggaaa

SEQ ID NO: 7634581 - DNA, 22 bp, Homo sapiens
ctggagggctgcagcgaggctg

SEQ ID NO: 7634582 - DNA, 22 bp, Homo sapiens
ctggagggctgcagcgaggctg

SEQ ID NO: 7634583 - DNA, 22 bp, Homo sapiens
ctggagggctgcagcgaggctg

SEQ ID NO: 7634584 - DNA, 22 bp, Homo sapiens
ctggagggctgcagcgaggctg

SEQ ID NO: 7634585 - DNA, 22 bp, Homo sapiens
ctggagggctgcagcgaggctg

SEQ ID NO: 7634586 - DNA, 22 bp, Homo sapiens
ctggagggatgtagggtgtatt

SEQ ID NO: 7634587 - DNA, 22 bp, Homo sapiens
ctggagggatgtagggtgtatt

SEQ ID NO: 7634588 - DNA, 22 bp, Homo sapiens
ctggagggatgtagggtgtatt

SEQ ID NO: 7634589 - DNA, 22 bp, Homo sapiens
ctggagggctgcagcgaggctg

SEQ ID NO: 7634590 - DNA, 22 bp, Homo sapiens
ctggagggctgcagcgaggctg

SEQ ID NO: 7634591 - DNA, 22 bp, Homo sapiens
ctggagggctgcagcgaggctg

SEQ ID NO: 7634592 - DNA, 22 bp, Homo sapiens
ctggagggctgcagcgaggctg

SEQ ID NO: 7634593 - DNA, 22 bp, Homo sapiens
ctggagtcttcagcttgctgcc

SEQ ID NO: 7634594 - DNA, 22 bp, Homo sapiens
ctggagtcttcagcttgctgcc

SEQ ID NO: 7634595 - DNA, 22 bp, Homo sapiens
ctggagtgaagcttatttttca

SEQ ID NO: 7634596 - DNA, 21 bp, Homo sapiens
ctggagtctgggggtggcagt

SEQ ID NO: 7634597 - DNA, 22 bp, Homo sapiens
ctggagtcttaggttatggtga

SEQ ID NO: 7634598 - DNA, 21 bp, Homo sapiens
ctggagtctgggggtggcagt

SEQ ID NO: 7634599 - DNA, 21 bp, Homo sapiens
ctggagtctgggggtggcagt

SEQ ID NO: 7634600 - DNA, 22 bp, Homo sapiens
ctggagtgaggtctgggagcct

SEQ ID NO: 7634601 - DNA, 22 bp, Homo sapiens
ctggagtgaggtctgggagcct

SEQ ID NO: 7634602 - DNA, 22 bp, Homo sapiens
ctggagtgactttgttcctttt

SEQ ID NO: 7634603 - DNA, 22 bp, Homo sapiens
ctggagtgaagtctggcagctt

SEQ ID NO: 7634604 - DNA, 22 bp, Homo sapiens
ctggagtgaagtctggcagctt

SEQ ID NO: 7634605 - DNA, 22 bp, Homo sapiens
ctggagtgaagtctggcagctt

SEQ ID NO: 7634606 - DNA, 22 bp, Homo sapiens
ctggagtgaagtctggcagctt

SEQ ID NO: 7634607 - DNA, 22 bp, Homo sapiens
ctggagtgaagtctggcagctt

SEQ ID NO: 7634608 - DNA, 22 bp, Homo sapiens
ctggagtgaagtctggcagctt

SEQ ID NO: 7634609 - DNA, 22 bp, Homo sapiens
ctggagtgaagtctggcagctt

SEQ ID NO: 7634610 - DNA, 22 bp, Homo sapiens
agtggcttcatttctgccagaa

SEQ ID NO: 7634611 - DNA, 22 bp, Homo sapiens
agtggcttcatttctgccagaa

SEQ ID NO: 7634612 - DNA, 22 bp, Homo sapiens
agtggcttcatttctgccagaa

SEQ ID NO: 7634613 - DNA, 22 bp, Homo sapiens
agtggcttcatttctgccagaa

SEQ ID NO: 7634614 - DNA, 22 bp, Homo sapiens
agtggcttatctgggacagcta

SEQ ID NO: 7634615 - DNA, 22 bp, Homo sapiens
agtggcttatctgggacagcta

SEQ ID NO: 7634616 - DNA, 22 bp, Homo sapiens
agtggctgtttataggtgggta

SEQ ID NO: 7634617 - DNA, 22 bp, Homo sapiens
agtggctgtttataggtgggta

SEQ ID NO: 7634618 - DNA, 22 bp, Homo sapiens
agtggctgttccaggtgaggac

SEQ ID NO: 7634619 - DNA, 22 bp, Homo sapiens
agtggctgttccaggtgaggac

SEQ ID NO: 7634620 - DNA, 22 bp, Homo sapiens
agtggctgttcattttacacaa

SEQ ID NO: 7634621 - DNA, 22 bp, Homo sapiens
agtggctgtgaaatacatggga

SEQ ID NO: 7634622 - DNA, 22 bp, Homo sapiens
agtggctgtttataggtgggta

SEQ ID NO: 7634623 - DNA, 22 bp, Homo sapiens
agtggctgttccaggtgaggac

SEQ ID NO: 7634624 - DNA, 22 bp, Homo sapiens
agtggctgttccaggtgaggac

SEQ ID NO: 7634625 - DNA, 22 bp, Homo sapiens
agtggcttttcttgcttctggc

SEQ ID NO: 7634626 - DNA, 22 bp, Homo sapiens
agtggcttttcttgcttctggc

SEQ ID NO: 7634627 - DNA, 22 bp, Homo sapiens
agtggcttgtccgtggtcacat

SEQ ID NO: 7634628 - DNA, 22 bp, Homo sapiens
agtggcttgtccgtggtcacat

SEQ ID NO: 7634629 - DNA, 22 bp, Homo sapiens
agtggcttggctgcactacagg

SEQ ID NO: 7634630 - DNA, 22 bp, Homo sapiens
agtggcttggctgcactacagg

SEQ ID NO: 7634631 - DNA, 22 bp, Homo sapiens
agtggcttgtccgtggtcacat

SEQ ID NO: 7634632 - DNA, 22 bp, Homo sapiens
agtggcttggctgcactacagg

SEQ ID NO: 7634633 - DNA, 22 bp, Homo sapiens
agtggcttccttcataagcttt

SEQ ID NO: 7634634 - DNA, 18 bp, Homo sapiens
agtggcttcctgctcata

SEQ ID NO: 7634635 - DNA, 18 bp, Homo sapiens
agtggcttcctgctcata

SEQ ID NO: 7634636 - DNA, 18 bp, Homo sapiens
agtggcttcctgctcata

SEQ ID NO: 7634637 - DNA, 22 bp, Homo sapiens
agtggcttgctctgcctcagcc

SEQ ID NO: 7634638 - DNA, 22 bp, Homo sapiens
agtggcttccttcataagcttt

SEQ ID NO: 7634639 - DNA, 22 bp, Homo sapiens
agtggcttgctctgcctcagcc

SEQ ID NO: 7634640 - DNA, 22 bp, Homo sapiens
agtgggaccggtgctattccag

SEQ ID NO: 7634641 - DNA, 21 bp, Homo sapiens
agtgggacacctaagagattt

SEQ ID NO: 7634642 - DNA, 22 bp, Homo sapiens
agtgggaatttcagtgctaaaa

SEQ ID NO: 7634643 - DNA, 22 bp, Homo sapiens
agtgggaaactggagagacttc

SEQ ID NO: 7634644 - DNA, 22 bp, Homo sapiens
agtgggaaactggagagacttc

SEQ ID NO: 7634645 - DNA, 22 bp, Homo sapiens
agtggcttttcttgcttctggc

SEQ ID NO: 7634646 - DNA, 22 bp, Homo sapiens
agtggcttttcttgcttctggc

SEQ ID NO: 7634647 - DNA, 22 bp, Homo sapiens
agtgggaaactggagagacttc

SEQ ID NO: 7634648 - DNA, 22 bp, Homo sapiens
agtgggaaactggagagacttc

SEQ ID NO: 7634649 - DNA, 22 bp, Homo sapiens
agtggctttttagtggcagatg

SEQ ID NO: 7634650 - DNA, 22 bp, Homo sapiens
agtggctttttagtggcagatg

SEQ ID NO: 7634651 - DNA, 22 bp, Homo sapiens
agtggctttttagtggcagatg

SEQ ID NO: 7634652 - DNA, 22 bp, Homo sapiens
agtgggagaatgaataagggcc

SEQ ID NO: 7634653 - DNA, 22 bp, Homo sapiens
agtgggactgctatgacagaag

SEQ ID NO: 7634654 - DNA, 22 bp, Homo sapiens
agtgggagaatgaataagggcc

SEQ ID NO: 7634655 - DNA, 22 bp, Homo sapiens
agtgggagaatgaataagggcc

SEQ ID NO: 7634656 - DNA, 22 bp, Homo sapiens
agtgggagaatgaataagggcc

SEQ ID NO: 7634657 - DNA, 22 bp, Homo sapiens
agtgggagaatgaataagggcc

SEQ ID NO: 7634658 - DNA, 22 bp, Homo sapiens
agtgggagagaagcaagtagta

SEQ ID NO: 7634659 - DNA, 22 bp, Homo sapiens
agtgggagagaagcaagtagta

SEQ ID NO: 7634660 - DNA, 22 bp, Homo sapiens
ctctggggttagatctgatgct

SEQ ID NO: 7634661 - DNA, 22 bp, Homo sapiens
agtgggagagaagcaagtagta

SEQ ID NO: 7634662 - DNA, 21 bp, Homo sapiens
ctctggtttgcattggattat

SEQ ID NO: 7634663 - DNA, 22 bp, Homo sapiens
ctctggggttagatctgatgct

SEQ ID NO: 7634664 - DNA, 22 bp, Homo sapiens
ctctggggttagatctgatgct

SEQ ID NO: 7634665 - DNA, 22 bp, Homo sapiens
agtgggagaatgaataagggcc

SEQ ID NO: 7634666 - DNA, 22 bp, Homo sapiens
agtgggagagaagcaagtagta

SEQ ID NO: 7634667 - DNA, 22 bp, Homo sapiens
ctctggggttagatctgatgct

SEQ ID NO: 7634668 - DNA, 22 bp, Homo sapiens
ctctggggttagatctgatgct

SEQ ID NO: 7634669 - DNA, 22 bp, Homo sapiens
ctctgtaccttaaaagggcttt

SEQ ID NO: 7634670 - DNA, 22 bp, Homo sapiens
ctctgtatagaaaggaaacatt

SEQ ID NO: 7634671 - DNA, 22 bp, Homo sapiens
ctctgtcaggctgcagatgctc

SEQ ID NO: 7634672 - DNA, 18 bp, Homo sapiens
ctctgtcataagtgtcat

SEQ ID NO: 7634673 - DNA, 22 bp, Homo sapiens
ctctgtcacttctccagctgag

SEQ ID NO: 7634674 - DNA, 22 bp, Homo sapiens
ctctgtcacttctccagctgag

SEQ ID NO: 7634675 - DNA, 22 bp, Homo sapiens
ctctgtcacttctccagctgag

SEQ ID NO: 7634676 - DNA, 22 bp, Homo sapiens
ctctgtatagaaaggaaacatt

SEQ ID NO: 7634677 - DNA, 22 bp, Homo sapiens
ctctgtatagaaaggaaacatt

SEQ ID NO: 7634678 - DNA, 22 bp, Homo sapiens
ctctgtatgaatcatatggagt

SEQ ID NO: 7634679 - DNA, 22 bp, Homo sapiens
ctctggagaacgctatggatct

SEQ ID NO: 7634680 - DNA, 22 bp, Homo sapiens
ctctggagaacgctatggatct

SEQ ID NO: 7634681 - DNA, 19 bp, Homo sapiens
ctctggagaacaatagtgc

SEQ ID NO: 7634682 - DNA, 22 bp, Homo sapiens
ctctggagaacgctatggatct

SEQ ID NO: 7634683 - DNA, 22 bp, Homo sapiens
ctctggagaacgctatggatct

SEQ ID NO: 7634684 - DNA, 22 bp, Homo sapiens
ctctggagaactccttgtgtct

SEQ ID NO: 7634685 - DNA, 22 bp, Homo sapiens
ctctggagaactccttgtgtct

SEQ ID NO: 7634686 - DNA, 23 bp, Homo sapiens
ctctggagatcctctgcctgggt

SEQ ID NO: 7634687 - DNA, 22 bp, Homo sapiens
ctctggagaggttcccatggga

SEQ ID NO: 7634688 - DNA, 22 bp, Homo sapiens
ctctggagaggttcccatggga

SEQ ID NO: 7634689 - DNA, 22 bp, Homo sapiens
ctctggagaactccttgtgtct

SEQ ID NO: 7634690 - DNA, 22 bp, Homo sapiens
ctctggagaactccttgtgtct

SEQ ID NO: 7634691 - DNA, 22 bp, Homo sapiens
ctctggagaggttcccatggga

SEQ ID NO: 7634692 - DNA, 22 bp, Homo sapiens
ctctggagaggttcccatggga

SEQ ID NO: 7634693 - DNA, 22 bp, Homo sapiens
ctctggagcaccgggctatcca

SEQ ID NO: 7634694 - DNA, 22 bp, Homo sapiens
ctctggagcaccgggctatcca

SEQ ID NO: 7634695 - DNA, 22 bp, Homo sapiens
ctctggagcaccgggctatcca

SEQ ID NO: 7634696 - DNA, 22 bp, Homo sapiens
ctctggagatggttctcaattg

SEQ ID NO: 7634697 - DNA, 19 bp, Homo sapiens
ctctggagcagacactgga

SEQ ID NO: 7634698 - DNA, 22 bp, Homo sapiens
agtggctgtgaaatacatggga

SEQ ID NO: 7634699 - DNA, 22 bp, Homo sapiens
agtggctgtgaaatacatggga

SEQ ID NO: 7634700 - DNA, 23 bp, Homo sapiens
ctctggagatcctctgcctgggt

SEQ ID NO: 7634701 - DNA, 22 bp, Homo sapiens
ctctggagatggttctcaattg

SEQ ID NO: 7634702 - DNA, 22 bp, Homo sapiens
ctctggagatggttctcaattg

SEQ ID NO: 7634703 - DNA, 22 bp, Homo sapiens
ctctggagaggttcccatggga

SEQ ID NO: 7634704 - DNA, 23 bp, Homo sapiens
ctctggagatcctctgcctgggt

SEQ ID NO: 7634705 - DNA, 23 bp, Homo sapiens
ctctggagatcctctgcctgggt

SEQ ID NO: 7634706 - DNA, 23 bp, Homo sapiens
ctctggagatcctctgcctgggt

SEQ ID NO: 7634707 - DNA, 23 bp, Homo sapiens
ctctggagatcctctgcctgggt

SEQ ID NO: 7634708 - DNA, 22 bp, Homo sapiens
ctctgctgccaccagaaccact

SEQ ID NO: 7634709 - DNA, 22 bp, Homo sapiens
ctctgctgcaggaaggcgtgca

SEQ ID NO: 7634710 - DNA, 17 bp, Homo sapiens
ctctggaattggtgaag

SEQ ID NO: 7634711 - DNA, 22 bp, Homo sapiens
ctctgctgcaggaaggcgtgca

SEQ ID NO: 7634712 - DNA, 22 bp, Homo sapiens
ctctgctgcaggaaggcgtgca

SEQ ID NO: 7634713 - DNA, 22 bp, Homo sapiens
ctctgctgcaggaaggcgtgca

SEQ ID NO: 7634714 - DNA, 22 bp, Homo sapiens
ctctgctgcaggaaggcgtgca

SEQ ID NO: 7634715 - DNA, 22 bp, Homo sapiens
ctctctccttagctgcagacca

SEQ ID NO: 7634716 - DNA, 22 bp, Homo sapiens
ctctctccttagctgcagacca

SEQ ID NO: 7634717 - DNA, 22 bp, Homo sapiens
ctctctccttagctgcagacca

SEQ ID NO: 7634718 - DNA, 20 bp, Homo sapiens
ctctctccatctcagtggcc

SEQ ID NO: 7634719 - DNA, 20 bp, Homo sapiens
ctctctccatctcagtggcc

SEQ ID NO: 7634720 - DNA, 20 bp, Homo sapiens
ctctctccatctcagtggcc

SEQ ID NO: 7634721 - DNA, 20 bp, Homo sapiens
ctctctccatctcagtggcc

SEQ ID NO: 7634722 - DNA, 20 bp, Homo sapiens
ctctctccatctcagtggcc

SEQ ID NO: 7634723 - DNA, 19 bp, Homo sapiens
ctctctccagtggctggct

SEQ ID NO: 7634724 - DNA, 19 bp, Homo sapiens
ctctctccagtggctggct

SEQ ID NO: 7634725 - DNA, 22 bp, Homo sapiens
ctctggacactggcatggggtc

SEQ ID NO: 7634726 - DNA, 22 bp, Homo sapiens
ctctggacactggcatggggtc

SEQ ID NO: 7634727 - DNA, 22 bp, Homo sapiens
ctctggacagccctccaggaag

SEQ ID NO: 7634728 - DNA, 22 bp, Homo sapiens
ctctggacagccctccaggaag

SEQ ID NO: 7634729 - DNA, 22 bp, Homo sapiens
ctctggacagccctccaggaag

SEQ ID NO: 7634730 - DNA, 22 bp, Homo sapiens
ctctggacccagacaaacctgg

SEQ ID NO: 7634731 - DNA, 19 bp, Homo sapiens
ctctggagaacaatagtgc

SEQ ID NO: 7634732 - DNA, 22 bp, Homo sapiens
ctctggacctcagtctactaat

SEQ ID NO: 7634733 - DNA, 22 bp, Homo sapiens
ctctggacctcagctacagact

SEQ ID NO: 7634734 - DNA, 22 bp, Homo sapiens
ctctggaccctcctgctgagag

SEQ ID NO: 7634735 - DNA, 22 bp, Homo sapiens
ctctggacctcagctacagact

SEQ ID NO: 7634736 - DNA, 22 bp, Homo sapiens
ctctgtcctggtttatactggc

SEQ ID NO: 7634737 - DNA, 22 bp, Homo sapiens
ctctgtcctccacctgctttca

SEQ ID NO: 7634738 - DNA, 22 bp, Homo sapiens
ctctgtcctatgcttgatagaa

SEQ ID NO: 7634739 - DNA, 22 bp, Homo sapiens
ctctgtcctccacctgctttca

SEQ ID NO: 7634740 - DNA, 22 bp, Homo sapiens
ctctgtcccagacccacctctc

SEQ ID NO: 7634741 - DNA, 18 bp, Homo sapiens
ctctgtcataagtgtcat

SEQ ID NO: 7634742 - DNA, 22 bp, Homo sapiens
ctctgtcccagacccacctctc

SEQ ID NO: 7634743 - DNA, 18 bp, Homo sapiens
ctctgtcataagtgtcat

SEQ ID NO: 7634744 - DNA, 22 bp, Homo sapiens
ctctgtccacaggtttgtccct

SEQ ID NO: 7634745 - DNA, 22 bp, Homo sapiens
ctctgtccacaggtttgtccct

SEQ ID NO: 7634746 - DNA, 22 bp, Homo sapiens
ctctgtcccagacccacctctc

SEQ ID NO: 7634747 - DNA, 22 bp, Homo sapiens
ctctgtcccagacccacctctc

SEQ ID NO: 7634748 - DNA, 22 bp, Homo sapiens
ctctgtgaacccctcctttctt

SEQ ID NO: 7634749 - DNA, 22 bp, Homo sapiens
ctctgtgagggtctgtacagaa

SEQ ID NO: 7634750 - DNA, 22 bp, Homo sapiens
ctctgtctatcccattctgtgc

SEQ ID NO: 7634751 - DNA, 22 bp, Homo sapiens
ctctgtctatcccattctgtgc

SEQ ID NO: 7634752 - DNA, 22 bp, Homo sapiens
ctctgtccttgcacagttccta

SEQ ID NO: 7634753 - DNA, 22 bp, Homo sapiens
ctctgtcctggtttatactggc

SEQ ID NO: 7634754 - DNA, 22 bp, Homo sapiens
agtggtctccccagtagaataa

SEQ ID NO: 7634755 - DNA, 22 bp, Homo sapiens
ctctgtgagggtctgtacagaa

SEQ ID NO: 7634756 - DNA, 22 bp, Homo sapiens
agtggtctgcctgcctcagcct

SEQ ID NO: 7634757 - DNA, 22 bp, Homo sapiens
agtggtctgcctgcctcagcct

SEQ ID NO: 7634758 - DNA, 22 bp, Homo sapiens
agtggtctgcctgcctcagcct

SEQ ID NO: 7634759 - DNA, 22 bp, Homo sapiens
agtggtctgggctaaatgaggt

SEQ ID NO: 7634760 - DNA, 18 bp, Homo sapiens
agtggtctgttatatcat

SEQ ID NO: 7634761 - DNA, 22 bp, Homo sapiens
agtggtggagccaggaaatgtg

SEQ ID NO: 7634762 - DNA, 22 bp, Homo sapiens
agtggtggagagatgaggacac

SEQ ID NO: 7634763 - DNA, 22 bp, Homo sapiens
agtggtggagccaggaaatgtg

SEQ ID NO: 7634764 - DNA, 22 bp, Homo sapiens
agtggtggagccaggaaatgtg

SEQ ID NO: 7634765 - DNA, 22 bp, Homo sapiens
agtggtgtcgtgggagtggaag

SEQ ID NO: 7634766 - DNA, 22 bp, Homo sapiens
agtggtggagccaggaaatgtg

SEQ ID NO: 7634767 - DNA, 22 bp, Homo sapiens
agtggtgtctgagtggccaggg

SEQ ID NO: 7634768 - DNA, 22 bp, Homo sapiens
agtggtgtcgtgggagtggaag

SEQ ID NO: 7634769 - DNA, 22 bp, Homo sapiens
agtgtaaagctgtatatgtgcc

SEQ ID NO: 7634770 - DNA, 22 bp, Homo sapiens
agtgtaaagctgtatatgtgcc

SEQ ID NO: 7634771 - DNA, 22 bp, Homo sapiens
agtgtaaacttaagagaatatc

SEQ ID NO: 7634772 - DNA, 22 bp, Homo sapiens
agtgtaaacttaagagaatatc

SEQ ID NO: 7634773 - DNA, 22 bp, Homo sapiens
agtgtaaacttaagagaatatc

SEQ ID NO: 7634774 - DNA, 22 bp, Homo sapiens
agtggtggagagatgaggacac

SEQ ID NO: 7634775 - DNA, 22 bp, Homo sapiens
agtggtgtgtcaggagcaaatt

SEQ ID NO: 7634776 - DNA, 22 bp, Homo sapiens
agtggtgtcgtgggagtggaag

SEQ ID NO: 7634777 - DNA, 22 bp, Homo sapiens
agtggttactcaagcaaatctc

SEQ ID NO: 7634778 - DNA, 22 bp, Homo sapiens
agtgtaagtgatcattgatagt

SEQ ID NO: 7634779 - DNA, 22 bp, Homo sapiens
agtgtaagtgatcattgatagt

SEQ ID NO: 7634780 - DNA, 22 bp, Homo sapiens
agtgtaagtgatcattgatagt

SEQ ID NO: 7634781 - DNA, 22 bp, Homo sapiens
agtgtacaaaatgatagataaa

SEQ ID NO: 7634782 - DNA, 22 bp, Homo sapiens
agtgtacaaaatgatagataaa

SEQ ID NO: 7634783 - DNA, 22 bp, Homo sapiens
agtggtgcccacctgagcctga

SEQ ID NO: 7634784 - DNA, 22 bp, Homo sapiens
agtggtgctaggtggaatatag

SEQ ID NO: 7634785 - DNA, 22 bp, Homo sapiens
agtggtgctaggtggaatatag

SEQ ID NO: 7634786 - DNA, 22 bp, Homo sapiens
agtggtgctgcgcgcggagctc

SEQ ID NO: 7634787 - DNA, 22 bp, Homo sapiens
agtggtgctgcgcgcggagctc

SEQ ID NO: 7634788 - DNA, 22 bp, Homo sapiens
agtggtggagagatgaggacac

SEQ ID NO: 7634789 - DNA, 22 bp, Homo sapiens
agtggtgctgcgcgcggagctc

SEQ ID NO: 7634790 - DNA, 22 bp, Homo sapiens
agtggtggagagatgaggacac

SEQ ID NO: 7634791 - DNA, 22 bp, Homo sapiens
agtggtggagagatgaggacac

SEQ ID NO: 7634792 - DNA, 22 bp, Homo sapiens
agtggtggagagatgaggacac

SEQ ID NO: 7634793 - DNA, 21 bp, Homo sapiens
agtggtctttttcacccagtg

SEQ ID NO: 7634794 - DNA, 22 bp, Homo sapiens
agtggtcttagcttgctgggct

SEQ ID NO: 7634795 - DNA, 21 bp, Homo sapiens
agtggtctttttcacccagtg

SEQ ID NO: 7634796 - DNA, 22 bp, Homo sapiens
agtggtgagacctggtgctttc

SEQ ID NO: 7634797 - DNA, 22 bp, Homo sapiens
agtggtgaggggcatgtgtgat

SEQ ID NO: 7634798 - DNA, 22 bp, Homo sapiens
agtggtgaggggcatgtgtgat

SEQ ID NO: 7634799 - DNA, 22 bp, Homo sapiens
agtggtgaggggcatgtgtgat

SEQ ID NO: 7634800 - DNA, 22 bp, Homo sapiens
agtggtgataaccgctatcata

SEQ ID NO: 7634801 - DNA, 22 bp, Homo sapiens
agtggtgcaaactggggcagct

SEQ ID NO: 7634802 - DNA, 22 bp, Homo sapiens
agtggtgatgtctctattattg

SEQ ID NO: 7634803 - DNA, 22 bp, Homo sapiens
agtggtgatgacagcagtttct

SEQ ID NO: 7634804 - DNA, 22 bp, Homo sapiens
agtggtgcaaactggggcagct

SEQ ID NO: 7634805 - DNA, 22 bp, Homo sapiens
agtggtgcaaactggggcagct

SEQ ID NO: 7634806 - DNA, 22 bp, Homo sapiens
agtggtgccattaaaatcattg

SEQ ID NO: 7634807 - DNA, 22 bp, Homo sapiens
ctcttcttggcccccatgaggg

SEQ ID NO: 7634808 - DNA, 22 bp, Homo sapiens
ctcttctttagtccagaccatc

SEQ ID NO: 7634809 - DNA, 22 bp, Homo sapiens
ctcttcttgtctctggttagaa

SEQ ID NO: 7634810 - DNA, 22 bp, Homo sapiens
ctcttctttagtccagaccatc

SEQ ID NO: 7634811 - DNA, 22 bp, Homo sapiens
ctcttctttccatccctagcca

SEQ ID NO: 7634812 - DNA, 22 bp, Homo sapiens
ctcttgaaaattggaacacaga

SEQ ID NO: 7634813 - DNA, 22 bp, Homo sapiens
ctcttagtaatgccatgaagca

SEQ ID NO: 7634814 - DNA, 22 bp, Homo sapiens
ctcttagtaatgccatgaagca

SEQ ID NO: 7634815 - DNA, 22 bp, Homo sapiens
ctcttagtaatgccatgaagca

SEQ ID NO: 7634816 - DNA, 22 bp, Homo sapiens
ctcttcttggcccccatgaggg

SEQ ID NO: 7634817 - DNA, 22 bp, Homo sapiens
ctcttcttggcccccatgaggg

SEQ ID NO: 7634818 - DNA, 22 bp, Homo sapiens
ctcttagtgcatctcattagtt

SEQ ID NO: 7634819 - DNA, 20 bp, Homo sapiens
ctcttagtactgttcctggt

SEQ ID NO: 7634820 - DNA, 21 bp, Homo sapiens
ctcttgaatgcttgataagat

SEQ ID NO: 7634821 - DNA, 22 bp, Homo sapiens
ctcttgaactttctagtttcat

SEQ ID NO: 7634822 - DNA, 22 bp, Homo sapiens
ctcttgaagcaggggccagttc

SEQ ID NO: 7634823 - DNA, 22 bp, Homo sapiens
ctcttgaagggcatctgagtta

SEQ ID NO: 7634824 - DNA, 22 bp, Homo sapiens
ctcttgaaaattggaacacaga

SEQ ID NO: 7634825 - DNA, 22 bp, Homo sapiens
ctcttgaaaattggaacacaga

SEQ ID NO: 7634826 - DNA, 22 bp, Homo sapiens
ctcttgaactttctagtttcat

SEQ ID NO: 7634827 - DNA, 22 bp, Homo sapiens
ctcttgaactttctagtttcat

SEQ ID NO: 7634828 - DNA, 22 bp, Homo sapiens
ctcttgagtggcatgctctaac

SEQ ID NO: 7634829 - DNA, 21 bp, Homo sapiens
ctcttgaatgcttgataagat

SEQ ID NO: 7634830 - DNA, 22 bp, Homo sapiens
ctcttgatgactgttgctggtt

SEQ ID NO: 7634831 - DNA, 22 bp, Homo sapiens
ctcttgatgactgttgctggtt

SEQ ID NO: 7634832 - DNA, 22 bp, Homo sapiens
ctcttgcagataccttgaagga

SEQ ID NO: 7634833 - DNA, 22 bp, Homo sapiens
ctcttgcatctgttgtattggt

SEQ ID NO: 7634834 - DNA, 22 bp, Homo sapiens
ctcttgcatgagatccaggagt

SEQ ID NO: 7634835 - DNA, 22 bp, Homo sapiens
ctcttgcatgagatccaggagt

SEQ ID NO: 7634836 - DNA, 22 bp, Homo sapiens
ctcttgcattctatccctccag

SEQ ID NO: 7634837 - DNA, 22 bp, Homo sapiens
ctcttgcattctatccctccag

SEQ ID NO: 7634838 - DNA, 22 bp, Homo sapiens
ctcttgcattctatccctccag

SEQ ID NO: 7634839 - DNA, 22 bp, Homo sapiens
ctcttgccagagatgagactct

SEQ ID NO: 7634840 - DNA, 21 bp, Homo sapiens
ctcttgctgatgtctccttta

SEQ ID NO: 7634841 - DNA, 22 bp, Homo sapiens
ctcttgccagagatgagactct

SEQ ID NO: 7634842 - DNA, 22 bp, Homo sapiens
ctcttgcttgcaagtggggata

SEQ ID NO: 7634843 - DNA, 22 bp, Homo sapiens
ctcttgctgtcaaagcagggta

SEQ ID NO: 7634844 - DNA, 22 bp, Homo sapiens
ctcttgctgtcaaagcagggta

SEQ ID NO: 7634845 - DNA, 21 bp, Homo sapiens
ctcttgctgatgtctccttta

SEQ ID NO: 7634846 - DNA, 22 bp, Homo sapiens
ctctttggcgttggcagagcca

SEQ ID NO: 7634847 - DNA, 22 bp, Homo sapiens
ctctttggcgttggcagagcca

SEQ ID NO: 7634848 - DNA, 21 bp, Homo sapiens
ctcttgtctttgctcagtagc

SEQ ID NO: 7634849 - DNA, 21 bp, Homo sapiens
ctcttgtctttgctcagtagc

SEQ ID NO: 7634850 - DNA, 22 bp, Homo sapiens
ctctttggcgttggcagagcca

SEQ ID NO: 7634851 - DNA, 16 bp, Homo sapiens
ctctttggcttccaag

SEQ ID NO: 7634852 - DNA, 22 bp, Homo sapiens
ctctttggctttgactcccatt

SEQ ID NO: 7634853 - DNA, 16 bp, Homo sapiens
ctctttggcttccaag

SEQ ID NO: 7634854 - DNA, 22 bp, Homo sapiens
ctctttggctttgactcccatt

SEQ ID NO: 7634855 - DNA, 22 bp, Homo sapiens
ctctttggctttgactcccatt

SEQ ID NO: 7634856 - DNA, 22 bp, Homo sapiens
ctcttggtaagacattagaggt

SEQ ID NO: 7634857 - DNA, 22 bp, Homo sapiens
ctcttgggtgggcagtgggcct

SEQ ID NO: 7634858 - DNA, 22 bp, Homo sapiens
ctcttgggtgggcagtgggcct

SEQ ID NO: 7634859 - DNA, 22 bp, Homo sapiens
ctcttgggtgggcagtgggcct

SEQ ID NO: 7634860 - DNA, 21 bp, Homo sapiens
ctcttgtctttgctcagtagc

SEQ ID NO: 7634861 - DNA, 22 bp, Homo sapiens
ctcttggtttgcctccatggac

SEQ ID NO: 7634862 - DNA, 22 bp, Homo sapiens
ctcttggtttgcctccatggac

SEQ ID NO: 7634863 - DNA, 22 bp, Homo sapiens
ctcttgtattggagttagtggg

SEQ ID NO: 7634864 - DNA, 21 bp, Homo sapiens
ctcttggtcctccctgtgacc

SEQ ID NO: 7634865 - DNA, 21 bp, Homo sapiens
ctcttggtcctccctgtgacc

SEQ ID NO: 7634866 - DNA, 22 bp, Homo sapiens
ctcttggtgggtggcctgttga

SEQ ID NO: 7634867 - DNA, 22 bp, Homo sapiens
ctcttggtgtgttctcctggga

SEQ ID NO: 7634868 - DNA, 22 bp, Homo sapiens
ctcttggtgtgttctcctggga

SEQ ID NO: 7634869 - DNA, 22 bp, Homo sapiens
ctcttgggatacactgccatag

SEQ ID NO: 7634870 - DNA, 22 bp, Homo sapiens
ctcttgggagtgctctggagaa

SEQ ID NO: 7634871 - DNA, 22 bp, Homo sapiens
ctcttgggagtgctctggagaa

SEQ ID NO: 7634872 - DNA, 22 bp, Homo sapiens
ctcttggccagacacagaggca

SEQ ID NO: 7634873 - DNA, 22 bp, Homo sapiens
ctcttggccagacacagaggca

SEQ ID NO: 7634874 - DNA, 22 bp, Homo sapiens
ctcttggccagacacagaggca

SEQ ID NO: 7634875 - DNA, 22 bp, Homo sapiens
ctcttgcttgcaagtggggata

SEQ ID NO: 7634876 - DNA, 22 bp, Homo sapiens
ctcttgggatttgcaggctcag

SEQ ID NO: 7634877 - DNA, 22 bp, Homo sapiens
ctcttgggatttgcaggctcag

SEQ ID NO: 7634878 - DNA, 22 bp, Homo sapiens
ctcttgggatttgcaggctcag

SEQ ID NO: 7634879 - DNA, 20 bp, Homo sapiens
ctcttgggcccaaagggcct

SEQ ID NO: 7634880 - DNA, 19 bp, Homo sapiens
ctcttgggtggcagaggcc

SEQ ID NO: 7634881 - DNA, 19 bp, Homo sapiens
ctcttgggtggcagaggcc

SEQ ID NO: 7634882 - DNA, 19 bp, Homo sapiens
ctcttgggtggcagaggcc

SEQ ID NO: 7634883 - DNA, 19 bp, Homo sapiens
ctcttgggtggcagaggcc

SEQ ID NO: 7634884 - DNA, 22 bp, Homo sapiens
ctccttgggttctttcggttcc

SEQ ID NO: 7634885 - DNA, 22 bp, Homo sapiens
ctccttggggtaaattgatgtg

SEQ ID NO: 7634886 - DNA, 22 bp, Homo sapiens
ctccttggggtaaattgatgtg

SEQ ID NO: 7634887 - DNA, 22 bp, Homo sapiens
ctccttggccgttaatgtcaca

SEQ ID NO: 7634888 - DNA, 23 bp, Homo sapiens
ctccttggtatgccatgcccagc

SEQ ID NO: 7634889 - DNA, 23 bp, Homo sapiens
ctccttggtatgccatgcccagc

SEQ ID NO: 7634890 - DNA, 23 bp, Homo sapiens
ctccttggtatgccatgcccagc

SEQ ID NO: 7634891 - DNA, 18 bp, Homo sapiens
ctccttggagaagaggcc

SEQ ID NO: 7634892 - DNA, 18 bp, Homo sapiens
ctccttggagaagaggcc

SEQ ID NO: 7634893 - DNA, 18 bp, Homo sapiens
ctccttggagaagaggcc

SEQ ID NO: 7634894 - DNA, 18 bp, Homo sapiens
ctccttggagaagaggcc

SEQ ID NO: 7634895 - DNA, 18 bp, Homo sapiens
ctccttggagaagaggcc

SEQ ID NO: 7634896 - DNA, 22 bp, Homo sapiens
ctccttggccgttaatgtcaca

SEQ ID NO: 7634897 - DNA, 18 bp, Homo sapiens
ctcctttccctacacctc

SEQ ID NO: 7634898 - DNA, 22 bp, Homo sapiens
ctccttttcctactcatactat

SEQ ID NO: 7634899 - DNA, 22 bp, Homo sapiens
ctccttttcctactcatactat

SEQ ID NO: 7634900 - DNA, 22 bp, Homo sapiens
ctcctttgatcccaaatgaccc

SEQ ID NO: 7634901 - DNA, 22 bp, Homo sapiens
ctcctttgatcccaaatgaccc

SEQ ID NO: 7634902 - DNA, 22 bp, Homo sapiens
ctccttggtgtagtactgagca

SEQ ID NO: 7634903 - DNA, 22 bp, Homo sapiens
ctccttggtgtagtactgagca

SEQ ID NO: 7634904 - DNA, 22 bp, Homo sapiens
ctccttggtgtagtactgagca

SEQ ID NO: 7634905 - DNA, 22 bp, Homo sapiens
ctccttggttcaaatgataaaa

SEQ ID NO: 7634906 - DNA, 22 bp, Homo sapiens
ctccttggttcaaatgataaaa

SEQ ID NO: 7634907 - DNA, 22 bp, Homo sapiens
ctccttggttcaaatgataaaa

SEQ ID NO: 7634908 - DNA, 22 bp, Homo sapiens
ctcgctatgcttttgctctgtg

SEQ ID NO: 7634909 - DNA, 22 bp, Homo sapiens
ctcgctggcttttccggttccc

SEQ ID NO: 7634910 - DNA, 22 bp, Homo sapiens
ctcgcggcgcccgaagcccttg

SEQ ID NO: 7634911 - DNA, 22 bp, Homo sapiens
ctcgcgttccagctgcgggccg

SEQ ID NO: 7634912 - DNA, 22 bp, Homo sapiens
ctcgcctgagtttgaatgctgg

SEQ ID NO: 7634913 - DNA, 22 bp, Homo sapiens
ctcgcctgcctgtgtctctccc

SEQ ID NO: 7634914 - DNA, 22 bp, Homo sapiens
ctcggagatgctggctgagatc

SEQ ID NO: 7634915 - DNA, 22 bp, Homo sapiens
ctcggagatgctggctgagatc

SEQ ID NO: 7634916 - DNA, 22 bp, Homo sapiens
ctcggaagcctgaagattttaa

SEQ ID NO: 7634917 - DNA, 22 bp, Homo sapiens
ctccttttcctactcatactat

SEQ ID NO: 7634918 - DNA, 22 bp, Homo sapiens
ctccttttcctactcatactat

SEQ ID NO: 7634919 - DNA, 22 bp, Homo sapiens
ctcgagagatcctcttgccacc

SEQ ID NO: 7634920 - DNA, 22 bp, Homo sapiens
ctcgagtttccacagtttgcat

SEQ ID NO: 7634921 - DNA, 22 bp, Homo sapiens
ctcgcaggacagtgctaggact

SEQ ID NO: 7634922 - DNA, 22 bp, Homo sapiens
ctcgcatgccctgcctcatcca

SEQ ID NO: 7634923 - DNA, 22 bp, Homo sapiens
ctcctgcatgctcacatatgcc

SEQ ID NO: 7634924 - DNA, 22 bp, Homo sapiens
ctcctgcaggtcagcaggcttg

SEQ ID NO: 7634925 - DNA, 22 bp, Homo sapiens
ctcctgcatgctcacatatgcc

SEQ ID NO: 7634926 - DNA, 22 bp, Homo sapiens
ctcctgccaccgcggtgtcctg

SEQ ID NO: 7634927 - DNA, 22 bp, Homo sapiens
ctcctgccaccgcggtgtcctg

SEQ ID NO: 7634928 - DNA, 22 bp, Homo sapiens
ctcctgcatggttgtgctattg

SEQ ID NO: 7634929 - DNA, 22 bp, Homo sapiens
ctcctggtgctggggctgccgc

SEQ ID NO: 7634930 - DNA, 22 bp, Homo sapiens
ctcctggtgctggggctgccgc

SEQ ID NO: 7634931 - DNA, 22 bp, Homo sapiens
ctcctgccaccgcggtgtcctg

SEQ ID NO: 7634932 - DNA, 22 bp, Homo sapiens
ctccttctgaggctctgggttc

SEQ ID NO: 7634933 - DNA, 22 bp, Homo sapiens
ctcctggttcagagagctgaga

SEQ ID NO: 7634934 - DNA, 22 bp, Homo sapiens
ctcctggttcagagagctgaga

SEQ ID NO: 7634935 - DNA, 22 bp, Homo sapiens
ctcctggtgctggggctgccgc

SEQ ID NO: 7634936 - DNA, 22 bp, Homo sapiens
ctcctggttcagagagctgaga

SEQ ID NO: 7634937 - DNA, 22 bp, Homo sapiens
ctcctgaggggacaggactcat

SEQ ID NO: 7634938 - DNA, 22 bp, Homo sapiens
ctcctgaggggacaggactcat

SEQ ID NO: 7634939 - DNA, 22 bp, Homo sapiens
ctcctgaggggacaggactcat

SEQ ID NO: 7634940 - DNA, 22 bp, Homo sapiens
ctcctgaggggacaggactcat

SEQ ID NO: 7634941 - DNA, 22 bp, Homo sapiens
ctcctgaggggacaggactcat

SEQ ID NO: 7634942 - DNA, 22 bp, Homo sapiens
ctcctgagtagtagcattgtca

SEQ ID NO: 7634943 - DNA, 22 bp, Homo sapiens
ctcctgagtagtagcattgtca

SEQ ID NO: 7634944 - DNA, 22 bp, Homo sapiens
ctcctgaggggacaggactcat

SEQ ID NO: 7634945 - DNA, 22 bp, Homo sapiens
ctcctgagtctccacgccccgt

SEQ ID NO: 7634946 - DNA, 22 bp, Homo sapiens
ctcctgagtctccacgccccgt

SEQ ID NO: 7634947 - DNA, 17 bp, Homo sapiens
ctcctgagtgaaaggga

SEQ ID NO: 7634948 - DNA, 17 bp, Homo sapiens
ctcctgagtgaaaggga

SEQ ID NO: 7634949 - DNA, 22 bp, Homo sapiens
ctcctgagtctccacgccccgt

SEQ ID NO: 7634950 - DNA, 22 bp, Homo sapiens
ctcctgagtctccacgccccgt

SEQ ID NO: 7634951 - DNA, 22 bp, Homo sapiens
ctcctgagtagtagcattgtca

SEQ ID NO: 7634952 - DNA, 22 bp, Homo sapiens
ctcctgagtagtagcattgtca

SEQ ID NO: 7634953 - DNA, 22 bp, Homo sapiens
ctcctgcaggtcagcaggcttg

SEQ ID NO: 7634954 - DNA, 22 bp, Homo sapiens
ctcctgcaggtcagcaggcttg

SEQ ID NO: 7634955 - DNA, 22 bp, Homo sapiens
ctcctgcaagcctccccaagca

SEQ ID NO: 7634956 - DNA, 22 bp, Homo sapiens
ctcctgcaagcctccccaagca

SEQ ID NO: 7634957 - DNA, 22 bp, Homo sapiens
ctcctgagggatgcttaggctt

SEQ ID NO: 7634958 - DNA, 22 bp, Homo sapiens
ctcctgagggatgcttaggctt

SEQ ID NO: 7634959 - DNA, 22 bp, Homo sapiens
ctcctgagggatgcttaggctt

SEQ ID NO: 7634960 - DNA, 22 bp, Homo sapiens
ctcctgaggacttctattgggt

SEQ ID NO: 7634961 - DNA, 22 bp, Homo sapiens
ctcctgaggacttctattgggt

SEQ ID NO: 7634962 - DNA, 22 bp, Homo sapiens
ctcctgaggggacaggactcat

SEQ ID NO: 7634963 - DNA, 22 bp, Homo sapiens
ctcctgaggggacaggactcat

SEQ ID NO: 7634964 - DNA, 22 bp, Homo sapiens
ctcctgagggatgcttaggctt

SEQ ID NO: 7634965 - DNA, 22 bp, Homo sapiens
ctcctgagggatgcttaggctt

SEQ ID NO: 7634966 - DNA, 22 bp, Homo sapiens
ctcctgagggatgcttaggctt

SEQ ID NO: 7634967 - DNA, 22 bp, Homo sapiens
ctcctgagggatgcttaggctt

SEQ ID NO: 7634968 - DNA, 22 bp, Homo sapiens
ctcctgagctgcagccttgtgt

SEQ ID NO: 7634969 - DNA, 22 bp, Homo sapiens
ctcctgaggaaaagcttggtca

SEQ ID NO: 7634970 - DNA, 22 bp, Homo sapiens
ctcctgaggaaaagcttggtca

SEQ ID NO: 7634971 - DNA, 22 bp, Homo sapiens
agtgctggattacaggcgtgag

SEQ ID NO: 7634972 - DNA, 22 bp, Homo sapiens
ctcctgaggaaaagcttggtca

SEQ ID NO: 7634973 - DNA, 22 bp, Homo sapiens
ctcctgaggaaaagcttggtca

SEQ ID NO: 7634974 - DNA, 22 bp, Homo sapiens
ctcctgaggaaaagcttggtca

SEQ ID NO: 7634975 - DNA, 22 bp, Homo sapiens
ctcctgaggaaaagcttggtca

SEQ ID NO: 7634976 - DNA, 22 bp, Homo sapiens
agtgctggattacaggcgtgag

SEQ ID NO: 7634977 - DNA, 22 bp, Homo sapiens
agtgctggattacaggcgtgag

SEQ ID NO: 7634978 - DNA, 22 bp, Homo sapiens
agtgctggattacaggcgtgag

SEQ ID NO: 7634979 - DNA, 22 bp, Homo sapiens
agtgctggattacaggcgtgag

SEQ ID NO: 7634980 - DNA, 22 bp, Homo sapiens
agtgctggattacaggcgtgag

SEQ ID NO: 7634981 - DNA, 22 bp, Homo sapiens
agtgctggattacaggcgtgag

SEQ ID NO: 7634982 - DNA, 22 bp, Homo sapiens
agtgctggattacaggcgtgag

SEQ ID NO: 7634983 - DNA, 22 bp, Homo sapiens
agtgctggagggaggcaggttc

SEQ ID NO: 7634984 - DNA, 22 bp, Homo sapiens
agtgctggagggaggcaggttc

SEQ ID NO: 7634985 - DNA, 22 bp, Homo sapiens
agtgctggagggaggcaggttc

SEQ ID NO: 7634986 - DNA, 22 bp, Homo sapiens
agtgctggagggaggcaggttc

SEQ ID NO: 7634987 - DNA, 22 bp, Homo sapiens
agtgctggagggaggcaggttc

SEQ ID NO: 7634988 - DNA, 22 bp, Homo sapiens
agtgctggattacaggcgtgag

SEQ ID NO: 7634989 - DNA, 22 bp, Homo sapiens
agtgctggattacaggcgtgag

SEQ ID NO: 7634990 - DNA, 22 bp, Homo sapiens
agtgctataaaggtagaccaca

SEQ ID NO: 7634991 - DNA, 22 bp, Homo sapiens
ctccagagagtccagctctggg

SEQ ID NO: 7634992 - DNA, 22 bp, Homo sapiens
ctccagagagtccagctctggg

SEQ ID NO: 7634993 - DNA, 22 bp, Homo sapiens
ctccagagagtccagctctggg

SEQ ID NO: 7634994 - DNA, 22 bp, Homo sapiens
ctccagagagtccagctctggg

SEQ ID NO: 7634995 - DNA, 22 bp, Homo sapiens
ctccagagagtccagctctggg

SEQ ID NO: 7634996 - DNA, 22 bp, Homo sapiens
ctccagagagtccagctctggg

SEQ ID NO: 7634997 - DNA, 22 bp, Homo sapiens
ctccagagagtccagctctggg

SEQ ID NO: 7634998 - DNA, 22 bp, Homo sapiens
ctccagagagtccagctctggg

SEQ ID NO: 7634999 - DNA, 22 bp, Homo sapiens
ctccagagagtccagctctggg

SEQ ID NO: 7635000 - DNA, 22 bp, Homo sapiens
ctccagagagtccagctctggg

SEQ ID NO: 7635001 - DNA, 22 bp, Homo sapiens
agtgctatcgagttctaatgct

SEQ ID NO: 7635002 - DNA, 22 bp, Homo sapiens
agtgctatcgagttctaatgct

SEQ ID NO: 7635003 - DNA, 22 bp, Homo sapiens
agtgctatcgagttctaatgct

SEQ ID NO: 7635004 - DNA, 22 bp, Homo sapiens
agtgctatcgagttctaatgct

SEQ ID NO: 7635005 - DNA, 22 bp, Homo sapiens
agtgctatcgagttctaatgct

SEQ ID NO: 7635006 - DNA, 23 bp, Homo sapiens
agtgctgaattgaaagctccagg

SEQ ID NO: 7635007 - DNA, 22 bp, Homo sapiens
agtgctatcgagttctaatgct

SEQ ID NO: 7635008 - DNA, 22 bp, Homo sapiens
agtgctgactctgggcacagtg

SEQ ID NO: 7635009 - DNA, 22 bp, Homo sapiens
agtgctggagggaggcaggttc

SEQ ID NO: 7635010 - DNA, 22 bp, Homo sapiens
agtgctggagggaggcaggttc

SEQ ID NO: 7635011 - DNA, 22 bp, Homo sapiens
agtgctggagggaggcaggttc

SEQ ID NO: 7635012 - DNA, 23 bp, Homo sapiens
agtgctggagaagcttctggctt

SEQ ID NO: 7635013 - DNA, 23 bp, Homo sapiens
agtgctggagaagcttctggctt

SEQ ID NO: 7635014 - DNA, 23 bp, Homo sapiens
agtgctggagaagcttctggctt

SEQ ID NO: 7635015 - DNA, 23 bp, Homo sapiens
agtgctggagaagcttctggctt

SEQ ID NO: 7635016 - DNA, 22 bp, Homo sapiens
agtgctggaaagggacggagga

SEQ ID NO: 7635017 - DNA, 22 bp, Homo sapiens
agtgctgagtgattgcaaagga

SEQ ID NO: 7635018 - DNA, 22 bp, Homo sapiens
agtgctggaaagggacggagga

SEQ ID NO: 7635019 - DNA, 22 bp, Homo sapiens
agtgctggaaagggacggagga

SEQ ID NO: 7635020 - DNA, 22 bp, Homo sapiens
agtgctggaaagggacggagga

SEQ ID NO: 7635021 - DNA, 22 bp, Homo sapiens
agtgctggaaagggacggagga

SEQ ID NO: 7635022 - DNA, 22 bp, Homo sapiens
agtgctgactctgggcacagtg

SEQ ID NO: 7635023 - DNA, 22 bp, Homo sapiens
agtgctgaggccatactccata

SEQ ID NO: 7635024 - DNA, 22 bp, Homo sapiens
agtgctgaggagaggtactcca

SEQ ID NO: 7635025 - DNA, 22 bp, Homo sapiens
ctctcccagtcaggctcaggat

SEQ ID NO: 7635026 - DNA, 22 bp, Homo sapiens
ctctcccagtcaggctcaggat

SEQ ID NO: 7635027 - DNA, 22 bp, Homo sapiens
ctctcccagtcaggctcaggat

SEQ ID NO: 7635028 - DNA, 22 bp, Homo sapiens
ctctcccagtcaggctcaggat

SEQ ID NO: 7635029 - DNA, 20 bp, Homo sapiens
ctctcccagcacagcttcct

SEQ ID NO: 7635030 - DNA, 20 bp, Homo sapiens
ctctcccagcacagcttcct

SEQ ID NO: 7635031 - DNA, 20 bp, Homo sapiens
ctctcccagcacagcttcct

SEQ ID NO: 7635032 - DNA, 20 bp, Homo sapiens
ctctcccagcacagcttcct

SEQ ID NO: 7635033 - DNA, 20 bp, Homo sapiens
ctctcccagcacagcttcct

SEQ ID NO: 7635034 - DNA, 20 bp, Homo sapiens
ctctcccagcacagcttcct

SEQ ID NO: 7635035 - DNA, 20 bp, Homo sapiens
ctctcccagcacagcttcct

SEQ ID NO: 7635036 - DNA, 20 bp, Homo sapiens
ctctcccagcacagcttcct

SEQ ID NO: 7635037 - DNA, 20 bp, Homo sapiens
ctctcccagcacagcttcct

SEQ ID NO: 7635038 - DNA, 22 bp, Homo sapiens
ctctccccacaccctctgcatg

SEQ ID NO: 7635039 - DNA, 17 bp, Homo sapiens
ctctccttcctctgagg

SEQ ID NO: 7635040 - DNA, 22 bp, Homo sapiens
ctctccccacaccctctgcatg

SEQ ID NO: 7635041 - DNA, 22 bp, Homo sapiens
ctctccccacaccctctgcatg

SEQ ID NO: 7635042 - DNA, 22 bp, Homo sapiens
ctctccccacaccctctgcatg

SEQ ID NO: 7635043 - DNA, 22 bp, Homo sapiens
ctctccccacaccctctgcatg

SEQ ID NO: 7635044 - DNA, 22 bp, Homo sapiens
ctctcccagtcaggctcaggat

SEQ ID NO: 7635045 - DNA, 22 bp, Homo sapiens
ctctccccacaccctctgcatg

SEQ ID NO: 7635046 - DNA, 22 bp, Homo sapiens
ctctccccacaccctctgcatg

SEQ ID NO: 7635047 - DNA, 22 bp, Homo sapiens
ctctcccagtcaggctcaggat

SEQ ID NO: 7635048 - DNA, 22 bp, Homo sapiens
ctctcccagtcaggctcaggat

SEQ ID NO: 7635049 - DNA, 22 bp, Homo sapiens
ctctcccagtcaggctcaggat

SEQ ID NO: 7635050 - DNA, 22 bp, Homo sapiens
ctctcccagtcaggctcaggat

SEQ ID NO: 7635051 - DNA, 22 bp, Homo sapiens
ctctcccagtcaggctcaggat

SEQ ID NO: 7635052 - DNA, 22 bp, Homo sapiens
ctctccccacaccctctgcatg

SEQ ID NO: 7635053 - DNA, 22 bp, Homo sapiens
ctctccccacaccctctgcatg

SEQ ID NO: 7635054 - DNA, 22 bp, Homo sapiens
ctctccccacaccctctgcatg

SEQ ID NO: 7635055 - DNA, 22 bp, Homo sapiens
ctctccccacaccctctgcatg

SEQ ID NO: 7635056 - DNA, 22 bp, Homo sapiens
ctctcccagtcaggctcaggat

SEQ ID NO: 7635057 - DNA, 22 bp, Homo sapiens
ctctcccagtcaggctcaggat

SEQ ID NO: 7635058 - DNA, 22 bp, Homo sapiens
ctctctcagtgtaatacaggat

SEQ ID NO: 7635059 - DNA, 22 bp, Homo sapiens
ctctctcagtgtaatacaggat

SEQ ID NO: 7635060 - DNA, 19 bp, Homo sapiens
ctctctccagtggctggct

SEQ ID NO: 7635061 - DNA, 19 bp, Homo sapiens
ctctctccagtggctggct

SEQ ID NO: 7635062 - DNA, 22 bp, Homo sapiens
ctctctagaggcccaccttgag

SEQ ID NO: 7635063 - DNA, 22 bp, Homo sapiens
ctctctagaggcccaccttgag

SEQ ID NO: 7635064 - DNA, 22 bp, Homo sapiens
ctctctagaggcccaccttgag

SEQ ID NO: 7635065 - DNA, 22 bp, Homo sapiens
ctctcgcgtgtgcctttccgct

SEQ ID NO: 7635066 - DNA, 22 bp, Homo sapiens
ctctctaacgacattcccattc

SEQ ID NO: 7635067 - DNA, 22 bp, Homo sapiens
ctctctaacgacattcccattc

SEQ ID NO: 7635068 - DNA, 22 bp, Homo sapiens
ctctcgccagcggggctgcgct

SEQ ID NO: 7635069 - DNA, 22 bp, Homo sapiens
ctctcgccagcggggctgcgct

SEQ ID NO: 7635070 - DNA, 22 bp, Homo sapiens
ctctcctttactgcagagagcg

SEQ ID NO: 7635071 - DNA, 22 bp, Homo sapiens
ctctcctttactgcagagagcg

SEQ ID NO: 7635072 - DNA, 22 bp, Homo sapiens
ctctcctttgaagcaactgtat

SEQ ID NO: 7635073 - DNA, 22 bp, Homo sapiens
ctctcctttcactaaatattct

SEQ ID NO: 7635074 - DNA, 17 bp, Homo sapiens
ctctccttcctctgagg

SEQ ID NO: 7635075 - DNA, 22 bp, Homo sapiens
ctctccttgcagatggctgcct

SEQ ID NO: 7635076 - DNA, 22 bp, Homo sapiens
ctctccttgcagatggctgcct

SEQ ID NO: 7635077 - DNA, 22 bp, Homo sapiens
ctctccttgcagatggctgcct

SEQ ID NO: 7635078 - DNA, 22 bp, Homo sapiens
ctctccttgcagatggctgcct

SEQ ID NO: 7635079 - DNA, 22 bp, Homo sapiens
ctctccttgcagatggctgcct

SEQ ID NO: 7635080 - DNA, 22 bp, Homo sapiens
agtgctggcccatagctgctgg

SEQ ID NO: 7635081 - DNA, 22 bp, Homo sapiens
agtgctgggattacaggcataa

SEQ ID NO: 7635082 - DNA, 22 bp, Homo sapiens
agtgctggcccatagctgctgg

SEQ ID NO: 7635083 - DNA, 22 bp, Homo sapiens
agtgctgggattacaggcataa

SEQ ID NO: 7635084 - DNA, 22 bp, Homo sapiens
agtgctgggattacaggcataa

SEQ ID NO: 7635085 - DNA, 22 bp, Homo sapiens
agtgctgggattacaggcataa

SEQ ID NO: 7635086 - DNA, 22 bp, Homo sapiens
agtgctgggattacaggcataa

SEQ ID NO: 7635087 - DNA, 22 bp, Homo sapiens
agtgctgggattacaggcataa

SEQ ID NO: 7635088 - DNA, 22 bp, Homo sapiens
agtgctgggattgcaggcatga

SEQ ID NO: 7635089 - DNA, 22 bp, Homo sapiens
agtgctgggattgcaggcatga

SEQ ID NO: 7635090 - DNA, 22 bp, Homo sapiens
agtgctgggattgcaggcatga

SEQ ID NO: 7635091 - DNA, 22 bp, Homo sapiens
agtgctgggattacaggcataa

SEQ ID NO: 7635092 - DNA, 22 bp, Homo sapiens
agtgctgggattgcaggcatga

SEQ ID NO: 7635093 - DNA, 22 bp, Homo sapiens
agtgctgggattacaggcataa

SEQ ID NO: 7635094 - DNA, 22 bp, Homo sapiens
agtgctgggattacaggcataa

SEQ ID NO: 7635095 - DNA, 22 bp, Homo sapiens
agtgctgggattacaggcataa

SEQ ID NO: 7635096 - DNA, 22 bp, Homo sapiens
agtgctgggattacaggcataa

SEQ ID NO: 7635097 - DNA, 22 bp, Homo sapiens
agtgctgggattacaggcataa

SEQ ID NO: 7635098 - DNA, 22 bp, Homo sapiens
agtgctggcccatagctgctgg

SEQ ID NO: 7635099 - DNA, 22 bp, Homo sapiens
agtgctggcccatagctgctgg

SEQ ID NO: 7635100 - DNA, 22 bp, Homo sapiens
agtgctggcccatagctgctgg

SEQ ID NO: 7635101 - DNA, 22 bp, Homo sapiens
agtgctggcccatagctgctgg

SEQ ID NO: 7635102 - DNA, 22 bp, Homo sapiens
agtgctggcccatagctgctgg

SEQ ID NO: 7635103 - DNA, 22 bp, Homo sapiens
agtgctggcccatagctgctgg

SEQ ID NO: 7635104 - DNA, 22 bp, Homo sapiens
ctcgggcaccctggttctggtg

SEQ ID NO: 7635105 - DNA, 22 bp, Homo sapiens
ctcggctgtgtgggtcccgggc

SEQ ID NO: 7635106 - DNA, 22 bp, Homo sapiens
ctcggctgtgtgggtcccgggc

SEQ ID NO: 7635107 - DNA, 22 bp, Homo sapiens
ctcgggcaccctggttctggtg

SEQ ID NO: 7635108 - DNA, 22 bp, Homo sapiens
ctcgggcaccctggttctggtg

SEQ ID NO: 7635109 - DNA, 22 bp, Homo sapiens
ctcggcaggtggaggttgtagt

SEQ ID NO: 7635110 - DNA, 22 bp, Homo sapiens
ctcggcaggtggaggttgtagt

SEQ ID NO: 7635111 - DNA, 22 bp, Homo sapiens
ctcggcaggtggaggttgtagt

SEQ ID NO: 7635112 - DNA, 22 bp, Homo sapiens
ctcggcaggtggaggttgtagt

SEQ ID NO: 7635113 - DNA, 22 bp, Homo sapiens
ctcggcaggtggaggttgtagt

SEQ ID NO: 7635114 - DNA, 22 bp, Homo sapiens
agtgctgggtactgttcccatt

SEQ ID NO: 7635115 - DNA, 22 bp, Homo sapiens
agtgctgggtactgttcccatt

SEQ ID NO: 7635116 - DNA, 22 bp, Homo sapiens
agtgctgggctatctactgcta

SEQ ID NO: 7635117 - DNA, 22 bp, Homo sapiens
agtgctgggctatctactgcta

SEQ ID NO: 7635118 - DNA, 22 bp, Homo sapiens
agtgctgggctatctactgcta

SEQ ID NO: 7635119 - DNA, 23 bp, Homo sapiens
ctctccaccttcccacccaggga

SEQ ID NO: 7635120 - DNA, 22 bp, Homo sapiens
ctctccaagttatcaagatgaa

SEQ ID NO: 7635121 - DNA, 22 bp, Homo sapiens
agtgctgggattgcaggcatga

SEQ ID NO: 7635122 - DNA, 22 bp, Homo sapiens
agtgctgggctatctactgcta

SEQ ID NO: 7635123 - DNA, 22 bp, Homo sapiens
agtgctgggctatctactgcta

SEQ ID NO: 7635124 - DNA, 22 bp, Homo sapiens
agtgctgggattgcaggcatga

SEQ ID NO: 7635125 - DNA, 22 bp, Homo sapiens
agtgctgggattgcaggcatga

SEQ ID NO: 7635126 - DNA, 22 bp, Homo sapiens
agtgctgggattgcaggcatga

SEQ ID NO: 7635127 - DNA, 22 bp, Homo sapiens
agtgctgggattgcaggcatga

SEQ ID NO: 7635128 - DNA, 22 bp, Homo sapiens
agtgctgggattgcaggcatga

SEQ ID NO: 7635129 - DNA, 22 bp, Homo sapiens
agtgctgggattgcaggcatga

SEQ ID NO: 7635130 - DNA, 22 bp, Homo sapiens
agtgctgggattgcaggcatga

SEQ ID NO: 7635131 - DNA, 22 bp, Homo sapiens
ctctccattccctacagttttc

SEQ ID NO: 7635132 - DNA, 22 bp, Homo sapiens
ctctccattccctacagttttc

SEQ ID NO: 7635133 - DNA, 22 bp, Homo sapiens
ctctccattccctacagttttc

SEQ ID NO: 7635134 - DNA, 22 bp, Homo sapiens
ctctccattccctacagttttc

SEQ ID NO: 7635135 - DNA, 22 bp, Homo sapiens
ctctccattccctacagttttc

SEQ ID NO: 7635136 - DNA, 22 bp, Homo sapiens
ctctccattccctacagttttc

SEQ ID NO: 7635137 - DNA, 22 bp, Homo sapiens
ctctccattccctacagttttc

SEQ ID NO: 7635138 - DNA, 22 bp, Homo sapiens
ctctccattccctacagttttc

SEQ ID NO: 7635139 - DNA, 20 bp, Homo sapiens
ctctcccagcacagcttcct

SEQ ID NO: 7635140 - DNA, 22 bp, Homo sapiens
ctctccattccctacagttttc

SEQ ID NO: 7635141 - DNA, 22 bp, Homo sapiens
ctctccattccctacagttttc

SEQ ID NO: 7635142 - DNA, 22 bp, Homo sapiens
ctctccagttatagctgatttg

SEQ ID NO: 7635143 - DNA, 23 bp, Homo sapiens
ctctccaccttcccacccaggga

SEQ ID NO: 7635144 - DNA, 22 bp, Homo sapiens
ctctccatctgtgtgacctccc

SEQ ID NO: 7635145 - DNA, 22 bp, Homo sapiens
ctctccatctgtgtgacctccc

SEQ ID NO: 7635146 - DNA, 22 bp, Homo sapiens
ctctccatctgtgtgacctccc

SEQ ID NO: 7635147 - DNA, 22 bp, Homo sapiens
ctcagatgtttgatattgttat

SEQ ID NO: 7635148 - DNA, 22 bp, Homo sapiens
ctcagatgtagaaagattgtga

SEQ ID NO: 7635149 - DNA, 22 bp, Homo sapiens
ctcagataatctttgagtcttc

SEQ ID NO: 7635150 - DNA, 22 bp, Homo sapiens
ctcagatctttcccattttccc

SEQ ID NO: 7635151 - DNA, 22 bp, Homo sapiens
ctcagatcatcagaaacaatgt

SEQ ID NO: 7635152 - DNA, 22 bp, Homo sapiens
ctcagcaacacggcctattaag

SEQ ID NO: 7635153 - DNA, 22 bp, Homo sapiens
ctcagatgtttgatattgttat

SEQ ID NO: 7635154 - DNA, 22 bp, Homo sapiens
ctcagattctgaataataaaca

SEQ ID NO: 7635155 - DNA, 19 bp, Homo sapiens
ctcagcaagatagaaatgg

SEQ ID NO: 7635156 - DNA, 19 bp, Homo sapiens
ctcagcaagatagaaatgg

SEQ ID NO: 7635157 - DNA, 22 bp, Homo sapiens
ctcagcaagacccccaccgtgt

SEQ ID NO: 7635158 - DNA, 22 bp, Homo sapiens
ctcagcaaccctagaacatttg

SEQ ID NO: 7635159 - DNA, 19 bp, Homo sapiens
ctcagcaagatagaaatgg

SEQ ID NO: 7635160 - DNA, 22 bp, Homo sapiens
ctcagcaattacctgtgtctct

SEQ ID NO: 7635161 - DNA, 22 bp, Homo sapiens
ctcagcaagattaagcagcttg

SEQ ID NO: 7635162 - DNA, 22 bp, Homo sapiens
ctcagcaagattaagcagcttg

SEQ ID NO: 7635163 - DNA, 22 bp, Homo sapiens
ctcagataatctttgagtcttc

SEQ ID NO: 7635164 - DNA, 22 bp, Homo sapiens
ctcagataatctttgagtcttc

SEQ ID NO: 7635165 - DNA, 22 bp, Homo sapiens
ctcagagtggggctccctgagg

SEQ ID NO: 7635166 - DNA, 22 bp, Homo sapiens
ctcagagttctcctgggaggtg

SEQ ID NO: 7635167 - DNA, 22 bp, Homo sapiens
ctcagagtggggctccctgagg

SEQ ID NO: 7635168 - DNA, 22 bp, Homo sapiens
ctcagagtccatagtttacagt

SEQ ID NO: 7635169 - DNA, 22 bp, Homo sapiens
ctcagagtccccacatctgggt

SEQ ID NO: 7635170 - DNA, 22 bp, Homo sapiens
ctcagagtccccacatctgggt

SEQ ID NO: 7635171 - DNA, 22 bp, Homo sapiens
ctcagagtccccagtgggtttg

SEQ ID NO: 7635172 - DNA, 22 bp, Homo sapiens
ctcagagtcccttccctcgtgg

SEQ ID NO: 7635173 - DNA, 23 bp, Homo sapiens
ctcagaggtgtttttcacttact

SEQ ID NO: 7635174 - DNA, 22 bp, Homo sapiens
ctcagaggtggatgccttgtgg

SEQ ID NO: 7635175 - DNA, 23 bp, Homo sapiens
ctcagaggtgtttttcacttact

SEQ ID NO: 7635176 - DNA, 23 bp, Homo sapiens
ctcagaggtgtttttcacttact

SEQ ID NO: 7635177 - DNA, 23 bp, Homo sapiens
ctcagaggtgtttttcacttact

SEQ ID NO: 7635178 - DNA, 22 bp, Homo sapiens
ctcagaggtggatgccttgtgg

SEQ ID NO: 7635179 - DNA, 22 bp, Homo sapiens
ctcagaggtggatgccttgtgg

SEQ ID NO: 7635180 - DNA, 22 bp, Homo sapiens
ctcagaggtggatgccttgtgg

SEQ ID NO: 7635181 - DNA, 22 bp, Homo sapiens
ctcagaggtggatgccttgtgg

SEQ ID NO: 7635182 - DNA, 22 bp, Homo sapiens
ctcagaggtcaagagcagagct

SEQ ID NO: 7635183 - DNA, 22 bp, Homo sapiens
ctcagaggtcaagagcagagct

SEQ ID NO: 7635184 - DNA, 22 bp, Homo sapiens
ctcagaggtcaagagcagagct

SEQ ID NO: 7635185 - DNA, 22 bp, Homo sapiens
ctcagaggtcaagagcagagct

SEQ ID NO: 7635186 - DNA, 22 bp, Homo sapiens
ctcagactaaaatgggaatgta

SEQ ID NO: 7635187 - DNA, 22 bp, Homo sapiens
ctcagactaaaatgggaatgta

SEQ ID NO: 7635188 - DNA, 22 bp, Homo sapiens
ctcagactaaaatgggaatgta

SEQ ID NO: 7635189 - DNA, 22 bp, Homo sapiens
ctcagactggagccccaaggac

SEQ ID NO: 7635190 - DNA, 22 bp, Homo sapiens
ctcagacttgctttttatggaa

SEQ ID NO: 7635191 - DNA, 22 bp, Homo sapiens
ctcagactggagccccaaggac

SEQ ID NO: 7635192 - DNA, 22 bp, Homo sapiens
ctcagactggggctccctgagt

SEQ ID NO: 7635193 - DNA, 21 bp, Homo sapiens
ctcagaccacagctcacaccc

SEQ ID NO: 7635194 - DNA, 21 bp, Homo sapiens
ctcagaccacagctcacaccc

SEQ ID NO: 7635195 - DNA, 18 bp, Homo sapiens
ctcagacatgcttctttt

SEQ ID NO: 7635196 - DNA, 18 bp, Homo sapiens
ctcagacatgcttctttt

SEQ ID NO: 7635197 - DNA, 18 bp, Homo sapiens
ctcagacatgcttctttt

SEQ ID NO: 7635198 - DNA, 18 bp, Homo sapiens
ctcagacatgcttctttt

SEQ ID NO: 7635199 - DNA, 22 bp, Homo sapiens
ctcagacttttgttcaacgagt

SEQ ID NO: 7635200 - DNA, 22 bp, Homo sapiens
ctcagagaaaaggagcaagggt

SEQ ID NO: 7635201 - DNA, 22 bp, Homo sapiens
ctcagagaaaaggagcaagggt

SEQ ID NO: 7635202 - DNA, 22 bp, Homo sapiens
ctcagaggggatgcttggagaa

SEQ ID NO: 7635203 - DNA, 22 bp, Homo sapiens
ctcagagggttgaaggtgctct

SEQ ID NO: 7635204 - DNA, 22 bp, Homo sapiens
ctcagagggttgaaggtgctct

SEQ ID NO: 7635205 - DNA, 22 bp, Homo sapiens
ctcagagggtctcctccagaat

SEQ ID NO: 7635206 - DNA, 22 bp, Homo sapiens
ctcagagggtacaggtgaaccc

SEQ ID NO: 7635207 - DNA, 22 bp, Homo sapiens
ctcagagggtacaggtgaaccc

SEQ ID NO: 7635208 - DNA, 22 bp, Homo sapiens
ctcagagggtctcctccagaat

SEQ ID NO: 7635209 - DNA, 22 bp, Homo sapiens
ctcagagggtctcctccagaat

SEQ ID NO: 7635210 - DNA, 22 bp, Homo sapiens
ctcagaggtcaagagcagagct

SEQ ID NO: 7635211 - DNA, 22 bp, Homo sapiens
ctcagaggtcaagagcagagct

SEQ ID NO: 7635212 - DNA, 22 bp, Homo sapiens
ctcagaggtcaagagcagagct

SEQ ID NO: 7635213 - DNA, 22 bp, Homo sapiens
ctcagaggtcaagagcagagct

SEQ ID NO: 7635214 - DNA, 22 bp, Homo sapiens
ctcagagggttgaaggtgctct

SEQ ID NO: 7635215 - DNA, 22 bp, Homo sapiens
ctcagagggttgaaggtgctct

SEQ ID NO: 7635216 - DNA, 22 bp, Homo sapiens
ctcagagggttgaaggtgctct

SEQ ID NO: 7635217 - DNA, 22 bp, Homo sapiens
ctcagagggttgaaggtgctct

SEQ ID NO: 7635218 - DNA, 22 bp, Homo sapiens
ctcagagggttgaaggtgctct

SEQ ID NO: 7635219 - DNA, 22 bp, Homo sapiens
ctcagagggtctcctccagaat

SEQ ID NO: 7635220 - DNA, 22 bp, Homo sapiens
ctcagaggtcaagagcagagct

SEQ ID NO: 7635221 - DNA, 22 bp, Homo sapiens
ctcagaggtcaagagcagagct

SEQ ID NO: 7635222 - DNA, 22 bp, Homo sapiens
ctcagaggtcaagagcagagct

SEQ ID NO: 7635223 - DNA, 22 bp, Homo sapiens
ctcagaggtcaagagcagagct

SEQ ID NO: 7635224 - DNA, 22 bp, Homo sapiens
ctcagaaagtgacaggggggtg

SEQ ID NO: 7635225 - DNA, 22 bp, Homo sapiens
ctcaccatatgactttactaac

SEQ ID NO: 7635226 - DNA, 22 bp, Homo sapiens
ctcagaaatcccactctgtgta

SEQ ID NO: 7635227 - DNA, 22 bp, Homo sapiens
ctcagaaagtgacaggggggtg

SEQ ID NO: 7635228 - DNA, 22 bp, Homo sapiens
ctcagaaatcccactctgtgta

SEQ ID NO: 7635229 - DNA, 22 bp, Homo sapiens
ctcagaaatcccactctgtgta

SEQ ID NO: 7635230 - DNA, 22 bp, Homo sapiens
ctcagaaatcccactctgtgta

SEQ ID NO: 7635231 - DNA, 22 bp, Homo sapiens
ctcagaaatcccactctgtgta

SEQ ID NO: 7635232 - DNA, 22 bp, Homo sapiens
ctcagaaattacaaaagggaca

SEQ ID NO: 7635233 - DNA, 22 bp, Homo sapiens
ctcagaaattacaaaagggaca

SEQ ID NO: 7635234 - DNA, 22 bp, Homo sapiens
ctcagaaattacaaaagggaca

SEQ ID NO: 7635235 - DNA, 22 bp, Homo sapiens
ctcagaaattacaaaagggaca

SEQ ID NO: 7635236 - DNA, 22 bp, Homo sapiens
ctcagaagaacaaaggctctac

SEQ ID NO: 7635237 - DNA, 22 bp, Homo sapiens
ctcagaagaacaaaggctctac

SEQ ID NO: 7635238 - DNA, 22 bp, Homo sapiens
ctcagaagaacccagggtccca

SEQ ID NO: 7635239 - DNA, 22 bp, Homo sapiens
ctcagaagaacaaaggctctac

SEQ ID NO: 7635240 - DNA, 22 bp, Homo sapiens
ctcagaagaacaaaggctctac

SEQ ID NO: 7635241 - DNA, 22 bp, Homo sapiens
ctcagaagaacccagggtccca

SEQ ID NO: 7635242 - DNA, 22 bp, Homo sapiens
ctcagaagaatcagcagctatt

SEQ ID NO: 7635243 - DNA, 22 bp, Homo sapiens
ctcagaataatgtttctaaagg

SEQ ID NO: 7635244 - DNA, 22 bp, Homo sapiens
ctcagaatctgccaagttcagg

SEQ ID NO: 7635245 - DNA, 22 bp, Homo sapiens
ctcagaatctgccaagttcagg

SEQ ID NO: 7635246 - DNA, 22 bp, Homo sapiens
ctcagaatttagggctctgagg

SEQ ID NO: 7635247 - DNA, 22 bp, Homo sapiens
ctcagaattacatcccatttta

SEQ ID NO: 7635248 - DNA, 21 bp, Homo sapiens
ctcagacagggaggctctggg

SEQ ID NO: 7635249 - DNA, 22 bp, Homo sapiens
ctcagacaaatgattaaggtta

SEQ ID NO: 7635250 - DNA, 22 bp, Homo sapiens
ctcagacacagccccacgaagt

SEQ ID NO: 7635251 - DNA, 22 bp, Homo sapiens
ctcagaagccttcagtcttggc

SEQ ID NO: 7635252 - DNA, 22 bp, Homo sapiens
ctcagaagaatcagcagctatt

SEQ ID NO: 7635253 - DNA, 22 bp, Homo sapiens
ctcagaagccttcagtcttggc

SEQ ID NO: 7635254 - DNA, 22 bp, Homo sapiens
ctcagaagccttcagtcttggc

SEQ ID NO: 7635255 - DNA, 22 bp, Homo sapiens
ctcagaagttcagcctagagta

SEQ ID NO: 7635256 - DNA, 22 bp, Homo sapiens
ctcagaagttcagcctagagta

SEQ ID NO: 7635257 - DNA, 22 bp, Homo sapiens
ctcagaagttcagcctagagta

SEQ ID NO: 7635258 - DNA, 22 bp, Homo sapiens
ctcagaagctctgctcctttgc

SEQ ID NO: 7635259 - DNA, 22 bp, Homo sapiens
ctcagaagttcagcctagagta

SEQ ID NO: 7635260 - DNA, 22 bp, Homo sapiens
ctcagaagctctgctcctttgc

SEQ ID NO: 7635261 - DNA, 22 bp, Homo sapiens
agtcccagatctccattcggtc

SEQ ID NO: 7635262 - DNA, 22 bp, Homo sapiens
agtcccagatctacaggaggga

SEQ ID NO: 7635263 - DNA, 22 bp, Homo sapiens
agtcccagatctacaggaggga

SEQ ID NO: 7635264 - DNA, 22 bp, Homo sapiens
agtcccagatctacaggaggga

SEQ ID NO: 7635265 - DNA, 22 bp, Homo sapiens
agtcccagatctacaggaggga

SEQ ID NO: 7635266 - DNA, 22 bp, Homo sapiens
agtcccagatctacaggaggga

SEQ ID NO: 7635267 - DNA, 22 bp, Homo sapiens
agtcccagatgacccagctact

SEQ ID NO: 7635268 - DNA, 22 bp, Homo sapiens
agtcccagatgacccagctact

SEQ ID NO: 7635269 - DNA, 22 bp, Homo sapiens
agtcccagatgacccagctact

SEQ ID NO: 7635270 - DNA, 22 bp, Homo sapiens
agtcccagatgacccagctact

SEQ ID NO: 7635271 - DNA, 22 bp, Homo sapiens
agtcccagatctccattcggtc

SEQ ID NO: 7635272 - DNA, 22 bp, Homo sapiens
agtcccagatctccattcggtc

SEQ ID NO: 7635273 - DNA, 22 bp, Homo sapiens
agtcccagatctacaggaggga

SEQ ID NO: 7635274 - DNA, 20 bp, Homo sapiens
agtcccagatcaaatttctg

SEQ ID NO: 7635275 - DNA, 20 bp, Homo sapiens
agtcccagatcaaatttctg

SEQ ID NO: 7635276 - DNA, 22 bp, Homo sapiens
agtcccagagaggtcggggcca

SEQ ID NO: 7635277 - DNA, 22 bp, Homo sapiens
agtcccagagaggtcggggcca

SEQ ID NO: 7635278 - DNA, 22 bp, Homo sapiens
agtcccagatctacaggaggga

SEQ ID NO: 7635279 - DNA, 22 bp, Homo sapiens
agtcccagatctacaggaggga

SEQ ID NO: 7635280 - DNA, 22 bp, Homo sapiens
agtcccagatctacaggaggga

SEQ ID NO: 7635281 - DNA, 22 bp, Homo sapiens
agtcccagcccagtcctgtaag

SEQ ID NO: 7635282 - DNA, 22 bp, Homo sapiens
agtcccagatgacccagctact

SEQ ID NO: 7635283 - DNA, 22 bp, Homo sapiens
agtcccagatgacccagctact

SEQ ID NO: 7635284 - DNA, 22 bp, Homo sapiens
agtcccagcctaggctgtgctg

SEQ ID NO: 7635285 - DNA, 22 bp, Homo sapiens
agtcccagcccagtcctgtaag

SEQ ID NO: 7635286 - DNA, 22 bp, Homo sapiens
agtcccagcctaggctgtgctg

SEQ ID NO: 7635287 - DNA, 22 bp, Homo sapiens
agtcccagcctaggctgtgctg

SEQ ID NO: 7635288 - DNA, 22 bp, Homo sapiens
agtcccagcctaggctgtgctg

SEQ ID NO: 7635289 - DNA, 22 bp, Homo sapiens
agtcccagcctaggctgtgctg

SEQ ID NO: 7635290 - DNA, 20 bp, Homo sapiens
ctcaccaggtgtaggctgag

SEQ ID NO: 7635291 - DNA, 20 bp, Homo sapiens
ctcaccaggtgtaggctgag

SEQ ID NO: 7635292 - DNA, 22 bp, Homo sapiens
ctcaccaggaacagctgcggag

SEQ ID NO: 7635293 - DNA, 22 bp, Homo sapiens
ctcaccagatgtcgggctgagt

SEQ ID NO: 7635294 - DNA, 22 bp, Homo sapiens
ctcaccagatgtcgggctgagt

SEQ ID NO: 7635295 - DNA, 22 bp, Homo sapiens
ctcaccagatgtcgggctgagt

SEQ ID NO: 7635296 - DNA, 22 bp, Homo sapiens
ctcaccaggaacagctgcggag

SEQ ID NO: 7635297 - DNA, 22 bp, Homo sapiens
ctcaccaggaacagctgcggag

SEQ ID NO: 7635298 - DNA, 22 bp, Homo sapiens
agtcccagctactcaagaggct

SEQ ID NO: 7635299 - DNA, 22 bp, Homo sapiens
ctcaccagacatggaacctgtc

SEQ ID NO: 7635300 - DNA, 22 bp, Homo sapiens
agtcccagcctgtaggattggg

SEQ ID NO: 7635301 - DNA, 22 bp, Homo sapiens
agtcccagcctgtaggattggg

SEQ ID NO: 7635302 - DNA, 22 bp, Homo sapiens
cgggttcacgccattctcctgc

SEQ ID NO: 7635303 - DNA, 22 bp, Homo sapiens
cgggttcacgccattctcctgc

SEQ ID NO: 7635304 - DNA, 22 bp, Homo sapiens
cgggttcacgccattctcctgc

SEQ ID NO: 7635305 - DNA, 22 bp, Homo sapiens
cgggttcacgccattctcctgc

SEQ ID NO: 7635306 - DNA, 22 bp, Homo sapiens
cgggttcacgccattctcctgc

SEQ ID NO: 7635307 - DNA, 22 bp, Homo sapiens
cgggttcacgccattctcctgc

SEQ ID NO: 7635308 - DNA, 22 bp, Homo sapiens
cgggttcacgccattctcctgc

SEQ ID NO: 7635309 - DNA, 22 bp, Homo sapiens
cgggtggttttcatcaagatgg

SEQ ID NO: 7635310 - DNA, 22 bp, Homo sapiens
cgggtcacctatcaattttgtg

SEQ ID NO: 7635311 - DNA, 21 bp, Homo sapiens
cgggtgagttgagcaggacac

SEQ ID NO: 7635312 - DNA, 21 bp, Homo sapiens
cgggtgagttgagcaggacac

SEQ ID NO: 7635313 - DNA, 22 bp, Homo sapiens
cgggtaggaacaaagagctgca

SEQ ID NO: 7635314 - DNA, 23 bp, Homo sapiens
cgggtaggaacatcaggatgtga

SEQ ID NO: 7635315 - DNA, 22 bp, Homo sapiens
cgggttcacgccattctcctgc

SEQ ID NO: 7635316 - DNA, 23 bp, Homo sapiens
cgggttcacgccattctcctgcc

SEQ ID NO: 7635317 - DNA, 22 bp, Homo sapiens
cgggttcacgccattctcctgc

SEQ ID NO: 7635318 - DNA, 22 bp, Homo sapiens
cgggttcacgccattctcctgc

SEQ ID NO: 7635319 - DNA, 22 bp, Homo sapiens
cgggttcacgccattctcctgc

SEQ ID NO: 7635320 - DNA, 22 bp, Homo sapiens
cgggttcacgccattctcctgc

SEQ ID NO: 7635321 - DNA, 22 bp, Homo sapiens
cggggtgggaatagacctgtct

SEQ ID NO: 7635322 - DNA, 22 bp, Homo sapiens
cggggtgggaatagacctgtct

SEQ ID NO: 7635323 - DNA, 22 bp, Homo sapiens
cggggtgggaatagacctgtct

SEQ ID NO: 7635324 - DNA, 22 bp, Homo sapiens
cggggtgggaatagacctgtct

SEQ ID NO: 7635325 - DNA, 22 bp, Homo sapiens
cggggtgggaatagacctgtct

SEQ ID NO: 7635326 - DNA, 22 bp, Homo sapiens
cggggtgggaatagacctgtct

SEQ ID NO: 7635327 - DNA, 22 bp, Homo sapiens
cggggtggcactctaaatagaa

SEQ ID NO: 7635328 - DNA, 22 bp, Homo sapiens
cggggtggcactctaaatagaa

SEQ ID NO: 7635329 - DNA, 22 bp, Homo sapiens
cggggtggcactctaaatagaa

SEQ ID NO: 7635330 - DNA, 22 bp, Homo sapiens
cggggtggcactctaaatagaa

SEQ ID NO: 7635331 - DNA, 22 bp, Homo sapiens
cggggtggcactctaaatagaa

SEQ ID NO: 7635332 - DNA, 22 bp, Homo sapiens
cggggttcatccatgctgtggc

SEQ ID NO: 7635333 - DNA, 22 bp, Homo sapiens
cggggttcatccatgctgtggc

SEQ ID NO: 7635334 - DNA, 22 bp, Homo sapiens
cggggtgggaatagacctgtct

SEQ ID NO: 7635335 - DNA, 22 bp, Homo sapiens
cggggttcatccatgctgtggc

SEQ ID NO: 7635336 - DNA, 22 bp, Homo sapiens
cgggtaggaacaaagagctgca

SEQ ID NO: 7635337 - DNA, 22 bp, Homo sapiens
cggggttcatccatgctgtggc

SEQ ID NO: 7635338 - DNA, 22 bp, Homo sapiens
cggggttcatccatgctgtggc

SEQ ID NO: 7635339 - DNA, 22 bp, Homo sapiens
agtatcattttggcattagtat

SEQ ID NO: 7635340 - DNA, 21 bp, Homo sapiens
agtatcgtacctttaaggcag

SEQ ID NO: 7635341 - DNA, 22 bp, Homo sapiens
agtatctatttcacatatggtt

SEQ ID NO: 7635342 - DNA, 22 bp, Homo sapiens
agtatcattttggcattagtat

SEQ ID NO: 7635343 - DNA, 22 bp, Homo sapiens
agtatcattttggcattagtat

SEQ ID NO: 7635344 - DNA, 22 bp, Homo sapiens
agtatctgcatgattttgagaa

SEQ ID NO: 7635345 - DNA, 22 bp, Homo sapiens
agtatctcaaagtggtttatgg

SEQ ID NO: 7635346 - DNA, 22 bp, Homo sapiens
agtatctttacttaaatagtca

SEQ ID NO: 7635347 - DNA, 22 bp, Homo sapiens
agtatcttaacagcttccagga

SEQ ID NO: 7635348 - DNA, 21 bp, Homo sapiens
agtatcataatgaatagttct

SEQ ID NO: 7635349 - DNA, 21 bp, Homo sapiens
agtatcataatgaatagttct

SEQ ID NO: 7635350 - DNA, 22 bp, Homo sapiens
agtatcagcagagcttaaaaga

SEQ ID NO: 7635351 - DNA, 22 bp, Homo sapiens
agtatcatctccatttcactga

SEQ ID NO: 7635352 - DNA, 22 bp, Homo sapiens
agtatcatctccatttcactga

SEQ ID NO: 7635353 - DNA, 22 bp, Homo sapiens
agtatcatgttggaattaatca

SEQ ID NO: 7635354 - DNA, 22 bp, Homo sapiens
agtatgaagaatacatagatga

SEQ ID NO: 7635355 - DNA, 22 bp, Homo sapiens
agtatgaagaatacatagatga

SEQ ID NO: 7635356 - DNA, 22 bp, Homo sapiens
agtatgaagatgatgaaaaata

SEQ ID NO: 7635357 - DNA, 22 bp, Homo sapiens
agtatgaatacagattttctct

SEQ ID NO: 7635358 - DNA, 22 bp, Homo sapiens
agtatgaatctctttattctgc

SEQ ID NO: 7635359 - DNA, 22 bp, Homo sapiens
agtatgaatctctttattctgc

SEQ ID NO: 7635360 - DNA, 22 bp, Homo sapiens
agtatgaagattataatttttc

SEQ ID NO: 7635361 - DNA, 22 bp, Homo sapiens
agtatgaagctgaatgatttta

SEQ ID NO: 7635362 - DNA, 22 bp, Homo sapiens
agtatgaagctgaatgatttta

SEQ ID NO: 7635363 - DNA, 22 bp, Homo sapiens
cgggggagttgaggcacatggg

SEQ ID NO: 7635364 - DNA, 22 bp, Homo sapiens
cgggggcacccacaaatgagga

SEQ ID NO: 7635365 - DNA, 22 bp, Homo sapiens
agtatgaatggaaactacctat

SEQ ID NO: 7635366 - DNA, 22 bp, Homo sapiens
agtatgaatggaaactacctat

SEQ ID NO: 7635367 - DNA, 22 bp, Homo sapiens
agtatgaatctctttattctgc

SEQ ID NO: 7635368 - DNA, 22 bp, Homo sapiens
cggggtccctgcccacccatac

SEQ ID NO: 7635369 - DNA, 22 bp, Homo sapiens
cgggggcacccacaaatgagga

SEQ ID NO: 7635370 - DNA, 22 bp, Homo sapiens
cgggggcgtctggtgagaccat

SEQ ID NO: 7635371 - DNA, 22 bp, Homo sapiens
cggggtccctgcccacccatac

SEQ ID NO: 7635372 - DNA, 22 bp, Homo sapiens
cgggggcacccacaaatgagga

SEQ ID NO: 7635373 - DNA, 22 bp, Homo sapiens
cgggggcacccacaaatgagga

SEQ ID NO: 7635374 - DNA, 22 bp, Homo sapiens
ctcaaatatgtggtcagaaagc

SEQ ID NO: 7635375 - DNA, 22 bp, Homo sapiens
ctcaaatatgtggtcagaaagc

SEQ ID NO: 7635376 - DNA, 22 bp, Homo sapiens
ctcaaatatgtggtcagaaagc

SEQ ID NO: 7635377 - DNA, 22 bp, Homo sapiens
ctcaaatatgtggtcagaaagc

SEQ ID NO: 7635378 - DNA, 22 bp, Homo sapiens
ctcaaatatgtggtcagaaagc

SEQ ID NO: 7635379 - DNA, 22 bp, Homo sapiens
ctcaaatatgtggtcagaaagc

SEQ ID NO: 7635380 - DNA, 21 bp, Homo sapiens
ctcaaatgccagttttattta

SEQ ID NO: 7635381 - DNA, 21 bp, Homo sapiens
ctcaaatgccagttttattta

SEQ ID NO: 7635382 - DNA, 22 bp, Homo sapiens
ctcaaatccccgttcctcattc

SEQ ID NO: 7635383 - DNA, 22 bp, Homo sapiens
ctcaaatgtttccacttctgct

SEQ ID NO: 7635384 - DNA, 22 bp, Homo sapiens
ctcaacacgtcctcgagaagcg

SEQ ID NO: 7635385 - DNA, 22 bp, Homo sapiens
ctcaacatgcctactcagtctg

SEQ ID NO: 7635386 - DNA, 22 bp, Homo sapiens
ctcaacatttaacagtgaaaaa

SEQ ID NO: 7635387 - DNA, 22 bp, Homo sapiens
ctcaagaagagggagacctaca

SEQ ID NO: 7635388 - DNA, 22 bp, Homo sapiens
ctcaagaagagggagacctaca

SEQ ID NO: 7635389 - DNA, 22 bp, Homo sapiens
ctcaagaaggatgagctattgc

SEQ ID NO: 7635390 - DNA, 22 bp, Homo sapiens
ctcaagaaggatgagctattgc

SEQ ID NO: 7635391 - DNA, 23 bp, Homo sapiens
ctcaaccctagtaagggagtagg

SEQ ID NO: 7635392 - DNA, 23 bp, Homo sapiens
ctcaaccctagtaagggagtagg

SEQ ID NO: 7635393 - DNA, 23 bp, Homo sapiens
ctcaaccctagtaagggagtagg

SEQ ID NO: 7635394 - DNA, 22 bp, Homo sapiens
ctcaagaagagggagacctaca

SEQ ID NO: 7635395 - DNA, 22 bp, Homo sapiens
agtcccagagaggtcggggcca

SEQ ID NO: 7635396 - DNA, 22 bp, Homo sapiens
agtcccagagaggtcggggcca

SEQ ID NO: 7635397 - DNA, 22 bp, Homo sapiens
agtcccagagaggtcggggcca

SEQ ID NO: 7635398 - DNA, 22 bp, Homo sapiens
agtcccagactccagttttctg

SEQ ID NO: 7635399 - DNA, 22 bp, Homo sapiens
ctcaagaatctagggaggattc

SEQ ID NO: 7635400 - DNA, 22 bp, Homo sapiens
agtcccaacagcttacaaggaa

SEQ ID NO: 7635401 - DNA, 22 bp, Homo sapiens
agtcccaacagcttacaaggaa

SEQ ID NO: 7635402 - DNA, 20 bp, Homo sapiens
agtcccaacattcagctctg

SEQ ID NO: 7635403 - DNA, 22 bp, Homo sapiens
ctcaaatatgtggtcagaaagc

SEQ ID NO: 7635404 - DNA, 22 bp, Homo sapiens
ctcaaatataagctaaatgtgg

SEQ ID NO: 7635405 - DNA, 22 bp, Homo sapiens
ctcaaatatgtggtcagaaagc

SEQ ID NO: 7635406 - DNA, 22 bp, Homo sapiens
ctcaaatatgtggtcagaaagc

SEQ ID NO: 7635407 - DNA, 22 bp, Homo sapiens
ctcaaatatgtggtcagaaagc

SEQ ID NO: 7635408 - DNA, 22 bp, Homo sapiens
ctcaaatatgtggtcagaaagc

SEQ ID NO: 7635409 - DNA, 22 bp, Homo sapiens
ctcaaatataagctaaatgtgg

SEQ ID NO: 7635410 - DNA, 22 bp, Homo sapiens
ctcaaatataagctaaatgtgg

SEQ ID NO: 7635411 - DNA, 22 bp, Homo sapiens
ctcaaatataagctaaatgtgg

SEQ ID NO: 7635412 - DNA, 22 bp, Homo sapiens
ctcaaatagaactgatctataa

SEQ ID NO: 7635413 - DNA, 22 bp, Homo sapiens
ctcaaatagaactgatctataa

SEQ ID NO: 7635414 - DNA, 22 bp, Homo sapiens
ctcaaatagaactgatctataa

SEQ ID NO: 7635415 - DNA, 22 bp, Homo sapiens
ctcaaagataatcctatgtctc

SEQ ID NO: 7635416 - DNA, 22 bp, Homo sapiens
ctcaaatacctctccatgtgac

SEQ ID NO: 7635417 - DNA, 22 bp, Homo sapiens
ctcaaatacctctccatgtgac

SEQ ID NO: 7635418 - DNA, 22 bp, Homo sapiens
ctcaaatagaactgatctataa

SEQ ID NO: 7635419 - DNA, 22 bp, Homo sapiens
ctcaaatagaactgatctataa

SEQ ID NO: 7635420 - DNA, 22 bp, Homo sapiens
ctcaaatagaactgatctataa

SEQ ID NO: 7635421 - DNA, 22 bp, Homo sapiens
ctcaaagacaaaaatctgaggt

SEQ ID NO: 7635422 - DNA, 22 bp, Homo sapiens
ctcaaactgtgcttgtaaattc

SEQ ID NO: 7635423 - DNA, 22 bp, Homo sapiens
ctcaaaatggttaattttaata

SEQ ID NO: 7635424 - DNA, 22 bp, Homo sapiens
ctcaaaatggttaattttaata

SEQ ID NO: 7635425 - DNA, 22 bp, Homo sapiens
ctcaaactgtgcttgtaaattc

SEQ ID NO: 7635426 - DNA, 22 bp, Homo sapiens
ctatttatgtccaagtgtttta

SEQ ID NO: 7635427 - DNA, 22 bp, Homo sapiens
ctatttatgtccaagtgtttta

SEQ ID NO: 7635428 - DNA, 22 bp, Homo sapiens
ctatttatgtccaagtgtttta

SEQ ID NO: 7635429 - DNA, 22 bp, Homo sapiens
cgggttcacgccattctcctgc

SEQ ID NO: 7635430 - DNA, 22 bp, Homo sapiens
cgggttttccacaggagtcttt

SEQ ID NO: 7635431 - DNA, 22 bp, Homo sapiens
cgggttcttaaacgactgggct

SEQ ID NO: 7635432 - DNA, 22 bp, Homo sapiens
ctatttatgtgctattttgtat

SEQ ID NO: 7635433 - DNA, 22 bp, Homo sapiens
ctatttatgtgctattttgtat

SEQ ID NO: 7635434 - DNA, 22 bp, Homo sapiens
ctatttatgtccaagtgtttta

SEQ ID NO: 7635435 - DNA, 22 bp, Homo sapiens
agtgaatttaaaacactgagga

SEQ ID NO: 7635436 - DNA, 22 bp, Homo sapiens
agtgaattctgcactactgaag

SEQ ID NO: 7635437 - DNA, 22 bp, Homo sapiens
agtgaattctaaatgctaaaga

SEQ ID NO: 7635438 - DNA, 22 bp, Homo sapiens
agtgaattctccacccagtagg

SEQ ID NO: 7635439 - DNA, 20 bp, Homo sapiens
agtgaatttaaataatattc

SEQ ID NO: 7635440 - DNA, 22 bp, Homo sapiens
agtgaattgttgccacagagac

SEQ ID NO: 7635441 - DNA, 22 bp, Homo sapiens
agtgacaaaacggaacatacag

SEQ ID NO: 7635442 - DNA, 22 bp, Homo sapiens
agtgacaaaacggaacatacag

SEQ ID NO: 7635443 - DNA, 20 bp, Homo sapiens
agtgaatttaaataatattc

SEQ ID NO: 7635444 - DNA, 22 bp, Homo sapiens
agtgaatttcatgtaagtgtgt

SEQ ID NO: 7635445 - DNA, 22 bp, Homo sapiens
ctcagtgttaaagactttccag

SEQ ID NO: 7635446 - DNA, 22 bp, Homo sapiens
ctcagtgttaaagactttccag

SEQ ID NO: 7635447 - DNA, 22 bp, Homo sapiens
ctcagtgttaaagactttccag

SEQ ID NO: 7635448 - DNA, 22 bp, Homo sapiens
ctcagtgttaaatataaggtat

SEQ ID NO: 7635449 - DNA, 22 bp, Homo sapiens
ctcagtgttaaatataaggtat

SEQ ID NO: 7635450 - DNA, 22 bp, Homo sapiens
ctcagtgttaaatataaggtat

SEQ ID NO: 7635451 - DNA, 17 bp, Homo sapiens
agtgaaatttacattgc

SEQ ID NO: 7635452 - DNA, 17 bp, Homo sapiens
agtgaaatttacattgc

SEQ ID NO: 7635453 - DNA, 17 bp, Homo sapiens
agtgaaatttacattgc

SEQ ID NO: 7635454 - DNA, 22 bp, Homo sapiens
agtgacacggagagacagcatg

SEQ ID NO: 7635455 - DNA, 20 bp, Homo sapiens
agtgacagagactgtgtggc

SEQ ID NO: 7635456 - DNA, 20 bp, Homo sapiens
agtgacagagactgtgtggc

SEQ ID NO: 7635457 - DNA, 22 bp, Homo sapiens
agtgacacggagagacagcatg

SEQ ID NO: 7635458 - DNA, 22 bp, Homo sapiens
agtgacacggagagacagcatg

SEQ ID NO: 7635459 - DNA, 22 bp, Homo sapiens
agtgacaaggtggtaatgaagc

SEQ ID NO: 7635460 - DNA, 22 bp, Homo sapiens
agtgacaaggtggtaatgaagc

SEQ ID NO: 7635461 - DNA, 22 bp, Homo sapiens
agtgacaaggtggtaatgaagc

SEQ ID NO: 7635462 - DNA, 22 bp, Homo sapiens
agtgacaatatgtgctaggtat

SEQ ID NO: 7635463 - DNA, 22 bp, Homo sapiens
agtgacaatatgtgctaggtat

SEQ ID NO: 7635464 - DNA, 22 bp, Homo sapiens
agtgacaaggtggtaatgaagc

SEQ ID NO: 7635465 - DNA, 22 bp, Homo sapiens
agtgacaatatgtgctaggtat

SEQ ID NO: 7635466 - DNA, 23 bp, Homo sapiens
agtgacaatgggccagaggtggc

SEQ ID NO: 7635467 - DNA, 22 bp, Homo sapiens
agtgacaaggtagttagttgga

SEQ ID NO: 7635468 - DNA, 22 bp, Homo sapiens
agtgacaaggtagttagttgga

SEQ ID NO: 7635469 - DNA, 22 bp, Homo sapiens
agtgacaaggcctgaagctcct

SEQ ID NO: 7635470 - DNA, 22 bp, Homo sapiens
agtgacaaggcctgaagctcct

SEQ ID NO: 7635471 - DNA, 22 bp, Homo sapiens
agtgacaacatcaattggggct

SEQ ID NO: 7635472 - DNA, 22 bp, Homo sapiens
agtgacaacaagttgactagaa

SEQ ID NO: 7635473 - DNA, 22 bp, Homo sapiens
agtgacaagagctaggcttttt

SEQ ID NO: 7635474 - DNA, 22 bp, Homo sapiens
agtgacaagagctaggcttttt

SEQ ID NO: 7635475 - DNA, 22 bp, Homo sapiens
agtgacaaaacggaacatacag

SEQ ID NO: 7635476 - DNA, 22 bp, Homo sapiens
agtgacaaagattctccttgtt

SEQ ID NO: 7635477 - DNA, 22 bp, Homo sapiens
agtgacaaagattctccttgtt

SEQ ID NO: 7635478 - DNA, 22 bp, Homo sapiens
agtgacaacaagttgactagaa

SEQ ID NO: 7635479 - DNA, 22 bp, Homo sapiens
agtgacaacaagttgactagaa

SEQ ID NO: 7635480 - DNA, 22 bp, Homo sapiens
agtgacaacaagttgactagaa

SEQ ID NO: 7635481 - DNA, 20 bp, Homo sapiens
ctcagtgtggcctgagtgtt

SEQ ID NO: 7635482 - DNA, 23 bp, Homo sapiens
ctcagtgtgtgacccatggcctc

SEQ ID NO: 7635483 - DNA, 23 bp, Homo sapiens
ctcagtgtgtgacccatggcctc

SEQ ID NO: 7635484 - DNA, 20 bp, Homo sapiens
ctcagtgtggcctgagtgtt

SEQ ID NO: 7635485 - DNA, 20 bp, Homo sapiens
ctcagtgtggcctgagtgtt

SEQ ID NO: 7635486 - DNA, 20 bp, Homo sapiens
ctcagtgtggcctgagtgtt

SEQ ID NO: 7635487 - DNA, 20 bp, Homo sapiens
ctcagtgtggcctgagtgtt

SEQ ID NO: 7635488 - DNA, 22 bp, Homo sapiens
ctcagtgtgagtgagaagtgca

SEQ ID NO: 7635489 - DNA, 22 bp, Homo sapiens
ctcagtgtgagtgagaagtgca

SEQ ID NO: 7635490 - DNA, 22 bp, Homo sapiens
ctcagtgtcttattgtacacat

SEQ ID NO: 7635491 - DNA, 22 bp, Homo sapiens
ctcagtgtcttattgtacacat

SEQ ID NO: 7635492 - DNA, 22 bp, Homo sapiens
ctcagtgtcttattgtacacat

SEQ ID NO: 7635493 - DNA, 22 bp, Homo sapiens
ctcagtgtcttatttgagttct

SEQ ID NO: 7635494 - DNA, 22 bp, Homo sapiens
ctcagtgtcttatttgagttct

SEQ ID NO: 7635495 - DNA, 22 bp, Homo sapiens
ctcagtgtcttattgtacacat

SEQ ID NO: 7635496 - DNA, 22 bp, Homo sapiens
ctcagtgtcttatttgagttct

SEQ ID NO: 7635497 - DNA, 22 bp, Homo sapiens
ctcagtgtcttatttgagttct

SEQ ID NO: 7635498 - DNA, 22 bp, Homo sapiens
ctcagtgtgaatgctcagtaaa

SEQ ID NO: 7635499 - DNA, 22 bp, Homo sapiens
ctcagtgtgaatgctcagtaaa

SEQ ID NO: 7635500 - DNA, 22 bp, Homo sapiens
ctcagtgtgaatgctcagtaaa

SEQ ID NO: 7635501 - DNA, 22 bp, Homo sapiens
ctcagtgtgagtgagaagtgca

SEQ ID NO: 7635502 - DNA, 22 bp, Homo sapiens
ctcagtgtgagtgagaagtgca

SEQ ID NO: 7635503 - DNA, 22 bp, Homo sapiens
ctcagtgtcacgttttgcctta

SEQ ID NO: 7635504 - DNA, 22 bp, Homo sapiens
ctcagtgtcacgttttgcctta

SEQ ID NO: 7635505 - DNA, 22 bp, Homo sapiens
ctcagtgtcacgttttgcctta

SEQ ID NO: 7635506 - DNA, 22 bp, Homo sapiens
ctcagtgtctggggccccaggg

SEQ ID NO: 7635507 - DNA, 22 bp, Homo sapiens
ctcagtgtcacgttttgcctta

SEQ ID NO: 7635508 - DNA, 20 bp, Homo sapiens
ctcagtgtattctgggtgct

SEQ ID NO: 7635509 - DNA, 20 bp, Homo sapiens
ctcagtgtattctgggtgct

SEQ ID NO: 7635510 - DNA, 20 bp, Homo sapiens
ctcagtgtattctgggtgct

SEQ ID NO: 7635511 - DNA, 22 bp, Homo sapiens
ctcagtggttgagagcctgggc

SEQ ID NO: 7635512 - DNA, 22 bp, Homo sapiens
ctcagtggttgagagcctgggc

SEQ ID NO: 7635513 - DNA, 22 bp, Homo sapiens
ctcagtggttgagagcctgggc

SEQ ID NO: 7635514 - DNA, 22 bp, Homo sapiens
ctcagtggtggtcacttggtgg

SEQ ID NO: 7635515 - DNA, 22 bp, Homo sapiens
ctcagtggagagcggtcctggg

SEQ ID NO: 7635516 - DNA, 22 bp, Homo sapiens
ctcagtggggcgacagggtgct

SEQ ID NO: 7635517 - DNA, 22 bp, Homo sapiens
ctcagtggggcgacagggtgct

SEQ ID NO: 7635518 - DNA, 22 bp, Homo sapiens
ctcagggagtagcacatgtgga

SEQ ID NO: 7635519 - DNA, 22 bp, Homo sapiens
ctcagggagtagcacatgtgga

SEQ ID NO: 7635520 - DNA, 22 bp, Homo sapiens
ctcagggagtagcacatgtgga

SEQ ID NO: 7635521 - DNA, 22 bp, Homo sapiens
ctcagggagtagcacatgtgga

SEQ ID NO: 7635522 - DNA, 22 bp, Homo sapiens
ctcagtgctttggatcctggat

SEQ ID NO: 7635523 - DNA, 22 bp, Homo sapiens
ctccagaagacccatcctcatg

SEQ ID NO: 7635524 - DNA, 22 bp, Homo sapiens
ctccagaaggtgggggagccac

SEQ ID NO: 7635525 - DNA, 22 bp, Homo sapiens
ctccagaaggtgggggagccac

SEQ ID NO: 7635526 - DNA, 22 bp, Homo sapiens
ctccagaaggtgggggagccac

SEQ ID NO: 7635527 - DNA, 19 bp, Homo sapiens
ctccagaatacatgttcct

SEQ ID NO: 7635528 - DNA, 22 bp, Homo sapiens
ctccagaaggtgggggagccac

SEQ ID NO: 7635529 - DNA, 19 bp, Homo sapiens
ctccagaatacatgttcct

SEQ ID NO: 7635530 - DNA, 19 bp, Homo sapiens
ctccagaatacatgttcct

SEQ ID NO: 7635531 - DNA, 22 bp, Homo sapiens
ctccagaactgggagagaataa

SEQ ID NO: 7635532 - DNA, 22 bp, Homo sapiens
ctccagaaatttggatgcagca

SEQ ID NO: 7635533 - DNA, 22 bp, Homo sapiens
ctccagaactgggagagaataa

SEQ ID NO: 7635534 - DNA, 22 bp, Homo sapiens
ctccagaactgggagagaataa

SEQ ID NO: 7635535 - DNA, 22 bp, Homo sapiens
ctccagaactgggagagaataa

SEQ ID NO: 7635536 - DNA, 22 bp, Homo sapiens
ctccagaagacccatcctcatg

SEQ ID NO: 7635537 - DNA, 22 bp, Homo sapiens
ctccagaactgggagagaataa

SEQ ID NO: 7635538 - DNA, 22 bp, Homo sapiens
ctccactctggggtgggtgaga

SEQ ID NO: 7635539 - DNA, 22 bp, Homo sapiens
ctccagaaattcaacagcaaat

SEQ ID NO: 7635540 - DNA, 22 bp, Homo sapiens
ctccagaaattcaacagcaaat

SEQ ID NO: 7635541 - DNA, 22 bp, Homo sapiens
ctccagaaattcaacagcaaat

SEQ ID NO: 7635542 - DNA, 22 bp, Homo sapiens
ctccagaaattcaacagcaaat

SEQ ID NO: 7635543 - DNA, 22 bp, Homo sapiens
ctccagaaattcaacagcaaat

SEQ ID NO: 7635544 - DNA, 22 bp, Homo sapiens
ctccagaaatttggatgcagca

SEQ ID NO: 7635545 - DNA, 22 bp, Homo sapiens
ctccagaaatttggatgcagca

SEQ ID NO: 7635546 - DNA, 22 bp, Homo sapiens
ctccagaaatttggatgcagca

SEQ ID NO: 7635547 - DNA, 22 bp, Homo sapiens
ctccagaaattcaacagcaaat

SEQ ID NO: 7635548 - DNA, 22 bp, Homo sapiens
ctccagaaatttggatgcagca

SEQ ID NO: 7635549 - DNA, 22 bp, Homo sapiens
ctccagaaatttggatgcagca

SEQ ID NO: 7635550 - DNA, 22 bp, Homo sapiens
ctccagaaatttggatgcagca

SEQ ID NO: 7635551 - DNA, 22 bp, Homo sapiens
ctccagagagaaaggaggccgc

SEQ ID NO: 7635552 - DNA, 22 bp, Homo sapiens
ctccagagacacttctcatgat

SEQ ID NO: 7635553 - DNA, 22 bp, Homo sapiens
ctccagagagaaaggaggccgc

SEQ ID NO: 7635554 - DNA, 22 bp, Homo sapiens
ctccagagagaaaggaggccgc

SEQ ID NO: 7635555 - DNA, 22 bp, Homo sapiens
ctccagagagaaaggaggccgc

SEQ ID NO: 7635556 - DNA, 22 bp, Homo sapiens
ctccagagagaaaggaggccgc

SEQ ID NO: 7635557 - DNA, 22 bp, Homo sapiens
ctccagagagaaaggaggccgc

SEQ ID NO: 7635558 - DNA, 22 bp, Homo sapiens
ctccagagagaaaggaggccgc

SEQ ID NO: 7635559 - DNA, 22 bp, Homo sapiens
ctccagagagaaaggaggccgc

SEQ ID NO: 7635560 - DNA, 22 bp, Homo sapiens
ctccagagacacttctcatgat

SEQ ID NO: 7635561 - DNA, 22 bp, Homo sapiens
ctccagagacacttctcatgat

SEQ ID NO: 7635562 - DNA, 22 bp, Homo sapiens
ctccagagacacttctcatgat

SEQ ID NO: 7635563 - DNA, 22 bp, Homo sapiens
ctccagagacacttctcatgat

SEQ ID NO: 7635564 - DNA, 22 bp, Homo sapiens
ctccagacagatcttctagcag

SEQ ID NO: 7635565 - DNA, 22 bp, Homo sapiens
ctccagaattgtccattggaaa

SEQ ID NO: 7635566 - DNA, 20 bp, Homo sapiens
ctccagactacagaagagcc

SEQ ID NO: 7635567 - DNA, 20 bp, Homo sapiens
ctccagactacagaagagcc

SEQ ID NO: 7635568 - DNA, 22 bp, Homo sapiens
ctccagaattgtccattggaaa

SEQ ID NO: 7635569 - DNA, 19 bp, Homo sapiens
ctccagaatacatgttcct

SEQ ID NO: 7635570 - DNA, 22 bp, Homo sapiens
ctccagaattgtccattggaaa

SEQ ID NO: 7635571 - DNA, 22 bp, Homo sapiens
ctccagaattgtccattggaaa

SEQ ID NO: 7635572 - DNA, 22 bp, Homo sapiens
agtgacaggggaggcaggtgtg

SEQ ID NO: 7635573 - DNA, 22 bp, Homo sapiens
agtgacagggaaggataggatt

SEQ ID NO: 7635574 - DNA, 22 bp, Homo sapiens
agtgacagggaaggataggatt

SEQ ID NO: 7635575 - DNA, 22 bp, Homo sapiens
agtgacaggggaggcaggtgtg

SEQ ID NO: 7635576 - DNA, 22 bp, Homo sapiens
agtgacaggggaggcaggtgtg

SEQ ID NO: 7635577 - DNA, 22 bp, Homo sapiens
agtgacaggggaggcaggtgtg

SEQ ID NO: 7635578 - DNA, 22 bp, Homo sapiens
ctccactcaccgaggcagagca

SEQ ID NO: 7635579 - DNA, 22 bp, Homo sapiens
agtgacagggaaggataggatt

SEQ ID NO: 7635580 - DNA, 22 bp, Homo sapiens
agtgacagggaaaatgacactg

SEQ ID NO: 7635581 - DNA, 22 bp, Homo sapiens
agtgacagggaaaatgacactg

SEQ ID NO: 7635582 - DNA, 22 bp, Homo sapiens
agtgacagggaaaatgacactg

SEQ ID NO: 7635583 - DNA, 22 bp, Homo sapiens
agtgacagggaaggataggatt

SEQ ID NO: 7635584 - DNA, 22 bp, Homo sapiens
agtgacagggaaggataggatt

SEQ ID NO: 7635585 - DNA, 22 bp, Homo sapiens
agtgacagggaaggataggatt

SEQ ID NO: 7635586 - DNA, 22 bp, Homo sapiens
agtgacagggaaggataggatt

SEQ ID NO: 7635587 - DNA, 22 bp, Homo sapiens
agtgacaggaccaggtctggaa

SEQ ID NO: 7635588 - DNA, 22 bp, Homo sapiens
agtgacagggaaaatgacactg

SEQ ID NO: 7635589 - DNA, 22 bp, Homo sapiens
agtgacaggaccaggtctggaa

SEQ ID NO: 7635590 - DNA, 22 bp, Homo sapiens
agtgacaggaccaggtctggaa

SEQ ID NO: 7635591 - DNA, 22 bp, Homo sapiens
agtgacaggaccaggtctggaa

SEQ ID NO: 7635592 - DNA, 22 bp, Homo sapiens
agtgacaggaccaggtctggaa

SEQ ID NO: 7635593 - DNA, 22 bp, Homo sapiens
agtgacagctgggaaggtgaaa

SEQ ID NO: 7635594 - DNA, 22 bp, Homo sapiens
agtgacagattaccggcagagc

SEQ ID NO: 7635595 - DNA, 22 bp, Homo sapiens
agtgacagccaaatccatccat

SEQ ID NO: 7635596 - DNA, 22 bp, Homo sapiens
agtgacagctgggaaggtgaaa

SEQ ID NO: 7635597 - DNA, 22 bp, Homo sapiens
agtgacagccaaatccatccat

SEQ ID NO: 7635598 - DNA, 22 bp, Homo sapiens
agtgacagattaccggcagagc

SEQ ID NO: 7635599 - DNA, 22 bp, Homo sapiens
agtgacagaggcaggcctgtgg

SEQ ID NO: 7635600 - DNA, 22 bp, Homo sapiens
agtgacagattaccggcagagc

SEQ ID NO: 7635601 - DNA, 22 bp, Homo sapiens
agtgacagattaccggcagagc

SEQ ID NO: 7635602 - DNA, 22 bp, Homo sapiens
agtgacagattaccggcagagc

SEQ ID NO: 7635603 - DNA, 21 bp, Homo sapiens
agtgacagaggaaggtgcata

SEQ ID NO: 7635604 - DNA, 20 bp, Homo sapiens
agtgacagagactgtgtggc

SEQ ID NO: 7635605 - DNA, 22 bp, Homo sapiens
agtgacagagcttggtgccccc

SEQ ID NO: 7635606 - DNA, 22 bp, Homo sapiens
agtgacagagcttggtgccccc

SEQ ID NO: 7635607 - DNA, 22 bp, Homo sapiens
agtgacagagcttggtgccccc

SEQ ID NO: 7635608 - DNA, 22 bp, Homo sapiens
agtgacagaggcaggcctgtgg

SEQ ID NO: 7635609 - DNA, 22 bp, Homo sapiens
agtgacagaggcaggcctgtgg

SEQ ID NO: 7635610 - DNA, 21 bp, Homo sapiens
agtgacagaggaaggtgcata

SEQ ID NO: 7635611 - DNA, 21 bp, Homo sapiens
agtgacagaggaaggtgcata

SEQ ID NO: 7635612 - DNA, 21 bp, Homo sapiens
agtgacagaggaaggtgcata

SEQ ID NO: 7635613 - DNA, 21 bp, Homo sapiens
agtgacagaggaaggtgcata

SEQ ID NO: 7635614 - DNA, 22 bp, Homo sapiens
agtctcagagtacctgagggac

SEQ ID NO: 7635615 - DNA, 22 bp, Homo sapiens
agtctcagagtacctgagggac

SEQ ID NO: 7635616 - DNA, 22 bp, Homo sapiens
ctcagctggcaattctggctcc

SEQ ID NO: 7635617 - DNA, 22 bp, Homo sapiens
agtctcagagtacctgagggac

SEQ ID NO: 7635618 - DNA, 22 bp, Homo sapiens
ctcagctgcagcctggctggca

SEQ ID NO: 7635619 - DNA, 22 bp, Homo sapiens
ctcagctgcagcctggctggca

SEQ ID NO: 7635620 - DNA, 22 bp, Homo sapiens
agtctcagagtacctgagggac

SEQ ID NO: 7635621 - DNA, 22 bp, Homo sapiens
agtctcagagtacctgagggac

SEQ ID NO: 7635622 - DNA, 22 bp, Homo sapiens
agtctcagagtacctgagggac

SEQ ID NO: 7635623 - DNA, 22 bp, Homo sapiens
agtctcagcaagcatggctagt

SEQ ID NO: 7635624 - DNA, 22 bp, Homo sapiens
agtctcagcaagcatggctagt

SEQ ID NO: 7635625 - DNA, 22 bp, Homo sapiens
agtctcagagtacctgagggac

SEQ ID NO: 7635626 - DNA, 18 bp, Homo sapiens
agtctcagcggaggagta

SEQ ID NO: 7635627 - DNA, 22 bp, Homo sapiens
agtctcagctacttgggaggct

SEQ ID NO: 7635628 - DNA, 22 bp, Homo sapiens
agtctcagctacttgggaggct

SEQ ID NO: 7635629 - DNA, 22 bp, Homo sapiens
agtctcagctacttgggaggct

SEQ ID NO: 7635630 - DNA, 22 bp, Homo sapiens
agtctcagctacttgggaggct

SEQ ID NO: 7635631 - DNA, 23 bp, Homo sapiens
agtctcagctggaaacatgtgtc

SEQ ID NO: 7635632 - DNA, 22 bp, Homo sapiens
agtctcagccacacagacctat

SEQ ID NO: 7635633 - DNA, 22 bp, Homo sapiens
agtctcagccacacagacctat

SEQ ID NO: 7635634 - DNA, 22 bp, Homo sapiens
agtctcagccacacagacctat

SEQ ID NO: 7635635 - DNA, 18 bp, Homo sapiens
agtctcagcggaggagta

SEQ ID NO: 7635636 - DNA, 18 bp, Homo sapiens
agtctcagcggaggagta

SEQ ID NO: 7635637 - DNA, 18 bp, Homo sapiens
agtctcagcggaggagta

SEQ ID NO: 7635638 - DNA, 20 bp, Homo sapiens
ctcagctcttcagggcaagt

SEQ ID NO: 7635639 - DNA, 22 bp, Homo sapiens
ctcagctctgtcacttactagc

SEQ ID NO: 7635640 - DNA, 22 bp, Homo sapiens
ctcagctctgtcacttactagc

SEQ ID NO: 7635641 - DNA, 22 bp, Homo sapiens
ctcagctctgtcacttactagc

SEQ ID NO: 7635642 - DNA, 22 bp, Homo sapiens
ctcagctctttatactagctgt

SEQ ID NO: 7635643 - DNA, 22 bp, Homo sapiens
ctcagctctttatactagctgt

SEQ ID NO: 7635644 - DNA, 22 bp, Homo sapiens
ctcagctctttatactagctgt

SEQ ID NO: 7635645 - DNA, 20 bp, Homo sapiens
ctcagctcttcagggcaagt

SEQ ID NO: 7635646 - DNA, 22 bp, Homo sapiens
ctcagctctttatactagctgt

SEQ ID NO: 7635647 - DNA, 22 bp, Homo sapiens
ctcagctctttatactagctgt

SEQ ID NO: 7635648 - DNA, 17 bp, Homo sapiens
ctcagctgaaccccaga

SEQ ID NO: 7635649 - DNA, 22 bp, Homo sapiens
ctcagctgcagcctggctggca

SEQ ID NO: 7635650 - DNA, 22 bp, Homo sapiens
ctcagctgcagcctggctggca

SEQ ID NO: 7635651 - DNA, 17 bp, Homo sapiens
ctcagctgaaccccaga

SEQ ID NO: 7635652 - DNA, 22 bp, Homo sapiens
ctcagctccaggtgtgcatctt

SEQ ID NO: 7635653 - DNA, 22 bp, Homo sapiens
ctcagctccaggtgtgcatctt

SEQ ID NO: 7635654 - DNA, 22 bp, Homo sapiens
ctcagctccaggtgtgcatctt

SEQ ID NO: 7635655 - DNA, 22 bp, Homo sapiens
ctcagctctgacaggaggcatc

SEQ ID NO: 7635656 - DNA, 22 bp, Homo sapiens
ctcagctctgtcacttactagc

SEQ ID NO: 7635657 - DNA, 22 bp, Homo sapiens
ctcagctctgacaggaggcatc

SEQ ID NO: 7635658 - DNA, 22 bp, Homo sapiens
ctcagctctgacaggaggcatc

SEQ ID NO: 7635659 - DNA, 22 bp, Homo sapiens
ctcagcctgtgaagagcagagg

SEQ ID NO: 7635660 - DNA, 22 bp, Homo sapiens
ctcagcctgtgaagagcagagg

SEQ ID NO: 7635661 - DNA, 20 bp, Homo sapiens
ctcagctaaacaacactgac

SEQ ID NO: 7635662 - DNA, 22 bp, Homo sapiens
ctcagccctccccggggaataa

SEQ ID NO: 7635663 - DNA, 22 bp, Homo sapiens
ctcagcccggtgctcgtgccac

SEQ ID NO: 7635664 - DNA, 22 bp, Homo sapiens
ctcagcacactcccatctaatt

SEQ ID NO: 7635665 - DNA, 22 bp, Homo sapiens
ctcagcaattacctgtgtctct

SEQ ID NO: 7635666 - DNA, 22 bp, Homo sapiens
ctcagccccagcccagatagca

SEQ ID NO: 7635667 - DNA, 22 bp, Homo sapiens
ctcagcacatctttacatttcc

SEQ ID NO: 7635668 - DNA, 22 bp, Homo sapiens
ctcagccccaatttgccctctt

SEQ ID NO: 7635669 - DNA, 22 bp, Homo sapiens
ctcagccccagcccagatagca

SEQ ID NO: 7635670 - DNA, 22 bp, Homo sapiens
ctcagccccagcccagatagca

SEQ ID NO: 7635671 - DNA, 22 bp, Homo sapiens
ctcagccccagcccagatagca

SEQ ID NO: 7635672 - DNA, 22 bp, Homo sapiens
ctcagctccaggtgtgcatctt

SEQ ID NO: 7635673 - DNA, 22 bp, Homo sapiens
ctcagctccaggtgtgcatctt

SEQ ID NO: 7635674 - DNA, 22 bp, Homo sapiens
ctcagctccaggtgtgcatctt

SEQ ID NO: 7635675 - DNA, 22 bp, Homo sapiens
ctcagctccagccctcagcagc

SEQ ID NO: 7635676 - DNA, 22 bp, Homo sapiens
ctcagctccagccctcagcagc

SEQ ID NO: 7635677 - DNA, 22 bp, Homo sapiens
ctcagctccagccctcagcagc

SEQ ID NO: 7635678 - DNA, 22 bp, Homo sapiens
ctcagctcattgtggatccggt

SEQ ID NO: 7635679 - DNA, 22 bp, Homo sapiens
ctcagctcaaaattcacctttg

SEQ ID NO: 7635680 - DNA, 22 bp, Homo sapiens
ctcagctccagccctcagcagc

SEQ ID NO: 7635681 - DNA, 22 bp, Homo sapiens
ctcagctcattgtggatccggt

SEQ ID NO: 7635682 - DNA, 22 bp, Homo sapiens
ctcagctccagccctcagcagc

SEQ ID NO: 7635683 - DNA, 22 bp, Homo sapiens
ctcagctccagccctcagcagc

SEQ ID NO: 7635684 - DNA, 22 bp, Homo sapiens
ctcagctagtaacgtacatgtc

SEQ ID NO: 7635685 - DNA, 22 bp, Homo sapiens
ctcagctcaaaattcacctttg

SEQ ID NO: 7635686 - DNA, 22 bp, Homo sapiens
ctcagctcaaaattcacctttg

SEQ ID NO: 7635687 - DNA, 22 bp, Homo sapiens
ctcagctcactcttttgtgctt

SEQ ID NO: 7635688 - DNA, 22 bp, Homo sapiens
ctcagctcactcttttgtgctt

SEQ ID NO: 7635689 - DNA, 22 bp, Homo sapiens
ctcagctagtaacgtacatgtc

SEQ ID NO: 7635690 - DNA, 22 bp, Homo sapiens
ctcagctacgctttcaccagct

SEQ ID NO: 7635691 - DNA, 22 bp, Homo sapiens
ctcagctacttgggaagcttag

SEQ ID NO: 7635692 - DNA, 22 bp, Homo sapiens
ctcagctagggaaggttagctt

SEQ ID NO: 7635693 - DNA, 22 bp, Homo sapiens
ctcagctacgctttcaccagct

SEQ ID NO: 7635694 - DNA, 22 bp, Homo sapiens
ctcagcctgtgaagagcagagg

SEQ ID NO: 7635695 - DNA, 16 bp, Homo sapiens
ctcagctaaggagagg

SEQ ID NO: 7635696 - DNA, 22 bp, Homo sapiens
ctcagggaggcctctgctggtt

SEQ ID NO: 7635697 - DNA, 22 bp, Homo sapiens
ctcagggaggcctctgctggtt

SEQ ID NO: 7635698 - DNA, 22 bp, Homo sapiens
ctcagggaggcctctgctggtt

SEQ ID NO: 7635699 - DNA, 22 bp, Homo sapiens
ctcagggaggccctgggaccct

SEQ ID NO: 7635700 - DNA, 22 bp, Homo sapiens
ctcagggaggccctgggaccct

SEQ ID NO: 7635701 - DNA, 22 bp, Homo sapiens
ctcagggaggtcctgtgctgaa

SEQ ID NO: 7635702 - DNA, 22 bp, Homo sapiens
ctcagggaggtcctgtgctgaa

SEQ ID NO: 7635703 - DNA, 22 bp, Homo sapiens
ctcagggaggtcctgtgctgaa

SEQ ID NO: 7635704 - DNA, 22 bp, Homo sapiens
ctcagggaggcctctgctggtt

SEQ ID NO: 7635705 - DNA, 22 bp, Homo sapiens
ctcagggagagccaagagttcc

SEQ ID NO: 7635706 - DNA, 22 bp, Homo sapiens
ctcagggagagccaagagttcc

SEQ ID NO: 7635707 - DNA, 22 bp, Homo sapiens
ctcagggagagccaagagttcc

SEQ ID NO: 7635708 - DNA, 22 bp, Homo sapiens
ctcagggagagccaagagttcc

SEQ ID NO: 7635709 - DNA, 22 bp, Homo sapiens
ctcagggaggagcttctgggcc

SEQ ID NO: 7635710 - DNA, 22 bp, Homo sapiens
ctcagggaggccctgggaccct

SEQ ID NO: 7635711 - DNA, 22 bp, Homo sapiens
ctcagggaggccctgggaccct

SEQ ID NO: 7635712 - DNA, 22 bp, Homo sapiens
ctcagggaggccctgggaccct

SEQ ID NO: 7635713 - DNA, 22 bp, Homo sapiens
ctcagggaggccaatttatcaa

SEQ ID NO: 7635714 - DNA, 22 bp, Homo sapiens
ctcagggaggagcttctgggcc

SEQ ID NO: 7635715 - DNA, 22 bp, Homo sapiens
ctcagggaggagcttctgggcc

SEQ ID NO: 7635716 - DNA, 22 bp, Homo sapiens
ctcagggacggcatctcatttc

SEQ ID NO: 7635717 - DNA, 22 bp, Homo sapiens
ctcagggacggaggcttgcgga

SEQ ID NO: 7635718 - DNA, 22 bp, Homo sapiens
ctcagggacgttagaggacagg

SEQ ID NO: 7635719 - DNA, 22 bp, Homo sapiens
ctcagggacggaggcttgcgga

SEQ ID NO: 7635720 - DNA, 22 bp, Homo sapiens
ctcagggacggaggcttgcgga

SEQ ID NO: 7635721 - DNA, 22 bp, Homo sapiens
ctcagggacagtatcatttagg

SEQ ID NO: 7635722 - DNA, 22 bp, Homo sapiens
ctcagggacaaggggagacccc

SEQ ID NO: 7635723 - DNA, 22 bp, Homo sapiens
ctcagggacaaggggagacccc

SEQ ID NO: 7635724 - DNA, 22 bp, Homo sapiens
ctcagggacaaggggagacccc

SEQ ID NO: 7635725 - DNA, 22 bp, Homo sapiens
ctcagggacaaggggagacccc

SEQ ID NO: 7635726 - DNA, 22 bp, Homo sapiens
ctcagggacgttagaggacagg

SEQ ID NO: 7635727 - DNA, 22 bp, Homo sapiens
ctcagggacgttagaggacagg

SEQ ID NO: 7635728 - DNA, 22 bp, Homo sapiens
ctcagggacgttagaggacagg

SEQ ID NO: 7635729 - DNA, 22 bp, Homo sapiens
ctcagggacttggatcctggcc

SEQ ID NO: 7635730 - DNA, 22 bp, Homo sapiens
ctcagggacttggatcctggcc

SEQ ID NO: 7635731 - DNA, 22 bp, Homo sapiens
ctcagggacttggatcctggcc

SEQ ID NO: 7635732 - DNA, 22 bp, Homo sapiens
ctcagggacttggatcctggcc

SEQ ID NO: 7635733 - DNA, 22 bp, Homo sapiens
ctcagggacttggatcctggcc

SEQ ID NO: 7635734 - DNA, 22 bp, Homo sapiens
ctcaggccaataagctccagcc

SEQ ID NO: 7635735 - DNA, 22 bp, Homo sapiens
ctcaggccaataagctccagcc

SEQ ID NO: 7635736 - DNA, 22 bp, Homo sapiens
ctcagggaattgaatctccttg

SEQ ID NO: 7635737 - DNA, 22 bp, Homo sapiens
ctcagggaattgaatctccttg

SEQ ID NO: 7635738 - DNA, 22 bp, Homo sapiens
ctcaggccaataagctccagcc

SEQ ID NO: 7635739 - DNA, 22 bp, Homo sapiens
ctcaggccaataagctccagcc

SEQ ID NO: 7635740 - DNA, 21 bp, Homo sapiens
ctcaggcatttgaggagagtc

SEQ ID NO: 7635741 - DNA, 22 bp, Homo sapiens
agtctccgctctcggagtcggc

SEQ ID NO: 7635742 - DNA, 22 bp, Homo sapiens
agtctccttggcctcaatgcct

SEQ ID NO: 7635743 - DNA, 22 bp, Homo sapiens
agtctcctctttccttgttatt

SEQ ID NO: 7635744 - DNA, 22 bp, Homo sapiens
agtctccagaaatatagcagtg

SEQ ID NO: 7635745 - DNA, 22 bp, Homo sapiens
agtctccagaaatatagcagtg

SEQ ID NO: 7635746 - DNA, 22 bp, Homo sapiens
agtctccagaaatatagcagtg

SEQ ID NO: 7635747 - DNA, 22 bp, Homo sapiens
agtctccacttgacatcagcag

SEQ ID NO: 7635748 - DNA, 22 bp, Homo sapiens
agtctcagggccacccggggaa

SEQ ID NO: 7635749 - DNA, 19 bp, Homo sapiens
agtctcagtgtacagaggc

SEQ ID NO: 7635750 - DNA, 19 bp, Homo sapiens
agtctcagtgtacagaggc

SEQ ID NO: 7635751 - DNA, 22 bp, Homo sapiens
agtctcagggccacccggggaa

SEQ ID NO: 7635752 - DNA, 22 bp, Homo sapiens
agtctcatcaggcatgtagtca

SEQ ID NO: 7635753 - DNA, 19 bp, Homo sapiens
agtctcagtgtacagaggc

SEQ ID NO: 7635754 - DNA, 22 bp, Homo sapiens
agtctcaggcagaggaaggcta

SEQ ID NO: 7635755 - DNA, 22 bp, Homo sapiens
agtctcaggcagaggaaggcta

SEQ ID NO: 7635756 - DNA, 22 bp, Homo sapiens
agtctcaggcagaggaaggcta

SEQ ID NO: 7635757 - DNA, 22 bp, Homo sapiens
agtctcaggcagaggaaggcta

SEQ ID NO: 7635758 - DNA, 23 bp, Homo sapiens
agtctcagctggaaacatgtgtc

SEQ ID NO: 7635759 - DNA, 23 bp, Homo sapiens
agtctcagctggaaacatgtgtc

SEQ ID NO: 7635760 - DNA, 22 bp, Homo sapiens
agtctccacccatgacagtaca

SEQ ID NO: 7635761 - DNA, 22 bp, Homo sapiens
agtctccacttgacatcagcag

SEQ ID NO: 7635762 - DNA, 22 bp, Homo sapiens
agtctccacttgacatcagcag

SEQ ID NO: 7635763 - DNA, 22 bp, Homo sapiens
agtctccacactggcagatgcc

SEQ ID NO: 7635764 - DNA, 22 bp, Homo sapiens
agtctccacactggcagatgcc

SEQ ID NO: 7635765 - DNA, 22 bp, Homo sapiens
agtctccacactggcagatgcc

SEQ ID NO: 7635766 - DNA, 22 bp, Homo sapiens
agtctccacccatgacagtaca

SEQ ID NO: 7635767 - DNA, 22 bp, Homo sapiens
agtctccacactggcagatgcc

SEQ ID NO: 7635768 - DNA, 22 bp, Homo sapiens
agtctccacactggcagatgcc

SEQ ID NO: 7635769 - DNA, 22 bp, Homo sapiens
agtctccacaacagccctgata

SEQ ID NO: 7635770 - DNA, 22 bp, Homo sapiens
cggccctggcggaggcgggaga

SEQ ID NO: 7635771 - DNA, 22 bp, Homo sapiens
cggccctggcggaggcgggaga

SEQ ID NO: 7635772 - DNA, 22 bp, Homo sapiens
cggccgcagcagtgtcggccca

SEQ ID NO: 7635773 - DNA, 22 bp, Homo sapiens
cggccgcagcagtgtcggccca

SEQ ID NO: 7635774 - DNA, 22 bp, Homo sapiens
cggccgcagcagtgtcggccca

SEQ ID NO: 7635775 - DNA, 22 bp, Homo sapiens
cggccctgctgagcttgtctgg

SEQ ID NO: 7635776 - DNA, 22 bp, Homo sapiens
cggccctgctgagcttgtctgg

SEQ ID NO: 7635777 - DNA, 22 bp, Homo sapiens
cggccctggcggaggcgggaga

SEQ ID NO: 7635778 - DNA, 22 bp, Homo sapiens
cggccctgaccagaccttagtt

SEQ ID NO: 7635779 - DNA, 22 bp, Homo sapiens
cggccctgaccagaccttagtt

SEQ ID NO: 7635780 - DNA, 22 bp, Homo sapiens
cggccctgaccagaccttagtt

SEQ ID NO: 7635781 - DNA, 22 bp, Homo sapiens
cggcctgcacttgcctcgaggc

SEQ ID NO: 7635782 - DNA, 22 bp, Homo sapiens
cggccttctccctgggcatcac

SEQ ID NO: 7635783 - DNA, 20 bp, Homo sapiens
cggcctcacggtggcggtgc

SEQ ID NO: 7635784 - DNA, 22 bp, Homo sapiens
cggccgcgtccagggccgccag

SEQ ID NO: 7635785 - DNA, 22 bp, Homo sapiens
cggccgcagcagtgtcggccca

SEQ ID NO: 7635786 - DNA, 22 bp, Homo sapiens
cggccgcagcagtgtcggccca

SEQ ID NO: 7635787 - DNA, 22 bp, Homo sapiens
cggctcactgcagctccgcctc

SEQ ID NO: 7635788 - DNA, 22 bp, Homo sapiens
cggctcactgcagctccgcctc

SEQ ID NO: 7635789 - DNA, 22 bp, Homo sapiens
cggctcactgcagctccgcctc

SEQ ID NO: 7635790 - DNA, 22 bp, Homo sapiens
cggctcactgcagctccgcctc

SEQ ID NO: 7635791 - DNA, 22 bp, Homo sapiens
cggctcactgcagctccgcctc

SEQ ID NO: 7635792 - DNA, 22 bp, Homo sapiens
cggctcactgcagctccgcctc

SEQ ID NO: 7635793 - DNA, 22 bp, Homo sapiens
cggctcactgcagctccgcctc

SEQ ID NO: 7635794 - DNA, 22 bp, Homo sapiens
cggcgcaggcagaccgcgggct

SEQ ID NO: 7635795 - DNA, 20 bp, Homo sapiens
agtaggtgtccttcaggata

SEQ ID NO: 7635796 - DNA, 20 bp, Homo sapiens
agtaggggaatgcaagagca

SEQ ID NO: 7635797 - DNA, 20 bp, Homo sapiens
cggctcagcctctccctccc

SEQ ID NO: 7635798 - DNA, 20 bp, Homo sapiens
cggctcagcctctccctccc

SEQ ID NO: 7635799 - DNA, 22 bp, Homo sapiens
cggctcagacttcccaagaaca

SEQ ID NO: 7635800 - DNA, 22 bp, Homo sapiens
cggctcagacttcccaagaaca

SEQ ID NO: 7635801 - DNA, 22 bp, Homo sapiens
cggctcagacttcccaagaaca

SEQ ID NO: 7635802 - DNA, 22 bp, Homo sapiens
cggctcagacttcccaagaaca

SEQ ID NO: 7635803 - DNA, 22 bp, Homo sapiens
cggctcactgcagctccgcctc

SEQ ID NO: 7635804 - DNA, 22 bp, Homo sapiens
cggctcactgcagctccgcctc

SEQ ID NO: 7635805 - DNA, 22 bp, Homo sapiens
cggctcactgcagctccgcctc

SEQ ID NO: 7635806 - DNA, 22 bp, Homo sapiens
cggctcactgcagctccgcctc

SEQ ID NO: 7635807 - DNA, 22 bp, Homo sapiens
cggctcactgcagctccgcctc

SEQ ID NO: 7635808 - DNA, 22 bp, Homo sapiens
cggctcactgcagctccgcctc

SEQ ID NO: 7635809 - DNA, 22 bp, Homo sapiens
cggctcactgcagctccgcctc

SEQ ID NO: 7635810 - DNA, 22 bp, Homo sapiens
cggctcactgcagctccgcctc

SEQ ID NO: 7635811 - DNA, 22 bp, Homo sapiens
agtatattgctcttaatcatag

SEQ ID NO: 7635812 - DNA, 22 bp, Homo sapiens
agtatattgctcttaatcatag

SEQ ID NO: 7635813 - DNA, 22 bp, Homo sapiens
agtatatgtgcacatatgcatg

SEQ ID NO: 7635814 - DNA, 22 bp, Homo sapiens
agtatatggggaattgcataat

SEQ ID NO: 7635815 - DNA, 22 bp, Homo sapiens
agtatatcacatgtagtaatgg

SEQ ID NO: 7635816 - DNA, 22 bp, Homo sapiens
agtatatagtggcgctgtatgc

SEQ ID NO: 7635817 - DNA, 22 bp, Homo sapiens
agtatatatgaggaaccacaaa

SEQ ID NO: 7635818 - DNA, 22 bp, Homo sapiens
agtatatatgaggaaccacaaa

SEQ ID NO: 7635819 - DNA, 22 bp, Homo sapiens
agtatatatgaggaaccacaaa

SEQ ID NO: 7635820 - DNA, 22 bp, Homo sapiens
agtagtcacttctattaatggc

SEQ ID NO: 7635821 - DNA, 22 bp, Homo sapiens
agtagtcagcagataatatagg

SEQ ID NO: 7635822 - DNA, 22 bp, Homo sapiens
agtatatagtggcgctgtatgc

SEQ ID NO: 7635823 - DNA, 21 bp, Homo sapiens
agtagtatcctggagggacaa

SEQ ID NO: 7635824 - DNA, 22 bp, Homo sapiens
agtagtattctacagagggtgc

SEQ ID NO: 7635825 - DNA, 22 bp, Homo sapiens
agtagtcacttcacccatccca

SEQ ID NO: 7635826 - DNA, 22 bp, Homo sapiens
agtagtcacttctattaatggc

SEQ ID NO: 7635827 - DNA, 22 bp, Homo sapiens
agtatattttgattgtatgtgt

SEQ ID NO: 7635828 - DNA, 22 bp, Homo sapiens
agtatattttgattgtatgtgt

SEQ ID NO: 7635829 - DNA, 22 bp, Homo sapiens
agtatatttgttaagattattc

SEQ ID NO: 7635830 - DNA, 22 bp, Homo sapiens
agtatatttgttaagattattc

SEQ ID NO: 7635831 - DNA, 22 bp, Homo sapiens
agtatcaaggatctccagcacc

SEQ ID NO: 7635832 - DNA, 22 bp, Homo sapiens
agtatcaaggatctccagcacc

SEQ ID NO: 7635833 - DNA, 22 bp, Homo sapiens
agtatcaaagggcatgtggtta

SEQ ID NO: 7635834 - DNA, 22 bp, Homo sapiens
agtatatttgttaagattattc

SEQ ID NO: 7635835 - DNA, 22 bp, Homo sapiens
agtatatttgttaagattattc

SEQ ID NO: 7635836 - DNA, 22 bp, Homo sapiens
agtatatttgttaagattattc

SEQ ID NO: 7635837 - DNA, 22 bp, Homo sapiens
agtatatttgttaagattattc

SEQ ID NO: 7635838 - DNA, 22 bp, Homo sapiens
agtatatttgttaagattattc

SEQ ID NO: 7635839 - DNA, 22 bp, Homo sapiens
agtatattggtgttattcctca

SEQ ID NO: 7635840 - DNA, 22 bp, Homo sapiens
agtatattgctcttaatcatag

SEQ ID NO: 7635841 - DNA, 22 bp, Homo sapiens
agtatattggtgttattcctca

SEQ ID NO: 7635842 - DNA, 22 bp, Homo sapiens
agtatatttaccattgggtggg

SEQ ID NO: 7635843 - DNA, 23 bp, Homo sapiens
cggaggcaaatcggccatttaag

SEQ ID NO: 7635844 - DNA, 22 bp, Homo sapiens
cggaggcctgccaggagcttct

SEQ ID NO: 7635845 - DNA, 22 bp, Homo sapiens
cggaggcctcagctcatggttt

SEQ ID NO: 7635846 - DNA, 22 bp, Homo sapiens
cggaggggatacattttctgaa

SEQ ID NO: 7635847 - DNA, 22 bp, Homo sapiens
cggaggggatacattttctgaa

SEQ ID NO: 7635848 - DNA, 22 bp, Homo sapiens
cggaggggatacattttctgaa

SEQ ID NO: 7635849 - DNA, 23 bp, Homo sapiens
cggaggcaaatcggccatttaag

SEQ ID NO: 7635850 - DNA, 23 bp, Homo sapiens
cggaggcaaatcggccatttaag

SEQ ID NO: 7635851 - DNA, 22 bp, Homo sapiens
cggagcgctgggggactctgca

SEQ ID NO: 7635852 - DNA, 22 bp, Homo sapiens
cggaggcaaactcacctggctc

SEQ ID NO: 7635853 - DNA, 22 bp, Homo sapiens
cggaggcaaactcacctggctc

SEQ ID NO: 7635854 - DNA, 22 bp, Homo sapiens
cggaggcaaactcacctggctc

SEQ ID NO: 7635855 - DNA, 21 bp, Homo sapiens
cggagctgggcagggcatccc

SEQ ID NO: 7635856 - DNA, 21 bp, Homo sapiens
cggagctgggcagggcatccc

SEQ ID NO: 7635857 - DNA, 22 bp, Homo sapiens
cggagctgcctgccaagcctgc

SEQ ID NO: 7635858 - DNA, 22 bp, Homo sapiens
cggagctgcctgccaagcctgc

SEQ ID NO: 7635859 - DNA, 22 bp, Homo sapiens
cggagctgcgccgggacacggg

SEQ ID NO: 7635860 - DNA, 22 bp, Homo sapiens
cggagctgcgccgggacacggg

SEQ ID NO: 7635861 - DNA, 22 bp, Homo sapiens
cggagctggcgtctgtgtggac

SEQ ID NO: 7635862 - DNA, 22 bp, Homo sapiens
cggagctggcgtctgtgtggac

SEQ ID NO: 7635863 - DNA, 22 bp, Homo sapiens
cggagctgcgccgggacacggg

SEQ ID NO: 7635864 - DNA, 22 bp, Homo sapiens
cggagcagagccactcgggccg

SEQ ID NO: 7635865 - DNA, 22 bp, Homo sapiens
cggagcagagccactcgggccg

SEQ ID NO: 7635866 - DNA, 22 bp, Homo sapiens
cggagcagagccactcgggccg

SEQ ID NO: 7635867 - DNA, 22 bp, Homo sapiens
cggagcagaaggcgccgccggc

SEQ ID NO: 7635868 - DNA, 22 bp, Homo sapiens
cggagccagaggctggagaggc

SEQ ID NO: 7635869 - DNA, 22 bp, Homo sapiens
cggagcagagccactcgggccg

SEQ ID NO: 7635870 - DNA, 22 bp, Homo sapiens
cggagcagagccactcgggccg

SEQ ID NO: 7635871 - DNA, 22 bp, Homo sapiens
cggagcctgcttgttgcagctg

SEQ ID NO: 7635872 - DNA, 22 bp, Homo sapiens
cggagcctgcttgttgcagctg

SEQ ID NO: 7635873 - DNA, 22 bp, Homo sapiens
cggagcagaaggcgccgccggc

SEQ ID NO: 7635874 - DNA, 22 bp, Homo sapiens
cggagcagaaggcgccgccggc

SEQ ID NO: 7635875 - DNA, 22 bp, Homo sapiens
cggagcagaaggcgccgccggc

SEQ ID NO: 7635876 - DNA, 20 bp, Homo sapiens
cgctccaccctggacctggc

SEQ ID NO: 7635877 - DNA, 22 bp, Homo sapiens
cggagaggtgggggcagcatct

SEQ ID NO: 7635878 - DNA, 21 bp, Homo sapiens
cgctccaccccacccactggc

SEQ ID NO: 7635879 - DNA, 21 bp, Homo sapiens
cgctccaccccacccactggc

SEQ ID NO: 7635880 - DNA, 21 bp, Homo sapiens
cgctccaccccacccactggc

SEQ ID NO: 7635881 - DNA, 22 bp, Homo sapiens
cgctccaagcttgatgggacca

SEQ ID NO: 7635882 - DNA, 22 bp, Homo sapiens
cgctcagtagcttcctccacct

SEQ ID NO: 7635883 - DNA, 20 bp, Homo sapiens
cgctccaccctggacctggc

SEQ ID NO: 7635884 - DNA, 20 bp, Homo sapiens
cgctccaccctggacctggc

SEQ ID NO: 7635885 - DNA, 20 bp, Homo sapiens
cgctccagtcgctggtgtgt

SEQ ID NO: 7635886 - DNA, 20 bp, Homo sapiens
cgctccagtcgctggtgtgt

SEQ ID NO: 7635887 - DNA, 22 bp, Homo sapiens
cggagaggtgggggcagcatct

SEQ ID NO: 7635888 - DNA, 22 bp, Homo sapiens
cggaggggtttgaacagaggag

SEQ ID NO: 7635889 - DNA, 22 bp, Homo sapiens
cggaggggtttgaacagaggag

SEQ ID NO: 7635890 - DNA, 22 bp, Homo sapiens
cggaggggtttgaacagaggag

SEQ ID NO: 7635891 - DNA, 22 bp, Homo sapiens
cggaggggtttgaacagaggag

SEQ ID NO: 7635892 - DNA, 22 bp, Homo sapiens
cggaggggtttgaacagaggag

SEQ ID NO: 7635893 - DNA, 22 bp, Homo sapiens
cggaggggatacattttctgaa

SEQ ID NO: 7635894 - DNA, 22 bp, Homo sapiens
cggaggggatacattttctgaa

SEQ ID NO: 7635895 - DNA, 22 bp, Homo sapiens
cggaggggatacattttctgaa

SEQ ID NO: 7635896 - DNA, 22 bp, Homo sapiens
cggaggggatacattttctgaa

SEQ ID NO: 7635897 - DNA, 22 bp, Homo sapiens
cggaggggtttgaacagaggag

SEQ ID NO: 7635898 - DNA, 22 bp, Homo sapiens
cggaggggtttgaacagaggag

SEQ ID NO: 7635899 - DNA, 22 bp, Homo sapiens
cggaggggtttgaacagaggag

SEQ ID NO: 7635900 - DNA, 22 bp, Homo sapiens
cggaggggtttgaacagaggag

SEQ ID NO: 7635901 - DNA, 22 bp, Homo sapiens
cggaggggtttgaacagaggag

SEQ ID NO: 7635902 - DNA, 22 bp, Homo sapiens
cggaggggtttgaacagaggag

SEQ ID NO: 7635903 - DNA, 22 bp, Homo sapiens
cggaggggtttgaacagaggag

SEQ ID NO: 7635904 - DNA, 22 bp, Homo sapiens
cggaggggtttgaacagaggag

SEQ ID NO: 7635905 - DNA, 22 bp, Homo sapiens
cggaggttgaggctgcagtgag

SEQ ID NO: 7635906 - DNA, 22 bp, Homo sapiens
cggcatgggcgtccccctcact

SEQ ID NO: 7635907 - DNA, 22 bp, Homo sapiens
cggcatgggcgtccccctcact

SEQ ID NO: 7635908 - DNA, 22 bp, Homo sapiens
cggaggttgaggctgcagtgag

SEQ ID NO: 7635909 - DNA, 22 bp, Homo sapiens
cggaggttgaggctgcagtgag

SEQ ID NO: 7635910 - DNA, 22 bp, Homo sapiens
cggccaagccggggccccgaag

SEQ ID NO: 7635911 - DNA, 22 bp, Homo sapiens
cggccaagccggggccccgaag

SEQ ID NO: 7635912 - DNA, 22 bp, Homo sapiens
cggccaagccggggccccgaag

SEQ ID NO: 7635913 - DNA, 22 bp, Homo sapiens
cggccaagccggggccccgaag

SEQ ID NO: 7635914 - DNA, 22 bp, Homo sapiens
cggccaagccggggccccgaag

SEQ ID NO: 7635915 - DNA, 22 bp, Homo sapiens
cggccaggcacagtggcccacg

SEQ ID NO: 7635916 - DNA, 22 bp, Homo sapiens
cggccaagccggggccccgaag

SEQ ID NO: 7635917 - DNA, 22 bp, Homo sapiens
cggccaagccggggccccgaag

SEQ ID NO: 7635918 - DNA, 19 bp, Homo sapiens
cggcccctcctctcgcgcc

SEQ ID NO: 7635919 - DNA, 22 bp, Homo sapiens
cggcccgctgcgagtgcaccgt

SEQ ID NO: 7635920 - DNA, 22 bp, Homo sapiens
cggccaagccggggccccgaag

SEQ ID NO: 7635921 - DNA, 22 bp, Homo sapiens
cggccaggcacagtggcccacg

SEQ ID NO: 7635922 - DNA, 22 bp, Homo sapiens
cgaggcagggaagctgcaaaag

SEQ ID NO: 7635923 - DNA, 20 bp, Homo sapiens
cgaggccaaggggctgggcc

SEQ ID NO: 7635924 - DNA, 20 bp, Homo sapiens
cgaggccaaggggctgggcc

SEQ ID NO: 7635925 - DNA, 20 bp, Homo sapiens
cgaggccaaggggctgggcc

SEQ ID NO: 7635926 - DNA, 22 bp, Homo sapiens
cgaggcagggaagctgcaaaag

SEQ ID NO: 7635927 - DNA, 18 bp, Homo sapiens
cgaggcaggcggatcacg

SEQ ID NO: 7635928 - DNA, 18 bp, Homo sapiens
cgaggcaggcggatcacg

SEQ ID NO: 7635929 - DNA, 22 bp, Homo sapiens
cgaggcagggaagctgcaaaag

SEQ ID NO: 7635930 - DNA, 22 bp, Homo sapiens
cgaggcagggaagctgcaaaag

SEQ ID NO: 7635931 - DNA, 22 bp, Homo sapiens
cgaggccagctctaagccctac

SEQ ID NO: 7635932 - DNA, 22 bp, Homo sapiens
cgaggccagctctaagccctac

SEQ ID NO: 7635933 - DNA, 22 bp, Homo sapiens
cgaggccaccgtggtttccgag

SEQ ID NO: 7635934 - DNA, 22 bp, Homo sapiens
cgctcagactcatgatatgctg

SEQ ID NO: 7635935 - DNA, 23 bp, Homo sapiens
cgctcagaggttctgtccttggt

SEQ ID NO: 7635936 - DNA, 22 bp, Homo sapiens
cgctcagtacagtaatgatggg

SEQ ID NO: 7635937 - DNA, 22 bp, Homo sapiens
cgaggccacacctgcttctggg

SEQ ID NO: 7635938 - DNA, 22 bp, Homo sapiens
cgaggccaccgtggtttccgag

SEQ ID NO: 7635939 - DNA, 22 bp, Homo sapiens
cgaggccaccgtggtttccgag

SEQ ID NO: 7635940 - DNA, 22 bp, Homo sapiens
cgaggccaatgtgttttatgaa

SEQ ID NO: 7635941 - DNA, 22 bp, Homo sapiens
cgaggccaatgtgttttatgaa

SEQ ID NO: 7635942 - DNA, 22 bp, Homo sapiens
cgaggccacacctgcttctggg

SEQ ID NO: 7635943 - DNA, 22 bp, Homo sapiens
cgaggccacacctgcttctggg

SEQ ID NO: 7635944 - DNA, 22 bp, Homo sapiens
cgaggcagacaaaagttggaag

SEQ ID NO: 7635945 - DNA, 22 bp, Homo sapiens
cgaggcagacaaaagttggaag

SEQ ID NO: 7635946 - DNA, 22 bp, Homo sapiens
cgaggcagacaaaagttggaag

SEQ ID NO: 7635947 - DNA, 22 bp, Homo sapiens
cgaggcagacaaaagttggaag

SEQ ID NO: 7635948 - DNA, 22 bp, Homo sapiens
cgaggcagacaaaagttggaag

SEQ ID NO: 7635949 - DNA, 22 bp, Homo sapiens
cgaggaggaaacgcggagaact

SEQ ID NO: 7635950 - DNA, 22 bp, Homo sapiens
cgaggcaatagagcccagaggt

SEQ ID NO: 7635951 - DNA, 22 bp, Homo sapiens
cgaggatgggatgtcttgacag

SEQ ID NO: 7635952 - DNA, 22 bp, Homo sapiens
cgaggaggaaacgcggagaact

SEQ ID NO: 7635953 - DNA, 22 bp, Homo sapiens
cgaggcagaggctgaaacggct

SEQ ID NO: 7635954 - DNA, 22 bp, Homo sapiens
cgaggcaggcaggcggaggata

SEQ ID NO: 7635955 - DNA, 22 bp, Homo sapiens
cgaggcaggcaggcggaggata

SEQ ID NO: 7635956 - DNA, 22 bp, Homo sapiens
cgaggcaggcaggcggaggata

SEQ ID NO: 7635957 - DNA, 22 bp, Homo sapiens
cgaggcaggcaggcggaggata

SEQ ID NO: 7635958 - DNA, 22 bp, Homo sapiens
cgaggcagaggctgaaacggct

SEQ ID NO: 7635959 - DNA, 22 bp, Homo sapiens
cgaggcagaggctgaaacggct

SEQ ID NO: 7635960 - DNA, 22 bp, Homo sapiens
cgaggcagaggctgaaacggct

SEQ ID NO: 7635961 - DNA, 22 bp, Homo sapiens
cgaggcagaggctgaaacggct

SEQ ID NO: 7635962 - DNA, 22 bp, Homo sapiens
cgaggcaggcaggcggaggata

SEQ ID NO: 7635963 - DNA, 22 bp, Homo sapiens
cgaggcaggcaggcggaggata

SEQ ID NO: 7635964 - DNA, 18 bp, Homo sapiens
cgaggcaggcggatcacg

SEQ ID NO: 7635965 - DNA, 18 bp, Homo sapiens
cgaggcaggcggatcacg

SEQ ID NO: 7635966 - DNA, 18 bp, Homo sapiens
cgaggcaggcggatcacg

SEQ ID NO: 7635967 - DNA, 22 bp, Homo sapiens
cgaggaggaaacgcggagaact

SEQ ID NO: 7635968 - DNA, 22 bp, Homo sapiens
cgaggaagaagtttgagtcaag

SEQ ID NO: 7635969 - DNA, 22 bp, Homo sapiens
cgagcatgatgacggctgtggc

SEQ ID NO: 7635970 - DNA, 22 bp, Homo sapiens
cgaggaaatatttacaactgat

SEQ ID NO: 7635971 - DNA, 22 bp, Homo sapiens
cgaggaagaagtttgagtcaag

SEQ ID NO: 7635972 - DNA, 22 bp, Homo sapiens
cgaggaagaagtttgagtcaag

SEQ ID NO: 7635973 - DNA, 22 bp, Homo sapiens
cgaggaagaagtttgagtcaag

SEQ ID NO: 7635974 - DNA, 22 bp, Homo sapiens
cgaggaaaggcgatggctctcg

SEQ ID NO: 7635975 - DNA, 22 bp, Homo sapiens
cgaggaaaggcgatggctctcg

SEQ ID NO: 7635976 - DNA, 22 bp, Homo sapiens
cgaggaaaggcgatggctctcg

SEQ ID NO: 7635977 - DNA, 22 bp, Homo sapiens
cgaggaaatatttacaactgat

SEQ ID NO: 7635978 - DNA, 22 bp, Homo sapiens
cgaggaaatatttacaactgat

SEQ ID NO: 7635979 - DNA, 22 bp, Homo sapiens
cgaggaaatatttacaactgat

SEQ ID NO: 7635980 - DNA, 22 bp, Homo sapiens
ccttttatgaacttgagcaggt

SEQ ID NO: 7635981 - DNA, 22 bp, Homo sapiens
cgagcatgatgacggctgtggc

SEQ ID NO: 7635982 - DNA, 22 bp, Homo sapiens
ccttttcccatgtttctggagc

SEQ ID NO: 7635983 - DNA, 22 bp, Homo sapiens
cgagcatgatgacggctgtggc

SEQ ID NO: 7635984 - DNA, 22 bp, Homo sapiens
cgagcatgatgacggctgtggc

SEQ ID NO: 7635985 - DNA, 22 bp, Homo sapiens
cgagcatgatgacggctgtggc

SEQ ID NO: 7635986 - DNA, 22 bp, Homo sapiens
ccttttataaagttgtattgaa

SEQ ID NO: 7635987 - DNA, 22 bp, Homo sapiens
ccttttataaagttgtattgaa

SEQ ID NO: 7635988 - DNA, 22 bp, Homo sapiens
ccttttataaagttgtattgaa

SEQ ID NO: 7635989 - DNA, 22 bp, Homo sapiens
ccttttatactcagtgatatca

SEQ ID NO: 7635990 - DNA, 22 bp, Homo sapiens
ccttttatactcagtgatatca

SEQ ID NO: 7635991 - DNA, 22 bp, Homo sapiens
ccttttatactcagtgatatca

SEQ ID NO: 7635992 - DNA, 22 bp, Homo sapiens
ccttttatactcagtgatatca

SEQ ID NO: 7635993 - DNA, 22 bp, Homo sapiens
ccttttatactctgtcctctgg

SEQ ID NO: 7635994 - DNA, 22 bp, Homo sapiens
ccttttatactctgtcctctgg

SEQ ID NO: 7635995 - DNA, 22 bp, Homo sapiens
ccttttatactctgtcctctgg

SEQ ID NO: 7635996 - DNA, 22 bp, Homo sapiens
ccttttatactctgtcctctgg

SEQ ID NO: 7635997 - DNA, 22 bp, Homo sapiens
ccttttatactctgtcctctgg

SEQ ID NO: 7635998 - DNA, 22 bp, Homo sapiens
ccttttatagatcagtgtgtta

SEQ ID NO: 7635999 - DNA, 22 bp, Homo sapiens
ccttttatatggctcatcacag

SEQ ID NO: 7636000 - DNA, 22 bp, Homo sapiens
ccttttatatggctcatcacag

SEQ ID NO: 7636001 - DNA, 22 bp, Homo sapiens
ccttttatagatcagtgtgtta

SEQ ID NO: 7636002 - DNA, 22 bp, Homo sapiens
ccttttatagatcagtgtgtta

SEQ ID NO: 7636003 - DNA, 22 bp, Homo sapiens
ccttttatagatcagtgtgtta

SEQ ID NO: 7636004 - DNA, 22 bp, Homo sapiens
ccttttatatggctcatcacag

SEQ ID NO: 7636005 - DNA, 22 bp, Homo sapiens
ccttttatatggctcatcacag

SEQ ID NO: 7636006 - DNA, 22 bp, Homo sapiens
ccttttatatggctcatcacag

SEQ ID NO: 7636007 - DNA, 22 bp, Homo sapiens
ccttttatgaacttgagcaggt

SEQ ID NO: 7636008 - DNA, 22 bp, Homo sapiens
ccttttatgaacttgagcaggt

SEQ ID NO: 7636009 - DNA, 22 bp, Homo sapiens
ccttttatgaacttgagcaggt

SEQ ID NO: 7636010 - DNA, 22 bp, Homo sapiens
ccttttatgaacttgagcaggt

SEQ ID NO: 7636011 - DNA, 22 bp, Homo sapiens
aggtgggggctgtgtccttgac

SEQ ID NO: 7636012 - DNA, 22 bp, Homo sapiens
aggtgggggctgtgtccttgac

SEQ ID NO: 7636013 - DNA, 22 bp, Homo sapiens
aggtgggggctgtgtccttgac

SEQ ID NO: 7636014 - DNA, 22 bp, Homo sapiens
aggtgggggctgtgtccttgac

SEQ ID NO: 7636015 - DNA, 22 bp, Homo sapiens
aggtgggggctgtgtccttgac

SEQ ID NO: 7636016 - DNA, 22 bp, Homo sapiens
aggtgggggctgtgtccttgac

SEQ ID NO: 7636017 - DNA, 22 bp, Homo sapiens
aggtgggggctgtgtccttgac

SEQ ID NO: 7636018 - DNA, 22 bp, Homo sapiens
aggtggggtgagctgcagacta

SEQ ID NO: 7636019 - DNA, 22 bp, Homo sapiens
aggtggggtgagctgcagacta

SEQ ID NO: 7636020 - DNA, 22 bp, Homo sapiens
aggtggggtgagctgcagacta

SEQ ID NO: 7636021 - DNA, 22 bp, Homo sapiens
aggtggggtgagctgcagacta

SEQ ID NO: 7636022 - DNA, 22 bp, Homo sapiens
aggtggggtgagctgcagacta

SEQ ID NO: 7636023 - DNA, 22 bp, Homo sapiens
aggtggggtgagctgcagacta

SEQ ID NO: 7636024 - DNA, 22 bp, Homo sapiens
aggtgggggctgtgtccttgac

SEQ ID NO: 7636025 - DNA, 22 bp, Homo sapiens
aggtgggggctgtgtccttgac

SEQ ID NO: 7636026 - DNA, 22 bp, Homo sapiens
cctttattcaattagtcctaat

SEQ ID NO: 7636027 - DNA, 22 bp, Homo sapiens
cctttattcaattagtcctaat

SEQ ID NO: 7636028 - DNA, 22 bp, Homo sapiens
cctttattcaattagtcctaat

SEQ ID NO: 7636029 - DNA, 22 bp, Homo sapiens
cctttattcaattagtcctaat

SEQ ID NO: 7636030 - DNA, 22 bp, Homo sapiens
aggtggggtgttggatgtttat

SEQ ID NO: 7636031 - DNA, 22 bp, Homo sapiens
aggtggggtgttggatgtttat

SEQ ID NO: 7636032 - DNA, 22 bp, Homo sapiens
aggtggggtgttggatgtttat

SEQ ID NO: 7636033 - DNA, 22 bp, Homo sapiens
aggtggggtgttggatgtttat

SEQ ID NO: 7636034 - DNA, 22 bp, Homo sapiens
aggtggggtgagctgcagacta

SEQ ID NO: 7636035 - DNA, 22 bp, Homo sapiens
aggtggggtgagctgcagacta

SEQ ID NO: 7636036 - DNA, 22 bp, Homo sapiens
aggtggggtgagctgcagacta

SEQ ID NO: 7636037 - DNA, 22 bp, Homo sapiens
cctttgttcactggagagtgga

SEQ ID NO: 7636038 - DNA, 22 bp, Homo sapiens
cctttgttcattgccttcagtc

SEQ ID NO: 7636039 - DNA, 22 bp, Homo sapiens
cctttgtggggcggtgggtaat

SEQ ID NO: 7636040 - DNA, 22 bp, Homo sapiens
cctttgtggtggcccagtgtgg

SEQ ID NO: 7636041 - DNA, 22 bp, Homo sapiens
ccttttaagggagactagagat

SEQ ID NO: 7636042 - DNA, 22 bp, Homo sapiens
ccttttataaagttgtattgaa

SEQ ID NO: 7636043 - DNA, 22 bp, Homo sapiens
ccttttataaagttgtattgaa

SEQ ID NO: 7636044 - DNA, 22 bp, Homo sapiens
ccttttaagggagactagagat

SEQ ID NO: 7636045 - DNA, 22 bp, Homo sapiens
ccttttaagggagactagagat

SEQ ID NO: 7636046 - DNA, 22 bp, Homo sapiens
cctttgttcattgccttcagtc

SEQ ID NO: 7636047 - DNA, 19 bp, Homo sapiens
cctttggtttttggttcat

SEQ ID NO: 7636048 - DNA, 22 bp, Homo sapiens
cctttgtaagatgtgaagactg

SEQ ID NO: 7636049 - DNA, 19 bp, Homo sapiens
cctttggtttccatgacat

SEQ ID NO: 7636050 - DNA, 19 bp, Homo sapiens
cctttggtttttggttcat

SEQ ID NO: 7636051 - DNA, 22 bp, Homo sapiens
cctttgtgaatatgcagaaaat

SEQ ID NO: 7636052 - DNA, 22 bp, Homo sapiens
cctttgtgaatatgcagaaaat

SEQ ID NO: 7636053 - DNA, 22 bp, Homo sapiens
cctttgtgaggtcctgtggggg

SEQ ID NO: 7636054 - DNA, 22 bp, Homo sapiens
cctttggtcacctccactctta

SEQ ID NO: 7636055 - DNA, 22 bp, Homo sapiens
cctttggtcacctccactctta

SEQ ID NO: 7636056 - DNA, 22 bp, Homo sapiens
cctttggtcacctccactctta

SEQ ID NO: 7636057 - DNA, 22 bp, Homo sapiens
cctttggtcacctccactctta

SEQ ID NO: 7636058 - DNA, 22 bp, Homo sapiens
cctttggtcacctccactctta

SEQ ID NO: 7636059 - DNA, 22 bp, Homo sapiens
cctttggtcttgatgaactgtt

SEQ ID NO: 7636060 - DNA, 22 bp, Homo sapiens
cctttggtcttgatgaactgtt

SEQ ID NO: 7636061 - DNA, 22 bp, Homo sapiens
cctttggtcttgatgaactgtt

SEQ ID NO: 7636062 - DNA, 22 bp, Homo sapiens
cctttggtcttgatgaactgtt

SEQ ID NO: 7636063 - DNA, 22 bp, Homo sapiens
cctttggtcttgatgaactgtt

SEQ ID NO: 7636064 - DNA, 22 bp, Homo sapiens
cctttggtcttgatgaactgtt

SEQ ID NO: 7636065 - DNA, 22 bp, Homo sapiens
cctttggtggcttcaaaatggc

SEQ ID NO: 7636066 - DNA, 22 bp, Homo sapiens
cctttggtgttattgggagaca

SEQ ID NO: 7636067 - DNA, 22 bp, Homo sapiens
cctttggtgttattgggagaca

SEQ ID NO: 7636068 - DNA, 22 bp, Homo sapiens
cctttggtggttttcagagatc

SEQ ID NO: 7636069 - DNA, 22 bp, Homo sapiens
cctttggtggttttcagagatc

SEQ ID NO: 7636070 - DNA, 22 bp, Homo sapiens
cctttggtggttttcagagatc

SEQ ID NO: 7636071 - DNA, 22 bp, Homo sapiens
cctttggtggttttcagagatc

SEQ ID NO: 7636072 - DNA, 19 bp, Homo sapiens
cctttggtttccatgacat

SEQ ID NO: 7636073 - DNA, 19 bp, Homo sapiens
cctttggtttccatgacat

SEQ ID NO: 7636074 - DNA, 19 bp, Homo sapiens
cctttggtttccatgacat

SEQ ID NO: 7636075 - DNA, 22 bp, Homo sapiens
cctttggttgagtgaaagtaag

SEQ ID NO: 7636076 - DNA, 22 bp, Homo sapiens
cctttggtgttattgggagaca

SEQ ID NO: 7636077 - DNA, 22 bp, Homo sapiens
cctttggtgttattgggagaca

SEQ ID NO: 7636078 - DNA, 22 bp, Homo sapiens
cctttggttgagtgaaagtaag

SEQ ID NO: 7636079 - DNA, 17 bp, Homo sapiens
aggtgccagtgatatac

SEQ ID NO: 7636080 - DNA, 22 bp, Homo sapiens
aggtgccagtgctgtggtcccc

SEQ ID NO: 7636081 - DNA, 22 bp, Homo sapiens
aggtgccaggagggaatttagg

SEQ ID NO: 7636082 - DNA, 22 bp, Homo sapiens
aggtgccagtgctgtggtcccc

SEQ ID NO: 7636083 - DNA, 22 bp, Homo sapiens
aggtgccattgcttgccagttt

SEQ ID NO: 7636084 - DNA, 23 bp, Homo sapiens
aggtgcccagggcaggtttactg

SEQ ID NO: 7636085 - DNA, 22 bp, Homo sapiens
aggtgccagtgctgtggtcccc

SEQ ID NO: 7636086 - DNA, 23 bp, Homo sapiens
aggtgcccagaccccaccctctt

SEQ ID NO: 7636087 - DNA, 23 bp, Homo sapiens
aggtgcccagaccccaccctctt

SEQ ID NO: 7636088 - DNA, 22 bp, Homo sapiens
aggtgcaggagctgtgcaggga

SEQ ID NO: 7636089 - DNA, 22 bp, Homo sapiens
aggtgcaggagctgtgcaggga

SEQ ID NO: 7636090 - DNA, 22 bp, Homo sapiens
aggtgcaggagctgtgcaggga

SEQ ID NO: 7636091 - DNA, 22 bp, Homo sapiens
aggtgcaggagctgtgcaggga

SEQ ID NO: 7636092 - DNA, 22 bp, Homo sapiens
aggtgcaggagctgtgcaggga

SEQ ID NO: 7636093 - DNA, 22 bp, Homo sapiens
aggtgcaggagctgtgcaggga

SEQ ID NO: 7636094 - DNA, 22 bp, Homo sapiens
aggtgcaggagctgtgcaggga

SEQ ID NO: 7636095 - DNA, 22 bp, Homo sapiens
aggtgccagctctcaggcagga

SEQ ID NO: 7636096 - DNA, 22 bp, Homo sapiens
aggtgccagctctcaggcagga

SEQ ID NO: 7636097 - DNA, 22 bp, Homo sapiens
aggtgccttccgcggagctcgc

SEQ ID NO: 7636098 - DNA, 22 bp, Homo sapiens
aggtgcctgtcgtctctggtta

SEQ ID NO: 7636099 - DNA, 22 bp, Homo sapiens
aggtgccttccgcggagctcgc

SEQ ID NO: 7636100 - DNA, 22 bp, Homo sapiens
aggtgctctaggtatctacttt

SEQ ID NO: 7636101 - DNA, 18 bp, Homo sapiens
aggtgctcaaatgggaaa

SEQ ID NO: 7636102 - DNA, 22 bp, Homo sapiens
aggtgcctgtcgtctctggtta

SEQ ID NO: 7636103 - DNA, 22 bp, Homo sapiens
aggtgcctgggagctccctgag

SEQ ID NO: 7636104 - DNA, 22 bp, Homo sapiens
aggtgcctgtcgtctctggtta

SEQ ID NO: 7636105 - DNA, 22 bp, Homo sapiens
aggtgcctgtcgtctctggtta

SEQ ID NO: 7636106 - DNA, 22 bp, Homo sapiens
aggtgccttccgcggagctcgc

SEQ ID NO: 7636107 - DNA, 22 bp, Homo sapiens
aggtgccttccgcggagctcgc

SEQ ID NO: 7636108 - DNA, 22 bp, Homo sapiens
aggtgcctgggagctccctgag

SEQ ID NO: 7636109 - DNA, 22 bp, Homo sapiens
aggtgcctatctggtctctgca

SEQ ID NO: 7636110 - DNA, 22 bp, Homo sapiens
aggtgcctatctggtctctgca

SEQ ID NO: 7636111 - DNA, 22 bp, Homo sapiens
aggtgcctatctggtctctgca

SEQ ID NO: 7636112 - DNA, 22 bp, Homo sapiens
aggtgcctatctggtctctgca

SEQ ID NO: 7636113 - DNA, 18 bp, Homo sapiens
aggtgccctccttacact

SEQ ID NO: 7636114 - DNA, 22 bp, Homo sapiens
aggtgccctgctgtgcccttct

SEQ ID NO: 7636115 - DNA, 22 bp, Homo sapiens
aggtgccctgctgtgcccttct

SEQ ID NO: 7636116 - DNA, 22 bp, Homo sapiens
aggtgccctgctgtgcccttct

SEQ ID NO: 7636117 - DNA, 18 bp, Homo sapiens
aggtgccctccttacact

SEQ ID NO: 7636118 - DNA, 23 bp, Homo sapiens
aggtgcccagaccccaccctctt

SEQ ID NO: 7636119 - DNA, 22 bp, Homo sapiens
aggtgcccatcacctcacagtc

SEQ ID NO: 7636120 - DNA, 22 bp, Homo sapiens
aggtgcccatcacctcacagtc

SEQ ID NO: 7636121 - DNA, 22 bp, Homo sapiens
aggtgcccatcacctcacagtc

SEQ ID NO: 7636122 - DNA, 22 bp, Homo sapiens
aggtgcccatgagctccatggc

SEQ ID NO: 7636123 - DNA, 22 bp, Homo sapiens
aggtgcccatgagctccatggc

SEQ ID NO: 7636124 - DNA, 22 bp, Homo sapiens
cctgggacctcgcgggaagcgg

SEQ ID NO: 7636125 - DNA, 22 bp, Homo sapiens
cctgggacctcgcgggaagcgg

SEQ ID NO: 7636126 - DNA, 21 bp, Homo sapiens
cctgggacactcaccagctcc

SEQ ID NO: 7636127 - DNA, 21 bp, Homo sapiens
cctgggacactcaccagctcc

SEQ ID NO: 7636128 - DNA, 22 bp, Homo sapiens
cctgggacctcgcgggaagcgg

SEQ ID NO: 7636129 - DNA, 21 bp, Homo sapiens
cctgggacactcaccagctcc

SEQ ID NO: 7636130 - DNA, 22 bp, Homo sapiens
cctgggacctcgcgggaagcgg

SEQ ID NO: 7636131 - DNA, 22 bp, Homo sapiens
cctgggactcggccaggacaga

SEQ ID NO: 7636132 - DNA, 22 bp, Homo sapiens
cctgggacgactctgtaccctt

SEQ ID NO: 7636133 - DNA, 22 bp, Homo sapiens
cctgggacgactctgtaccctt

SEQ ID NO: 7636134 - DNA, 22 bp, Homo sapiens
cctgggacctcgcgggaagcgg

SEQ ID NO: 7636135 - DNA, 22 bp, Homo sapiens
cctgggacctcgcgggaagcgg

SEQ ID NO: 7636136 - DNA, 22 bp, Homo sapiens
cctgggacctcgcgggaagcgg

SEQ ID NO: 7636137 - DNA, 22 bp, Homo sapiens
cctgggacctcgcgggaagcgg

SEQ ID NO: 7636138 - DNA, 22 bp, Homo sapiens
cctgggacctcgcgggaagcgg

SEQ ID NO: 7636139 - DNA, 22 bp, Homo sapiens
cctgggaagttgtggctgcagt

SEQ ID NO: 7636140 - DNA, 22 bp, Homo sapiens
cctgggaagttgtggctgcagt

SEQ ID NO: 7636141 - DNA, 22 bp, Homo sapiens
cctgggaagttgtggctgcagt

SEQ ID NO: 7636142 - DNA, 22 bp, Homo sapiens
cctgggaagtggaggttacagt

SEQ ID NO: 7636143 - DNA, 22 bp, Homo sapiens
cctgggaagttgtggctgcagt

SEQ ID NO: 7636144 - DNA, 22 bp, Homo sapiens
cctgggaagttgtggctgcagt

SEQ ID NO: 7636145 - DNA, 21 bp, Homo sapiens
cctgggacactcaccagctcc

SEQ ID NO: 7636146 - DNA, 19 bp, Homo sapiens
cctgggacttaggctgggt

SEQ ID NO: 7636147 - DNA, 19 bp, Homo sapiens
cctgggacttaggctgggt

SEQ ID NO: 7636148 - DNA, 19 bp, Homo sapiens
cctgggacttaggctgggt

SEQ ID NO: 7636149 - DNA, 19 bp, Homo sapiens
cctgggacttaggctgggt

SEQ ID NO: 7636150 - DNA, 19 bp, Homo sapiens
cctgggacttaggctgggt

SEQ ID NO: 7636151 - DNA, 19 bp, Homo sapiens
cctgggacttaggctgggt

SEQ ID NO: 7636152 - DNA, 19 bp, Homo sapiens
cctgggacttaggctgggt

SEQ ID NO: 7636153 - DNA, 22 bp, Homo sapiens
cctgggactcggccaggacaga

SEQ ID NO: 7636154 - DNA, 22 bp, Homo sapiens
cctgggactcggccaggacaga

SEQ ID NO: 7636155 - DNA, 22 bp, Homo sapiens
cctgggactcggccaggacaga

SEQ ID NO: 7636156 - DNA, 22 bp, Homo sapiens
cctgggactcggccaggacaga

SEQ ID NO: 7636157 - DNA, 22 bp, Homo sapiens
cctgggactcggccaggacaga

SEQ ID NO: 7636158 - DNA, 22 bp, Homo sapiens
cctgggactcggccaggacaga

SEQ ID NO: 7636159 - DNA, 22 bp, Homo sapiens
cctgggactcggccaggacaga

SEQ ID NO: 7636160 - DNA, 22 bp, Homo sapiens
cctgggactcggccaggacaga

SEQ ID NO: 7636161 - DNA, 22 bp, Homo sapiens
cctgggagaactgctgggttgg

SEQ ID NO: 7636162 - DNA, 22 bp, Homo sapiens
cctgggacttggtctggggttt

SEQ ID NO: 7636163 - DNA, 19 bp, Homo sapiens
cctgggacttaggctgggt

SEQ ID NO: 7636164 - DNA, 22 bp, Homo sapiens
cctgggacttggtctggggttt

SEQ ID NO: 7636165 - DNA, 22 bp, Homo sapiens
aggtgcaggagctgtgcaggga

SEQ ID NO: 7636166 - DNA, 22 bp, Homo sapiens
cctgggagaactgctgggttgg

SEQ ID NO: 7636167 - DNA, 22 bp, Homo sapiens
cctgggagaactgctgggttgg

SEQ ID NO: 7636168 - DNA, 22 bp, Homo sapiens
aggtgctggagtagaagaaaaa

SEQ ID NO: 7636169 - DNA, 22 bp, Homo sapiens
aggtgctggagtagaagaaaaa

SEQ ID NO: 7636170 - DNA, 22 bp, Homo sapiens
aggtgctggagtctgggcagga

SEQ ID NO: 7636171 - DNA, 17 bp, Homo sapiens
aggtgctggagcatcag

SEQ ID NO: 7636172 - DNA, 17 bp, Homo sapiens
aggtgctggagcatcag

SEQ ID NO: 7636173 - DNA, 17 bp, Homo sapiens
aggtgctggagcatcag

SEQ ID NO: 7636174 - DNA, 22 bp, Homo sapiens
aggtgctgaactggtgaggtct

SEQ ID NO: 7636175 - DNA, 22 bp, Homo sapiens
aggtgctgaactggtgaggtct

SEQ ID NO: 7636176 - DNA, 22 bp, Homo sapiens
aggtgctgaactggtgaggtct

SEQ ID NO: 7636177 - DNA, 22 bp, Homo sapiens
aggtgctgaactggtgaggtct

SEQ ID NO: 7636178 - DNA, 22 bp, Homo sapiens
aggtgctgaactggtgaggtct

SEQ ID NO: 7636179 - DNA, 22 bp, Homo sapiens
aggtgctgaactggtgaggtct

SEQ ID NO: 7636180 - DNA, 22 bp, Homo sapiens
aggtgctgccccgagaaggatg

SEQ ID NO: 7636181 - DNA, 17 bp, Homo sapiens
aggtgctggagcatcag

SEQ ID NO: 7636182 - DNA, 17 bp, Homo sapiens
aggtgctggagcatcag

SEQ ID NO: 7636183 - DNA, 17 bp, Homo sapiens
aggtgctggagcatcag

SEQ ID NO: 7636184 - DNA, 22 bp, Homo sapiens
aggtgctgccccgagaaggatg

SEQ ID NO: 7636185 - DNA, 22 bp, Homo sapiens
aggtgctggcgccccaggagac

SEQ ID NO: 7636186 - DNA, 21 bp, Homo sapiens
aggtgctggcgccccaggaga

SEQ ID NO: 7636187 - DNA, 22 bp, Homo sapiens
aggtgctggcgccccaggagac

SEQ ID NO: 7636188 - DNA, 22 bp, Homo sapiens
aggtgctgggcagcagtcattg

SEQ ID NO: 7636189 - DNA, 22 bp, Homo sapiens
aggtgctgggcagcagtcattg

SEQ ID NO: 7636190 - DNA, 22 bp, Homo sapiens
aggtgctggcgccccaggagac

SEQ ID NO: 7636191 - DNA, 22 bp, Homo sapiens
aggtgctggcgccccaggagac

SEQ ID NO: 7636192 - DNA, 21 bp, Homo sapiens
aggtgctggcgccccaggaga

SEQ ID NO: 7636193 - DNA, 22 bp, Homo sapiens
aggtgctggagtctgggcagga

SEQ ID NO: 7636194 - DNA, 22 bp, Homo sapiens
aggtgctggagtctgggcagga

SEQ ID NO: 7636195 - DNA, 22 bp, Homo sapiens
aggtgctggagtctgggcagga

SEQ ID NO: 7636196 - DNA, 22 bp, Homo sapiens
aggtgctggagtctgggcagga

SEQ ID NO: 7636197 - DNA, 22 bp, Homo sapiens
aggtgctggagtctgggcagga

SEQ ID NO: 7636198 - DNA, 22 bp, Homo sapiens
aggtgctggagtctgggcagga

SEQ ID NO: 7636199 - DNA, 22 bp, Homo sapiens
aggtgctggagtctgggcagga

SEQ ID NO: 7636200 - DNA, 22 bp, Homo sapiens
aggtgctggagtctgggcagga

SEQ ID NO: 7636201 - DNA, 19 bp, Homo sapiens
aggtgctggtgagggtgtt

SEQ ID NO: 7636202 - DNA, 19 bp, Homo sapiens
aggtgctggtgagggtgtt

SEQ ID NO: 7636203 - DNA, 19 bp, Homo sapiens
aggtgctggtgagggtgtt

SEQ ID NO: 7636204 - DNA, 22 bp, Homo sapiens
aggtgctgggcagcagtcattg

SEQ ID NO: 7636205 - DNA, 22 bp, Homo sapiens
aggtgctgtgctatgcacttgt

SEQ ID NO: 7636206 - DNA, 22 bp, Homo sapiens
aggtgctgtgctatgcacttgt

SEQ ID NO: 7636207 - DNA, 19 bp, Homo sapiens
aggtgctggtgagggtgtt

SEQ ID NO: 7636208 - DNA, 19 bp, Homo sapiens
aggtgctggtgagggtgtt

SEQ ID NO: 7636209 - DNA, 19 bp, Homo sapiens
aggtgctggtgagggtgtt

SEQ ID NO: 7636210 - DNA, 22 bp, Homo sapiens
aggtgctgtttgtcagcagttt

SEQ ID NO: 7636211 - DNA, 22 bp, Homo sapiens
aggtgctgtttgtcagcagttt

SEQ ID NO: 7636212 - DNA, 22 bp, Homo sapiens
aggtgctgtttgtcagcagttt

SEQ ID NO: 7636213 - DNA, 22 bp, Homo sapiens
aggtgctgttggcagcgggcag

SEQ ID NO: 7636214 - DNA, 22 bp, Homo sapiens
aggtgctgttggcagcgggcag

SEQ ID NO: 7636215 - DNA, 22 bp, Homo sapiens
aggtgctgttaacatatgaggt

SEQ ID NO: 7636216 - DNA, 22 bp, Homo sapiens
aggtgctgttggcagcgggcag

SEQ ID NO: 7636217 - DNA, 22 bp, Homo sapiens
aggtgctgttggcagcgggcag

SEQ ID NO: 7636218 - DNA, 22 bp, Homo sapiens
aggtgctgttggcagcgggcag

SEQ ID NO: 7636219 - DNA, 22 bp, Homo sapiens
aggtggcagttgtggaaccatc

SEQ ID NO: 7636220 - DNA, 22 bp, Homo sapiens
aggtggcagttgtggaaccatc

SEQ ID NO: 7636221 - DNA, 22 bp, Homo sapiens
aggtgctgtttgtcagcagttt

SEQ ID NO: 7636222 - DNA, 22 bp, Homo sapiens
aggtgctgtttgtcagcagttt

SEQ ID NO: 7636223 - DNA, 22 bp, Homo sapiens
aggtggcatgagactgtaccag

SEQ ID NO: 7636224 - DNA, 22 bp, Homo sapiens
aggtggcatgagactgtaccag

SEQ ID NO: 7636225 - DNA, 22 bp, Homo sapiens
aggtggctctgacagctctggt

SEQ ID NO: 7636226 - DNA, 22 bp, Homo sapiens
aggtggcatgagactgtaccag

SEQ ID NO: 7636227 - DNA, 20 bp, Homo sapiens
aggtggctcttcctgggctt

SEQ ID NO: 7636228 - DNA, 20 bp, Homo sapiens
aggtggctcttcctgggctt

SEQ ID NO: 7636229 - DNA, 20 bp, Homo sapiens
aggtggctcttcctgggctt

SEQ ID NO: 7636230 - DNA, 20 bp, Homo sapiens
aggtggctcttcctgggctt

SEQ ID NO: 7636231 - DNA, 22 bp, Homo sapiens
aggtggctctgacagctctggt

SEQ ID NO: 7636232 - DNA, 22 bp, Homo sapiens
aggtggctctgacagctctggt

SEQ ID NO: 7636233 - DNA, 22 bp, Homo sapiens
aggtggctctgacagctctggt

SEQ ID NO: 7636234 - DNA, 22 bp, Homo sapiens
aggtggcagttgtggaaccatc

SEQ ID NO: 7636235 - DNA, 22 bp, Homo sapiens
aggtggctctgacagctctggt

SEQ ID NO: 7636236 - DNA, 22 bp, Homo sapiens
ccttggccctagcctcaggcaa

SEQ ID NO: 7636237 - DNA, 22 bp, Homo sapiens
ccttggctaaactcaatccagc

SEQ ID NO: 7636238 - DNA, 22 bp, Homo sapiens
ccttggccctagcctcaggcaa

SEQ ID NO: 7636239 - DNA, 22 bp, Homo sapiens
ccttggctaaactcaatccagc

SEQ ID NO: 7636240 - DNA, 22 bp, Homo sapiens
ccttggccctagcctcaggcaa

SEQ ID NO: 7636241 - DNA, 22 bp, Homo sapiens
ccttggccctagcctcaggcaa

SEQ ID NO: 7636242 - DNA, 22 bp, Homo sapiens
ccttggctaggcagcggctgtc

SEQ ID NO: 7636243 - DNA, 22 bp, Homo sapiens
ccttggctaggcagcggctgtc

SEQ ID NO: 7636244 - DNA, 22 bp, Homo sapiens
ccttggctgaggagggagctga

SEQ ID NO: 7636245 - DNA, 22 bp, Homo sapiens
ccttggctaaactcaatccagc

SEQ ID NO: 7636246 - DNA, 22 bp, Homo sapiens
ccttggctaggcagcggctgtc

SEQ ID NO: 7636247 - DNA, 22 bp, Homo sapiens
ccttggctgaggagggagctga

SEQ ID NO: 7636248 - DNA, 22 bp, Homo sapiens
aggtggggctgggaaagattcc

SEQ ID NO: 7636249 - DNA, 22 bp, Homo sapiens
aggtggggctgggaaagattcc

SEQ ID NO: 7636250 - DNA, 22 bp, Homo sapiens
aggtggggctgggaaagattcc

SEQ ID NO: 7636251 - DNA, 22 bp, Homo sapiens
ccttggccctagcctcaggcaa

SEQ ID NO: 7636252 - DNA, 22 bp, Homo sapiens
ccttggccctagcctcaggcaa

SEQ ID NO: 7636253 - DNA, 22 bp, Homo sapiens
ccttggcatgtggcatgtggct

SEQ ID NO: 7636254 - DNA, 22 bp, Homo sapiens
ccttggcatgtggcatgtggct

SEQ ID NO: 7636255 - DNA, 22 bp, Homo sapiens
ccttggcaggcacgtcctgcgg

SEQ ID NO: 7636256 - DNA, 22 bp, Homo sapiens
ccttggcaggcacgtcctgcgg

SEQ ID NO: 7636257 - DNA, 22 bp, Homo sapiens
ccttggcaggggagaaatatat

SEQ ID NO: 7636258 - DNA, 16 bp, Homo sapiens
ccttggcatcagctgt

SEQ ID NO: 7636259 - DNA, 22 bp, Homo sapiens
ccttggcaaaccagggcagctg

SEQ ID NO: 7636260 - DNA, 22 bp, Homo sapiens
ccttggcaaaccagggcagctg

SEQ ID NO: 7636261 - DNA, 22 bp, Homo sapiens
ccttggattttgtgcccacgcc

SEQ ID NO: 7636262 - DNA, 22 bp, Homo sapiens
ccttggagttctgtttggctta

SEQ ID NO: 7636263 - DNA, 22 bp, Homo sapiens
ccttggagttctgtttggctta

SEQ ID NO: 7636264 - DNA, 22 bp, Homo sapiens
ccttggattttgtgcccacgcc

SEQ ID NO: 7636265 - DNA, 22 bp, Homo sapiens
ccttggcaagacagtggagggt

SEQ ID NO: 7636266 - DNA, 22 bp, Homo sapiens
ccttggcaaaccagggcagctg

SEQ ID NO: 7636267 - DNA, 22 bp, Homo sapiens
ccttggcaaaccagggcagctg

SEQ ID NO: 7636268 - DNA, 22 bp, Homo sapiens
ccttggcaagacagtggagggt

SEQ ID NO: 7636269 - DNA, 22 bp, Homo sapiens
ccttggcaagacagtggagggt

SEQ ID NO: 7636270 - DNA, 22 bp, Homo sapiens
ccttgctcaagctagtgacggg

SEQ ID NO: 7636271 - DNA, 22 bp, Homo sapiens
ccttgctcatcccccagtgcct

SEQ ID NO: 7636272 - DNA, 22 bp, Homo sapiens
ccttgctcatcccccagtgcct

SEQ ID NO: 7636273 - DNA, 22 bp, Homo sapiens
ccttgctcatcccccagtgcct

SEQ ID NO: 7636274 - DNA, 22 bp, Homo sapiens
ccttgctgcgtgctagcacaga

SEQ ID NO: 7636275 - DNA, 22 bp, Homo sapiens
ccttgctcggggagctgcagga

SEQ ID NO: 7636276 - DNA, 22 bp, Homo sapiens
ccttgctcatcccccagtgcct

SEQ ID NO: 7636277 - DNA, 22 bp, Homo sapiens
ccttgctcggggagctgcagga

SEQ ID NO: 7636278 - DNA, 22 bp, Homo sapiens
ccttgctctcccaagcccgcag

SEQ ID NO: 7636279 - DNA, 20 bp, Homo sapiens
ccttctctggaattgcctcc

SEQ ID NO: 7636280 - DNA, 20 bp, Homo sapiens
ccttctctggaattgcctcc

SEQ ID NO: 7636281 - DNA, 22 bp, Homo sapiens
ccttctctgcaggtagttggct

SEQ ID NO: 7636282 - DNA, 22 bp, Homo sapiens
ccttgctcaagctagtgacggg

SEQ ID NO: 7636283 - DNA, 22 bp, Homo sapiens
ccttgctcaagctagtgacggg

SEQ ID NO: 7636284 - DNA, 22 bp, Homo sapiens
ccttgctcaagctagtgacggg

SEQ ID NO: 7636285 - DNA, 22 bp, Homo sapiens
ccttgctcaagctagtgacggg

SEQ ID NO: 7636286 - DNA, 22 bp, Homo sapiens
ccttggagacctgggtctgtgc

SEQ ID NO: 7636287 - DNA, 22 bp, Homo sapiens
ccttggagacctgggtctgtgc

SEQ ID NO: 7636288 - DNA, 22 bp, Homo sapiens
ccttggagacctgggtctgtgc

SEQ ID NO: 7636289 - DNA, 22 bp, Homo sapiens
ccttggagacctgggtctgtgc

SEQ ID NO: 7636290 - DNA, 22 bp, Homo sapiens
ccttggagacaggtttgctttc

SEQ ID NO: 7636291 - DNA, 22 bp, Homo sapiens
ccttggagacaggtttgctttc

SEQ ID NO: 7636292 - DNA, 22 bp, Homo sapiens
ccttggagaagacagtgccagg

SEQ ID NO: 7636293 - DNA, 22 bp, Homo sapiens
ccttggagaagacagtgccagg

SEQ ID NO: 7636294 - DNA, 22 bp, Homo sapiens
ccttggagaagacagtgccagg

SEQ ID NO: 7636295 - DNA, 22 bp, Homo sapiens
ccttggagaagacagtgccagg

SEQ ID NO: 7636296 - DNA, 22 bp, Homo sapiens
ccttgctgttagcctacattat

SEQ ID NO: 7636297 - DNA, 19 bp, Homo sapiens
ccttggagttccaggtgga

SEQ ID NO: 7636298 - DNA, 19 bp, Homo sapiens
ccttggagttccaggtgga

SEQ ID NO: 7636299 - DNA, 22 bp, Homo sapiens
ccttggaggactgctgcttctt

SEQ ID NO: 7636300 - DNA, 19 bp, Homo sapiens
ccttggagttccaggtgga

SEQ ID NO: 7636301 - DNA, 22 bp, Homo sapiens
ccttggaggactgctgcttctt

SEQ ID NO: 7636302 - DNA, 22 bp, Homo sapiens
ccttggaggactgctgcttctt

SEQ ID NO: 7636303 - DNA, 22 bp, Homo sapiens
ccttggagcggtcagcactggt

SEQ ID NO: 7636304 - DNA, 22 bp, Homo sapiens
ccttggagcggtcagcactggt

SEQ ID NO: 7636305 - DNA, 22 bp, Homo sapiens
ccttggagcggtcagcactggt

SEQ ID NO: 7636306 - DNA, 22 bp, Homo sapiens
ccttggagcggtcagcactggt

SEQ ID NO: 7636307 - DNA, 22 bp, Homo sapiens
ccttggagcggtcagcactggt

SEQ ID NO: 7636308 - DNA, 22 bp, Homo sapiens
ccttctctgcaggtagttggct

SEQ ID NO: 7636309 - DNA, 22 bp, Homo sapiens
aggtgggcaatgaggcctgagt

SEQ ID NO: 7636310 - DNA, 22 bp, Homo sapiens
ccttctctctgaagaccccaaa

SEQ ID NO: 7636311 - DNA, 21 bp, Homo sapiens
aggtgggagaccatgtaggtc

SEQ ID NO: 7636312 - DNA, 21 bp, Homo sapiens
aggtgggagaccatgtaggtc

SEQ ID NO: 7636313 - DNA, 21 bp, Homo sapiens
aggtgggagaccatgtaggtc

SEQ ID NO: 7636314 - DNA, 21 bp, Homo sapiens
aggtgggagaccatgtaggtc

SEQ ID NO: 7636315 - DNA, 22 bp, Homo sapiens
aggtgggacccgtggggtgcga

SEQ ID NO: 7636316 - DNA, 21 bp, Homo sapiens
aggtgggagaccatgtaggtc

SEQ ID NO: 7636317 - DNA, 21 bp, Homo sapiens
aggtgggagaccatgtaggtc

SEQ ID NO: 7636318 - DNA, 21 bp, Homo sapiens
aggtgggagaccatgtaggtc

SEQ ID NO: 7636319 - DNA, 22 bp, Homo sapiens
aggtgggacccgtggggtgcga

SEQ ID NO: 7636320 - DNA, 22 bp, Homo sapiens
aggtgggacccgtggggtgcga

SEQ ID NO: 7636321 - DNA, 22 bp, Homo sapiens
aggtgggacccgtggggtgcga

SEQ ID NO: 7636322 - DNA, 22 bp, Homo sapiens
aggtgggacccgtggggtgcga

SEQ ID NO: 7636323 - DNA, 21 bp, Homo sapiens
aggtgggagaccatgtaggtc

SEQ ID NO: 7636324 - DNA, 22 bp, Homo sapiens
aggtgggaacccagcagggccc

SEQ ID NO: 7636325 - DNA, 22 bp, Homo sapiens
aggtgggaacccagcagggccc

SEQ ID NO: 7636326 - DNA, 22 bp, Homo sapiens
aggtgggaacccagcagggccc

SEQ ID NO: 7636327 - DNA, 22 bp, Homo sapiens
aggtgggaacccagcagggccc

SEQ ID NO: 7636328 - DNA, 22 bp, Homo sapiens
aggtgggaacccagcagggccc

SEQ ID NO: 7636329 - DNA, 22 bp, Homo sapiens
aggtgggacccgtggggtgcga

SEQ ID NO: 7636330 - DNA, 22 bp, Homo sapiens
aggtgggacccgtggggtgcga

SEQ ID NO: 7636331 - DNA, 22 bp, Homo sapiens
aggtgggacccgtggggtgcga

SEQ ID NO: 7636332 - DNA, 22 bp, Homo sapiens
aggtgggacccgtggggtgcga

SEQ ID NO: 7636333 - DNA, 22 bp, Homo sapiens
aggtgggacccgtggggtgcga

SEQ ID NO: 7636334 - DNA, 22 bp, Homo sapiens
aggtgggaacccagcagggccc

SEQ ID NO: 7636335 - DNA, 22 bp, Homo sapiens
aggtgggaacccagcagggccc

SEQ ID NO: 7636336 - DNA, 22 bp, Homo sapiens
aggtggctttactgtttcttac

SEQ ID NO: 7636337 - DNA, 22 bp, Homo sapiens
aggtgggaacccagcagggccc

SEQ ID NO: 7636338 - DNA, 22 bp, Homo sapiens
aggtggcttctggccaggtgtg

SEQ ID NO: 7636339 - DNA, 22 bp, Homo sapiens
aggtggcttctggccaggtgtg

SEQ ID NO: 7636340 - DNA, 22 bp, Homo sapiens
aggtggcttctggccaggtgtg

SEQ ID NO: 7636341 - DNA, 22 bp, Homo sapiens
aggtggctttactgtttcttac

SEQ ID NO: 7636342 - DNA, 17 bp, Homo sapiens
aggtggctgctgcgcct

SEQ ID NO: 7636343 - DNA, 22 bp, Homo sapiens
aggtggctgcctccccgcgcgg

SEQ ID NO: 7636344 - DNA, 22 bp, Homo sapiens
aggtggctgcctccccgcgcgg

SEQ ID NO: 7636345 - DNA, 22 bp, Homo sapiens
aggtggctgcctccccgcgcgg

SEQ ID NO: 7636346 - DNA, 22 bp, Homo sapiens
aggtggctgcctccccgcgcgg

SEQ ID NO: 7636347 - DNA, 21 bp, Homo sapiens
aggtggctgcatcctcagaag

SEQ ID NO: 7636348 - DNA, 21 bp, Homo sapiens
aggtggctgcatcctcagaag

SEQ ID NO: 7636349 - DNA, 21 bp, Homo sapiens
aggtggctgcatcctcagaag

SEQ ID NO: 7636350 - DNA, 21 bp, Homo sapiens
aggtggctgcatcctcagaag

SEQ ID NO: 7636351 - DNA, 21 bp, Homo sapiens
aggtggctgcatcctcagaag

SEQ ID NO: 7636352 - DNA, 22 bp, Homo sapiens
aggtggctgagctgtgcccctg

SEQ ID NO: 7636353 - DNA, 21 bp, Homo sapiens
aggtggctgcatcctcagaag

SEQ ID NO: 7636354 - DNA, 21 bp, Homo sapiens
aggtggctgcatcctcagaag

SEQ ID NO: 7636355 - DNA, 22 bp, Homo sapiens
aggtggctgaagagtgggtgag

SEQ ID NO: 7636356 - DNA, 22 bp, Homo sapiens
aggtggctgagctgtgcccctg

SEQ ID NO: 7636357 - DNA, 20 bp, Homo sapiens
aggtggctcttcctgggctt

SEQ ID NO: 7636358 - DNA, 19 bp, Homo sapiens
aggtggctgaaactacaga

SEQ ID NO: 7636359 - DNA, 19 bp, Homo sapiens
aggtggctgaaactacaga

SEQ ID NO: 7636360 - DNA, 19 bp, Homo sapiens
aggtggctgaaactacaga

SEQ ID NO: 7636361 - DNA, 22 bp, Homo sapiens
aggtggctgaagagtgggtgag

SEQ ID NO: 7636362 - DNA, 22 bp, Homo sapiens
aggtggctgaagagtgggtgag

SEQ ID NO: 7636363 - DNA, 22 bp, Homo sapiens
aggtggctgtattcagctgtaa

SEQ ID NO: 7636364 - DNA, 22 bp, Homo sapiens
aggtggctgtattcagctgtaa

SEQ ID NO: 7636365 - DNA, 22 bp, Homo sapiens
aggtggctgtattcagctgtaa

SEQ ID NO: 7636366 - DNA, 22 bp, Homo sapiens
aggtggctgtggcttcccttgt

SEQ ID NO: 7636367 - DNA, 22 bp, Homo sapiens
aggtggcttctggccaggtgtg

SEQ ID NO: 7636368 - DNA, 22 bp, Homo sapiens
aggtggcttctggccaggtgtg

SEQ ID NO: 7636369 - DNA, 22 bp, Homo sapiens
aggtggcttctggccaggtgtg

SEQ ID NO: 7636370 - DNA, 22 bp, Homo sapiens
aggtggcttctggccaggtgtg

SEQ ID NO: 7636371 - DNA, 22 bp, Homo sapiens
aggtggctgtggcttcccttgt

SEQ ID NO: 7636372 - DNA, 22 bp, Homo sapiens
aggtggctggtccaggctgcag

SEQ ID NO: 7636373 - DNA, 22 bp, Homo sapiens
aggtggctggtccaggctgcag

SEQ ID NO: 7636374 - DNA, 22 bp, Homo sapiens
aggtggctggtccaggctgcag

SEQ ID NO: 7636375 - DNA, 17 bp, Homo sapiens
aggtggctgctgcgcct

SEQ ID NO: 7636376 - DNA, 22 bp, Homo sapiens
aggtggctggtccaggctgcag

SEQ ID NO: 7636377 - DNA, 22 bp, Homo sapiens
aggtggctggtccaggctgcag

SEQ ID NO: 7636378 - DNA, 22 bp, Homo sapiens
aggtggctggtccaggctgcag

SEQ ID NO: 7636379 - DNA, 22 bp, Homo sapiens
aggtggctggtccaggctgcag

SEQ ID NO: 7636380 - DNA, 22 bp, Homo sapiens
cctgggaagtcagccaaggacg

SEQ ID NO: 7636381 - DNA, 22 bp, Homo sapiens
cctgggaagtcagccaaggacg

SEQ ID NO: 7636382 - DNA, 22 bp, Homo sapiens
cctgggaagtcagccaaggacg

SEQ ID NO: 7636383 - DNA, 22 bp, Homo sapiens
cctgggaagtcagccaaggacg

SEQ ID NO: 7636384 - DNA, 22 bp, Homo sapiens
cctgggaaggtgaggccctgga

SEQ ID NO: 7636385 - DNA, 22 bp, Homo sapiens
cctgggaaggtcttagcatcta

SEQ ID NO: 7636386 - DNA, 22 bp, Homo sapiens
cctgggaaggtgaggccctgga

SEQ ID NO: 7636387 - DNA, 22 bp, Homo sapiens
cctgggaaggggaagagaattc

SEQ ID NO: 7636388 - DNA, 22 bp, Homo sapiens
cctggctggtggcagcgacaag

SEQ ID NO: 7636389 - DNA, 20 bp, Homo sapiens
cctggctggtggaggaaagg

SEQ ID NO: 7636390 - DNA, 22 bp, Homo sapiens
cctggctggtggcagcgacaag

SEQ ID NO: 7636391 - DNA, 22 bp, Homo sapiens
cctggctggtggcagcgacaag

SEQ ID NO: 7636392 - DNA, 22 bp, Homo sapiens
cctggctggtggcagcgacaag

SEQ ID NO: 7636393 - DNA, 20 bp, Homo sapiens
cctggctggtggaggaaagg

SEQ ID NO: 7636394 - DNA, 22 bp, Homo sapiens
cctggctggtggcagcgacaag

SEQ ID NO: 7636395 - DNA, 22 bp, Homo sapiens
cctggctggttgtctgattcta

SEQ ID NO: 7636396 - DNA, 22 bp, Homo sapiens
cctggctggtggcagcgacaag

SEQ ID NO: 7636397 - DNA, 22 bp, Homo sapiens
cctgggaaggggaagagaattc

SEQ ID NO: 7636398 - DNA, 22 bp, Homo sapiens
cctggctggttgtctgattcta

SEQ ID NO: 7636399 - DNA, 22 bp, Homo sapiens
cctgggaaggggaagagaattc

SEQ ID NO: 7636400 - DNA, 20 bp, Homo sapiens
cctggctggtggaggaaagg

SEQ ID NO: 7636401 - DNA, 20 bp, Homo sapiens
cctggctggtggaggaaagg

SEQ ID NO: 7636402 - DNA, 22 bp, Homo sapiens
cctggctggtggcagcgacaag

SEQ ID NO: 7636403 - DNA, 22 bp, Homo sapiens
cctggctggggtagaagtgagg

SEQ ID NO: 7636404 - DNA, 22 bp, Homo sapiens
cctggctggggtagaagtgagg

SEQ ID NO: 7636405 - DNA, 22 bp, Homo sapiens
cctggctgggcctgatttctca

SEQ ID NO: 7636406 - DNA, 22 bp, Homo sapiens
cctggctgggcctgatttctca

SEQ ID NO: 7636407 - DNA, 22 bp, Homo sapiens
cctggctgggcctgatttctca

SEQ ID NO: 7636408 - DNA, 17 bp, Homo sapiens
cctggctgggaatctga

SEQ ID NO: 7636409 - DNA, 17 bp, Homo sapiens
cctggctgggaatctga

SEQ ID NO: 7636410 - DNA, 22 bp, Homo sapiens
cctggctggcaagatcgtgaag

SEQ ID NO: 7636411 - DNA, 23 bp, Homo sapiens
cctggctggattctctgcattca

SEQ ID NO: 7636412 - DNA, 22 bp, Homo sapiens
cctggctggcaagatcgtgaag

SEQ ID NO: 7636413 - DNA, 22 bp, Homo sapiens
cctggctggcaagatcgtgaag

SEQ ID NO: 7636414 - DNA, 17 bp, Homo sapiens
cctggctgggaatctga

SEQ ID NO: 7636415 - DNA, 17 bp, Homo sapiens
cctggctgggaatctga

SEQ ID NO: 7636416 - DNA, 17 bp, Homo sapiens
cctggctgggaatctga

SEQ ID NO: 7636417 - DNA, 23 bp, Homo sapiens
cctggctggattctctgcattca

SEQ ID NO: 7636418 - DNA, 23 bp, Homo sapiens
cctggctggattctctgcattca

SEQ ID NO: 7636419 - DNA, 23 bp, Homo sapiens
cctggctggattctctgcattca

SEQ ID NO: 7636420 - DNA, 23 bp, Homo sapiens
cctggctggattctctgcattca

SEQ ID NO: 7636421 - DNA, 22 bp, Homo sapiens
cctggctgctttcactatggag

SEQ ID NO: 7636422 - DNA, 22 bp, Homo sapiens
cctggctgctttcactatggag

SEQ ID NO: 7636423 - DNA, 22 bp, Homo sapiens
cctggctgcttcctctgccatg

SEQ ID NO: 7636424 - DNA, 22 bp, Homo sapiens
cctggctgctttcactatggag

SEQ ID NO: 7636425 - DNA, 22 bp, Homo sapiens
cctggctgctttcactatggag

SEQ ID NO: 7636426 - DNA, 22 bp, Homo sapiens
cctggctggactggaccgtggc

SEQ ID NO: 7636427 - DNA, 22 bp, Homo sapiens
cctggctggactggaccgtggc

SEQ ID NO: 7636428 - DNA, 22 bp, Homo sapiens
cctggctggactggaccgtggc

SEQ ID NO: 7636429 - DNA, 22 bp, Homo sapiens
cctggctggactggaccgtggc

SEQ ID NO: 7636430 - DNA, 22 bp, Homo sapiens
cctggctggactggaccgtggc

SEQ ID NO: 7636431 - DNA, 22 bp, Homo sapiens
cctggctgctttcactatggag

SEQ ID NO: 7636432 - DNA, 22 bp, Homo sapiens
cctggctgctttcactatggag

SEQ ID NO: 7636433 - DNA, 22 bp, Homo sapiens
cctggctgctttcactatggag

SEQ ID NO: 7636434 - DNA, 23 bp, Homo sapiens
cctggctggattctctgcattca

SEQ ID NO: 7636435 - DNA, 23 bp, Homo sapiens
cctggctggattctctgcattca

SEQ ID NO: 7636436 - DNA, 22 bp, Homo sapiens
cctggctggatggagcccctgg

SEQ ID NO: 7636437 - DNA, 22 bp, Homo sapiens
cctggctggatggagcccctgg

SEQ ID NO: 7636438 - DNA, 22 bp, Homo sapiens
cctggctggatggagcccctgg

SEQ ID NO: 7636439 - DNA, 22 bp, Homo sapiens
cctggctggatggagcccctgg

SEQ ID NO: 7636440 - DNA, 22 bp, Homo sapiens
cctggctggatggagcccctgg

SEQ ID NO: 7636441 - DNA, 22 bp, Homo sapiens
cctggctggactggaccgtggc

SEQ ID NO: 7636442 - DNA, 22 bp, Homo sapiens
cctggctggactggaccgtggc

SEQ ID NO: 7636443 - DNA, 22 bp, Homo sapiens
cctggctggactggaccgtggc

SEQ ID NO: 7636444 - DNA, 22 bp, Homo sapiens
cctggctggactggaccgtggc

SEQ ID NO: 7636445 - DNA, 22 bp, Homo sapiens
cctggccagaggcgtgcctgtg

SEQ ID NO: 7636446 - DNA, 22 bp, Homo sapiens
cctggccagcagccccttcctc

SEQ ID NO: 7636447 - DNA, 22 bp, Homo sapiens
cctggccagcagccccttcctc

SEQ ID NO: 7636448 - DNA, 22 bp, Homo sapiens
cctggctctgtcctcgcgcaaa

SEQ ID NO: 7636449 - DNA, 22 bp, Homo sapiens
cctggctctgtcctcgcgcaaa

SEQ ID NO: 7636450 - DNA, 22 bp, Homo sapiens
cctggccagaggcgtgcctgtg

SEQ ID NO: 7636451 - DNA, 22 bp, Homo sapiens
cctggctcttcagaggttccta

SEQ ID NO: 7636452 - DNA, 21 bp, Homo sapiens
cctggctctgtgtttattatg

SEQ ID NO: 7636453 - DNA, 19 bp, Homo sapiens
cctggctgctgtgggatgc

SEQ ID NO: 7636454 - DNA, 22 bp, Homo sapiens
cctggctcttcagaggttccta

SEQ ID NO: 7636455 - DNA, 22 bp, Homo sapiens
cctggctcttcagaggttccta

SEQ ID NO: 7636456 - DNA, 22 bp, Homo sapiens
cctggctgctgtcactgaccat

SEQ ID NO: 7636457 - DNA, 22 bp, Homo sapiens
cctggctgcttcctctgccatg

SEQ ID NO: 7636458 - DNA, 22 bp, Homo sapiens
cctggctgcttcctctgccatg

SEQ ID NO: 7636459 - DNA, 22 bp, Homo sapiens
cctggctgcttcctctgccatg

SEQ ID NO: 7636460 - DNA, 22 bp, Homo sapiens
cctggctgcttcctctgccatg

SEQ ID NO: 7636461 - DNA, 22 bp, Homo sapiens
cctggctgcttcctctgccatg

SEQ ID NO: 7636462 - DNA, 19 bp, Homo sapiens
cctggctgctgtgggatgc

SEQ ID NO: 7636463 - DNA, 19 bp, Homo sapiens
cctggctgctgtgggatgc

SEQ ID NO: 7636464 - DNA, 19 bp, Homo sapiens
cctggctgctgtgggatgc

SEQ ID NO: 7636465 - DNA, 19 bp, Homo sapiens
cctggctgctgtgggatgc

SEQ ID NO: 7636466 - DNA, 19 bp, Homo sapiens
cctggctgctgtgggatgc

SEQ ID NO: 7636467 - DNA, 19 bp, Homo sapiens
cctggctgctgtgggatgc

SEQ ID NO: 7636468 - DNA, 19 bp, Homo sapiens
cctggctgctgtgggatgc

SEQ ID NO: 7636469 - DNA, 22 bp, Homo sapiens
cctggcagctgtttggcttggc

SEQ ID NO: 7636470 - DNA, 22 bp, Homo sapiens
cctggcagctgtttggcttggc

SEQ ID NO: 7636471 - DNA, 22 bp, Homo sapiens
cctggcagctgtttggcttggc

SEQ ID NO: 7636472 - DNA, 17 bp, Homo sapiens
cctggcattgttcctga

SEQ ID NO: 7636473 - DNA, 22 bp, Homo sapiens
cctggcattttttgcttaaggt

SEQ ID NO: 7636474 - DNA, 22 bp, Homo sapiens
cctggcattttttgcttaaggt

SEQ ID NO: 7636475 - DNA, 21 bp, Homo sapiens
cctggccaatctgatagggtt

SEQ ID NO: 7636476 - DNA, 21 bp, Homo sapiens
cctggccaatctgatagggtt

SEQ ID NO: 7636477 - DNA, 21 bp, Homo sapiens
cctggccaatctgatagggtt

SEQ ID NO: 7636478 - DNA, 21 bp, Homo sapiens
cctggccaatctgatagggtt

SEQ ID NO: 7636479 - DNA, 21 bp, Homo sapiens
cctggccaatctgatagggtt

SEQ ID NO: 7636480 - DNA, 21 bp, Homo sapiens
cctggccaatctgatagggtt

SEQ ID NO: 7636481 - DNA, 22 bp, Homo sapiens
cctggccaatctagggctgtta

SEQ ID NO: 7636482 - DNA, 22 bp, Homo sapiens
cctggccaatctagggctgtta

SEQ ID NO: 7636483 - DNA, 22 bp, Homo sapiens
cctggccaatctagggctgtta

SEQ ID NO: 7636484 - DNA, 22 bp, Homo sapiens
cctggccaatctagggctgtta

SEQ ID NO: 7636485 - DNA, 22 bp, Homo sapiens
cctggccaatctagggctgtta

SEQ ID NO: 7636486 - DNA, 22 bp, Homo sapiens
cctggccaatctagggctgtta

SEQ ID NO: 7636487 - DNA, 22 bp, Homo sapiens
cctggcagctcctccccggcgg

SEQ ID NO: 7636488 - DNA, 22 bp, Homo sapiens
cctggcagctcctccccggcgg

SEQ ID NO: 7636489 - DNA, 22 bp, Homo sapiens
cctggcagctcctccccggcgg

SEQ ID NO: 7636490 - DNA, 22 bp, Homo sapiens
cctggcagctcctccccggcgg

SEQ ID NO: 7636491 - DNA, 22 bp, Homo sapiens
cctggcagctccgtggccttcc

SEQ ID NO: 7636492 - DNA, 22 bp, Homo sapiens
cctggcagctaagtgctttgag

SEQ ID NO: 7636493 - DNA, 22 bp, Homo sapiens
cctggcagctccgtggccttcc

SEQ ID NO: 7636494 - DNA, 22 bp, Homo sapiens
cctggcagctccgtggccttcc

SEQ ID NO: 7636495 - DNA, 22 bp, Homo sapiens
cctggcagctccgtggccttcc

SEQ ID NO: 7636496 - DNA, 22 bp, Homo sapiens
cctggcagctccgtggccttcc

SEQ ID NO: 7636497 - DNA, 22 bp, Homo sapiens
cctggcagctccgtggccttcc

SEQ ID NO: 7636498 - DNA, 22 bp, Homo sapiens
cctggccacccagccttggcca

SEQ ID NO: 7636499 - DNA, 22 bp, Homo sapiens
cctggccacccagccttggcca

SEQ ID NO: 7636500 - DNA, 22 bp, Homo sapiens
cctggccacccagccttggcca

SEQ ID NO: 7636501 - DNA, 22 bp, Homo sapiens
cctggccacccagccttggcca

SEQ ID NO: 7636502 - DNA, 22 bp, Homo sapiens
cctggccacagggctctgcatt

SEQ ID NO: 7636503 - DNA, 22 bp, Homo sapiens
cctggccacagggctctgcatt

SEQ ID NO: 7636504 - DNA, 22 bp, Homo sapiens
cctggccacagggctctgcatt

SEQ ID NO: 7636505 - DNA, 22 bp, Homo sapiens
cctggccacagggctctgcatt

SEQ ID NO: 7636506 - DNA, 22 bp, Homo sapiens
cctggccacagggctctgcatt

SEQ ID NO: 7636507 - DNA, 22 bp, Homo sapiens
cctggccacagggctctgcatt

SEQ ID NO: 7636508 - DNA, 20 bp, Homo sapiens
cctggccaatgagataggaa

SEQ ID NO: 7636509 - DNA, 20 bp, Homo sapiens
cctggccaatgagataggaa

SEQ ID NO: 7636510 - DNA, 20 bp, Homo sapiens
cctggccaatgagataggaa

SEQ ID NO: 7636511 - DNA, 20 bp, Homo sapiens
cctggccaatgagataggaa

SEQ ID NO: 7636512 - DNA, 20 bp, Homo sapiens
cctggccaatgagataggaa

SEQ ID NO: 7636513 - DNA, 20 bp, Homo sapiens
cctggccaatgagataggaa

SEQ ID NO: 7636514 - DNA, 20 bp, Homo sapiens
cctggccaatgagataggaa

SEQ ID NO: 7636515 - DNA, 21 bp, Homo sapiens
cctggccaatctgatagggtt

SEQ ID NO: 7636516 - DNA, 21 bp, Homo sapiens
cctggccaatctgatagggtt

SEQ ID NO: 7636517 - DNA, 22 bp, Homo sapiens
cctggccagaggcgtgcctgtg

SEQ ID NO: 7636518 - DNA, 22 bp, Homo sapiens
cctggccagaggcgtgcctgtg

SEQ ID NO: 7636519 - DNA, 22 bp, Homo sapiens
cctggccagaggcgtgcctgtg

SEQ ID NO: 7636520 - DNA, 22 bp, Homo sapiens
cctggccagaggcgtgcctgtg

SEQ ID NO: 7636521 - DNA, 19 bp, Homo sapiens
cctggccagacttctgccc

SEQ ID NO: 7636522 - DNA, 22 bp, Homo sapiens
cctggccagaggcgtgcctgtg

SEQ ID NO: 7636523 - DNA, 22 bp, Homo sapiens
cctggccagaggcgtgcctgtg

SEQ ID NO: 7636524 - DNA, 22 bp, Homo sapiens
cctggccacccagccttggcca

SEQ ID NO: 7636525 - DNA, 22 bp, Homo sapiens
cctggccactcaggtgtggggc

SEQ ID NO: 7636526 - DNA, 22 bp, Homo sapiens
cctggccactcaggtgtggggc

SEQ ID NO: 7636527 - DNA, 22 bp, Homo sapiens
cctggccactcaggtgtggggc

SEQ ID NO: 7636528 - DNA, 22 bp, Homo sapiens
cctggccactcaggtgtggggc

SEQ ID NO: 7636529 - DNA, 22 bp, Homo sapiens
cctggccacccagccttggcca

SEQ ID NO: 7636530 - DNA, 19 bp, Homo sapiens
cctggccagacttctgccc

SEQ ID NO: 7636531 - DNA, 19 bp, Homo sapiens
cctggccagacttctgccc

SEQ ID NO: 7636532 - DNA, 22 bp, Homo sapiens
cctggccactcaggtgtggggc

SEQ ID NO: 7636533 - DNA, 22 bp, Homo sapiens
cctggacaagtggcttacttgg

SEQ ID NO: 7636534 - DNA, 22 bp, Homo sapiens
cctggaagttggaggttgcagt

SEQ ID NO: 7636535 - DNA, 22 bp, Homo sapiens
cctggacaatgagatgtcaggg

SEQ ID NO: 7636536 - DNA, 22 bp, Homo sapiens
cctggacaatgagatgtcaggg

SEQ ID NO: 7636537 - DNA, 22 bp, Homo sapiens
cctggacaatgagatgtcaggg

SEQ ID NO: 7636538 - DNA, 22 bp, Homo sapiens
cctggacacccattccttggct

SEQ ID NO: 7636539 - DNA, 22 bp, Homo sapiens
cctggaccaaacactggcctgg

SEQ ID NO: 7636540 - DNA, 22 bp, Homo sapiens
cctggacagggccaggccatgc

SEQ ID NO: 7636541 - DNA, 22 bp, Homo sapiens
cctggaccaaacactggcctgg

SEQ ID NO: 7636542 - DNA, 22 bp, Homo sapiens
cctggaccaaacactggcctgg

SEQ ID NO: 7636543 - DNA, 22 bp, Homo sapiens
cctggacagagggcagcggcca

SEQ ID NO: 7636544 - DNA, 22 bp, Homo sapiens
cctggaaggcaggcatggattg

SEQ ID NO: 7636545 - DNA, 22 bp, Homo sapiens
cctggacacccattccttggct

SEQ ID NO: 7636546 - DNA, 22 bp, Homo sapiens
cctggacagggccaggccatgc

SEQ ID NO: 7636547 - DNA, 22 bp, Homo sapiens
cctggacagggccaggccatgc

SEQ ID NO: 7636548 - DNA, 22 bp, Homo sapiens
cctggacagggccaggccatgc

SEQ ID NO: 7636549 - DNA, 22 bp, Homo sapiens
cctggacagggccaggccatgc

SEQ ID NO: 7636550 - DNA, 22 bp, Homo sapiens
cctggacacccattccttggct

SEQ ID NO: 7636551 - DNA, 22 bp, Homo sapiens
cctggacagagggcagcggcca

SEQ ID NO: 7636552 - DNA, 22 bp, Homo sapiens
cctggaaggacaatagatagtg

SEQ ID NO: 7636553 - DNA, 22 bp, Homo sapiens
cctggaagattcaccactacca

SEQ ID NO: 7636554 - DNA, 22 bp, Homo sapiens
cctggaagagctgaatcaggca

SEQ ID NO: 7636555 - DNA, 22 bp, Homo sapiens
cctggaagagctgaatcaggca

SEQ ID NO: 7636556 - DNA, 22 bp, Homo sapiens
cctggaaggtgatggtacagca

SEQ ID NO: 7636557 - DNA, 22 bp, Homo sapiens
cctggaaggtgatggtacagca

SEQ ID NO: 7636558 - DNA, 22 bp, Homo sapiens
cctggaaggtgatggtacagca

SEQ ID NO: 7636559 - DNA, 22 bp, Homo sapiens
cctggaaggtgatggtacagca

SEQ ID NO: 7636560 - DNA, 22 bp, Homo sapiens
cctggaaggcaggcatggattg

SEQ ID NO: 7636561 - DNA, 22 bp, Homo sapiens
cctggaaggcaggcatggattg

SEQ ID NO: 7636562 - DNA, 22 bp, Homo sapiens
cctggcagcgtgccgagctgcg

SEQ ID NO: 7636563 - DNA, 22 bp, Homo sapiens
cctggcagcgtgccgagctgcg

SEQ ID NO: 7636564 - DNA, 22 bp, Homo sapiens
cctggcagcgtgccgagctgcg

SEQ ID NO: 7636565 - DNA, 22 bp, Homo sapiens
cctggcagcgtgccgagctgcg

SEQ ID NO: 7636566 - DNA, 22 bp, Homo sapiens
cctggcagcgtgccgagctgcg

SEQ ID NO: 7636567 - DNA, 22 bp, Homo sapiens
cctggcagctaagtgctttgag

SEQ ID NO: 7636568 - DNA, 22 bp, Homo sapiens
cctggcagcgtgccgagctgcg

SEQ ID NO: 7636569 - DNA, 22 bp, Homo sapiens
cctggcagcgccgaagctggcc

SEQ ID NO: 7636570 - DNA, 22 bp, Homo sapiens
cctggcagcgccgaagctggcc

SEQ ID NO: 7636571 - DNA, 22 bp, Homo sapiens
cctggcagcgccgaagctggcc

SEQ ID NO: 7636572 - DNA, 22 bp, Homo sapiens
cctggcagcgccgaagctggcc

SEQ ID NO: 7636573 - DNA, 22 bp, Homo sapiens
cctggcagcgccgaagctggcc

SEQ ID NO: 7636574 - DNA, 22 bp, Homo sapiens
cctggcagcgccgaagctggcc

SEQ ID NO: 7636575 - DNA, 22 bp, Homo sapiens
cctggcagcgccgaagctggcc

SEQ ID NO: 7636576 - DNA, 22 bp, Homo sapiens
cctggcagcctcagccaattct

SEQ ID NO: 7636577 - DNA, 22 bp, Homo sapiens
cctggcagcctcagccaattct

SEQ ID NO: 7636578 - DNA, 22 bp, Homo sapiens
cctggcagcccagagcgccgct

SEQ ID NO: 7636579 - DNA, 22 bp, Homo sapiens
cctggcacatagcaacccctcc

SEQ ID NO: 7636580 - DNA, 22 bp, Homo sapiens
cctggcacataatagtggctca

SEQ ID NO: 7636581 - DNA, 22 bp, Homo sapiens
cctggcacagatccttcataca

SEQ ID NO: 7636582 - DNA, 22 bp, Homo sapiens
cctggacctgcagcatcagcat

SEQ ID NO: 7636583 - DNA, 22 bp, Homo sapiens
cctggcacagatccttcataca

SEQ ID NO: 7636584 - DNA, 22 bp, Homo sapiens
cctggaccaaacactggcctgg

SEQ ID NO: 7636585 - DNA, 22 bp, Homo sapiens
cctggcacataatagtggctca

SEQ ID NO: 7636586 - DNA, 22 bp, Homo sapiens
cctggcacataatagtggctca

SEQ ID NO: 7636587 - DNA, 22 bp, Homo sapiens
cctggcacataatagtggctca

SEQ ID NO: 7636588 - DNA, 22 bp, Homo sapiens
cctggcacataatagtggctca

SEQ ID NO: 7636589 - DNA, 22 bp, Homo sapiens
cctggcacataatagtggctca

SEQ ID NO: 7636590 - DNA, 22 bp, Homo sapiens
cctggcacataatagtggctca

SEQ ID NO: 7636591 - DNA, 22 bp, Homo sapiens
cctggcacataatagtggctca

SEQ ID NO: 7636592 - DNA, 19 bp, Homo sapiens
cctgctgaagtgatgcagc

SEQ ID NO: 7636593 - DNA, 19 bp, Homo sapiens
cctgctgaagtgatgcagc

SEQ ID NO: 7636594 - DNA, 19 bp, Homo sapiens
cctgctgaagtgatgcagc

SEQ ID NO: 7636595 - DNA, 22 bp, Homo sapiens
cctgctgagaccctgaggtggg

SEQ ID NO: 7636596 - DNA, 22 bp, Homo sapiens
cctgctgagaaatcaagggagt

SEQ ID NO: 7636597 - DNA, 22 bp, Homo sapiens
cctgctcttatagctgtttcca

SEQ ID NO: 7636598 - DNA, 22 bp, Homo sapiens
cctgctcttatagctgtttcca

SEQ ID NO: 7636599 - DNA, 22 bp, Homo sapiens
cctgctcttatagctgtttcca

SEQ ID NO: 7636600 - DNA, 22 bp, Homo sapiens
cctgctgaggtcagccacccaa

SEQ ID NO: 7636601 - DNA, 19 bp, Homo sapiens
cctgctgcaccacttgtta

SEQ ID NO: 7636602 - DNA, 19 bp, Homo sapiens
cctgctgcaccacttgtta

SEQ ID NO: 7636603 - DNA, 19 bp, Homo sapiens
cctgctgcaccacttgtta

SEQ ID NO: 7636604 - DNA, 19 bp, Homo sapiens
cctgctgcaccacttgtta

SEQ ID NO: 7636605 - DNA, 22 bp, Homo sapiens
cctgctgagacttccaagggag

SEQ ID NO: 7636606 - DNA, 22 bp, Homo sapiens
cctgctgagaccctgaggtggg

SEQ ID NO: 7636607 - DNA, 22 bp, Homo sapiens
cctggaaagaggaaggaagcct

SEQ ID NO: 7636608 - DNA, 22 bp, Homo sapiens
cctgctgctatgaaggtgacag

SEQ ID NO: 7636609 - DNA, 22 bp, Homo sapiens
cctgctgctatgaaggtgacag

SEQ ID NO: 7636610 - DNA, 22 bp, Homo sapiens
cctggaaagaggaaggaagcct

SEQ ID NO: 7636611 - DNA, 22 bp, Homo sapiens
cctggaaagaggaaggaagcct

SEQ ID NO: 7636612 - DNA, 22 bp, Homo sapiens
cctgctgctatgaaggtgacag

SEQ ID NO: 7636613 - DNA, 22 bp, Homo sapiens
cctgctgctatgaaggtgacag

SEQ ID NO: 7636614 - DNA, 22 bp, Homo sapiens
cctgctgctatgaaggtgacag

SEQ ID NO: 7636615 - DNA, 22 bp, Homo sapiens
cctgctgctatgaaggtgacag

SEQ ID NO: 7636616 - DNA, 19 bp, Homo sapiens
cctgctgcccaccctctgc

SEQ ID NO: 7636617 - DNA, 19 bp, Homo sapiens
cctgctgcccaccctctgc

SEQ ID NO: 7636618 - DNA, 19 bp, Homo sapiens
cctgctgcccaccctctgc

SEQ ID NO: 7636619 - DNA, 22 bp, Homo sapiens
cctggaaagcggttcattttgt

SEQ ID NO: 7636620 - DNA, 22 bp, Homo sapiens
cctggaaagattgcagttgctg

SEQ ID NO: 7636621 - DNA, 22 bp, Homo sapiens
cctggaaatgcaaaagccatga

SEQ ID NO: 7636622 - DNA, 22 bp, Homo sapiens
cctggaaatgtcgcgtgtagaa

SEQ ID NO: 7636623 - DNA, 22 bp, Homo sapiens
cctggaaatgtcgcgtgtagaa

SEQ ID NO: 7636624 - DNA, 22 bp, Homo sapiens
cctggaaatgtcgcgtgtagaa

SEQ ID NO: 7636625 - DNA, 22 bp, Homo sapiens
cctggaaatgcaaaagccatga

SEQ ID NO: 7636626 - DNA, 22 bp, Homo sapiens
cctggaaatgcaaaagccatga

SEQ ID NO: 7636627 - DNA, 22 bp, Homo sapiens
cctggaaatgcaaaagccatga

SEQ ID NO: 7636628 - DNA, 22 bp, Homo sapiens
cctgctctgccaagtcctcttt

SEQ ID NO: 7636629 - DNA, 22 bp, Homo sapiens
cctgctctgccaagtcctcttt

SEQ ID NO: 7636630 - DNA, 22 bp, Homo sapiens
cctgctctgccaagtcctcttt

SEQ ID NO: 7636631 - DNA, 22 bp, Homo sapiens
cctgctctgccaagtcctcttt

SEQ ID NO: 7636632 - DNA, 22 bp, Homo sapiens
cctgctctgccaagtcctcttt

SEQ ID NO: 7636633 - DNA, 22 bp, Homo sapiens
cctgctctgccaagtcctcttt

SEQ ID NO: 7636634 - DNA, 22 bp, Homo sapiens
cctgctctgccaagtcctcttt

SEQ ID NO: 7636635 - DNA, 22 bp, Homo sapiens
cctgctctgccaagtcctcttt

SEQ ID NO: 7636636 - DNA, 22 bp, Homo sapiens
cctgctctgccaagtcctcttt

SEQ ID NO: 7636637 - DNA, 22 bp, Homo sapiens
cctgctctgccaagtcctcttt

SEQ ID NO: 7636638 - DNA, 22 bp, Homo sapiens
cctgctctggtttagtcagtct

SEQ ID NO: 7636639 - DNA, 22 bp, Homo sapiens
cctgctctggtttagtcagtct

SEQ ID NO: 7636640 - DNA, 22 bp, Homo sapiens
cctgctctggtttagtcagtct

SEQ ID NO: 7636641 - DNA, 22 bp, Homo sapiens
cctgctctccatacactttcta

SEQ ID NO: 7636642 - DNA, 22 bp, Homo sapiens
cctgctctccatacactttcta

SEQ ID NO: 7636643 - DNA, 22 bp, Homo sapiens
cctgctctccatacactttcta

SEQ ID NO: 7636644 - DNA, 22 bp, Homo sapiens
cctgctctagactctgggaagg

SEQ ID NO: 7636645 - DNA, 22 bp, Homo sapiens
cctgctctagactctgggaagg

SEQ ID NO: 7636646 - DNA, 22 bp, Homo sapiens
cctgctctccatacactttcta

SEQ ID NO: 7636647 - DNA, 22 bp, Homo sapiens
cctgctctagactctgggaagg

SEQ ID NO: 7636648 - DNA, 22 bp, Homo sapiens
cctgctctagactctgggaagg

SEQ ID NO: 7636649 - DNA, 22 bp, Homo sapiens
cctgcctggcttccagaagaga

SEQ ID NO: 7636650 - DNA, 22 bp, Homo sapiens
cctgctctaaatctcatggaac

SEQ ID NO: 7636651 - DNA, 22 bp, Homo sapiens
cctgctctaaatctcatggaac

SEQ ID NO: 7636652 - DNA, 22 bp, Homo sapiens
cctgctctagactctgggaagg

SEQ ID NO: 7636653 - DNA, 22 bp, Homo sapiens
cctgctctagactctgggaagg

SEQ ID NO: 7636654 - DNA, 22 bp, Homo sapiens
cctgcctggcttccagaagaga

SEQ ID NO: 7636655 - DNA, 22 bp, Homo sapiens
cctgcctggcttccagaagaga

SEQ ID NO: 7636656 - DNA, 22 bp, Homo sapiens
cctgcctggcttccagaagaga

SEQ ID NO: 7636657 - DNA, 22 bp, Homo sapiens
cctgcctggcttccagaagaga

SEQ ID NO: 7636658 - DNA, 22 bp, Homo sapiens
cctgcctggcttccagaagaga

SEQ ID NO: 7636659 - DNA, 22 bp, Homo sapiens
cctctctccttcctttgccaaa

SEQ ID NO: 7636660 - DNA, 22 bp, Homo sapiens
cctctctccttcctttgccaaa

SEQ ID NO: 7636661 - DNA, 22 bp, Homo sapiens
cctctctccttcctttgccaaa

SEQ ID NO: 7636662 - DNA, 22 bp, Homo sapiens
cctctctccttcctttgccaaa

SEQ ID NO: 7636663 - DNA, 22 bp, Homo sapiens
cctctctccttcctttgccaaa

SEQ ID NO: 7636664 - DNA, 23 bp, Homo sapiens
cctctctccctgtttggcaaata

SEQ ID NO: 7636665 - DNA, 22 bp, Homo sapiens
cctctctccaattttcacctca

SEQ ID NO: 7636666 - DNA, 22 bp, Homo sapiens
cctctctccaattttcacctca

SEQ ID NO: 7636667 - DNA, 22 bp, Homo sapiens
cctctctccaattttcacctca

SEQ ID NO: 7636668 - DNA, 22 bp, Homo sapiens
cctctctccaattttcacctca

SEQ ID NO: 7636669 - DNA, 22 bp, Homo sapiens
cctctctccaattttcacctca

SEQ ID NO: 7636670 - DNA, 22 bp, Homo sapiens
cctctctccaattttcacctca

SEQ ID NO: 7636671 - DNA, 22 bp, Homo sapiens
cctctctccaattttcacctca

SEQ ID NO: 7636672 - DNA, 22 bp, Homo sapiens
cctctctccaattttcacctca

SEQ ID NO: 7636673 - DNA, 22 bp, Homo sapiens
cctctctccaattttcacctca

SEQ ID NO: 7636674 - DNA, 22 bp, Homo sapiens
cctctctctcctgcacacacac

SEQ ID NO: 7636675 - DNA, 22 bp, Homo sapiens
cctctctctcctgcacacacac

SEQ ID NO: 7636676 - DNA, 22 bp, Homo sapiens
cctctctctcctgcacacacac

SEQ ID NO: 7636677 - DNA, 22 bp, Homo sapiens
cctctctctcctgcacacacac

SEQ ID NO: 7636678 - DNA, 22 bp, Homo sapiens
cctctctctcctgcacacacac

SEQ ID NO: 7636679 - DNA, 22 bp, Homo sapiens
cctctctcttgtagtccctgcc

SEQ ID NO: 7636680 - DNA, 22 bp, Homo sapiens
cctctctcttgtagtccctgcc

SEQ ID NO: 7636681 - DNA, 22 bp, Homo sapiens
cctctctcttgtagtccctgcc

SEQ ID NO: 7636682 - DNA, 22 bp, Homo sapiens
cctctctctgcatctggagggc

SEQ ID NO: 7636683 - DNA, 22 bp, Homo sapiens
cctctctctgcatctggagggc

SEQ ID NO: 7636684 - DNA, 22 bp, Homo sapiens
cctctctctgcatctggagggc

SEQ ID NO: 7636685 - DNA, 22 bp, Homo sapiens
cctctctctgcatctggagggc

SEQ ID NO: 7636686 - DNA, 22 bp, Homo sapiens
cctctctctgcatctggagggc

SEQ ID NO: 7636687 - DNA, 22 bp, Homo sapiens
cctctctctgcatctggagggc

SEQ ID NO: 7636688 - DNA, 22 bp, Homo sapiens
cctctgcacttcaccttagctc

SEQ ID NO: 7636689 - DNA, 22 bp, Homo sapiens
cctctgcacttcaccttagctc

SEQ ID NO: 7636690 - DNA, 22 bp, Homo sapiens
cctctgcacttcaccttagctc

SEQ ID NO: 7636691 - DNA, 22 bp, Homo sapiens
cctctgcacttcaccttagctc

SEQ ID NO: 7636692 - DNA, 22 bp, Homo sapiens
cctctgcacttcaccttagctc

SEQ ID NO: 7636693 - DNA, 22 bp, Homo sapiens
cctctgcatcccatataattct

SEQ ID NO: 7636694 - DNA, 22 bp, Homo sapiens
cctctgcatcccatataattct

SEQ ID NO: 7636695 - DNA, 22 bp, Homo sapiens
cctctgcagcagagagccagag

SEQ ID NO: 7636696 - DNA, 22 bp, Homo sapiens
cctctgcagcagagagccagag

SEQ ID NO: 7636697 - DNA, 22 bp, Homo sapiens
cctctgcagcagagagccagag

SEQ ID NO: 7636698 - DNA, 22 bp, Homo sapiens
cctctgcagcagagagccagag

SEQ ID NO: 7636699 - DNA, 22 bp, Homo sapiens
cctctgcagcagagagccagag

SEQ ID NO: 7636700 - DNA, 19 bp, Homo sapiens
cctctgcatggaaacagct

SEQ ID NO: 7636701 - DNA, 22 bp, Homo sapiens
cctctgccacctcccacgaggc

SEQ ID NO: 7636702 - DNA, 22 bp, Homo sapiens
cctctgccacctcccacgaggc

SEQ ID NO: 7636703 - DNA, 22 bp, Homo sapiens
cctctgccacctcccacgaggc

SEQ ID NO: 7636704 - DNA, 19 bp, Homo sapiens
cctctgcatggaaacagct

SEQ ID NO: 7636705 - DNA, 22 bp, Homo sapiens
cctctgcatctggctgctgcag

SEQ ID NO: 7636706 - DNA, 22 bp, Homo sapiens
cctctgcatctggctgctgcag

SEQ ID NO: 7636707 - DNA, 22 bp, Homo sapiens
cctctgcatctggctgctgcag

SEQ ID NO: 7636708 - DNA, 22 bp, Homo sapiens
cctctgcatctggctgctgcag

SEQ ID NO: 7636709 - DNA, 22 bp, Homo sapiens
cctctgcaaagaatttgtctcc

SEQ ID NO: 7636710 - DNA, 22 bp, Homo sapiens
cctctgcaccatagccttcagc

SEQ ID NO: 7636711 - DNA, 22 bp, Homo sapiens
cctctgcaccatagccttcagc

SEQ ID NO: 7636712 - DNA, 22 bp, Homo sapiens
cctctgcaccatagccttcagc

SEQ ID NO: 7636713 - DNA, 22 bp, Homo sapiens
cctctgagttagagatctagat

SEQ ID NO: 7636714 - DNA, 22 bp, Homo sapiens
cctctgagtgttttccccgggt

SEQ ID NO: 7636715 - DNA, 22 bp, Homo sapiens
cctctgagtgttttccccgggt

SEQ ID NO: 7636716 - DNA, 22 bp, Homo sapiens
cctctgagttggcctgtcttgt

SEQ ID NO: 7636717 - DNA, 22 bp, Homo sapiens
cctctgagttggcctgtcttgt

SEQ ID NO: 7636718 - DNA, 22 bp, Homo sapiens
cctctgagtgctttgagggaga

SEQ ID NO: 7636719 - DNA, 22 bp, Homo sapiens
cctctgagtgctttgagggaga

SEQ ID NO: 7636720 - DNA, 22 bp, Homo sapiens
cctctgagtgacagcctcctct

SEQ ID NO: 7636721 - DNA, 22 bp, Homo sapiens
cctctgagtcctttgggctctc

SEQ ID NO: 7636722 - DNA, 22 bp, Homo sapiens
cctctgagtcctttgggctctc

SEQ ID NO: 7636723 - DNA, 22 bp, Homo sapiens
cctctgagtcctttgggctctc

SEQ ID NO: 7636724 - DNA, 22 bp, Homo sapiens
cctctgagtgacagcctcctct

SEQ ID NO: 7636725 - DNA, 22 bp, Homo sapiens
cctctgagtgacagcctcctct

SEQ ID NO: 7636726 - DNA, 22 bp, Homo sapiens
cctctgagtctcactgtaacct

SEQ ID NO: 7636727 - DNA, 22 bp, Homo sapiens
cctgccaggacattgcttgaag

SEQ ID NO: 7636728 - DNA, 22 bp, Homo sapiens
cctgccaggacattgcttgaag

SEQ ID NO: 7636729 - DNA, 22 bp, Homo sapiens
cctgccaggacattgcttgaag

SEQ ID NO: 7636730 - DNA, 22 bp, Homo sapiens
cctgccaggacattgcttgaag

SEQ ID NO: 7636731 - DNA, 22 bp, Homo sapiens
cctgccaggagctggtgctgca

SEQ ID NO: 7636732 - DNA, 22 bp, Homo sapiens
cctgccaggagctggtgctgca

SEQ ID NO: 7636733 - DNA, 22 bp, Homo sapiens
cctgcccagcttcacctcaggc

SEQ ID NO: 7636734 - DNA, 22 bp, Homo sapiens
cctctgccacctcccacgaggc

SEQ ID NO: 7636735 - DNA, 22 bp, Homo sapiens
cctctgccacctcccacgaggc

SEQ ID NO: 7636736 - DNA, 22 bp, Homo sapiens
cctctgccacctcccacgaggc

SEQ ID NO: 7636737 - DNA, 22 bp, Homo sapiens
cctctgccacctcccacgaggc

SEQ ID NO: 7636738 - DNA, 19 bp, Homo sapiens
cctctgccagcccgcctct

SEQ ID NO: 7636739 - DNA, 19 bp, Homo sapiens
cctctgccagcccgcctct

SEQ ID NO: 7636740 - DNA, 19 bp, Homo sapiens
cctctgccagcccgcctct

SEQ ID NO: 7636741 - DNA, 19 bp, Homo sapiens
cctctgccagcccgcctct

SEQ ID NO: 7636742 - DNA, 22 bp, Homo sapiens
cctgcccagcttcccgagtgca

SEQ ID NO: 7636743 - DNA, 23 bp, Homo sapiens
cctgcccaggaatccggcggcgt

SEQ ID NO: 7636744 - DNA, 23 bp, Homo sapiens
cctgcccaggaatccggcggcgt

SEQ ID NO: 7636745 - DNA, 22 bp, Homo sapiens
cctgcccaggagtctctctgtg

SEQ ID NO: 7636746 - DNA, 22 bp, Homo sapiens
cctgcccaggagtctctctgtg

SEQ ID NO: 7636747 - DNA, 22 bp, Homo sapiens
cctgcccaggagtctctctgtg

SEQ ID NO: 7636748 - DNA, 22 bp, Homo sapiens
cctgcccagcttcccgagtgca

SEQ ID NO: 7636749 - DNA, 22 bp, Homo sapiens
cctgcccagcttcccgagtgca

SEQ ID NO: 7636750 - DNA, 22 bp, Homo sapiens
cctgcccagcttcccgagtgca

SEQ ID NO: 7636751 - DNA, 19 bp, Homo sapiens
cctctgccagcccgcctct

SEQ ID NO: 7636752 - DNA, 22 bp, Homo sapiens
cctgcccagcttcccgagtgca

SEQ ID NO: 7636753 - DNA, 22 bp, Homo sapiens
cctgcccagggtcaccacagag

SEQ ID NO: 7636754 - DNA, 22 bp, Homo sapiens
cctgcccagggtcaccacagag

SEQ ID NO: 7636755 - DNA, 22 bp, Homo sapiens
cctgcccaggccctaagttagg

SEQ ID NO: 7636756 - DNA, 22 bp, Homo sapiens
cctgcccaggagtctctctgtg

SEQ ID NO: 7636757 - DNA, 22 bp, Homo sapiens
cctgcccaggagtctctctgtg

SEQ ID NO: 7636758 - DNA, 22 bp, Homo sapiens
cctgcccaggagtctctctgtg

SEQ ID NO: 7636759 - DNA, 22 bp, Homo sapiens
cctgcccaggagtctctctgtg

SEQ ID NO: 7636760 - DNA, 22 bp, Homo sapiens
cctgccctagagatgacacaat

SEQ ID NO: 7636761 - DNA, 22 bp, Homo sapiens
cctgccctagagatgacacaat

SEQ ID NO: 7636762 - DNA, 22 bp, Homo sapiens
cctgccctagagatgacacaat

SEQ ID NO: 7636763 - DNA, 22 bp, Homo sapiens
cctgccctagagatgacacaat

SEQ ID NO: 7636764 - DNA, 22 bp, Homo sapiens
cctgccctaatccagagactag

SEQ ID NO: 7636765 - DNA, 22 bp, Homo sapiens
cctgccctaatccagagactag

SEQ ID NO: 7636766 - DNA, 22 bp, Homo sapiens
cctgccctaatccagagactag

SEQ ID NO: 7636767 - DNA, 22 bp, Homo sapiens
cctgccctaatccagagactag

SEQ ID NO: 7636768 - DNA, 22 bp, Homo sapiens
cctgccctagagatgacacaat

SEQ ID NO: 7636769 - DNA, 22 bp, Homo sapiens
cctgccctaatccagagactag

SEQ ID NO: 7636770 - DNA, 22 bp, Homo sapiens
cctgccctaatccagagactag

SEQ ID NO: 7636771 - DNA, 22 bp, Homo sapiens
cctgccctatgaccagcttcac

SEQ ID NO: 7636772 - DNA, 22 bp, Homo sapiens
cctgccctatgaccagcttcac

SEQ ID NO: 7636773 - DNA, 22 bp, Homo sapiens
cctgccctatgaccagcttcac

SEQ ID NO: 7636774 - DNA, 22 bp, Homo sapiens
cctgccctatgaccagcttcac

SEQ ID NO: 7636775 - DNA, 22 bp, Homo sapiens
cctgccctatgaccagcttcac

SEQ ID NO: 7636776 - DNA, 22 bp, Homo sapiens
cctgccctatgaccagcttcac

SEQ ID NO: 7636777 - DNA, 22 bp, Homo sapiens
cctgccctagagatgacacaat

SEQ ID NO: 7636778 - DNA, 22 bp, Homo sapiens
cctgccctatgaccagcttcac

SEQ ID NO: 7636779 - DNA, 22 bp, Homo sapiens
cctgccctatgaccagcttcac

SEQ ID NO: 7636780 - DNA, 22 bp, Homo sapiens
cctgccctatgaccagcttcac

SEQ ID NO: 7636781 - DNA, 22 bp, Homo sapiens
cctgcccctcaaggcctggtgc

SEQ ID NO: 7636782 - DNA, 22 bp, Homo sapiens
cctgcccctcaaggcctggtgc

SEQ ID NO: 7636783 - DNA, 22 bp, Homo sapiens
cctgcccctcaaggcctggtgc

SEQ ID NO: 7636784 - DNA, 22 bp, Homo sapiens
cctgcccctcaaggcctggtgc

SEQ ID NO: 7636785 - DNA, 22 bp, Homo sapiens
cctgcccctcaaggcctggtgc

SEQ ID NO: 7636786 - DNA, 22 bp, Homo sapiens
cctgcccctcaaggcctggtgc

SEQ ID NO: 7636787 - DNA, 22 bp, Homo sapiens
cctgcccctcaaggcctggtgc

SEQ ID NO: 7636788 - DNA, 22 bp, Homo sapiens
cctgcccctcaaggcctggtgc

SEQ ID NO: 7636789 - DNA, 22 bp, Homo sapiens
cctgcccctcaaggcctggtgc

SEQ ID NO: 7636790 - DNA, 22 bp, Homo sapiens
cctgcccccgtcagaggtgatg

SEQ ID NO: 7636791 - DNA, 22 bp, Homo sapiens
cctgcccccgtcagaggtgatg

SEQ ID NO: 7636792 - DNA, 22 bp, Homo sapiens
cctgcccccgtcagaggtgatg

SEQ ID NO: 7636793 - DNA, 22 bp, Homo sapiens
cctgcccagggtcaccacagag

SEQ ID NO: 7636794 - DNA, 22 bp, Homo sapiens
cctgcccatactgacctctaat

SEQ ID NO: 7636795 - DNA, 22 bp, Homo sapiens
cctgcccagggtcaccacagag

SEQ ID NO: 7636796 - DNA, 22 bp, Homo sapiens
cctgcccagggtcaccacagag

SEQ ID NO: 7636797 - DNA, 22 bp, Homo sapiens
cctgcccagggtcaccacagag

SEQ ID NO: 7636798 - DNA, 22 bp, Homo sapiens
cctgcccaggccctaagttagg

SEQ ID NO: 7636799 - DNA, 22 bp, Homo sapiens
cctgcccagggtcaccacagag

SEQ ID NO: 7636800 - DNA, 22 bp, Homo sapiens
cctgcccatcccgtccttggcc

SEQ ID NO: 7636801 - DNA, 22 bp, Homo sapiens
cctgcccatcccgtccttggcc

SEQ ID NO: 7636802 - DNA, 22 bp, Homo sapiens
cctgcccatcccgtccttggcc

SEQ ID NO: 7636803 - DNA, 22 bp, Homo sapiens
cctgcccatactgacctctaat

SEQ ID NO: 7636804 - DNA, 22 bp, Homo sapiens
cctgcccatactgacctctaat

SEQ ID NO: 7636805 - DNA, 20 bp, Homo sapiens
agggtgagacatgagcctcc

SEQ ID NO: 7636806 - DNA, 20 bp, Homo sapiens
agggtgagacatgagcctcc

SEQ ID NO: 7636807 - DNA, 20 bp, Homo sapiens
agggtgagacatgagcctcc

SEQ ID NO: 7636808 - DNA, 20 bp, Homo sapiens
agggtgagacatgagcctcc

SEQ ID NO: 7636809 - DNA, 23 bp, Homo sapiens
agggtgagcaagctatggagacc

SEQ ID NO: 7636810 - DNA, 23 bp, Homo sapiens
agggtgagcaagctatggagacc

SEQ ID NO: 7636811 - DNA, 22 bp, Homo sapiens
agggtgaatctcacaactctta

SEQ ID NO: 7636812 - DNA, 22 bp, Homo sapiens
agggtctttcctgggagccagc

SEQ ID NO: 7636813 - DNA, 22 bp, Homo sapiens
agggtgaatctcacaactctta

SEQ ID NO: 7636814 - DNA, 22 bp, Homo sapiens
agggtgaatctcacaactctta

SEQ ID NO: 7636815 - DNA, 22 bp, Homo sapiens
agggtgaatctcacaactctta

SEQ ID NO: 7636816 - DNA, 22 bp, Homo sapiens
agggtgaatctcacaactctta

SEQ ID NO: 7636817 - DNA, 22 bp, Homo sapiens
agggtgaatctcacaactctta

SEQ ID NO: 7636818 - DNA, 22 bp, Homo sapiens
agggtgaatctcacaactctta

SEQ ID NO: 7636819 - DNA, 22 bp, Homo sapiens
agggtgaatctcacaactctta

SEQ ID NO: 7636820 - DNA, 22 bp, Homo sapiens
agggtgaatctcacaactctta

SEQ ID NO: 7636821 - DNA, 22 bp, Homo sapiens
agggtctgtggatgcatctggg

SEQ ID NO: 7636822 - DNA, 22 bp, Homo sapiens
agggtctgtggatgcatctggg

SEQ ID NO: 7636823 - DNA, 22 bp, Homo sapiens
agggtctgtggatgcatctggg

SEQ ID NO: 7636824 - DNA, 22 bp, Homo sapiens
agggtctgtgcaagaacacgcc

SEQ ID NO: 7636825 - DNA, 22 bp, Homo sapiens
agggtctgtatttctggcaagc

SEQ ID NO: 7636826 - DNA, 22 bp, Homo sapiens
agggtctgtatttctggcaagc

SEQ ID NO: 7636827 - DNA, 22 bp, Homo sapiens
agggtcttcccaccattcctgc

SEQ ID NO: 7636828 - DNA, 22 bp, Homo sapiens
agggtcttcccaccattcctgc

SEQ ID NO: 7636829 - DNA, 22 bp, Homo sapiens
agggtcttgaggatctgaactg

SEQ ID NO: 7636830 - DNA, 22 bp, Homo sapiens
agggtctttcctgggagccagc

SEQ ID NO: 7636831 - DNA, 22 bp, Homo sapiens
agggtctgttgtttgttctgga

SEQ ID NO: 7636832 - DNA, 22 bp, Homo sapiens
agggtctgtggatgcatctggg

SEQ ID NO: 7636833 - DNA, 22 bp, Homo sapiens
agggtctgtggatgcatctggg

SEQ ID NO: 7636834 - DNA, 22 bp, Homo sapiens
agggtctgtggatgcatctggg

SEQ ID NO: 7636835 - DNA, 22 bp, Homo sapiens
agggtctgttgtttgttctgga

SEQ ID NO: 7636836 - DNA, 20 bp, Homo sapiens
agggtctggccctgttcctt

SEQ ID NO: 7636837 - DNA, 22 bp, Homo sapiens
agggtctggtgtagaagttctc

SEQ ID NO: 7636838 - DNA, 20 bp, Homo sapiens
agggtctgctgggtaggaca

SEQ ID NO: 7636839 - DNA, 20 bp, Homo sapiens
agggtctgctgggtaggaca

SEQ ID NO: 7636840 - DNA, 23 bp, Homo sapiens
agggtctgctcagtgtcgttcaa

SEQ ID NO: 7636841 - DNA, 23 bp, Homo sapiens
agggtctgctcagtgtcgttcaa

SEQ ID NO: 7636842 - DNA, 22 bp, Homo sapiens
agggtctgcagggatcttctgg

SEQ ID NO: 7636843 - DNA, 20 bp, Homo sapiens
agggtctgctgggtaggaca

SEQ ID NO: 7636844 - DNA, 23 bp, Homo sapiens
agggtctgctcagtgtcgttcaa

SEQ ID NO: 7636845 - DNA, 20 bp, Homo sapiens
agggtctgctgggtaggaca

SEQ ID NO: 7636846 - DNA, 20 bp, Homo sapiens
agggtctgatgtggtggccc

SEQ ID NO: 7636847 - DNA, 22 bp, Homo sapiens
agggtctgactgaatggaaaag

SEQ ID NO: 7636848 - DNA, 22 bp, Homo sapiens
agggtctgactgaatggaaaag

SEQ ID NO: 7636849 - DNA, 20 bp, Homo sapiens
agggtctgatgtggtggccc

SEQ ID NO: 7636850 - DNA, 20 bp, Homo sapiens
agggtctgatgtggtggccc

SEQ ID NO: 7636851 - DNA, 22 bp, Homo sapiens
agggtctgactcctctggcaag

SEQ ID NO: 7636852 - DNA, 22 bp, Homo sapiens
agggtctgactgaatggaaaag

SEQ ID NO: 7636853 - DNA, 22 bp, Homo sapiens
agggtctgactcctctggcaag

SEQ ID NO: 7636854 - DNA, 22 bp, Homo sapiens
agggtctgaccaccagtaggga

SEQ ID NO: 7636855 - DNA, 22 bp, Homo sapiens
agggtctgaccaccagtaggga

SEQ ID NO: 7636856 - DNA, 22 bp, Homo sapiens
agggtctgaccaccagtaggga

SEQ ID NO: 7636857 - DNA, 22 bp, Homo sapiens
agggtctgaccaccagtaggga

SEQ ID NO: 7636858 - DNA, 22 bp, Homo sapiens
agggtctgaccaccagtaggga

SEQ ID NO: 7636859 - DNA, 22 bp, Homo sapiens
agggtctgaccaccagtaggga

SEQ ID NO: 7636860 - DNA, 22 bp, Homo sapiens
agggtctgaccaccagtaggga

SEQ ID NO: 7636861 - DNA, 22 bp, Homo sapiens
agggtctgacaatgtgacttag

SEQ ID NO: 7636862 - DNA, 22 bp, Homo sapiens
agggtctctggagagctgagga

SEQ ID NO: 7636863 - DNA, 22 bp, Homo sapiens
agggtctctggagagctgagga

SEQ ID NO: 7636864 - DNA, 22 bp, Homo sapiens
agggtctctggagagctgagga

SEQ ID NO: 7636865 - DNA, 22 bp, Homo sapiens
agggtctctggagagctgagga

SEQ ID NO: 7636866 - DNA, 22 bp, Homo sapiens
agggtctcttgccatgcctcag

SEQ ID NO: 7636867 - DNA, 22 bp, Homo sapiens
agggtctctgggagtagggcac

SEQ ID NO: 7636868 - DNA, 22 bp, Homo sapiens
agggtctctggagagctgagga

SEQ ID NO: 7636869 - DNA, 22 bp, Homo sapiens
agggtcagagatcggccatgtg

SEQ ID NO: 7636870 - DNA, 20 bp, Homo sapiens
agggtcagagagcgtgagtg

SEQ ID NO: 7636871 - DNA, 22 bp, Homo sapiens
agggtcagagatcggccatgtg

SEQ ID NO: 7636872 - DNA, 22 bp, Homo sapiens
agggtcagagtcaggtgcagta

SEQ ID NO: 7636873 - DNA, 22 bp, Homo sapiens
agggtcagagtcaggtgcagta

SEQ ID NO: 7636874 - DNA, 22 bp, Homo sapiens
agggtcagagtcaggtgcagta

SEQ ID NO: 7636875 - DNA, 22 bp, Homo sapiens
agggtcagagtcaggtgcagta

SEQ ID NO: 7636876 - DNA, 22 bp, Homo sapiens
agggtcagagatcggccatgtg

SEQ ID NO: 7636877 - DNA, 22 bp, Homo sapiens
agggtcagagatcggccatgtg

SEQ ID NO: 7636878 - DNA, 20 bp, Homo sapiens
agggtcagagagcgtgagtg

SEQ ID NO: 7636879 - DNA, 20 bp, Homo sapiens
agggtcagagagcgtgagtg

SEQ ID NO: 7636880 - DNA, 20 bp, Homo sapiens
agggtcagagagcgtgagtg

SEQ ID NO: 7636881 - DNA, 22 bp, Homo sapiens
agggtcacctgcttgccagggc

SEQ ID NO: 7636882 - DNA, 22 bp, Homo sapiens
cctgccctgctcactgtcggta

SEQ ID NO: 7636883 - DNA, 22 bp, Homo sapiens
cctgccctgctcactgtcggta

SEQ ID NO: 7636884 - DNA, 22 bp, Homo sapiens
cctgccctgtcactggctaggg

SEQ ID NO: 7636885 - DNA, 22 bp, Homo sapiens
cctgccctgctcactgtcggta

SEQ ID NO: 7636886 - DNA, 20 bp, Homo sapiens
agggtcagagagcgtgagtg

SEQ ID NO: 7636887 - DNA, 20 bp, Homo sapiens
agggtcagagagcgtgagtg

SEQ ID NO: 7636888 - DNA, 20 bp, Homo sapiens
agggtcagagagcgtgagtg

SEQ ID NO: 7636889 - DNA, 20 bp, Homo sapiens
agggtcagagagcgtgagtg

SEQ ID NO: 7636890 - DNA, 20 bp, Homo sapiens
agggtcagagagcgtgagtg

SEQ ID NO: 7636891 - DNA, 22 bp, Homo sapiens
agggtcagagtcaggtgcagta

SEQ ID NO: 7636892 - DNA, 22 bp, Homo sapiens
agggtcagagtcaggtgcagta

SEQ ID NO: 7636893 - DNA, 22 bp, Homo sapiens
agggtcagagtcaggtgcagta

SEQ ID NO: 7636894 - DNA, 22 bp, Homo sapiens
agggtcagagtcaggtgcagta

SEQ ID NO: 7636895 - DNA, 22 bp, Homo sapiens
agggtcagctggctgtcagggg

SEQ ID NO: 7636896 - DNA, 22 bp, Homo sapiens
agggtcagctggctgtcagggg

SEQ ID NO: 7636897 - DNA, 22 bp, Homo sapiens
agggtcagctggctgtcagggg

SEQ ID NO: 7636898 - DNA, 22 bp, Homo sapiens
agggtcagctggctgtcagggg

SEQ ID NO: 7636899 - DNA, 21 bp, Homo sapiens
agggtcaggaaccagggtacc

SEQ ID NO: 7636900 - DNA, 21 bp, Homo sapiens
agggtcaggaaccagggtacc

SEQ ID NO: 7636901 - DNA, 21 bp, Homo sapiens
agggtcaggaaccagggtacc

SEQ ID NO: 7636902 - DNA, 21 bp, Homo sapiens
agggtcaggaaccagggtacc

SEQ ID NO: 7636903 - DNA, 22 bp, Homo sapiens
agggtcagctggctgtcagggg

SEQ ID NO: 7636904 - DNA, 21 bp, Homo sapiens
agggtcaggaaccagggtacc

SEQ ID NO: 7636905 - DNA, 21 bp, Homo sapiens
agggtcaggaaccagggtacc

SEQ ID NO: 7636906 - DNA, 21 bp, Homo sapiens
agggtcaggaaccagggtacc

SEQ ID NO: 7636907 - DNA, 21 bp, Homo sapiens
agggtcaggaaccagggtacc

SEQ ID NO: 7636908 - DNA, 19 bp, Homo sapiens
agggtcaggacaaggactt

SEQ ID NO: 7636909 - DNA, 19 bp, Homo sapiens
agggtcaggacaaggactt

SEQ ID NO: 7636910 - DNA, 19 bp, Homo sapiens
agggtcaggacaaggactt

SEQ ID NO: 7636911 - DNA, 19 bp, Homo sapiens
agggtcaggacaaggactt

SEQ ID NO: 7636912 - DNA, 21 bp, Homo sapiens
agggtcaggaaccagggtacc

SEQ ID NO: 7636913 - DNA, 17 bp, Homo sapiens
agggtcaggtgaagttc

SEQ ID NO: 7636914 - DNA, 17 bp, Homo sapiens
agggtcaggtgaagttc

SEQ ID NO: 7636915 - DNA, 17 bp, Homo sapiens
agggtcaggtgaagttc

SEQ ID NO: 7636916 - DNA, 22 bp, Homo sapiens
agggtcagggagtgagtattta

SEQ ID NO: 7636917 - DNA, 22 bp, Homo sapiens
agggtcagggagtgagtattta

SEQ ID NO: 7636918 - DNA, 22 bp, Homo sapiens
agggtcaggagacactggcaac

SEQ ID NO: 7636919 - DNA, 22 bp, Homo sapiens
agggtcaggagacactggcaac

SEQ ID NO: 7636920 - DNA, 22 bp, Homo sapiens
agggtcaggagacactggcaac

SEQ ID NO: 7636921 - DNA, 22 bp, Homo sapiens
agggtcaggagacactggcaac

SEQ ID NO: 7636922 - DNA, 19 bp, Homo sapiens
agggtcaggacaaggactt

SEQ ID NO: 7636923 - DNA, 22 bp, Homo sapiens
agggtcaggagacactggcaac

SEQ ID NO: 7636924 - DNA, 22 bp, Homo sapiens
agggtcaggagacactggcaac

SEQ ID NO: 7636925 - DNA, 20 bp, Homo sapiens
agggtcagtagcacagagct

SEQ ID NO: 7636926 - DNA, 20 bp, Homo sapiens
agggtcagtagcacagagct

SEQ ID NO: 7636927 - DNA, 20 bp, Homo sapiens
agggtcagtagcacagagct

SEQ ID NO: 7636928 - DNA, 22 bp, Homo sapiens
agggtcaggttaagggagtcat

SEQ ID NO: 7636929 - DNA, 22 bp, Homo sapiens
agggtcaggttaagggagtcat

SEQ ID NO: 7636930 - DNA, 20 bp, Homo sapiens
agggtcagtagcacagagct

SEQ ID NO: 7636931 - DNA, 20 bp, Homo sapiens
agggtcagtagcacagagct

SEQ ID NO: 7636932 - DNA, 20 bp, Homo sapiens
agggtcagtagcacagagct

SEQ ID NO: 7636933 - DNA, 22 bp, Homo sapiens
agggtcaggttaagggagtcat

SEQ ID NO: 7636934 - DNA, 17 bp, Homo sapiens
agggtcaggtgaagttc

SEQ ID NO: 7636935 - DNA, 17 bp, Homo sapiens
agggtcaggtgaagttc

SEQ ID NO: 7636936 - DNA, 17 bp, Homo sapiens
agggtcaggtgaagttc

SEQ ID NO: 7636937 - DNA, 22 bp, Homo sapiens
agggtcaggttaagggagtcat

SEQ ID NO: 7636938 - DNA, 22 bp, Homo sapiens
agggtcaggttaagggagtcat

SEQ ID NO: 7636939 - DNA, 22 bp, Homo sapiens
agggtcaggttaagggagtcat

SEQ ID NO: 7636940 - DNA, 22 bp, Homo sapiens
agggtctcagagcctgagaacc

SEQ ID NO: 7636941 - DNA, 22 bp, Homo sapiens
agggtccttctgttcctgagca

SEQ ID NO: 7636942 - DNA, 22 bp, Homo sapiens
agggtctatctctctgcctttg

SEQ ID NO: 7636943 - DNA, 22 bp, Homo sapiens
agggtccttctgttcctgagca

SEQ ID NO: 7636944 - DNA, 22 bp, Homo sapiens
agggtccttctgttcctgagca

SEQ ID NO: 7636945 - DNA, 22 bp, Homo sapiens
agggtcctgggtgcagttgctt

SEQ ID NO: 7636946 - DNA, 22 bp, Homo sapiens
agggtcctgagcctggggcgca

SEQ ID NO: 7636947 - DNA, 22 bp, Homo sapiens
agggtcctgagcctggggcgca

SEQ ID NO: 7636948 - DNA, 21 bp, Homo sapiens
agggtcctacagggctcagga

SEQ ID NO: 7636949 - DNA, 20 bp, Homo sapiens
agggtcagtagcacagagct

SEQ ID NO: 7636950 - DNA, 20 bp, Homo sapiens
agggtcagtagcacagagct

SEQ ID NO: 7636951 - DNA, 21 bp, Homo sapiens
agggtcctacagggctcagga

SEQ ID NO: 7636952 - DNA, 22 bp, Homo sapiens
agggagagtagatatcaggtgt

SEQ ID NO: 7636953 - DNA, 22 bp, Homo sapiens
agggagagtagatatcaggtgt

SEQ ID NO: 7636954 - DNA, 22 bp, Homo sapiens
agggagaggttgaaacctcagt

SEQ ID NO: 7636955 - DNA, 22 bp, Homo sapiens
agggagagtagatatcaggtgt

SEQ ID NO: 7636956 - DNA, 22 bp, Homo sapiens
agggagagtagatatcaggtgt

SEQ ID NO: 7636957 - DNA, 22 bp, Homo sapiens
agggagagtagatatcaggtgt

SEQ ID NO: 7636958 - DNA, 22 bp, Homo sapiens
agggagagtagatatcaggtgt

SEQ ID NO: 7636959 - DNA, 22 bp, Homo sapiens
agggagagtagatatcaggtgt

SEQ ID NO: 7636960 - DNA, 22 bp, Homo sapiens
agggagaggttgaaacctcagt

SEQ ID NO: 7636961 - DNA, 22 bp, Homo sapiens
agggagaggttgaaacctcagt

SEQ ID NO: 7636962 - DNA, 22 bp, Homo sapiens
agggagaggttgaaacctcagt

SEQ ID NO: 7636963 - DNA, 22 bp, Homo sapiens
agggagaggctgaactatccta

SEQ ID NO: 7636964 - DNA, 22 bp, Homo sapiens
agggagaggttgaaacctcagt

SEQ ID NO: 7636965 - DNA, 22 bp, Homo sapiens
agggagaggttgaaacctcagt

SEQ ID NO: 7636966 - DNA, 22 bp, Homo sapiens
agggagaggttgaaacctcagt

SEQ ID NO: 7636967 - DNA, 22 bp, Homo sapiens
agggagaggttgaaacctcagt

SEQ ID NO: 7636968 - DNA, 22 bp, Homo sapiens
agggaatgctccgtataaatct

SEQ ID NO: 7636969 - DNA, 22 bp, Homo sapiens
agggaatctaggctcagagtgc

SEQ ID NO: 7636970 - DNA, 19 bp, Homo sapiens
agggaatccggctgaggga

SEQ ID NO: 7636971 - DNA, 19 bp, Homo sapiens
agggaatccggctgaggga

SEQ ID NO: 7636972 - DNA, 19 bp, Homo sapiens
agggaatccggctgaggga

SEQ ID NO: 7636973 - DNA, 22 bp, Homo sapiens
agggagaatgaccaaggtatat

SEQ ID NO: 7636974 - DNA, 22 bp, Homo sapiens
agggagaatgaccaaggtatat

SEQ ID NO: 7636975 - DNA, 22 bp, Homo sapiens
agggagaatgaccaaggtatat

SEQ ID NO: 7636976 - DNA, 22 bp, Homo sapiens
agggagaaggtttagctgtgag

SEQ ID NO: 7636977 - DNA, 22 bp, Homo sapiens
agggagaaggtttagctgtgag

SEQ ID NO: 7636978 - DNA, 22 bp, Homo sapiens
agggaatggatgatggcaggtt

SEQ ID NO: 7636979 - DNA, 19 bp, Homo sapiens
agggagaattccaagagga

SEQ ID NO: 7636980 - DNA, 19 bp, Homo sapiens
agggagaattccaagagga

SEQ ID NO: 7636981 - DNA, 22 bp, Homo sapiens
agggaatggatgatggcaggtt

SEQ ID NO: 7636982 - DNA, 19 bp, Homo sapiens
agggagaattccaagagga

SEQ ID NO: 7636983 - DNA, 19 bp, Homo sapiens
agggagaattccaagagga

SEQ ID NO: 7636984 - DNA, 22 bp, Homo sapiens
agggagaggctgaactatccta

SEQ ID NO: 7636985 - DNA, 22 bp, Homo sapiens
agggaaggtagaggtcaccggc

SEQ ID NO: 7636986 - DNA, 22 bp, Homo sapiens
agggaagtgaatgacagatatc

SEQ ID NO: 7636987 - DNA, 22 bp, Homo sapiens
agggaagtgaatgacagatatc

SEQ ID NO: 7636988 - DNA, 22 bp, Homo sapiens
agggaagtccatgggggcggtg

SEQ ID NO: 7636989 - DNA, 22 bp, Homo sapiens
agggaagtccatgggggcggtg

SEQ ID NO: 7636990 - DNA, 22 bp, Homo sapiens
agggaagtccatgggggcggtg

SEQ ID NO: 7636991 - DNA, 22 bp, Homo sapiens
agggaaggtagaggtcaccggc

SEQ ID NO: 7636992 - DNA, 22 bp, Homo sapiens
agggaaggtagaggtcaccggc

SEQ ID NO: 7636993 - DNA, 22 bp, Homo sapiens
agggaaggtagaggtcaccggc

SEQ ID NO: 7636994 - DNA, 22 bp, Homo sapiens
agggaaggtagaggtcaccggc

SEQ ID NO: 7636995 - DNA, 22 bp, Homo sapiens
agggaaggtagaggtcaccggc

SEQ ID NO: 7636996 - DNA, 22 bp, Homo sapiens
agggaaggtagaggtcaccggc

SEQ ID NO: 7636997 - DNA, 22 bp, Homo sapiens
agggaaggtagaggtcaccggc

SEQ ID NO: 7636998 - DNA, 19 bp, Homo sapiens
agggaatccggctgaggga

SEQ ID NO: 7636999 - DNA, 19 bp, Homo sapiens
agggaatccggctgaggga

SEQ ID NO: 7637000 - DNA, 19 bp, Homo sapiens
agggaatccggctgaggga

SEQ ID NO: 7637001 - DNA, 19 bp, Homo sapiens
agggaatccggctgaggga

SEQ ID NO: 7637002 - DNA, 22 bp, Homo sapiens
agggaatccatctatcttcatt

SEQ ID NO: 7637003 - DNA, 22 bp, Homo sapiens
agggaatccatctatcttcatt

SEQ ID NO: 7637004 - DNA, 22 bp, Homo sapiens
agggaaggtagaggtcaccggc

SEQ ID NO: 7637005 - DNA, 22 bp, Homo sapiens
agggaagtggtctgggaacttg

SEQ ID NO: 7637006 - DNA, 22 bp, Homo sapiens
agggaagtgaatgacagatatc

SEQ ID NO: 7637007 - DNA, 22 bp, Homo sapiens
agggaagtgatggagttcgatc

SEQ ID NO: 7637008 - DNA, 20 bp, Homo sapiens
agggaagtgcgccatcaggg

SEQ ID NO: 7637009 - DNA, 22 bp, Homo sapiens
agggaagtgaatgacagatatc

SEQ ID NO: 7637010 - DNA, 22 bp, Homo sapiens
agggaagtgaatgacagatatc

SEQ ID NO: 7637011 - DNA, 22 bp, Homo sapiens
agggaagtgataggacgtctct

SEQ ID NO: 7637012 - DNA, 22 bp, Homo sapiens
agggaagggcagggtctatgca

SEQ ID NO: 7637013 - DNA, 22 bp, Homo sapiens
agggaagggcagggtctatgca

SEQ ID NO: 7637014 - DNA, 22 bp, Homo sapiens
agggaagggcagggtctatgca

SEQ ID NO: 7637015 - DNA, 22 bp, Homo sapiens
agggaagggcagggtctatgca

SEQ ID NO: 7637016 - DNA, 22 bp, Homo sapiens
agggaagggaaaaacactcgtc

SEQ ID NO: 7637017 - DNA, 22 bp, Homo sapiens
agggaagggcagggtctatgca

SEQ ID NO: 7637018 - DNA, 22 bp, Homo sapiens
agggaagggcagggtctatgca

SEQ ID NO: 7637019 - DNA, 22 bp, Homo sapiens
agggaagggcagggtctatgca

SEQ ID NO: 7637020 - DNA, 22 bp, Homo sapiens
agggaagggcagggtctatgca

SEQ ID NO: 7637021 - DNA, 22 bp, Homo sapiens
agggaagggcagggtctatgca

SEQ ID NO: 7637022 - DNA, 23 bp, Homo sapiens
agggaagggggcttattccacag

SEQ ID NO: 7637023 - DNA, 23 bp, Homo sapiens
agggaagggggcttattccacag

SEQ ID NO: 7637024 - DNA, 23 bp, Homo sapiens
agggaagggggcttattccacag

SEQ ID NO: 7637025 - DNA, 23 bp, Homo sapiens
agggaagggggcttattccacag

SEQ ID NO: 7637026 - DNA, 22 bp, Homo sapiens
agggaagggcagggtctatgca

SEQ ID NO: 7637027 - DNA, 22 bp, Homo sapiens
agggaagggcagggtctatgca

SEQ ID NO: 7637028 - DNA, 23 bp, Homo sapiens
agggaagggggcttattccacag

SEQ ID NO: 7637029 - DNA, 23 bp, Homo sapiens
agggaagggggcttattccacag

SEQ ID NO: 7637030 - DNA, 22 bp, Homo sapiens
agggaagggaaaaacactcgtc

SEQ ID NO: 7637031 - DNA, 22 bp, Homo sapiens
agggaagggaaaaacactcgtc

SEQ ID NO: 7637032 - DNA, 22 bp, Homo sapiens
agggaagggaaaaacactcgtc

SEQ ID NO: 7637033 - DNA, 22 bp, Homo sapiens
agggaagggaaaaacactcgtc

SEQ ID NO: 7637034 - DNA, 22 bp, Homo sapiens
agggaagggaaaaacactcgtc

SEQ ID NO: 7637035 - DNA, 22 bp, Homo sapiens
agggaagggaaaaacactcgtc

SEQ ID NO: 7637036 - DNA, 22 bp, Homo sapiens
agggaaggcttttgacatttcc

SEQ ID NO: 7637037 - DNA, 22 bp, Homo sapiens
agggaaggcttttgacatttcc

SEQ ID NO: 7637038 - DNA, 22 bp, Homo sapiens
agggaaggcttttgacatttcc

SEQ ID NO: 7637039 - DNA, 22 bp, Homo sapiens
agggaaggcttttgacatttcc

SEQ ID NO: 7637040 - DNA, 22 bp, Homo sapiens
agggaaggcttttgacatttcc

SEQ ID NO: 7637041 - DNA, 22 bp, Homo sapiens
agggaaggcttttgacatttcc

SEQ ID NO: 7637042 - DNA, 19 bp, Homo sapiens
agggaaggattctgtcatt

SEQ ID NO: 7637043 - DNA, 19 bp, Homo sapiens
agggaaggattctgtcatt

SEQ ID NO: 7637044 - DNA, 19 bp, Homo sapiens
agggaaggattctgtcatt

SEQ ID NO: 7637045 - DNA, 19 bp, Homo sapiens
agggaaggattctgtcatt

SEQ ID NO: 7637046 - DNA, 22 bp, Homo sapiens
agggaaggcttttgacatttcc

SEQ ID NO: 7637047 - DNA, 22 bp, Homo sapiens
agggaaggaggccatgtgtccc

SEQ ID NO: 7637048 - DNA, 22 bp, Homo sapiens
agggaaggaggttagaacccac

SEQ ID NO: 7637049 - DNA, 22 bp, Homo sapiens
agggaaggaggccatgtgtccc

SEQ ID NO: 7637050 - DNA, 22 bp, Homo sapiens
agggaaggaggccatgtgtccc

SEQ ID NO: 7637051 - DNA, 22 bp, Homo sapiens
agggaaggaggccatgtgtccc

SEQ ID NO: 7637052 - DNA, 22 bp, Homo sapiens
agggaaggaggccatgtgtccc

SEQ ID NO: 7637053 - DNA, 22 bp, Homo sapiens
agggaaggaggccatgtgtccc

SEQ ID NO: 7637054 - DNA, 22 bp, Homo sapiens
agggaaggaggccatgtgtccc

SEQ ID NO: 7637055 - DNA, 22 bp, Homo sapiens
agggaaggaggccatgtgtccc

SEQ ID NO: 7637056 - DNA, 22 bp, Homo sapiens
agggaaggaggccatgtgtccc

SEQ ID NO: 7637057 - DNA, 22 bp, Homo sapiens
agggaaggaggccatgtgtccc

SEQ ID NO: 7637058 - DNA, 22 bp, Homo sapiens
agggaaggaggttagaacccac

SEQ ID NO: 7637059 - DNA, 22 bp, Homo sapiens
agggaaggaggttagaacccac

SEQ ID NO: 7637060 - DNA, 22 bp, Homo sapiens
agggaaggaggttagaacccac

SEQ ID NO: 7637061 - DNA, 22 bp, Homo sapiens
agggaaggaggccatgtgtccc

SEQ ID NO: 7637062 - DNA, 22 bp, Homo sapiens
agggaaggaggttagaacccac

SEQ ID NO: 7637063 - DNA, 19 bp, Homo sapiens
agggaaggattctgtcatt

SEQ ID NO: 7637064 - DNA, 19 bp, Homo sapiens
agggaaggattctgtcatt

SEQ ID NO: 7637065 - DNA, 19 bp, Homo sapiens
agggaaggattctgtcatt

SEQ ID NO: 7637066 - DNA, 19 bp, Homo sapiens
agggaaggattctgtcatt

SEQ ID NO: 7637067 - DNA, 22 bp, Homo sapiens
agggaaggaaaagctgtcgctt

SEQ ID NO: 7637068 - DNA, 22 bp, Homo sapiens
agggaaggaaaagctgtcgctt

SEQ ID NO: 7637069 - DNA, 22 bp, Homo sapiens
agggaaggaggccatgtgtccc

SEQ ID NO: 7637070 - DNA, 22 bp, Homo sapiens
agggaaggaaaagctgtcgctt

SEQ ID NO: 7637071 - DNA, 22 bp, Homo sapiens
agggaaggaaaagctgtcgctt

SEQ ID NO: 7637072 - DNA, 22 bp, Homo sapiens
agggaaggaaaagctgtcgctt

SEQ ID NO: 7637073 - DNA, 22 bp, Homo sapiens
agggaagaagctggtagtaggt

SEQ ID NO: 7637074 - DNA, 22 bp, Homo sapiens
agggaaggaaaagctgtcgctt

SEQ ID NO: 7637075 - DNA, 22 bp, Homo sapiens
agggaagcttgttactgagaag

SEQ ID NO: 7637076 - DNA, 22 bp, Homo sapiens
agggaaggaaaagctgtcgctt

SEQ ID NO: 7637077 - DNA, 22 bp, Homo sapiens
agggaaggaaaagctgtcgctt

SEQ ID NO: 7637078 - DNA, 22 bp, Homo sapiens
agggaaggaaaagctgtcgctt

SEQ ID NO: 7637079 - DNA, 22 bp, Homo sapiens
agggaaggaaaagctgtcgctt

SEQ ID NO: 7637080 - DNA, 22 bp, Homo sapiens
agggaaggaaaagctgtcgctt

SEQ ID NO: 7637081 - DNA, 22 bp, Homo sapiens
agggaagaatcactgggatgtt

SEQ ID NO: 7637082 - DNA, 22 bp, Homo sapiens
agggaagaatcactgggatgtt

SEQ ID NO: 7637083 - DNA, 22 bp, Homo sapiens
aggcttatagcttatatttaag

SEQ ID NO: 7637084 - DNA, 22 bp, Homo sapiens
aggcttatagcttatatttaag

SEQ ID NO: 7637085 - DNA, 21 bp, Homo sapiens
aggcttagcaatttcctatgg

SEQ ID NO: 7637086 - DNA, 21 bp, Homo sapiens
aggcttagcaatttcctatgg

SEQ ID NO: 7637087 - DNA, 22 bp, Homo sapiens
aggcttagactacctggtctgt

SEQ ID NO: 7637088 - DNA, 22 bp, Homo sapiens
aggcttatgtgcagtttactct

SEQ ID NO: 7637089 - DNA, 22 bp, Homo sapiens
aggcttattaatatgattctgc

SEQ ID NO: 7637090 - DNA, 22 bp, Homo sapiens
aggcttattaatatgattctgc

SEQ ID NO: 7637091 - DNA, 22 bp, Homo sapiens
aggcttattttaggtctctctt

SEQ ID NO: 7637092 - DNA, 22 bp, Homo sapiens
aggcttattttaggtctctctt

SEQ ID NO: 7637093 - DNA, 22 bp, Homo sapiens
aggcttagaaattcagctgagt

SEQ ID NO: 7637094 - DNA, 22 bp, Homo sapiens
aggcttagaaagggtaagtgac

SEQ ID NO: 7637095 - DNA, 18 bp, Homo sapiens
aggcttacagcagcaggc

SEQ ID NO: 7637096 - DNA, 22 bp, Homo sapiens
aggcttaatgagttaaatcact

SEQ ID NO: 7637097 - DNA, 22 bp, Homo sapiens
aggcttcaaggacagcagccac

SEQ ID NO: 7637098 - DNA, 20 bp, Homo sapiens
aggcttcaaccatacacctt

SEQ ID NO: 7637099 - DNA, 22 bp, Homo sapiens
aggcttcaaggacctgagggaa

SEQ ID NO: 7637100 - DNA, 22 bp, Homo sapiens
aggcttcaaggttcttggcagg

SEQ ID NO: 7637101 - DNA, 22 bp, Homo sapiens
agggaagaagctggtagtaggt

SEQ ID NO: 7637102 - DNA, 22 bp, Homo sapiens
agggaagaagctggtagtaggt

SEQ ID NO: 7637103 - DNA, 21 bp, Homo sapiens
ccccatggagtacagttgggc

SEQ ID NO: 7637104 - DNA, 22 bp, Homo sapiens
ccccatgctgggatctgacacc

SEQ ID NO: 7637105 - DNA, 22 bp, Homo sapiens
ccccatgctgggatctgacacc

SEQ ID NO: 7637106 - DNA, 22 bp, Homo sapiens
ccccatgaagtagggtctctga

SEQ ID NO: 7637107 - DNA, 22 bp, Homo sapiens
ccccatgaagtagggtctctga

SEQ ID NO: 7637108 - DNA, 22 bp, Homo sapiens
ccccatgaagtagggtctctga

SEQ ID NO: 7637109 - DNA, 22 bp, Homo sapiens
ccccagtggaggtgagggtcct

SEQ ID NO: 7637110 - DNA, 22 bp, Homo sapiens
ccccagtggttgcaacagcaga

SEQ ID NO: 7637111 - DNA, 22 bp, Homo sapiens
ccccatcccacctgagtgtcac

SEQ ID NO: 7637112 - DNA, 22 bp, Homo sapiens
ccccatcccacctgagtgtcac

SEQ ID NO: 7637113 - DNA, 22 bp, Homo sapiens
ccccatcatctttgaggtcatt

SEQ ID NO: 7637114 - DNA, 22 bp, Homo sapiens
ccccatcctattcatgtttctg

SEQ ID NO: 7637115 - DNA, 22 bp, Homo sapiens
ccccatcccacctgagtgtcac

SEQ ID NO: 7637116 - DNA, 22 bp, Homo sapiens
ccccatgaagtagggtctctga

SEQ ID NO: 7637117 - DNA, 22 bp, Homo sapiens
ccccagggtcagtgtgtggagg

SEQ ID NO: 7637118 - DNA, 22 bp, Homo sapiens
agggaggaaggaactccttcta

SEQ ID NO: 7637119 - DNA, 22 bp, Homo sapiens
agggaggaaggaactccttcta

SEQ ID NO: 7637120 - DNA, 22 bp, Homo sapiens
agggaggaaggaactccttcta

SEQ ID NO: 7637121 - DNA, 22 bp, Homo sapiens
agggaggaaggaactccttcta

SEQ ID NO: 7637122 - DNA, 22 bp, Homo sapiens
agggaggaaggaactccttcta

SEQ ID NO: 7637123 - DNA, 22 bp, Homo sapiens
agggagctttttcatgtgtcta

SEQ ID NO: 7637124 - DNA, 22 bp, Homo sapiens
agggaggaaggaactccttcta

SEQ ID NO: 7637125 - DNA, 22 bp, Homo sapiens
agggaggaaggaactccttcta

SEQ ID NO: 7637126 - DNA, 22 bp, Homo sapiens
ccccatggcaactgctgggggt

SEQ ID NO: 7637127 - DNA, 21 bp, Homo sapiens
ccccatggagtacagttgggc

SEQ ID NO: 7637128 - DNA, 22 bp, Homo sapiens
ccccatggcaactgctgggggt

SEQ ID NO: 7637129 - DNA, 22 bp, Homo sapiens
ccccatggcaactgctgggggt

SEQ ID NO: 7637130 - DNA, 22 bp, Homo sapiens
ccccatggcaactgctgggggt

SEQ ID NO: 7637131 - DNA, 22 bp, Homo sapiens
ccccattctggccagcccagct

SEQ ID NO: 7637132 - DNA, 22 bp, Homo sapiens
ccccatgggtgtagggaggtgg

SEQ ID NO: 7637133 - DNA, 22 bp, Homo sapiens
agggagctttttcatgtgtcta

SEQ ID NO: 7637134 - DNA, 19 bp, Homo sapiens
ccccagggtaggctagggg

SEQ ID NO: 7637135 - DNA, 22 bp, Homo sapiens
ccccagggtcagtgtgtggagg

SEQ ID NO: 7637136 - DNA, 22 bp, Homo sapiens
ccccagggtcagtgtgtggagg

SEQ ID NO: 7637137 - DNA, 19 bp, Homo sapiens
ccccagggtaggctagggg

SEQ ID NO: 7637138 - DNA, 19 bp, Homo sapiens
ccccagggtaggctagggg

SEQ ID NO: 7637139 - DNA, 19 bp, Homo sapiens
ccccagggtaggctagggg

SEQ ID NO: 7637140 - DNA, 19 bp, Homo sapiens
ccccagggtaggctagggg

SEQ ID NO: 7637141 - DNA, 19 bp, Homo sapiens
ccccagggtaggctagggg

SEQ ID NO: 7637142 - DNA, 19 bp, Homo sapiens
ccccagggtaggctagggg

SEQ ID NO: 7637143 - DNA, 22 bp, Homo sapiens
ccccagggtcagtgtgtggagg

SEQ ID NO: 7637144 - DNA, 22 bp, Homo sapiens
ccccagggtcagtgtgtggagg

SEQ ID NO: 7637145 - DNA, 22 bp, Homo sapiens
ccccagggtcagtgtgtggagg

SEQ ID NO: 7637146 - DNA, 22 bp, Homo sapiens
ccccaggtggatggctcgcata

SEQ ID NO: 7637147 - DNA, 22 bp, Homo sapiens
ccccagggtcagtgtgtggagg

SEQ ID NO: 7637148 - DNA, 22 bp, Homo sapiens
ccccagggtcagtgtgtggagg

SEQ ID NO: 7637149 - DNA, 22 bp, Homo sapiens
ccccagggactggtttcatgga

SEQ ID NO: 7637150 - DNA, 22 bp, Homo sapiens
ccccagggactggtttcatgga

SEQ ID NO: 7637151 - DNA, 19 bp, Homo sapiens
ccccagggtaggctagggg

SEQ ID NO: 7637152 - DNA, 19 bp, Homo sapiens
ccccagggtaggctagggg

SEQ ID NO: 7637153 - DNA, 19 bp, Homo sapiens
ccccagggtaggctagggg

SEQ ID NO: 7637154 - DNA, 19 bp, Homo sapiens
ccccagggtaggctagggg

SEQ ID NO: 7637155 - DNA, 22 bp, Homo sapiens
ccccagggactggtttcatgga

SEQ ID NO: 7637156 - DNA, 22 bp, Homo sapiens
ccccagcagactcagggcaggt

SEQ ID NO: 7637157 - DNA, 22 bp, Homo sapiens
ccccagcagactcagggcaggt

SEQ ID NO: 7637158 - DNA, 22 bp, Homo sapiens
ccccagggaagctttgcttact

SEQ ID NO: 7637159 - DNA, 22 bp, Homo sapiens
ccccagggaagctttgcttact

SEQ ID NO: 7637160 - DNA, 22 bp, Homo sapiens
ccccagcacttggagtggggag

SEQ ID NO: 7637161 - DNA, 22 bp, Homo sapiens
ccccagcagactcagggcaggt

SEQ ID NO: 7637162 - DNA, 22 bp, Homo sapiens
ccccagcagactcagggcaggt

SEQ ID NO: 7637163 - DNA, 22 bp, Homo sapiens
ccccagcagactcagggcaggt

SEQ ID NO: 7637164 - DNA, 22 bp, Homo sapiens
ccccagcagactcagggcaggt

SEQ ID NO: 7637165 - DNA, 22 bp, Homo sapiens
agggagcagggctcctttgggt

SEQ ID NO: 7637166 - DNA, 18 bp, Homo sapiens
agggagcatctggttgcc

SEQ ID NO: 7637167 - DNA, 22 bp, Homo sapiens
agggagcagggctcctttgggt

SEQ ID NO: 7637168 - DNA, 22 bp, Homo sapiens
agggagcagggctcctttgggt

SEQ ID NO: 7637169 - DNA, 18 bp, Homo sapiens
agggagcatctggttgcc

SEQ ID NO: 7637170 - DNA, 18 bp, Homo sapiens
agggagcatctggttgcc

SEQ ID NO: 7637171 - DNA, 22 bp, Homo sapiens
agggagcatgggtgaagcaggc

SEQ ID NO: 7637172 - DNA, 18 bp, Homo sapiens
agggagcatctggttgcc

SEQ ID NO: 7637173 - DNA, 22 bp, Homo sapiens
agggagcagcagccacaggatg

SEQ ID NO: 7637174 - DNA, 22 bp, Homo sapiens
agggagcacagtaagttagtct

SEQ ID NO: 7637175 - DNA, 22 bp, Homo sapiens
agggagcagcagccacaggatg

SEQ ID NO: 7637176 - DNA, 22 bp, Homo sapiens
agggagcagcagccacaggatg

SEQ ID NO: 7637177 - DNA, 22 bp, Homo sapiens
agggagcagcagccacaggatg

SEQ ID NO: 7637178 - DNA, 22 bp, Homo sapiens
agggagcagcagccacaggatg

SEQ ID NO: 7637179 - DNA, 22 bp, Homo sapiens
agggagcagcagccacaggatg

SEQ ID NO: 7637180 - DNA, 22 bp, Homo sapiens
agggagcagcagccacaggatg

SEQ ID NO: 7637181 - DNA, 22 bp, Homo sapiens
agggagcagcagccacaggatg

SEQ ID NO: 7637182 - DNA, 22 bp, Homo sapiens
agggagcagcagccacaggatg

SEQ ID NO: 7637183 - DNA, 22 bp, Homo sapiens
agggagcagcagccacaggatg

SEQ ID NO: 7637184 - DNA, 22 bp, Homo sapiens
agggagcagcagccacaggatg

SEQ ID NO: 7637185 - DNA, 22 bp, Homo sapiens
agggagcagcagccacaggatg

SEQ ID NO: 7637186 - DNA, 22 bp, Homo sapiens
agggagcagcagccacaggatg

SEQ ID NO: 7637187 - DNA, 22 bp, Homo sapiens
agggagagtttgatgtttcctc

SEQ ID NO: 7637188 - DNA, 22 bp, Homo sapiens
agggagagtagatatcaggtgt

SEQ ID NO: 7637189 - DNA, 22 bp, Homo sapiens
agggagagtagatatcaggtgt

SEQ ID NO: 7637190 - DNA, 22 bp, Homo sapiens
agggagagtagatatcaggtgt

SEQ ID NO: 7637191 - DNA, 22 bp, Homo sapiens
agggagagtttgatgtttcctc

SEQ ID NO: 7637192 - DNA, 22 bp, Homo sapiens
agggagagtttgatgtttcctc

SEQ ID NO: 7637193 - DNA, 22 bp, Homo sapiens
agggagagtagatatcaggtgt

SEQ ID NO: 7637194 - DNA, 22 bp, Homo sapiens
agggagagtttgatgtttcctc

SEQ ID NO: 7637195 - DNA, 22 bp, Homo sapiens
agggagagtttgatgtttcctc

SEQ ID NO: 7637196 - DNA, 22 bp, Homo sapiens
agggagcaaaggtttcagggtt

SEQ ID NO: 7637197 - DNA, 22 bp, Homo sapiens
agggagcaaaggtttcagggtt

SEQ ID NO: 7637198 - DNA, 22 bp, Homo sapiens
agggagcacagtaagttagtct

SEQ ID NO: 7637199 - DNA, 22 bp, Homo sapiens
agggagcacagtaagttagtct

SEQ ID NO: 7637200 - DNA, 23 bp, Homo sapiens
agggagatgccacaaagatgccc

SEQ ID NO: 7637201 - DNA, 23 bp, Homo sapiens
agggagatgccacaaagatgccc

SEQ ID NO: 7637202 - DNA, 22 bp, Homo sapiens
agggagcaaaggtttcagggtt

SEQ ID NO: 7637203 - DNA, 22 bp, Homo sapiens
agggagatcgaccgtgttatat

SEQ ID NO: 7637204 - DNA, 22 bp, Homo sapiens
agggagatcgaccgtgttatat

SEQ ID NO: 7637205 - DNA, 23 bp, Homo sapiens
agggagatgccacaaagatgccc

SEQ ID NO: 7637206 - DNA, 23 bp, Homo sapiens
agggagatgccacaaagatgccc

SEQ ID NO: 7637207 - DNA, 23 bp, Homo sapiens
agggagatgccacaaagatgccc

SEQ ID NO: 7637208 - DNA, 22 bp, Homo sapiens
agggagccaggaacgcaggtcg

SEQ ID NO: 7637209 - DNA, 22 bp, Homo sapiens
agggagccaggaacgcaggtcg

SEQ ID NO: 7637210 - DNA, 22 bp, Homo sapiens
agggagccaggggccagctatt

SEQ ID NO: 7637211 - DNA, 22 bp, Homo sapiens
agggagccaggaacgcaggtcg

SEQ ID NO: 7637212 - DNA, 22 bp, Homo sapiens
agggagccaggggccagctatt

SEQ ID NO: 7637213 - DNA, 22 bp, Homo sapiens
agggagccaggggccagctatt

SEQ ID NO: 7637214 - DNA, 22 bp, Homo sapiens
agggagccaggggccagctatt

SEQ ID NO: 7637215 - DNA, 22 bp, Homo sapiens
agggagccctgaaccagagggt

SEQ ID NO: 7637216 - DNA, 22 bp, Homo sapiens
agggagccctgaaccagagggt

SEQ ID NO: 7637217 - DNA, 22 bp, Homo sapiens
agggagccaggggccagctatt

SEQ ID NO: 7637218 - DNA, 22 bp, Homo sapiens
agggagccagagttgggagctc

SEQ ID NO: 7637219 - DNA, 22 bp, Homo sapiens
agggagccagagttgggagctc

SEQ ID NO: 7637220 - DNA, 22 bp, Homo sapiens
agggagccagagttgggagctc

SEQ ID NO: 7637221 - DNA, 22 bp, Homo sapiens
agggagccagagttgggagctc

SEQ ID NO: 7637222 - DNA, 22 bp, Homo sapiens
agggagccagagttgggagctc

SEQ ID NO: 7637223 - DNA, 22 bp, Homo sapiens
agggagccagagttgggagctc

SEQ ID NO: 7637224 - DNA, 22 bp, Homo sapiens
agggagccagagttgggagctc

SEQ ID NO: 7637225 - DNA, 22 bp, Homo sapiens
agggagccagagttgggagctc

SEQ ID NO: 7637226 - DNA, 22 bp, Homo sapiens
agggagccaggaacgcaggtcg

SEQ ID NO: 7637227 - DNA, 22 bp, Homo sapiens
agggagccagagttgggagctc

SEQ ID NO: 7637228 - DNA, 22 bp, Homo sapiens
agggagcattgtgacatatcac

SEQ ID NO: 7637229 - DNA, 22 bp, Homo sapiens
agggagcattgtgacatatcac

SEQ ID NO: 7637230 - DNA, 22 bp, Homo sapiens
agggagccagagttgggagctc

SEQ ID NO: 7637231 - DNA, 22 bp, Homo sapiens
agggagcattgtgacatatcac

SEQ ID NO: 7637232 - DNA, 21 bp, Homo sapiens
agggagcatgttagctttcga

SEQ ID NO: 7637233 - DNA, 21 bp, Homo sapiens
agggagcatgttagctttcga

SEQ ID NO: 7637234 - DNA, 21 bp, Homo sapiens
agggagcatgttagctttcga

SEQ ID NO: 7637235 - DNA, 22 bp, Homo sapiens
agggagcatgggtgaagcaggc

SEQ ID NO: 7637236 - DNA, 21 bp, Homo sapiens
agggagcatgttagctttcga

SEQ ID NO: 7637237 - DNA, 22 bp, Homo sapiens
agggagcatgggtgaagcaggc

SEQ ID NO: 7637238 - DNA, 22 bp, Homo sapiens
agggagcatgggtgaagcaggc

SEQ ID NO: 7637239 - DNA, 22 bp, Homo sapiens
agggagcatgggtgaagcaggc

SEQ ID NO: 7637240 - DNA, 22 bp, Homo sapiens
agggagcatgggtgaagcaggc

SEQ ID NO: 7637241 - DNA, 22 bp, Homo sapiens
agggagcatgggtgaagcaggc

SEQ ID NO: 7637242 - DNA, 22 bp, Homo sapiens
agggagcatgggtgaagcaggc

SEQ ID NO: 7637243 - DNA, 22 bp, Homo sapiens
agggagcatgggtgaagcaggc

SEQ ID NO: 7637244 - DNA, 22 bp, Homo sapiens
agggagcatgggtgaagcaggc

SEQ ID NO: 7637245 - DNA, 22 bp, Homo sapiens
agggagcatgggtgaagcaggc

SEQ ID NO: 7637246 - DNA, 22 bp, Homo sapiens
agggagcatgggtgaagcaggc

SEQ ID NO: 7637247 - DNA, 22 bp, Homo sapiens
agggagcatgggtgaagcaggc

SEQ ID NO: 7637248 - DNA, 22 bp, Homo sapiens
agggagcatgggtgaagcaggc

SEQ ID NO: 7637249 - DNA, 22 bp, Homo sapiens
agggagcatgggtgaagcaggc

SEQ ID NO: 7637250 - DNA, 22 bp, Homo sapiens
agggagcatgggtgaagcaggc

SEQ ID NO: 7637251 - DNA, 22 bp, Homo sapiens
agggagcatgggtgaagcaggc

SEQ ID NO: 7637252 - DNA, 22 bp, Homo sapiens
agggagcatgggtgaagcaggc

SEQ ID NO: 7637253 - DNA, 22 bp, Homo sapiens
ccatgaccatacctgggcctga

SEQ ID NO: 7637254 - DNA, 22 bp, Homo sapiens
ccatgagaagttagactagcca

SEQ ID NO: 7637255 - DNA, 22 bp, Homo sapiens
ccatgagaagttagactagcca

SEQ ID NO: 7637256 - DNA, 22 bp, Homo sapiens
ccatgagccagctctaagcaaa

SEQ ID NO: 7637257 - DNA, 22 bp, Homo sapiens
ccatgagcttcaactgacacag

SEQ ID NO: 7637258 - DNA, 22 bp, Homo sapiens
ccatgagccagctctaagcaaa

SEQ ID NO: 7637259 - DNA, 22 bp, Homo sapiens
ccatgagccaggctgaggaagc

SEQ ID NO: 7637260 - DNA, 22 bp, Homo sapiens
ccatgcaacagaatccagattt

SEQ ID NO: 7637261 - DNA, 22 bp, Homo sapiens
ccatgcaacagaatccagattt

SEQ ID NO: 7637262 - DNA, 22 bp, Homo sapiens
ccatgcaaagaatgtgggcata

SEQ ID NO: 7637263 - DNA, 22 bp, Homo sapiens
ccatgattggaatgtcttttca

SEQ ID NO: 7637264 - DNA, 22 bp, Homo sapiens
ccatgattggaatgtcttttca

SEQ ID NO: 7637265 - DNA, 22 bp, Homo sapiens
ccatgatttcccctgctgcaca

SEQ ID NO: 7637266 - DNA, 22 bp, Homo sapiens
ccatgatttgagctacttactg

SEQ ID NO: 7637267 - DNA, 22 bp, Homo sapiens
ccatgatttgagctacttactg

SEQ ID NO: 7637268 - DNA, 22 bp, Homo sapiens
ccatgagtagcgatttcatttt

SEQ ID NO: 7637269 - DNA, 22 bp, Homo sapiens
ccatgagccaggctgaggaagc

SEQ ID NO: 7637270 - DNA, 22 bp, Homo sapiens
ccatgagcttcctatatagggt

SEQ ID NO: 7637271 - DNA, 22 bp, Homo sapiens
ccatgagtagcgatttcatttt

SEQ ID NO: 7637272 - DNA, 22 bp, Homo sapiens
ccatgattcctctaagacctct

SEQ ID NO: 7637273 - DNA, 22 bp, Homo sapiens
ccatctccagtttattcttcct

SEQ ID NO: 7637274 - DNA, 22 bp, Homo sapiens
ccatctccagtttattcttcct

SEQ ID NO: 7637275 - DNA, 22 bp, Homo sapiens
ccatctccagtttattcttcct

SEQ ID NO: 7637276 - DNA, 22 bp, Homo sapiens
ccatctgtatctgacaaattct

SEQ ID NO: 7637277 - DNA, 22 bp, Homo sapiens
ccatctggatctgtccactgac

SEQ ID NO: 7637278 - DNA, 22 bp, Homo sapiens
ccatctggagcatttgacctgg

SEQ ID NO: 7637279 - DNA, 22 bp, Homo sapiens
ccatctgactgccacccaggcc

SEQ ID NO: 7637280 - DNA, 22 bp, Homo sapiens
ccatctgtctcctcctcgaatt

SEQ ID NO: 7637281 - DNA, 21 bp, Homo sapiens
ccatctgtgctcatatttgct

SEQ ID NO: 7637282 - DNA, 22 bp, Homo sapiens
ccatcttaattctaaagacaaa

SEQ ID NO: 7637283 - DNA, 22 bp, Homo sapiens
ccatctgtctcctcctcgaatt

SEQ ID NO: 7637284 - DNA, 22 bp, Homo sapiens
ccatctgtatctgacaaattct

SEQ ID NO: 7637285 - DNA, 22 bp, Homo sapiens
ccatgaattcactccatgctag

SEQ ID NO: 7637286 - DNA, 22 bp, Homo sapiens
ccatgaattcactccatgctag

SEQ ID NO: 7637287 - DNA, 22 bp, Homo sapiens
ccatcttgggtcactgcccccc

SEQ ID NO: 7637288 - DNA, 22 bp, Homo sapiens
ccatcttgggtcactgcccccc

SEQ ID NO: 7637289 - DNA, 22 bp, Homo sapiens
ccatgaattcactccatgctag

SEQ ID NO: 7637290 - DNA, 21 bp, Homo sapiens
ccataaacagatggtaactgt

SEQ ID NO: 7637291 - DNA, 22 bp, Homo sapiens
ccagtttttccagtgctttctg

SEQ ID NO: 7637292 - DNA, 22 bp, Homo sapiens
ccataaagtaggaaacactaca

SEQ ID NO: 7637293 - DNA, 22 bp, Homo sapiens
ccataaagtaggaaacactaca

SEQ ID NO: 7637294 - DNA, 22 bp, Homo sapiens
ccataaagtaggaaacactaca

SEQ ID NO: 7637295 - DNA, 22 bp, Homo sapiens
ccagtttttccagtgctttctg

SEQ ID NO: 7637296 - DNA, 22 bp, Homo sapiens
ccagttttgccatggtaacact

SEQ ID NO: 7637297 - DNA, 22 bp, Homo sapiens
ccagttttgccatggtaacact

SEQ ID NO: 7637298 - DNA, 22 bp, Homo sapiens
ccataatattaaatgcttttgt

SEQ ID NO: 7637299 - DNA, 22 bp, Homo sapiens
ccataaggagccagacattcca

SEQ ID NO: 7637300 - DNA, 22 bp, Homo sapiens
ccataaggagccagacattcca

SEQ ID NO: 7637301 - DNA, 22 bp, Homo sapiens
ccataatcatgtaagtaaattc

SEQ ID NO: 7637302 - DNA, 22 bp, Homo sapiens
ccataatcgtgtgttaaataat

SEQ ID NO: 7637303 - DNA, 22 bp, Homo sapiens
ccataatcgtgtgttaaataat

SEQ ID NO: 7637304 - DNA, 22 bp, Homo sapiens
ccataatctggctttgagagag

SEQ ID NO: 7637305 - DNA, 22 bp, Homo sapiens
ccatctccaaataccatcacat

SEQ ID NO: 7637306 - DNA, 22 bp, Homo sapiens
ccatctccactgtccctgtcaa

SEQ ID NO: 7637307 - DNA, 22 bp, Homo sapiens
ccatctccactgtccctgtcaa

SEQ ID NO: 7637308 - DNA, 22 bp, Homo sapiens
ccatctccactgtccctgtcaa

SEQ ID NO: 7637309 - DNA, 22 bp, Homo sapiens
ccatctccactgtccctgtcaa

SEQ ID NO: 7637310 - DNA, 22 bp, Homo sapiens
ccatctcactcatgtttctaga

SEQ ID NO: 7637311 - DNA, 22 bp, Homo sapiens
ccatctactgacttagcctcat

SEQ ID NO: 7637312 - DNA, 22 bp, Homo sapiens
ccatctccaaataccatcacat

SEQ ID NO: 7637313 - DNA, 22 bp, Homo sapiens
ccatctccaaataccatcacat

SEQ ID NO: 7637314 - DNA, 22 bp, Homo sapiens
ccatcctgtctgtggcctcagg

SEQ ID NO: 7637315 - DNA, 22 bp, Homo sapiens
ccatcgcttcaaatctcagact

SEQ ID NO: 7637316 - DNA, 21 bp, Homo sapiens
ccataatcttaggatcaaaat

SEQ ID NO: 7637317 - DNA, 21 bp, Homo sapiens
ccataattttgtttcagaagt

SEQ ID NO: 7637318 - DNA, 22 bp, Homo sapiens
ccataattgggtagccatctga

SEQ ID NO: 7637319 - DNA, 22 bp, Homo sapiens
ccatcctgtctgtggcctcagg

SEQ ID NO: 7637320 - DNA, 22 bp, Homo sapiens
ccataatcatgtaagtaaattc

SEQ ID NO: 7637321 - DNA, 22 bp, Homo sapiens
ccatcctgtctgtggcctcagg

SEQ ID NO: 7637322 - DNA, 21 bp, Homo sapiens
ccataattttgtttcagaagt

SEQ ID NO: 7637323 - DNA, 21 bp, Homo sapiens
ccataattttgtttcagaagt

SEQ ID NO: 7637324 - DNA, 22 bp, Homo sapiens
cccagcacaggcaattccatac

SEQ ID NO: 7637325 - DNA, 22 bp, Homo sapiens
cccagcactcagcaggctcata

SEQ ID NO: 7637326 - DNA, 22 bp, Homo sapiens
cccagcactcagcaggctcata

SEQ ID NO: 7637327 - DNA, 22 bp, Homo sapiens
cccagcactcagcaggctcata

SEQ ID NO: 7637328 - DNA, 22 bp, Homo sapiens
cccagcacaggcaattccatac

SEQ ID NO: 7637329 - DNA, 22 bp, Homo sapiens
cccagcaaggccagctcagggc

SEQ ID NO: 7637330 - DNA, 22 bp, Homo sapiens
cccagcaaggccagctcagggc

SEQ ID NO: 7637331 - DNA, 22 bp, Homo sapiens
ccatgcaatatatatcctcaag

SEQ ID NO: 7637332 - DNA, 22 bp, Homo sapiens
ccatgcaatttctgtaaaacca

SEQ ID NO: 7637333 - DNA, 22 bp, Homo sapiens
ccatgcaagggtctggtcctgc

SEQ ID NO: 7637334 - DNA, 22 bp, Homo sapiens
ccatgcaaggagaactctcact

SEQ ID NO: 7637335 - DNA, 22 bp, Homo sapiens
ccatgcaagaagtccaaccatc

SEQ ID NO: 7637336 - DNA, 22 bp, Homo sapiens
cccagcagtacccaagcccttg

SEQ ID NO: 7637337 - DNA, 22 bp, Homo sapiens
cccagcagtacccaagcccttg

SEQ ID NO: 7637338 - DNA, 22 bp, Homo sapiens
cccagcagtacccaagcccttg

SEQ ID NO: 7637339 - DNA, 22 bp, Homo sapiens
cccagcagtacccaagcccttg

SEQ ID NO: 7637340 - DNA, 22 bp, Homo sapiens
cccagcagtacccaagcccttg

SEQ ID NO: 7637341 - DNA, 22 bp, Homo sapiens
cccagcagtacccaagcccttg

SEQ ID NO: 7637342 - DNA, 22 bp, Homo sapiens
cccagcagtaaccagtggaaat

SEQ ID NO: 7637343 - DNA, 22 bp, Homo sapiens
cccagcactcagcaggctcata

SEQ ID NO: 7637344 - DNA, 22 bp, Homo sapiens
cccagcagtaaccagtggaaat

SEQ ID NO: 7637345 - DNA, 22 bp, Homo sapiens
cccagcactcagcaggctcata

SEQ ID NO: 7637346 - DNA, 22 bp, Homo sapiens
cccagcagtgacccagtgatac

SEQ ID NO: 7637347 - DNA, 22 bp, Homo sapiens
cccagcagtgacccagtgatac

SEQ ID NO: 7637348 - DNA, 22 bp, Homo sapiens
cccagcagtgacccagtgatac

SEQ ID NO: 7637349 - DNA, 22 bp, Homo sapiens
cccagcagtggttctcaaactt

SEQ ID NO: 7637350 - DNA, 22 bp, Homo sapiens
cccagcagtgacccagtgatac

SEQ ID NO: 7637351 - DNA, 22 bp, Homo sapiens
cccagcagtgacccagtgatac

SEQ ID NO: 7637352 - DNA, 22 bp, Homo sapiens
cccagcagtgacccagtgatac

SEQ ID NO: 7637353 - DNA, 22 bp, Homo sapiens
cccagcagtagagctcatatgg

SEQ ID NO: 7637354 - DNA, 22 bp, Homo sapiens
cccagcagtgacccagtgatac

SEQ ID NO: 7637355 - DNA, 22 bp, Homo sapiens
cccagcagtgacccagtgatac

SEQ ID NO: 7637356 - DNA, 22 bp, Homo sapiens
cccagcagtgacccagtgatac

SEQ ID NO: 7637357 - DNA, 22 bp, Homo sapiens
cccagcagtacccaagcccttg

SEQ ID NO: 7637358 - DNA, 22 bp, Homo sapiens
cccagcagtacccaagcccttg

SEQ ID NO: 7637359 - DNA, 22 bp, Homo sapiens
cccagcagtagagctcatatgg

SEQ ID NO: 7637360 - DNA, 22 bp, Homo sapiens
cccagcagttgttggtgcacat

SEQ ID NO: 7637361 - DNA, 22 bp, Homo sapiens
cccagcagttgttggtgcacat

SEQ ID NO: 7637362 - DNA, 22 bp, Homo sapiens
cccagcagtttgcttagagtga

SEQ ID NO: 7637363 - DNA, 22 bp, Homo sapiens
cccagcagttgttggtgcacat

SEQ ID NO: 7637364 - DNA, 22 bp, Homo sapiens
cccagcagtttgcttagagtga

SEQ ID NO: 7637365 - DNA, 22 bp, Homo sapiens
cccagcagtttgcttagagtga

SEQ ID NO: 7637366 - DNA, 22 bp, Homo sapiens
cccagcagttgttggtgcacat

SEQ ID NO: 7637367 - DNA, 22 bp, Homo sapiens
cccagcagttgttggtgcacat

SEQ ID NO: 7637368 - DNA, 22 bp, Homo sapiens
cccagcagttgttggtgcacat

SEQ ID NO: 7637369 - DNA, 22 bp, Homo sapiens
cccagcagttgttggtgcacat

SEQ ID NO: 7637370 - DNA, 22 bp, Homo sapiens
cccagcagttgttggtgcacat

SEQ ID NO: 7637371 - DNA, 22 bp, Homo sapiens
cccagcagtggttctcaaactt

SEQ ID NO: 7637372 - DNA, 22 bp, Homo sapiens
cccagcagtggttctcaaactt

SEQ ID NO: 7637373 - DNA, 22 bp, Homo sapiens
cccagcagtggttctcaaactt

SEQ ID NO: 7637374 - DNA, 22 bp, Homo sapiens
cccagcagtggttctcaaactt

SEQ ID NO: 7637375 - DNA, 22 bp, Homo sapiens
cccagcagtggttctcaaactt

SEQ ID NO: 7637376 - DNA, 22 bp, Homo sapiens
cccagcagtggttctcaaactt

SEQ ID NO: 7637377 - DNA, 22 bp, Homo sapiens
cccagcctcagctttacttcca

SEQ ID NO: 7637378 - DNA, 22 bp, Homo sapiens
cccagcatctccaggcatggcc

SEQ ID NO: 7637379 - DNA, 22 bp, Homo sapiens
cccagcatctccaggcatggcc

SEQ ID NO: 7637380 - DNA, 22 bp, Homo sapiens
cccagcctcagctttacttcca

SEQ ID NO: 7637381 - DNA, 22 bp, Homo sapiens
cccagcctcagctttacttcca

SEQ ID NO: 7637382 - DNA, 22 bp, Homo sapiens
cccagcatcctcagggagcggg

SEQ ID NO: 7637383 - DNA, 22 bp, Homo sapiens
cccagcatcctcagggagcggg

SEQ ID NO: 7637384 - DNA, 22 bp, Homo sapiens
cccagcatcccagtgggcagca

SEQ ID NO: 7637385 - DNA, 22 bp, Homo sapiens
cccagcatcccagtgggcagca

SEQ ID NO: 7637386 - DNA, 22 bp, Homo sapiens
cccagcatcccagtgggcagca

SEQ ID NO: 7637387 - DNA, 22 bp, Homo sapiens
cccagcagtttgcttagagtga

SEQ ID NO: 7637388 - DNA, 22 bp, Homo sapiens
cccagcatcccagtgggcagca

SEQ ID NO: 7637389 - DNA, 22 bp, Homo sapiens
cccagcatcccagtgggcagca

SEQ ID NO: 7637390 - DNA, 22 bp, Homo sapiens
cccagcatcccagtgggcagca

SEQ ID NO: 7637391 - DNA, 22 bp, Homo sapiens
cccagcatcccagtgggcagca

SEQ ID NO: 7637392 - DNA, 22 bp, Homo sapiens
cccagcatcctcagggagcggg

SEQ ID NO: 7637393 - DNA, 22 bp, Homo sapiens
cccagcatcctcagggagcggg

SEQ ID NO: 7637394 - DNA, 22 bp, Homo sapiens
cccagctctctgctcttagcct

SEQ ID NO: 7637395 - DNA, 19 bp, Homo sapiens
cccagctctcgtggtgtgc

SEQ ID NO: 7637396 - DNA, 22 bp, Homo sapiens
cccagctctctgctcttagcct

SEQ ID NO: 7637397 - DNA, 22 bp, Homo sapiens
cccagctctctcagttctgctt

SEQ ID NO: 7637398 - DNA, 22 bp, Homo sapiens
cccagctctctcagttctgctt

SEQ ID NO: 7637399 - DNA, 22 bp, Homo sapiens
cccagctctctcagttctgctt

SEQ ID NO: 7637400 - DNA, 22 bp, Homo sapiens
cccagctctctgctcttagcct

SEQ ID NO: 7637401 - DNA, 22 bp, Homo sapiens
cccagctctctgctcttagcct

SEQ ID NO: 7637402 - DNA, 22 bp, Homo sapiens
cccagctctctgctcttagcct

SEQ ID NO: 7637403 - DNA, 22 bp, Homo sapiens
cccagctctctgctcttagcct

SEQ ID NO: 7637404 - DNA, 22 bp, Homo sapiens
cccagctctcgcacttactagc

SEQ ID NO: 7637405 - DNA, 22 bp, Homo sapiens
cccagctctcgcacttactagc

SEQ ID NO: 7637406 - DNA, 22 bp, Homo sapiens
cccagctctcgcacttactagc

SEQ ID NO: 7637407 - DNA, 22 bp, Homo sapiens
cccagctctaggagtggtggca

SEQ ID NO: 7637408 - DNA, 22 bp, Homo sapiens
cccagctctctcagttctgctt

SEQ ID NO: 7637409 - DNA, 19 bp, Homo sapiens
cccagctctcgtggtgtgc

SEQ ID NO: 7637410 - DNA, 19 bp, Homo sapiens
cccagctctcgtggtgtgc

SEQ ID NO: 7637411 - DNA, 22 bp, Homo sapiens
cccagctctcgcacttactagc

SEQ ID NO: 7637412 - DNA, 22 bp, Homo sapiens
cccagctctcgcacttactagc

SEQ ID NO: 7637413 - DNA, 19 bp, Homo sapiens
cccagctctcgtggtgtgc

SEQ ID NO: 7637414 - DNA, 19 bp, Homo sapiens
cccagctctcgtggtgtgc

SEQ ID NO: 7637415 - DNA, 22 bp, Homo sapiens
cccagctctcgcacttactagc

SEQ ID NO: 7637416 - DNA, 22 bp, Homo sapiens
cccagctctgccatctacccac

SEQ ID NO: 7637417 - DNA, 22 bp, Homo sapiens
cccagctctgccatctacccac

SEQ ID NO: 7637418 - DNA, 22 bp, Homo sapiens
cccagctctgccatctacccac

SEQ ID NO: 7637419 - DNA, 22 bp, Homo sapiens
cccagctctgccatctacccac

SEQ ID NO: 7637420 - DNA, 22 bp, Homo sapiens
cccagctctgcagacctgccct

SEQ ID NO: 7637421 - DNA, 22 bp, Homo sapiens
cccagctctgcagacctgccct

SEQ ID NO: 7637422 - DNA, 22 bp, Homo sapiens
cccagctctgcagacctgccct

SEQ ID NO: 7637423 - DNA, 22 bp, Homo sapiens
cccagctctgcagacctgccct

SEQ ID NO: 7637424 - DNA, 22 bp, Homo sapiens
cccagctctgcagacctgccct

SEQ ID NO: 7637425 - DNA, 22 bp, Homo sapiens
cccagctctctgctcttagcct

SEQ ID NO: 7637426 - DNA, 22 bp, Homo sapiens
cccagctctgcagacctgccct

SEQ ID NO: 7637427 - DNA, 22 bp, Homo sapiens
aggctgtggtgggctttgagcc

SEQ ID NO: 7637428 - DNA, 22 bp, Homo sapiens
cccagctctggaaggtggggga

SEQ ID NO: 7637429 - DNA, 22 bp, Homo sapiens
cccagctctggaaggtggggga

SEQ ID NO: 7637430 - DNA, 22 bp, Homo sapiens
cccagctctgccatctacccac

SEQ ID NO: 7637431 - DNA, 22 bp, Homo sapiens
cccagctctggaaggtggggga

SEQ ID NO: 7637432 - DNA, 22 bp, Homo sapiens
cccagctctggaaggtggggga

SEQ ID NO: 7637433 - DNA, 22 bp, Homo sapiens
cccagctctgccatctacccac

SEQ ID NO: 7637434 - DNA, 22 bp, Homo sapiens
cccagctctgccatctacccac

SEQ ID NO: 7637435 - DNA, 22 bp, Homo sapiens
cccagctctgccatctacccac

SEQ ID NO: 7637436 - DNA, 22 bp, Homo sapiens
cccagctctgccatctacccac

SEQ ID NO: 7637437 - DNA, 22 bp, Homo sapiens
aggctgtgtttcccctggagct

SEQ ID NO: 7637438 - DNA, 22 bp, Homo sapiens
aggctgtgtttcccctggagct

SEQ ID NO: 7637439 - DNA, 22 bp, Homo sapiens
aggctgtgtttcccctggagct

SEQ ID NO: 7637440 - DNA, 22 bp, Homo sapiens
aggctgtgtttcccctggagct

SEQ ID NO: 7637441 - DNA, 22 bp, Homo sapiens
aggctgttctaggagagtggga

SEQ ID NO: 7637442 - DNA, 22 bp, Homo sapiens
aggctgttctaggagagtggga

SEQ ID NO: 7637443 - DNA, 22 bp, Homo sapiens
aggctgttctaggagagtggga

SEQ ID NO: 7637444 - DNA, 22 bp, Homo sapiens
aggctgtgtttcttgcgttttc

SEQ ID NO: 7637445 - DNA, 22 bp, Homo sapiens
aggctgttttgtataaactgga

SEQ ID NO: 7637446 - DNA, 22 bp, Homo sapiens
aggctgttttgtataaactgga

SEQ ID NO: 7637447 - DNA, 22 bp, Homo sapiens
aggctgttgcatgccacagata

SEQ ID NO: 7637448 - DNA, 22 bp, Homo sapiens
aggctgttgcatgccacagata

SEQ ID NO: 7637449 - DNA, 22 bp, Homo sapiens
aggctgttgagccccagcaagt

SEQ ID NO: 7637450 - DNA, 22 bp, Homo sapiens
aggcttaaatgctcatatcagt

SEQ ID NO: 7637451 - DNA, 19 bp, Homo sapiens
aggctgtttgttaataaag

SEQ ID NO: 7637452 - DNA, 22 bp, Homo sapiens
aggcttaatgagttaaatcact

SEQ ID NO: 7637453 - DNA, 22 bp, Homo sapiens
aggctgtgtggataatattggg

SEQ ID NO: 7637454 - DNA, 22 bp, Homo sapiens
aggctgtgtcctcattttatat

SEQ ID NO: 7637455 - DNA, 22 bp, Homo sapiens
aggctgtgtggtcatggtggct

SEQ ID NO: 7637456 - DNA, 22 bp, Homo sapiens
aggctgtgtggtcatggtggct

SEQ ID NO: 7637457 - DNA, 22 bp, Homo sapiens
aggctgtgtggatgagtcttac

SEQ ID NO: 7637458 - DNA, 22 bp, Homo sapiens
aggctgtgtggtcatggtggct

SEQ ID NO: 7637459 - DNA, 22 bp, Homo sapiens
aggctgtgttctggttcttagc

SEQ ID NO: 7637460 - DNA, 22 bp, Homo sapiens
aggctgtgttctggttcttagc

SEQ ID NO: 7637461 - DNA, 22 bp, Homo sapiens
aggctgtgtggtcatggtggct

SEQ ID NO: 7637462 - DNA, 22 bp, Homo sapiens
aggctgtgtttcccctggagct

SEQ ID NO: 7637463 - DNA, 22 bp, Homo sapiens
aggctgtgtttaagtggtaatg

SEQ ID NO: 7637464 - DNA, 22 bp, Homo sapiens
aggctgtgtttaagtggtaatg

SEQ ID NO: 7637465 - DNA, 22 bp, Homo sapiens
aggctgtgtttaagtggtaatg

SEQ ID NO: 7637466 - DNA, 22 bp, Homo sapiens
cccagcctgatctcggccagct

SEQ ID NO: 7637467 - DNA, 22 bp, Homo sapiens
cccagcctctgtttgctcctct

SEQ ID NO: 7637468 - DNA, 22 bp, Homo sapiens
cccagcctctgtttgctcctct

SEQ ID NO: 7637469 - DNA, 22 bp, Homo sapiens
cccagcctctgtttgctcctct

SEQ ID NO: 7637470 - DNA, 22 bp, Homo sapiens
cccagcctgatctcggccagct

SEQ ID NO: 7637471 - DNA, 22 bp, Homo sapiens
cccagcctgatctcggccagct

SEQ ID NO: 7637472 - DNA, 22 bp, Homo sapiens
cccagcctgatctcggccagct

SEQ ID NO: 7637473 - DNA, 22 bp, Homo sapiens
cccagcctgatctcggccagct

SEQ ID NO: 7637474 - DNA, 22 bp, Homo sapiens
cccagcctgatctcggccagct

SEQ ID NO: 7637475 - DNA, 22 bp, Homo sapiens
cccagcctgatctcggccagct

SEQ ID NO: 7637476 - DNA, 22 bp, Homo sapiens
cccagcctgatctcggccagct

SEQ ID NO: 7637477 - DNA, 22 bp, Homo sapiens
cccagcctggtgcactgtgggg

SEQ ID NO: 7637478 - DNA, 22 bp, Homo sapiens
cccagcctggtgcactgtgggg

SEQ ID NO: 7637479 - DNA, 22 bp, Homo sapiens
cccagcctggtgcactgtgggg

SEQ ID NO: 7637480 - DNA, 22 bp, Homo sapiens
cccagcctggtgcactgtgggg

SEQ ID NO: 7637481 - DNA, 22 bp, Homo sapiens
cccagcctggtgcactgtgggg

SEQ ID NO: 7637482 - DNA, 22 bp, Homo sapiens
cccagcctggtgcactgtgggg

SEQ ID NO: 7637483 - DNA, 22 bp, Homo sapiens
cccagcctggtgcactgtgggg

SEQ ID NO: 7637484 - DNA, 22 bp, Homo sapiens
cccagcctgatctcggccagct

SEQ ID NO: 7637485 - DNA, 22 bp, Homo sapiens
cccagcctgatctcggccagct

SEQ ID NO: 7637486 - DNA, 22 bp, Homo sapiens
cccagcctgatctcggccagct

SEQ ID NO: 7637487 - DNA, 22 bp, Homo sapiens
cccagctccttacagggccgaa

SEQ ID NO: 7637488 - DNA, 22 bp, Homo sapiens
cccagctccttggatgggcagg

SEQ ID NO: 7637489 - DNA, 22 bp, Homo sapiens
cccagctccttggatgggcagg

SEQ ID NO: 7637490 - DNA, 22 bp, Homo sapiens
cccagctccttggatgggcagg

SEQ ID NO: 7637491 - DNA, 22 bp, Homo sapiens
cccagctccttggatgggcagg

SEQ ID NO: 7637492 - DNA, 22 bp, Homo sapiens
cccagctccttggatgggcagg

SEQ ID NO: 7637493 - DNA, 22 bp, Homo sapiens
cccagctcgccgccgatgtgcg

SEQ ID NO: 7637494 - DNA, 22 bp, Homo sapiens
cccagctctaggagtggtggca

SEQ ID NO: 7637495 - DNA, 22 bp, Homo sapiens
cccagctctaggagtggtggca

SEQ ID NO: 7637496 - DNA, 22 bp, Homo sapiens
cccagctctaggagtggtggca

SEQ ID NO: 7637497 - DNA, 22 bp, Homo sapiens
cccagctctaggagtggtggca

SEQ ID NO: 7637498 - DNA, 22 bp, Homo sapiens
cccagctcgccgccgatgtgcg

SEQ ID NO: 7637499 - DNA, 22 bp, Homo sapiens
cccagctcgccgccgatgtgcg

SEQ ID NO: 7637500 - DNA, 22 bp, Homo sapiens
cccagctcgccgccgatgtgcg

SEQ ID NO: 7637501 - DNA, 22 bp, Homo sapiens
cccagctccttgtttgcatctc

SEQ ID NO: 7637502 - DNA, 22 bp, Homo sapiens
cccagctccttgtttgcatctc

SEQ ID NO: 7637503 - DNA, 22 bp, Homo sapiens
cccagctccttgtttgcatctc

SEQ ID NO: 7637504 - DNA, 22 bp, Homo sapiens
cccagctccttgtttgcatctc

SEQ ID NO: 7637505 - DNA, 18 bp, Homo sapiens
cccagcctctcctttcta

SEQ ID NO: 7637506 - DNA, 18 bp, Homo sapiens
cccagcctctcctttcta

SEQ ID NO: 7637507 - DNA, 18 bp, Homo sapiens
cccagcctctcctttcta

SEQ ID NO: 7637508 - DNA, 18 bp, Homo sapiens
cccagcctctcctttcta

SEQ ID NO: 7637509 - DNA, 22 bp, Homo sapiens
cccagcctctggattctgccct

SEQ ID NO: 7637510 - DNA, 22 bp, Homo sapiens
cccagcctctggattctgccct

SEQ ID NO: 7637511 - DNA, 22 bp, Homo sapiens
cccagcctctggattctgccct

SEQ ID NO: 7637512 - DNA, 22 bp, Homo sapiens
cccagcctctggattctgccct

SEQ ID NO: 7637513 - DNA, 18 bp, Homo sapiens
cccagcctctcctttcta

SEQ ID NO: 7637514 - DNA, 18 bp, Homo sapiens
cccagcctctcctttcta

SEQ ID NO: 7637515 - DNA, 22 bp, Homo sapiens
cccagcctctgggctcacccaa

SEQ ID NO: 7637516 - DNA, 22 bp, Homo sapiens
cccagcctctggattctgccct

SEQ ID NO: 7637517 - DNA, 22 bp, Homo sapiens
cccagcctctggattctgccct

SEQ ID NO: 7637518 - DNA, 22 bp, Homo sapiens
cccagcctctgggctcacccaa

SEQ ID NO: 7637519 - DNA, 22 bp, Homo sapiens
cccagcctctgggctcacccaa

SEQ ID NO: 7637520 - DNA, 22 bp, Homo sapiens
cccagcctctgggctcacccaa

SEQ ID NO: 7637521 - DNA, 22 bp, Homo sapiens
cccagcctctgtttgctcctct

SEQ ID NO: 7637522 - DNA, 22 bp, Homo sapiens
cccagcctctgtttgctcctct

SEQ ID NO: 7637523 - DNA, 22 bp, Homo sapiens
cccagcctctgtttgctcctct

SEQ ID NO: 7637524 - DNA, 22 bp, Homo sapiens
cccagcctctgtttgctcctct

SEQ ID NO: 7637525 - DNA, 22 bp, Homo sapiens
cccagcctctgtttgctcctct

SEQ ID NO: 7637526 - DNA, 22 bp, Homo sapiens
cccagcctctgtttgctcctct

SEQ ID NO: 7637527 - DNA, 22 bp, Homo sapiens
cccagcctctgtttgctcctct

SEQ ID NO: 7637528 - DNA, 22 bp, Homo sapiens
cccagcctctgtttgctcctct

SEQ ID NO: 7637529 - DNA, 22 bp, Homo sapiens
cccagcctctgtttgctcctct

SEQ ID NO: 7637530 - DNA, 22 bp, Homo sapiens
cccagcctctgggttctgccgg

SEQ ID NO: 7637531 - DNA, 22 bp, Homo sapiens
cccagcctctgggttctgccgg

SEQ ID NO: 7637532 - DNA, 22 bp, Homo sapiens
cccagcctctgggttctgccgg

SEQ ID NO: 7637533 - DNA, 22 bp, Homo sapiens
cccagcctctgggttctgccgg

SEQ ID NO: 7637534 - DNA, 22 bp, Homo sapiens
cccagcctctgggttctgccgg

SEQ ID NO: 7637535 - DNA, 22 bp, Homo sapiens
cccagcctctgggttctgccgg

SEQ ID NO: 7637536 - DNA, 22 bp, Homo sapiens
cccagcctctgggctcacccaa

SEQ ID NO: 7637537 - DNA, 22 bp, Homo sapiens
cccagcctctgggctcacccaa

SEQ ID NO: 7637538 - DNA, 22 bp, Homo sapiens
agggaggagaatggactccttc

SEQ ID NO: 7637539 - DNA, 22 bp, Homo sapiens
agggaggagaatggactccttc

SEQ ID NO: 7637540 - DNA, 22 bp, Homo sapiens
agggaggagaatggactccttc

SEQ ID NO: 7637541 - DNA, 22 bp, Homo sapiens
agggaggagaatggactccttc

SEQ ID NO: 7637542 - DNA, 22 bp, Homo sapiens
agggaggagaatggactccttc

SEQ ID NO: 7637543 - DNA, 22 bp, Homo sapiens
agggaggagtcctcaaagtcat

SEQ ID NO: 7637544 - DNA, 22 bp, Homo sapiens
agggaggagaatggactccttc

SEQ ID NO: 7637545 - DNA, 22 bp, Homo sapiens
agggaggagaatggactccttc

SEQ ID NO: 7637546 - DNA, 22 bp, Homo sapiens
agggaggagaatggactccttc

SEQ ID NO: 7637547 - DNA, 22 bp, Homo sapiens
agggaggagaatggactccttc

SEQ ID NO: 7637548 - DNA, 22 bp, Homo sapiens
agggaggagaatggactccttc

SEQ ID NO: 7637549 - DNA, 22 bp, Homo sapiens
agggaggagtcctcaaagtcat

SEQ ID NO: 7637550 - DNA, 22 bp, Homo sapiens
agggaggagtcctcaaagtcat

SEQ ID NO: 7637551 - DNA, 22 bp, Homo sapiens
agggaggagtcctcaaagtcat

SEQ ID NO: 7637552 - DNA, 22 bp, Homo sapiens
agggaggagtcctcaaagtcat

SEQ ID NO: 7637553 - DNA, 22 bp, Homo sapiens
agggaggagtcctcaaagtcat

SEQ ID NO: 7637554 - DNA, 22 bp, Homo sapiens
agggcagagggtgcctcacctg

SEQ ID NO: 7637555 - DNA, 22 bp, Homo sapiens
agggcagagggtgcctcacctg

SEQ ID NO: 7637556 - DNA, 22 bp, Homo sapiens
agggcagagggtgcctcacctg

SEQ ID NO: 7637557 - DNA, 22 bp, Homo sapiens
agggcagagggtgcctcacctg

SEQ ID NO: 7637558 - DNA, 22 bp, Homo sapiens
agggcagagggtgcctcacctg

SEQ ID NO: 7637559 - DNA, 22 bp, Homo sapiens
agggaggaccaatgtgtggtta

SEQ ID NO: 7637560 - DNA, 22 bp, Homo sapiens
agggaggaccaatgtgtggtta

SEQ ID NO: 7637561 - DNA, 22 bp, Homo sapiens
agggaggaccaatgtgtggtta

SEQ ID NO: 7637562 - DNA, 22 bp, Homo sapiens
agggaggaccaatgtgtggtta

SEQ ID NO: 7637563 - DNA, 22 bp, Homo sapiens
agggaggagaatggactccttc

SEQ ID NO: 7637564 - DNA, 22 bp, Homo sapiens
agggaggagaatggactccttc

SEQ ID NO: 7637565 - DNA, 22 bp, Homo sapiens
agggaggagaatggactccttc

SEQ ID NO: 7637566 - DNA, 22 bp, Homo sapiens
agggaggaccaatgtgtggtta

SEQ ID NO: 7637567 - DNA, 22 bp, Homo sapiens
agggaggagaatggactccttc

SEQ ID NO: 7637568 - DNA, 22 bp, Homo sapiens
agggaggaccaatgtgtggtta

SEQ ID NO: 7637569 - DNA, 22 bp, Homo sapiens
agggaggaccaatgtgtggtta

SEQ ID NO: 7637570 - DNA, 22 bp, Homo sapiens
agggaggaccaatgtgtggtta

SEQ ID NO: 7637571 - DNA, 22 bp, Homo sapiens
agggaggaaggatgttccaaag

SEQ ID NO: 7637572 - DNA, 22 bp, Homo sapiens
agggaggaaggatgttccaaag

SEQ ID NO: 7637573 - DNA, 22 bp, Homo sapiens
agggaggaaggatgttccaaag

SEQ ID NO: 7637574 - DNA, 22 bp, Homo sapiens
agggaggaaggatgttccaaag

SEQ ID NO: 7637575 - DNA, 22 bp, Homo sapiens
agggaggaaggaactccttcta

SEQ ID NO: 7637576 - DNA, 22 bp, Homo sapiens
agggaggaaggatgttccaaag

SEQ ID NO: 7637577 - DNA, 22 bp, Homo sapiens
agggaggaaggatgttccaaag

SEQ ID NO: 7637578 - DNA, 22 bp, Homo sapiens
agggaggaaggatgttccaaag

SEQ ID NO: 7637579 - DNA, 22 bp, Homo sapiens
agggcagcccttctgggagggc

SEQ ID NO: 7637580 - DNA, 22 bp, Homo sapiens
agggcagcccttctgggagggc

SEQ ID NO: 7637581 - DNA, 22 bp, Homo sapiens
agggcagcccttctgggagggc

SEQ ID NO: 7637582 - DNA, 22 bp, Homo sapiens
agggcagcccttctgggagggc

SEQ ID NO: 7637583 - DNA, 22 bp, Homo sapiens
agggcagcccttctgggagggc

SEQ ID NO: 7637584 - DNA, 22 bp, Homo sapiens
agggcagcccttctgggagggc

SEQ ID NO: 7637585 - DNA, 22 bp, Homo sapiens
agggcagccattgagggattct

SEQ ID NO: 7637586 - DNA, 22 bp, Homo sapiens
agggcagccattgagggattct

SEQ ID NO: 7637587 - DNA, 22 bp, Homo sapiens
agggcagccattgagggattct

SEQ ID NO: 7637588 - DNA, 22 bp, Homo sapiens
agggcagccatgagccttcagg

SEQ ID NO: 7637589 - DNA, 22 bp, Homo sapiens
agggcagccatgagccttcagg

SEQ ID NO: 7637590 - DNA, 22 bp, Homo sapiens
agggcagccatgagccttcagg

SEQ ID NO: 7637591 - DNA, 22 bp, Homo sapiens
agggcagccatgagccttcagg

SEQ ID NO: 7637592 - DNA, 22 bp, Homo sapiens
agggcagccattgagggattct

SEQ ID NO: 7637593 - DNA, 22 bp, Homo sapiens
agggcagccattgagggattct

SEQ ID NO: 7637594 - DNA, 22 bp, Homo sapiens
agggcagccatgagccttcagg

SEQ ID NO: 7637595 - DNA, 22 bp, Homo sapiens
agggcagccatgagccttcagg

SEQ ID NO: 7637596 - DNA, 22 bp, Homo sapiens
agggcagccatgagccttcagg

SEQ ID NO: 7637597 - DNA, 22 bp, Homo sapiens
agggcagcattgcctttctcca

SEQ ID NO: 7637598 - DNA, 22 bp, Homo sapiens
agggcagcagctcctcctagct

SEQ ID NO: 7637599 - DNA, 22 bp, Homo sapiens
agggcagcagctcctcctagct

SEQ ID NO: 7637600 - DNA, 22 bp, Homo sapiens
agggcagatggaacttccccga

SEQ ID NO: 7637601 - DNA, 22 bp, Homo sapiens
agggcagcagctcctcctagct

SEQ ID NO: 7637602 - DNA, 22 bp, Homo sapiens
agggcagatggaacttccccga

SEQ ID NO: 7637603 - DNA, 22 bp, Homo sapiens
agggcagatggaacttccccga

SEQ ID NO: 7637604 - DNA, 22 bp, Homo sapiens
agggcagcagctgtccctgaga

SEQ ID NO: 7637605 - DNA, 22 bp, Homo sapiens
agggcagcagctgtccctgaga

SEQ ID NO: 7637606 - DNA, 22 bp, Homo sapiens
agggcagcagctcctcctagct

SEQ ID NO: 7637607 - DNA, 22 bp, Homo sapiens
agggcagcagctcctcctagct

SEQ ID NO: 7637608 - DNA, 22 bp, Homo sapiens
agggcagcattgcctttctcca

SEQ ID NO: 7637609 - DNA, 22 bp, Homo sapiens
agggcagcattgcctttctcca

SEQ ID NO: 7637610 - DNA, 22 bp, Homo sapiens
agggcagcattgcctttctcca

SEQ ID NO: 7637611 - DNA, 22 bp, Homo sapiens
agggcagcattgcctttctcca

SEQ ID NO: 7637612 - DNA, 22 bp, Homo sapiens
agggcagcagctgtccctgaga

SEQ ID NO: 7637613 - DNA, 22 bp, Homo sapiens
agggcagcattgcctttctcca

SEQ ID NO: 7637614 - DNA, 22 bp, Homo sapiens
agggcagcattgcctttctcca

SEQ ID NO: 7637615 - DNA, 22 bp, Homo sapiens
agggcagcagctgtccctgaga

SEQ ID NO: 7637616 - DNA, 22 bp, Homo sapiens
agggcagcagctgtccctgaga

SEQ ID NO: 7637617 - DNA, 22 bp, Homo sapiens
agggccagccccaccctctctg

SEQ ID NO: 7637618 - DNA, 22 bp, Homo sapiens
agggccagccccaccctctctg

SEQ ID NO: 7637619 - DNA, 22 bp, Homo sapiens
agggccagccccaccctctctg

SEQ ID NO: 7637620 - DNA, 21 bp, Homo sapiens
agggccagatcaccaaggagc

SEQ ID NO: 7637621 - DNA, 21 bp, Homo sapiens
agggccagatcaccaaggagc

SEQ ID NO: 7637622 - DNA, 21 bp, Homo sapiens
agggccagatcaccaaggagc

SEQ ID NO: 7637623 - DNA, 22 bp, Homo sapiens
agggccagccgacttccagcct

SEQ ID NO: 7637624 - DNA, 22 bp, Homo sapiens
agggccagccccaccctctctg

SEQ ID NO: 7637625 - DNA, 22 bp, Homo sapiens
agggccagccccaccctctctg

SEQ ID NO: 7637626 - DNA, 22 bp, Homo sapiens
agggccagccccaccctctctg

SEQ ID NO: 7637627 - DNA, 22 bp, Homo sapiens
agggcagctgtgagccactgtg

SEQ ID NO: 7637628 - DNA, 22 bp, Homo sapiens
agggccagagtctgtgtagata

SEQ ID NO: 7637629 - DNA, 22 bp, Homo sapiens
agggcagctgtgagccactgtg

SEQ ID NO: 7637630 - DNA, 22 bp, Homo sapiens
agggccagagtctgtgtagata

SEQ ID NO: 7637631 - DNA, 21 bp, Homo sapiens
agggccagatcaccaaggagc

SEQ ID NO: 7637632 - DNA, 21 bp, Homo sapiens
agggccagatcaccaaggagc

SEQ ID NO: 7637633 - DNA, 21 bp, Homo sapiens
agggccagatcaccaaggagc

SEQ ID NO: 7637634 - DNA, 22 bp, Homo sapiens
agggccagagtggcaaaagcct

SEQ ID NO: 7637635 - DNA, 22 bp, Homo sapiens
agggccagagtggcaaaagcct

SEQ ID NO: 7637636 - DNA, 22 bp, Homo sapiens
agggccagagtggcaaaagcct

SEQ ID NO: 7637637 - DNA, 22 bp, Homo sapiens
agggcagctggaaggtggcttc

SEQ ID NO: 7637638 - DNA, 22 bp, Homo sapiens
agggcagctggaaggtggcttc

SEQ ID NO: 7637639 - DNA, 22 bp, Homo sapiens
agggcagctggaaggtggcttc

SEQ ID NO: 7637640 - DNA, 22 bp, Homo sapiens
agggcagctggaaggtggcttc

SEQ ID NO: 7637641 - DNA, 22 bp, Homo sapiens
agggcagctgtgagccactgtg

SEQ ID NO: 7637642 - DNA, 22 bp, Homo sapiens
agggcagctgtgagccactgtg

SEQ ID NO: 7637643 - DNA, 22 bp, Homo sapiens
agggcagctgtgagccactgtg

SEQ ID NO: 7637644 - DNA, 22 bp, Homo sapiens
agggcagctgtgagccactgtg

SEQ ID NO: 7637645 - DNA, 22 bp, Homo sapiens
agggcagctgtgagccactgtg

SEQ ID NO: 7637646 - DNA, 22 bp, Homo sapiens
agggcagctggaaggtggcttc

SEQ ID NO: 7637647 - DNA, 22 bp, Homo sapiens
agggcagctctcacctctggcc

SEQ ID NO: 7637648 - DNA, 22 bp, Homo sapiens
agggcagctctcacctctggcc

SEQ ID NO: 7637649 - DNA, 22 bp, Homo sapiens
agggcagctctcacctctggcc

SEQ ID NO: 7637650 - DNA, 22 bp, Homo sapiens
agggcagctctcacctctggcc

SEQ ID NO: 7637651 - DNA, 22 bp, Homo sapiens
agggcagctctcacctctggcc

SEQ ID NO: 7637652 - DNA, 22 bp, Homo sapiens
agggcagctggaaggtggcttc

SEQ ID NO: 7637653 - DNA, 22 bp, Homo sapiens
agggcagctggaaggtggcttc

SEQ ID NO: 7637654 - DNA, 22 bp, Homo sapiens
agggcagctggaaggtggcttc

SEQ ID NO: 7637655 - DNA, 22 bp, Homo sapiens
agggcagctggaaggtggcttc

SEQ ID NO: 7637656 - DNA, 22 bp, Homo sapiens
agggcagctggaaggtggcttc

SEQ ID NO: 7637657 - DNA, 22 bp, Homo sapiens
agggcagctctcacctctggcc

SEQ ID NO: 7637658 - DNA, 22 bp, Homo sapiens
agggcagcctctcagcctaggt

SEQ ID NO: 7637659 - DNA, 22 bp, Homo sapiens
agggcagcctctcagcctaggt

SEQ ID NO: 7637660 - DNA, 22 bp, Homo sapiens
agggcagcctctcagcctaggt

SEQ ID NO: 7637661 - DNA, 22 bp, Homo sapiens
agggcagcccttctgggagggc

SEQ ID NO: 7637662 - DNA, 22 bp, Homo sapiens
agggcagcccttctgggagggc

SEQ ID NO: 7637663 - DNA, 22 bp, Homo sapiens
agggcagcccttctgggagggc

SEQ ID NO: 7637664 - DNA, 22 bp, Homo sapiens
agggcagcctctcagcctaggt

SEQ ID NO: 7637665 - DNA, 22 bp, Homo sapiens
agggcagcctctcagcctaggt

SEQ ID NO: 7637666 - DNA, 22 bp, Homo sapiens
agggcagcctctcagcctaggt

SEQ ID NO: 7637667 - DNA, 22 bp, Homo sapiens
agggcagcctctcagcctaggt

SEQ ID NO: 7637668 - DNA, 22 bp, Homo sapiens
agggcagcctctcagcctaggt

SEQ ID NO: 7637669 - DNA, 22 bp, Homo sapiens
agggcagcctgagtgctggccc

SEQ ID NO: 7637670 - DNA, 22 bp, Homo sapiens
agggcagcctctcagcctaggt

SEQ ID NO: 7637671 - DNA, 22 bp, Homo sapiens
agggcagcctgagtgctggccc

SEQ ID NO: 7637672 - DNA, 22 bp, Homo sapiens
agggcagcctgagtgctggccc

SEQ ID NO: 7637673 - DNA, 22 bp, Homo sapiens
agggcagcctgagtgctggccc

SEQ ID NO: 7637674 - DNA, 22 bp, Homo sapiens
agggcagcctgagtgctggccc

SEQ ID NO: 7637675 - DNA, 22 bp, Homo sapiens
agggcagcggtgcttgtgttat

SEQ ID NO: 7637676 - DNA, 22 bp, Homo sapiens
agggcagcctgagtgctggccc

SEQ ID NO: 7637677 - DNA, 22 bp, Homo sapiens
agggcagcggtgcttgtgttat

SEQ ID NO: 7637678 - DNA, 22 bp, Homo sapiens
agggcagcggtgcttgtgttat

SEQ ID NO: 7637679 - DNA, 22 bp, Homo sapiens
agggcagcggtgcttgtgttat

SEQ ID NO: 7637680 - DNA, 22 bp, Homo sapiens
agggcagctaaggtgctgactg

SEQ ID NO: 7637681 - DNA, 22 bp, Homo sapiens
agggcagctaaggtgctgactg

SEQ ID NO: 7637682 - DNA, 22 bp, Homo sapiens
agggcagctaaggtgctgactg

SEQ ID NO: 7637683 - DNA, 22 bp, Homo sapiens
agggcagctaaggtgctgactg

SEQ ID NO: 7637684 - DNA, 22 bp, Homo sapiens
agggcagctaaggtgctgactg

SEQ ID NO: 7637685 - DNA, 22 bp, Homo sapiens
agggcagctagctgtagaaaga

SEQ ID NO: 7637686 - DNA, 22 bp, Homo sapiens
agggcagctaaggtgctgactg

SEQ ID NO: 7637687 - DNA, 22 bp, Homo sapiens
agggcagctctcacctctggcc

SEQ ID NO: 7637688 - DNA, 22 bp, Homo sapiens
agggcagctctcacctctggcc

SEQ ID NO: 7637689 - DNA, 22 bp, Homo sapiens
agggcagctctcacctctggcc

SEQ ID NO: 7637690 - DNA, 22 bp, Homo sapiens
agggcagctagctgtagaaaga

SEQ ID NO: 7637691 - DNA, 22 bp, Homo sapiens
agggcagctagctgtagaaaga

SEQ ID NO: 7637692 - DNA, 22 bp, Homo sapiens
agggcagctagctgtagaaaga

SEQ ID NO: 7637693 - DNA, 22 bp, Homo sapiens
agggccagggaagctgtatttt

SEQ ID NO: 7637694 - DNA, 22 bp, Homo sapiens
agggccagggaagctgtatttt

SEQ ID NO: 7637695 - DNA, 22 bp, Homo sapiens
agggccagggaagctgtatttt

SEQ ID NO: 7637696 - DNA, 22 bp, Homo sapiens
agggccagggaagctgtatttt

SEQ ID NO: 7637697 - DNA, 22 bp, Homo sapiens
agggccagggaagctgtatttt

SEQ ID NO: 7637698 - DNA, 22 bp, Homo sapiens
ccctggcccctcactccgaggc

SEQ ID NO: 7637699 - DNA, 22 bp, Homo sapiens
ccctggcccctcactccgaggc

SEQ ID NO: 7637700 - DNA, 22 bp, Homo sapiens
ccctggcccctcactccgaggc

SEQ ID NO: 7637701 - DNA, 21 bp, Homo sapiens
ccctgggatgggcttggactt

SEQ ID NO: 7637702 - DNA, 22 bp, Homo sapiens
ccctgggattcaatttcactct

SEQ ID NO: 7637703 - DNA, 21 bp, Homo sapiens
ccctgggatgggcttggactt

SEQ ID NO: 7637704 - DNA, 22 bp, Homo sapiens
ccctggcccctcactccgaggc

SEQ ID NO: 7637705 - DNA, 22 bp, Homo sapiens
ccctggcccctcactccgaggc

SEQ ID NO: 7637706 - DNA, 22 bp, Homo sapiens
ccctgggatggattggcaggaa

SEQ ID NO: 7637707 - DNA, 22 bp, Homo sapiens
ccctgggatggattggcaggaa

SEQ ID NO: 7637708 - DNA, 22 bp, Homo sapiens
agggccagggaaacgatcagca

SEQ ID NO: 7637709 - DNA, 22 bp, Homo sapiens
agggccagggaaacgatcagca

SEQ ID NO: 7637710 - DNA, 22 bp, Homo sapiens
agggccagggaaacgatcagca

SEQ ID NO: 7637711 - DNA, 22 bp, Homo sapiens
agggccagggaaacgatcagca

SEQ ID NO: 7637712 - DNA, 22 bp, Homo sapiens
agggccagggaaacgatcagca

SEQ ID NO: 7637713 - DNA, 22 bp, Homo sapiens
agggccaggctcccatgtcagg

SEQ ID NO: 7637714 - DNA, 22 bp, Homo sapiens
agggccaggctcccatgtcagg

SEQ ID NO: 7637715 - DNA, 22 bp, Homo sapiens
agggccaggctcccatgtcagg

SEQ ID NO: 7637716 - DNA, 22 bp, Homo sapiens
agggccaggctcccatgtcagg

SEQ ID NO: 7637717 - DNA, 22 bp, Homo sapiens
agggccaggctcccatgtcagg

SEQ ID NO: 7637718 - DNA, 22 bp, Homo sapiens
agggccaggctcccatgtcagg

SEQ ID NO: 7637719 - DNA, 22 bp, Homo sapiens
agggccaggctcccatgtcagg

SEQ ID NO: 7637720 - DNA, 22 bp, Homo sapiens
agggccaggctcccatgtcagg

SEQ ID NO: 7637721 - DNA, 22 bp, Homo sapiens
agggccaggctcccatgtcagg

SEQ ID NO: 7637722 - DNA, 22 bp, Homo sapiens
ccctggggagcaggcgaaggag

SEQ ID NO: 7637723 - DNA, 22 bp, Homo sapiens
ccctggggctgagggatggccg

SEQ ID NO: 7637724 - DNA, 22 bp, Homo sapiens
ccctggggctgagggatggccg

SEQ ID NO: 7637725 - DNA, 22 bp, Homo sapiens
ccctggggctgagggatggccg

SEQ ID NO: 7637726 - DNA, 22 bp, Homo sapiens
ccctggggctgagggatggccg

SEQ ID NO: 7637727 - DNA, 22 bp, Homo sapiens
ccctggggctgagggatggccg

SEQ ID NO: 7637728 - DNA, 22 bp, Homo sapiens
ccctggggagcaggcgaaggag

SEQ ID NO: 7637729 - DNA, 22 bp, Homo sapiens
ccctggggagcaggcgaaggag

SEQ ID NO: 7637730 - DNA, 22 bp, Homo sapiens
ccctggggagcaggcgaaggag

SEQ ID NO: 7637731 - DNA, 22 bp, Homo sapiens
ccctggggagcaggcgaaggag

SEQ ID NO: 7637732 - DNA, 22 bp, Homo sapiens
ccctggggagcaggcgaaggag

SEQ ID NO: 7637733 - DNA, 22 bp, Homo sapiens
ccctggggagcaggcgaaggag

SEQ ID NO: 7637734 - DNA, 22 bp, Homo sapiens
ccctgggctcagagcaggtagc

SEQ ID NO: 7637735 - DNA, 22 bp, Homo sapiens
ccctgggctcagagcaggtagc

SEQ ID NO: 7637736 - DNA, 22 bp, Homo sapiens
ccctgggctcagagcaggtagc

SEQ ID NO: 7637737 - DNA, 22 bp, Homo sapiens
ccctgggctcagagcaggtagc

SEQ ID NO: 7637738 - DNA, 22 bp, Homo sapiens
ccctgggctcagagcaggtagc

SEQ ID NO: 7637739 - DNA, 22 bp, Homo sapiens
ccctgggctcagagcaggtagc

SEQ ID NO: 7637740 - DNA, 22 bp, Homo sapiens
ccctgggctcagagcaggtagc

SEQ ID NO: 7637741 - DNA, 22 bp, Homo sapiens
ccctgggctcagagcaggtagc

SEQ ID NO: 7637742 - DNA, 22 bp, Homo sapiens
ccctgggctcagagcaggtagc

SEQ ID NO: 7637743 - DNA, 22 bp, Homo sapiens
ccctggggagcaggcgaaggag

SEQ ID NO: 7637744 - DNA, 22 bp, Homo sapiens
ccctggggagcaggcgaaggag

SEQ ID NO: 7637745 - DNA, 22 bp, Homo sapiens
ccctggggagcaggcgaaggag

SEQ ID NO: 7637746 - DNA, 22 bp, Homo sapiens
ccctgggctcagagcaggtagc

SEQ ID NO: 7637747 - DNA, 22 bp, Homo sapiens
ccctgggattgccttggccttg

SEQ ID NO: 7637748 - DNA, 22 bp, Homo sapiens
ccctgggattgccttggccttg

SEQ ID NO: 7637749 - DNA, 22 bp, Homo sapiens
ccctgggcaagccctattttcc

SEQ ID NO: 7637750 - DNA, 22 bp, Homo sapiens
ccctgggattgccttggccttg

SEQ ID NO: 7637751 - DNA, 22 bp, Homo sapiens
ccctgggcaccaggcctggtaa

SEQ ID NO: 7637752 - DNA, 22 bp, Homo sapiens
ccctgggcaccaggcctggtaa

SEQ ID NO: 7637753 - DNA, 22 bp, Homo sapiens
ccctgggcaccaggcctggtaa

SEQ ID NO: 7637754 - DNA, 22 bp, Homo sapiens
ccctgggcaccaggcctggtaa

SEQ ID NO: 7637755 - DNA, 22 bp, Homo sapiens
ccctgggcaccaggcctggtaa

SEQ ID NO: 7637756 - DNA, 22 bp, Homo sapiens
ccctgggcaagccctattttcc

SEQ ID NO: 7637757 - DNA, 22 bp, Homo sapiens
ccctgggcagtctgcacttcag

SEQ ID NO: 7637758 - DNA, 22 bp, Homo sapiens
ccctgggcagtctgcacttcag

SEQ ID NO: 7637759 - DNA, 22 bp, Homo sapiens
ccctgggcagtctgcacttcag

SEQ ID NO: 7637760 - DNA, 22 bp, Homo sapiens
ccctgggcagtctgcacttcag

SEQ ID NO: 7637761 - DNA, 22 bp, Homo sapiens
ccctgggcagtctgcacttcag

SEQ ID NO: 7637762 - DNA, 22 bp, Homo sapiens
ccctgggcagtctgcacttcag

SEQ ID NO: 7637763 - DNA, 22 bp, Homo sapiens
ccctgggcaccaggcctggtaa

SEQ ID NO: 7637764 - DNA, 22 bp, Homo sapiens
agggccagccgacttccagcct

SEQ ID NO: 7637765 - DNA, 22 bp, Homo sapiens
agggccagccgacttccagcct

SEQ ID NO: 7637766 - DNA, 22 bp, Homo sapiens
agggccagccgacttccagcct

SEQ ID NO: 7637767 - DNA, 22 bp, Homo sapiens
agggccagccgacttccagcct

SEQ ID NO: 7637768 - DNA, 22 bp, Homo sapiens
agggccagctagagccctcgcc

SEQ ID NO: 7637769 - DNA, 22 bp, Homo sapiens
agggccagctagagccctcgcc

SEQ ID NO: 7637770 - DNA, 22 bp, Homo sapiens
agggccagctagagccctcgcc

SEQ ID NO: 7637771 - DNA, 22 bp, Homo sapiens
agggccagctagagccctcgcc

SEQ ID NO: 7637772 - DNA, 22 bp, Homo sapiens
agggccagctagagccctcgcc

SEQ ID NO: 7637773 - DNA, 22 bp, Homo sapiens
agggccagctagagccctcgcc

SEQ ID NO: 7637774 - DNA, 22 bp, Homo sapiens
agggccagctagagccctcgcc

SEQ ID NO: 7637775 - DNA, 22 bp, Homo sapiens
agggccagctagagccctcgcc

SEQ ID NO: 7637776 - DNA, 22 bp, Homo sapiens
agggccagctagagccctcgcc

SEQ ID NO: 7637777 - DNA, 22 bp, Homo sapiens
agggccagctgatgagaatgag

SEQ ID NO: 7637778 - DNA, 22 bp, Homo sapiens
agggccagctgatgagaatgag

SEQ ID NO: 7637779 - DNA, 22 bp, Homo sapiens
agggccagctgatgagaatgag

SEQ ID NO: 7637780 - DNA, 22 bp, Homo sapiens
agggccagctgatgagaatgag

SEQ ID NO: 7637781 - DNA, 22 bp, Homo sapiens
agggccagctgatgagaatgag

SEQ ID NO: 7637782 - DNA, 22 bp, Homo sapiens
agggccagctgatgagaatgag

SEQ ID NO: 7637783 - DNA, 22 bp, Homo sapiens
agggccagctgatgagaatgag

SEQ ID NO: 7637784 - DNA, 22 bp, Homo sapiens
agggccagctgatgagaatgag

SEQ ID NO: 7637785 - DNA, 22 bp, Homo sapiens
agggccagctgatgagaatgag

SEQ ID NO: 7637786 - DNA, 22 bp, Homo sapiens
agggccagctgatgagaatgag

SEQ ID NO: 7637787 - DNA, 22 bp, Homo sapiens
agggccagctgatgagaatgag

SEQ ID NO: 7637788 - DNA, 22 bp, Homo sapiens
agggccagctgcagaattagca

SEQ ID NO: 7637789 - DNA, 22 bp, Homo sapiens
agggccagctgcagaattagca

SEQ ID NO: 7637790 - DNA, 22 bp, Homo sapiens
agggccagctgatgagaatgag

SEQ ID NO: 7637791 - DNA, 18 bp, Homo sapiens
agggccagctgtgagtag

SEQ ID NO: 7637792 - DNA, 18 bp, Homo sapiens
agggccagctgtgagtag

SEQ ID NO: 7637793 - DNA, 22 bp, Homo sapiens
agggccagctgcagaattagca

SEQ ID NO: 7637794 - DNA, 22 bp, Homo sapiens
agggccagctgcagaattagca

SEQ ID NO: 7637795 - DNA, 22 bp, Homo sapiens
agggccaggaacacctgaaggg

SEQ ID NO: 7637796 - DNA, 18 bp, Homo sapiens
agggccagctgtgagtag

SEQ ID NO: 7637797 - DNA, 22 bp, Homo sapiens
agggccaggaacacctgaaggg

SEQ ID NO: 7637798 - DNA, 22 bp, Homo sapiens
agggccaggaacacctgaaggg

SEQ ID NO: 7637799 - DNA, 22 bp, Homo sapiens
agggccaggaacacctgaaggg

SEQ ID NO: 7637800 - DNA, 22 bp, Homo sapiens
agggccaggaacacctgaaggg

SEQ ID NO: 7637801 - DNA, 22 bp, Homo sapiens
agggccaggaacacctgaaggg

SEQ ID NO: 7637802 - DNA, 22 bp, Homo sapiens
agggccaggaacacctgaaggg

SEQ ID NO: 7637803 - DNA, 22 bp, Homo sapiens
agggccaggaacacctgaaggg

SEQ ID NO: 7637804 - DNA, 22 bp, Homo sapiens
agggccaggaacacctgaaggg

SEQ ID NO: 7637805 - DNA, 22 bp, Homo sapiens
agggccaggaacacctgaaggg

SEQ ID NO: 7637806 - DNA, 18 bp, Homo sapiens
agggccagctgtgagtag

SEQ ID NO: 7637807 - DNA, 18 bp, Homo sapiens
agggccagctgtgagtag

SEQ ID NO: 7637808 - DNA, 18 bp, Homo sapiens
agggccagctgtgagtag

SEQ ID NO: 7637809 - DNA, 18 bp, Homo sapiens
agggccagctgtgagtag

SEQ ID NO: 7637810 - DNA, 18 bp, Homo sapiens
agggccagctgtgagtag

SEQ ID NO: 7637811 - DNA, 18 bp, Homo sapiens
agggccagctgtgagtag

SEQ ID NO: 7637812 - DNA, 18 bp, Homo sapiens
agggccagctgtgagtag

SEQ ID NO: 7637813 - DNA, 18 bp, Homo sapiens
agggccagctgtgagtag

SEQ ID NO: 7637814 - DNA, 22 bp, Homo sapiens
agggccaggatcacagccaaga

SEQ ID NO: 7637815 - DNA, 22 bp, Homo sapiens
agggccaggatcacagccaaga

SEQ ID NO: 7637816 - DNA, 22 bp, Homo sapiens
agggccaggatcacagccaaga

SEQ ID NO: 7637817 - DNA, 22 bp, Homo sapiens
agggccaggatcacagccaaga

SEQ ID NO: 7637818 - DNA, 22 bp, Homo sapiens
agggccaggatcacagccaaga

SEQ ID NO: 7637819 - DNA, 22 bp, Homo sapiens
agggccaggatcacagccaaga

SEQ ID NO: 7637820 - DNA, 19 bp, Homo sapiens
agggccaggattctggaac

SEQ ID NO: 7637821 - DNA, 19 bp, Homo sapiens
agggccaggattctggaac

SEQ ID NO: 7637822 - DNA, 19 bp, Homo sapiens
agggccaggattctggaac

SEQ ID NO: 7637823 - DNA, 22 bp, Homo sapiens
agggccaggatcacagccaaga

SEQ ID NO: 7637824 - DNA, 22 bp, Homo sapiens
agggccaggatcacagccaaga

SEQ ID NO: 7637825 - DNA, 19 bp, Homo sapiens
agggccaggattctggaac

SEQ ID NO: 7637826 - DNA, 19 bp, Homo sapiens
agggccaggattctggaac

SEQ ID NO: 7637827 - DNA, 19 bp, Homo sapiens
agggccaggattctggaac

SEQ ID NO: 7637828 - DNA, 19 bp, Homo sapiens
agggccaggattctggaac

SEQ ID NO: 7637829 - DNA, 22 bp, Homo sapiens
cccttcagggttaagtagaggg

SEQ ID NO: 7637830 - DNA, 22 bp, Homo sapiens
cctagacacttatggaagtgag

SEQ ID NO: 7637831 - DNA, 22 bp, Homo sapiens
cctagacattaagcttgggttt

SEQ ID NO: 7637832 - DNA, 22 bp, Homo sapiens
cctagacattaagcttgggttt

SEQ ID NO: 7637833 - DNA, 22 bp, Homo sapiens
cctagactagaggcagggagcc

SEQ ID NO: 7637834 - DNA, 22 bp, Homo sapiens
cctcaaagcggtatgcagacgg

SEQ ID NO: 7637835 - DNA, 22 bp, Homo sapiens
cctcaaagcggtatgcagacgg

SEQ ID NO: 7637836 - DNA, 22 bp, Homo sapiens
cctcaaagcggtatgcagacgg

SEQ ID NO: 7637837 - DNA, 22 bp, Homo sapiens
cctcaaagctcaaatgaggctt

SEQ ID NO: 7637838 - DNA, 22 bp, Homo sapiens
cctcaaataagttttatttatc

SEQ ID NO: 7637839 - DNA, 22 bp, Homo sapiens
cctcaaatagcccccagtctag

SEQ ID NO: 7637840 - DNA, 22 bp, Homo sapiens
cctcaaatagcccccagtctag

SEQ ID NO: 7637841 - DNA, 22 bp, Homo sapiens
cctcaaaggcctggcaccagaa

SEQ ID NO: 7637842 - DNA, 22 bp, Homo sapiens
cctcaaaggcctggcaccagaa

SEQ ID NO: 7637843 - DNA, 22 bp, Homo sapiens
cctcaaaggcctggcaccagaa

SEQ ID NO: 7637844 - DNA, 22 bp, Homo sapiens
cctcaaagtagagggagatgag

SEQ ID NO: 7637845 - DNA, 20 bp, Homo sapiens
cctcaaataagtgccagcat

SEQ ID NO: 7637846 - DNA, 20 bp, Homo sapiens
cctcaaataagtgccagcat

SEQ ID NO: 7637847 - DNA, 22 bp, Homo sapiens
cccttcagggttaagtagaggg

SEQ ID NO: 7637848 - DNA, 22 bp, Homo sapiens
cccttcagggttaagtagaggg

SEQ ID NO: 7637849 - DNA, 22 bp, Homo sapiens
cccttcagggttaagtagaggg

SEQ ID NO: 7637850 - DNA, 22 bp, Homo sapiens
cccttcagggttaagtagaggg

SEQ ID NO: 7637851 - DNA, 22 bp, Homo sapiens
cccttcagctgagtgggacagc

SEQ ID NO: 7637852 - DNA, 22 bp, Homo sapiens
cccttcagctgagtgggacagc

SEQ ID NO: 7637853 - DNA, 22 bp, Homo sapiens
cccttcagctgagtgggacagc

SEQ ID NO: 7637854 - DNA, 23 bp, Homo sapiens
cccttcagcgagggcattaaggt

SEQ ID NO: 7637855 - DNA, 23 bp, Homo sapiens
cccttcagcgagggcattaaggt

SEQ ID NO: 7637856 - DNA, 23 bp, Homo sapiens
cccttcagcgagggcattaaggt

SEQ ID NO: 7637857 - DNA, 22 bp, Homo sapiens
cccttagtttgagaacttgtct

SEQ ID NO: 7637858 - DNA, 22 bp, Homo sapiens
cccttcaagctctctgggtttt

SEQ ID NO: 7637859 - DNA, 17 bp, Homo sapiens
ccctgggtgagttctca

SEQ ID NO: 7637860 - DNA, 22 bp, Homo sapiens
ccctgtggttgctagggcacag

SEQ ID NO: 7637861 - DNA, 22 bp, Homo sapiens
ccctgtggtgacaggcctgtct

SEQ ID NO: 7637862 - DNA, 22 bp, Homo sapiens
ccctgtggttgctagggcacag

SEQ ID NO: 7637863 - DNA, 22 bp, Homo sapiens
ccctgtggttgctagggcacag

SEQ ID NO: 7637864 - DNA, 22 bp, Homo sapiens
ccctgtggttgctagggcacag

SEQ ID NO: 7637865 - DNA, 22 bp, Homo sapiens
ccctgtggttgctagggcacag

SEQ ID NO: 7637866 - DNA, 22 bp, Homo sapiens
ccctgtggttgctagggcacag

SEQ ID NO: 7637867 - DNA, 22 bp, Homo sapiens
ccctgtgtagttaactttccac

SEQ ID NO: 7637868 - DNA, 19 bp, Homo sapiens
ccctgggggtttctggtac

SEQ ID NO: 7637869 - DNA, 19 bp, Homo sapiens
ccctgggggtttctggtac

SEQ ID NO: 7637870 - DNA, 19 bp, Homo sapiens
ccctgggggtttctggtac

SEQ ID NO: 7637871 - DNA, 19 bp, Homo sapiens
ccctgggggtttctggtac

SEQ ID NO: 7637872 - DNA, 22 bp, Homo sapiens
ccctggggctgagggatggccg

SEQ ID NO: 7637873 - DNA, 22 bp, Homo sapiens
ccctggggctgagggatggccg

SEQ ID NO: 7637874 - DNA, 22 bp, Homo sapiens
ccctggggctgagggatggccg

SEQ ID NO: 7637875 - DNA, 22 bp, Homo sapiens
ccctggggctgagggatggccg

SEQ ID NO: 7637876 - DNA, 22 bp, Homo sapiens
cccttacatcagctccttcacc

SEQ ID NO: 7637877 - DNA, 22 bp, Homo sapiens
cccttaaaggctttgcctctct

SEQ ID NO: 7637878 - DNA, 22 bp, Homo sapiens
cccttagaacaacattagcata

SEQ ID NO: 7637879 - DNA, 22 bp, Homo sapiens
cccttagagattctgtcagagt

SEQ ID NO: 7637880 - DNA, 17 bp, Homo sapiens
cccttagagcaaaagat

SEQ ID NO: 7637881 - DNA, 22 bp, Homo sapiens
cccttagaggctggaggcagca

SEQ ID NO: 7637882 - DNA, 22 bp, Homo sapiens
ccctgttttaagttgatattga

SEQ ID NO: 7637883 - DNA, 22 bp, Homo sapiens
ccctgttttaagttgatattga

SEQ ID NO: 7637884 - DNA, 22 bp, Homo sapiens
ccctgtttaagaaacctgtaaa

SEQ ID NO: 7637885 - DNA, 22 bp, Homo sapiens
ccctgtttatttttggagagaa

SEQ ID NO: 7637886 - DNA, 22 bp, Homo sapiens
ccctgtttatttttggagagaa

SEQ ID NO: 7637887 - DNA, 22 bp, Homo sapiens
ccctgtttggatggggacccag

SEQ ID NO: 7637888 - DNA, 21 bp, Homo sapiens
ccctgtgttccacagcagaca

SEQ ID NO: 7637889 - DNA, 22 bp, Homo sapiens
ccctgtgtcttcttgcctttgt

SEQ ID NO: 7637890 - DNA, 21 bp, Homo sapiens
ccctgtgttccacagcagaca

SEQ ID NO: 7637891 - DNA, 21 bp, Homo sapiens
ccctgtgttccacagcagaca

SEQ ID NO: 7637892 - DNA, 22 bp, Homo sapiens
cctcaagatgcactgaacatat

SEQ ID NO: 7637893 - DNA, 22 bp, Homo sapiens
cctcaagaacaatccaccatta

SEQ ID NO: 7637894 - DNA, 22 bp, Homo sapiens
cctcaaattgtcaaataagaat

SEQ ID NO: 7637895 - DNA, 22 bp, Homo sapiens
cctcaaattggcattaattaag

SEQ ID NO: 7637896 - DNA, 22 bp, Homo sapiens
cctcaaattggcattaattaag

SEQ ID NO: 7637897 - DNA, 22 bp, Homo sapiens
cctcaaattggcattaattaag

SEQ ID NO: 7637898 - DNA, 22 bp, Homo sapiens
cctcaaattgtcaaataagaat

SEQ ID NO: 7637899 - DNA, 22 bp, Homo sapiens
cctcaaattgtcaaataagaat

SEQ ID NO: 7637900 - DNA, 22 bp, Homo sapiens
cctcaaattgtcaaataagaat

SEQ ID NO: 7637901 - DNA, 22 bp, Homo sapiens
cctcaaatctttagagttattt

SEQ ID NO: 7637902 - DNA, 22 bp, Homo sapiens
cctcaaatctttagagttattt

SEQ ID NO: 7637903 - DNA, 23 bp, Homo sapiens
cctcaaatgtagcctttttccca

SEQ ID NO: 7637904 - DNA, 23 bp, Homo sapiens
cctcaaatgtagcctttttccca

SEQ ID NO: 7637905 - DNA, 23 bp, Homo sapiens
cctcaaatgtagcctttttccca

SEQ ID NO: 7637906 - DNA, 22 bp, Homo sapiens
cctcaaattgctcagcgtctag

SEQ ID NO: 7637907 - DNA, 22 bp, Homo sapiens
cctcaaattgctcagcgtctag

SEQ ID NO: 7637908 - DNA, 21 bp, Homo sapiens
cctcaagtgcctcctgctgct

SEQ ID NO: 7637909 - DNA, 22 bp, Homo sapiens
cctcaagtcaattctgtctcgc

SEQ ID NO: 7637910 - DNA, 22 bp, Homo sapiens
cctcaagttggaaataaaatgt

SEQ ID NO: 7637911 - DNA, 22 bp, Homo sapiens
cctcaagtcattccggagacct

SEQ ID NO: 7637912 - DNA, 22 bp, Homo sapiens
cctcaagcctagttagatccat

SEQ ID NO: 7637913 - DNA, 22 bp, Homo sapiens
cctcaagtcaattctgtctcgc

SEQ ID NO: 7637914 - DNA, 20 bp, Homo sapiens
cctcaagcagactgacagct

SEQ ID NO: 7637915 - DNA, 22 bp, Homo sapiens
cctcaagatgcactgaacatat

SEQ ID NO: 7637916 - DNA, 22 bp, Homo sapiens
cctcagacacagtcaagctttt

SEQ ID NO: 7637917 - DNA, 22 bp, Homo sapiens
cctcagaatagtcctcagatca

SEQ ID NO: 7637918 - DNA, 22 bp, Homo sapiens
cctcacacagttatctcttcat

SEQ ID NO: 7637919 - DNA, 21 bp, Homo sapiens
cctcaagtgcctcctgctgct

SEQ ID NO: 7637920 - DNA, 22 bp, Homo sapiens
cctcacacagttatctcttcat

SEQ ID NO: 7637921 - DNA, 22 bp, Homo sapiens
cctcacacagttatctcttcat

SEQ ID NO: 7637922 - DNA, 22 bp, Homo sapiens
cctcaagttggaaataaaatgt

SEQ ID NO: 7637923 - DNA, 22 bp, Homo sapiens
cctcaagttggaaataaaatgt

SEQ ID NO: 7637924 - DNA, 22 bp, Homo sapiens
cctcacacagttatctcttcat

SEQ ID NO: 7637925 - DNA, 18 bp, Homo sapiens
cctcacagacttccatgt

SEQ ID NO: 7637926 - DNA, 23 bp, Homo sapiens
cctcagagaggcagagccacatg

SEQ ID NO: 7637927 - DNA, 22 bp, Homo sapiens
cctcagagcagcacccagatga

SEQ ID NO: 7637928 - DNA, 23 bp, Homo sapiens
cctcagagaggcagagccacatg

SEQ ID NO: 7637929 - DNA, 22 bp, Homo sapiens
cctcagagacagtaactggaat

SEQ ID NO: 7637930 - DNA, 21 bp, Homo sapiens
cctcagagacagatacgggtg

SEQ ID NO: 7637931 - DNA, 22 bp, Homo sapiens
cctcagagactgcatcttccct

SEQ ID NO: 7637932 - DNA, 22 bp, Homo sapiens
cctcagagactgcatcttccct

SEQ ID NO: 7637933 - DNA, 22 bp, Homo sapiens
cctcagagactgcatcttccct

SEQ ID NO: 7637934 - DNA, 22 bp, Homo sapiens
cctcagagccatgcctgagttc

SEQ ID NO: 7637935 - DNA, 22 bp, Homo sapiens
cctcagagccatgcctgagttc

SEQ ID NO: 7637936 - DNA, 22 bp, Homo sapiens
cctcagagcctccagaaggaat

SEQ ID NO: 7637937 - DNA, 22 bp, Homo sapiens
cctcagagcctccagaaggaat

SEQ ID NO: 7637938 - DNA, 22 bp, Homo sapiens
cctcagagcctccagaaggaat

SEQ ID NO: 7637939 - DNA, 20 bp, Homo sapiens
cctcagagcgcaggccccct

SEQ ID NO: 7637940 - DNA, 20 bp, Homo sapiens
cctcagagcgcaggccccct

SEQ ID NO: 7637941 - DNA, 22 bp, Homo sapiens
cctcagagcctccagaaggaat

SEQ ID NO: 7637942 - DNA, 22 bp, Homo sapiens
cctcagagcctccagaaggaat

SEQ ID NO: 7637943 - DNA, 22 bp, Homo sapiens
cctcagaccttgctagtagtct

SEQ ID NO: 7637944 - DNA, 22 bp, Homo sapiens
cctcagaccttgctagtagtct

SEQ ID NO: 7637945 - DNA, 22 bp, Homo sapiens
cctcagacgcaggcctatgggc

SEQ ID NO: 7637946 - DNA, 22 bp, Homo sapiens
cctcagactcagtgcgttgtga

SEQ ID NO: 7637947 - DNA, 22 bp, Homo sapiens
cctcagacccctgctgagcttc

SEQ ID NO: 7637948 - DNA, 22 bp, Homo sapiens
cctcagacccctgctgagcttc

SEQ ID NO: 7637949 - DNA, 22 bp, Homo sapiens
cctcagacacagtcaagctttt

SEQ ID NO: 7637950 - DNA, 22 bp, Homo sapiens
cctcagaccccacagggcctgt

SEQ ID NO: 7637951 - DNA, 21 bp, Homo sapiens
cctcagagacagatacgggtg

SEQ ID NO: 7637952 - DNA, 22 bp, Homo sapiens
cctcagagaaatgtctattcaa

SEQ ID NO: 7637953 - DNA, 22 bp, Homo sapiens
cctcagagacagtaactggaat

SEQ ID NO: 7637954 - DNA, 22 bp, Homo sapiens
cctcagagaaatgtctattcaa

SEQ ID NO: 7637955 - DNA, 22 bp, Homo sapiens
cctcagagaaaggtatggctga

SEQ ID NO: 7637956 - DNA, 22 bp, Homo sapiens
cctcagacttgataattgggtt

SEQ ID NO: 7637957 - DNA, 22 bp, Homo sapiens
cctcagagaaaggtatggctga

SEQ ID NO: 7637958 - DNA, 22 bp, Homo sapiens
cctccccacagcccaggagact

SEQ ID NO: 7637959 - DNA, 22 bp, Homo sapiens
cctcccatggagctctgtccat

SEQ ID NO: 7637960 - DNA, 22 bp, Homo sapiens
cctccccacagcccaggagact

SEQ ID NO: 7637961 - DNA, 22 bp, Homo sapiens
cctccccacagcccaggagact

SEQ ID NO: 7637962 - DNA, 22 bp, Homo sapiens
cctccccacagcccaggagact

SEQ ID NO: 7637963 - DNA, 22 bp, Homo sapiens
cctccccacagcccaggagact

SEQ ID NO: 7637964 - DNA, 22 bp, Homo sapiens
cctccccacagcccaggagact

SEQ ID NO: 7637965 - DNA, 22 bp, Homo sapiens
cctccccacagcccaggagact

SEQ ID NO: 7637966 - DNA, 22 bp, Homo sapiens
cctccccacagcccaggagact

SEQ ID NO: 7637967 - DNA, 22 bp, Homo sapiens
cctccccacagcccaggagact

SEQ ID NO: 7637968 - DNA, 22 bp, Homo sapiens
cctccccacagcccaggagact

SEQ ID NO: 7637969 - DNA, 22 bp, Homo sapiens
cctccccacagcccaggagact

SEQ ID NO: 7637970 - DNA, 22 bp, Homo sapiens
cctccccacaggccaaataggc

SEQ ID NO: 7637971 - DNA, 22 bp, Homo sapiens
cctccccacaggccaaataggc

SEQ ID NO: 7637972 - DNA, 22 bp, Homo sapiens
cctccccacaggccaaataggc

SEQ ID NO: 7637973 - DNA, 22 bp, Homo sapiens
cctccccacagcccaggagact

SEQ ID NO: 7637974 - DNA, 22 bp, Homo sapiens
cctccccacagcccaggagact

SEQ ID NO: 7637975 - DNA, 22 bp, Homo sapiens
cctccccacaggccaaataggc

SEQ ID NO: 7637976 - DNA, 23 bp, Homo sapiens
cctccccaccagactctaacata

SEQ ID NO: 7637977 - DNA, 23 bp, Homo sapiens
cctccccaccagactctaacata

SEQ ID NO: 7637978 - DNA, 23 bp, Homo sapiens
cctccccaccagactctaacata

SEQ ID NO: 7637979 - DNA, 23 bp, Homo sapiens
cctccccaccagactctaacata

SEQ ID NO: 7637980 - DNA, 23 bp, Homo sapiens
cctccccaccagactctaacata

SEQ ID NO: 7637981 - DNA, 23 bp, Homo sapiens
cctccccaccagactctaacata

SEQ ID NO: 7637982 - DNA, 23 bp, Homo sapiens
cctccccaccagactctaacata

SEQ ID NO: 7637983 - DNA, 22 bp, Homo sapiens
cctcccagtgccggggccggct

SEQ ID NO: 7637984 - DNA, 22 bp, Homo sapiens
cctcccagtgccggggccggct

SEQ ID NO: 7637985 - DNA, 22 bp, Homo sapiens
cctcccagtgcctccagagcag

SEQ ID NO: 7637986 - DNA, 22 bp, Homo sapiens
cctcccagtgcctccagagcag

SEQ ID NO: 7637987 - DNA, 22 bp, Homo sapiens
cctcccagtgcctccagagcag

SEQ ID NO: 7637988 - DNA, 22 bp, Homo sapiens
cctcccagtgcctccagagcag

SEQ ID NO: 7637989 - DNA, 22 bp, Homo sapiens
cctcccatccctgcaagagagc

SEQ ID NO: 7637990 - DNA, 22 bp, Homo sapiens
cctcccagtgcctccagagcag

SEQ ID NO: 7637991 - DNA, 22 bp, Homo sapiens
cctcccagtgcctccagagcag

SEQ ID NO: 7637992 - DNA, 22 bp, Homo sapiens
cctcccagtgcctccagagcag

SEQ ID NO: 7637993 - DNA, 22 bp, Homo sapiens
cctcccatggagctctgtccat

SEQ ID NO: 7637994 - DNA, 22 bp, Homo sapiens
cctcccatggagctctgtccat

SEQ ID NO: 7637995 - DNA, 22 bp, Homo sapiens
cctcccatccctgcaagagagc

SEQ ID NO: 7637996 - DNA, 22 bp, Homo sapiens
cctcccatggagctctgtccat

SEQ ID NO: 7637997 - DNA, 22 bp, Homo sapiens
cctcccatggagctctgtccat

SEQ ID NO: 7637998 - DNA, 22 bp, Homo sapiens
cctccccacccacggctggtgg

SEQ ID NO: 7637999 - DNA, 22 bp, Homo sapiens
cctccccacccacggctggtgg

SEQ ID NO: 7638000 - DNA, 22 bp, Homo sapiens
cctccccacccacggctggtgg

SEQ ID NO: 7638001 - DNA, 22 bp, Homo sapiens
cctcgcggcactcgggccggat

SEQ ID NO: 7638002 - DNA, 22 bp, Homo sapiens
cctcgcggcactcgggccggat

SEQ ID NO: 7638003 - DNA, 22 bp, Homo sapiens
cctcgacctccccaggctcagg

SEQ ID NO: 7638004 - DNA, 22 bp, Homo sapiens
cctccccacccacggctggtgg

SEQ ID NO: 7638005 - DNA, 22 bp, Homo sapiens
cctccccacccacggctggtgg

SEQ ID NO: 7638006 - DNA, 22 bp, Homo sapiens
cctccccacccacggctggtgg

SEQ ID NO: 7638007 - DNA, 22 bp, Homo sapiens
cctccccacccacggctggtgg

SEQ ID NO: 7638008 - DNA, 22 bp, Homo sapiens
cctccccacccacggctggtgg

SEQ ID NO: 7638009 - DNA, 22 bp, Homo sapiens
cctccccacccacggctggtgg

SEQ ID NO: 7638010 - DNA, 22 bp, Homo sapiens
cctcgctgtgtgaccttgggtg

SEQ ID NO: 7638011 - DNA, 22 bp, Homo sapiens
cctcgctgtgtgaccttgggtg

SEQ ID NO: 7638012 - DNA, 22 bp, Homo sapiens
cctcggaatctattctagttac

SEQ ID NO: 7638013 - DNA, 22 bp, Homo sapiens
cctcggagaaaggcagctccac

SEQ ID NO: 7638014 - DNA, 22 bp, Homo sapiens
cctcgcggcactcgggccggat

SEQ ID NO: 7638015 - DNA, 22 bp, Homo sapiens
cctctccttgcacccgtcccgc

SEQ ID NO: 7638016 - DNA, 22 bp, Homo sapiens
cctctccttgcacccgtcccgc

SEQ ID NO: 7638017 - DNA, 22 bp, Homo sapiens
cctctccttgcacccgtcccgc

SEQ ID NO: 7638018 - DNA, 22 bp, Homo sapiens
cctctccttgcacccgtcccgc

SEQ ID NO: 7638019 - DNA, 22 bp, Homo sapiens
cctctccttgcacccgtcccgc

SEQ ID NO: 7638020 - DNA, 22 bp, Homo sapiens
cctctccttgcacccgtcccgc

SEQ ID NO: 7638021 - DNA, 22 bp, Homo sapiens
cctctcggcagcccatcttgtc

SEQ ID NO: 7638022 - DNA, 22 bp, Homo sapiens
cctctccttgcacccgtcccgc

SEQ ID NO: 7638023 - DNA, 22 bp, Homo sapiens
cctctctcagcttgctgcaact

SEQ ID NO: 7638024 - DNA, 22 bp, Homo sapiens
cctctcggcagcccatcttgtc

SEQ ID NO: 7638025 - DNA, 22 bp, Homo sapiens
cctctctcagcttgctgcaact

SEQ ID NO: 7638026 - DNA, 22 bp, Homo sapiens
cctctctcagcttgctgcaact

SEQ ID NO: 7638027 - DNA, 22 bp, Homo sapiens
cctctctcagcttgctgcaact

SEQ ID NO: 7638028 - DNA, 22 bp, Homo sapiens
cctctctccaagggaaatccta

SEQ ID NO: 7638029 - DNA, 21 bp, Homo sapiens
cctctctcattgtaatgaagt

SEQ ID NO: 7638030 - DNA, 22 bp, Homo sapiens
cctctctccaattttcacctca

SEQ ID NO: 7638031 - DNA, 22 bp, Homo sapiens
cctctctccaattttcacctca

SEQ ID NO: 7638032 - DNA, 22 bp, Homo sapiens
cctctctccaattttcacctca

SEQ ID NO: 7638033 - DNA, 22 bp, Homo sapiens
cctccaggataagtcagggcct

SEQ ID NO: 7638034 - DNA, 22 bp, Homo sapiens
cctccaggataagtcagggcct

SEQ ID NO: 7638035 - DNA, 22 bp, Homo sapiens
cctccaggataagtcagggcct

SEQ ID NO: 7638036 - DNA, 22 bp, Homo sapiens
cctccaggataagtcagggcct

SEQ ID NO: 7638037 - DNA, 22 bp, Homo sapiens
cctccaggataagtcagggcct

SEQ ID NO: 7638038 - DNA, 20 bp, Homo sapiens
cctccaggcacacccatgtg

SEQ ID NO: 7638039 - DNA, 20 bp, Homo sapiens
cctccaggcacacccatgtg

SEQ ID NO: 7638040 - DNA, 20 bp, Homo sapiens
cctccaggcacacccatgtg

SEQ ID NO: 7638041 - DNA, 20 bp, Homo sapiens
cctccaggcacacccatgtg

SEQ ID NO: 7638042 - DNA, 22 bp, Homo sapiens
cctccaggccttgcaggttaac

SEQ ID NO: 7638043 - DNA, 22 bp, Homo sapiens
cctccaggccttgcaggttaac

SEQ ID NO: 7638044 - DNA, 22 bp, Homo sapiens
cctccaggctgaatatctagaa

SEQ ID NO: 7638045 - DNA, 22 bp, Homo sapiens
cctccaggctgaatatctagaa

SEQ ID NO: 7638046 - DNA, 22 bp, Homo sapiens
cctccaggctgaatatctagaa

SEQ ID NO: 7638047 - DNA, 22 bp, Homo sapiens
cctccaggctggttatcagctg

SEQ ID NO: 7638048 - DNA, 22 bp, Homo sapiens
cctccaggctggttatcagctg

SEQ ID NO: 7638049 - DNA, 23 bp, Homo sapiens
cctcccaggctgcgagtcccgag

SEQ ID NO: 7638050 - DNA, 23 bp, Homo sapiens
cctcccaggctgcgagtcccgag

SEQ ID NO: 7638051 - DNA, 22 bp, Homo sapiens
cctcccagtgccggggccggct

SEQ ID NO: 7638052 - DNA, 23 bp, Homo sapiens
cctcccaggctgcgagtcccgag

SEQ ID NO: 7638053 - DNA, 23 bp, Homo sapiens
cctcccaggctgcgagtcccgag

SEQ ID NO: 7638054 - DNA, 21 bp, Homo sapiens
cctccaggagcagagccctga

SEQ ID NO: 7638055 - DNA, 21 bp, Homo sapiens
cctccaggagcagagccctga

SEQ ID NO: 7638056 - DNA, 21 bp, Homo sapiens
cctccaggagcagagccctga

SEQ ID NO: 7638057 - DNA, 21 bp, Homo sapiens
cctccaggagcagagccctga

SEQ ID NO: 7638058 - DNA, 21 bp, Homo sapiens
cctccaggagcagagccctga

SEQ ID NO: 7638059 - DNA, 21 bp, Homo sapiens
cctccaggagcagagccctga

SEQ ID NO: 7638060 - DNA, 22 bp, Homo sapiens
cctccaggaggaaatggaacac

SEQ ID NO: 7638061 - DNA, 22 bp, Homo sapiens
cctccaggaggaaatggaacac

SEQ ID NO: 7638062 - DNA, 21 bp, Homo sapiens
cctccaggagcagagccctga

SEQ ID NO: 7638063 - DNA, 21 bp, Homo sapiens
cctccaggagcagagccctga

SEQ ID NO: 7638064 - DNA, 22 bp, Homo sapiens
cctccaggataagtcagggcct

SEQ ID NO: 7638065 - DNA, 22 bp, Homo sapiens
cctccaggaggaaatggaacac

SEQ ID NO: 7638066 - DNA, 22 bp, Homo sapiens
cctccaggaacttgagagacac

SEQ ID NO: 7638067 - DNA, 22 bp, Homo sapiens
cctccaggaacttgagagacac

SEQ ID NO: 7638068 - DNA, 22 bp, Homo sapiens
cctcagtgacctattgcattca

SEQ ID NO: 7638069 - DNA, 22 bp, Homo sapiens
cctccaggaacttgagagacac

SEQ ID NO: 7638070 - DNA, 22 bp, Homo sapiens
cctccaggaacttgagagacac

SEQ ID NO: 7638071 - DNA, 22 bp, Homo sapiens
cctccaggaacttgagagacac

SEQ ID NO: 7638072 - DNA, 22 bp, Homo sapiens
cctccagctgcctcagtctctt

SEQ ID NO: 7638073 - DNA, 22 bp, Homo sapiens
cctcagtgacctattgcattca

SEQ ID NO: 7638074 - DNA, 22 bp, Homo sapiens
cctcagtcttgaattagccaga

SEQ ID NO: 7638075 - DNA, 20 bp, Homo sapiens
cctcagagcgcaggccccct

SEQ ID NO: 7638076 - DNA, 22 bp, Homo sapiens
cctcagtctccgtgctcacctt

SEQ ID NO: 7638077 - DNA, 22 bp, Homo sapiens
cctcagtctgtctgatctgcca

SEQ ID NO: 7638078 - DNA, 22 bp, Homo sapiens
ccaggctctgagcctcactctt

SEQ ID NO: 7638079 - DNA, 22 bp, Homo sapiens
ccaggctctgagaggaatgtga

SEQ ID NO: 7638080 - DNA, 22 bp, Homo sapiens
ccaggctctgagaggaatgtga

SEQ ID NO: 7638081 - DNA, 22 bp, Homo sapiens
ccaggctctgacatagatggga

SEQ ID NO: 7638082 - DNA, 22 bp, Homo sapiens
ccaggctctgacatagatggga

SEQ ID NO: 7638083 - DNA, 22 bp, Homo sapiens
ccaggctctgacatagatggga

SEQ ID NO: 7638084 - DNA, 22 bp, Homo sapiens
ccaggctctgacatagatggga

SEQ ID NO: 7638085 - DNA, 22 bp, Homo sapiens
ccaggctctgagcctcactctt

SEQ ID NO: 7638086 - DNA, 22 bp, Homo sapiens
ccaggctctgagcctcactctt

SEQ ID NO: 7638087 - DNA, 22 bp, Homo sapiens
ccaggctctgagcctcactctt

SEQ ID NO: 7638088 - DNA, 22 bp, Homo sapiens
ccaggctctgagcctcactctt

SEQ ID NO: 7638089 - DNA, 22 bp, Homo sapiens
ccaggctctgagcctcactctt

SEQ ID NO: 7638090 - DNA, 22 bp, Homo sapiens
ccaggctctgcaaaatcaggct

SEQ ID NO: 7638091 - DNA, 22 bp, Homo sapiens
ccaggctctgagcctcactctt

SEQ ID NO: 7638092 - DNA, 22 bp, Homo sapiens
ccaggctctgagcctcactctt

SEQ ID NO: 7638093 - DNA, 22 bp, Homo sapiens
ccaggctctgagcctcactctt

SEQ ID NO: 7638094 - DNA, 22 bp, Homo sapiens
ccaggctctgcgctggacatgg

SEQ ID NO: 7638095 - DNA, 22 bp, Homo sapiens
ccaggctctgcgctggacatgg

SEQ ID NO: 7638096 - DNA, 22 bp, Homo sapiens
ccaggctctgcgctggacatgg

SEQ ID NO: 7638097 - DNA, 22 bp, Homo sapiens
ccaggctctgccaggcccttga

SEQ ID NO: 7638098 - DNA, 22 bp, Homo sapiens
ccaggctctgccaggcccttga

SEQ ID NO: 7638099 - DNA, 22 bp, Homo sapiens
aggctccttgctcacaggctca

SEQ ID NO: 7638100 - DNA, 22 bp, Homo sapiens
ccaggctctgcgctggacatgg

SEQ ID NO: 7638101 - DNA, 22 bp, Homo sapiens
aggctccttgctcacaggctca

SEQ ID NO: 7638102 - DNA, 22 bp, Homo sapiens
aggctccttgctcacaggctca

SEQ ID NO: 7638103 - DNA, 22 bp, Homo sapiens
ccaggctctgccaggcccttga

SEQ ID NO: 7638104 - DNA, 22 bp, Homo sapiens
ccaggctctgccaggcccttga

SEQ ID NO: 7638105 - DNA, 22 bp, Homo sapiens
ccaggctctgccaggcccttga

SEQ ID NO: 7638106 - DNA, 22 bp, Homo sapiens
ccaggctctgcaaaatcaggct

SEQ ID NO: 7638107 - DNA, 22 bp, Homo sapiens
ccaggctctatccctccttctt

SEQ ID NO: 7638108 - DNA, 22 bp, Homo sapiens
ccaggctctatccctccttctt

SEQ ID NO: 7638109 - DNA, 22 bp, Homo sapiens
ccaggctctatccctccttctt

SEQ ID NO: 7638110 - DNA, 21 bp, Homo sapiens
ccaggctcctgaggctggtca

SEQ ID NO: 7638111 - DNA, 22 bp, Homo sapiens
ccaggctctatccctccttctt

SEQ ID NO: 7638112 - DNA, 22 bp, Homo sapiens
ccaggctctgacatagatggga

SEQ ID NO: 7638113 - DNA, 22 bp, Homo sapiens
ccaggctctatccctccttctt

SEQ ID NO: 7638114 - DNA, 22 bp, Homo sapiens
ccaggctctatccctccttctt

SEQ ID NO: 7638115 - DNA, 22 bp, Homo sapiens
ccaggctctatccctccttctt

SEQ ID NO: 7638116 - DNA, 22 bp, Homo sapiens
ccaggctctatccctccttctt

SEQ ID NO: 7638117 - DNA, 22 bp, Homo sapiens
ccaggctctatccctccttctt

SEQ ID NO: 7638118 - DNA, 21 bp, Homo sapiens
aggctcccagaaatgggcatc

SEQ ID NO: 7638119 - DNA, 21 bp, Homo sapiens
aggctcccagaaatgggcatc

SEQ ID NO: 7638120 - DNA, 21 bp, Homo sapiens
aggctcccagaaatgggcatc

SEQ ID NO: 7638121 - DNA, 21 bp, Homo sapiens
aggctcccagaaatgggcatc

SEQ ID NO: 7638122 - DNA, 22 bp, Homo sapiens
aggctcccatggtgtggcagga

SEQ ID NO: 7638123 - DNA, 22 bp, Homo sapiens
aggctcccatggtgtggcagga

SEQ ID NO: 7638124 - DNA, 22 bp, Homo sapiens
aggctcccatggtgtggcagga

SEQ ID NO: 7638125 - DNA, 21 bp, Homo sapiens
ccaggctcctgaggctggtca

SEQ ID NO: 7638126 - DNA, 21 bp, Homo sapiens
ccaggctcctgaggctggtca

SEQ ID NO: 7638127 - DNA, 22 bp, Homo sapiens
aggctcccatggtgtggcagga

SEQ ID NO: 7638128 - DNA, 22 bp, Homo sapiens
aggctccattcatgtgaaggca

SEQ ID NO: 7638129 - DNA, 22 bp, Homo sapiens
aggctccattccaggagctaga

SEQ ID NO: 7638130 - DNA, 22 bp, Homo sapiens
aggctccattccaggagctaga

SEQ ID NO: 7638131 - DNA, 22 bp, Homo sapiens
aggctccattccaggagctaga

SEQ ID NO: 7638132 - DNA, 22 bp, Homo sapiens
aggctccattccaggagctaga

SEQ ID NO: 7638133 - DNA, 22 bp, Homo sapiens
aggctccattttcctgcagctg

SEQ ID NO: 7638134 - DNA, 22 bp, Homo sapiens
aggctccattccaggagctaga

SEQ ID NO: 7638135 - DNA, 22 bp, Homo sapiens
aggctccattttcctgcagctg

SEQ ID NO: 7638136 - DNA, 22 bp, Homo sapiens
aggctccattttcctgcagctg

SEQ ID NO: 7638137 - DNA, 22 bp, Homo sapiens
aggctccattttcctgcagctg

SEQ ID NO: 7638138 - DNA, 22 bp, Homo sapiens
aggctccattttcctgcagctg

SEQ ID NO: 7638139 - DNA, 21 bp, Homo sapiens
aggctcccagaaatgggcatc

SEQ ID NO: 7638140 - DNA, 22 bp, Homo sapiens
aggctcccaagcactgacccca

SEQ ID NO: 7638141 - DNA, 22 bp, Homo sapiens
aggctcccaagcactgacccca

SEQ ID NO: 7638142 - DNA, 22 bp, Homo sapiens
aggctccattttcctgcagctg

SEQ ID NO: 7638143 - DNA, 22 bp, Homo sapiens
aggctcccaagcactgacccca

SEQ ID NO: 7638144 - DNA, 22 bp, Homo sapiens
ccaggcctcacctgcccaccta

SEQ ID NO: 7638145 - DNA, 22 bp, Homo sapiens
ccaggcctcacctgcccaccta

SEQ ID NO: 7638146 - DNA, 22 bp, Homo sapiens
ccaggcctcacctgcccaccta

SEQ ID NO: 7638147 - DNA, 22 bp, Homo sapiens
ccaggcctcacctgcccaccta

SEQ ID NO: 7638148 - DNA, 22 bp, Homo sapiens
ccaggcctcacctgcccaccta

SEQ ID NO: 7638149 - DNA, 22 bp, Homo sapiens
ccaggcctcacctgcccaccta

SEQ ID NO: 7638150 - DNA, 22 bp, Homo sapiens
ccaggcctcacctgcccaccta

SEQ ID NO: 7638151 - DNA, 22 bp, Homo sapiens
ccaggcctcacctgcccaccta

SEQ ID NO: 7638152 - DNA, 22 bp, Homo sapiens
ccaggcctagcccctgagggta

SEQ ID NO: 7638153 - DNA, 22 bp, Homo sapiens
aggctccagtctgaaccttggg

SEQ ID NO: 7638154 - DNA, 22 bp, Homo sapiens
aggctccacggtcactggctct

SEQ ID NO: 7638155 - DNA, 22 bp, Homo sapiens
aggctccacggcaggatgctgt

SEQ ID NO: 7638156 - DNA, 22 bp, Homo sapiens
aggctccacggcaggatgctgt

SEQ ID NO: 7638157 - DNA, 22 bp, Homo sapiens
aggctccatgctaagcgatatg

SEQ ID NO: 7638158 - DNA, 22 bp, Homo sapiens
aggctccatgcaaaggctgttt

SEQ ID NO: 7638159 - DNA, 22 bp, Homo sapiens
aggctccatgcaaaggctgttt

SEQ ID NO: 7638160 - DNA, 22 bp, Homo sapiens
aggctccatgcaaaggctgttt

SEQ ID NO: 7638161 - DNA, 22 bp, Homo sapiens
aggctccatggttctccctcag

SEQ ID NO: 7638162 - DNA, 22 bp, Homo sapiens
aggctccatggttctccctcag

SEQ ID NO: 7638163 - DNA, 22 bp, Homo sapiens
aggctccattcatgtgaaggca

SEQ ID NO: 7638164 - DNA, 22 bp, Homo sapiens
aggctccattcatgtgaaggca

SEQ ID NO: 7638165 - DNA, 22 bp, Homo sapiens
aggctccataccatctccggag

SEQ ID NO: 7638166 - DNA, 22 bp, Homo sapiens
aggctccataccatctccggag

SEQ ID NO: 7638167 - DNA, 22 bp, Homo sapiens
aggctccataccatctccggag

SEQ ID NO: 7638168 - DNA, 22 bp, Homo sapiens
aggctccataccatctccggag

SEQ ID NO: 7638169 - DNA, 22 bp, Homo sapiens
aggctccatgcaaaggctgttt

SEQ ID NO: 7638170 - DNA, 22 bp, Homo sapiens
aggctccatgcaaaggctgttt

SEQ ID NO: 7638171 - DNA, 22 bp, Homo sapiens
ccaggccctgcctgtggttcct

SEQ ID NO: 7638172 - DNA, 22 bp, Homo sapiens
ccaggccctgctcctcacacca

SEQ ID NO: 7638173 - DNA, 22 bp, Homo sapiens
ccaggccctgcctgtggttcct

SEQ ID NO: 7638174 - DNA, 22 bp, Homo sapiens
ccaggccctgctcctcacacca

SEQ ID NO: 7638175 - DNA, 22 bp, Homo sapiens
ccaggccctgctcctcacacca

SEQ ID NO: 7638176 - DNA, 22 bp, Homo sapiens
ccaggccctgctcctcacacca

SEQ ID NO: 7638177 - DNA, 22 bp, Homo sapiens
ccaggccctgcctgtggttcct

SEQ ID NO: 7638178 - DNA, 22 bp, Homo sapiens
ccaggccctgctcctcacacca

SEQ ID NO: 7638179 - DNA, 22 bp, Homo sapiens
ccaggccctgctcctcacacca

SEQ ID NO: 7638180 - DNA, 22 bp, Homo sapiens
ccaggccctgctcctcacacca

SEQ ID NO: 7638181 - DNA, 22 bp, Homo sapiens
ccaggccctgctcctcacacca

SEQ ID NO: 7638182 - DNA, 22 bp, Homo sapiens
ccaggcccgttcccttctccag

SEQ ID NO: 7638183 - DNA, 22 bp, Homo sapiens
ccaggccagagtgcagtggcac

SEQ ID NO: 7638184 - DNA, 22 bp, Homo sapiens
ccaggccagagtgcagtggcac

SEQ ID NO: 7638185 - DNA, 22 bp, Homo sapiens
ccaggcccgttcccttctccag

SEQ ID NO: 7638186 - DNA, 22 bp, Homo sapiens
ccaggcccgttcccttctccag

SEQ ID NO: 7638187 - DNA, 22 bp, Homo sapiens
ccaggcccgttcccttctccag

SEQ ID NO: 7638188 - DNA, 22 bp, Homo sapiens
ccaggcccgttcccttctccag

SEQ ID NO: 7638189 - DNA, 22 bp, Homo sapiens
ccaggcccgttcccttctccag

SEQ ID NO: 7638190 - DNA, 22 bp, Homo sapiens
ccaggccctgcctgtggttcct

SEQ ID NO: 7638191 - DNA, 22 bp, Homo sapiens
ccaggccctgcctgtggttcct

SEQ ID NO: 7638192 - DNA, 22 bp, Homo sapiens
ccaggccctgcctgtggttcct

SEQ ID NO: 7638193 - DNA, 22 bp, Homo sapiens
ccaggccctgcctgtggttcct

SEQ ID NO: 7638194 - DNA, 22 bp, Homo sapiens
ccaggcccgttcccttctccag

SEQ ID NO: 7638195 - DNA, 22 bp, Homo sapiens
ccaggcccgttcccttctccag

SEQ ID NO: 7638196 - DNA, 22 bp, Homo sapiens
ccaggcccttgcaagtcccacc

SEQ ID NO: 7638197 - DNA, 22 bp, Homo sapiens
ccaggcccttgcaagtcccacc

SEQ ID NO: 7638198 - DNA, 22 bp, Homo sapiens
ccaggcccttgcaagtcccacc

SEQ ID NO: 7638199 - DNA, 22 bp, Homo sapiens
ccaggcccttgcaagtcccacc

SEQ ID NO: 7638200 - DNA, 22 bp, Homo sapiens
ccaggcccttgcaagtcccacc

SEQ ID NO: 7638201 - DNA, 22 bp, Homo sapiens
ccaggcccttgcaagtcccacc

SEQ ID NO: 7638202 - DNA, 22 bp, Homo sapiens
ccaggcccttgcaagtcccacc

SEQ ID NO: 7638203 - DNA, 22 bp, Homo sapiens
ccaggccctgctcctcacacca

SEQ ID NO: 7638204 - DNA, 22 bp, Homo sapiens
ccaggccctgctcctcacacca

SEQ ID NO: 7638205 - DNA, 22 bp, Homo sapiens
ccaggcctagcccctgagggta

SEQ ID NO: 7638206 - DNA, 22 bp, Homo sapiens
ccaggcctagcccctgagggta

SEQ ID NO: 7638207 - DNA, 22 bp, Homo sapiens
ccaggcctagcccctgagggta

SEQ ID NO: 7638208 - DNA, 22 bp, Homo sapiens
ccaggcctagcccctgagggta

SEQ ID NO: 7638209 - DNA, 22 bp, Homo sapiens
ccaggcctagcccctgagggta

SEQ ID NO: 7638210 - DNA, 22 bp, Homo sapiens
ccaggcctagcccctgagggta

SEQ ID NO: 7638211 - DNA, 22 bp, Homo sapiens
ccaggcctagcccctgagggta

SEQ ID NO: 7638212 - DNA, 22 bp, Homo sapiens
ccaggcctagcccctgagggta

SEQ ID NO: 7638213 - DNA, 22 bp, Homo sapiens
aggcctcacacaacagatgcat

SEQ ID NO: 7638214 - DNA, 22 bp, Homo sapiens
aggcctcacacaacagatgcat

SEQ ID NO: 7638215 - DNA, 22 bp, Homo sapiens
aggcctcacacaacagatgcat

SEQ ID NO: 7638216 - DNA, 22 bp, Homo sapiens
aggcctcacacaacagatgcat

SEQ ID NO: 7638217 - DNA, 22 bp, Homo sapiens
aggcctcacacaacagatgcat

SEQ ID NO: 7638218 - DNA, 22 bp, Homo sapiens
aggcctagaggaatggccaggg

SEQ ID NO: 7638219 - DNA, 22 bp, Homo sapiens
aggcctagaggaatggccaggg

SEQ ID NO: 7638220 - DNA, 22 bp, Homo sapiens
aggcctagagctttggagggca

SEQ ID NO: 7638221 - DNA, 22 bp, Homo sapiens
aggcctagaggaatggccaggg

SEQ ID NO: 7638222 - DNA, 22 bp, Homo sapiens
aggcctcagcctgccaggcctg

SEQ ID NO: 7638223 - DNA, 22 bp, Homo sapiens
aggcctcagcctgccaggcctg

SEQ ID NO: 7638224 - DNA, 22 bp, Homo sapiens
aggcctcagcctgccaggcctg

SEQ ID NO: 7638225 - DNA, 22 bp, Homo sapiens
aggcctcactctcagagcttct

SEQ ID NO: 7638226 - DNA, 22 bp, Homo sapiens
aggcctcagcctgccaggcctg

SEQ ID NO: 7638227 - DNA, 22 bp, Homo sapiens
aggcctcactctcagagcttct

SEQ ID NO: 7638228 - DNA, 22 bp, Homo sapiens
aggcctcacattgggcttcaag

SEQ ID NO: 7638229 - DNA, 22 bp, Homo sapiens
aggcctcacattgggcttcaag

SEQ ID NO: 7638230 - DNA, 22 bp, Homo sapiens
aggcctcactctcagagcttct

SEQ ID NO: 7638231 - DNA, 22 bp, Homo sapiens
aggcctcacattgggcttcaag

SEQ ID NO: 7638232 - DNA, 22 bp, Homo sapiens
aggcctcacattgggcttcaag

SEQ ID NO: 7638233 - DNA, 22 bp, Homo sapiens
aggcctcagctcagtgtgacag

SEQ ID NO: 7638234 - DNA, 22 bp, Homo sapiens
aggcctcagctcagtgtgacag

SEQ ID NO: 7638235 - DNA, 22 bp, Homo sapiens
aggcctcagctcagtgtgacag

SEQ ID NO: 7638236 - DNA, 22 bp, Homo sapiens
aggcctcagctcagtgtgacag

SEQ ID NO: 7638237 - DNA, 22 bp, Homo sapiens
aggcctcagctcagtgtgacag

SEQ ID NO: 7638238 - DNA, 22 bp, Homo sapiens
aggcctcagctcagtgtgacag

SEQ ID NO: 7638239 - DNA, 22 bp, Homo sapiens
aggcctcaggaaggtaaagaag

SEQ ID NO: 7638240 - DNA, 22 bp, Homo sapiens
aggcctcaggaaggtaaagaag

SEQ ID NO: 7638241 - DNA, 22 bp, Homo sapiens
aggcctcaggaaggtaaagaag

SEQ ID NO: 7638242 - DNA, 22 bp, Homo sapiens
aggcctcagtgatcatcatcag

SEQ ID NO: 7638243 - DNA, 17 bp, Homo sapiens
aggcctcaggtgaaacc

SEQ ID NO: 7638244 - DNA, 17 bp, Homo sapiens
aggcctcaggtgaaacc

SEQ ID NO: 7638245 - DNA, 17 bp, Homo sapiens
aggcctcaggtgaaacc

SEQ ID NO: 7638246 - DNA, 22 bp, Homo sapiens
aggcctcagtttccccagttgt

SEQ ID NO: 7638247 - DNA, 22 bp, Homo sapiens
aggcctcagtttccccagttgt

SEQ ID NO: 7638248 - DNA, 22 bp, Homo sapiens
aggcctcagttcttgccaggtg

SEQ ID NO: 7638249 - DNA, 22 bp, Homo sapiens
aggcctcagtttccccagttgt

SEQ ID NO: 7638250 - DNA, 22 bp, Homo sapiens
aggcctcagttcttgccaggtg

SEQ ID NO: 7638251 - DNA, 22 bp, Homo sapiens
aggcctcagttcttgccaggtg

SEQ ID NO: 7638252 - DNA, 22 bp, Homo sapiens
aggcctcagttcttgccaggtg

SEQ ID NO: 7638253 - DNA, 22 bp, Homo sapiens
aggcctcagttcttgccaggtg

SEQ ID NO: 7638254 - DNA, 22 bp, Homo sapiens
aggcctcagtgatcatcatcag

SEQ ID NO: 7638255 - DNA, 22 bp, Homo sapiens
aggcctcagttcttgccaggtg

SEQ ID NO: 7638256 - DNA, 22 bp, Homo sapiens
aggcctcagtgatcatcatcag

SEQ ID NO: 7638257 - DNA, 22 bp, Homo sapiens
aggcctcagttcttgccaggtg

SEQ ID NO: 7638258 - DNA, 17 bp, Homo sapiens
aggcctccctccaggcc

SEQ ID NO: 7638259 - DNA, 17 bp, Homo sapiens
aggcctccctccaggcc

SEQ ID NO: 7638260 - DNA, 17 bp, Homo sapiens
aggcctccctccaggcc

SEQ ID NO: 7638261 - DNA, 21 bp, Homo sapiens
aggcctccctgttgacagggc

SEQ ID NO: 7638262 - DNA, 21 bp, Homo sapiens
aggcctccctgttgacagggc

SEQ ID NO: 7638263 - DNA, 21 bp, Homo sapiens
aggcctccctgttgacagggc

SEQ ID NO: 7638264 - DNA, 22 bp, Homo sapiens
aggcctcctgcagggatgagtg

SEQ ID NO: 7638265 - DNA, 22 bp, Homo sapiens
aggcctcctgcagggatgagtg

SEQ ID NO: 7638266 - DNA, 22 bp, Homo sapiens
aggcctcctgcagggatgagtg

SEQ ID NO: 7638267 - DNA, 22 bp, Homo sapiens
aggcctccagccacatgccagt

SEQ ID NO: 7638268 - DNA, 22 bp, Homo sapiens
aggcctccagccacatgccagt

SEQ ID NO: 7638269 - DNA, 22 bp, Homo sapiens
aggcctccagccacatgccagt

SEQ ID NO: 7638270 - DNA, 22 bp, Homo sapiens
aggcctccagccacatgccagt

SEQ ID NO: 7638271 - DNA, 22 bp, Homo sapiens
aggcctccagccacatgccagt

SEQ ID NO: 7638272 - DNA, 17 bp, Homo sapiens
aggcctccctccaggcc

SEQ ID NO: 7638273 - DNA, 22 bp, Homo sapiens
aggcctccagctgagttttgct

SEQ ID NO: 7638274 - DNA, 17 bp, Homo sapiens
aggcctccctccaggcc

SEQ ID NO: 7638275 - DNA, 22 bp, Homo sapiens
aggcctccagccacatgccagt

SEQ ID NO: 7638276 - DNA, 22 bp, Homo sapiens
aggcctcattttcactttatgc

SEQ ID NO: 7638277 - DNA, 22 bp, Homo sapiens
aggcctcattgcccacctgtgg

SEQ ID NO: 7638278 - DNA, 22 bp, Homo sapiens
aggcctcattgcccacctgtgg

SEQ ID NO: 7638279 - DNA, 22 bp, Homo sapiens
aggcctcattgcccacctgtgg

SEQ ID NO: 7638280 - DNA, 22 bp, Homo sapiens
aggcctcattgcccacctgtgg

SEQ ID NO: 7638281 - DNA, 22 bp, Homo sapiens
aggcctcattgcccacctgtgg

SEQ ID NO: 7638282 - DNA, 22 bp, Homo sapiens
aggcctcattgcccacctgtgg

SEQ ID NO: 7638283 - DNA, 22 bp, Homo sapiens
aggcctcatgtcaaagcagcaa

SEQ ID NO: 7638284 - DNA, 22 bp, Homo sapiens
aggcctcatgtcaaagcagcaa

SEQ ID NO: 7638285 - DNA, 22 bp, Homo sapiens
aggcctcatagtagacctgccc

SEQ ID NO: 7638286 - DNA, 22 bp, Homo sapiens
aggcctcatgtcaaagcagcaa

SEQ ID NO: 7638287 - DNA, 22 bp, Homo sapiens
aggcctcatgtcaaagcagcaa

SEQ ID NO: 7638288 - DNA, 22 bp, Homo sapiens
aggcctcatgtcaaagcagcaa

SEQ ID NO: 7638289 - DNA, 22 bp, Homo sapiens
aggcctcatagtagacctgccc

SEQ ID NO: 7638290 - DNA, 22 bp, Homo sapiens
aggcctcatagtagacctgccc

SEQ ID NO: 7638291 - DNA, 22 bp, Homo sapiens
aggcctcatagtagacctgccc

SEQ ID NO: 7638292 - DNA, 22 bp, Homo sapiens
aggcctcatagtagacctgccc

SEQ ID NO: 7638293 - DNA, 22 bp, Homo sapiens
aggcctcatagtagacctgccc

SEQ ID NO: 7638294 - DNA, 22 bp, Homo sapiens
aggcctcatagtagacctgccc

SEQ ID NO: 7638295 - DNA, 22 bp, Homo sapiens
aggcctcagtttgtcatctgta

SEQ ID NO: 7638296 - DNA, 22 bp, Homo sapiens
aggcctcatagtagacctgccc

SEQ ID NO: 7638297 - DNA, 22 bp, Homo sapiens
aggcctcagtttgtcatctgta

SEQ ID NO: 7638298 - DNA, 22 bp, Homo sapiens
aggcctcagtttgtcatctgta

SEQ ID NO: 7638299 - DNA, 22 bp, Homo sapiens
aggcctcagtttgtcatctgta

SEQ ID NO: 7638300 - DNA, 22 bp, Homo sapiens
ccaggccaaattcagtcagcag

SEQ ID NO: 7638301 - DNA, 22 bp, Homo sapiens
ccaggccaaattcagtcagcag

SEQ ID NO: 7638302 - DNA, 22 bp, Homo sapiens
ccaggccaaattcagtcagcag

SEQ ID NO: 7638303 - DNA, 22 bp, Homo sapiens
ccaggccagagtgcagtggcac

SEQ ID NO: 7638304 - DNA, 22 bp, Homo sapiens
ccaggccagagtgcagtggcac

SEQ ID NO: 7638305 - DNA, 22 bp, Homo sapiens
ccaggccagagtgcagtggcac

SEQ ID NO: 7638306 - DNA, 22 bp, Homo sapiens
ccaggccaaattcagtcagcag

SEQ ID NO: 7638307 - DNA, 22 bp, Homo sapiens
ccaggccaaattcagtcagcag

SEQ ID NO: 7638308 - DNA, 22 bp, Homo sapiens
ccaggccaaattcagtcagcag

SEQ ID NO: 7638309 - DNA, 22 bp, Homo sapiens
ccaggcattgtgagtgggcagg

SEQ ID NO: 7638310 - DNA, 22 bp, Homo sapiens
ccaggccaaattcagtcagcag

SEQ ID NO: 7638311 - DNA, 22 bp, Homo sapiens
ccaggcattgtgagtgggcagg

SEQ ID NO: 7638312 - DNA, 22 bp, Homo sapiens
ccaggcattgtgagtgggcagg

SEQ ID NO: 7638313 - DNA, 22 bp, Homo sapiens
ccaggcattgtgagtgggcagg

SEQ ID NO: 7638314 - DNA, 22 bp, Homo sapiens
ccaggcattgtgagtgggcagg

SEQ ID NO: 7638315 - DNA, 22 bp, Homo sapiens
ccaggcattgtgagtgggcagg

SEQ ID NO: 7638316 - DNA, 21 bp, Homo sapiens
ccaggcatgactgcagagagc

SEQ ID NO: 7638317 - DNA, 22 bp, Homo sapiens
ccaggcatggggagagccagat

SEQ ID NO: 7638318 - DNA, 22 bp, Homo sapiens
ccaggcatggggagagccagat

SEQ ID NO: 7638319 - DNA, 22 bp, Homo sapiens
ccaggcatggggagagccagat

SEQ ID NO: 7638320 - DNA, 22 bp, Homo sapiens
ccaggcatggggagagccagat

SEQ ID NO: 7638321 - DNA, 21 bp, Homo sapiens
ccaggcatgactgcagagagc

SEQ ID NO: 7638322 - DNA, 21 bp, Homo sapiens
ccaggcatgactgcagagagc

SEQ ID NO: 7638323 - DNA, 21 bp, Homo sapiens
ccaggcatgactgcagagagc

SEQ ID NO: 7638324 - DNA, 22 bp, Homo sapiens
ccaggcagtggaagctaaaatt

SEQ ID NO: 7638325 - DNA, 22 bp, Homo sapiens
ccaggcatcacgggcatgtggc

SEQ ID NO: 7638326 - DNA, 22 bp, Homo sapiens
ccaggcatccattgcttcctct

SEQ ID NO: 7638327 - DNA, 22 bp, Homo sapiens
ccaggcatcacgggcatgtggc

SEQ ID NO: 7638328 - DNA, 22 bp, Homo sapiens
ccaggcagtggaagctaaaatt

SEQ ID NO: 7638329 - DNA, 22 bp, Homo sapiens
ccaggcagtcagggttgtgtgt

SEQ ID NO: 7638330 - DNA, 22 bp, Homo sapiens
ccaggcagtggaagctaaaatt

SEQ ID NO: 7638331 - DNA, 22 bp, Homo sapiens
ccaggcagtggaagctaaaatt

SEQ ID NO: 7638332 - DNA, 22 bp, Homo sapiens
ccaggcagtcagggttgtgtgt

SEQ ID NO: 7638333 - DNA, 22 bp, Homo sapiens
ccaggcagtcagggttgtgtgt

SEQ ID NO: 7638334 - DNA, 22 bp, Homo sapiens
ccaggcagtcagggttgtgtgt

SEQ ID NO: 7638335 - DNA, 22 bp, Homo sapiens
aggcctcctggctccaggcctt

SEQ ID NO: 7638336 - DNA, 22 bp, Homo sapiens
aggcctctctccttggcttgta

SEQ ID NO: 7638337 - DNA, 22 bp, Homo sapiens
aggcctctctccttggcttgta

SEQ ID NO: 7638338 - DNA, 22 bp, Homo sapiens
aggcctctctccttggcttgta

SEQ ID NO: 7638339 - DNA, 22 bp, Homo sapiens
aggcctctctgcttagcttgta

SEQ ID NO: 7638340 - DNA, 22 bp, Homo sapiens
aggcctcctggctccaggcctt

SEQ ID NO: 7638341 - DNA, 22 bp, Homo sapiens
aggcctcctggctccaggcctt

SEQ ID NO: 7638342 - DNA, 22 bp, Homo sapiens
aggcctcctgcagggatgagtg

SEQ ID NO: 7638343 - DNA, 22 bp, Homo sapiens
aggcctcctggctccaggcctt

SEQ ID NO: 7638344 - DNA, 22 bp, Homo sapiens
ccaggcacttcatcattagggt

SEQ ID NO: 7638345 - DNA, 22 bp, Homo sapiens
ccaggcacttcatcattagggt

SEQ ID NO: 7638346 - DNA, 22 bp, Homo sapiens
ccaggcacttcatcattagggt

SEQ ID NO: 7638347 - DNA, 22 bp, Homo sapiens
ccaggcacttcatcattagggt

SEQ ID NO: 7638348 - DNA, 22 bp, Homo sapiens
aggcctctgagcagcactcatg

SEQ ID NO: 7638349 - DNA, 22 bp, Homo sapiens
aggcctctgagcagcactcatg

SEQ ID NO: 7638350 - DNA, 22 bp, Homo sapiens
aggcctctgagcagcactcatg

SEQ ID NO: 7638351 - DNA, 22 bp, Homo sapiens
aggcctctgagcagcactcatg

SEQ ID NO: 7638352 - DNA, 22 bp, Homo sapiens
aggcctctgagcagcactcatg

SEQ ID NO: 7638353 - DNA, 22 bp, Homo sapiens
ccaggcagtcagggttgtgtgt

SEQ ID NO: 7638354 - DNA, 22 bp, Homo sapiens
ccaggcagtcagggttgtgtgt

SEQ ID NO: 7638355 - DNA, 22 bp, Homo sapiens
ccaggcagtcagggttgtgtgt

SEQ ID NO: 7638356 - DNA, 23 bp, Homo sapiens
ccaggcagtagctattgaagtga

SEQ ID NO: 7638357 - DNA, 23 bp, Homo sapiens
ccaggcagtagctattgaagtga

SEQ ID NO: 7638358 - DNA, 23 bp, Homo sapiens
ccaggcagtagctattgaagtga

SEQ ID NO: 7638359 - DNA, 23 bp, Homo sapiens
ccaggcagtagctattgaagtga

SEQ ID NO: 7638360 - DNA, 23 bp, Homo sapiens
ccaggcagtagctattgaagtga

SEQ ID NO: 7638361 - DNA, 23 bp, Homo sapiens
ccaggcagtagctattgaagtga

SEQ ID NO: 7638362 - DNA, 23 bp, Homo sapiens
ccaggcagtagctattgaagtga

SEQ ID NO: 7638363 - DNA, 22 bp, Homo sapiens
ccaggcagggctcaaggaacct

SEQ ID NO: 7638364 - DNA, 22 bp, Homo sapiens
ccaggcagggctcaaggaacct

SEQ ID NO: 7638365 - DNA, 22 bp, Homo sapiens
ccaggcacttcatcattagggt

SEQ ID NO: 7638366 - DNA, 22 bp, Homo sapiens
ccaggcacttgtttgccaggca

SEQ ID NO: 7638367 - DNA, 22 bp, Homo sapiens
ccaggcagggagctgtttggcc

SEQ ID NO: 7638368 - DNA, 22 bp, Homo sapiens
ccaggcagggctcaaggaacct

SEQ ID NO: 7638369 - DNA, 22 bp, Homo sapiens
ccaggcagggctcaaggaacct

SEQ ID NO: 7638370 - DNA, 22 bp, Homo sapiens
ccaggcagggctcaaggaacct

SEQ ID NO: 7638371 - DNA, 22 bp, Homo sapiens
ccaggcagggctcaaggaacct

SEQ ID NO: 7638372 - DNA, 22 bp, Homo sapiens
ccaggcagggctcaaggaacct

SEQ ID NO: 7638373 - DNA, 22 bp, Homo sapiens
ccaggcagggctcaaggaacct

SEQ ID NO: 7638374 - DNA, 22 bp, Homo sapiens
ccaggcagggctcaaggaacct

SEQ ID NO: 7638375 - DNA, 22 bp, Homo sapiens
aggctgaggcaggtggatcact

SEQ ID NO: 7638376 - DNA, 22 bp, Homo sapiens
aggctgaggcaggtggatcact

SEQ ID NO: 7638377 - DNA, 22 bp, Homo sapiens
aggctgaggcaggtggatcact

SEQ ID NO: 7638378 - DNA, 22 bp, Homo sapiens
aggctgaggcaggtggatcact

SEQ ID NO: 7638379 - DNA, 22 bp, Homo sapiens
aggctgaggcaggtggatcact

SEQ ID NO: 7638380 - DNA, 22 bp, Homo sapiens
aggctgaggcaggtggatcatt

SEQ ID NO: 7638381 - DNA, 22 bp, Homo sapiens
aggctgaggcaggtggatcact

SEQ ID NO: 7638382 - DNA, 22 bp, Homo sapiens
aggctgaggcaggtggatcact

SEQ ID NO: 7638383 - DNA, 22 bp, Homo sapiens
aggctgaggcaggtggatcact

SEQ ID NO: 7638384 - DNA, 22 bp, Homo sapiens
aggctgaggcaggtggatcact

SEQ ID NO: 7638385 - DNA, 22 bp, Homo sapiens
aggctgaggcaggtggatcact

SEQ ID NO: 7638386 - DNA, 22 bp, Homo sapiens
ccagtgcaccatttccctctgt

SEQ ID NO: 7638387 - DNA, 22 bp, Homo sapiens
ccagtgcacagccaggcaggtg

SEQ ID NO: 7638388 - DNA, 22 bp, Homo sapiens
ccagtgcaccaagaggcctaga

SEQ ID NO: 7638389 - DNA, 22 bp, Homo sapiens
ccagtgcaccaagaggcctaga

SEQ ID NO: 7638390 - DNA, 22 bp, Homo sapiens
ccagtgcaccaagaggcctaga

SEQ ID NO: 7638391 - DNA, 22 bp, Homo sapiens
ccagtgcaccaagaggcctaga

SEQ ID NO: 7638392 - DNA, 22 bp, Homo sapiens
ccagtgcaccatttccctctgt

SEQ ID NO: 7638393 - DNA, 22 bp, Homo sapiens
aggctgaggcaggtggatcatt

SEQ ID NO: 7638394 - DNA, 22 bp, Homo sapiens
aggctgaggcaggtggatcatt

SEQ ID NO: 7638395 - DNA, 22 bp, Homo sapiens
aggctgaggcaggtggatcatt

SEQ ID NO: 7638396 - DNA, 22 bp, Homo sapiens
aggctgaggcaggtggatcatt

SEQ ID NO: 7638397 - DNA, 22 bp, Homo sapiens
aggctgaggcaggtggatcatt

SEQ ID NO: 7638398 - DNA, 22 bp, Homo sapiens
aggctgaggcaggtggatcatt

SEQ ID NO: 7638399 - DNA, 22 bp, Homo sapiens
aggctgaggcaggtggatcatt

SEQ ID NO: 7638400 - DNA, 22 bp, Homo sapiens
aggctgaggcaggtggatcatt

SEQ ID NO: 7638401 - DNA, 22 bp, Homo sapiens
aggctgaggcgggaggatcact

SEQ ID NO: 7638402 - DNA, 22 bp, Homo sapiens
aggctgaggcgggaggatcact

SEQ ID NO: 7638403 - DNA, 22 bp, Homo sapiens
aggctgaggcgggaggatcact

SEQ ID NO: 7638404 - DNA, 22 bp, Homo sapiens
aggctgaggcgggaggatcact

SEQ ID NO: 7638405 - DNA, 22 bp, Homo sapiens
aggctgaggcgggaggatcact

SEQ ID NO: 7638406 - DNA, 22 bp, Homo sapiens
aggctgaggcaggtggatcatt

SEQ ID NO: 7638407 - DNA, 22 bp, Homo sapiens
aggctgaggcgggaggatcact

SEQ ID NO: 7638408 - DNA, 22 bp, Homo sapiens
aggctgaggcgggaggatcact

SEQ ID NO: 7638409 - DNA, 22 bp, Homo sapiens
aggctgaggcgggaggatcact

SEQ ID NO: 7638410 - DNA, 22 bp, Homo sapiens
aggctgaggcgggaggatcact

SEQ ID NO: 7638411 - DNA, 22 bp, Homo sapiens
aggctgaggcgggaggatcact

SEQ ID NO: 7638412 - DNA, 23 bp, Homo sapiens
ccagtttatctttagtgtagatc

SEQ ID NO: 7638413 - DNA, 22 bp, Homo sapiens
ccagtttcttaagtaggaagaa

SEQ ID NO: 7638414 - DNA, 20 bp, Homo sapiens
ccagtttctttcccagcctc

SEQ ID NO: 7638415 - DNA, 22 bp, Homo sapiens
ccagtttataagaaagaaaacc

SEQ ID NO: 7638416 - DNA, 22 bp, Homo sapiens
ccagtttataagaaagaaaacc

SEQ ID NO: 7638417 - DNA, 23 bp, Homo sapiens
ccagtttatctttagtgtagatc

SEQ ID NO: 7638418 - DNA, 22 bp, Homo sapiens
ccagtttaggacacatgcccac

SEQ ID NO: 7638419 - DNA, 22 bp, Homo sapiens
ccagtttaagacttatctcaat

SEQ ID NO: 7638420 - DNA, 22 bp, Homo sapiens
ccagtttaagacttatctcaat

SEQ ID NO: 7638421 - DNA, 22 bp, Homo sapiens
ccagtttaagacttatctcaat

SEQ ID NO: 7638422 - DNA, 22 bp, Homo sapiens
ccagttgtttgccttgaaatga

SEQ ID NO: 7638423 - DNA, 22 bp, Homo sapiens
ccagttgttccctgtcagagat

SEQ ID NO: 7638424 - DNA, 22 bp, Homo sapiens
ccagttggtttcaatgggacag

SEQ ID NO: 7638425 - DNA, 22 bp, Homo sapiens
ccagttggtttcaatgggacag

SEQ ID NO: 7638426 - DNA, 22 bp, Homo sapiens
ccagttctgagatgaatatcca

SEQ ID NO: 7638427 - DNA, 22 bp, Homo sapiens
ccagttctttctgtgtgcaaca

SEQ ID NO: 7638428 - DNA, 22 bp, Homo sapiens
ccagttgggatttgtcctggtt

SEQ ID NO: 7638429 - DNA, 22 bp, Homo sapiens
ccagttctttctgtgtgcaaca

SEQ ID NO: 7638430 - DNA, 23 bp, Homo sapiens
ccagttctcctttgaacagtgac

SEQ ID NO: 7638431 - DNA, 22 bp, Homo sapiens
ccagttctgagatgaatatcca

SEQ ID NO: 7638432 - DNA, 22 bp, Homo sapiens
ccagttctaaacataaagctaa

SEQ ID NO: 7638433 - DNA, 22 bp, Homo sapiens
ccagttctaaacataaagctaa

SEQ ID NO: 7638434 - DNA, 22 bp, Homo sapiens
ccagttctaaacataaagctaa

SEQ ID NO: 7638435 - DNA, 22 bp, Homo sapiens
ccagttctaaacataaagctaa

SEQ ID NO: 7638436 - DNA, 22 bp, Homo sapiens
ccagtgtgcattatcatgtgtc

SEQ ID NO: 7638437 - DNA, 22 bp, Homo sapiens
ccagtgtgcattatcatgtgtc

SEQ ID NO: 7638438 - DNA, 22 bp, Homo sapiens
ccagtgtgcattatcatgtgtc

SEQ ID NO: 7638439 - DNA, 22 bp, Homo sapiens
ccagtgtgcattatcatgtgtc

SEQ ID NO: 7638440 - DNA, 22 bp, Homo sapiens
ccagtgtgcaatctctggctta

SEQ ID NO: 7638441 - DNA, 22 bp, Homo sapiens
ccagtgtgcattatcatgtgtc

SEQ ID NO: 7638442 - DNA, 22 bp, Homo sapiens
aggctgaggcgggaggatcact

SEQ ID NO: 7638443 - DNA, 22 bp, Homo sapiens
aggctgaggcgggaggatcact

SEQ ID NO: 7638444 - DNA, 22 bp, Homo sapiens
aggctgaggcgggaggatcact

SEQ ID NO: 7638445 - DNA, 22 bp, Homo sapiens
aggctgaggcgggaggatcact

SEQ ID NO: 7638446 - DNA, 22 bp, Homo sapiens
ccagtgtgcattatcatgtgtc

SEQ ID NO: 7638447 - DNA, 22 bp, Homo sapiens
ccagtgtgccaatttacagctg

SEQ ID NO: 7638448 - DNA, 22 bp, Homo sapiens
ccagttatccagcatgctgtct

SEQ ID NO: 7638449 - DNA, 22 bp, Homo sapiens
ccagttcatacacttagaaatt

SEQ ID NO: 7638450 - DNA, 22 bp, Homo sapiens
ccagttcaccagtggcagaagt

SEQ ID NO: 7638451 - DNA, 22 bp, Homo sapiens
ccagttccagtgctcacatcca

SEQ ID NO: 7638452 - DNA, 22 bp, Homo sapiens
aggctgagcggggtcccagagc

SEQ ID NO: 7638453 - DNA, 22 bp, Homo sapiens
aggctgagcggggtcccagagc

SEQ ID NO: 7638454 - DNA, 22 bp, Homo sapiens
aggctgagcggggtcccagagc

SEQ ID NO: 7638455 - DNA, 22 bp, Homo sapiens
aggctgagcctgggcgtggtgg

SEQ ID NO: 7638456 - DNA, 22 bp, Homo sapiens
aggctgagcctgggcgtggtgg

SEQ ID NO: 7638457 - DNA, 22 bp, Homo sapiens
aggctgagcctgggcgtggtgg

SEQ ID NO: 7638458 - DNA, 22 bp, Homo sapiens
aggctgagcggggtcccagagc

SEQ ID NO: 7638459 - DNA, 22 bp, Homo sapiens
aggctgagcggggtcccagagc

SEQ ID NO: 7638460 - DNA, 22 bp, Homo sapiens
aggctgagcggggtcccagagc

SEQ ID NO: 7638461 - DNA, 23 bp, Homo sapiens
aggctgagctctcccagcttcag

SEQ ID NO: 7638462 - DNA, 23 bp, Homo sapiens
aggctgagctctcccagcttcag

SEQ ID NO: 7638463 - DNA, 22 bp, Homo sapiens
aggctgagcggggtcccagagc

SEQ ID NO: 7638464 - DNA, 23 bp, Homo sapiens
aggctgagctctcccagcttcag

SEQ ID NO: 7638465 - DNA, 23 bp, Homo sapiens
aggctgagctctcccagcttcag

SEQ ID NO: 7638466 - DNA, 23 bp, Homo sapiens
aggctgagctctcccagcttcag

SEQ ID NO: 7638467 - DNA, 23 bp, Homo sapiens
aggctgagctctcccagcttcag

SEQ ID NO: 7638468 - DNA, 22 bp, Homo sapiens
ccagtctgtactttgctctgtt

SEQ ID NO: 7638469 - DNA, 22 bp, Homo sapiens
ccagtctggcaggagggggaac

SEQ ID NO: 7638470 - DNA, 22 bp, Homo sapiens
ccagtctgtactttgctctgtt

SEQ ID NO: 7638471 - DNA, 22 bp, Homo sapiens
ccagtctgtactttgctctgtt

SEQ ID NO: 7638472 - DNA, 22 bp, Homo sapiens
ccagtctggcaggagggggaac

SEQ ID NO: 7638473 - DNA, 22 bp, Homo sapiens
ccagtcactggaaaatgggaat

SEQ ID NO: 7638474 - DNA, 22 bp, Homo sapiens
ccagtcactggaaaatgggaat

SEQ ID NO: 7638475 - DNA, 22 bp, Homo sapiens
ccagtcactggaaaatgggaat

SEQ ID NO: 7638476 - DNA, 23 bp, Homo sapiens
aggctgagctctcccagcttcag

SEQ ID NO: 7638477 - DNA, 23 bp, Homo sapiens
aggctgagctctcccagcttcag

SEQ ID NO: 7638478 - DNA, 22 bp, Homo sapiens
aggctgagctgacctggtttgg

SEQ ID NO: 7638479 - DNA, 22 bp, Homo sapiens
ccagtcacaggtgtgtttatat

SEQ ID NO: 7638480 - DNA, 22 bp, Homo sapiens
ccagtcactctgtgagagctac

SEQ ID NO: 7638481 - DNA, 22 bp, Homo sapiens
ccagtcactctgtgagagctac

SEQ ID NO: 7638482 - DNA, 22 bp, Homo sapiens
ccagtcactctgtgagagctac

SEQ ID NO: 7638483 - DNA, 22 bp, Homo sapiens
ccagtcactctgtgagagctac

SEQ ID NO: 7638484 - DNA, 23 bp, Homo sapiens
ccagtgattgcctggaaggaggt

SEQ ID NO: 7638485 - DNA, 23 bp, Homo sapiens
ccagtgattgcctggaaggaggt

SEQ ID NO: 7638486 - DNA, 23 bp, Homo sapiens
ccagtgattgcctggaaggaggt

SEQ ID NO: 7638487 - DNA, 23 bp, Homo sapiens
ccagtgattgcctggaaggaggt

SEQ ID NO: 7638488 - DNA, 23 bp, Homo sapiens
ccagtgattgcctggaaggaggt

SEQ ID NO: 7638489 - DNA, 22 bp, Homo sapiens
ccagtgatggtgatcagatgtt

SEQ ID NO: 7638490 - DNA, 22 bp, Homo sapiens
ccagtgattcattcatttacct

SEQ ID NO: 7638491 - DNA, 23 bp, Homo sapiens
ccagtgattgcctggaaggaggt

SEQ ID NO: 7638492 - DNA, 23 bp, Homo sapiens
ccagtgattgcctggaaggaggt

SEQ ID NO: 7638493 - DNA, 22 bp, Homo sapiens
ccagtgcacagccaggcaggtg

SEQ ID NO: 7638494 - DNA, 22 bp, Homo sapiens
ccagtgcacagccaggcaggtg

SEQ ID NO: 7638495 - DNA, 22 bp, Homo sapiens
ccagtgcacagccaggcaggtg

SEQ ID NO: 7638496 - DNA, 22 bp, Homo sapiens
ccagtgatttagtacaatgtag

SEQ ID NO: 7638497 - DNA, 19 bp, Homo sapiens
ccagtgcaaggtaagatag

SEQ ID NO: 7638498 - DNA, 22 bp, Homo sapiens
ccagtctgtgtgccagcctgcg

SEQ ID NO: 7638499 - DNA, 22 bp, Homo sapiens
ccagtctgtgtgccagcctgcg

SEQ ID NO: 7638500 - DNA, 22 bp, Homo sapiens
ccagtctgttctcacctctgag

SEQ ID NO: 7638501 - DNA, 22 bp, Homo sapiens
ccagtctgttctcacctctgag

SEQ ID NO: 7638502 - DNA, 22 bp, Homo sapiens
ccagtgactggctttctggtgt

SEQ ID NO: 7638503 - DNA, 22 bp, Homo sapiens
ccagtctgttctcacctctgag

SEQ ID NO: 7638504 - DNA, 22 bp, Homo sapiens
ccagtctgtgtgccagcctgcg

SEQ ID NO: 7638505 - DNA, 22 bp, Homo sapiens
ccagtctgtgtgccagcctgcg

SEQ ID NO: 7638506 - DNA, 22 bp, Homo sapiens
ccagtctgtgtgccagcctgcg

SEQ ID NO: 7638507 - DNA, 22 bp, Homo sapiens
ccagtgagaatgaagataaggc

SEQ ID NO: 7638508 - DNA, 22 bp, Homo sapiens
ccagtgagaatgaagataaggc

SEQ ID NO: 7638509 - DNA, 22 bp, Homo sapiens
ccagtgagaatgaagataaggc

SEQ ID NO: 7638510 - DNA, 22 bp, Homo sapiens
ccagtgagaatgaagataaggc

SEQ ID NO: 7638511 - DNA, 22 bp, Homo sapiens
ccagtgagatatctgggcatta

SEQ ID NO: 7638512 - DNA, 22 bp, Homo sapiens
ccagtgactggctttctggtgt

SEQ ID NO: 7638513 - DNA, 22 bp, Homo sapiens
ccagtgactggctttctggtgt

SEQ ID NO: 7638514 - DNA, 22 bp, Homo sapiens
ccagtgacttgccaggtggatc

SEQ ID NO: 7638515 - DNA, 22 bp, Homo sapiens
ccagtgacttgccaggtggatc

SEQ ID NO: 7638516 - DNA, 22 bp, Homo sapiens
ccagtgacttgccaggtggatc

SEQ ID NO: 7638517 - DNA, 22 bp, Homo sapiens
ccagtgacttgccaggtggatc

SEQ ID NO: 7638518 - DNA, 23 bp, Homo sapiens
ccagtgagcatggctgtgttcca

SEQ ID NO: 7638519 - DNA, 23 bp, Homo sapiens
ccagtgagcatggctgtgttcca

SEQ ID NO: 7638520 - DNA, 22 bp, Homo sapiens
ccagtgagatatctgggcatta

SEQ ID NO: 7638521 - DNA, 22 bp, Homo sapiens
ccagtgatctgacaccaaatca

SEQ ID NO: 7638522 - DNA, 22 bp, Homo sapiens
ccagtgatgataggaagaccct

SEQ ID NO: 7638523 - DNA, 22 bp, Homo sapiens
ccagtgatggtgatcagatgtt

SEQ ID NO: 7638524 - DNA, 22 bp, Homo sapiens
ccagtgatggtgatcagatgtt

SEQ ID NO: 7638525 - DNA, 21 bp, Homo sapiens
ccagtgattcaatgaaaacag

SEQ ID NO: 7638526 - DNA, 19 bp, Homo sapiens
aggctctgagctcctggag

SEQ ID NO: 7638527 - DNA, 19 bp, Homo sapiens
aggctctgagctcctggag

SEQ ID NO: 7638528 - DNA, 19 bp, Homo sapiens
aggctctgagctcctggag

SEQ ID NO: 7638529 - DNA, 19 bp, Homo sapiens
aggctctgagctcctggag

SEQ ID NO: 7638530 - DNA, 19 bp, Homo sapiens
aggctctgagctcctggag

SEQ ID NO: 7638531 - DNA, 22 bp, Homo sapiens
aggctccttgttcatcatccat

SEQ ID NO: 7638532 - DNA, 22 bp, Homo sapiens
aggctccttgttcatcatccat

SEQ ID NO: 7638533 - DNA, 22 bp, Homo sapiens
aggctccttgttcatcatccat

SEQ ID NO: 7638534 - DNA, 19 bp, Homo sapiens
aggctctgagctcctggag

SEQ ID NO: 7638535 - DNA, 19 bp, Homo sapiens
aggctctgagctcctggag

SEQ ID NO: 7638536 - DNA, 22 bp, Homo sapiens
aggctctgaggcagattttcgt

SEQ ID NO: 7638537 - DNA, 19 bp, Homo sapiens
aggctctgagctcctggag

SEQ ID NO: 7638538 - DNA, 22 bp, Homo sapiens
aggctctgagtagagctgccag

SEQ ID NO: 7638539 - DNA, 22 bp, Homo sapiens
ccaggctctgcgctggacatgg

SEQ ID NO: 7638540 - DNA, 22 bp, Homo sapiens
aggctctgaggcagattttcgt

SEQ ID NO: 7638541 - DNA, 22 bp, Homo sapiens
aggctctgagtagagctgccag

SEQ ID NO: 7638542 - DNA, 22 bp, Homo sapiens
aggctctgagtagagctgccag

SEQ ID NO: 7638543 - DNA, 22 bp, Homo sapiens
aggctctgagtagagctgccag

SEQ ID NO: 7638544 - DNA, 22 bp, Homo sapiens
aggctctgagtagagctgccag

SEQ ID NO: 7638545 - DNA, 22 bp, Homo sapiens
aggctctgagtctggtgtctgc

SEQ ID NO: 7638546 - DNA, 22 bp, Homo sapiens
aggctctgagtctggtgtctgc

SEQ ID NO: 7638547 - DNA, 22 bp, Homo sapiens
aggctctgagtagagctgccag

SEQ ID NO: 7638548 - DNA, 22 bp, Homo sapiens
aggctctgagtagagctgccag

SEQ ID NO: 7638549 - DNA, 22 bp, Homo sapiens
aggctctgagtagagctgccag

SEQ ID NO: 7638550 - DNA, 22 bp, Homo sapiens
aggctctgatcaggtggctgtg

SEQ ID NO: 7638551 - DNA, 22 bp, Homo sapiens
aggctctgagtctggtgtctgc

SEQ ID NO: 7638552 - DNA, 22 bp, Homo sapiens
aggctctgagtctggtgtctgc

SEQ ID NO: 7638553 - DNA, 22 bp, Homo sapiens
aggctctgagtctggtgtctgc

SEQ ID NO: 7638554 - DNA, 22 bp, Homo sapiens
aggctctgagtctggtgtctgc

SEQ ID NO: 7638555 - DNA, 22 bp, Homo sapiens
aggctctgatcaggtggctgtg

SEQ ID NO: 7638556 - DNA, 22 bp, Homo sapiens
aggctctgatcaggtggctgtg

SEQ ID NO: 7638557 - DNA, 22 bp, Homo sapiens
aggctctgatcaggtggctgtg

SEQ ID NO: 7638558 - DNA, 22 bp, Homo sapiens
aggctctgatcaggtggctgtg

SEQ ID NO: 7638559 - DNA, 22 bp, Homo sapiens
aggctctgatgcaagcccaggg

SEQ ID NO: 7638560 - DNA, 22 bp, Homo sapiens
aggctctgatcaggtggctgtg

SEQ ID NO: 7638561 - DNA, 22 bp, Homo sapiens
aggctctgatcaggtggctgtg

SEQ ID NO: 7638562 - DNA, 20 bp, Homo sapiens
aggctctgcatttctgagtg

SEQ ID NO: 7638563 - DNA, 22 bp, Homo sapiens
aggctctgcatccaggctttat

SEQ ID NO: 7638564 - DNA, 20 bp, Homo sapiens
aggctctgcatttctgagtg

SEQ ID NO: 7638565 - DNA, 20 bp, Homo sapiens
aggctctgcatttctgagtg

SEQ ID NO: 7638566 - DNA, 22 bp, Homo sapiens
aggctctgcatccaggctttat

SEQ ID NO: 7638567 - DNA, 22 bp, Homo sapiens
aggctctgcagtgctggaggac

SEQ ID NO: 7638568 - DNA, 22 bp, Homo sapiens
aggctctgcagtgctggaggac

SEQ ID NO: 7638569 - DNA, 22 bp, Homo sapiens
aggctctgcagtgctggaggac

SEQ ID NO: 7638570 - DNA, 22 bp, Homo sapiens
aggctctgcagtgctggaggac

SEQ ID NO: 7638571 - DNA, 22 bp, Homo sapiens
aggctctgcagtgctggaggac

SEQ ID NO: 7638572 - DNA, 22 bp, Homo sapiens
aggctctgcagtccatcccgtg

SEQ ID NO: 7638573 - DNA, 22 bp, Homo sapiens
aggctctgcagtccatcccgtg

SEQ ID NO: 7638574 - DNA, 22 bp, Homo sapiens
aggctctgcagtgctggaggac

SEQ ID NO: 7638575 - DNA, 22 bp, Homo sapiens
aggctctgcagtgctggaggac

SEQ ID NO: 7638576 - DNA, 22 bp, Homo sapiens
aggctctgcaggtatttcttga

SEQ ID NO: 7638577 - DNA, 22 bp, Homo sapiens
aggctctgatgcaagcccaggg

SEQ ID NO: 7638578 - DNA, 22 bp, Homo sapiens
aggctctgcagaccccagctgt

SEQ ID NO: 7638579 - DNA, 22 bp, Homo sapiens
aggctctgcagaccccagctgt

SEQ ID NO: 7638580 - DNA, 22 bp, Homo sapiens
aggctctgcagtccatcccgtg

SEQ ID NO: 7638581 - DNA, 22 bp, Homo sapiens
aggctctgcagtccatcccgtg

SEQ ID NO: 7638582 - DNA, 22 bp, Homo sapiens
aggctctgcagtccatcccgtg

SEQ ID NO: 7638583 - DNA, 22 bp, Homo sapiens
aggctctgcagtccatcccgtg

SEQ ID NO: 7638584 - DNA, 22 bp, Homo sapiens
aggctctgcagaccccagctgt

SEQ ID NO: 7638585 - DNA, 22 bp, Homo sapiens
aggctctgcagaccccagctgt

SEQ ID NO: 7638586 - DNA, 22 bp, Homo sapiens
aggctctgcagaccccagctgt

SEQ ID NO: 7638587 - DNA, 22 bp, Homo sapiens
aggctctgcagaccccagctgt

SEQ ID NO: 7638588 - DNA, 22 bp, Homo sapiens
aggctctgatgcaagcccaggg

SEQ ID NO: 7638589 - DNA, 22 bp, Homo sapiens
aggctctgatgcaagcccaggg

SEQ ID NO: 7638590 - DNA, 22 bp, Homo sapiens
aggctctgatgcaagcccaggg

SEQ ID NO: 7638591 - DNA, 22 bp, Homo sapiens
aggctctgatgcaagcccaggg

SEQ ID NO: 7638592 - DNA, 22 bp, Homo sapiens
aggctctgatgcaagcccaggg

SEQ ID NO: 7638593 - DNA, 22 bp, Homo sapiens
aggctgagataggtggatcatt

SEQ ID NO: 7638594 - DNA, 22 bp, Homo sapiens
aggctgagataggtggatcatt

SEQ ID NO: 7638595 - DNA, 22 bp, Homo sapiens
aggctgagataggtggatcatt

SEQ ID NO: 7638596 - DNA, 22 bp, Homo sapiens
aggctgagataggtggatcatt

SEQ ID NO: 7638597 - DNA, 22 bp, Homo sapiens
aggctgagataggtggatcatt

SEQ ID NO: 7638598 - DNA, 22 bp, Homo sapiens
aggctgagagcaacgtgtcaga

SEQ ID NO: 7638599 - DNA, 22 bp, Homo sapiens
aggctgagataggtggatcatt

SEQ ID NO: 7638600 - DNA, 22 bp, Homo sapiens
aggctgagataggtggatcatt

SEQ ID NO: 7638601 - DNA, 22 bp, Homo sapiens
aggctgagataggtggatcatt

SEQ ID NO: 7638602 - DNA, 22 bp, Homo sapiens
aggctgagataggtggatcatt

SEQ ID NO: 7638603 - DNA, 22 bp, Homo sapiens
aggctgagataggtggatcatt

SEQ ID NO: 7638604 - DNA, 22 bp, Homo sapiens
aggctgagcaaagggccttacc

SEQ ID NO: 7638605 - DNA, 22 bp, Homo sapiens
aggctgagcaaagggccttacc

SEQ ID NO: 7638606 - DNA, 22 bp, Homo sapiens
aggctgagcaaagggccttacc

SEQ ID NO: 7638607 - DNA, 22 bp, Homo sapiens
aggctgagcaaagggccttacc

SEQ ID NO: 7638608 - DNA, 22 bp, Homo sapiens
aggctgagcaaagggccttacc

SEQ ID NO: 7638609 - DNA, 22 bp, Homo sapiens
aggctgagcaaagggccttacc

SEQ ID NO: 7638610 - DNA, 22 bp, Homo sapiens
aggctgagccacggggctggct

SEQ ID NO: 7638611 - DNA, 22 bp, Homo sapiens
aggctgagcaaagggccttacc

SEQ ID NO: 7638612 - DNA, 22 bp, Homo sapiens
aggctgagccacggggctggct

SEQ ID NO: 7638613 - DNA, 22 bp, Homo sapiens
aggctgagccacggggctggct

SEQ ID NO: 7638614 - DNA, 22 bp, Homo sapiens
aggctgagccacggggctggct

SEQ ID NO: 7638615 - DNA, 22 bp, Homo sapiens
aggctgagccacggggctggct

SEQ ID NO: 7638616 - DNA, 22 bp, Homo sapiens
aggctgagccacggggctggct

SEQ ID NO: 7638617 - DNA, 22 bp, Homo sapiens
aggctgagcaaagggccttacc

SEQ ID NO: 7638618 - DNA, 22 bp, Homo sapiens
aggctgagccacggggctggct

SEQ ID NO: 7638619 - DNA, 22 bp, Homo sapiens
aggctgagccacggggctggct

SEQ ID NO: 7638620 - DNA, 22 bp, Homo sapiens
aggctgagccacggggctggct

SEQ ID NO: 7638621 - DNA, 22 bp, Homo sapiens
aggctgagcctgggcgtggtgg

SEQ ID NO: 7638622 - DNA, 22 bp, Homo sapiens
aggctgagcctgggcgtggtgg

SEQ ID NO: 7638623 - DNA, 22 bp, Homo sapiens
aggctgagcctgggcgtggtgg

SEQ ID NO: 7638624 - DNA, 22 bp, Homo sapiens
aggctgagcctgggcgtggtgg

SEQ ID NO: 7638625 - DNA, 22 bp, Homo sapiens
aggctgagccacggggctggct

SEQ ID NO: 7638626 - DNA, 22 bp, Homo sapiens
aggctgagccacggggctggct

SEQ ID NO: 7638627 - DNA, 22 bp, Homo sapiens
aggctgagagcaacgtgtcaga

SEQ ID NO: 7638628 - DNA, 22 bp, Homo sapiens
aggctgagagcaacgtgtcaga

SEQ ID NO: 7638629 - DNA, 22 bp, Homo sapiens
aggctgagagcaacgtgtcaga

SEQ ID NO: 7638630 - DNA, 22 bp, Homo sapiens
aggctgagagcaacgtgtcaga

SEQ ID NO: 7638631 - DNA, 22 bp, Homo sapiens
aggctgagagcaacgtgtcaga

SEQ ID NO: 7638632 - DNA, 22 bp, Homo sapiens
aggctgagagcaacgtgtcaga

SEQ ID NO: 7638633 - DNA, 22 bp, Homo sapiens
aggctgagactgtgcattagtg

SEQ ID NO: 7638634 - DNA, 22 bp, Homo sapiens
aggctgagactgtgcattagtg

SEQ ID NO: 7638635 - DNA, 22 bp, Homo sapiens
aggctgagactgtgcattagtg

SEQ ID NO: 7638636 - DNA, 22 bp, Homo sapiens
aggctctgttattctagagggc

SEQ ID NO: 7638637 - DNA, 22 bp, Homo sapiens
aggctctgttattctagagggc

SEQ ID NO: 7638638 - DNA, 22 bp, Homo sapiens
aggctctgttattctagagggc

SEQ ID NO: 7638639 - DNA, 22 bp, Homo sapiens
aggctctgttattctagagggc

SEQ ID NO: 7638640 - DNA, 22 bp, Homo sapiens
aggctctgttattctagagggc

SEQ ID NO: 7638641 - DNA, 20 bp, Homo sapiens
aggctctgcctgcaggccca

SEQ ID NO: 7638642 - DNA, 20 bp, Homo sapiens
aggctctgcctgcaggccca

SEQ ID NO: 7638643 - DNA, 22 bp, Homo sapiens
aggctctgttattctagagggc

SEQ ID NO: 7638644 - DNA, 22 bp, Homo sapiens
aggctctgttattctagagggc

SEQ ID NO: 7638645 - DNA, 22 bp, Homo sapiens
aggctctgttattctagagggc

SEQ ID NO: 7638646 - DNA, 22 bp, Homo sapiens
aggctctgttattctagagggc

SEQ ID NO: 7638647 - DNA, 22 bp, Homo sapiens
aggctctgccaattccttcctc

SEQ ID NO: 7638648 - DNA, 22 bp, Homo sapiens
aggctctgccaattccttcctc

SEQ ID NO: 7638649 - DNA, 22 bp, Homo sapiens
aggctctgccaattccttcctc

SEQ ID NO: 7638650 - DNA, 20 bp, Homo sapiens
aggctctgcatttctgagtg

SEQ ID NO: 7638651 - DNA, 20 bp, Homo sapiens
aggctctgcatttctgagtg

SEQ ID NO: 7638652 - DNA, 20 bp, Homo sapiens
aggctctgcctgcaggccca

SEQ ID NO: 7638653 - DNA, 20 bp, Homo sapiens
aggctctgcctgcaggccca

SEQ ID NO: 7638654 - DNA, 20 bp, Homo sapiens
aggctctgcctgcaggccca

SEQ ID NO: 7638655 - DNA, 20 bp, Homo sapiens
aggctctgccattgtccctg

SEQ ID NO: 7638656 - DNA, 20 bp, Homo sapiens
aggctctgccattgtccctg

SEQ ID NO: 7638657 - DNA, 20 bp, Homo sapiens
aggctctgccattgtccctg

SEQ ID NO: 7638658 - DNA, 22 bp, Homo sapiens
aggctctgccaattccttcctc

SEQ ID NO: 7638659 - DNA, 22 bp, Homo sapiens
aggctctgccaattccttcctc

SEQ ID NO: 7638660 - DNA, 22 bp, Homo sapiens
aggctctgccaattccttcctc

SEQ ID NO: 7638661 - DNA, 20 bp, Homo sapiens
aggctctgccattgtccctg

SEQ ID NO: 7638662 - DNA, 22 bp, Homo sapiens
aggcagtggaaggagaaagcaa

SEQ ID NO: 7638663 - DNA, 22 bp, Homo sapiens
aggcagtgctgtgccctgaacc

SEQ ID NO: 7638664 - DNA, 22 bp, Homo sapiens
aggcagtgctgtgccctgaacc

SEQ ID NO: 7638665 - DNA, 22 bp, Homo sapiens
aggcagtgctgtgccctgaacc

SEQ ID NO: 7638666 - DNA, 22 bp, Homo sapiens
aggcagtggaaggagaaagcaa

SEQ ID NO: 7638667 - DNA, 22 bp, Homo sapiens
aggcagtggaaggagaaagcaa

SEQ ID NO: 7638668 - DNA, 22 bp, Homo sapiens
aggcagtggaaggagaaagcaa

SEQ ID NO: 7638669 - DNA, 22 bp, Homo sapiens
aggcagtggaaggagaaagcaa

SEQ ID NO: 7638670 - DNA, 22 bp, Homo sapiens
aggcagtggaaggagaaagcaa

SEQ ID NO: 7638671 - DNA, 22 bp, Homo sapiens
aggcagtggagctggaataggc

SEQ ID NO: 7638672 - DNA, 22 bp, Homo sapiens
aggcagtggagctggaataggc

SEQ ID NO: 7638673 - DNA, 22 bp, Homo sapiens
aggcagtggagctggaataggc

SEQ ID NO: 7638674 - DNA, 22 bp, Homo sapiens
aggcagtggagctggaataggc

SEQ ID NO: 7638675 - DNA, 22 bp, Homo sapiens
aggcagtggagctggaataggc

SEQ ID NO: 7638676 - DNA, 22 bp, Homo sapiens
aggcagtggagctggaataggc

SEQ ID NO: 7638677 - DNA, 22 bp, Homo sapiens
aggcagtggagaaggtttgtga

SEQ ID NO: 7638678 - DNA, 22 bp, Homo sapiens
aggcagtggagaaggtttgtga

SEQ ID NO: 7638679 - DNA, 22 bp, Homo sapiens
aggcagtggagctggaataggc

SEQ ID NO: 7638680 - DNA, 22 bp, Homo sapiens
aggcagtggagctggaataggc

SEQ ID NO: 7638681 - DNA, 22 bp, Homo sapiens
aggcagtggagctggaataggc

SEQ ID NO: 7638682 - DNA, 22 bp, Homo sapiens
aggcagtggagctggaataggc

SEQ ID NO: 7638683 - DNA, 22 bp, Homo sapiens
aggcagtggatgtcaggaatgg

SEQ ID NO: 7638684 - DNA, 22 bp, Homo sapiens
aggcagtggatgtcaggaatgg

SEQ ID NO: 7638685 - DNA, 22 bp, Homo sapiens
aggcagtggatgtcaggaatgg

SEQ ID NO: 7638686 - DNA, 22 bp, Homo sapiens
aggcagtggagctggaataggc

SEQ ID NO: 7638687 - DNA, 22 bp, Homo sapiens
aggcagtggatgtcaggaatgg

SEQ ID NO: 7638688 - DNA, 22 bp, Homo sapiens
aggcagtggctgagaccagggg

SEQ ID NO: 7638689 - DNA, 22 bp, Homo sapiens
aggcagtggctgagaccagggg

SEQ ID NO: 7638690 - DNA, 22 bp, Homo sapiens
aggcagtggctgagaccagggg

SEQ ID NO: 7638691 - DNA, 22 bp, Homo sapiens
aggcagtggctgagaccagggg

SEQ ID NO: 7638692 - DNA, 22 bp, Homo sapiens
aggcagtggctgagaccagggg

SEQ ID NO: 7638693 - DNA, 22 bp, Homo sapiens
aggcagtggatgtcaggaatgg

SEQ ID NO: 7638694 - DNA, 22 bp, Homo sapiens
aggcagtggctgagaccagggg

SEQ ID NO: 7638695 - DNA, 22 bp, Homo sapiens
aggcagtggctgagaccagggg

SEQ ID NO: 7638696 - DNA, 22 bp, Homo sapiens
aggcagtggctgagaccagggg

SEQ ID NO: 7638697 - DNA, 22 bp, Homo sapiens
aggcagtgcagagtcctcttct

SEQ ID NO: 7638698 - DNA, 22 bp, Homo sapiens
aggcagtgcatgcaaaggtcgg

SEQ ID NO: 7638699 - DNA, 22 bp, Homo sapiens
aggcagtgcatgcaaaggtcgg

SEQ ID NO: 7638700 - DNA, 22 bp, Homo sapiens
aggcagtgcagagtcctcttct

SEQ ID NO: 7638701 - DNA, 22 bp, Homo sapiens
aggcagtgcctggaccccagct

SEQ ID NO: 7638702 - DNA, 22 bp, Homo sapiens
aggcagtgcctggaccccagct

SEQ ID NO: 7638703 - DNA, 22 bp, Homo sapiens
aggcagtgcatgcaaaggtcgg

SEQ ID NO: 7638704 - DNA, 22 bp, Homo sapiens
aggcagtgctcaagacagcagc

SEQ ID NO: 7638705 - DNA, 22 bp, Homo sapiens
aggcagtgctcaagacagcagc

SEQ ID NO: 7638706 - DNA, 22 bp, Homo sapiens
aggcagtgctcaagacagcagc

SEQ ID NO: 7638707 - DNA, 22 bp, Homo sapiens
aggcagtgctcaagacagcagc

SEQ ID NO: 7638708 - DNA, 22 bp, Homo sapiens
aggcagtgctcaagacagcagc

SEQ ID NO: 7638709 - DNA, 22 bp, Homo sapiens
aggcagtgctcaagacagcagc

SEQ ID NO: 7638710 - DNA, 22 bp, Homo sapiens
aggcagtgctcaagacagcagc

SEQ ID NO: 7638711 - DNA, 22 bp, Homo sapiens
aggcagtgctcaagacagcagc

SEQ ID NO: 7638712 - DNA, 22 bp, Homo sapiens
aggcagtgctcaagacagcagc

SEQ ID NO: 7638713 - DNA, 22 bp, Homo sapiens
aggcagtgagtgtgacttcaca

SEQ ID NO: 7638714 - DNA, 22 bp, Homo sapiens
aggcagtgagtgtgacttcaca

SEQ ID NO: 7638715 - DNA, 22 bp, Homo sapiens
aggcagtgagtgtgacttcaca

SEQ ID NO: 7638716 - DNA, 22 bp, Homo sapiens
aggcagtgatgagtcatgaata

SEQ ID NO: 7638717 - DNA, 22 bp, Homo sapiens
aggcagtgatgagtcatgaata

SEQ ID NO: 7638718 - DNA, 22 bp, Homo sapiens
aggcagtgcagagtcctcttct

SEQ ID NO: 7638719 - DNA, 22 bp, Homo sapiens
aggcagtgcagagtcctcttct

SEQ ID NO: 7638720 - DNA, 22 bp, Homo sapiens
aggcagtgcagagtcctcttct

SEQ ID NO: 7638721 - DNA, 22 bp, Homo sapiens
aggcagtgagaaatagcaagat

SEQ ID NO: 7638722 - DNA, 22 bp, Homo sapiens
aggcagtgagaaatagcaagat

SEQ ID NO: 7638723 - DNA, 22 bp, Homo sapiens
aggcagtctatctctggagcct

SEQ ID NO: 7638724 - DNA, 22 bp, Homo sapiens
aggcagtgagaaatagcaagat

SEQ ID NO: 7638725 - DNA, 22 bp, Homo sapiens
aggcagtgagcagggtgtcatg

SEQ ID NO: 7638726 - DNA, 22 bp, Homo sapiens
aggcagtgagcagggtgtcatg

SEQ ID NO: 7638727 - DNA, 22 bp, Homo sapiens
aggcagtctatctctggagcct

SEQ ID NO: 7638728 - DNA, 22 bp, Homo sapiens
aggcagtgagcagggtgtcatg

SEQ ID NO: 7638729 - DNA, 22 bp, Homo sapiens
aggcagtgagcagggtgtcatg

SEQ ID NO: 7638730 - DNA, 22 bp, Homo sapiens
aggcagtgagcagggtgtcatg

SEQ ID NO: 7638731 - DNA, 22 bp, Homo sapiens
aggcagtgagcagggtgtcatg

SEQ ID NO: 7638732 - DNA, 22 bp, Homo sapiens
aggcagtgagcagggtgtcatg

SEQ ID NO: 7638733 - DNA, 23 bp, Homo sapiens
aggcaggtttgggctcttcttgt

SEQ ID NO: 7638734 - DNA, 22 bp, Homo sapiens
aggcagtcagccctgctagggt

SEQ ID NO: 7638735 - DNA, 22 bp, Homo sapiens
aggcagtcagccctgctagggt

SEQ ID NO: 7638736 - DNA, 22 bp, Homo sapiens
aggcagtcagccctgctagggt

SEQ ID NO: 7638737 - DNA, 19 bp, Homo sapiens
aggcagtcattggaatata

SEQ ID NO: 7638738 - DNA, 22 bp, Homo sapiens
aggcagtctatctctggagcct

SEQ ID NO: 7638739 - DNA, 22 bp, Homo sapiens
aggcagtctatctctggagcct

SEQ ID NO: 7638740 - DNA, 22 bp, Homo sapiens
aggcagtctagtccccaggcaa

SEQ ID NO: 7638741 - DNA, 19 bp, Homo sapiens
aggcagtcattggaatata

SEQ ID NO: 7638742 - DNA, 22 bp, Homo sapiens
aggcagtccccaggggtgttgc

SEQ ID NO: 7638743 - DNA, 23 bp, Homo sapiens
aggcaggtttgggctcttcttgt

SEQ ID NO: 7638744 - DNA, 23 bp, Homo sapiens
aggcaggtttgggctcttcttgt

SEQ ID NO: 7638745 - DNA, 22 bp, Homo sapiens
aggcaggtttactcttatttgg

SEQ ID NO: 7638746 - DNA, 22 bp, Homo sapiens
aggcaggtttcccggctgtcaa

SEQ ID NO: 7638747 - DNA, 22 bp, Homo sapiens
aggcaggtttcccggctgtcaa

SEQ ID NO: 7638748 - DNA, 22 bp, Homo sapiens
aggcaggttggtgagaagactg

SEQ ID NO: 7638749 - DNA, 18 bp, Homo sapiens
aggcaggtgctaatattt

SEQ ID NO: 7638750 - DNA, 18 bp, Homo sapiens
aggcaggtgctggaagtc

SEQ ID NO: 7638751 - DNA, 22 bp, Homo sapiens
aggcaggttggtgagaagactg

SEQ ID NO: 7638752 - DNA, 22 bp, Homo sapiens
aggcaggttggtgagaagactg

SEQ ID NO: 7638753 - DNA, 22 bp, Homo sapiens
aggcaggttggtgagaagactg

SEQ ID NO: 7638754 - DNA, 22 bp, Homo sapiens
aggcagcctttagacagtctgc

SEQ ID NO: 7638755 - DNA, 22 bp, Homo sapiens
aggcagcctttttggaaacata

SEQ ID NO: 7638756 - DNA, 22 bp, Homo sapiens
aggcagcctttttggaaacata

SEQ ID NO: 7638757 - DNA, 22 bp, Homo sapiens
aggcagcctggtttgaatggaa

SEQ ID NO: 7638758 - DNA, 22 bp, Homo sapiens
aggcagcctggtttgaatggaa

SEQ ID NO: 7638759 - DNA, 22 bp, Homo sapiens
aggcagcctggtttgaatggaa

SEQ ID NO: 7638760 - DNA, 22 bp, Homo sapiens
aggcagcctttagacagtctgc

SEQ ID NO: 7638761 - DNA, 22 bp, Homo sapiens
aggcagcctttagacagtctgc

SEQ ID NO: 7638762 - DNA, 22 bp, Homo sapiens
aggcagccatccaggaggctca

SEQ ID NO: 7638763 - DNA, 22 bp, Homo sapiens
aggcagccatccaggaggctca

SEQ ID NO: 7638764 - DNA, 22 bp, Homo sapiens
aggcagccatccaggaggctca

SEQ ID NO: 7638765 - DNA, 22 bp, Homo sapiens
aggcagccatccaggaggctca

SEQ ID NO: 7638766 - DNA, 22 bp, Homo sapiens
aggcagccatccaggaggctca

SEQ ID NO: 7638767 - DNA, 22 bp, Homo sapiens
aggcagccatctgcaggaagga

SEQ ID NO: 7638768 - DNA, 22 bp, Homo sapiens
aggcagccatctgcaggaagga

SEQ ID NO: 7638769 - DNA, 22 bp, Homo sapiens
aggcagccatctgcaggaagga

SEQ ID NO: 7638770 - DNA, 22 bp, Homo sapiens
aggcagccatctgcaggaagga

SEQ ID NO: 7638771 - DNA, 22 bp, Homo sapiens
aggcagccatctgcaggaagga

SEQ ID NO: 7638772 - DNA, 22 bp, Homo sapiens
aggcagccatctgcaggaagga

SEQ ID NO: 7638773 - DNA, 22 bp, Homo sapiens
aggcagccattaccaagggcat

SEQ ID NO: 7638774 - DNA, 22 bp, Homo sapiens
aggcagccattaccaagggcat

SEQ ID NO: 7638775 - DNA, 22 bp, Homo sapiens
aggcagccattaccaagggcat

SEQ ID NO: 7638776 - DNA, 22 bp, Homo sapiens
aggcagcccacaggacacagga

SEQ ID NO: 7638777 - DNA, 22 bp, Homo sapiens
aggcagcccacaggacacagga

SEQ ID NO: 7638778 - DNA, 22 bp, Homo sapiens
aggcagcccacaggacacagga

SEQ ID NO: 7638779 - DNA, 22 bp, Homo sapiens
aggcagccattaccaagggcat

SEQ ID NO: 7638780 - DNA, 22 bp, Homo sapiens
aggcagccctgtgctggatgct

SEQ ID NO: 7638781 - DNA, 22 bp, Homo sapiens
aggcagccctgtgctggatgct

SEQ ID NO: 7638782 - DNA, 22 bp, Homo sapiens
aggcagccctgtgctggatgct

SEQ ID NO: 7638783 - DNA, 22 bp, Homo sapiens
aggcagccctgtgctggatgct

SEQ ID NO: 7638784 - DNA, 22 bp, Homo sapiens
aggcagcccacaggacacagga

SEQ ID NO: 7638785 - DNA, 22 bp, Homo sapiens
aggcagcccacaggacacagga

SEQ ID NO: 7638786 - DNA, 22 bp, Homo sapiens
aggcagcccacaggacacagga

SEQ ID NO: 7638787 - DNA, 22 bp, Homo sapiens
aggcagcctatggggagctcag

SEQ ID NO: 7638788 - DNA, 22 bp, Homo sapiens
aggcagcctatggggagctcag

SEQ ID NO: 7638789 - DNA, 22 bp, Homo sapiens
aggcagccctgtgctggatgct

SEQ ID NO: 7638790 - DNA, 22 bp, Homo sapiens
aggcagcctatggggagctcag

SEQ ID NO: 7638791 - DNA, 22 bp, Homo sapiens
aggcagcctatggggagctcag

SEQ ID NO: 7638792 - DNA, 22 bp, Homo sapiens
aggcagccctgtgctggatgct

SEQ ID NO: 7638793 - DNA, 22 bp, Homo sapiens
aggcagccctgtgctggatgct

SEQ ID NO: 7638794 - DNA, 22 bp, Homo sapiens
aggcagcctggtttgaatggaa

SEQ ID NO: 7638795 - DNA, 22 bp, Homo sapiens
aggcagcctggtttgaatggaa

SEQ ID NO: 7638796 - DNA, 22 bp, Homo sapiens
aggcagcctatggggagctcag

SEQ ID NO: 7638797 - DNA, 22 bp, Homo sapiens
aggcagcctatggggagctcag

SEQ ID NO: 7638798 - DNA, 22 bp, Homo sapiens
aggcagcctatggggagctcag

SEQ ID NO: 7638799 - DNA, 22 bp, Homo sapiens
aggcagtggcttttgttgtgtt

SEQ ID NO: 7638800 - DNA, 22 bp, Homo sapiens
aggcagtggcttttgttgtgtt

SEQ ID NO: 7638801 - DNA, 22 bp, Homo sapiens
aggcagtggcttttgttgtgtt

SEQ ID NO: 7638802 - DNA, 23 bp, Homo sapiens
aggcagtgggggccactttgctt

SEQ ID NO: 7638803 - DNA, 23 bp, Homo sapiens
aggcagtgggggccactttgctt

SEQ ID NO: 7638804 - DNA, 23 bp, Homo sapiens
aggcagtgggggccactttgctt

SEQ ID NO: 7638805 - DNA, 22 bp, Homo sapiens
aggcagtggcttttgttgtgtt

SEQ ID NO: 7638806 - DNA, 22 bp, Homo sapiens
aggcagtggcttttgttgtgtt

SEQ ID NO: 7638807 - DNA, 22 bp, Homo sapiens
aggcagttgagtggctttttca

SEQ ID NO: 7638808 - DNA, 21 bp, Homo sapiens
aggcagttgagcatgttatga

SEQ ID NO: 7638809 - DNA, 21 bp, Homo sapiens
aggcagttgagcatgttatga

SEQ ID NO: 7638810 - DNA, 21 bp, Homo sapiens
aggcagttgagcatgttatga

SEQ ID NO: 7638811 - DNA, 22 bp, Homo sapiens
aggcagttctcgtgtgtgtccc

SEQ ID NO: 7638812 - DNA, 22 bp, Homo sapiens
aggcagttctcgtgtgtgtccc

SEQ ID NO: 7638813 - DNA, 23 bp, Homo sapiens
aggcagtggtggtaacatgtcaa

SEQ ID NO: 7638814 - DNA, 23 bp, Homo sapiens
aggcagtggtggtaacatgtcaa

SEQ ID NO: 7638815 - DNA, 23 bp, Homo sapiens
aggcagtggtggtaacatgtcaa

SEQ ID NO: 7638816 - DNA, 22 bp, Homo sapiens
aggcataggacatctatgtcat

SEQ ID NO: 7638817 - DNA, 22 bp, Homo sapiens
aggcatatgattgtaaccttta

SEQ ID NO: 7638818 - DNA, 22 bp, Homo sapiens
aggcatcaggagtatagccaga

SEQ ID NO: 7638819 - DNA, 22 bp, Homo sapiens
aggcatcaggagtatagccaga

SEQ ID NO: 7638820 - DNA, 22 bp, Homo sapiens
aggcatcaggagtatagccaga

SEQ ID NO: 7638821 - DNA, 22 bp, Homo sapiens
aggcatccatggtggtcgctga

SEQ ID NO: 7638822 - DNA, 22 bp, Homo sapiens
aggcagtttatccccagagcct

SEQ ID NO: 7638823 - DNA, 20 bp, Homo sapiens
aggcagtttcaattttgtta

SEQ ID NO: 7638824 - DNA, 22 bp, Homo sapiens
aggcagtttctgggacagcata

SEQ ID NO: 7638825 - DNA, 22 bp, Homo sapiens
aggcataaccttttatctggat

SEQ ID NO: 7638826 - DNA, 22 bp, Homo sapiens
aggcataaccttttatctggat

SEQ ID NO: 7638827 - DNA, 22 bp, Homo sapiens
aggcagttgtagagagggctct

SEQ ID NO: 7638828 - DNA, 22 bp, Homo sapiens
aggcagttgttgctgagcagct

SEQ ID NO: 7638829 - DNA, 22 bp, Homo sapiens
aggcagttgttgctgagcagct

SEQ ID NO: 7638830 - DNA, 22 bp, Homo sapiens
aggcagtttaggcagcgattta

SEQ ID NO: 7638831 - DNA, 22 bp, Homo sapiens
aggcagttgagtggctttttca

SEQ ID NO: 7638832 - DNA, 22 bp, Homo sapiens
aggcagtttatccccagagcct

SEQ ID NO: 7638833 - DNA, 22 bp, Homo sapiens
aggcatgactttggctgaagaa

SEQ ID NO: 7638834 - DNA, 22 bp, Homo sapiens
aggcatgactttggctgaagaa

SEQ ID NO: 7638835 - DNA, 22 bp, Homo sapiens
aggcatgactttggctgaagaa

SEQ ID NO: 7638836 - DNA, 23 bp, Homo sapiens
aggcatcttctgagttaagagca

SEQ ID NO: 7638837 - DNA, 21 bp, Homo sapiens
aggcatgagccctgcatggac

SEQ ID NO: 7638838 - DNA, 22 bp, Homo sapiens
aggcatgactttggctgaagaa

SEQ ID NO: 7638839 - DNA, 21 bp, Homo sapiens
aggcatgagccctgcatggac

SEQ ID NO: 7638840 - DNA, 21 bp, Homo sapiens
aggcatgagccctgcatggac

SEQ ID NO: 7638841 - DNA, 17 bp, Homo sapiens
aggcatgaggcatcact

SEQ ID NO: 7638842 - DNA, 22 bp, Homo sapiens
aggcatgatgtgcagtggcaaa

SEQ ID NO: 7638843 - DNA, 22 bp, Homo sapiens
aggcatgatgtgcagtggcaaa

SEQ ID NO: 7638844 - DNA, 22 bp, Homo sapiens
aggcatgatgtgcagtggcaaa

SEQ ID NO: 7638845 - DNA, 22 bp, Homo sapiens
ccactgctagagatgcatcccc

SEQ ID NO: 7638846 - DNA, 22 bp, Homo sapiens
aggcatgcaaacagtctagagt

SEQ ID NO: 7638847 - DNA, 22 bp, Homo sapiens
ccactgctagagatgcatcccc

SEQ ID NO: 7638848 - DNA, 22 bp, Homo sapiens
aggcatgatgtgcagtggcaaa

SEQ ID NO: 7638849 - DNA, 22 bp, Homo sapiens
aggcatgatgtgcagtggcaaa

SEQ ID NO: 7638850 - DNA, 22 bp, Homo sapiens
aggcatgatgtgcagtggcaaa

SEQ ID NO: 7638851 - DNA, 22 bp, Homo sapiens
aggcatctctctgcttctgagc

SEQ ID NO: 7638852 - DNA, 22 bp, Homo sapiens
aggcatctgagatttttatact

SEQ ID NO: 7638853 - DNA, 20 bp, Homo sapiens
aggcatctgagtcacatctt

SEQ ID NO: 7638854 - DNA, 22 bp, Homo sapiens
aggcatctatacattatgttca

SEQ ID NO: 7638855 - DNA, 22 bp, Homo sapiens
aggcatctctctgcttctgagc

SEQ ID NO: 7638856 - DNA, 22 bp, Homo sapiens
aggcatctctctgcttctgagc

SEQ ID NO: 7638857 - DNA, 21 bp, Homo sapiens
aggcatctaaagagagtagac

SEQ ID NO: 7638858 - DNA, 21 bp, Homo sapiens
aggcatctaaagagagtagac

SEQ ID NO: 7638859 - DNA, 22 bp, Homo sapiens
aggcatcctctctgccttgagg

SEQ ID NO: 7638860 - DNA, 21 bp, Homo sapiens
aggcatctaaagagagtagac

SEQ ID NO: 7638861 - DNA, 22 bp, Homo sapiens
aggcatctgagatttttatact

SEQ ID NO: 7638862 - DNA, 20 bp, Homo sapiens
aggcatctgagtcacatctt

SEQ ID NO: 7638863 - DNA, 22 bp, Homo sapiens
aggcatctgagtttgcaagctt

SEQ ID NO: 7638864 - DNA, 22 bp, Homo sapiens
aggcatctgagtttgcaagctt

SEQ ID NO: 7638865 - DNA, 22 bp, Homo sapiens
aggcatctgctgcccttctgga

SEQ ID NO: 7638866 - DNA, 22 bp, Homo sapiens
aggcatctgctgcccttctgga

SEQ ID NO: 7638867 - DNA, 23 bp, Homo sapiens
aggcatcttctgagttaagagca

SEQ ID NO: 7638868 - DNA, 22 bp, Homo sapiens
aggcatctgctgcccttctgga

SEQ ID NO: 7638869 - DNA, 21 bp, Homo sapiens
aggcattataaatttcacctg

SEQ ID NO: 7638870 - DNA, 22 bp, Homo sapiens
aggcattctagaagtagaagta

SEQ ID NO: 7638871 - DNA, 22 bp, Homo sapiens
aggcattagttgtaaagtattg

SEQ ID NO: 7638872 - DNA, 22 bp, Homo sapiens
aggcattacatctaaatattta

SEQ ID NO: 7638873 - DNA, 22 bp, Homo sapiens
aggcatgtgaccctggactcag

SEQ ID NO: 7638874 - DNA, 22 bp, Homo sapiens
aggcatgttaatcatcttaaaa

SEQ ID NO: 7638875 - DNA, 19 bp, Homo sapiens
aggcattgttctttagcaa

SEQ ID NO: 7638876 - DNA, 22 bp, Homo sapiens
aggcatttaaagatgtaagact

SEQ ID NO: 7638877 - DNA, 22 bp, Homo sapiens
aggcatttaaagatgtaagact

SEQ ID NO: 7638878 - DNA, 22 bp, Homo sapiens
aggcattgctggtattggaagt

SEQ ID NO: 7638879 - DNA, 22 bp, Homo sapiens
aggcatttgatgaagattggct

SEQ ID NO: 7638880 - DNA, 22 bp, Homo sapiens
aggcatttgagtccatgggtga

SEQ ID NO: 7638881 - DNA, 22 bp, Homo sapiens
aggcatttcctatgggcagaga

SEQ ID NO: 7638882 - DNA, 22 bp, Homo sapiens
aggcatttggctgtcatttgta

SEQ ID NO: 7638883 - DNA, 19 bp, Homo sapiens
ccactggggctccacatta

SEQ ID NO: 7638884 - DNA, 19 bp, Homo sapiens
ccactggggctccacatta

SEQ ID NO: 7638885 - DNA, 22 bp, Homo sapiens
ccactgggcgtttctgtccaat

SEQ ID NO: 7638886 - DNA, 22 bp, Homo sapiens
ccactgggcgtttctgtccaat

SEQ ID NO: 7638887 - DNA, 22 bp, Homo sapiens
ccactgggcgtttctgtccaat

SEQ ID NO: 7638888 - DNA, 22 bp, Homo sapiens
ccactgggcgtttctgtccaat

SEQ ID NO: 7638889 - DNA, 22 bp, Homo sapiens
ccactggcttttcctaggtctc

SEQ ID NO: 7638890 - DNA, 22 bp, Homo sapiens
ccactggctgtcagcaggactc

SEQ ID NO: 7638891 - DNA, 22 bp, Homo sapiens
ccactgggcgtttctgtccaat

SEQ ID NO: 7638892 - DNA, 22 bp, Homo sapiens
ccactgggcgtttctgtccaat

SEQ ID NO: 7638893 - DNA, 22 bp, Homo sapiens
aggcatggcatggggcagatgt

SEQ ID NO: 7638894 - DNA, 22 bp, Homo sapiens
aggcatggcatggggcagatgt

SEQ ID NO: 7638895 - DNA, 20 bp, Homo sapiens
aggcatgtcccagtttctcc

SEQ ID NO: 7638896 - DNA, 20 bp, Homo sapiens
aggcatgtcccagtttctcc

SEQ ID NO: 7638897 - DNA, 22 bp, Homo sapiens
aggcatgtcggattgttgtatt

SEQ ID NO: 7638898 - DNA, 22 bp, Homo sapiens
aggcatgtcggattgttgtatt

SEQ ID NO: 7638899 - DNA, 22 bp, Homo sapiens
aggcatgtcttcctttgagtgt

SEQ ID NO: 7638900 - DNA, 22 bp, Homo sapiens
aggcatggcatggggcagatgt

SEQ ID NO: 7638901 - DNA, 22 bp, Homo sapiens
aggcatggcatggggcagatgt

SEQ ID NO: 7638902 - DNA, 19 bp, Homo sapiens
ccactggggctccacatta

SEQ ID NO: 7638903 - DNA, 22 bp, Homo sapiens
aggcatggcatggggcagatgt

SEQ ID NO: 7638904 - DNA, 22 bp, Homo sapiens
aggcatggcatggggcagatgt

SEQ ID NO: 7638905 - DNA, 22 bp, Homo sapiens
aggcatggcatggggcagatgt

SEQ ID NO: 7638906 - DNA, 23 bp, Homo sapiens
ccactgctttcattttgtcatgg

SEQ ID NO: 7638907 - DNA, 23 bp, Homo sapiens
ccactgctttcattttgtcatgg

SEQ ID NO: 7638908 - DNA, 22 bp, Homo sapiens
ccactggaaatgacacgtcact

SEQ ID NO: 7638909 - DNA, 22 bp, Homo sapiens
ccactggaaatgacacgtcact

SEQ ID NO: 7638910 - DNA, 22 bp, Homo sapiens
ccactgctgttacttacgcaaa

SEQ ID NO: 7638911 - DNA, 22 bp, Homo sapiens
ccactgctgttacttacgcaaa

SEQ ID NO: 7638912 - DNA, 22 bp, Homo sapiens
ccactggaagatgctgaggtca

SEQ ID NO: 7638913 - DNA, 22 bp, Homo sapiens
ccactggaagatgctgaggtca

SEQ ID NO: 7638914 - DNA, 22 bp, Homo sapiens
ccactggaagatgctgaggtca

SEQ ID NO: 7638915 - DNA, 23 bp, Homo sapiens
ccactggagaaagtggcaggtgg

SEQ ID NO: 7638916 - DNA, 23 bp, Homo sapiens
ccactggagaaagtggcaggtgg

SEQ ID NO: 7638917 - DNA, 22 bp, Homo sapiens
ccactggagaacgtctgatgaa

SEQ ID NO: 7638918 - DNA, 22 bp, Homo sapiens
ccactggagaacgtctgatgaa

SEQ ID NO: 7638919 - DNA, 22 bp, Homo sapiens
ccactgctgttacttacgcaaa

SEQ ID NO: 7638920 - DNA, 21 bp, Homo sapiens
ccactgctcttccctagggcc

SEQ ID NO: 7638921 - DNA, 21 bp, Homo sapiens
ccactgctcttccctagggcc

SEQ ID NO: 7638922 - DNA, 22 bp, Homo sapiens
ccactgctctgccaggagctgg

SEQ ID NO: 7638923 - DNA, 22 bp, Homo sapiens
ccactgctcggcctcaaagaag

SEQ ID NO: 7638924 - DNA, 22 bp, Homo sapiens
ccactgctctgccaggagctgg

SEQ ID NO: 7638925 - DNA, 22 bp, Homo sapiens
ccactgctctgccaggagctgg

SEQ ID NO: 7638926 - DNA, 22 bp, Homo sapiens
ccactgctcctgaccaaggtca

SEQ ID NO: 7638927 - DNA, 22 bp, Homo sapiens
ccactgctcctgaccaaggtca

SEQ ID NO: 7638928 - DNA, 22 bp, Homo sapiens
ccactggcatccagctgccatc

SEQ ID NO: 7638929 - DNA, 22 bp, Homo sapiens
ccactggctgtcagcaggactc

SEQ ID NO: 7638930 - DNA, 22 bp, Homo sapiens
ccactggcatccagctgccatc

SEQ ID NO: 7638931 - DNA, 22 bp, Homo sapiens
ccactggcagttggctagcctt

SEQ ID NO: 7638932 - DNA, 22 bp, Homo sapiens
ccactggcatccagctgccatc

SEQ ID NO: 7638933 - DNA, 22 bp, Homo sapiens
ccactggcagttggctagcctt

SEQ ID NO: 7638934 - DNA, 22 bp, Homo sapiens
ccactggcagttggctagcctt

SEQ ID NO: 7638935 - DNA, 22 bp, Homo sapiens
ccactggagactggtctctgtg

SEQ ID NO: 7638936 - DNA, 22 bp, Homo sapiens
ccactggagactggtctctgtg

SEQ ID NO: 7638937 - DNA, 22 bp, Homo sapiens
ccactggagactggtctctgtg

SEQ ID NO: 7638938 - DNA, 22 bp, Homo sapiens
ccactggagactggtctctgtg

SEQ ID NO: 7638939 - DNA, 22 bp, Homo sapiens
ccactggcaaccccgcctcata

SEQ ID NO: 7638940 - DNA, 22 bp, Homo sapiens
ccactggcaaccccgcctcata

SEQ ID NO: 7638941 - DNA, 22 bp, Homo sapiens
ccactggagatgtcagacaggt

SEQ ID NO: 7638942 - DNA, 22 bp, Homo sapiens
ccactggattttcttactgtag

SEQ ID NO: 7638943 - DNA, 22 bp, Homo sapiens
ccactggattttcttactgtag

SEQ ID NO: 7638944 - DNA, 22 bp, Homo sapiens
aggcatttttgttaatctttgg

SEQ ID NO: 7638945 - DNA, 22 bp, Homo sapiens
aggcatttttgttaatctttgg

SEQ ID NO: 7638946 - DNA, 22 bp, Homo sapiens
aggcatttttgttaatctttgg

SEQ ID NO: 7638947 - DNA, 22 bp, Homo sapiens
aggccaaaccggatggaaaagg

SEQ ID NO: 7638948 - DNA, 22 bp, Homo sapiens
aggccaaagcacagagctggaa

SEQ ID NO: 7638949 - DNA, 22 bp, Homo sapiens
aggcattttctgtatggacaga

SEQ ID NO: 7638950 - DNA, 22 bp, Homo sapiens
aggcattttgttcaagatgaca

SEQ ID NO: 7638951 - DNA, 22 bp, Homo sapiens
aggcatttttattgtccttaaa

SEQ ID NO: 7638952 - DNA, 22 bp, Homo sapiens
aggcatttttattgtccttaaa

SEQ ID NO: 7638953 - DNA, 22 bp, Homo sapiens
aggcatttggctgtcatttgta

SEQ ID NO: 7638954 - DNA, 22 bp, Homo sapiens
aggcattttaagatgctctgca

SEQ ID NO: 7638955 - DNA, 22 bp, Homo sapiens
aggcattttcactgatgtcatc

SEQ ID NO: 7638956 - DNA, 22 bp, Homo sapiens
aggcattttctgtatggacaga

SEQ ID NO: 7638957 - DNA, 22 bp, Homo sapiens
aggcattttctgtatggacaga

SEQ ID NO: 7638958 - DNA, 22 bp, Homo sapiens
aggccaagctcccagagaagct

SEQ ID NO: 7638959 - DNA, 22 bp, Homo sapiens
aggccaagctcccagagaagct

SEQ ID NO: 7638960 - DNA, 22 bp, Homo sapiens
aggccaagctcccagagaagct

SEQ ID NO: 7638961 - DNA, 22 bp, Homo sapiens
aggccaagattttggatcagct

SEQ ID NO: 7638962 - DNA, 22 bp, Homo sapiens
aggccaagctcccagagaagct

SEQ ID NO: 7638963 - DNA, 22 bp, Homo sapiens
aggccaaagctcacctgcagct

SEQ ID NO: 7638964 - DNA, 22 bp, Homo sapiens
aggccaaagcacagagctggaa

SEQ ID NO: 7638965 - DNA, 22 bp, Homo sapiens
aggccaaagcacagagctggaa

SEQ ID NO: 7638966 - DNA, 22 bp, Homo sapiens
aggccaaatgtgtataaaacat

SEQ ID NO: 7638967 - DNA, 22 bp, Homo sapiens
aggccaaatgtgtataaaacat

SEQ ID NO: 7638968 - DNA, 22 bp, Homo sapiens
aggccaagattttggatcagct

SEQ ID NO: 7638969 - DNA, 22 bp, Homo sapiens
aggccaagattttggatcagct

SEQ ID NO: 7638970 - DNA, 22 bp, Homo sapiens
aggccaaatgtgtataaaacat

SEQ ID NO: 7638971 - DNA, 22 bp, Homo sapiens
aggccaagtgctgggacaggtg

SEQ ID NO: 7638972 - DNA, 22 bp, Homo sapiens
aggccaagtgctgggacaggtg

SEQ ID NO: 7638973 - DNA, 22 bp, Homo sapiens
aggccaagtgctgggacaggtg

SEQ ID NO: 7638974 - DNA, 22 bp, Homo sapiens
aggccaagtgctgggacaggtg

SEQ ID NO: 7638975 - DNA, 22 bp, Homo sapiens
aggccaagtgaacaatgctagt

SEQ ID NO: 7638976 - DNA, 22 bp, Homo sapiens
aggccaagtgaacaatgctagt

SEQ ID NO: 7638977 - DNA, 22 bp, Homo sapiens
aggccaagttacttgggaaagc

SEQ ID NO: 7638978 - DNA, 22 bp, Homo sapiens
aggccaagttacttgggaaagc

SEQ ID NO: 7638979 - DNA, 22 bp, Homo sapiens
aggccacaaccaccctgtgccc

SEQ ID NO: 7638980 - DNA, 22 bp, Homo sapiens
aggccacaaccaccctgtgccc

SEQ ID NO: 7638981 - DNA, 21 bp, Homo sapiens
aggccaagttggatttcttca

SEQ ID NO: 7638982 - DNA, 22 bp, Homo sapiens
aggccacaaccaccctgtgccc

SEQ ID NO: 7638983 - DNA, 22 bp, Homo sapiens
aggccaagtagccgctgtccta

SEQ ID NO: 7638984 - DNA, 22 bp, Homo sapiens
aggccaagtagccgctgtccta

SEQ ID NO: 7638985 - DNA, 22 bp, Homo sapiens
aggccaagggcaaagcggagag

SEQ ID NO: 7638986 - DNA, 22 bp, Homo sapiens
aggccaagggcaaagcggagag

SEQ ID NO: 7638987 - DNA, 22 bp, Homo sapiens
aggccaagggcaaagcggagag

SEQ ID NO: 7638988 - DNA, 22 bp, Homo sapiens
aggccaagctcccagagaagct

SEQ ID NO: 7638989 - DNA, 22 bp, Homo sapiens
aggccaagggcaaagcggagag

SEQ ID NO: 7638990 - DNA, 22 bp, Homo sapiens
aggccaagggcaaagcggagag

SEQ ID NO: 7638991 - DNA, 22 bp, Homo sapiens
aggccaagtagctagcattgaa

SEQ ID NO: 7638992 - DNA, 22 bp, Homo sapiens
aggccaagtagccgctgtccta

SEQ ID NO: 7638993 - DNA, 22 bp, Homo sapiens
aggccaagtagccgctgtccta

SEQ ID NO: 7638994 - DNA, 22 bp, Homo sapiens
aggccaagtagctagcattgaa

SEQ ID NO: 7638995 - DNA, 22 bp, Homo sapiens
aggccaagtagctagcattgaa

SEQ ID NO: 7638996 - DNA, 22 bp, Homo sapiens
aggccaagtagctagcattgaa

SEQ ID NO: 7638997 - DNA, 22 bp, Homo sapiens
aggccaagtgaacaatgctagt

SEQ ID NO: 7638998 - DNA, 22 bp, Homo sapiens
aggccagcttccagaggggcag

SEQ ID NO: 7638999 - DNA, 22 bp, Homo sapiens
aggccagcttccagaggggcag

SEQ ID NO: 7639000 - DNA, 22 bp, Homo sapiens
aggccagcttccagaggggcag

SEQ ID NO: 7639001 - DNA, 22 bp, Homo sapiens
aggccagcttccagaggggcag

SEQ ID NO: 7639002 - DNA, 22 bp, Homo sapiens
aggccagcttccagaggggcag

SEQ ID NO: 7639003 - DNA, 22 bp, Homo sapiens
aggccagcttccagaggggcag

SEQ ID NO: 7639004 - DNA, 22 bp, Homo sapiens
aggccagctgttactagagcca

SEQ ID NO: 7639005 - DNA, 22 bp, Homo sapiens
aggccagctgttactagagcca

SEQ ID NO: 7639006 - DNA, 22 bp, Homo sapiens
aggccagctgttactagagcca

SEQ ID NO: 7639007 - DNA, 22 bp, Homo sapiens
aggccagctgttactagagcca

SEQ ID NO: 7639008 - DNA, 22 bp, Homo sapiens
aggccagctgttactagagcca

SEQ ID NO: 7639009 - DNA, 22 bp, Homo sapiens
aggccagctgccacccggtccg

SEQ ID NO: 7639010 - DNA, 22 bp, Homo sapiens
aggccagctgccacccggtccg

SEQ ID NO: 7639011 - DNA, 22 bp, Homo sapiens
aggccagctgccacccggtccg

SEQ ID NO: 7639012 - DNA, 22 bp, Homo sapiens
aggccagctgccacccggtccg

SEQ ID NO: 7639013 - DNA, 22 bp, Homo sapiens
aggccagctgttactagagcca

SEQ ID NO: 7639014 - DNA, 22 bp, Homo sapiens
aggccagctgttactagagcca

SEQ ID NO: 7639015 - DNA, 22 bp, Homo sapiens
aggccagctgttactagagcca

SEQ ID NO: 7639016 - DNA, 22 bp, Homo sapiens
aggccagctgttactagagcca

SEQ ID NO: 7639017 - DNA, 22 bp, Homo sapiens
aggccagctgttactagagcca

SEQ ID NO: 7639018 - DNA, 22 bp, Homo sapiens
aggccagctctacccttggact

SEQ ID NO: 7639019 - DNA, 22 bp, Homo sapiens
aggccagctctacccttggact

SEQ ID NO: 7639020 - DNA, 22 bp, Homo sapiens
aggccagctctacccttggact

SEQ ID NO: 7639021 - DNA, 22 bp, Homo sapiens
aggccagctctacccttggact

SEQ ID NO: 7639022 - DNA, 22 bp, Homo sapiens
aggccagctgccacccggtccg

SEQ ID NO: 7639023 - DNA, 22 bp, Homo sapiens
aggccagctgccacccggtccg

SEQ ID NO: 7639024 - DNA, 22 bp, Homo sapiens
aggccagctctacccttggact

SEQ ID NO: 7639025 - DNA, 22 bp, Homo sapiens
aggccagctctacccttggact

SEQ ID NO: 7639026 - DNA, 22 bp, Homo sapiens
aggccagctctacccttggact

SEQ ID NO: 7639027 - DNA, 22 bp, Homo sapiens
aggccagctctacccttggact

SEQ ID NO: 7639028 - DNA, 22 bp, Homo sapiens
aggccagctcaccctggctcct

SEQ ID NO: 7639029 - DNA, 22 bp, Homo sapiens
aggccagctcaccctggctcct

SEQ ID NO: 7639030 - DNA, 22 bp, Homo sapiens
aggccagctcaccctggctcct

SEQ ID NO: 7639031 - DNA, 22 bp, Homo sapiens
aggccagctcaccctggctcct

SEQ ID NO: 7639032 - DNA, 22 bp, Homo sapiens
aggccagctcaccctggctcct

SEQ ID NO: 7639033 - DNA, 22 bp, Homo sapiens
aggccagctcaccctggctcct

SEQ ID NO: 7639034 - DNA, 22 bp, Homo sapiens
aggccagctcaccctggctcct

SEQ ID NO: 7639035 - DNA, 22 bp, Homo sapiens
aggccagctcaccctggctcct

SEQ ID NO: 7639036 - DNA, 22 bp, Homo sapiens
aggccagctcaccctggctcct

SEQ ID NO: 7639037 - DNA, 22 bp, Homo sapiens
aggccacaagaaaatgcttcat

SEQ ID NO: 7639038 - DNA, 22 bp, Homo sapiens
aggccacaagaaaatgcttcat

SEQ ID NO: 7639039 - DNA, 22 bp, Homo sapiens
aggccacaagaaaatgcttcat

SEQ ID NO: 7639040 - DNA, 22 bp, Homo sapiens
aggccacaaccaccctgtgccc

SEQ ID NO: 7639041 - DNA, 22 bp, Homo sapiens
aggccacaaccaccctgtgccc

SEQ ID NO: 7639042 - DNA, 22 bp, Homo sapiens
aggccacaaccaccctgtgccc

SEQ ID NO: 7639043 - DNA, 22 bp, Homo sapiens
aggccacaagaaaatgcttcat

SEQ ID NO: 7639044 - DNA, 22 bp, Homo sapiens
aggccacaagaaaatgcttcat

SEQ ID NO: 7639045 - DNA, 22 bp, Homo sapiens
aggccagatgtcgggctagaag

SEQ ID NO: 7639046 - DNA, 22 bp, Homo sapiens
aggccagcctgcccaaagctgc

SEQ ID NO: 7639047 - DNA, 22 bp, Homo sapiens
aggccagcctgcccaaagctgc

SEQ ID NO: 7639048 - DNA, 22 bp, Homo sapiens
aggccagcctcaggcagggacc

SEQ ID NO: 7639049 - DNA, 22 bp, Homo sapiens
aggccagcaagaaagagagtct

SEQ ID NO: 7639050 - DNA, 22 bp, Homo sapiens
aggccagcaagaaagagagtct

SEQ ID NO: 7639051 - DNA, 22 bp, Homo sapiens
aggccagcaagaaagagagtct

SEQ ID NO: 7639052 - DNA, 22 bp, Homo sapiens
aggccagcaagaaagagagtct

SEQ ID NO: 7639053 - DNA, 22 bp, Homo sapiens
aggccagcaagaaagagagtct

SEQ ID NO: 7639054 - DNA, 22 bp, Homo sapiens
aggccagcaagaaagagagtct

SEQ ID NO: 7639055 - DNA, 22 bp, Homo sapiens
aggccagcgctgctagctcccg

SEQ ID NO: 7639056 - DNA, 23 bp, Homo sapiens
aggccagcgcagacaccgagcac

SEQ ID NO: 7639057 - DNA, 23 bp, Homo sapiens
aggccagcgcagacaccgagcac

SEQ ID NO: 7639058 - DNA, 23 bp, Homo sapiens
aggccagcgcagacaccgagcac

SEQ ID NO: 7639059 - DNA, 22 bp, Homo sapiens
aggccagccttgtaaatgcctc

SEQ ID NO: 7639060 - DNA, 22 bp, Homo sapiens
aggccagcctcaggcagggacc

SEQ ID NO: 7639061 - DNA, 22 bp, Homo sapiens
aggccagcctgcccaaagctgc

SEQ ID NO: 7639062 - DNA, 22 bp, Homo sapiens
aggccagccttgtaaatgcctc

SEQ ID NO: 7639063 - DNA, 22 bp, Homo sapiens
aggccagcgctgctagctcccg

SEQ ID NO: 7639064 - DNA, 22 bp, Homo sapiens
aggccagctatgactctgctcc

SEQ ID NO: 7639065 - DNA, 22 bp, Homo sapiens
aggccagctatgactctgctcc

SEQ ID NO: 7639066 - DNA, 22 bp, Homo sapiens
aggccagctatgactctgctcc

SEQ ID NO: 7639067 - DNA, 22 bp, Homo sapiens
aggccagcgctgctagctcccg

SEQ ID NO: 7639068 - DNA, 22 bp, Homo sapiens
aggccagcgctgctagctcccg

SEQ ID NO: 7639069 - DNA, 22 bp, Homo sapiens
aggccagcgctgctagctcccg

SEQ ID NO: 7639070 - DNA, 22 bp, Homo sapiens
aggccagcgctgctagctcccg

SEQ ID NO: 7639071 - DNA, 22 bp, Homo sapiens
aggccctgaagtcggcccctca

SEQ ID NO: 7639072 - DNA, 22 bp, Homo sapiens
aggccctgaagtcggcccctca

SEQ ID NO: 7639073 - DNA, 22 bp, Homo sapiens
aggccctctcattccagaggca

SEQ ID NO: 7639074 - DNA, 22 bp, Homo sapiens
aggccctgaagtcggcccctca

SEQ ID NO: 7639075 - DNA, 22 bp, Homo sapiens
aggccctgaagtcggcccctca

SEQ ID NO: 7639076 - DNA, 22 bp, Homo sapiens
aggccctctcattccagaggca

SEQ ID NO: 7639077 - DNA, 22 bp, Homo sapiens
aggccctctcattccagaggca

SEQ ID NO: 7639078 - DNA, 22 bp, Homo sapiens
aggccctctagaggagtgtttg

SEQ ID NO: 7639079 - DNA, 22 bp, Homo sapiens
aggccctctcattccagaggca

SEQ ID NO: 7639080 - DNA, 20 bp, Homo sapiens
aggccctccccactgttgct

SEQ ID NO: 7639081 - DNA, 22 bp, Homo sapiens
aggccctccattgatgtttatt

SEQ ID NO: 7639082 - DNA, 22 bp, Homo sapiens
aggccctattcaatggggccca

SEQ ID NO: 7639083 - DNA, 22 bp, Homo sapiens
aggccctattcaatggggccca

SEQ ID NO: 7639084 - DNA, 22 bp, Homo sapiens
aggccctattcaatggggccca

SEQ ID NO: 7639085 - DNA, 22 bp, Homo sapiens
aggcccgaggttcgtgtgcacc

SEQ ID NO: 7639086 - DNA, 18 bp, Homo sapiens
aggcccgttgtgtggaat

SEQ ID NO: 7639087 - DNA, 22 bp, Homo sapiens
aggccctaatccaacatgactg

SEQ ID NO: 7639088 - DNA, 22 bp, Homo sapiens
aggccctaatccaacatgactg

SEQ ID NO: 7639089 - DNA, 22 bp, Homo sapiens
aggccctaatccaacatgactg

SEQ ID NO: 7639090 - DNA, 19 bp, Homo sapiens
aggccctcaagtaacatta

SEQ ID NO: 7639091 - DNA, 19 bp, Homo sapiens
aggccctcaagtaacatta

SEQ ID NO: 7639092 - DNA, 22 bp, Homo sapiens
aggccctcacagtctattgtga

SEQ ID NO: 7639093 - DNA, 22 bp, Homo sapiens
aggccctcacagtctattgtga

SEQ ID NO: 7639094 - DNA, 22 bp, Homo sapiens
aggccctattcaatggggccca

SEQ ID NO: 7639095 - DNA, 22 bp, Homo sapiens
aggccctgggttagggcccact

SEQ ID NO: 7639096 - DNA, 22 bp, Homo sapiens
aggccctgacctgggagatcta

SEQ ID NO: 7639097 - DNA, 22 bp, Homo sapiens
aggccctggtcaggtctggctg

SEQ ID NO: 7639098 - DNA, 22 bp, Homo sapiens
aggccctggtcaggtctggctg

SEQ ID NO: 7639099 - DNA, 22 bp, Homo sapiens
aggccctggtcaggtctggctg

SEQ ID NO: 7639100 - DNA, 22 bp, Homo sapiens
aggccctgggttagggcccact

SEQ ID NO: 7639101 - DNA, 22 bp, Homo sapiens
aggccggcgcttcccaggaggc

SEQ ID NO: 7639102 - DNA, 22 bp, Homo sapiens
aggcctagagctttggagggca

SEQ ID NO: 7639103 - DNA, 22 bp, Homo sapiens
aggccggcgcttcccaggaggc

SEQ ID NO: 7639104 - DNA, 22 bp, Homo sapiens
aggccggcgcttcccaggaggc

SEQ ID NO: 7639105 - DNA, 22 bp, Homo sapiens
aggccgcctggggagaggccct

SEQ ID NO: 7639106 - DNA, 22 bp, Homo sapiens
aggccctggtcaggtctggctg

SEQ ID NO: 7639107 - DNA, 22 bp, Homo sapiens
aggccctgaagtcggcccctca

SEQ ID NO: 7639108 - DNA, 22 bp, Homo sapiens
aggccctggtcaggtctggctg

SEQ ID NO: 7639109 - DNA, 22 bp, Homo sapiens
aggcccgaggttcgtgtgcacc

SEQ ID NO: 7639110 - DNA, 22 bp, Homo sapiens
aggccccccttgctggtttgct

SEQ ID NO: 7639111 - DNA, 22 bp, Homo sapiens
aggcccccacaggcttgaggca

SEQ ID NO: 7639112 - DNA, 22 bp, Homo sapiens
aggccccctccacccattctgg

SEQ ID NO: 7639113 - DNA, 22 bp, Homo sapiens
aggccccatcaggaaggaggcc

SEQ ID NO: 7639114 - DNA, 22 bp, Homo sapiens
aggccccatcaggaaggaggcc

SEQ ID NO: 7639115 - DNA, 20 bp, Homo sapiens
aggccccaggtggacactag

SEQ ID NO: 7639116 - DNA, 22 bp, Homo sapiens
aggccccaaagcagtgcaagta

SEQ ID NO: 7639117 - DNA, 22 bp, Homo sapiens
aggccccaaagcagtgcaagta

SEQ ID NO: 7639118 - DNA, 22 bp, Homo sapiens
aggccccaaagcagtgcaagta

SEQ ID NO: 7639119 - DNA, 20 bp, Homo sapiens
aggccccaggaaactctcag

SEQ ID NO: 7639120 - DNA, 20 bp, Homo sapiens
aggccccaggaaactctcag

SEQ ID NO: 7639121 - DNA, 22 bp, Homo sapiens
aggcccagtgtggcttcctgga

SEQ ID NO: 7639122 - DNA, 22 bp, Homo sapiens
aggcccagtgtggcttcctgga

SEQ ID NO: 7639123 - DNA, 22 bp, Homo sapiens
aggcccagtgtggcttcctgga

SEQ ID NO: 7639124 - DNA, 22 bp, Homo sapiens
aggcccagtgtggcttcctgga

SEQ ID NO: 7639125 - DNA, 22 bp, Homo sapiens
aggcccagtgtggcttcctgga

SEQ ID NO: 7639126 - DNA, 22 bp, Homo sapiens
aggcccagttatcctacttgtt

SEQ ID NO: 7639127 - DNA, 22 bp, Homo sapiens
aggcccagttatcctacttgtt

SEQ ID NO: 7639128 - DNA, 22 bp, Homo sapiens
aggcccagttatcctacttgtt

SEQ ID NO: 7639129 - DNA, 22 bp, Homo sapiens
aggcccagttatcctacttgtt

SEQ ID NO: 7639130 - DNA, 22 bp, Homo sapiens
aggcccagttatcctacttgtt

SEQ ID NO: 7639131 - DNA, 22 bp, Homo sapiens
aggccaggaccattagcccaga

SEQ ID NO: 7639132 - DNA, 22 bp, Homo sapiens
aggccaggaccattagcccaga

SEQ ID NO: 7639133 - DNA, 22 bp, Homo sapiens
aggccaggaccattagcccaga

SEQ ID NO: 7639134 - DNA, 22 bp, Homo sapiens
aggccaggaccattagcccaga

SEQ ID NO: 7639135 - DNA, 22 bp, Homo sapiens
aggccaggaccattagcccaga

SEQ ID NO: 7639136 - DNA, 22 bp, Homo sapiens
aggccaggaccattagcccaga

SEQ ID NO: 7639137 - DNA, 22 bp, Homo sapiens
aggccaggatagcatggatcag

SEQ ID NO: 7639138 - DNA, 22 bp, Homo sapiens
aggccaggatagcatggatcag

SEQ ID NO: 7639139 - DNA, 22 bp, Homo sapiens
aggccaggaccattagcccaga

SEQ ID NO: 7639140 - DNA, 22 bp, Homo sapiens
aggccaggacacttaagtaaga

SEQ ID NO: 7639141 - DNA, 22 bp, Homo sapiens
aggccaggacacttaagtaaga

SEQ ID NO: 7639142 - DNA, 22 bp, Homo sapiens
aggccaggacacttaagtaaga

SEQ ID NO: 7639143 - DNA, 22 bp, Homo sapiens
aggccaggacacttaagtaaga

SEQ ID NO: 7639144 - DNA, 22 bp, Homo sapiens
aggccaggacacttaagtaaga

SEQ ID NO: 7639145 - DNA, 22 bp, Homo sapiens
aggccaggacacttaagtaaga

SEQ ID NO: 7639146 - DNA, 22 bp, Homo sapiens
aggccaggaatccttgtcccag

SEQ ID NO: 7639147 - DNA, 22 bp, Homo sapiens
aggccaggaatccttgtcccag

SEQ ID NO: 7639148 - DNA, 22 bp, Homo sapiens
aggccaggaatccttgtcccag

SEQ ID NO: 7639149 - DNA, 22 bp, Homo sapiens
aggccagcttctaccctctgtt

SEQ ID NO: 7639150 - DNA, 22 bp, Homo sapiens
aggccagcttccagaggggcag

SEQ ID NO: 7639151 - DNA, 22 bp, Homo sapiens
aggccagcttctaccctctgtt

SEQ ID NO: 7639152 - DNA, 22 bp, Homo sapiens
aggccagcttctaccctctgtt

SEQ ID NO: 7639153 - DNA, 22 bp, Homo sapiens
aggccagcttctaccctctgtt

SEQ ID NO: 7639154 - DNA, 22 bp, Homo sapiens
aggccagcttccagaggggcag

SEQ ID NO: 7639155 - DNA, 22 bp, Homo sapiens
aggccagcttctaccctctgtt

SEQ ID NO: 7639156 - DNA, 20 bp, Homo sapiens
aggccaggaaatgtagttct

SEQ ID NO: 7639157 - DNA, 22 bp, Homo sapiens
aggccaggaatccttgtcccag

SEQ ID NO: 7639158 - DNA, 22 bp, Homo sapiens
aggccaggaatccttgtcccag

SEQ ID NO: 7639159 - DNA, 20 bp, Homo sapiens
aggccaggaaatgtagttct

SEQ ID NO: 7639160 - DNA, 20 bp, Homo sapiens
aggccaggaaatgtagttct

SEQ ID NO: 7639161 - DNA, 20 bp, Homo sapiens
aggccaggaaatgtagttct

SEQ ID NO: 7639162 - DNA, 20 bp, Homo sapiens
aggccaggaaatgtagttct

SEQ ID NO: 7639163 - DNA, 20 bp, Homo sapiens
aggccaggaaatgtagttct

SEQ ID NO: 7639164 - DNA, 22 bp, Homo sapiens
aggcccagtagtgctgccttta

SEQ ID NO: 7639165 - DNA, 22 bp, Homo sapiens
aggcccagtagtgctgccttta

SEQ ID NO: 7639166 - DNA, 22 bp, Homo sapiens
aggcccagtcctctgccgtctg

SEQ ID NO: 7639167 - DNA, 22 bp, Homo sapiens
aggcccagtcctctgccgtctg

SEQ ID NO: 7639168 - DNA, 22 bp, Homo sapiens
aggcccagtcctctgccgtctg

SEQ ID NO: 7639169 - DNA, 22 bp, Homo sapiens
aggcccagtcctctgccgtctg

SEQ ID NO: 7639170 - DNA, 22 bp, Homo sapiens
aggcccagtcctctgccgtctg

SEQ ID NO: 7639171 - DNA, 20 bp, Homo sapiens
aggcccagtgaatatattgc

SEQ ID NO: 7639172 - DNA, 22 bp, Homo sapiens
aggcccagtcctctgccgtctg

SEQ ID NO: 7639173 - DNA, 22 bp, Homo sapiens
aggcccagtcctctgccgtctg

SEQ ID NO: 7639174 - DNA, 22 bp, Homo sapiens
aggcccagtcctctgccgtctg

SEQ ID NO: 7639175 - DNA, 22 bp, Homo sapiens
aggcccagtgccattagttttg

SEQ ID NO: 7639176 - DNA, 22 bp, Homo sapiens
aggcccagtgccattagttttg

SEQ ID NO: 7639177 - DNA, 20 bp, Homo sapiens
aggcccagtgaatatattgc

SEQ ID NO: 7639178 - DNA, 22 bp, Homo sapiens
aggcccagtgccattagttttg

SEQ ID NO: 7639179 - DNA, 22 bp, Homo sapiens
aggcccagtgccattagttttg

SEQ ID NO: 7639180 - DNA, 22 bp, Homo sapiens
aggcccagtgtggcttcctgga

SEQ ID NO: 7639181 - DNA, 22 bp, Homo sapiens
aggcccagtgtggcttcctgga

SEQ ID NO: 7639182 - DNA, 22 bp, Homo sapiens
aggcccagtgtggcttcctgga

SEQ ID NO: 7639183 - DNA, 22 bp, Homo sapiens
aggcccagctgggccaggaaca

SEQ ID NO: 7639184 - DNA, 22 bp, Homo sapiens
aggcccagctgggccaggaaca

SEQ ID NO: 7639185 - DNA, 22 bp, Homo sapiens
aggcccagctgggccaggaaca

SEQ ID NO: 7639186 - DNA, 22 bp, Homo sapiens
aggcccagctgggccaggaaca

SEQ ID NO: 7639187 - DNA, 22 bp, Homo sapiens
aggcccagtagtcgacggcgct

SEQ ID NO: 7639188 - DNA, 22 bp, Homo sapiens
aggcccagtagtgctgccttta

SEQ ID NO: 7639189 - DNA, 22 bp, Homo sapiens
aggcccagtagtgctgccttta

SEQ ID NO: 7639190 - DNA, 22 bp, Homo sapiens
aggcccagtagtgctgccttta

SEQ ID NO: 7639191 - DNA, 22 bp, Homo sapiens
aggcccagtagtgctgccttta

SEQ ID NO: 7639192 - DNA, 22 bp, Homo sapiens
aggcccagtagtgctgccttta

SEQ ID NO: 7639193 - DNA, 22 bp, Homo sapiens
aggccaggaccattagcccaga

SEQ ID NO: 7639194 - DNA, 22 bp, Homo sapiens
aggccaggatagcatggatcag

SEQ ID NO: 7639195 - DNA, 22 bp, Homo sapiens
aggccaggatagcatggatcag

SEQ ID NO: 7639196 - DNA, 22 bp, Homo sapiens
aggccaggatagcatggatcag

SEQ ID NO: 7639197 - DNA, 22 bp, Homo sapiens
aggcccagctgggccaggaaca

SEQ ID NO: 7639198 - DNA, 22 bp, Homo sapiens
aggcccagctgggccaggaaca

SEQ ID NO: 7639199 - DNA, 22 bp, Homo sapiens
aggcccagctgggccaggaaca

SEQ ID NO: 7639200 - DNA, 22 bp, Homo sapiens
aggccaggatagcatggatcag

SEQ ID NO: 7639201 - DNA, 22 bp, Homo sapiens
aggagaggcatcaagaaaatcg

SEQ ID NO: 7639202 - DNA, 22 bp, Homo sapiens
aggagaggcatcaagaaaatcg

SEQ ID NO: 7639203 - DNA, 22 bp, Homo sapiens
aggagaggcatcaagaaaatcg

SEQ ID NO: 7639204 - DNA, 22 bp, Homo sapiens
aggagagaggttttaaatgggg

SEQ ID NO: 7639205 - DNA, 22 bp, Homo sapiens
aggagaggcatcaagaaaatcg

SEQ ID NO: 7639206 - DNA, 22 bp, Homo sapiens
aggagaggcatcaagaaaatcg

SEQ ID NO: 7639207 - DNA, 22 bp, Homo sapiens
aggagagcaggccagccgtccc

SEQ ID NO: 7639208 - DNA, 22 bp, Homo sapiens
aggagagcaggccagccgtccc

SEQ ID NO: 7639209 - DNA, 22 bp, Homo sapiens
aggagagcaggccagccgtccc

SEQ ID NO: 7639210 - DNA, 22 bp, Homo sapiens
aggagagctggtgtctggaatc

SEQ ID NO: 7639211 - DNA, 22 bp, Homo sapiens
aggagagctggtgtctggaatc

SEQ ID NO: 7639212 - DNA, 22 bp, Homo sapiens
aggagagctggtgtctggaatc

SEQ ID NO: 7639213 - DNA, 22 bp, Homo sapiens
aggagagctggtgtctggaatc

SEQ ID NO: 7639214 - DNA, 22 bp, Homo sapiens
aggagagctggtgtctggaatc

SEQ ID NO: 7639215 - DNA, 22 bp, Homo sapiens
aggagaggaatcattattacaa

SEQ ID NO: 7639216 - DNA, 22 bp, Homo sapiens
aggagaggaatcattattacaa

SEQ ID NO: 7639217 - DNA, 22 bp, Homo sapiens
aggagaggggtaggattaattt

SEQ ID NO: 7639218 - DNA, 22 bp, Homo sapiens
aggagaggggtaggattaattt

SEQ ID NO: 7639219 - DNA, 22 bp, Homo sapiens
aggagaggggtaggattaattt

SEQ ID NO: 7639220 - DNA, 22 bp, Homo sapiens
aggagaggggtaggattaattt

SEQ ID NO: 7639221 - DNA, 22 bp, Homo sapiens
aggagaggggtaggattaattt

SEQ ID NO: 7639222 - DNA, 22 bp, Homo sapiens
aggagaggggtaggattaattt

SEQ ID NO: 7639223 - DNA, 22 bp, Homo sapiens
aggagaggctctaactctgtgt

SEQ ID NO: 7639224 - DNA, 22 bp, Homo sapiens
aggagaggcatcaagaaaatcg

SEQ ID NO: 7639225 - DNA, 22 bp, Homo sapiens
aggagaggcatcaagaaaatcg

SEQ ID NO: 7639226 - DNA, 22 bp, Homo sapiens
aggagaggcatcaagaaaatcg

SEQ ID NO: 7639227 - DNA, 22 bp, Homo sapiens
aggagaggctctaactctgtgt

SEQ ID NO: 7639228 - DNA, 22 bp, Homo sapiens
aggagaggctctaactctgtgt

SEQ ID NO: 7639229 - DNA, 22 bp, Homo sapiens
aggagaggctctaactctgtgt

SEQ ID NO: 7639230 - DNA, 22 bp, Homo sapiens
aggagaggctctaactctgtgt

SEQ ID NO: 7639231 - DNA, 22 bp, Homo sapiens
aggagagaatgttccaggcttg

SEQ ID NO: 7639232 - DNA, 22 bp, Homo sapiens
aggagacactgagacttcacca

SEQ ID NO: 7639233 - DNA, 22 bp, Homo sapiens
aggagactgtgaattgactgtc

SEQ ID NO: 7639234 - DNA, 22 bp, Homo sapiens
aggagacagccaggggcctgag

SEQ ID NO: 7639235 - DNA, 22 bp, Homo sapiens
aggagactgtgaattgactgtc

SEQ ID NO: 7639236 - DNA, 22 bp, Homo sapiens
aggagagaatgttccaggcttg

SEQ ID NO: 7639237 - DNA, 22 bp, Homo sapiens
aggagagaatgttccaggcttg

SEQ ID NO: 7639238 - DNA, 22 bp, Homo sapiens
aggagagaatgttccaggcttg

SEQ ID NO: 7639239 - DNA, 22 bp, Homo sapiens
aggagagaatgttccaggcttg

SEQ ID NO: 7639240 - DNA, 22 bp, Homo sapiens
aggagagaatgttccaggcttg

SEQ ID NO: 7639241 - DNA, 22 bp, Homo sapiens
aggagagaatgttccaggcttg

SEQ ID NO: 7639242 - DNA, 22 bp, Homo sapiens
aggagagaatgttccaggcttg

SEQ ID NO: 7639243 - DNA, 22 bp, Homo sapiens
aggagagaattactgggtgtca

SEQ ID NO: 7639244 - DNA, 22 bp, Homo sapiens
aggagagaattactgggtgtca

SEQ ID NO: 7639245 - DNA, 22 bp, Homo sapiens
aggagagaattactgggtgtca

SEQ ID NO: 7639246 - DNA, 22 bp, Homo sapiens
aggagagaattactgggtgtca

SEQ ID NO: 7639247 - DNA, 22 bp, Homo sapiens
aggagagaggttttaaatgggg

SEQ ID NO: 7639248 - DNA, 22 bp, Homo sapiens
aggagagagctgagctttgctg

SEQ ID NO: 7639249 - DNA, 22 bp, Homo sapiens
aggagagaggttttaaatgggg

SEQ ID NO: 7639250 - DNA, 22 bp, Homo sapiens
aggagagcaggccagccgtccc

SEQ ID NO: 7639251 - DNA, 22 bp, Homo sapiens
aggagagcaggccagccgtccc

SEQ ID NO: 7639252 - DNA, 22 bp, Homo sapiens
aggagagagctgagctttgctg

SEQ ID NO: 7639253 - DNA, 22 bp, Homo sapiens
aggagagagctgagctttgctg

SEQ ID NO: 7639254 - DNA, 22 bp, Homo sapiens
aggagagaggttttaaatgggg

SEQ ID NO: 7639255 - DNA, 22 bp, Homo sapiens
aggagagagaacacttgggtcc

SEQ ID NO: 7639256 - DNA, 22 bp, Homo sapiens
aggagagagaacacttgggtcc

SEQ ID NO: 7639257 - DNA, 22 bp, Homo sapiens
aggagagagaacacttgggtcc

SEQ ID NO: 7639258 - DNA, 22 bp, Homo sapiens
aggagagagaacacttgggtcc

SEQ ID NO: 7639259 - DNA, 22 bp, Homo sapiens
aggagagagctgagctttgctg

SEQ ID NO: 7639260 - DNA, 22 bp, Homo sapiens
aggagagagctgagctttgctg

SEQ ID NO: 7639261 - DNA, 22 bp, Homo sapiens
aggagagagaacacttgggtcc

SEQ ID NO: 7639262 - DNA, 22 bp, Homo sapiens
aggagagagctgagctttgctg

SEQ ID NO: 7639263 - DNA, 22 bp, Homo sapiens
aggagagagctgagctttgctg

SEQ ID NO: 7639264 - DNA, 22 bp, Homo sapiens
aggagagggtggcattaagttt

SEQ ID NO: 7639265 - DNA, 22 bp, Homo sapiens
aggagagggtggcattaagttt

SEQ ID NO: 7639266 - DNA, 22 bp, Homo sapiens
aggagagggtggcattaagttt

SEQ ID NO: 7639267 - DNA, 22 bp, Homo sapiens
aggagagggtggcattaagttt

SEQ ID NO: 7639268 - DNA, 22 bp, Homo sapiens
aggagagggtggcattaagttt

SEQ ID NO: 7639269 - DNA, 22 bp, Homo sapiens
aggagaggtctcccttccccag

SEQ ID NO: 7639270 - DNA, 22 bp, Homo sapiens
aggagaggtctcccttccccag

SEQ ID NO: 7639271 - DNA, 22 bp, Homo sapiens
aggagaggtctcccttccccag

SEQ ID NO: 7639272 - DNA, 22 bp, Homo sapiens
aggagaggtctcccttccccag

SEQ ID NO: 7639273 - DNA, 22 bp, Homo sapiens
aggagaggtctcccttccccag

SEQ ID NO: 7639274 - DNA, 22 bp, Homo sapiens
aggagagtcttgagtcactggt

SEQ ID NO: 7639275 - DNA, 22 bp, Homo sapiens
aggagagttcacactggtcaga

SEQ ID NO: 7639276 - DNA, 22 bp, Homo sapiens
aggagagttcacactggtcaga

SEQ ID NO: 7639277 - DNA, 22 bp, Homo sapiens
aggagagtaccattgggccgca

SEQ ID NO: 7639278 - DNA, 22 bp, Homo sapiens
aggagagtcttgagtcactggt

SEQ ID NO: 7639279 - DNA, 22 bp, Homo sapiens
aggagagtcttgagtcactggt

SEQ ID NO: 7639280 - DNA, 22 bp, Homo sapiens
aggagataagaggctggtgtgg

SEQ ID NO: 7639281 - DNA, 22 bp, Homo sapiens
aggagatcagcctccctgcaac

SEQ ID NO: 7639282 - DNA, 22 bp, Homo sapiens
aggagccatgagcaggaggcaa

SEQ ID NO: 7639283 - DNA, 22 bp, Homo sapiens
aggagccatgagcaggaggcaa

SEQ ID NO: 7639284 - DNA, 22 bp, Homo sapiens
aggagccatgagcaggaggcaa

SEQ ID NO: 7639285 - DNA, 22 bp, Homo sapiens
aggagatcagcttagggaaggt

SEQ ID NO: 7639286 - DNA, 22 bp, Homo sapiens
aggagatcagcttagggaaggt

SEQ ID NO: 7639287 - DNA, 22 bp, Homo sapiens
aggagccatgagtgacatcaca

SEQ ID NO: 7639288 - DNA, 22 bp, Homo sapiens
aggagccatgagcaggaggcaa

SEQ ID NO: 7639289 - DNA, 22 bp, Homo sapiens
aggagccatgagcaggaggcaa

SEQ ID NO: 7639290 - DNA, 22 bp, Homo sapiens
aggagcctggctggcccacagg

SEQ ID NO: 7639291 - DNA, 22 bp, Homo sapiens
aggagcctggctggcccacagg

SEQ ID NO: 7639292 - DNA, 18 bp, Homo sapiens
aggagcctttgcactgga

SEQ ID NO: 7639293 - DNA, 19 bp, Homo sapiens
aggagccttgagcagtgag

SEQ ID NO: 7639294 - DNA, 19 bp, Homo sapiens
aggagccttgagcagtgag

SEQ ID NO: 7639295 - DNA, 19 bp, Homo sapiens
aggagccttgagcagtgag

SEQ ID NO: 7639296 - DNA, 19 bp, Homo sapiens
aggagccttgagcagtgag

SEQ ID NO: 7639297 - DNA, 19 bp, Homo sapiens
aggagccttgagcagtgag

SEQ ID NO: 7639298 - DNA, 22 bp, Homo sapiens
aggagcctgtgcctggcactcc

SEQ ID NO: 7639299 - DNA, 22 bp, Homo sapiens
aggagcctggctggcccacagg

SEQ ID NO: 7639300 - DNA, 22 bp, Homo sapiens
aggagcgtctgtctgtgtctct

SEQ ID NO: 7639301 - DNA, 22 bp, Homo sapiens
aggagctaattcataagccact

SEQ ID NO: 7639302 - DNA, 22 bp, Homo sapiens
aggagctcaaagatgccaggag

SEQ ID NO: 7639303 - DNA, 18 bp, Homo sapiens
aggagcctttgcactgga

SEQ ID NO: 7639304 - DNA, 18 bp, Homo sapiens
aggagcctttgcactgga

SEQ ID NO: 7639305 - DNA, 18 bp, Homo sapiens
aggagcctttgcactgga

SEQ ID NO: 7639306 - DNA, 22 bp, Homo sapiens
aggagctcccgtgaggagacca

SEQ ID NO: 7639307 - DNA, 22 bp, Homo sapiens
aggagctccagcccagggaagt

SEQ ID NO: 7639308 - DNA, 22 bp, Homo sapiens
aggagctcccgtgaggagacca

SEQ ID NO: 7639309 - DNA, 21 bp, Homo sapiens
aggagctctccaaggacaaag

SEQ ID NO: 7639310 - DNA, 22 bp, Homo sapiens
aggagctcattgaagtggatga

SEQ ID NO: 7639311 - DNA, 22 bp, Homo sapiens
aggagctcattgaagtggatga

SEQ ID NO: 7639312 - DNA, 22 bp, Homo sapiens
aggagctcagcctgcagggagc

SEQ ID NO: 7639313 - DNA, 22 bp, Homo sapiens
aggagctcagcctgcagggagc

SEQ ID NO: 7639314 - DNA, 22 bp, Homo sapiens
aggagctcagcctgcagggagc

SEQ ID NO: 7639315 - DNA, 22 bp, Homo sapiens
aggagctcaaagatgccaggag

SEQ ID NO: 7639316 - DNA, 22 bp, Homo sapiens
aggagctcagccattcatttga

SEQ ID NO: 7639317 - DNA, 22 bp, Homo sapiens
aggagctcacatctttatttct

SEQ ID NO: 7639318 - DNA, 22 bp, Homo sapiens
aggagctcaaagatgccaggag

SEQ ID NO: 7639319 - DNA, 21 bp, Homo sapiens
aggaggagagcttggcctacc

SEQ ID NO: 7639320 - DNA, 21 bp, Homo sapiens
aggaggagagcttggcctacc

SEQ ID NO: 7639321 - DNA, 21 bp, Homo sapiens
aggaggagagcttggcctacc

SEQ ID NO: 7639322 - DNA, 21 bp, Homo sapiens
aggaggagagcttggcctacc

SEQ ID NO: 7639323 - DNA, 21 bp, Homo sapiens
aggaggagagcttggcctacc

SEQ ID NO: 7639324 - DNA, 21 bp, Homo sapiens
aggaggagagcttggcctacc

SEQ ID NO: 7639325 - DNA, 22 bp, Homo sapiens
aggaggagcagctttttgtctc

SEQ ID NO: 7639326 - DNA, 21 bp, Homo sapiens
aggaggagagcttggcctacc

SEQ ID NO: 7639327 - DNA, 21 bp, Homo sapiens
aggaggagagcttggcctacc

SEQ ID NO: 7639328 - DNA, 21 bp, Homo sapiens
aggaggagagcttggcctacc

SEQ ID NO: 7639329 - DNA, 21 bp, Homo sapiens
aggaggagagcttggcctacc

SEQ ID NO: 7639330 - DNA, 22 bp, Homo sapiens
aggaggaggctggagtacaccc

SEQ ID NO: 7639331 - DNA, 22 bp, Homo sapiens
aggaggaggctggagtacaccc

SEQ ID NO: 7639332 - DNA, 22 bp, Homo sapiens
aggaggaggctggagtacaccc

SEQ ID NO: 7639333 - DNA, 22 bp, Homo sapiens
aggaggaggctggagtacaccc

SEQ ID NO: 7639334 - DNA, 22 bp, Homo sapiens
aggaggagcagctttttgtctc

SEQ ID NO: 7639335 - DNA, 22 bp, Homo sapiens
aggaggagcagctttttgtctc

SEQ ID NO: 7639336 - DNA, 22 bp, Homo sapiens
aggaggagcagctttttgtctc

SEQ ID NO: 7639337 - DNA, 22 bp, Homo sapiens
aggaggaggctggagtacaccc

SEQ ID NO: 7639338 - DNA, 22 bp, Homo sapiens
aggaggaggctggagtacaccc

SEQ ID NO: 7639339 - DNA, 22 bp, Homo sapiens
aggaggactctctgagccagcc

SEQ ID NO: 7639340 - DNA, 22 bp, Homo sapiens
aggaggactctctgagccagcc

SEQ ID NO: 7639341 - DNA, 22 bp, Homo sapiens
aggaggaattgacacagaagcc

SEQ ID NO: 7639342 - DNA, 22 bp, Homo sapiens
aggaggactctctgagccagcc

SEQ ID NO: 7639343 - DNA, 22 bp, Homo sapiens
aggaggaattgacacagaagcc

SEQ ID NO: 7639344 - DNA, 22 bp, Homo sapiens
aggaggaattgacacagaagcc

SEQ ID NO: 7639345 - DNA, 22 bp, Homo sapiens
aggaggaattgacacagaagcc

SEQ ID NO: 7639346 - DNA, 22 bp, Homo sapiens
aggaggaattgacacagaagcc

SEQ ID NO: 7639347 - DNA, 22 bp, Homo sapiens
aggaggaattgacacagaagcc

SEQ ID NO: 7639348 - DNA, 22 bp, Homo sapiens
aggaggaattgacacagaagcc

SEQ ID NO: 7639349 - DNA, 22 bp, Homo sapiens
aggaggaattgacacagaagcc

SEQ ID NO: 7639350 - DNA, 22 bp, Homo sapiens
aggaggaattgacacagaagcc

SEQ ID NO: 7639351 - DNA, 22 bp, Homo sapiens
aggaggaattgacacagaagcc

SEQ ID NO: 7639352 - DNA, 22 bp, Homo sapiens
aggaggaatacaatccagcagc

SEQ ID NO: 7639353 - DNA, 22 bp, Homo sapiens
aggaggaatacaatccagcagc

SEQ ID NO: 7639354 - DNA, 22 bp, Homo sapiens
aggaggaatacaatccagcagc

SEQ ID NO: 7639355 - DNA, 22 bp, Homo sapiens
aggaggaatacaatccagcagc

SEQ ID NO: 7639356 - DNA, 22 bp, Homo sapiens
aggaggaatacaatccagcagc

SEQ ID NO: 7639357 - DNA, 22 bp, Homo sapiens
aggaggaatacaatccagcagc

SEQ ID NO: 7639358 - DNA, 22 bp, Homo sapiens
aggaggaatacaatccagcagc

SEQ ID NO: 7639359 - DNA, 22 bp, Homo sapiens
aggaggaatacaatccagcagc

SEQ ID NO: 7639360 - DNA, 22 bp, Homo sapiens
aggaggaatacaatccagcagc

SEQ ID NO: 7639361 - DNA, 22 bp, Homo sapiens
aggaggaatacaatccagcagc

SEQ ID NO: 7639362 - DNA, 22 bp, Homo sapiens
aggaggaatacaatccagcagc

SEQ ID NO: 7639363 - DNA, 22 bp, Homo sapiens
aggaggaatacaatccagcagc

SEQ ID NO: 7639364 - DNA, 22 bp, Homo sapiens
aggaggataagttagttgggta

SEQ ID NO: 7639365 - DNA, 22 bp, Homo sapiens
aggaggaggtgggacacagtga

SEQ ID NO: 7639366 - DNA, 22 bp, Homo sapiens
aggaggaggtgggacacagtga

SEQ ID NO: 7639367 - DNA, 22 bp, Homo sapiens
aggaggaggtgggacacagtga

SEQ ID NO: 7639368 - DNA, 22 bp, Homo sapiens
aggaggaggtgggacacagtga

SEQ ID NO: 7639369 - DNA, 22 bp, Homo sapiens
aggaggaggtgggacacagtga

SEQ ID NO: 7639370 - DNA, 22 bp, Homo sapiens
aggaggaggtgggacacagtga

SEQ ID NO: 7639371 - DNA, 22 bp, Homo sapiens
aggaggaggctggagtacaccc

SEQ ID NO: 7639372 - DNA, 22 bp, Homo sapiens
aggaggaggtaagaaaagcata

SEQ ID NO: 7639373 - DNA, 22 bp, Homo sapiens
aggaggaggtgggacacagtga

SEQ ID NO: 7639374 - DNA, 22 bp, Homo sapiens
aggaggaggtgggacacagtga

SEQ ID NO: 7639375 - DNA, 22 bp, Homo sapiens
aggaggaggtaagaaaagcata

SEQ ID NO: 7639376 - DNA, 22 bp, Homo sapiens
aggaggaggtaagaaaagcata

SEQ ID NO: 7639377 - DNA, 22 bp, Homo sapiens
aggaggaggtaagaaaagcata

SEQ ID NO: 7639378 - DNA, 22 bp, Homo sapiens
aggaggaggtaagaaaagcata

SEQ ID NO: 7639379 - DNA, 22 bp, Homo sapiens
aggaggaggtaagaaaagcata

SEQ ID NO: 7639380 - DNA, 22 bp, Homo sapiens
aggaggcaaaggtctctgataa

SEQ ID NO: 7639381 - DNA, 22 bp, Homo sapiens
aggaggcaaaggtctctgataa

SEQ ID NO: 7639382 - DNA, 22 bp, Homo sapiens
aggaggcaaaggtctctgataa

SEQ ID NO: 7639383 - DNA, 17 bp, Homo sapiens
aggaggatcagagagta

SEQ ID NO: 7639384 - DNA, 17 bp, Homo sapiens
aggaggatcagagagta

SEQ ID NO: 7639385 - DNA, 17 bp, Homo sapiens
aggaggatcagagagta

SEQ ID NO: 7639386 - DNA, 22 bp, Homo sapiens
aggaggcaaaggtctctgataa

SEQ ID NO: 7639387 - DNA, 17 bp, Homo sapiens
aggaggatcagagagta

SEQ ID NO: 7639388 - DNA, 22 bp, Homo sapiens
aggaggataagttagttgggta

SEQ ID NO: 7639389 - DNA, 17 bp, Homo sapiens
aggaggatcagagagta

SEQ ID NO: 7639390 - DNA, 17 bp, Homo sapiens
aggaggatcagagagta

SEQ ID NO: 7639391 - DNA, 17 bp, Homo sapiens
aggaggatcagagagta

SEQ ID NO: 7639392 - DNA, 17 bp, Homo sapiens
aggaggatcagagagta

SEQ ID NO: 7639393 - DNA, 17 bp, Homo sapiens
aggaggatcagagagta

SEQ ID NO: 7639394 - DNA, 20 bp, Homo sapiens
aggaggcaatgtagataagc

SEQ ID NO: 7639395 - DNA, 20 bp, Homo sapiens
aggaggcaatgtagataagc

SEQ ID NO: 7639396 - DNA, 20 bp, Homo sapiens
aggaggcaatgtagataagc

SEQ ID NO: 7639397 - DNA, 20 bp, Homo sapiens
aggaggcaatgtagataagc

SEQ ID NO: 7639398 - DNA, 22 bp, Homo sapiens
aggaggcaactgagatttagaa

SEQ ID NO: 7639399 - DNA, 22 bp, Homo sapiens
aggaggcaactgagatttagaa

SEQ ID NO: 7639400 - DNA, 22 bp, Homo sapiens
aggaggcaactgagatttagaa

SEQ ID NO: 7639401 - DNA, 22 bp, Homo sapiens
aggaggcaactgagatttagaa

SEQ ID NO: 7639402 - DNA, 22 bp, Homo sapiens
aggaggcaactgagatttagaa

SEQ ID NO: 7639403 - DNA, 22 bp, Homo sapiens
aggagctgataaaagggggtca

SEQ ID NO: 7639404 - DNA, 22 bp, Homo sapiens
aggagctgataaaagggggtca

SEQ ID NO: 7639405 - DNA, 22 bp, Homo sapiens
aggagctgataaaagggggtca

SEQ ID NO: 7639406 - DNA, 22 bp, Homo sapiens
aggagctgataaaagggggtca

SEQ ID NO: 7639407 - DNA, 22 bp, Homo sapiens
aggagctgataaaagggggtca

SEQ ID NO: 7639408 - DNA, 22 bp, Homo sapiens
aggagctgataaaagggggtca

SEQ ID NO: 7639409 - DNA, 22 bp, Homo sapiens
aggagctgataaaagggggtca

SEQ ID NO: 7639410 - DNA, 22 bp, Homo sapiens
aggagctgagtcagcccgacag

SEQ ID NO: 7639411 - DNA, 22 bp, Homo sapiens
aggagctgagtcagcccgacag

SEQ ID NO: 7639412 - DNA, 22 bp, Homo sapiens
aggagctgagggagcgcccttg

SEQ ID NO: 7639413 - DNA, 22 bp, Homo sapiens
aggagctgagggagcgcccttg

SEQ ID NO: 7639414 - DNA, 22 bp, Homo sapiens
aggagctgagggagcgcccttg

SEQ ID NO: 7639415 - DNA, 22 bp, Homo sapiens
aggagctgagtcagcccgacag

SEQ ID NO: 7639416 - DNA, 22 bp, Homo sapiens
aggagctgagtcagcccgacag

SEQ ID NO: 7639417 - DNA, 22 bp, Homo sapiens
aggagctgagtcagcccgacag

SEQ ID NO: 7639418 - DNA, 22 bp, Homo sapiens
aggagctgagtcagcccgacag

SEQ ID NO: 7639419 - DNA, 22 bp, Homo sapiens
aggagctgatagtctatggaga

SEQ ID NO: 7639420 - DNA, 22 bp, Homo sapiens
aggagctgtgaatgggaggggt

SEQ ID NO: 7639421 - DNA, 21 bp, Homo sapiens
aggagctgtgtgcttcctttc

SEQ ID NO: 7639422 - DNA, 21 bp, Homo sapiens
aggagctgtgtgcttcctttc

SEQ ID NO: 7639423 - DNA, 22 bp, Homo sapiens
aggagctgatagtctatggaga

SEQ ID NO: 7639424 - DNA, 22 bp, Homo sapiens
aggagctgatagtctatggaga

SEQ ID NO: 7639425 - DNA, 22 bp, Homo sapiens
aggagctgatagtctatggaga

SEQ ID NO: 7639426 - DNA, 22 bp, Homo sapiens
aggagctgatagtctatggaga

SEQ ID NO: 7639427 - DNA, 22 bp, Homo sapiens
aggagctgatagtctatggaga

SEQ ID NO: 7639428 - DNA, 22 bp, Homo sapiens
aggaggaagggaagacaagtaa

SEQ ID NO: 7639429 - DNA, 22 bp, Homo sapiens
aggaggaagggaagacaagtaa

SEQ ID NO: 7639430 - DNA, 22 bp, Homo sapiens
aggaggaagggaagacaagtaa

SEQ ID NO: 7639431 - DNA, 22 bp, Homo sapiens
aggaggaagggaagacaagtaa

SEQ ID NO: 7639432 - DNA, 22 bp, Homo sapiens
aggaggaagggaagacaagtaa

SEQ ID NO: 7639433 - DNA, 22 bp, Homo sapiens
aggaggaaggcttcattaggtt

SEQ ID NO: 7639434 - DNA, 22 bp, Homo sapiens
aggaggaaggcttcattaggtt

SEQ ID NO: 7639435 - DNA, 20 bp, Homo sapiens
aggaggaagaaagcacactg

SEQ ID NO: 7639436 - DNA, 20 bp, Homo sapiens
aggagctgaattagagggtt

SEQ ID NO: 7639437 - DNA, 20 bp, Homo sapiens
aggagctgaattagagggtt

SEQ ID NO: 7639438 - DNA, 20 bp, Homo sapiens
aggagctgaattagagggtt

SEQ ID NO: 7639439 - DNA, 22 bp, Homo sapiens
aggagctgacttgtaaagcatt

SEQ ID NO: 7639440 - DNA, 22 bp, Homo sapiens
aggagctgagggagcgcccttg

SEQ ID NO: 7639441 - DNA, 22 bp, Homo sapiens
aggagctgacttgtaaagcatt

SEQ ID NO: 7639442 - DNA, 20 bp, Homo sapiens
aggagctgaattagagggtt

SEQ ID NO: 7639443 - DNA, 20 bp, Homo sapiens
aggagctgaattagagggtt

SEQ ID NO: 7639444 - DNA, 20 bp, Homo sapiens
aggagctgaattagagggtt

SEQ ID NO: 7639445 - DNA, 20 bp, Homo sapiens
aggagctgaattagagggtt

SEQ ID NO: 7639446 - DNA, 22 bp, Homo sapiens
aggagctgaagtctctgcactc

SEQ ID NO: 7639447 - DNA, 20 bp, Homo sapiens
aggagctgaattagagggtt

SEQ ID NO: 7639448 - DNA, 22 bp, Homo sapiens
aggagctgaagtctctgcactc

SEQ ID NO: 7639449 - DNA, 22 bp, Homo sapiens
aggagctgaagtctctgcactc

SEQ ID NO: 7639450 - DNA, 22 bp, Homo sapiens
aggagctgaaacttctcatatg

SEQ ID NO: 7639451 - DNA, 22 bp, Homo sapiens
aggagctgaaacttctcatatg

SEQ ID NO: 7639452 - DNA, 22 bp, Homo sapiens
aggagctgaagtctctgcactc

SEQ ID NO: 7639453 - DNA, 22 bp, Homo sapiens
aggagctgaagtctctgcactc

SEQ ID NO: 7639454 - DNA, 22 bp, Homo sapiens
aggagctgaaacttctcatatg

SEQ ID NO: 7639455 - DNA, 22 bp, Homo sapiens
aggagctctgggcagggcctcc

SEQ ID NO: 7639456 - DNA, 20 bp, Homo sapiens
aggagctctgtgctgggaag

SEQ ID NO: 7639457 - DNA, 20 bp, Homo sapiens
aggagctctgtgctgggaag

SEQ ID NO: 7639458 - DNA, 22 bp, Homo sapiens
aggagctcttgatgcttgaggg

SEQ ID NO: 7639459 - DNA, 22 bp, Homo sapiens
aggagctcttgatgcttgaggg

SEQ ID NO: 7639460 - DNA, 22 bp, Homo sapiens
aggagctcttgatgcttgaggg

SEQ ID NO: 7639461 - DNA, 22 bp, Homo sapiens
aggagctctgggcagggcctcc

SEQ ID NO: 7639462 - DNA, 22 bp, Homo sapiens
aggagctctcccatgctgcaga

SEQ ID NO: 7639463 - DNA, 21 bp, Homo sapiens
aggagctctccaaggacaaag

SEQ ID NO: 7639464 - DNA, 22 bp, Homo sapiens
aggagctctgggcagggcctcc

SEQ ID NO: 7639465 - DNA, 22 bp, Homo sapiens
aggagctctgggcagggcctcc

SEQ ID NO: 7639466 - DNA, 22 bp, Homo sapiens
aggaaggactgcagcatttggt

SEQ ID NO: 7639467 - DNA, 22 bp, Homo sapiens
aggaaggactgcagcatttggt

SEQ ID NO: 7639468 - DNA, 22 bp, Homo sapiens
aggaaggactccatggtccgtc

SEQ ID NO: 7639469 - DNA, 22 bp, Homo sapiens
aggaaggactccatggtccgtc

SEQ ID NO: 7639470 - DNA, 22 bp, Homo sapiens
aggaaggactccatggtccgtc

SEQ ID NO: 7639471 - DNA, 20 bp, Homo sapiens
aggaaggaagtttgcatgga

SEQ ID NO: 7639472 - DNA, 20 bp, Homo sapiens
aggaaggaagtttgcatgga

SEQ ID NO: 7639473 - DNA, 20 bp, Homo sapiens
aggaaggaagtttgcatgga

SEQ ID NO: 7639474 - DNA, 20 bp, Homo sapiens
aggaaggaagtttgcatgga

SEQ ID NO: 7639475 - DNA, 22 bp, Homo sapiens
aggaaggaagagacaccatttg

SEQ ID NO: 7639476 - DNA, 22 bp, Homo sapiens
aggaaggaagagacaccatttg

SEQ ID NO: 7639477 - DNA, 20 bp, Homo sapiens
aggaaggaagtttgcatgga

SEQ ID NO: 7639478 - DNA, 22 bp, Homo sapiens
aggaagcttgtgtgtattggtc

SEQ ID NO: 7639479 - DNA, 22 bp, Homo sapiens
aggaagcttggggcagggctac

SEQ ID NO: 7639480 - DNA, 22 bp, Homo sapiens
aggaagcttggggcagggctac

SEQ ID NO: 7639481 - DNA, 22 bp, Homo sapiens
aggaagctttatgaccagctaa

SEQ ID NO: 7639482 - DNA, 19 bp, Homo sapiens
aggaaggaacctgagtctg

SEQ ID NO: 7639483 - DNA, 19 bp, Homo sapiens
aggaaggaacctgagtctg

SEQ ID NO: 7639484 - DNA, 22 bp, Homo sapiens
aggaagctttatgaccagctaa

SEQ ID NO: 7639485 - DNA, 22 bp, Homo sapiens
aggaaggaagagacaccatttg

SEQ ID NO: 7639486 - DNA, 19 bp, Homo sapiens
aggaaggaacctgagtctg

SEQ ID NO: 7639487 - DNA, 19 bp, Homo sapiens
aggaaggaacctgagtctg

SEQ ID NO: 7639488 - DNA, 19 bp, Homo sapiens
aggaaggaacctgagtctg

SEQ ID NO: 7639489 - DNA, 19 bp, Homo sapiens
aggaaggaacctgagtctg

SEQ ID NO: 7639490 - DNA, 19 bp, Homo sapiens
aggaaggaacctgagtctg

SEQ ID NO: 7639491 - DNA, 19 bp, Homo sapiens
aggaaggaacctgagtctg

SEQ ID NO: 7639492 - DNA, 19 bp, Homo sapiens
aggaaggaacctgagtctg

SEQ ID NO: 7639493 - DNA, 22 bp, Homo sapiens
aggaagctctctgcttttaaga

SEQ ID NO: 7639494 - DNA, 20 bp, Homo sapiens
aggaagctgagatgtagagg

SEQ ID NO: 7639495 - DNA, 20 bp, Homo sapiens
aggaagctgagatgtagagg

SEQ ID NO: 7639496 - DNA, 20 bp, Homo sapiens
aggaagctgagatgtagagg

SEQ ID NO: 7639497 - DNA, 22 bp, Homo sapiens
aggaagctgcctgggatgggaa

SEQ ID NO: 7639498 - DNA, 22 bp, Homo sapiens
aggaagctgcctgggatgggaa

SEQ ID NO: 7639499 - DNA, 22 bp, Homo sapiens
aggaagctgcctgggatgggaa

SEQ ID NO: 7639500 - DNA, 21 bp, Homo sapiens
aggaagctgcccagatagtag

SEQ ID NO: 7639501 - DNA, 21 bp, Homo sapiens
aggaagctgcccagatagtag

SEQ ID NO: 7639502 - DNA, 22 bp, Homo sapiens
aggaagctgctggagtagtgtg

SEQ ID NO: 7639503 - DNA, 22 bp, Homo sapiens
aggaagctgggaaactgacatt

SEQ ID NO: 7639504 - DNA, 22 bp, Homo sapiens
aggaagctgcctgggatgggaa

SEQ ID NO: 7639505 - DNA, 22 bp, Homo sapiens
aggaagctgctaagaaacaatg

SEQ ID NO: 7639506 - DNA, 22 bp, Homo sapiens
aggaagctggttacgaagggat

SEQ ID NO: 7639507 - DNA, 22 bp, Homo sapiens
aggaagctggtgtgaggatgaa

SEQ ID NO: 7639508 - DNA, 22 bp, Homo sapiens
aggaagctggtgtgaggatgaa

SEQ ID NO: 7639509 - DNA, 22 bp, Homo sapiens
aggaagctgggaaactgacatt

SEQ ID NO: 7639510 - DNA, 22 bp, Homo sapiens
aggaagctggtgtgaggatgaa

SEQ ID NO: 7639511 - DNA, 22 bp, Homo sapiens
aggaagctggtgtgaggatgaa

SEQ ID NO: 7639512 - DNA, 22 bp, Homo sapiens
aggaagcttagatttccagatc

SEQ ID NO: 7639513 - DNA, 22 bp, Homo sapiens
aggaagctggttacgaagggat

SEQ ID NO: 7639514 - DNA, 22 bp, Homo sapiens
aggaagcttggggcagggctac

SEQ ID NO: 7639515 - DNA, 22 bp, Homo sapiens
aggaagcttggggcagggctac

SEQ ID NO: 7639516 - DNA, 22 bp, Homo sapiens
aggaagcttggggcagggctac

SEQ ID NO: 7639517 - DNA, 22 bp, Homo sapiens
cagtcctgcccaggctgacaga

SEQ ID NO: 7639518 - DNA, 22 bp, Homo sapiens
cagtcctgcccaggctgacaga

SEQ ID NO: 7639519 - DNA, 20 bp, Homo sapiens
cagtcctgcaggcgggagaa

SEQ ID NO: 7639520 - DNA, 20 bp, Homo sapiens
cagtcctgcaggcgggagaa

SEQ ID NO: 7639521 - DNA, 21 bp, Homo sapiens
cagtcctgcaaataattcttt

SEQ ID NO: 7639522 - DNA, 20 bp, Homo sapiens
cagtcctgcaggcgggagaa

SEQ ID NO: 7639523 - DNA, 20 bp, Homo sapiens
cagtcctgcaggcgggagaa

SEQ ID NO: 7639524 - DNA, 20 bp, Homo sapiens
cagtcctgcaggcgggagaa

SEQ ID NO: 7639525 - DNA, 22 bp, Homo sapiens
cagtcctgagctcctgggctga

SEQ ID NO: 7639526 - DNA, 22 bp, Homo sapiens
cagtcctgagctcctgggctga

SEQ ID NO: 7639527 - DNA, 22 bp, Homo sapiens
cagtcctgagctcctgggctga

SEQ ID NO: 7639528 - DNA, 22 bp, Homo sapiens
cagtcctgaggaagagctgctg

SEQ ID NO: 7639529 - DNA, 22 bp, Homo sapiens
cagtcctgaggaagagctgctg

SEQ ID NO: 7639530 - DNA, 22 bp, Homo sapiens
cagtcctgaggaagagctgctg

SEQ ID NO: 7639531 - DNA, 17 bp, Homo sapiens
cagtcctctgctctaag

SEQ ID NO: 7639532 - DNA, 22 bp, Homo sapiens
cagtcctctggagtgagggtga

SEQ ID NO: 7639533 - DNA, 22 bp, Homo sapiens
cagtcctctggagtgagggtga

SEQ ID NO: 7639534 - DNA, 22 bp, Homo sapiens
cagtcctctggagtgagggtga

SEQ ID NO: 7639535 - DNA, 22 bp, Homo sapiens
cagtcctgaatactggacggtg

SEQ ID NO: 7639536 - DNA, 22 bp, Homo sapiens
cagtcctgaatactggacggtg

SEQ ID NO: 7639537 - DNA, 22 bp, Homo sapiens
cagtcctgagctcctgggctga

SEQ ID NO: 7639538 - DNA, 22 bp, Homo sapiens
cagtcctgagccaatcatgatg

SEQ ID NO: 7639539 - DNA, 22 bp, Homo sapiens
cagtcctgaatactggacggtg

SEQ ID NO: 7639540 - DNA, 22 bp, Homo sapiens
cagtcctgagccaatcatgatg

SEQ ID NO: 7639541 - DNA, 18 bp, Homo sapiens
cagtcccaaaccttagga

SEQ ID NO: 7639542 - DNA, 22 bp, Homo sapiens
cagtcctctgcaacaccccttc

SEQ ID NO: 7639543 - DNA, 17 bp, Homo sapiens
cagtcctctgctctaag

SEQ ID NO: 7639544 - DNA, 18 bp, Homo sapiens
cagtcccaaaccttagga

SEQ ID NO: 7639545 - DNA, 18 bp, Homo sapiens
cagtcccaaaccttagga

SEQ ID NO: 7639546 - DNA, 22 bp, Homo sapiens
cagtccatatgccataattctt

SEQ ID NO: 7639547 - DNA, 22 bp, Homo sapiens
aggaaggactgcagcatttggt

SEQ ID NO: 7639548 - DNA, 22 bp, Homo sapiens
aggaaggactgcagcatttggt

SEQ ID NO: 7639549 - DNA, 22 bp, Homo sapiens
cagtccagtgatttttccagtt

SEQ ID NO: 7639550 - DNA, 22 bp, Homo sapiens
aggacagcaaccgttattcaca

SEQ ID NO: 7639551 - DNA, 22 bp, Homo sapiens
aggacagcaaccgttattcaca

SEQ ID NO: 7639552 - DNA, 22 bp, Homo sapiens
aggacagcagccattggcagtc

SEQ ID NO: 7639553 - DNA, 22 bp, Homo sapiens
cagtcctgggcacagccctggg

SEQ ID NO: 7639554 - DNA, 22 bp, Homo sapiens
cagtcctgggagacttacccag

SEQ ID NO: 7639555 - DNA, 22 bp, Homo sapiens
cagtcctgggcacagccctggg

SEQ ID NO: 7639556 - DNA, 22 bp, Homo sapiens
cagtcctgggcacagccctggg

SEQ ID NO: 7639557 - DNA, 22 bp, Homo sapiens
cagtcctgggcacagccctggg

SEQ ID NO: 7639558 - DNA, 22 bp, Homo sapiens
cagtcctgggcacagccctggg

SEQ ID NO: 7639559 - DNA, 22 bp, Homo sapiens
aggacagcagccattggcagtc

SEQ ID NO: 7639560 - DNA, 20 bp, Homo sapiens
aggacagcagctgccacttg

SEQ ID NO: 7639561 - DNA, 20 bp, Homo sapiens
aggacagcagctgccacttg

SEQ ID NO: 7639562 - DNA, 22 bp, Homo sapiens
aggacagcagccattggcagtc

SEQ ID NO: 7639563 - DNA, 20 bp, Homo sapiens
aggacagcagctgccacttg

SEQ ID NO: 7639564 - DNA, 21 bp, Homo sapiens
aggacagcaggagcatttatt

SEQ ID NO: 7639565 - DNA, 20 bp, Homo sapiens
aggacagcagctgccacttg

SEQ ID NO: 7639566 - DNA, 20 bp, Homo sapiens
aggacagcagctgccacttg

SEQ ID NO: 7639567 - DNA, 22 bp, Homo sapiens
aggacagcagtgctggcacttg

SEQ ID NO: 7639568 - DNA, 21 bp, Homo sapiens
aggacagcaggagcatttatt

SEQ ID NO: 7639569 - DNA, 22 bp, Homo sapiens
aggacagcagtgctggcacttg

SEQ ID NO: 7639570 - DNA, 20 bp, Homo sapiens
cagtcctgccccttggggac

SEQ ID NO: 7639571 - DNA, 22 bp, Homo sapiens
cagtcctgcccaggctgacaga

SEQ ID NO: 7639572 - DNA, 20 bp, Homo sapiens
cagtcctgccccttggggac

SEQ ID NO: 7639573 - DNA, 22 bp, Homo sapiens
cagtcctgcccaggctgacaga

SEQ ID NO: 7639574 - DNA, 20 bp, Homo sapiens
cagtcctgcaggcgggagaa

SEQ ID NO: 7639575 - DNA, 22 bp, Homo sapiens
cagtcctgcccaggctgacaga

SEQ ID NO: 7639576 - DNA, 22 bp, Homo sapiens
cagtcctgctagtgtgaaaagc

SEQ ID NO: 7639577 - DNA, 22 bp, Homo sapiens
cagtcctgctagtgtgaaaagc

SEQ ID NO: 7639578 - DNA, 22 bp, Homo sapiens
cagtcctgctagtgtgaaaagc

SEQ ID NO: 7639579 - DNA, 22 bp, Homo sapiens
cagtcctgggcacagccctggg

SEQ ID NO: 7639580 - DNA, 22 bp, Homo sapiens
cagtcctgggagacttacccag

SEQ ID NO: 7639581 - DNA, 22 bp, Homo sapiens
cagtcctggagcccttcttggc

SEQ ID NO: 7639582 - DNA, 22 bp, Homo sapiens
cagtcctgctggccttccctgg

SEQ ID NO: 7639583 - DNA, 22 bp, Homo sapiens
cagtcctgctggccttccctgg

SEQ ID NO: 7639584 - DNA, 22 bp, Homo sapiens
cagtcctgctggccttccctgg

SEQ ID NO: 7639585 - DNA, 22 bp, Homo sapiens
cagtcctggagcccttcttggc

SEQ ID NO: 7639586 - DNA, 22 bp, Homo sapiens
aggacaggattccttgccttgc

SEQ ID NO: 7639587 - DNA, 22 bp, Homo sapiens
aggacaggattccttgccttgc

SEQ ID NO: 7639588 - DNA, 22 bp, Homo sapiens
aggactgacttttgccatgaaa

SEQ ID NO: 7639589 - DNA, 22 bp, Homo sapiens
aggactttagagccagaaagac

SEQ ID NO: 7639590 - DNA, 22 bp, Homo sapiens
aggactgatgatggtgctgaca

SEQ ID NO: 7639591 - DNA, 22 bp, Homo sapiens
aggacaggattccttgccttgc

SEQ ID NO: 7639592 - DNA, 22 bp, Homo sapiens
aggactgacttttgccatgaaa

SEQ ID NO: 7639593 - DNA, 21 bp, Homo sapiens
aggagaaacacaggtcagccc

SEQ ID NO: 7639594 - DNA, 21 bp, Homo sapiens
aggagaaacacaggtcagccc

SEQ ID NO: 7639595 - DNA, 22 bp, Homo sapiens
aggacttttcatcagctatcct

SEQ ID NO: 7639596 - DNA, 22 bp, Homo sapiens
aggagaaaacagtgttttgcct

SEQ ID NO: 7639597 - DNA, 22 bp, Homo sapiens
aggagaaaacagtgttttgcct

SEQ ID NO: 7639598 - DNA, 22 bp, Homo sapiens
aggagaaaacagtgttttgcct

SEQ ID NO: 7639599 - DNA, 21 bp, Homo sapiens
aggagaaacacaggtcagccc

SEQ ID NO: 7639600 - DNA, 21 bp, Homo sapiens
aggagaaacacaggtcagccc

SEQ ID NO: 7639601 - DNA, 21 bp, Homo sapiens
aggagaaacacaggtcagccc

SEQ ID NO: 7639602 - DNA, 21 bp, Homo sapiens
aggagaaacacaggtcagccc

SEQ ID NO: 7639603 - DNA, 21 bp, Homo sapiens
aggagaaacacaggtcagccc

SEQ ID NO: 7639604 - DNA, 22 bp, Homo sapiens
aggagaaaacagtgttttgcct

SEQ ID NO: 7639605 - DNA, 22 bp, Homo sapiens
aggagaaaacagtgttttgcct

SEQ ID NO: 7639606 - DNA, 22 bp, Homo sapiens
aggagaaaacagtgttttgcct

SEQ ID NO: 7639607 - DNA, 22 bp, Homo sapiens
aggacttttcatcagctatcct

SEQ ID NO: 7639608 - DNA, 22 bp, Homo sapiens
aggactttgattttgtaagatc

SEQ ID NO: 7639609 - DNA, 22 bp, Homo sapiens
aggactttagagccagaaagac

SEQ ID NO: 7639610 - DNA, 22 bp, Homo sapiens
aggactttagagccagaaagac

SEQ ID NO: 7639611 - DNA, 18 bp, Homo sapiens
aggagaaagggaccaggg

SEQ ID NO: 7639612 - DNA, 22 bp, Homo sapiens
aggagaaatccatcgagaatgg

SEQ ID NO: 7639613 - DNA, 22 bp, Homo sapiens
aggagaaatccatcgagaatgg

SEQ ID NO: 7639614 - DNA, 18 bp, Homo sapiens
aggagaaagggaccaggg

SEQ ID NO: 7639615 - DNA, 18 bp, Homo sapiens
aggagaaagggaccaggg

SEQ ID NO: 7639616 - DNA, 22 bp, Homo sapiens
aggagaaatccatcgagaatgg

SEQ ID NO: 7639617 - DNA, 22 bp, Homo sapiens
aggagaaatccatcgagaatgg

SEQ ID NO: 7639618 - DNA, 22 bp, Homo sapiens
aggagaaatccatcgagaatgg

SEQ ID NO: 7639619 - DNA, 20 bp, Homo sapiens
aggagaaattcgggacacct

SEQ ID NO: 7639620 - DNA, 20 bp, Homo sapiens
aggagaaattcgggacacct

SEQ ID NO: 7639621 - DNA, 20 bp, Homo sapiens
aggagaaattcgggacacct

SEQ ID NO: 7639622 - DNA, 22 bp, Homo sapiens
aggagaaatccatcgagaatgg

SEQ ID NO: 7639623 - DNA, 20 bp, Homo sapiens
aggagaaattcgggacacct

SEQ ID NO: 7639624 - DNA, 20 bp, Homo sapiens
aggagaaattcgggacacct

SEQ ID NO: 7639625 - DNA, 20 bp, Homo sapiens
aggagaaattcgggacacct

SEQ ID NO: 7639626 - DNA, 22 bp, Homo sapiens
aggagaaagactggacagccaa

SEQ ID NO: 7639627 - DNA, 22 bp, Homo sapiens
aggagaaagactggacagccaa

SEQ ID NO: 7639628 - DNA, 22 bp, Homo sapiens
aggagaaagactggacagccaa

SEQ ID NO: 7639629 - DNA, 22 bp, Homo sapiens
aggagaaagactggacagccaa

SEQ ID NO: 7639630 - DNA, 22 bp, Homo sapiens
aggagaaagactggacagccaa

SEQ ID NO: 7639631 - DNA, 22 bp, Homo sapiens
aggagaaagactggacagccaa

SEQ ID NO: 7639632 - DNA, 22 bp, Homo sapiens
aggagaaagactggacagccaa

SEQ ID NO: 7639633 - DNA, 18 bp, Homo sapiens
aggagaaagggaccaggg

SEQ ID NO: 7639634 - DNA, 18 bp, Homo sapiens
aggagaaagggaccaggg

SEQ ID NO: 7639635 - DNA, 18 bp, Homo sapiens
aggagaaagggaccaggg

SEQ ID NO: 7639636 - DNA, 18 bp, Homo sapiens
aggagaaagggaccaggg

SEQ ID NO: 7639637 - DNA, 18 bp, Homo sapiens
aggagaaagggaccaggg

SEQ ID NO: 7639638 - DNA, 18 bp, Homo sapiens
aggagaaagggaccaggg

SEQ ID NO: 7639639 - DNA, 22 bp, Homo sapiens
aggacagcagtgctggcacttg

SEQ ID NO: 7639640 - DNA, 22 bp, Homo sapiens
aggacagcagtgctggcacttg

SEQ ID NO: 7639641 - DNA, 22 bp, Homo sapiens
aggacagcagtgctggcacttg

SEQ ID NO: 7639642 - DNA, 22 bp, Homo sapiens
aggacagcagttggtgaggttc

SEQ ID NO: 7639643 - DNA, 22 bp, Homo sapiens
aggacagcagttggtgaggttc

SEQ ID NO: 7639644 - DNA, 22 bp, Homo sapiens
aggacagcagttggtgaggttc

SEQ ID NO: 7639645 - DNA, 22 bp, Homo sapiens
aggacagcatatgggaaccagt

SEQ ID NO: 7639646 - DNA, 22 bp, Homo sapiens
aggacagcatatgggaaccagt

SEQ ID NO: 7639647 - DNA, 22 bp, Homo sapiens
aggacagcatatgggaaccagt

SEQ ID NO: 7639648 - DNA, 22 bp, Homo sapiens
aggacagcagttggtgaggttc

SEQ ID NO: 7639649 - DNA, 22 bp, Homo sapiens
aggacagcagttggtgaggttc

SEQ ID NO: 7639650 - DNA, 22 bp, Homo sapiens
aggacagcccccaacagcaaca

SEQ ID NO: 7639651 - DNA, 22 bp, Homo sapiens
aggacagcccccaacagcaaca

SEQ ID NO: 7639652 - DNA, 22 bp, Homo sapiens
aggacagcccccaacagcaaca

SEQ ID NO: 7639653 - DNA, 22 bp, Homo sapiens
aggacagcccccaacagcaaca

SEQ ID NO: 7639654 - DNA, 22 bp, Homo sapiens
aggacagcccccaacagcaaca

SEQ ID NO: 7639655 - DNA, 22 bp, Homo sapiens
aggacagcattttcagcatctc

SEQ ID NO: 7639656 - DNA, 22 bp, Homo sapiens
aggacagcattttcagcatctc

SEQ ID NO: 7639657 - DNA, 22 bp, Homo sapiens
aggacagcattttcagcatctc

SEQ ID NO: 7639658 - DNA, 22 bp, Homo sapiens
aggacagcattttcagcatctc

SEQ ID NO: 7639659 - DNA, 22 bp, Homo sapiens
aggacagcattttcagcatctc

SEQ ID NO: 7639660 - DNA, 21 bp, Homo sapiens
aggacaggaactggctgaata

SEQ ID NO: 7639661 - DNA, 21 bp, Homo sapiens
aggacaggaactggctgaata

SEQ ID NO: 7639662 - DNA, 21 bp, Homo sapiens
aggacaggaactggctgaata

SEQ ID NO: 7639663 - DNA, 22 bp, Homo sapiens
aggacagcccttgagagcacat

SEQ ID NO: 7639664 - DNA, 22 bp, Homo sapiens
aggacagcccttgagagcacat

SEQ ID NO: 7639665 - DNA, 22 bp, Homo sapiens
aggacagcccttgagagcacat

SEQ ID NO: 7639666 - DNA, 22 bp, Homo sapiens
aggacagcccttgagagcacat

SEQ ID NO: 7639667 - DNA, 22 bp, Homo sapiens
aggacagcccttgagagcacat

SEQ ID NO: 7639668 - DNA, 22 bp, Homo sapiens
aggacagcccttgagagcacat

SEQ ID NO: 7639669 - DNA, 22 bp, Homo sapiens
aggacagcccttgagagcacat

SEQ ID NO: 7639670 - DNA, 21 bp, Homo sapiens
aggacaggaactggctgaata

SEQ ID NO: 7639671 - DNA, 21 bp, Homo sapiens
aggacaggaactggctgaata

SEQ ID NO: 7639672 - DNA, 21 bp, Homo sapiens
aggacaggaactggctgaata

SEQ ID NO: 7639673 - DNA, 21 bp, Homo sapiens
aggacaggaactggctgaata

SEQ ID NO: 7639674 - DNA, 21 bp, Homo sapiens
aggacaggaactggctgaata

SEQ ID NO: 7639675 - DNA, 21 bp, Homo sapiens
aggacaggaactggctgaata

SEQ ID NO: 7639676 - DNA, 21 bp, Homo sapiens
aggacaggaactggctgaata

SEQ ID NO: 7639677 - DNA, 21 bp, Homo sapiens
aggacaggaactggctgaata

SEQ ID NO: 7639678 - DNA, 21 bp, Homo sapiens
aggacaggaactggctgaata

SEQ ID NO: 7639679 - DNA, 21 bp, Homo sapiens
aggacaggaactggctgaata

SEQ ID NO: 7639680 - DNA, 21 bp, Homo sapiens
aggacaggaactggctgaata

SEQ ID NO: 7639681 - DNA, 21 bp, Homo sapiens
aggacaggaactggctgaata

SEQ ID NO: 7639682 - DNA, 21 bp, Homo sapiens
aggacaggaactggctgaata

SEQ ID NO: 7639683 - DNA, 22 bp, Homo sapiens
cagtctcttttcagctccatcc

SEQ ID NO: 7639684 - DNA, 22 bp, Homo sapiens
cagtctcttttcagctccatcc

SEQ ID NO: 7639685 - DNA, 22 bp, Homo sapiens
cagtctcttttcagctccatcc

SEQ ID NO: 7639686 - DNA, 22 bp, Homo sapiens
cagtctcttttcagctccatcc

SEQ ID NO: 7639687 - DNA, 22 bp, Homo sapiens
cagtctcttttcagctccatcc

SEQ ID NO: 7639688 - DNA, 22 bp, Homo sapiens
cagtctcttttcagctccatcc

SEQ ID NO: 7639689 - DNA, 22 bp, Homo sapiens
aggagaattaggaactcaagat

SEQ ID NO: 7639690 - DNA, 22 bp, Homo sapiens
aggagaattaggaactcaagat

SEQ ID NO: 7639691 - DNA, 22 bp, Homo sapiens
aggagacactgagacttcacca

SEQ ID NO: 7639692 - DNA, 22 bp, Homo sapiens
aggagacagaatttaaatttgg

SEQ ID NO: 7639693 - DNA, 22 bp, Homo sapiens
cagtctctgtgccagatcctgg

SEQ ID NO: 7639694 - DNA, 22 bp, Homo sapiens
cagtctcttgcttcattagttg

SEQ ID NO: 7639695 - DNA, 22 bp, Homo sapiens
cagtctctttatccaccaagcc

SEQ ID NO: 7639696 - DNA, 22 bp, Homo sapiens
cagtctcttttcagctccatcc

SEQ ID NO: 7639697 - DNA, 22 bp, Homo sapiens
cagtctctttatccaccaagcc

SEQ ID NO: 7639698 - DNA, 22 bp, Homo sapiens
cagtctctggcagctgctggcc

SEQ ID NO: 7639699 - DNA, 22 bp, Homo sapiens
cagtctctggcagctgctggcc

SEQ ID NO: 7639700 - DNA, 22 bp, Homo sapiens
cagtctctggcagctgctggcc

SEQ ID NO: 7639701 - DNA, 22 bp, Homo sapiens
cagtctctggtgagttgacagt

SEQ ID NO: 7639702 - DNA, 22 bp, Homo sapiens
cagtctctgggaaagaggacag

SEQ ID NO: 7639703 - DNA, 22 bp, Homo sapiens
cagtctctggtgagttgacagt

SEQ ID NO: 7639704 - DNA, 22 bp, Homo sapiens
cagtctctgtgccagatcctgg

SEQ ID NO: 7639705 - DNA, 22 bp, Homo sapiens
cagtctctgtgccagatcctgg

SEQ ID NO: 7639706 - DNA, 22 bp, Homo sapiens
cagtctctgtgccagatcctgg

SEQ ID NO: 7639707 - DNA, 22 bp, Homo sapiens
cagtctctgtgccagatcctgg

SEQ ID NO: 7639708 - DNA, 22 bp, Homo sapiens
cagtctctgtcatctcatggga

SEQ ID NO: 7639709 - DNA, 22 bp, Homo sapiens
cagtctctgtcatctcatggga

SEQ ID NO: 7639710 - DNA, 22 bp, Homo sapiens
cagtctctgtcatctcatggga

SEQ ID NO: 7639711 - DNA, 22 bp, Homo sapiens
cagtctctgtcatctcatggga

SEQ ID NO: 7639712 - DNA, 22 bp, Homo sapiens
cagtctctgtcatctcatggga

SEQ ID NO: 7639713 - DNA, 19 bp, Homo sapiens
aggagaagactctctcccc

SEQ ID NO: 7639714 - DNA, 19 bp, Homo sapiens
aggagaagactctctcccc

SEQ ID NO: 7639715 - DNA, 23 bp, Homo sapiens
aggagaagagatttccacatgca

SEQ ID NO: 7639716 - DNA, 20 bp, Homo sapiens
aggagaaattcgggacacct

SEQ ID NO: 7639717 - DNA, 19 bp, Homo sapiens
aggagaagactctctcccc

SEQ ID NO: 7639718 - DNA, 23 bp, Homo sapiens
aggagaagagatttccacatgca

SEQ ID NO: 7639719 - DNA, 23 bp, Homo sapiens
aggagaagagatttccacatgca

SEQ ID NO: 7639720 - DNA, 23 bp, Homo sapiens
aggagaagagatttccacatgca

SEQ ID NO: 7639721 - DNA, 23 bp, Homo sapiens
aggagaagagatttccacatgca

SEQ ID NO: 7639722 - DNA, 23 bp, Homo sapiens
aggagaagagatttccacatgca

SEQ ID NO: 7639723 - DNA, 22 bp, Homo sapiens
aggagaagccaagttgtgagca

SEQ ID NO: 7639724 - DNA, 22 bp, Homo sapiens
aggagaagccaagttgtgagca

SEQ ID NO: 7639725 - DNA, 23 bp, Homo sapiens
aggagaagagatttccacatgca

SEQ ID NO: 7639726 - DNA, 23 bp, Homo sapiens
aggagaagagatttccacatgca

SEQ ID NO: 7639727 - DNA, 23 bp, Homo sapiens
aggagaagagatttccacatgca

SEQ ID NO: 7639728 - DNA, 23 bp, Homo sapiens
aggagaagagatttccacatgca

SEQ ID NO: 7639729 - DNA, 23 bp, Homo sapiens
aggagaagagatttccacatgca

SEQ ID NO: 7639730 - DNA, 23 bp, Homo sapiens
aggagaagagatttccacatgca

SEQ ID NO: 7639731 - DNA, 22 bp, Homo sapiens
cagtctctctgaagtattaaga

SEQ ID NO: 7639732 - DNA, 22 bp, Homo sapiens
cagtctctctccttgcaggcgt

SEQ ID NO: 7639733 - DNA, 22 bp, Homo sapiens
cagtctctctccttgcaggcgt

SEQ ID NO: 7639734 - DNA, 22 bp, Homo sapiens
cagtctctctccttgcaggcgt

SEQ ID NO: 7639735 - DNA, 22 bp, Homo sapiens
cagtctctctccttgcaggcgt

SEQ ID NO: 7639736 - DNA, 22 bp, Homo sapiens
aggagaagccaagttgtgagca

SEQ ID NO: 7639737 - DNA, 22 bp, Homo sapiens
aggagaagccaagttgtgagca

SEQ ID NO: 7639738 - DNA, 22 bp, Homo sapiens
aggagaagccaagttgtgagca

SEQ ID NO: 7639739 - DNA, 22 bp, Homo sapiens
cagtctctgccacttctaagct

SEQ ID NO: 7639740 - DNA, 22 bp, Homo sapiens
cagtctctggcagctgctggcc

SEQ ID NO: 7639741 - DNA, 22 bp, Homo sapiens
cagtctctgccacttctaagct

SEQ ID NO: 7639742 - DNA, 22 bp, Homo sapiens
cagtctctcttgtagtgcagct

SEQ ID NO: 7639743 - DNA, 22 bp, Homo sapiens
cagtctctctgaagtattaaga

SEQ ID NO: 7639744 - DNA, 22 bp, Homo sapiens
cagtctctcttgtagtgcagct

SEQ ID NO: 7639745 - DNA, 22 bp, Homo sapiens
cagtctctcttgtagtgcagct

SEQ ID NO: 7639746 - DNA, 22 bp, Homo sapiens
cagtctctcttgtagtgcagct

SEQ ID NO: 7639747 - DNA, 22 bp, Homo sapiens
cagtctctcttgtagtgcagct

SEQ ID NO: 7639748 - DNA, 22 bp, Homo sapiens
aggaggcactcactctcagggt

SEQ ID NO: 7639749 - DNA, 22 bp, Homo sapiens
aggaggcactcactctcagggt

SEQ ID NO: 7639750 - DNA, 22 bp, Homo sapiens
aggaggcactcactctcagggt

SEQ ID NO: 7639751 - DNA, 22 bp, Homo sapiens
aggaggcactcactctcagggt

SEQ ID NO: 7639752 - DNA, 20 bp, Homo sapiens
aggaggcaatgtagataagc

SEQ ID NO: 7639753 - DNA, 22 bp, Homo sapiens
aggaggcactcactctcagggt

SEQ ID NO: 7639754 - DNA, 22 bp, Homo sapiens
aggaggcactcactctcagggt

SEQ ID NO: 7639755 - DNA, 22 bp, Homo sapiens
aggaggcactcactctcagggt

SEQ ID NO: 7639756 - DNA, 22 bp, Homo sapiens
aggaggcactcactctcagggt

SEQ ID NO: 7639757 - DNA, 17 bp, Homo sapiens
catctttaaaatcctga

SEQ ID NO: 7639758 - DNA, 17 bp, Homo sapiens
catctttaaaatcctga

SEQ ID NO: 7639759 - DNA, 22 bp, Homo sapiens
aggaggcagatgcttggctgta

SEQ ID NO: 7639760 - DNA, 22 bp, Homo sapiens
aggaggcagatgcttggctgta

SEQ ID NO: 7639761 - DNA, 22 bp, Homo sapiens
aggaggcagatgcttggctgta

SEQ ID NO: 7639762 - DNA, 22 bp, Homo sapiens
aggaggcactcactctcagggt

SEQ ID NO: 7639763 - DNA, 22 bp, Homo sapiens
aggaggcagatgcttggctgta

SEQ ID NO: 7639764 - DNA, 22 bp, Homo sapiens
catgaaatattagtaactgttt

SEQ ID NO: 7639765 - DNA, 22 bp, Homo sapiens
catgaaatattagtaactgttt

SEQ ID NO: 7639766 - DNA, 22 bp, Homo sapiens
catgaaatatgctacctgtctt

SEQ ID NO: 7639767 - DNA, 22 bp, Homo sapiens
catgaaatatgctacctgtctt

SEQ ID NO: 7639768 - DNA, 22 bp, Homo sapiens
catgaaatatgctacctgtctt

SEQ ID NO: 7639769 - DNA, 22 bp, Homo sapiens
catgaaatatgctacctgtctt

SEQ ID NO: 7639770 - DNA, 22 bp, Homo sapiens
catgaaagcaggaatggtttta

SEQ ID NO: 7639771 - DNA, 22 bp, Homo sapiens
catgaaatatgctacctgtctt

SEQ ID NO: 7639772 - DNA, 22 bp, Homo sapiens
catgaaagcaggaatggtttta

SEQ ID NO: 7639773 - DNA, 22 bp, Homo sapiens
catgaaacatcagagatttctc

SEQ ID NO: 7639774 - DNA, 22 bp, Homo sapiens
catgaaagcaggaatggtttta

SEQ ID NO: 7639775 - DNA, 22 bp, Homo sapiens
catgaaagcaggaatggtttta

SEQ ID NO: 7639776 - DNA, 22 bp, Homo sapiens
catgaaacatcagagatttctc

SEQ ID NO: 7639777 - DNA, 22 bp, Homo sapiens
catgaaaatgtcaagttctgct

SEQ ID NO: 7639778 - DNA, 22 bp, Homo sapiens
catgaaaatgtcaagttctgct

SEQ ID NO: 7639779 - DNA, 22 bp, Homo sapiens
catctttaaaatgggaacaaca

SEQ ID NO: 7639780 - DNA, 22 bp, Homo sapiens
catgaaaatgtcaagttctgct

SEQ ID NO: 7639781 - DNA, 22 bp, Homo sapiens
catgaaaatgtcaagttctgct

SEQ ID NO: 7639782 - DNA, 22 bp, Homo sapiens
catgaaaatgtcaagttctgct

SEQ ID NO: 7639783 - DNA, 22 bp, Homo sapiens
catgaaaatgtcaagttctgct

SEQ ID NO: 7639784 - DNA, 22 bp, Homo sapiens
catgaaaatgtcaagttctgct

SEQ ID NO: 7639785 - DNA, 22 bp, Homo sapiens
catgaaatctgagtatgtttcc

SEQ ID NO: 7639786 - DNA, 22 bp, Homo sapiens
catgaaatcacaagctgaggac

SEQ ID NO: 7639787 - DNA, 22 bp, Homo sapiens
catgaaatctgagtatgtttcc

SEQ ID NO: 7639788 - DNA, 22 bp, Homo sapiens
catgaaatcacaagctgaggac

SEQ ID NO: 7639789 - DNA, 22 bp, Homo sapiens
catgaaatattagtaactgttt

SEQ ID NO: 7639790 - DNA, 22 bp, Homo sapiens
catgaaatcacaagctgaggac

SEQ ID NO: 7639791 - DNA, 22 bp, Homo sapiens
catgaaatcacaagctgaggac

SEQ ID NO: 7639792 - DNA, 22 bp, Homo sapiens
catgaaatgtgttaatctcttg

SEQ ID NO: 7639793 - DNA, 22 bp, Homo sapiens
catgaaatgtgttaatctcttg

SEQ ID NO: 7639794 - DNA, 22 bp, Homo sapiens
catgaaatggccaaccttcggc

SEQ ID NO: 7639795 - DNA, 22 bp, Homo sapiens
catgaaatgatatttgggtggg

SEQ ID NO: 7639796 - DNA, 22 bp, Homo sapiens
catgaaatgatatttgggtggg

SEQ ID NO: 7639797 - DNA, 22 bp, Homo sapiens
catgaaatgatatttgggtggg

SEQ ID NO: 7639798 - DNA, 22 bp, Homo sapiens
catgaaatggccaaccttcggc

SEQ ID NO: 7639799 - DNA, 22 bp, Homo sapiens
catgaaatggccaaccttcggc

SEQ ID NO: 7639800 - DNA, 22 bp, Homo sapiens
aggaggtgcgtggtgatcccct

SEQ ID NO: 7639801 - DNA, 22 bp, Homo sapiens
aggaggtgcgtggtgatcccct

SEQ ID NO: 7639802 - DNA, 22 bp, Homo sapiens
aggaggtgctagagaagatgtt

SEQ ID NO: 7639803 - DNA, 22 bp, Homo sapiens
aggaggtgcgtggtgatcccct

SEQ ID NO: 7639804 - DNA, 22 bp, Homo sapiens
aggaggtgcgtggtgatcccct

SEQ ID NO: 7639805 - DNA, 22 bp, Homo sapiens
catgaaattcagcaggtgagta

SEQ ID NO: 7639806 - DNA, 22 bp, Homo sapiens
catgaaatgttagaattagaca

SEQ ID NO: 7639807 - DNA, 22 bp, Homo sapiens
catgaaattcagcaggtgagta

SEQ ID NO: 7639808 - DNA, 22 bp, Homo sapiens
catgaaattcagcaggtgagta

SEQ ID NO: 7639809 - DNA, 22 bp, Homo sapiens
catgaaattcagcaggtgagta

SEQ ID NO: 7639810 - DNA, 22 bp, Homo sapiens
catgaaatgttagaattagaca

SEQ ID NO: 7639811 - DNA, 22 bp, Homo sapiens
catgaaatgttagaattagaca

SEQ ID NO: 7639812 - DNA, 22 bp, Homo sapiens
catgaaatgttagaattagaca

SEQ ID NO: 7639813 - DNA, 22 bp, Homo sapiens
catgaaatgttagaattagaca

SEQ ID NO: 7639814 - DNA, 22 bp, Homo sapiens
catgaaatgttagaattagaca

SEQ ID NO: 7639815 - DNA, 22 bp, Homo sapiens
catgaaatgttagaattagaca

SEQ ID NO: 7639816 - DNA, 22 bp, Homo sapiens
catgaaatgttagaattagaca

SEQ ID NO: 7639817 - DNA, 22 bp, Homo sapiens
catgaaatgtgttaatctcttg

SEQ ID NO: 7639818 - DNA, 22 bp, Homo sapiens
catgaaatgtgttaatctcttg

SEQ ID NO: 7639819 - DNA, 22 bp, Homo sapiens
aggaggtggctgaacttgaggg

SEQ ID NO: 7639820 - DNA, 22 bp, Homo sapiens
aggaggtggcctgagcgtgccc

SEQ ID NO: 7639821 - DNA, 22 bp, Homo sapiens
aggaggtggcctgagcgtgccc

SEQ ID NO: 7639822 - DNA, 22 bp, Homo sapiens
aggaggtggcctgagcgtgccc

SEQ ID NO: 7639823 - DNA, 22 bp, Homo sapiens
aggaggtggcctgagcgtgccc

SEQ ID NO: 7639824 - DNA, 22 bp, Homo sapiens
aggaggtggcctgagcgtgccc

SEQ ID NO: 7639825 - DNA, 22 bp, Homo sapiens
aggaggtggcctgagcgtgccc

SEQ ID NO: 7639826 - DNA, 22 bp, Homo sapiens
aggaggtggcctgagcgtgccc

SEQ ID NO: 7639827 - DNA, 22 bp, Homo sapiens
aggaggtggctgaacttgaggg

SEQ ID NO: 7639828 - DNA, 22 bp, Homo sapiens
aggaggtggctgaacttgaggg

SEQ ID NO: 7639829 - DNA, 22 bp, Homo sapiens
aggaggtgtagatttcctgtca

SEQ ID NO: 7639830 - DNA, 22 bp, Homo sapiens
aggaggtgtagatttcctgtca

SEQ ID NO: 7639831 - DNA, 22 bp, Homo sapiens
aggaggtgttgatagaaggttt

SEQ ID NO: 7639832 - DNA, 22 bp, Homo sapiens
aggaggtgttgatagaaggttt

SEQ ID NO: 7639833 - DNA, 22 bp, Homo sapiens
aggaggtgtagatttcctgtca

SEQ ID NO: 7639834 - DNA, 22 bp, Homo sapiens
aggaggtgctgtttgtcctgga

SEQ ID NO: 7639835 - DNA, 22 bp, Homo sapiens
aggaggtgctagagaagatgtt

SEQ ID NO: 7639836 - DNA, 22 bp, Homo sapiens
aggaggtgctagagaagatgtt

SEQ ID NO: 7639837 - DNA, 22 bp, Homo sapiens
aggaggtgctagagaagatgtt

SEQ ID NO: 7639838 - DNA, 22 bp, Homo sapiens
aggaggtgctagagaagatgtt

SEQ ID NO: 7639839 - DNA, 22 bp, Homo sapiens
aggaggtgctagagaagatgtt

SEQ ID NO: 7639840 - DNA, 22 bp, Homo sapiens
aggaggtgctagagaagatgtt

SEQ ID NO: 7639841 - DNA, 22 bp, Homo sapiens
aggaggtgctgtttgtcctgga

SEQ ID NO: 7639842 - DNA, 22 bp, Homo sapiens
aggaggtgctgtttgtcctgga

SEQ ID NO: 7639843 - DNA, 22 bp, Homo sapiens
aggaggtggcaactgtcgacag

SEQ ID NO: 7639844 - DNA, 22 bp, Homo sapiens
aggaggtgctgtttgtcctgga

SEQ ID NO: 7639845 - DNA, 22 bp, Homo sapiens
aggaggtggcaactgtcgacag

SEQ ID NO: 7639846 - DNA, 22 bp, Homo sapiens
aggaggtggcctgagcgtgccc

SEQ ID NO: 7639847 - DNA, 20 bp, Homo sapiens
catgcacagccatagcgcta

SEQ ID NO: 7639848 - DNA, 20 bp, Homo sapiens
catgcacagccatagcgcta

SEQ ID NO: 7639849 - DNA, 22 bp, Homo sapiens
catgcacagagcttggtcattg

SEQ ID NO: 7639850 - DNA, 22 bp, Homo sapiens
catgcacagtgatatctgaaga

SEQ ID NO: 7639851 - DNA, 22 bp, Homo sapiens
catgcacagtgatatctgaaga

SEQ ID NO: 7639852 - DNA, 22 bp, Homo sapiens
catgcacagtgatatctgaaga

SEQ ID NO: 7639853 - DNA, 22 bp, Homo sapiens
catgcacagtgatatctgaaga

SEQ ID NO: 7639854 - DNA, 20 bp, Homo sapiens
catgcacagccatagcgcta

SEQ ID NO: 7639855 - DNA, 22 bp, Homo sapiens
catgcacatgcaatagtgcttt

SEQ ID NO: 7639856 - DNA, 22 bp, Homo sapiens
catgcacatgcaatagtgcttt

SEQ ID NO: 7639857 - DNA, 22 bp, Homo sapiens
catgcactttatctttcagcca

SEQ ID NO: 7639858 - DNA, 22 bp, Homo sapiens
catgcactgagagggtctcggc

SEQ ID NO: 7639859 - DNA, 22 bp, Homo sapiens
catgcactgatgcaaggtctgc

SEQ ID NO: 7639860 - DNA, 22 bp, Homo sapiens
catgcactggaatctgattaca

SEQ ID NO: 7639861 - DNA, 22 bp, Homo sapiens
catgcactgatgcaaggtctgc

SEQ ID NO: 7639862 - DNA, 22 bp, Homo sapiens
catgcactctttgagaaggatg

SEQ ID NO: 7639863 - DNA, 22 bp, Homo sapiens
catgcactctttgagaaggatg

SEQ ID NO: 7639864 - DNA, 22 bp, Homo sapiens
catgcactctttgagaaggatg

SEQ ID NO: 7639865 - DNA, 22 bp, Homo sapiens
catgcacattattcaaagccca

SEQ ID NO: 7639866 - DNA, 22 bp, Homo sapiens
catgcacattattcaaagccca

SEQ ID NO: 7639867 - DNA, 22 bp, Homo sapiens
catgcacatgtggctatgtaat

SEQ ID NO: 7639868 - DNA, 22 bp, Homo sapiens
catgcacatgtggctatgtaat

SEQ ID NO: 7639869 - DNA, 22 bp, Homo sapiens
catgcacatgtggctatgtaat

SEQ ID NO: 7639870 - DNA, 22 bp, Homo sapiens
catgcacagagcttggtcattg

SEQ ID NO: 7639871 - DNA, 22 bp, Homo sapiens
catgcacagagcttggtcattg

SEQ ID NO: 7639872 - DNA, 22 bp, Homo sapiens
catgcacagagcttggtcattg

SEQ ID NO: 7639873 - DNA, 22 bp, Homo sapiens
catgcacagagcttggtcattg

SEQ ID NO: 7639874 - DNA, 22 bp, Homo sapiens
catgcacagagcttggtcattg

SEQ ID NO: 7639875 - DNA, 22 bp, Homo sapiens
catgcacactgcaacaaggact

SEQ ID NO: 7639876 - DNA, 22 bp, Homo sapiens
catgcacactgcaacaaggact

SEQ ID NO: 7639877 - DNA, 22 bp, Homo sapiens
catgagtgctatatgtgaagag

SEQ ID NO: 7639878 - DNA, 22 bp, Homo sapiens
catgagtgggattaatgacctt

SEQ ID NO: 7639879 - DNA, 22 bp, Homo sapiens
catgagtgggcgccaggaagag

SEQ ID NO: 7639880 - DNA, 22 bp, Homo sapiens
catgagtgggcgccaggaagag

SEQ ID NO: 7639881 - DNA, 22 bp, Homo sapiens
catgcacactgcaacaaggact

SEQ ID NO: 7639882 - DNA, 22 bp, Homo sapiens
aggaggtgttgatagaaggttt

SEQ ID NO: 7639883 - DNA, 22 bp, Homo sapiens
aggaggtgttgatagaaggttt

SEQ ID NO: 7639884 - DNA, 22 bp, Homo sapiens
aggaggtgttgatagaaggttt

SEQ ID NO: 7639885 - DNA, 22 bp, Homo sapiens
aggaggtgttgatagaaggttt

SEQ ID NO: 7639886 - DNA, 22 bp, Homo sapiens
catgaggtgataaagctgggat

SEQ ID NO: 7639887 - DNA, 22 bp, Homo sapiens
catgagtgagtatctcaagata

SEQ ID NO: 7639888 - DNA, 20 bp, Homo sapiens
catgccatgtctactgaggc

SEQ ID NO: 7639889 - DNA, 22 bp, Homo sapiens
catgccagttttgagatgcacc

SEQ ID NO: 7639890 - DNA, 22 bp, Homo sapiens
catgccagttttgagatgcacc

SEQ ID NO: 7639891 - DNA, 22 bp, Homo sapiens
catgccatgtgtgaggagagga

SEQ ID NO: 7639892 - DNA, 22 bp, Homo sapiens
catgccatgtgtgaggagagga

SEQ ID NO: 7639893 - DNA, 22 bp, Homo sapiens
catgccatttacttggaggaga

SEQ ID NO: 7639894 - DNA, 22 bp, Homo sapiens
catgccagttttgagatgcacc

SEQ ID NO: 7639895 - DNA, 23 bp, Homo sapiens
catgccagtttgtgcaggcagat

SEQ ID NO: 7639896 - DNA, 22 bp, Homo sapiens
catgccagggcttgctgcctgg

SEQ ID NO: 7639897 - DNA, 22 bp, Homo sapiens
catgccagggcttgctgcctgg

SEQ ID NO: 7639898 - DNA, 22 bp, Homo sapiens
catgccaggtttgagtatcttg

SEQ ID NO: 7639899 - DNA, 23 bp, Homo sapiens
catgccagtttgtgcaggcagat

SEQ ID NO: 7639900 - DNA, 22 bp, Homo sapiens
catgccctccttgccttcactg

SEQ ID NO: 7639901 - DNA, 17 bp, Homo sapiens
catgccccaggcttagc

SEQ ID NO: 7639902 - DNA, 17 bp, Homo sapiens
catgccccaggcttagc

SEQ ID NO: 7639903 - DNA, 22 bp, Homo sapiens
catgccctccttgccttcactg

SEQ ID NO: 7639904 - DNA, 22 bp, Homo sapiens
catgcctctgcagctgtttatt

SEQ ID NO: 7639905 - DNA, 22 bp, Homo sapiens
catgcctgcctggtgggcgtgg

SEQ ID NO: 7639906 - DNA, 22 bp, Homo sapiens
catgcccagagctccgggcgcc

SEQ ID NO: 7639907 - DNA, 22 bp, Homo sapiens
catgcccagagctccgggcgcc

SEQ ID NO: 7639908 - DNA, 22 bp, Homo sapiens
catgccatttcttctctttatg

SEQ ID NO: 7639909 - DNA, 22 bp, Homo sapiens
catgcctgtaatcccagctctt

SEQ ID NO: 7639910 - DNA, 22 bp, Homo sapiens
catgcctgtaatcccagctctt

SEQ ID NO: 7639911 - DNA, 22 bp, Homo sapiens
catgcctgtaatcccagctctt

SEQ ID NO: 7639912 - DNA, 22 bp, Homo sapiens
catgcctgtaatcccagctctt

SEQ ID NO: 7639913 - DNA, 22 bp, Homo sapiens
catgcctgtaatcccagcactt

SEQ ID NO: 7639914 - DNA, 22 bp, Homo sapiens
catgcctgtaatcccagcactt

SEQ ID NO: 7639915 - DNA, 20 bp, Homo sapiens
catgcctgctggtatctggc

SEQ ID NO: 7639916 - DNA, 20 bp, Homo sapiens
catgcctgctggtatctggc

SEQ ID NO: 7639917 - DNA, 22 bp, Homo sapiens
catgcacttacctgaaattcaa

SEQ ID NO: 7639918 - DNA, 22 bp, Homo sapiens
catgcactttgatggagagcgt

SEQ ID NO: 7639919 - DNA, 22 bp, Homo sapiens
catgcactttgatggagagcgt

SEQ ID NO: 7639920 - DNA, 22 bp, Homo sapiens
catgcactttgatggagagcgt

SEQ ID NO: 7639921 - DNA, 22 bp, Homo sapiens
catgcagaggtgccacgaggct

SEQ ID NO: 7639922 - DNA, 18 bp, Homo sapiens
catgcagagggatctgtg

SEQ ID NO: 7639923 - DNA, 22 bp, Homo sapiens
catgcagatatttttattgtgg

SEQ ID NO: 7639924 - DNA, 22 bp, Homo sapiens
catgcagatgtcatgaggcatg

SEQ ID NO: 7639925 - DNA, 22 bp, Homo sapiens
catgcagagtttattaccatct

SEQ ID NO: 7639926 - DNA, 22 bp, Homo sapiens
catgcagagtttattaccatct

SEQ ID NO: 7639927 - DNA, 22 bp, Homo sapiens
catgcagagtttattaccatct

SEQ ID NO: 7639928 - DNA, 22 bp, Homo sapiens
catgcagataattatattgtgt

SEQ ID NO: 7639929 - DNA, 22 bp, Homo sapiens
catgcagatgtcatgaggcatg

SEQ ID NO: 7639930 - DNA, 22 bp, Homo sapiens
catgcagatgtcatgaggcatg

SEQ ID NO: 7639931 - DNA, 21 bp, Homo sapiens
catgcagattctggagccaga

SEQ ID NO: 7639932 - DNA, 21 bp, Homo sapiens
catgcagattctggagccaga

SEQ ID NO: 7639933 - DNA, 22 bp, Homo sapiens
catgcagatttgctgagataat

SEQ ID NO: 7639934 - DNA, 22 bp, Homo sapiens
catgcagatttgctgagataat

SEQ ID NO: 7639935 - DNA, 22 bp, Homo sapiens
catgcagatttgctgagataat

SEQ ID NO: 7639936 - DNA, 21 bp, Homo sapiens
catgcagattctggagccaga

SEQ ID NO: 7639937 - DNA, 22 bp, Homo sapiens
catgcagcagaataatgactat

SEQ ID NO: 7639938 - DNA, 22 bp, Homo sapiens
catgcagcagaataatgactat

SEQ ID NO: 7639939 - DNA, 22 bp, Homo sapiens
catgcagatttgctgagataat

SEQ ID NO: 7639940 - DNA, 22 bp, Homo sapiens
catgcagatttgctgagataat

SEQ ID NO: 7639941 - DNA, 22 bp, Homo sapiens
catgcagcaggatctcattccc

SEQ ID NO: 7639942 - DNA, 22 bp, Homo sapiens
catgcagcctgtgaacagtgtc

SEQ ID NO: 7639943 - DNA, 22 bp, Homo sapiens
catgcaggcctatggagcagtg

SEQ ID NO: 7639944 - DNA, 22 bp, Homo sapiens
catgcaggcccgcctgaatggg

SEQ ID NO: 7639945 - DNA, 22 bp, Homo sapiens
catgccagggcttgctgcctgg

SEQ ID NO: 7639946 - DNA, 22 bp, Homo sapiens
catgccaggattaggacccagc

SEQ ID NO: 7639947 - DNA, 22 bp, Homo sapiens
catgccaggactctggaggctt

SEQ ID NO: 7639948 - DNA, 22 bp, Homo sapiens
catgcaggcctatggagcagtg

SEQ ID NO: 7639949 - DNA, 22 bp, Homo sapiens
catgcaggcctatggagcagtg

SEQ ID NO: 7639950 - DNA, 22 bp, Homo sapiens
catgcaggcctatggagcagtg

SEQ ID NO: 7639951 - DNA, 22 bp, Homo sapiens
catgccaggattaggacccagc

SEQ ID NO: 7639952 - DNA, 22 bp, Homo sapiens
catgcaggaggaaaaagcagct

SEQ ID NO: 7639953 - DNA, 21 bp, Homo sapiens
catgcaggatttaacctagaa

SEQ ID NO: 7639954 - DNA, 22 bp, Homo sapiens
catgcaggcacccagagcccac

SEQ ID NO: 7639955 - DNA, 22 bp, Homo sapiens
catgcaggcacccagagcccac

SEQ ID NO: 7639956 - DNA, 22 bp, Homo sapiens
catgcagcggcgtttggtttaa

SEQ ID NO: 7639957 - DNA, 22 bp, Homo sapiens
catgcagcggcgtttggtttaa

SEQ ID NO: 7639958 - DNA, 22 bp, Homo sapiens
catgcagcctgtgaacagtgtc

SEQ ID NO: 7639959 - DNA, 22 bp, Homo sapiens
catgcaggaggaaaaagcagct

SEQ ID NO: 7639960 - DNA, 22 bp, Homo sapiens
aggcacaggaggtggtaagaag

SEQ ID NO: 7639961 - DNA, 22 bp, Homo sapiens
aggcacaggaggtggtaagaag

SEQ ID NO: 7639962 - DNA, 22 bp, Homo sapiens
aggcacaggaggtggtaagaag

SEQ ID NO: 7639963 - DNA, 22 bp, Homo sapiens
aggcacaggaggtggtaagaag

SEQ ID NO: 7639964 - DNA, 22 bp, Homo sapiens
aggcacaggaggtggtaagaag

SEQ ID NO: 7639965 - DNA, 22 bp, Homo sapiens
aggcacaggaggtggtaagaag

SEQ ID NO: 7639966 - DNA, 22 bp, Homo sapiens
aggcacaggaggtggtaagaag

SEQ ID NO: 7639967 - DNA, 22 bp, Homo sapiens
aggcacaggaggtggtaagaag

SEQ ID NO: 7639968 - DNA, 22 bp, Homo sapiens
aggcacaggaatgtcatccagt

SEQ ID NO: 7639969 - DNA, 22 bp, Homo sapiens
aggcacaggaatgtcatccagt

SEQ ID NO: 7639970 - DNA, 22 bp, Homo sapiens
aggcacaggaatgtcatccagt

SEQ ID NO: 7639971 - DNA, 22 bp, Homo sapiens
aggcacaggaatgtcatccagt

SEQ ID NO: 7639972 - DNA, 22 bp, Homo sapiens
aggcacaggaatgtcatccagt

SEQ ID NO: 7639973 - DNA, 22 bp, Homo sapiens
aggcacaggaatgtcatccagt

SEQ ID NO: 7639974 - DNA, 22 bp, Homo sapiens
aggcacaggaatgtcatccagt

SEQ ID NO: 7639975 - DNA, 22 bp, Homo sapiens
aggcacaggaatgtcatccagt

SEQ ID NO: 7639976 - DNA, 22 bp, Homo sapiens
aggcacaggaatgtcatccagt

SEQ ID NO: 7639977 - DNA, 22 bp, Homo sapiens
aggcacaggaatgtcatccagt

SEQ ID NO: 7639978 - DNA, 22 bp, Homo sapiens
aggcacaggaatgtcatccagt

SEQ ID NO: 7639979 - DNA, 22 bp, Homo sapiens
aggcacaggaatgtcatccagt

SEQ ID NO: 7639980 - DNA, 22 bp, Homo sapiens
aggcacaggaatgtcatccagt

SEQ ID NO: 7639981 - DNA, 22 bp, Homo sapiens
catggccagggcagatggcagg

SEQ ID NO: 7639982 - DNA, 22 bp, Homo sapiens
catggccagggagagagaatgt

SEQ ID NO: 7639983 - DNA, 22 bp, Homo sapiens
catggccagggcagatggcagg

SEQ ID NO: 7639984 - DNA, 22 bp, Homo sapiens
catggccagggcagatggcagg

SEQ ID NO: 7639985 - DNA, 22 bp, Homo sapiens
catggccagggcagatggcagg

SEQ ID NO: 7639986 - DNA, 22 bp, Homo sapiens
catggccaggcccagggcccag

SEQ ID NO: 7639987 - DNA, 22 bp, Homo sapiens
catggccaggcccagggcccag

SEQ ID NO: 7639988 - DNA, 22 bp, Homo sapiens
catggccaggcccagggcccag

SEQ ID NO: 7639989 - DNA, 22 bp, Homo sapiens
catggccaggccaagagagtac

SEQ ID NO: 7639990 - DNA, 22 bp, Homo sapiens
catggccaggcccagggcccag

SEQ ID NO: 7639991 - DNA, 22 bp, Homo sapiens
aggcacaggcctcagcacccag

SEQ ID NO: 7639992 - DNA, 22 bp, Homo sapiens
aggcacaggcctcagcacccag

SEQ ID NO: 7639993 - DNA, 22 bp, Homo sapiens
aggcacaggcctcagcacccag

SEQ ID NO: 7639994 - DNA, 22 bp, Homo sapiens
aggcacaggaggtggtaagaag

SEQ ID NO: 7639995 - DNA, 22 bp, Homo sapiens
aggcacaggcctcagcacccag

SEQ ID NO: 7639996 - DNA, 22 bp, Homo sapiens
aggcacaggcctcagcacccag

SEQ ID NO: 7639997 - DNA, 22 bp, Homo sapiens
catggccaggccaagagagtac

SEQ ID NO: 7639998 - DNA, 22 bp, Homo sapiens
aggcacaggcctcagcacccag

SEQ ID NO: 7639999 - DNA, 22 bp, Homo sapiens
aggcacaggcctcagcacccag

SEQ ID NO: 7640000 - DNA, 22 bp, Homo sapiens
aggcacaggaacaggaaaagag

SEQ ID NO: 7640001 - DNA, 22 bp, Homo sapiens
aggcacaggaacaggaaaagag

SEQ ID NO: 7640002 - DNA, 22 bp, Homo sapiens
aggcacaggaacaggaaaagag

SEQ ID NO: 7640003 - DNA, 22 bp, Homo sapiens
aggcacaggaatgtcatccagt

SEQ ID NO: 7640004 - DNA, 22 bp, Homo sapiens
aggcacaggaacaggaaaagag

SEQ ID NO: 7640005 - DNA, 22 bp, Homo sapiens
aggcacaggaacaggaaaagag

SEQ ID NO: 7640006 - DNA, 22 bp, Homo sapiens
aggcacaggaacaggaaaagag

SEQ ID NO: 7640007 - DNA, 22 bp, Homo sapiens
aggcacaggaacaggaaaagag

SEQ ID NO: 7640008 - DNA, 22 bp, Homo sapiens
aggcacaggaacaggaaaagag

SEQ ID NO: 7640009 - DNA, 22 bp, Homo sapiens
aggcacaggaacaggaaaagag

SEQ ID NO: 7640010 - DNA, 22 bp, Homo sapiens
aggcacaggaacaggaaaagag

SEQ ID NO: 7640011 - DNA, 22 bp, Homo sapiens
aggcacaggaacaggaaaagag

SEQ ID NO: 7640012 - DNA, 22 bp, Homo sapiens
aggcacagcctcccttcacatg

SEQ ID NO: 7640013 - DNA, 22 bp, Homo sapiens
aggcacagcctcccttcacatg

SEQ ID NO: 7640014 - DNA, 22 bp, Homo sapiens
aggcacagcctcccttcacatg

SEQ ID NO: 7640015 - DNA, 22 bp, Homo sapiens
aggcacagcctcccttcacatg

SEQ ID NO: 7640016 - DNA, 22 bp, Homo sapiens
aggcacagcctcccttcacatg

SEQ ID NO: 7640017 - DNA, 22 bp, Homo sapiens
aggcacagcctcccttcacatg

SEQ ID NO: 7640018 - DNA, 22 bp, Homo sapiens
aggcacagcctcccttcacatg

SEQ ID NO: 7640019 - DNA, 22 bp, Homo sapiens
aggcacagcctcccttcacatg

SEQ ID NO: 7640020 - DNA, 22 bp, Homo sapiens
aggcacagcctcccttcacatg

SEQ ID NO: 7640021 - DNA, 22 bp, Homo sapiens
aggcacaaaagcagggtgacca

SEQ ID NO: 7640022 - DNA, 22 bp, Homo sapiens
aggcacagcacacctggccccc

SEQ ID NO: 7640023 - DNA, 22 bp, Homo sapiens
aggcacagcctcccccaactcc

SEQ ID NO: 7640024 - DNA, 22 bp, Homo sapiens
aggcacagcctcccccaactcc

SEQ ID NO: 7640025 - DNA, 22 bp, Homo sapiens
aggcacagcctcccccaactcc

SEQ ID NO: 7640026 - DNA, 22 bp, Homo sapiens
aggcacagcctcccccaactcc

SEQ ID NO: 7640027 - DNA, 22 bp, Homo sapiens
aggcacagcctcccccaactcc

SEQ ID NO: 7640028 - DNA, 22 bp, Homo sapiens
aggcacagcctcccccaactcc

SEQ ID NO: 7640029 - DNA, 22 bp, Homo sapiens
aggcacagcctcccccaactcc

SEQ ID NO: 7640030 - DNA, 22 bp, Homo sapiens
aggcaatgcagatagatgaatg

SEQ ID NO: 7640031 - DNA, 23 bp, Homo sapiens
aggcaatgccctgctgagaactc

SEQ ID NO: 7640032 - DNA, 23 bp, Homo sapiens
aggcaatgccctgctgagaactc

SEQ ID NO: 7640033 - DNA, 22 bp, Homo sapiens
catgcctgtatttctgatctat

SEQ ID NO: 7640034 - DNA, 22 bp, Homo sapiens
catgcctgtatttctgatctat

SEQ ID NO: 7640035 - DNA, 22 bp, Homo sapiens
cattcaaaggcatgtcctattt

SEQ ID NO: 7640036 - DNA, 22 bp, Homo sapiens
cattcaaagcaggaaaggcctt

SEQ ID NO: 7640037 - DNA, 22 bp, Homo sapiens
cattcaaagcaggaaaggcctt

SEQ ID NO: 7640038 - DNA, 22 bp, Homo sapiens
cattcaaagcaggaaaggcctt

SEQ ID NO: 7640039 - DNA, 22 bp, Homo sapiens
cattcaaacattaatttattca

SEQ ID NO: 7640040 - DNA, 22 bp, Homo sapiens
cattcaaacattaatttattca

SEQ ID NO: 7640041 - DNA, 22 bp, Homo sapiens
cattcaaacattaatttattca

SEQ ID NO: 7640042 - DNA, 20 bp, Homo sapiens
cattattgtaatcagctgta

SEQ ID NO: 7640043 - DNA, 22 bp, Homo sapiens
cattcaaaagctccatgtttgt

SEQ ID NO: 7640044 - DNA, 22 bp, Homo sapiens
cattcaaaagctccatgtttgt

SEQ ID NO: 7640045 - DNA, 22 bp, Homo sapiens
cattcaaaagctccatgtttgt

SEQ ID NO: 7640046 - DNA, 22 bp, Homo sapiens
cattcaaacattaatttattca

SEQ ID NO: 7640047 - DNA, 22 bp, Homo sapiens
cattcaaaatgggctgacctgt

SEQ ID NO: 7640048 - DNA, 22 bp, Homo sapiens
cattcaaaatgggctgacctgt

SEQ ID NO: 7640049 - DNA, 22 bp, Homo sapiens
cattcaaaagctccatgtttgt

SEQ ID NO: 7640050 - DNA, 22 bp, Homo sapiens
cattcaaaagctccatgtttgt

SEQ ID NO: 7640051 - DNA, 22 bp, Homo sapiens
cattccagctctcatactctgg

SEQ ID NO: 7640052 - DNA, 22 bp, Homo sapiens
cattccagctctcatactctgg

SEQ ID NO: 7640053 - DNA, 22 bp, Homo sapiens
cattcccacgtgttctttgctt

SEQ ID NO: 7640054 - DNA, 22 bp, Homo sapiens
cattcccatgactcctgctcag

SEQ ID NO: 7640055 - DNA, 22 bp, Homo sapiens
cattcccatgactcctgctcag

SEQ ID NO: 7640056 - DNA, 22 bp, Homo sapiens
cattccagctctcatactctgg

SEQ ID NO: 7640057 - DNA, 22 bp, Homo sapiens
cattccagatgaggccaggccc

SEQ ID NO: 7640058 - DNA, 22 bp, Homo sapiens
cattccagagctgcctctgcta

SEQ ID NO: 7640059 - DNA, 22 bp, Homo sapiens
cattccagagctgcctctgcta

SEQ ID NO: 7640060 - DNA, 22 bp, Homo sapiens
cattccagagctgcctctgcta

SEQ ID NO: 7640061 - DNA, 22 bp, Homo sapiens
cattccagatgaggccaggccc

SEQ ID NO: 7640062 - DNA, 22 bp, Homo sapiens
cattccagatgaggccaggccc

SEQ ID NO: 7640063 - DNA, 18 bp, Homo sapiens
cattccaagttctacctc

SEQ ID NO: 7640064 - DNA, 22 bp, Homo sapiens
cattccaagtatatacatgata

SEQ ID NO: 7640065 - DNA, 22 bp, Homo sapiens
cattccaaggccaagtctaaga

SEQ ID NO: 7640066 - DNA, 22 bp, Homo sapiens
cattcatttgcccagtaagtca

SEQ ID NO: 7640067 - DNA, 22 bp, Homo sapiens
cattccaaggccaagtctaaga

SEQ ID NO: 7640068 - DNA, 22 bp, Homo sapiens
cattccaaggccaagtctaaga

SEQ ID NO: 7640069 - DNA, 22 bp, Homo sapiens
cattccaagtatatacatgata

SEQ ID NO: 7640070 - DNA, 22 bp, Homo sapiens
cattccaagtatatacatgata

SEQ ID NO: 7640071 - DNA, 22 bp, Homo sapiens
cattccaagtatatacatgata

SEQ ID NO: 7640072 - DNA, 16 bp, Homo sapiens
aggcagatattgagtg

SEQ ID NO: 7640073 - DNA, 19 bp, Homo sapiens
aggcagaggcttggctagc

SEQ ID NO: 7640074 - DNA, 19 bp, Homo sapiens
aggcagaggcttggctagc

SEQ ID NO: 7640075 - DNA, 19 bp, Homo sapiens
aggcagaggcttggctagc

SEQ ID NO: 7640076 - DNA, 22 bp, Homo sapiens
cattccttaacgtggggagtct

SEQ ID NO: 7640077 - DNA, 22 bp, Homo sapiens
cattccttaacgtggggagtct

SEQ ID NO: 7640078 - DNA, 19 bp, Homo sapiens
aggcagaggcttggctagc

SEQ ID NO: 7640079 - DNA, 19 bp, Homo sapiens
aggcagcacccagtccttg

SEQ ID NO: 7640080 - DNA, 19 bp, Homo sapiens
aggcagcacccagtccttg

SEQ ID NO: 7640081 - DNA, 22 bp, Homo sapiens
aggcagcagaaaacaaatggtt

SEQ ID NO: 7640082 - DNA, 22 bp, Homo sapiens
aggcagcagaaaacaaatggtt

SEQ ID NO: 7640083 - DNA, 22 bp, Homo sapiens
aggcagcagaaaacaaatggtt

SEQ ID NO: 7640084 - DNA, 19 bp, Homo sapiens
aggcagcacccagtccttg

SEQ ID NO: 7640085 - DNA, 22 bp, Homo sapiens
cattcccatgactcctgctcag

SEQ ID NO: 7640086 - DNA, 18 bp, Homo sapiens
cattccccatctctgagc

SEQ ID NO: 7640087 - DNA, 18 bp, Homo sapiens
cattccccatctctgagc

SEQ ID NO: 7640088 - DNA, 22 bp, Homo sapiens
cattcctaaccacatgtgggct

SEQ ID NO: 7640089 - DNA, 22 bp, Homo sapiens
cattcctaacccatgcccatca

SEQ ID NO: 7640090 - DNA, 22 bp, Homo sapiens
cattcctattatgtccctagtg

SEQ ID NO: 7640091 - DNA, 22 bp, Homo sapiens
cattcccttggggagttcatgc

SEQ ID NO: 7640092 - DNA, 21 bp, Homo sapiens
cattcctcggctcatagagga

SEQ ID NO: 7640093 - DNA, 21 bp, Homo sapiens
cattcctcggctcatagagga

SEQ ID NO: 7640094 - DNA, 21 bp, Homo sapiens
cattcctcggctcatagagga

SEQ ID NO: 7640095 - DNA, 22 bp, Homo sapiens
cattcctattatgtccctagtg

SEQ ID NO: 7640096 - DNA, 21 bp, Homo sapiens
cattcctcccctgacgtcagc

SEQ ID NO: 7640097 - DNA, 21 bp, Homo sapiens
cattcctcccctgacgtcagc

SEQ ID NO: 7640098 - DNA, 22 bp, Homo sapiens
cattcctacatgataagaatta

SEQ ID NO: 7640099 - DNA, 22 bp, Homo sapiens
cattccttaacgtggggagtct

SEQ ID NO: 7640100 - DNA, 22 bp, Homo sapiens
cattccttaacgtggggagtct

SEQ ID NO: 7640101 - DNA, 22 bp, Homo sapiens
cattcctggacaaacatcaaaa

SEQ ID NO: 7640102 - DNA, 22 bp, Homo sapiens
cattcctggacaaacatcaaaa

SEQ ID NO: 7640103 - DNA, 20 bp, Homo sapiens
cattcctgaggaattcatgt

SEQ ID NO: 7640104 - DNA, 22 bp, Homo sapiens
cattcctgagggccccctactt

SEQ ID NO: 7640105 - DNA, 20 bp, Homo sapiens
cattcctgaggaattcatgt

SEQ ID NO: 7640106 - DNA, 23 bp, Homo sapiens
cattcctgatatggccacaagag

SEQ ID NO: 7640107 - DNA, 23 bp, Homo sapiens
cattcctgatatggccacaagag

SEQ ID NO: 7640108 - DNA, 22 bp, Homo sapiens
catggccccaaatcccatgcat

SEQ ID NO: 7640109 - DNA, 22 bp, Homo sapiens
catggccccaaatcccatgcat

SEQ ID NO: 7640110 - DNA, 22 bp, Homo sapiens
catggccccaaatcccatgcat

SEQ ID NO: 7640111 - DNA, 22 bp, Homo sapiens
catggcctcaaaggactgcaga

SEQ ID NO: 7640112 - DNA, 22 bp, Homo sapiens
catggccctcttctggagcaat

SEQ ID NO: 7640113 - DNA, 22 bp, Homo sapiens
catggccctcttctggagcaat

SEQ ID NO: 7640114 - DNA, 22 bp, Homo sapiens
catggcctctctcctggaatgg

SEQ ID NO: 7640115 - DNA, 22 bp, Homo sapiens
catggcctcaaaggactgcaga

SEQ ID NO: 7640116 - DNA, 22 bp, Homo sapiens
catggcctgcctcctcctggtg

SEQ ID NO: 7640117 - DNA, 22 bp, Homo sapiens
catggcctctctcctggaatgg

SEQ ID NO: 7640118 - DNA, 22 bp, Homo sapiens
catggcctgcctcctcctggtg

SEQ ID NO: 7640119 - DNA, 22 bp, Homo sapiens
catggcctgcctcctcctggtg

SEQ ID NO: 7640120 - DNA, 22 bp, Homo sapiens
catggcctgcctcctcctggtg

SEQ ID NO: 7640121 - DNA, 22 bp, Homo sapiens
catggcctgcctcctcctggtg

SEQ ID NO: 7640122 - DNA, 22 bp, Homo sapiens
catggccttgagtgactgcact

SEQ ID NO: 7640123 - DNA, 22 bp, Homo sapiens
catggccttgagtgactgcact

SEQ ID NO: 7640124 - DNA, 22 bp, Homo sapiens
catggccttcacctcccctgcc

SEQ ID NO: 7640125 - DNA, 22 bp, Homo sapiens
catggcggtcaggatgtaggtg

SEQ ID NO: 7640126 - DNA, 22 bp, Homo sapiens
catggcggtcaggatgtaggtg

SEQ ID NO: 7640127 - DNA, 22 bp, Homo sapiens
catggcggtcaggatgtaggtg

SEQ ID NO: 7640128 - DNA, 22 bp, Homo sapiens
cattaacactttggatttagac

SEQ ID NO: 7640129 - DNA, 22 bp, Homo sapiens
cattaagatttttttctactgg

SEQ ID NO: 7640130 - DNA, 22 bp, Homo sapiens
cattaagatttttttctactgg

SEQ ID NO: 7640131 - DNA, 21 bp, Homo sapiens
cattaagtaccagggcactgt

SEQ ID NO: 7640132 - DNA, 21 bp, Homo sapiens
cattaagtaccagggcactgt

SEQ ID NO: 7640133 - DNA, 22 bp, Homo sapiens
catggctcggggacaggaggta

SEQ ID NO: 7640134 - DNA, 22 bp, Homo sapiens
catggctcacaggatgggctag

SEQ ID NO: 7640135 - DNA, 22 bp, Homo sapiens
cattaacactttggatttagac

SEQ ID NO: 7640136 - DNA, 22 bp, Homo sapiens
cattatgtgagtgattaattca

SEQ ID NO: 7640137 - DNA, 20 bp, Homo sapiens
cattatggttgggcacagtg

SEQ ID NO: 7640138 - DNA, 22 bp, Homo sapiens
cattatgtgcgtacatgtatct

SEQ ID NO: 7640139 - DNA, 22 bp, Homo sapiens
cattatgtgagtgattaattca

SEQ ID NO: 7640140 - DNA, 22 bp, Homo sapiens
cattatgtgcgtacatgtatct

SEQ ID NO: 7640141 - DNA, 22 bp, Homo sapiens
cattatgtgggaaaatgttctt

SEQ ID NO: 7640142 - DNA, 22 bp, Homo sapiens
cattatgtgggaaaatgttctt

SEQ ID NO: 7640143 - DNA, 18 bp, Homo sapiens
cattatgtggttatagaa

SEQ ID NO: 7640144 - DNA, 18 bp, Homo sapiens
cattatgtggttatagaa

SEQ ID NO: 7640145 - DNA, 18 bp, Homo sapiens
cattatgtggttatagaa

SEQ ID NO: 7640146 - DNA, 22 bp, Homo sapiens
cattattaattcagcacatgct

SEQ ID NO: 7640147 - DNA, 22 bp, Homo sapiens
cattattaattcagcacatgct

SEQ ID NO: 7640148 - DNA, 22 bp, Homo sapiens
cattattaattcagcacatgct

SEQ ID NO: 7640149 - DNA, 22 bp, Homo sapiens
cattattgccagccatactgaa

SEQ ID NO: 7640150 - DNA, 22 bp, Homo sapiens
cattattaattcagcacatgct

SEQ ID NO: 7640151 - DNA, 22 bp, Homo sapiens
cattatgttcagtagcttaaaa

SEQ ID NO: 7640152 - DNA, 22 bp, Homo sapiens
cattatgttcagtagcttaaaa

SEQ ID NO: 7640153 - DNA, 22 bp, Homo sapiens
cattatgttcagtagcttaaaa

SEQ ID NO: 7640154 - DNA, 22 bp, Homo sapiens
cattatgttcagtagcttaaaa

SEQ ID NO: 7640155 - DNA, 22 bp, Homo sapiens
cattatgttcagtagcttaaaa

SEQ ID NO: 7640156 - DNA, 22 bp, Homo sapiens
cattatgatggtaattttctct

SEQ ID NO: 7640157 - DNA, 22 bp, Homo sapiens
cattatgatggtaattttctct

SEQ ID NO: 7640158 - DNA, 22 bp, Homo sapiens
cattatgcaaagaacacttgag

SEQ ID NO: 7640159 - DNA, 22 bp, Homo sapiens
cattatggaagtgaagagctct

SEQ ID NO: 7640160 - DNA, 22 bp, Homo sapiens
cattatggaagacagtgtggtg

SEQ ID NO: 7640161 - DNA, 22 bp, Homo sapiens
cattatggcagccaggatattg

SEQ ID NO: 7640162 - DNA, 22 bp, Homo sapiens
cattatggcagccaggatattg

SEQ ID NO: 7640163 - DNA, 20 bp, Homo sapiens
cattatggttgggcacagtg

SEQ ID NO: 7640164 - DNA, 20 bp, Homo sapiens
cattatggttgggcacagtg

SEQ ID NO: 7640165 - DNA, 22 bp, Homo sapiens
cattatgatggtaattttctct

SEQ ID NO: 7640166 - DNA, 22 bp, Homo sapiens
cattatgatggtaattttctct

SEQ ID NO: 7640167 - DNA, 22 bp, Homo sapiens
cattatgaagcatcatcttatt

SEQ ID NO: 7640168 - DNA, 22 bp, Homo sapiens
cattatgaagcatcatcttatt

SEQ ID NO: 7640169 - DNA, 22 bp, Homo sapiens
cattatctgccattgacaccat

SEQ ID NO: 7640170 - DNA, 22 bp, Homo sapiens
cattatgaagcatcatcttatt

SEQ ID NO: 7640171 - DNA, 22 bp, Homo sapiens
cattatgaagcatcatcttatt

SEQ ID NO: 7640172 - DNA, 22 bp, Homo sapiens
cattatctgccattgacaccat

SEQ ID NO: 7640173 - DNA, 22 bp, Homo sapiens
cattatctcttctatatgctag

SEQ ID NO: 7640174 - DNA, 22 bp, Homo sapiens
cattatctgagagtgtcctaca

SEQ ID NO: 7640175 - DNA, 22 bp, Homo sapiens
cattatctgagagtgtcctaca

SEQ ID NO: 7640176 - DNA, 22 bp, Homo sapiens
aggcagcagtcatgaggaaaga

SEQ ID NO: 7640177 - DNA, 22 bp, Homo sapiens
aggcagcagtcatgaggaaaga

SEQ ID NO: 7640178 - DNA, 19 bp, Homo sapiens
aggcagcattctggggctt

SEQ ID NO: 7640179 - DNA, 19 bp, Homo sapiens
aggcagcattctggggctt

SEQ ID NO: 7640180 - DNA, 22 bp, Homo sapiens
aggcagcagtcatgaggaaaga

SEQ ID NO: 7640181 - DNA, 19 bp, Homo sapiens
aggcagcattctggggctt

SEQ ID NO: 7640182 - DNA, 19 bp, Homo sapiens
aggcagcattctggggctt

SEQ ID NO: 7640183 - DNA, 19 bp, Homo sapiens
aggcagcattctggggctt

SEQ ID NO: 7640184 - DNA, 19 bp, Homo sapiens
aggcagcattctggggctt

SEQ ID NO: 7640185 - DNA, 22 bp, Homo sapiens
aggcagcatttctgcttatcca

SEQ ID NO: 7640186 - DNA, 22 bp, Homo sapiens
aggcagcatttctgcttatcca

SEQ ID NO: 7640187 - DNA, 19 bp, Homo sapiens
aggcagcattctggggctt

SEQ ID NO: 7640188 - DNA, 22 bp, Homo sapiens
aggcagcatttctgcttatcca

SEQ ID NO: 7640189 - DNA, 22 bp, Homo sapiens
aggcagcatttctgcttatcca

SEQ ID NO: 7640190 - DNA, 22 bp, Homo sapiens
aggcagcatttctgcttatcca

SEQ ID NO: 7640191 - DNA, 19 bp, Homo sapiens
aggcagcattctggggctt

SEQ ID NO: 7640192 - DNA, 22 bp, Homo sapiens
aggcagcagtcatgaggaaaga

SEQ ID NO: 7640193 - DNA, 22 bp, Homo sapiens
aggcagcagtcatgaggaaaga

SEQ ID NO: 7640194 - DNA, 22 bp, Homo sapiens
aggcagcagtcatgaggaaaga

SEQ ID NO: 7640195 - DNA, 22 bp, Homo sapiens
aggcagcagtcatgaggaaaga

SEQ ID NO: 7640196 - DNA, 22 bp, Homo sapiens
catttacatttaaggttaatat

SEQ ID NO: 7640197 - DNA, 22 bp, Homo sapiens
aggcagcagtcatgaggaaaga

SEQ ID NO: 7640198 - DNA, 22 bp, Homo sapiens
catttacatttaaggttaatat

SEQ ID NO: 7640199 - DNA, 22 bp, Homo sapiens
catttacatttaaggttaatat

SEQ ID NO: 7640200 - DNA, 22 bp, Homo sapiens
catttacatttaaggttaatat

SEQ ID NO: 7640201 - DNA, 22 bp, Homo sapiens
catttacatttaaggttaatat

SEQ ID NO: 7640202 - DNA, 22 bp, Homo sapiens
catttacatttaaggttaatat

SEQ ID NO: 7640203 - DNA, 22 bp, Homo sapiens
catttacatttaaggttaatat

SEQ ID NO: 7640204 - DNA, 22 bp, Homo sapiens
catttacatttaaggttaatat

SEQ ID NO: 7640205 - DNA, 22 bp, Homo sapiens
catttacatttaaggttaatat

SEQ ID NO: 7640206 - DNA, 22 bp, Homo sapiens
catttacatttaaggttaatat

SEQ ID NO: 7640207 - DNA, 22 bp, Homo sapiens
catttacatttaaggttaatat

SEQ ID NO: 7640208 - DNA, 22 bp, Homo sapiens
catttacatttaaggttaatat

SEQ ID NO: 7640209 - DNA, 22 bp, Homo sapiens
catttacatttaaggttaatat

SEQ ID NO: 7640210 - DNA, 22 bp, Homo sapiens
catttacatttaaggttaatat

SEQ ID NO: 7640211 - DNA, 21 bp, Homo sapiens
catttacatgacagattggtt

SEQ ID NO: 7640212 - DNA, 21 bp, Homo sapiens
catttacatgacagattggtt

SEQ ID NO: 7640213 - DNA, 21 bp, Homo sapiens
catttacatgacagattggtt

SEQ ID NO: 7640214 - DNA, 21 bp, Homo sapiens
catttacatgacagattggtt

SEQ ID NO: 7640215 - DNA, 21 bp, Homo sapiens
catttacatgacagattggtt

SEQ ID NO: 7640216 - DNA, 21 bp, Homo sapiens
catttacatgacagattggtt

SEQ ID NO: 7640217 - DNA, 21 bp, Homo sapiens
catttacatgacagattggtt

SEQ ID NO: 7640218 - DNA, 21 bp, Homo sapiens
aggcagccagtcatgctccct

SEQ ID NO: 7640219 - DNA, 21 bp, Homo sapiens
aggcagccagtcatgctccct

SEQ ID NO: 7640220 - DNA, 22 bp, Homo sapiens
aggcagccagatggcagcctgc

SEQ ID NO: 7640221 - DNA, 21 bp, Homo sapiens
aggcagccagtcatgctccct

SEQ ID NO: 7640222 - DNA, 21 bp, Homo sapiens
aggcagccagtcatgctccct

SEQ ID NO: 7640223 - DNA, 21 bp, Homo sapiens
aggcagccagtcatgctccct

SEQ ID NO: 7640224 - DNA, 22 bp, Homo sapiens
aggcagccagttcaggtttctt

SEQ ID NO: 7640225 - DNA, 22 bp, Homo sapiens
aggcagccagttcaggtttctt

SEQ ID NO: 7640226 - DNA, 22 bp, Homo sapiens
aggcagccagttcaggtttctt

SEQ ID NO: 7640227 - DNA, 22 bp, Homo sapiens
aggcagccagttcaggtttctt

SEQ ID NO: 7640228 - DNA, 22 bp, Homo sapiens
aggcagccagttcaggtttctt

SEQ ID NO: 7640229 - DNA, 22 bp, Homo sapiens
aggcagccacatgagctcctga

SEQ ID NO: 7640230 - DNA, 22 bp, Homo sapiens
aggcagccacatgagctcctga

SEQ ID NO: 7640231 - DNA, 22 bp, Homo sapiens
aggcagccacatgagctcctga

SEQ ID NO: 7640232 - DNA, 22 bp, Homo sapiens
aggcagccacatgagctcctga

SEQ ID NO: 7640233 - DNA, 22 bp, Homo sapiens
aggcagccacatgagctcctga

SEQ ID NO: 7640234 - DNA, 22 bp, Homo sapiens
aggcagccagatggcagcctgc

SEQ ID NO: 7640235 - DNA, 22 bp, Homo sapiens
aggcagccagatggcagcctgc

SEQ ID NO: 7640236 - DNA, 22 bp, Homo sapiens
aggcagccagatggcagcctgc

SEQ ID NO: 7640237 - DNA, 22 bp, Homo sapiens
aggcagccagatggcagcctgc

SEQ ID NO: 7640238 - DNA, 22 bp, Homo sapiens
aggcagccagatggcagcctgc

SEQ ID NO: 7640239 - DNA, 22 bp, Homo sapiens
aggcagccagatggcagcctgc

SEQ ID NO: 7640240 - DNA, 22 bp, Homo sapiens
aggcagccagatggcagcctgc

SEQ ID NO: 7640241 - DNA, 22 bp, Homo sapiens
aggcagccaatcagaggctgac

SEQ ID NO: 7640242 - DNA, 22 bp, Homo sapiens
aggcagccaatcagaggctgac

SEQ ID NO: 7640243 - DNA, 22 bp, Homo sapiens
aggcagccaatcagaggctgac

SEQ ID NO: 7640244 - DNA, 22 bp, Homo sapiens
aggcagccaatcagaggctgac

SEQ ID NO: 7640245 - DNA, 22 bp, Homo sapiens
aggcagccaatcagaggctgac

SEQ ID NO: 7640246 - DNA, 22 bp, Homo sapiens
aggcagccaatcagaggctgac

SEQ ID NO: 7640247 - DNA, 22 bp, Homo sapiens
aggcagccaaaaagaagtcctc

SEQ ID NO: 7640248 - DNA, 22 bp, Homo sapiens
aggcagcatttgaatccaggtc

SEQ ID NO: 7640249 - DNA, 22 bp, Homo sapiens
aggcagcatttgaatccaggtc

SEQ ID NO: 7640250 - DNA, 22 bp, Homo sapiens
aggcagcatttctgcttatcca

SEQ ID NO: 7640251 - DNA, 22 bp, Homo sapiens
aggcagcatttgaatccaggtc

SEQ ID NO: 7640252 - DNA, 22 bp, Homo sapiens
aggcagcatttgaatccaggtc

SEQ ID NO: 7640253 - DNA, 22 bp, Homo sapiens
aggcagcatttgaatccaggtc

SEQ ID NO: 7640254 - DNA, 22 bp, Homo sapiens
aggcagcatttgaatccaggtc

SEQ ID NO: 7640255 - DNA, 22 bp, Homo sapiens
aggcagcatttgaatccaggtc

SEQ ID NO: 7640256 - DNA, 22 bp, Homo sapiens
aggcagcagaggttgaggaaag

SEQ ID NO: 7640257 - DNA, 22 bp, Homo sapiens
aggcagcagaggttgaggaaag

SEQ ID NO: 7640258 - DNA, 22 bp, Homo sapiens
aggcagcagaggttgaggaaag

SEQ ID NO: 7640259 - DNA, 22 bp, Homo sapiens
aggcagcagaggttgaggaaag

SEQ ID NO: 7640260 - DNA, 22 bp, Homo sapiens
aggcagcagaggttgaggaaag

SEQ ID NO: 7640261 - DNA, 22 bp, Homo sapiens
aggcagcagaggttgaggaaag

SEQ ID NO: 7640262 - DNA, 22 bp, Homo sapiens
aggcagcagaggttgaggaaag

SEQ ID NO: 7640263 - DNA, 22 bp, Homo sapiens
aggcagcagaggttgaggaaag

SEQ ID NO: 7640264 - DNA, 22 bp, Homo sapiens
aggcagcagaggttgaggaaag

SEQ ID NO: 7640265 - DNA, 22 bp, Homo sapiens
aggcagcagaggttgaggaaag

SEQ ID NO: 7640266 - DNA, 22 bp, Homo sapiens
aggcagcagaggttgaggaaag

SEQ ID NO: 7640267 - DNA, 22 bp, Homo sapiens
aggcagcagactgttaatcaga

SEQ ID NO: 7640268 - DNA, 22 bp, Homo sapiens
aggcagcagactgttaatcaga

SEQ ID NO: 7640269 - DNA, 22 bp, Homo sapiens
aggcagcagaaaacaaatggtt

SEQ ID NO: 7640270 - DNA, 22 bp, Homo sapiens
aggcagcagactgttaatcaga

SEQ ID NO: 7640271 - DNA, 22 bp, Homo sapiens
aggcagcagactgttaatcaga

SEQ ID NO: 7640272 - DNA, 22 bp, Homo sapiens
aggcagcagactgttaatcaga

SEQ ID NO: 7640273 - DNA, 22 bp, Homo sapiens
aggcagcagaaaacaaatggtt

SEQ ID NO: 7640274 - DNA, 22 bp, Homo sapiens
aggcagcagaaaacaaatggtt

SEQ ID NO: 7640275 - DNA, 22 bp, Homo sapiens
aggcagcagaaaacaaatggtt

SEQ ID NO: 7640276 - DNA, 18 bp, Homo sapiens
aggcagcagcatcttctc

SEQ ID NO: 7640277 - DNA, 18 bp, Homo sapiens
aggcagcagcatcttctc

SEQ ID NO: 7640278 - DNA, 18 bp, Homo sapiens
aggcagcagcatcttctc

SEQ ID NO: 7640279 - DNA, 18 bp, Homo sapiens
aggcagcagcatcttctc

SEQ ID NO: 7640280 - DNA, 18 bp, Homo sapiens
aggcagcagcatcttctc

SEQ ID NO: 7640281 - DNA, 18 bp, Homo sapiens
aggcagcagcatcttctc

SEQ ID NO: 7640282 - DNA, 18 bp, Homo sapiens
aggcagcagcatcttctc

SEQ ID NO: 7640283 - DNA, 22 bp, Homo sapiens
aggcagcagaggttgaggaaag

SEQ ID NO: 7640284 - DNA, 18 bp, Homo sapiens
aggcagcagcatcttctc

SEQ ID NO: 7640285 - DNA, 18 bp, Homo sapiens
aggcagcagcatcttctc

SEQ ID NO: 7640286 - DNA, 22 bp, Homo sapiens
aggcagcagaggttgaggaaag

SEQ ID NO: 7640287 - DNA, 22 bp, Homo sapiens
aggcagcagccacaaggcctga

SEQ ID NO: 7640288 - DNA, 22 bp, Homo sapiens
aggcagcagccacaaggcctga

SEQ ID NO: 7640289 - DNA, 22 bp, Homo sapiens
aggcagcagccacaaggcctga

SEQ ID NO: 7640290 - DNA, 22 bp, Homo sapiens
aggcagcagccacaaggcctga

SEQ ID NO: 7640291 - DNA, 22 bp, Homo sapiens
aggcagcagccacaaggcctga

SEQ ID NO: 7640292 - DNA, 22 bp, Homo sapiens
aggcagcagcttgctggttgcc

SEQ ID NO: 7640293 - DNA, 22 bp, Homo sapiens
aggcagcagccacaaggcctga

SEQ ID NO: 7640294 - DNA, 22 bp, Homo sapiens
aggcagcagcttgctggttgcc

SEQ ID NO: 7640295 - DNA, 22 bp, Homo sapiens
aggcagcagcttgctggttgcc

SEQ ID NO: 7640296 - DNA, 22 bp, Homo sapiens
catttacagtgagagtttttac

SEQ ID NO: 7640297 - DNA, 22 bp, Homo sapiens
catttacagtgagagtttttac

SEQ ID NO: 7640298 - DNA, 22 bp, Homo sapiens
catttacagtgagagtttttac

SEQ ID NO: 7640299 - DNA, 22 bp, Homo sapiens
catttacagtgagagtttttac

SEQ ID NO: 7640300 - DNA, 22 bp, Homo sapiens
catttacagtgagagtttttac

SEQ ID NO: 7640301 - DNA, 22 bp, Homo sapiens
catttacagtgagagtttttac

SEQ ID NO: 7640302 - DNA, 22 bp, Homo sapiens
catttacagcagactgatgaaa

SEQ ID NO: 7640303 - DNA, 22 bp, Homo sapiens
catttacagtgagagtttttac

SEQ ID NO: 7640304 - DNA, 22 bp, Homo sapiens
catttacagtgagagtttttac

SEQ ID NO: 7640305 - DNA, 22 bp, Homo sapiens
catttacagtgagagtttttac

SEQ ID NO: 7640306 - DNA, 22 bp, Homo sapiens
catttacagtgagagtttttac

SEQ ID NO: 7640307 - DNA, 22 bp, Homo sapiens
aggcagcagcttgctggttgcc

SEQ ID NO: 7640308 - DNA, 22 bp, Homo sapiens
aggcagcagcttgctggttgcc

SEQ ID NO: 7640309 - DNA, 21 bp, Homo sapiens
aggcagcaggatccagggaca

SEQ ID NO: 7640310 - DNA, 22 bp, Homo sapiens
aggcagcagcttgctggttgcc

SEQ ID NO: 7640311 - DNA, 21 bp, Homo sapiens
aggcagcaggatccagggaca

SEQ ID NO: 7640312 - DNA, 22 bp, Homo sapiens
catttacagcagactgatgaaa

SEQ ID NO: 7640313 - DNA, 22 bp, Homo sapiens
catttacagcagactgatgaaa

SEQ ID NO: 7640314 - DNA, 22 bp, Homo sapiens
catttacagcagactgatgaaa

SEQ ID NO: 7640315 - DNA, 22 bp, Homo sapiens
catttacagcagactgatgaaa

SEQ ID NO: 7640316 - DNA, 22 bp, Homo sapiens
catttacataacagtaacgctg

SEQ ID NO: 7640317 - DNA, 22 bp, Homo sapiens
catttacataacagtaacgctg

SEQ ID NO: 7640318 - DNA, 22 bp, Homo sapiens
catttacagtgagagtttttac

SEQ ID NO: 7640319 - DNA, 22 bp, Homo sapiens
catttacagtgagagtttttac

SEQ ID NO: 7640320 - DNA, 22 bp, Homo sapiens
catttacagtgagagtttttac

SEQ ID NO: 7640321 - DNA, 22 bp, Homo sapiens
catttacagtgagagtttttac

SEQ ID NO: 7640322 - DNA, 22 bp, Homo sapiens
catttacagtgagagtttttac

SEQ ID NO: 7640323 - DNA, 22 bp, Homo sapiens
catttacataacagtaacgctg

SEQ ID NO: 7640324 - DNA, 22 bp, Homo sapiens
catttacataacagtaacgctg

SEQ ID NO: 7640325 - DNA, 22 bp, Homo sapiens
catttacataacagtaacgctg

SEQ ID NO: 7640326 - DNA, 22 bp, Homo sapiens
catttacataacagtaacgctg

SEQ ID NO: 7640327 - DNA, 22 bp, Homo sapiens
catttacataacagtaacgctg

SEQ ID NO: 7640328 - DNA, 22 bp, Homo sapiens
catttacataacagtaacgctg

SEQ ID NO: 7640329 - DNA, 22 bp, Homo sapiens
catttacataacagtaacgctg

SEQ ID NO: 7640330 - DNA, 22 bp, Homo sapiens
catttacataacagtaacgctg

SEQ ID NO: 7640331 - DNA, 22 bp, Homo sapiens
catttacataacagtaacgctg

SEQ ID NO: 7640332 - DNA, 21 bp, Homo sapiens
catttacatgacagattggtt

SEQ ID NO: 7640333 - DNA, 21 bp, Homo sapiens
catttacatgacagattggtt

SEQ ID NO: 7640334 - DNA, 21 bp, Homo sapiens
catttacatgacagattggtt

SEQ ID NO: 7640335 - DNA, 21 bp, Homo sapiens
catttacatgacagattggtt

SEQ ID NO: 7640336 - DNA, 21 bp, Homo sapiens
catttacatgacagattggtt

SEQ ID NO: 7640337 - DNA, 21 bp, Homo sapiens
catttacatgacagattggtt

SEQ ID NO: 7640338 - DNA, 22 bp, Homo sapiens
catttacataacagtaacgctg

SEQ ID NO: 7640339 - DNA, 22 bp, Homo sapiens
catttacataacagtaacgctg

SEQ ID NO: 7640340 - DNA, 22 bp, Homo sapiens
catttacataacagtaacgctg

SEQ ID NO: 7640341 - DNA, 22 bp, Homo sapiens
catttacataacagtaacgctg

SEQ ID NO: 7640342 - DNA, 18 bp, Homo sapiens
aggaaagacgaagagggc

SEQ ID NO: 7640343 - DNA, 18 bp, Homo sapiens
aggaaagacgaagagggc

SEQ ID NO: 7640344 - DNA, 18 bp, Homo sapiens
aggaaagacgaagagggc

SEQ ID NO: 7640345 - DNA, 22 bp, Homo sapiens
aggaaagactggggccccagaa

SEQ ID NO: 7640346 - DNA, 22 bp, Homo sapiens
aggaaagactggggccccagaa

SEQ ID NO: 7640347 - DNA, 22 bp, Homo sapiens
aggaaagactggggccccagaa

SEQ ID NO: 7640348 - DNA, 22 bp, Homo sapiens
aggaaagactggggccccagaa

SEQ ID NO: 7640349 - DNA, 18 bp, Homo sapiens
aggaaagacgaagagggc

SEQ ID NO: 7640350 - DNA, 18 bp, Homo sapiens
aggaaagacgaagagggc

SEQ ID NO: 7640351 - DNA, 18 bp, Homo sapiens
aggaaagacgaagagggc

SEQ ID NO: 7640352 - DNA, 18 bp, Homo sapiens
aggaaagacgaagagggc

SEQ ID NO: 7640353 - DNA, 18 bp, Homo sapiens
aggaaagacgaagagggc

SEQ ID NO: 7640354 - DNA, 22 bp, Homo sapiens
aggaaagaagtacattctcatg

SEQ ID NO: 7640355 - DNA, 22 bp, Homo sapiens
aggaaactaacttatctttata

SEQ ID NO: 7640356 - DNA, 22 bp, Homo sapiens
aggaaagaagtacattctcatg

SEQ ID NO: 7640357 - DNA, 22 bp, Homo sapiens
aggaaagaagtacattctcatg

SEQ ID NO: 7640358 - DNA, 18 bp, Homo sapiens
aggaaagacgaagagggc

SEQ ID NO: 7640359 - DNA, 18 bp, Homo sapiens
aggaaagacgaagagggc

SEQ ID NO: 7640360 - DNA, 18 bp, Homo sapiens
aggaaagacgaagagggc

SEQ ID NO: 7640361 - DNA, 18 bp, Homo sapiens
aggaaagacgaagagggc

SEQ ID NO: 7640362 - DNA, 18 bp, Homo sapiens
aggaaagacgaagagggc

SEQ ID NO: 7640363 - DNA, 18 bp, Homo sapiens
aggaaagacgaagagggc

SEQ ID NO: 7640364 - DNA, 18 bp, Homo sapiens
aggaaagacgaagagggc

SEQ ID NO: 7640365 - DNA, 18 bp, Homo sapiens
aggaaagacgaagagggc

SEQ ID NO: 7640366 - DNA, 18 bp, Homo sapiens
aggaaagacgaagagggc

SEQ ID NO: 7640367 - DNA, 22 bp, Homo sapiens
agctttatataaaagagtacat

SEQ ID NO: 7640368 - DNA, 22 bp, Homo sapiens
agctttagctccatttccttaa

SEQ ID NO: 7640369 - DNA, 22 bp, Homo sapiens
agctttatataaaagagtacat

SEQ ID NO: 7640370 - DNA, 22 bp, Homo sapiens
agctttatataaaagagtacat

SEQ ID NO: 7640371 - DNA, 22 bp, Homo sapiens
agctttatataaaagagtacat

SEQ ID NO: 7640372 - DNA, 22 bp, Homo sapiens
agctttatatgttgtttctcca

SEQ ID NO: 7640373 - DNA, 22 bp, Homo sapiens
aggaaactaacttatctttata

SEQ ID NO: 7640374 - DNA, 22 bp, Homo sapiens
aggaaactaaagcccagagagg

SEQ ID NO: 7640375 - DNA, 22 bp, Homo sapiens
aggaaaccggagctcagagagg

SEQ ID NO: 7640376 - DNA, 17 bp, Homo sapiens
aggaaacattttctttc

SEQ ID NO: 7640377 - DNA, 22 bp, Homo sapiens
agctttagagactcttaggctt

SEQ ID NO: 7640378 - DNA, 22 bp, Homo sapiens
agctttagagagccaagactca

SEQ ID NO: 7640379 - DNA, 22 bp, Homo sapiens
agctttagagactcttaggctt

SEQ ID NO: 7640380 - DNA, 22 bp, Homo sapiens
agctttagagagccaagactca

SEQ ID NO: 7640381 - DNA, 22 bp, Homo sapiens
agctttagagagccaagactca

SEQ ID NO: 7640382 - DNA, 22 bp, Homo sapiens
agctttagctccatttccttaa

SEQ ID NO: 7640383 - DNA, 22 bp, Homo sapiens
agctttagctccatttccttaa

SEQ ID NO: 7640384 - DNA, 22 bp, Homo sapiens
agctttatagaaaggatcagtg

SEQ ID NO: 7640385 - DNA, 22 bp, Homo sapiens
agctttacctgaaatttgatcc

SEQ ID NO: 7640386 - DNA, 22 bp, Homo sapiens
agctttacctgccttggggcac

SEQ ID NO: 7640387 - DNA, 22 bp, Homo sapiens
agctttacctgccttggggcac

SEQ ID NO: 7640388 - DNA, 22 bp, Homo sapiens
agctttacctgccttggggcac

SEQ ID NO: 7640389 - DNA, 22 bp, Homo sapiens
agctttagaatgatgcttttgc

SEQ ID NO: 7640390 - DNA, 22 bp, Homo sapiens
agctttagaatgatgcttttgc

SEQ ID NO: 7640391 - DNA, 22 bp, Homo sapiens
agctttagaattgttcagcaag

SEQ ID NO: 7640392 - DNA, 22 bp, Homo sapiens
agctttaaatcaatccagtgag

SEQ ID NO: 7640393 - DNA, 22 bp, Homo sapiens
agctttaaatcaatccagtgag

SEQ ID NO: 7640394 - DNA, 22 bp, Homo sapiens
agctttaaatcaatccagtgag

SEQ ID NO: 7640395 - DNA, 23 bp, Homo sapiens
agctttaaccctttcaggagcat

SEQ ID NO: 7640396 - DNA, 23 bp, Homo sapiens
agctttaaccctttcaggagcat

SEQ ID NO: 7640397 - DNA, 23 bp, Homo sapiens
agctttaaccctttcaggagcat

SEQ ID NO: 7640398 - DNA, 22 bp, Homo sapiens
agctttaaatcaatccagtgag

SEQ ID NO: 7640399 - DNA, 22 bp, Homo sapiens
agctttaaagcatatttctaag

SEQ ID NO: 7640400 - DNA, 22 bp, Homo sapiens
agctttaaagcatatttctaag

SEQ ID NO: 7640401 - DNA, 22 bp, Homo sapiens
agctttaaaaatccaatatcca

SEQ ID NO: 7640402 - DNA, 18 bp, Homo sapiens
agcttgtttttgccttct

SEQ ID NO: 7640403 - DNA, 22 bp, Homo sapiens
agctttaaaaatccaatatcca

SEQ ID NO: 7640404 - DNA, 22 bp, Homo sapiens
agctttaaaaatccaatatcca

SEQ ID NO: 7640405 - DNA, 22 bp, Homo sapiens
agctttaaagcatatttctaag

SEQ ID NO: 7640406 - DNA, 22 bp, Homo sapiens
agctttaaaaatccaatatcca

SEQ ID NO: 7640407 - DNA, 22 bp, Homo sapiens
agctttaaagcatatttctaag

SEQ ID NO: 7640408 - DNA, 22 bp, Homo sapiens
agctttaaagcatatttctaag

SEQ ID NO: 7640409 - DNA, 21 bp, Homo sapiens
agcttgttattaattcagaac

SEQ ID NO: 7640410 - DNA, 22 bp, Homo sapiens
agcttgttctcatccattcttc

SEQ ID NO: 7640411 - DNA, 22 bp, Homo sapiens
agcttgttataaatgcagaatg

SEQ ID NO: 7640412 - DNA, 22 bp, Homo sapiens
agcttgttcaaatgcagaatac

SEQ ID NO: 7640413 - DNA, 22 bp, Homo sapiens
agcttgttagggcagtggtcgc

SEQ ID NO: 7640414 - DNA, 21 bp, Homo sapiens
agcttgttattaattcagaac

SEQ ID NO: 7640415 - DNA, 18 bp, Homo sapiens
agcttgtttttgccttct

SEQ ID NO: 7640416 - DNA, 22 bp, Homo sapiens
agctttaaaaatccaatatcca

SEQ ID NO: 7640417 - DNA, 22 bp, Homo sapiens
agcttgttttgttgaatactta

SEQ ID NO: 7640418 - DNA, 17 bp, Homo sapiens
agcttgtttttgaaagc

SEQ ID NO: 7640419 - DNA, 22 bp, Homo sapiens
agcttgttgttactgatgcatt

SEQ ID NO: 7640420 - DNA, 22 bp, Homo sapiens
agcttgttggggaaggagaaag

SEQ ID NO: 7640421 - DNA, 22 bp, Homo sapiens
agcttgttttgttgaatactta

SEQ ID NO: 7640422 - DNA, 22 bp, Homo sapiens
agcttgttaaggatgcatatta

SEQ ID NO: 7640423 - DNA, 22 bp, Homo sapiens
agcttgttagaaatgtagactc

SEQ ID NO: 7640424 - DNA, 22 bp, Homo sapiens
agcttgtgtttttctaagtatc

SEQ ID NO: 7640425 - DNA, 22 bp, Homo sapiens
agcttgtgtttttctaagtatc

SEQ ID NO: 7640426 - DNA, 22 bp, Homo sapiens
agcttgttaaacagcctccact

SEQ ID NO: 7640427 - DNA, 21 bp, Homo sapiens
agcttgtgtgtatcacagtgt

SEQ ID NO: 7640428 - DNA, 21 bp, Homo sapiens
agcttgtgtgtatcacagtgt

SEQ ID NO: 7640429 - DNA, 22 bp, Homo sapiens
agcttgtctttcaaaggagttt

SEQ ID NO: 7640430 - DNA, 22 bp, Homo sapiens
agcttgtgctggaattacatgt

SEQ ID NO: 7640431 - DNA, 22 bp, Homo sapiens
cagggccactgtagatgaggag

SEQ ID NO: 7640432 - DNA, 22 bp, Homo sapiens
cagggccactgtagatgaggag

SEQ ID NO: 7640433 - DNA, 22 bp, Homo sapiens
cagggccagagagggctggctg

SEQ ID NO: 7640434 - DNA, 22 bp, Homo sapiens
cagggccagagagggctggctg

SEQ ID NO: 7640435 - DNA, 22 bp, Homo sapiens
cagggccagagagggctggctg

SEQ ID NO: 7640436 - DNA, 22 bp, Homo sapiens
cagggccagagagggctggctg

SEQ ID NO: 7640437 - DNA, 22 bp, Homo sapiens
cagggccagagagggctggctg

SEQ ID NO: 7640438 - DNA, 22 bp, Homo sapiens
cagggccagagagggctggctg

SEQ ID NO: 7640439 - DNA, 22 bp, Homo sapiens
cagggccagccatcctgctggg

SEQ ID NO: 7640440 - DNA, 22 bp, Homo sapiens
cagggccagccatcctgctggg

SEQ ID NO: 7640441 - DNA, 22 bp, Homo sapiens
cagggccagccatcctgctggg

SEQ ID NO: 7640442 - DNA, 22 bp, Homo sapiens
cagggccagccatcctgctggg

SEQ ID NO: 7640443 - DNA, 22 bp, Homo sapiens
cagggccagccatcctgctggg

SEQ ID NO: 7640444 - DNA, 22 bp, Homo sapiens
cagggccagagagggctggctg

SEQ ID NO: 7640445 - DNA, 22 bp, Homo sapiens
cagggccagagagggctggctg

SEQ ID NO: 7640446 - DNA, 22 bp, Homo sapiens
cagggccagagagggctggctg

SEQ ID NO: 7640447 - DNA, 22 bp, Homo sapiens
cagggccagagagggctggctg

SEQ ID NO: 7640448 - DNA, 22 bp, Homo sapiens
cagggccagccgcagcatccac

SEQ ID NO: 7640449 - DNA, 22 bp, Homo sapiens
cagggccagcccgacgtggtgc

SEQ ID NO: 7640450 - DNA, 22 bp, Homo sapiens
cagggccagccgcagcatccac

SEQ ID NO: 7640451 - DNA, 22 bp, Homo sapiens
cagggccagccgcagcatccac

SEQ ID NO: 7640452 - DNA, 22 bp, Homo sapiens
cagggccagccgcagcatccac

SEQ ID NO: 7640453 - DNA, 22 bp, Homo sapiens
cagggccagcccgacgtggtgc

SEQ ID NO: 7640454 - DNA, 22 bp, Homo sapiens
cagggccagcccgacgtggtgc

SEQ ID NO: 7640455 - DNA, 22 bp, Homo sapiens
cagggccagcgcccaggcccag

SEQ ID NO: 7640456 - DNA, 22 bp, Homo sapiens
cagggccagccgcagcatccac

SEQ ID NO: 7640457 - DNA, 22 bp, Homo sapiens
cagggccagccgcagcatccac

SEQ ID NO: 7640458 - DNA, 22 bp, Homo sapiens
cagggccagccgcagcatccac

SEQ ID NO: 7640459 - DNA, 22 bp, Homo sapiens
cagggccagcccgacgtggtgc

SEQ ID NO: 7640460 - DNA, 22 bp, Homo sapiens
cagggccagcccactagcgagg

SEQ ID NO: 7640461 - DNA, 22 bp, Homo sapiens
cagggccagcccactagcgagg

SEQ ID NO: 7640462 - DNA, 22 bp, Homo sapiens
cagggccagcccactagcgagg

SEQ ID NO: 7640463 - DNA, 22 bp, Homo sapiens
cagggccagccatcctgctggg

SEQ ID NO: 7640464 - DNA, 22 bp, Homo sapiens
cagggccagccatcctgctggg

SEQ ID NO: 7640465 - DNA, 22 bp, Homo sapiens
aggaaagatggaaggaggataa

SEQ ID NO: 7640466 - DNA, 22 bp, Homo sapiens
aggaaagcaatggctgagaaca

SEQ ID NO: 7640467 - DNA, 22 bp, Homo sapiens
aggaaagcaatggctgagaaca

SEQ ID NO: 7640468 - DNA, 22 bp, Homo sapiens
aggaaagatggaaggaggataa

SEQ ID NO: 7640469 - DNA, 22 bp, Homo sapiens
aggaaagcaatggctgagaaca

SEQ ID NO: 7640470 - DNA, 22 bp, Homo sapiens
aggaaagcaatggctgagaaca

SEQ ID NO: 7640471 - DNA, 22 bp, Homo sapiens
aggaaagcaatggctgagaaca

SEQ ID NO: 7640472 - DNA, 23 bp, Homo sapiens
aggaaagcattcatttttaccat

SEQ ID NO: 7640473 - DNA, 22 bp, Homo sapiens
aggaaagccaatctctcttgac

SEQ ID NO: 7640474 - DNA, 22 bp, Homo sapiens
aggaaagatggaaggaggataa

SEQ ID NO: 7640475 - DNA, 22 bp, Homo sapiens
aggaaagatggaaggaggataa

SEQ ID NO: 7640476 - DNA, 22 bp, Homo sapiens
aggaaagactggggccccagaa

SEQ ID NO: 7640477 - DNA, 22 bp, Homo sapiens
aggaaagatggaaggaggataa

SEQ ID NO: 7640478 - DNA, 22 bp, Homo sapiens
aggaaagatggaaggaggataa

SEQ ID NO: 7640479 - DNA, 22 bp, Homo sapiens
aggaaagactggggccccagaa

SEQ ID NO: 7640480 - DNA, 22 bp, Homo sapiens
aggaaagactggggccccagaa

SEQ ID NO: 7640481 - DNA, 22 bp, Homo sapiens
aggaaagatggaaggaggataa

SEQ ID NO: 7640482 - DNA, 22 bp, Homo sapiens
aggaaagatggaaggaggataa

SEQ ID NO: 7640483 - DNA, 22 bp, Homo sapiens
aggaaagatggaaggaggataa

SEQ ID NO: 7640484 - DNA, 22 bp, Homo sapiens
aggaaagatggaaggaggataa

SEQ ID NO: 7640485 - DNA, 22 bp, Homo sapiens
aggaaagatggaaggaggataa

SEQ ID NO: 7640486 - DNA, 22 bp, Homo sapiens
aggaaagcttggcaaactaaat

SEQ ID NO: 7640487 - DNA, 22 bp, Homo sapiens
aggaaagcttggcaaactaaat

SEQ ID NO: 7640488 - DNA, 21 bp, Homo sapiens
aggaaaggaagtccccagggt

SEQ ID NO: 7640489 - DNA, 22 bp, Homo sapiens
aggaaagcttggcaaactaaat

SEQ ID NO: 7640490 - DNA, 22 bp, Homo sapiens
aggaaagctcccagtagggctc

SEQ ID NO: 7640491 - DNA, 20 bp, Homo sapiens
aggaaagcctgtgtgagtct

SEQ ID NO: 7640492 - DNA, 20 bp, Homo sapiens
aggaaagcctgtgtgagtct

SEQ ID NO: 7640493 - DNA, 21 bp, Homo sapiens
aggaaaggaagtccccagggt

SEQ ID NO: 7640494 - DNA, 21 bp, Homo sapiens
aggaaaggaagtccccagggt

SEQ ID NO: 7640495 - DNA, 21 bp, Homo sapiens
aggaaaggaagtccccagggt

SEQ ID NO: 7640496 - DNA, 21 bp, Homo sapiens
aggaaaggaagtccccagggt

SEQ ID NO: 7640497 - DNA, 22 bp, Homo sapiens
aggaaagctcccagtagggctc

SEQ ID NO: 7640498 - DNA, 22 bp, Homo sapiens
aggaaagcttggcaaactaaat

SEQ ID NO: 7640499 - DNA, 21 bp, Homo sapiens
aggaaaggaagtccccagggt

SEQ ID NO: 7640500 - DNA, 21 bp, Homo sapiens
aggaaaggaagtccccagggt

SEQ ID NO: 7640501 - DNA, 21 bp, Homo sapiens
aggaaaggaagtccccagggt

SEQ ID NO: 7640502 - DNA, 21 bp, Homo sapiens
aggaaaggaagtccccagggt

SEQ ID NO: 7640503 - DNA, 22 bp, Homo sapiens
cagggccactgtagatgaggag

SEQ ID NO: 7640504 - DNA, 22 bp, Homo sapiens
cagggccactgtagatgaggag

SEQ ID NO: 7640505 - DNA, 22 bp, Homo sapiens
cagggccactgtagatgaggag

SEQ ID NO: 7640506 - DNA, 22 bp, Homo sapiens
cagggccactgtagatgaggag

SEQ ID NO: 7640507 - DNA, 22 bp, Homo sapiens
aggaaataggaccagacaaagc

SEQ ID NO: 7640508 - DNA, 22 bp, Homo sapiens
aggaaataggaccagacaaagc

SEQ ID NO: 7640509 - DNA, 22 bp, Homo sapiens
aggaaataggaccagacaaagc

SEQ ID NO: 7640510 - DNA, 22 bp, Homo sapiens
aggaaataggaccagacaaagc

SEQ ID NO: 7640511 - DNA, 22 bp, Homo sapiens
aggaaataggaccagacaaagc

SEQ ID NO: 7640512 - DNA, 22 bp, Homo sapiens
aggaaataggaccagacaaagc

SEQ ID NO: 7640513 - DNA, 22 bp, Homo sapiens
aggaaataggaccagacaaagc

SEQ ID NO: 7640514 - DNA, 22 bp, Homo sapiens
aggaaataggaccagacaaagc

SEQ ID NO: 7640515 - DNA, 22 bp, Homo sapiens
aggaaataggaccagacaaagc

SEQ ID NO: 7640516 - DNA, 22 bp, Homo sapiens
aggaaatgctgatgctcctgga

SEQ ID NO: 7640517 - DNA, 22 bp, Homo sapiens
aggaaatgctgatgctcctgga

SEQ ID NO: 7640518 - DNA, 22 bp, Homo sapiens
aggaaatgctgatgctcctgga

SEQ ID NO: 7640519 - DNA, 22 bp, Homo sapiens
aggaaatgctgatgctcctgga

SEQ ID NO: 7640520 - DNA, 22 bp, Homo sapiens
aggaaatgcaggcaaatactct

SEQ ID NO: 7640521 - DNA, 22 bp, Homo sapiens
aggaaatgcaggcaaatactct

SEQ ID NO: 7640522 - DNA, 22 bp, Homo sapiens
aggaaatgcaggcaaatactct

SEQ ID NO: 7640523 - DNA, 22 bp, Homo sapiens
aggaaatgcaggcaaatactct

SEQ ID NO: 7640524 - DNA, 22 bp, Homo sapiens
aggaaatgcaggcaaatactct

SEQ ID NO: 7640525 - DNA, 22 bp, Homo sapiens
aggaaatgccgcggctctcttt

SEQ ID NO: 7640526 - DNA, 22 bp, Homo sapiens
aggaaatgccgcggctctcttt

SEQ ID NO: 7640527 - DNA, 22 bp, Homo sapiens
aggaaatgccgcggctctcttt

SEQ ID NO: 7640528 - DNA, 22 bp, Homo sapiens
cagggccagcgcccaggcccag

SEQ ID NO: 7640529 - DNA, 22 bp, Homo sapiens
cagggccagcgcccaggcccag

SEQ ID NO: 7640530 - DNA, 22 bp, Homo sapiens
cagggccagcgcccaggcccag

SEQ ID NO: 7640531 - DNA, 22 bp, Homo sapiens
cagggccagcgcccaggcccag

SEQ ID NO: 7640532 - DNA, 22 bp, Homo sapiens
cagggccagcgcccaggcccag

SEQ ID NO: 7640533 - DNA, 22 bp, Homo sapiens
cagggccagcgtctcgggctat

SEQ ID NO: 7640534 - DNA, 22 bp, Homo sapiens
cagggccagcgtctcgggctat

SEQ ID NO: 7640535 - DNA, 22 bp, Homo sapiens
cagggccagcgtctcgggctat

SEQ ID NO: 7640536 - DNA, 22 bp, Homo sapiens
cagggccagcgcccaggcccag

SEQ ID NO: 7640537 - DNA, 22 bp, Homo sapiens
cagggccagcgcccaggcccag

SEQ ID NO: 7640538 - DNA, 22 bp, Homo sapiens
aggaaaggggtaggtgtggacg

SEQ ID NO: 7640539 - DNA, 22 bp, Homo sapiens
aggaaaggggtaggtgtggacg

SEQ ID NO: 7640540 - DNA, 22 bp, Homo sapiens
aggaaaggggtaggtgtggacg

SEQ ID NO: 7640541 - DNA, 22 bp, Homo sapiens
aggaaaggggtaggtgtggacg

SEQ ID NO: 7640542 - DNA, 22 bp, Homo sapiens
aggaaaggggtaggtgtggacg

SEQ ID NO: 7640543 - DNA, 22 bp, Homo sapiens
aggaaaggggtaggtgtggacg

SEQ ID NO: 7640544 - DNA, 23 bp, Homo sapiens
cagggccaggcagcagctgtcac

SEQ ID NO: 7640545 - DNA, 22 bp, Homo sapiens
aggaaaggcctttgcatttggt

SEQ ID NO: 7640546 - DNA, 22 bp, Homo sapiens
cagggccagcgtctcgggctat

SEQ ID NO: 7640547 - DNA, 22 bp, Homo sapiens
aggaacacaacttcctgagagc

SEQ ID NO: 7640548 - DNA, 22 bp, Homo sapiens
aggaacacaacttcctgagagc

SEQ ID NO: 7640549 - DNA, 22 bp, Homo sapiens
aggaacaattgataaactcaca

SEQ ID NO: 7640550 - DNA, 22 bp, Homo sapiens
aggaacacaacttcctgagagc

SEQ ID NO: 7640551 - DNA, 22 bp, Homo sapiens
aggaacacaatgcttctgtgtg

SEQ ID NO: 7640552 - DNA, 22 bp, Homo sapiens
aggaacacatggacatttctga

SEQ ID NO: 7640553 - DNA, 22 bp, Homo sapiens
aggaacacatctttgtagcagg

SEQ ID NO: 7640554 - DNA, 22 bp, Homo sapiens
aggaacacatctttgtagcagg

SEQ ID NO: 7640555 - DNA, 22 bp, Homo sapiens
aggaacaactgattcagtcaac

SEQ ID NO: 7640556 - DNA, 22 bp, Homo sapiens
aggaacaactgattcagtcaac

SEQ ID NO: 7640557 - DNA, 22 bp, Homo sapiens
aggaaattttgaatcagtgtct

SEQ ID NO: 7640558 - DNA, 22 bp, Homo sapiens
aggaacaactgattcagtcaac

SEQ ID NO: 7640559 - DNA, 22 bp, Homo sapiens
aggaacaattgataaactcaca

SEQ ID NO: 7640560 - DNA, 22 bp, Homo sapiens
aggaacaattgataaactcaca

SEQ ID NO: 7640561 - DNA, 22 bp, Homo sapiens
aggaacaattgataaactcaca

SEQ ID NO: 7640562 - DNA, 22 bp, Homo sapiens
aggaacaattgataaactcaca

SEQ ID NO: 7640563 - DNA, 22 bp, Homo sapiens
aggaacaattgataaactcaca

SEQ ID NO: 7640564 - DNA, 22 bp, Homo sapiens
aggaacaagggagccttttctc

SEQ ID NO: 7640565 - DNA, 22 bp, Homo sapiens
aggaacaagggagccttttctc

SEQ ID NO: 7640566 - DNA, 22 bp, Homo sapiens
aggaacaagggagccttttctc

SEQ ID NO: 7640567 - DNA, 22 bp, Homo sapiens
aggaaatgtagtcctcatctcc

SEQ ID NO: 7640568 - DNA, 22 bp, Homo sapiens
aggaaatgtacaaatgaagatg

SEQ ID NO: 7640569 - DNA, 22 bp, Homo sapiens
aggaaatgtacaaatgaagatg

SEQ ID NO: 7640570 - DNA, 22 bp, Homo sapiens
aggaaatgggaatagatggtat

SEQ ID NO: 7640571 - DNA, 22 bp, Homo sapiens
aggaaatgggaatagatggtat

SEQ ID NO: 7640572 - DNA, 22 bp, Homo sapiens
aggaaatgtacaaatgaagatg

SEQ ID NO: 7640573 - DNA, 22 bp, Homo sapiens
aggaaatgtacaaatgaagatg

SEQ ID NO: 7640574 - DNA, 22 bp, Homo sapiens
aggaaatgtacaaatgaagatg

SEQ ID NO: 7640575 - DNA, 22 bp, Homo sapiens
aggaaatgggaatagatggtat

SEQ ID NO: 7640576 - DNA, 22 bp, Homo sapiens
aggaaatgggaatagatggtat

SEQ ID NO: 7640577 - DNA, 22 bp, Homo sapiens
aggaaatgtacaaatgaagatg

SEQ ID NO: 7640578 - DNA, 22 bp, Homo sapiens
aggaaatgtacaaatgaagatg

SEQ ID NO: 7640579 - DNA, 22 bp, Homo sapiens
aggaaatgtacaaatgaagatg

SEQ ID NO: 7640580 - DNA, 22 bp, Homo sapiens
aggaaattgagaatcagaataa

SEQ ID NO: 7640581 - DNA, 22 bp, Homo sapiens
aggaaattgggacacagagaaa

SEQ ID NO: 7640582 - DNA, 22 bp, Homo sapiens
aggaaattgggacacagagaaa

SEQ ID NO: 7640583 - DNA, 22 bp, Homo sapiens
aggaaattgggacacagagaaa

SEQ ID NO: 7640584 - DNA, 22 bp, Homo sapiens
aggaaattgtctttttccttgt

SEQ ID NO: 7640585 - DNA, 22 bp, Homo sapiens
aggaaattttgaatcagtgtct

SEQ ID NO: 7640586 - DNA, 22 bp, Homo sapiens
aggaaattgtctttttccttgt

SEQ ID NO: 7640587 - DNA, 22 bp, Homo sapiens
aggaaatgtagtcctcatctcc

SEQ ID NO: 7640588 - DNA, 22 bp, Homo sapiens
aggaaattgagaatcagaataa

SEQ ID NO: 7640589 - DNA, 22 bp, Homo sapiens
aggaaattgagaatcagaataa

SEQ ID NO: 7640590 - DNA, 22 bp, Homo sapiens
aggaaattgagaatcagaataa

SEQ ID NO: 7640591 - DNA, 22 bp, Homo sapiens
aggaaattgagaatcagaataa

SEQ ID NO: 7640592 - DNA, 18 bp, Homo sapiens
aggaagcaggaggaaggc

SEQ ID NO: 7640593 - DNA, 22 bp, Homo sapiens
aggaagctcaaagccatgatgt

SEQ ID NO: 7640594 - DNA, 18 bp, Homo sapiens
aggaagcaggaggaaggc

SEQ ID NO: 7640595 - DNA, 18 bp, Homo sapiens
aggaagcaggaggaaggc

SEQ ID NO: 7640596 - DNA, 18 bp, Homo sapiens
aggaagcaggaggaaggc

SEQ ID NO: 7640597 - DNA, 22 bp, Homo sapiens
aggaagcagcccatggatatag

SEQ ID NO: 7640598 - DNA, 18 bp, Homo sapiens
aggaagcaggaggaaggc

SEQ ID NO: 7640599 - DNA, 22 bp, Homo sapiens
aggaagaaaactaattagatgg

SEQ ID NO: 7640600 - DNA, 22 bp, Homo sapiens
aggaagaaaactaattagatgg

SEQ ID NO: 7640601 - DNA, 22 bp, Homo sapiens
aggaactgtcatgtattgctca

SEQ ID NO: 7640602 - DNA, 22 bp, Homo sapiens
aggaagcagcccatggatatag

SEQ ID NO: 7640603 - DNA, 22 bp, Homo sapiens
aggaagcagcccatggatatag

SEQ ID NO: 7640604 - DNA, 22 bp, Homo sapiens
aggaactggtgaagtgtagtga

SEQ ID NO: 7640605 - DNA, 22 bp, Homo sapiens
aggaactggtgggaggtgattg

SEQ ID NO: 7640606 - DNA, 22 bp, Homo sapiens
aggaactgtcatgtattgctca

SEQ ID NO: 7640607 - DNA, 22 bp, Homo sapiens
aggaactgtcatgtattgctca

SEQ ID NO: 7640608 - DNA, 22 bp, Homo sapiens
aggaactggtgaagtgtagtga

SEQ ID NO: 7640609 - DNA, 22 bp, Homo sapiens
aggaactggtgggaggtgattg

SEQ ID NO: 7640610 - DNA, 22 bp, Homo sapiens
aggaactggtgggaggtgattg

SEQ ID NO: 7640611 - DNA, 22 bp, Homo sapiens
aggaactggtgggaggtgattg

SEQ ID NO: 7640612 - DNA, 22 bp, Homo sapiens
aggaactggggctattcaccct

SEQ ID NO: 7640613 - DNA, 22 bp, Homo sapiens
aggaactgggctcagcaaacat

SEQ ID NO: 7640614 - DNA, 22 bp, Homo sapiens
aggaactggggctattcaccct

SEQ ID NO: 7640615 - DNA, 22 bp, Homo sapiens
aggaactggggctattcaccct

SEQ ID NO: 7640616 - DNA, 22 bp, Homo sapiens
aggaactggggctattcaccct

SEQ ID NO: 7640617 - DNA, 22 bp, Homo sapiens
aggaactggtgaagtgtagtga

SEQ ID NO: 7640618 - DNA, 22 bp, Homo sapiens
aggaactggggctattcaccct

SEQ ID NO: 7640619 - DNA, 22 bp, Homo sapiens
aggaactggtgaagtgtagtga

SEQ ID NO: 7640620 - DNA, 22 bp, Homo sapiens
aggaagctcaaagccatgatgt

SEQ ID NO: 7640621 - DNA, 22 bp, Homo sapiens
aggaagctcaaagccatgatgt

SEQ ID NO: 7640622 - DNA, 22 bp, Homo sapiens
aggaagctcattttgacatatc

SEQ ID NO: 7640623 - DNA, 22 bp, Homo sapiens
aggaagctccatgaaggcagag

SEQ ID NO: 7640624 - DNA, 22 bp, Homo sapiens
aggaagctcctggagagccagt

SEQ ID NO: 7640625 - DNA, 22 bp, Homo sapiens
aggaagctcctggagagccagt

SEQ ID NO: 7640626 - DNA, 22 bp, Homo sapiens
aggaagctcctggagagccagt

SEQ ID NO: 7640627 - DNA, 22 bp, Homo sapiens
aggaagctcctggagagccagt

SEQ ID NO: 7640628 - DNA, 22 bp, Homo sapiens
aggaagctcggagagggcaaat

SEQ ID NO: 7640629 - DNA, 22 bp, Homo sapiens
aggaagctcggagagggcaaat

SEQ ID NO: 7640630 - DNA, 22 bp, Homo sapiens
aggaactgatttataactttag

SEQ ID NO: 7640631 - DNA, 22 bp, Homo sapiens
aggaactgatttataactttag

SEQ ID NO: 7640632 - DNA, 22 bp, Homo sapiens
aggaactgatgagcagccaggg

SEQ ID NO: 7640633 - DNA, 22 bp, Homo sapiens
aggaactgatttataactttag

SEQ ID NO: 7640634 - DNA, 23 bp, Homo sapiens
aggaactgcttcatttttgaaag

SEQ ID NO: 7640635 - DNA, 23 bp, Homo sapiens
aggaactgcttcatttttgaaag

SEQ ID NO: 7640636 - DNA, 23 bp, Homo sapiens
aggaactgcttcatttttgaaag

SEQ ID NO: 7640637 - DNA, 22 bp, Homo sapiens
aggaactggatataatgtgaga

SEQ ID NO: 7640638 - DNA, 22 bp, Homo sapiens
aggaactggatataatgtgaga

SEQ ID NO: 7640639 - DNA, 22 bp, Homo sapiens
aggaactggatataatgtgaga

SEQ ID NO: 7640640 - DNA, 22 bp, Homo sapiens
aggaactggatataatgtgaga

SEQ ID NO: 7640641 - DNA, 20 bp, Homo sapiens
aggaactggaagggaggaaa

SEQ ID NO: 7640642 - DNA, 20 bp, Homo sapiens
aggaactggaagggaggaaa

SEQ ID NO: 7640643 - DNA, 20 bp, Homo sapiens
aggaactggaagggaggaaa

SEQ ID NO: 7640644 - DNA, 22 bp, Homo sapiens
aggaactagtgcaacaggagcg

SEQ ID NO: 7640645 - DNA, 22 bp, Homo sapiens
aggaactgacttggtttaaatg

SEQ ID NO: 7640646 - DNA, 23 bp, Homo sapiens
aggaactgaggcctagggaggta

SEQ ID NO: 7640647 - DNA, 22 bp, Homo sapiens
aggaactgaagacttttactgt

SEQ ID NO: 7640648 - DNA, 22 bp, Homo sapiens
aggaactgaagacttttactgt

SEQ ID NO: 7640649 - DNA, 22 bp, Homo sapiens
aggaactgatgagcagccaggg

SEQ ID NO: 7640650 - DNA, 23 bp, Homo sapiens
aggaactgaggcctagggaggta

SEQ ID NO: 7640651 - DNA, 22 bp, Homo sapiens
aggaactgatgagcagccaggg

SEQ ID NO: 7640652 - DNA, 22 bp, Homo sapiens
aggaactgatgagcagccaggg

SEQ ID NO: 7640653 - DNA, 22 bp, Homo sapiens
aggaactgatgagcagccaggg

SEQ ID NO: 7640654 - DNA, 22 bp, Homo sapiens
aggaactgatgagcagccaggg

SEQ ID NO: 7640655 - DNA, 22 bp, Homo sapiens
aggaacctgagtctgatcattt

SEQ ID NO: 7640656 - DNA, 22 bp, Homo sapiens
aggaaccctgcgccatactttg

SEQ ID NO: 7640657 - DNA, 22 bp, Homo sapiens
aggaacccggtctgtcactgtg

SEQ ID NO: 7640658 - DNA, 22 bp, Homo sapiens
aggaaccagaggttgagcaact

SEQ ID NO: 7640659 - DNA, 22 bp, Homo sapiens
aggaaccagaggttgagcaact

SEQ ID NO: 7640660 - DNA, 22 bp, Homo sapiens
aggaacagaagagcaatgcagg

SEQ ID NO: 7640661 - DNA, 22 bp, Homo sapiens
aggaacagaagagcaatgcagg

SEQ ID NO: 7640662 - DNA, 22 bp, Homo sapiens
aggaacacttgtggaaacattc

SEQ ID NO: 7640663 - DNA, 22 bp, Homo sapiens
aggaacagaagagcaatgcagg

SEQ ID NO: 7640664 - DNA, 22 bp, Homo sapiens
aggaacagaagagcaatgcagg

SEQ ID NO: 7640665 - DNA, 22 bp, Homo sapiens
aggaacagaagagcaatgcagg

SEQ ID NO: 7640666 - DNA, 22 bp, Homo sapiens
aggaacagaagagcaatgcagg

SEQ ID NO: 7640667 - DNA, 22 bp, Homo sapiens
aggaacaggcctcgttttctat

SEQ ID NO: 7640668 - DNA, 22 bp, Homo sapiens
aggaacaggcctcgttttctat

SEQ ID NO: 7640669 - DNA, 22 bp, Homo sapiens
aggaacatctatcacataaacg

SEQ ID NO: 7640670 - DNA, 22 bp, Homo sapiens
aggaacatctatcacataaacg

SEQ ID NO: 7640671 - DNA, 22 bp, Homo sapiens
aggaacattctcatttcctgcc

SEQ ID NO: 7640672 - DNA, 22 bp, Homo sapiens
aggaaccagacagaactgaatg

SEQ ID NO: 7640673 - DNA, 22 bp, Homo sapiens
agcttgaaacgtaccaacattg

SEQ ID NO: 7640674 - DNA, 22 bp, Homo sapiens
agcttcttagttcacttttaat

SEQ ID NO: 7640675 - DNA, 22 bp, Homo sapiens
agcttcttttaccaggaagttg

SEQ ID NO: 7640676 - DNA, 22 bp, Homo sapiens
agcttgaacctaaaacaataat

SEQ ID NO: 7640677 - DNA, 22 bp, Homo sapiens
agcttgacagacagatggtagc

SEQ ID NO: 7640678 - DNA, 22 bp, Homo sapiens
agcttgacagacagatggtagc

SEQ ID NO: 7640679 - DNA, 22 bp, Homo sapiens
agcttcttaagttcctgcagca

SEQ ID NO: 7640680 - DNA, 22 bp, Homo sapiens
agcttctgttcatcttccaggc

SEQ ID NO: 7640681 - DNA, 22 bp, Homo sapiens
agcttacagttcaatgacaaag

SEQ ID NO: 7640682 - DNA, 22 bp, Homo sapiens
agcttcttaagttcctgcagca

SEQ ID NO: 7640683 - DNA, 22 bp, Homo sapiens
agcttcttaagttcctgcagca

SEQ ID NO: 7640684 - DNA, 22 bp, Homo sapiens
agcttcttagttcacttttaat

SEQ ID NO: 7640685 - DNA, 22 bp, Homo sapiens
agcttacagttcaatgacaaag

SEQ ID NO: 7640686 - DNA, 22 bp, Homo sapiens
agcttacaccccccaagattct

SEQ ID NO: 7640687 - DNA, 22 bp, Homo sapiens
agcttaatggaacttgctcaaa

SEQ ID NO: 7640688 - DNA, 22 bp, Homo sapiens
agcttaatggaacttgctcaaa

SEQ ID NO: 7640689 - DNA, 22 bp, Homo sapiens
agcttaacgctcctaccagatg

SEQ ID NO: 7640690 - DNA, 22 bp, Homo sapiens
agcttaaagccgccatctagta

SEQ ID NO: 7640691 - DNA, 22 bp, Homo sapiens
agcttaaagtatttaaatttca

SEQ ID NO: 7640692 - DNA, 22 bp, Homo sapiens
agcttaaactctttgaagttat

SEQ ID NO: 7640693 - DNA, 22 bp, Homo sapiens
agcttaaactctttgaagttat

SEQ ID NO: 7640694 - DNA, 22 bp, Homo sapiens
agctgtttttgtgggcatgtga

SEQ ID NO: 7640695 - DNA, 22 bp, Homo sapiens
agcttaaactctttgaagttat

SEQ ID NO: 7640696 - DNA, 22 bp, Homo sapiens
agctgtttttccagtctctgga

SEQ ID NO: 7640697 - DNA, 22 bp, Homo sapiens
agctgtttttgtctgctgatcc

SEQ ID NO: 7640698 - DNA, 22 bp, Homo sapiens
agctgtttttgtgggcatgtga

SEQ ID NO: 7640699 - DNA, 22 bp, Homo sapiens
agctgtttttgtgggcatgtga

SEQ ID NO: 7640700 - DNA, 22 bp, Homo sapiens
agcttgtcacagacgtcaggca

SEQ ID NO: 7640701 - DNA, 22 bp, Homo sapiens
agcttgtagaaggccacgagca

SEQ ID NO: 7640702 - DNA, 22 bp, Homo sapiens
agcttgtagaaggccacgagca

SEQ ID NO: 7640703 - DNA, 22 bp, Homo sapiens
agcttgtaacagacataaaaat

SEQ ID NO: 7640704 - DNA, 22 bp, Homo sapiens
agcttgtaacagacataaaaat

SEQ ID NO: 7640705 - DNA, 22 bp, Homo sapiens
agcttgtcacttaaggtctttg

SEQ ID NO: 7640706 - DNA, 22 bp, Homo sapiens
agcttgtcagcagttaatgata

SEQ ID NO: 7640707 - DNA, 22 bp, Homo sapiens
agcttgtcccggtgctcacata

SEQ ID NO: 7640708 - DNA, 22 bp, Homo sapiens
agcttgtcctccacccacactg

SEQ ID NO: 7640709 - DNA, 22 bp, Homo sapiens
agcttgtagaaggccacgagca

SEQ ID NO: 7640710 - DNA, 23 bp, Homo sapiens
agcttgtctcctggtgctgctag

SEQ ID NO: 7640711 - DNA, 22 bp, Homo sapiens
agcttgtcgggcctcagctccc

SEQ ID NO: 7640712 - DNA, 22 bp, Homo sapiens
agcttgtctaaggacacagctt

SEQ ID NO: 7640713 - DNA, 22 bp, Homo sapiens
agcttgtctaaggacacagctt

SEQ ID NO: 7640714 - DNA, 22 bp, Homo sapiens
agcttgggcaacacagcaagac

SEQ ID NO: 7640715 - DNA, 22 bp, Homo sapiens
agcttgggcaacacagcaagac

SEQ ID NO: 7640716 - DNA, 22 bp, Homo sapiens
agcttgggtgtgcctgcgagct

SEQ ID NO: 7640717 - DNA, 22 bp, Homo sapiens
agcttgggtgtgcctgcgagct

SEQ ID NO: 7640718 - DNA, 22 bp, Homo sapiens
agcttggtggccctcctggctg

SEQ ID NO: 7640719 - DNA, 22 bp, Homo sapiens
agcttggtggccctcctggctg

SEQ ID NO: 7640720 - DNA, 22 bp, Homo sapiens
agcttggtgttgcctgcttgag

SEQ ID NO: 7640721 - DNA, 22 bp, Homo sapiens
agcttgggtgtgcctgcgagct

SEQ ID NO: 7640722 - DNA, 22 bp, Homo sapiens
agcttggtggccctcctggctg

SEQ ID NO: 7640723 - DNA, 22 bp, Homo sapiens
agcttgccagtcatatctgttt

SEQ ID NO: 7640724 - DNA, 22 bp, Homo sapiens
agcttgcagtttctgctgtttt

SEQ ID NO: 7640725 - DNA, 22 bp, Homo sapiens
agcttgcagtttctgctgtttt

SEQ ID NO: 7640726 - DNA, 22 bp, Homo sapiens
agcttgccagttgaagatcttc

SEQ ID NO: 7640727 - DNA, 22 bp, Homo sapiens
agcttgatagtggctatcaagc

SEQ ID NO: 7640728 - DNA, 22 bp, Homo sapiens
agcttgcacagagaatacagta

SEQ ID NO: 7640729 - DNA, 22 bp, Homo sapiens
agcttgcacagagaatacagta

SEQ ID NO: 7640730 - DNA, 22 bp, Homo sapiens
agcttgagttttggatgaagtg

SEQ ID NO: 7640731 - DNA, 22 bp, Homo sapiens
agcttgagttttggatgaagtg

SEQ ID NO: 7640732 - DNA, 22 bp, Homo sapiens
agcttgctgtattttctggagg

SEQ ID NO: 7640733 - DNA, 22 bp, Homo sapiens
agcttgcctcttaatcacctca

SEQ ID NO: 7640734 - DNA, 23 bp, Homo sapiens
agcttggaacaatgcaaatacag

SEQ ID NO: 7640735 - DNA, 23 bp, Homo sapiens
agcttggaacaatgcaaatacag

SEQ ID NO: 7640736 - DNA, 22 bp, Homo sapiens
agcttgggcaacacagcaagac

SEQ ID NO: 7640737 - DNA, 17 bp, Homo sapiens
agcttggagcagcatga

SEQ ID NO: 7640738 - DNA, 22 bp, Homo sapiens
agctgttgttaattaactcatt

SEQ ID NO: 7640739 - DNA, 18 bp, Homo sapiens
agctgttgttgactctgt

SEQ ID NO: 7640740 - DNA, 18 bp, Homo sapiens
agctgttgttgactctgt

SEQ ID NO: 7640741 - DNA, 22 bp, Homo sapiens
agctgtttaaatgacttacttt

SEQ ID NO: 7640742 - DNA, 20 bp, Homo sapiens
agctgtttacatggatttct

SEQ ID NO: 7640743 - DNA, 22 bp, Homo sapiens
agctgtttaaatgacttacttt

SEQ ID NO: 7640744 - DNA, 22 bp, Homo sapiens
agctgtttaataaatgtctgtt

SEQ ID NO: 7640745 - DNA, 22 bp, Homo sapiens
agctgtttccataaatgagaca

SEQ ID NO: 7640746 - DNA, 22 bp, Homo sapiens
agctgtttccataaatgagaca

SEQ ID NO: 7640747 - DNA, 22 bp, Homo sapiens
agctgtttccataaatgagaca

SEQ ID NO: 7640748 - DNA, 22 bp, Homo sapiens
agctgtttccattcttgagtag

SEQ ID NO: 7640749 - DNA, 23 bp, Homo sapiens
agctgtttcattattacaacacc

SEQ ID NO: 7640750 - DNA, 22 bp, Homo sapiens
agctgtttatgcactcctgcct

SEQ ID NO: 7640751 - DNA, 20 bp, Homo sapiens
agctgtttacatggatttct

SEQ ID NO: 7640752 - DNA, 20 bp, Homo sapiens
agctgtttacatggatttct

SEQ ID NO: 7640753 - DNA, 22 bp, Homo sapiens
agctgtttgtacttagatagta

SEQ ID NO: 7640754 - DNA, 22 bp, Homo sapiens
agctgtttgtacttagatagta

SEQ ID NO: 7640755 - DNA, 22 bp, Homo sapiens
agctgttttactcagaaacata

SEQ ID NO: 7640756 - DNA, 22 bp, Homo sapiens
agctgttttactcagaaacata

SEQ ID NO: 7640757 - DNA, 22 bp, Homo sapiens
agctgttttactcagaaacata

SEQ ID NO: 7640758 - DNA, 22 bp, Homo sapiens
agctgtttgtacttagatagta

SEQ ID NO: 7640759 - DNA, 21 bp, Homo sapiens
agctgtttgaagctatattgg

SEQ ID NO: 7640760 - DNA, 21 bp, Homo sapiens
agctgtttgaagctatattgg

SEQ ID NO: 7640761 - DNA, 21 bp, Homo sapiens
agctgtttgaagctatattgg

SEQ ID NO: 7640762 - DNA, 23 bp, Homo sapiens
agctgtttcttgtgagttgagtg

SEQ ID NO: 7640763 - DNA, 23 bp, Homo sapiens
agctgtttcttgtgagttgagtg

SEQ ID NO: 7640764 - DNA, 22 bp, Homo sapiens
agctgttttcttctaggaagac

SEQ ID NO: 7640765 - DNA, 22 bp, Homo sapiens
agctgttttcttctaggaagac

SEQ ID NO: 7640766 - DNA, 22 bp, Homo sapiens
agctgttttcctggttagagac

SEQ ID NO: 7640767 - DNA, 22 bp, Homo sapiens
agctgttttctaatgcatttga

SEQ ID NO: 7640768 - DNA, 22 bp, Homo sapiens
agctgttttactggttgtataa

SEQ ID NO: 7640769 - DNA, 22 bp, Homo sapiens
agctgttttcctggttagagac

SEQ ID NO: 7640770 - DNA, 22 bp, Homo sapiens
agctgttttctaatgcatttga

SEQ ID NO: 7640771 - DNA, 22 bp, Homo sapiens
agctgtgtgtttccactgagct

SEQ ID NO: 7640772 - DNA, 22 bp, Homo sapiens
agctgtgtggtttgggcaaatt

SEQ ID NO: 7640773 - DNA, 22 bp, Homo sapiens
agctgtgtgtgaatttggccta

SEQ ID NO: 7640774 - DNA, 22 bp, Homo sapiens
agctgtgtgtgaatttggccta

SEQ ID NO: 7640775 - DNA, 22 bp, Homo sapiens
agctgtgtgtttgtcatgggcg

SEQ ID NO: 7640776 - DNA, 22 bp, Homo sapiens
agctgtgtgtttgtcatgggcg

SEQ ID NO: 7640777 - DNA, 22 bp, Homo sapiens
agctgtgtgtttccactgagct

SEQ ID NO: 7640778 - DNA, 22 bp, Homo sapiens
agctgtgttaggatgttaataa

SEQ ID NO: 7640779 - DNA, 22 bp, Homo sapiens
agctgtgtgcccatggtggagg

SEQ ID NO: 7640780 - DNA, 22 bp, Homo sapiens
agctgtgtgcccatggtggagg

SEQ ID NO: 7640781 - DNA, 23 bp, Homo sapiens
agctgtgtggccttgggcaagtt

SEQ ID NO: 7640782 - DNA, 22 bp, Homo sapiens
agctgtgtggtgtctgacagct

SEQ ID NO: 7640783 - DNA, 22 bp, Homo sapiens
agctgtgtggtgtctgacagct

SEQ ID NO: 7640784 - DNA, 22 bp, Homo sapiens
agctgtgttctggttgattcac

SEQ ID NO: 7640785 - DNA, 22 bp, Homo sapiens
agctgtgttattagaaacctgc

SEQ ID NO: 7640786 - DNA, 22 bp, Homo sapiens
agctgttagttattgaagatgt

SEQ ID NO: 7640787 - DNA, 22 bp, Homo sapiens
agctgttccaggcctcattgct

SEQ ID NO: 7640788 - DNA, 22 bp, Homo sapiens
agctgttccaggcctcattgct

SEQ ID NO: 7640789 - DNA, 22 bp, Homo sapiens
agctgttgctgggaggagagaa

SEQ ID NO: 7640790 - DNA, 22 bp, Homo sapiens
agctgttgctgggaggagagaa

SEQ ID NO: 7640791 - DNA, 22 bp, Homo sapiens
agctgttgctgggaggagagaa

SEQ ID NO: 7640792 - DNA, 22 bp, Homo sapiens
agctgttgcagggatcagcacc

SEQ ID NO: 7640793 - DNA, 22 bp, Homo sapiens
agctgttgcagggatcagcacc

SEQ ID NO: 7640794 - DNA, 22 bp, Homo sapiens
agctgttccctcactgcagtca

SEQ ID NO: 7640795 - DNA, 22 bp, Homo sapiens
agctgttccctcactgcagtca

SEQ ID NO: 7640796 - DNA, 22 bp, Homo sapiens
agctgttgaaaatggtgtccta

SEQ ID NO: 7640797 - DNA, 22 bp, Homo sapiens
agctgttgtctgcaggagaagc

SEQ ID NO: 7640798 - DNA, 22 bp, Homo sapiens
agctgttgtctgcaggagaagc

SEQ ID NO: 7640799 - DNA, 22 bp, Homo sapiens
agctgttggctggctgagctct

SEQ ID NO: 7640800 - DNA, 22 bp, Homo sapiens
agctgttggagtaaagcactta

SEQ ID NO: 7640801 - DNA, 22 bp, Homo sapiens
agctgttggctggctgagctct

SEQ ID NO: 7640802 - DNA, 22 bp, Homo sapiens
caggcctggcccccggcacacc

SEQ ID NO: 7640803 - DNA, 22 bp, Homo sapiens
caggcctggcccccggcacacc

SEQ ID NO: 7640804 - DNA, 22 bp, Homo sapiens
caggcctggcccccggcacacc

SEQ ID NO: 7640805 - DNA, 22 bp, Homo sapiens
caggcctggcccccggcacacc

SEQ ID NO: 7640806 - DNA, 22 bp, Homo sapiens
caggcctcccggtgcacactga

SEQ ID NO: 7640807 - DNA, 22 bp, Homo sapiens
caggcctcccggtgcacactga

SEQ ID NO: 7640808 - DNA, 22 bp, Homo sapiens
caggcctcccggtgcacactga

SEQ ID NO: 7640809 - DNA, 22 bp, Homo sapiens
caggcctcccggtgcacactga

SEQ ID NO: 7640810 - DNA, 22 bp, Homo sapiens
caggcctcccggtgcacactga

SEQ ID NO: 7640811 - DNA, 22 bp, Homo sapiens
caggcctcccggtgcacactga

SEQ ID NO: 7640812 - DNA, 22 bp, Homo sapiens
caggcctcccggtgcacactga

SEQ ID NO: 7640813 - DNA, 22 bp, Homo sapiens
caggcctggctgcagctcgcct

SEQ ID NO: 7640814 - DNA, 22 bp, Homo sapiens
caggcctggctgcagctcgcct

SEQ ID NO: 7640815 - DNA, 22 bp, Homo sapiens
caggcctggcccccggcacacc

SEQ ID NO: 7640816 - DNA, 22 bp, Homo sapiens
caggcctggcccccggcacacc

SEQ ID NO: 7640817 - DNA, 22 bp, Homo sapiens
caggcctggctgcagctcgcct

SEQ ID NO: 7640818 - DNA, 22 bp, Homo sapiens
caggcctggctgcagctcgcct

SEQ ID NO: 7640819 - DNA, 22 bp, Homo sapiens
caggcctggctgcagctcgcct

SEQ ID NO: 7640820 - DNA, 22 bp, Homo sapiens
caggcctggctgcagctcgcct

SEQ ID NO: 7640821 - DNA, 22 bp, Homo sapiens
caggcctggctgcagctcgcct

SEQ ID NO: 7640822 - DNA, 22 bp, Homo sapiens
caggcctgggctgggtatcagg

SEQ ID NO: 7640823 - DNA, 22 bp, Homo sapiens
caggcctgggctgggtatcagg

SEQ ID NO: 7640824 - DNA, 22 bp, Homo sapiens
caggcctgggctgggtatcagg

SEQ ID NO: 7640825 - DNA, 22 bp, Homo sapiens
caggcctgggctgggtatcagg

SEQ ID NO: 7640826 - DNA, 22 bp, Homo sapiens
caggcctgggcttcggggctga

SEQ ID NO: 7640827 - DNA, 22 bp, Homo sapiens
caggcctgggcttcggggctga

SEQ ID NO: 7640828 - DNA, 22 bp, Homo sapiens
caggcctgggcttcggggctga

SEQ ID NO: 7640829 - DNA, 22 bp, Homo sapiens
caggcctgggcttcggggctga

SEQ ID NO: 7640830 - DNA, 22 bp, Homo sapiens
agctgtgtgcatttgggtctca

SEQ ID NO: 7640831 - DNA, 22 bp, Homo sapiens
agctgtgtgccaggggagatgt

SEQ ID NO: 7640832 - DNA, 22 bp, Homo sapiens
agctgtgtgccaggggagatgt

SEQ ID NO: 7640833 - DNA, 22 bp, Homo sapiens
agctgtgtgcatttgggtctca

SEQ ID NO: 7640834 - DNA, 22 bp, Homo sapiens
agctgtgtgactctaagcaagt

SEQ ID NO: 7640835 - DNA, 22 bp, Homo sapiens
agctgtgtgacctagggcaagc

SEQ ID NO: 7640836 - DNA, 22 bp, Homo sapiens
agctgtgtgacctagggcaagc

SEQ ID NO: 7640837 - DNA, 22 bp, Homo sapiens
agctgtgtcatcctggaaaatg

SEQ ID NO: 7640838 - DNA, 22 bp, Homo sapiens
agctgtggccagatgtgagcgg

SEQ ID NO: 7640839 - DNA, 22 bp, Homo sapiens
agctgtggcagcagccgtggca

SEQ ID NO: 7640840 - DNA, 22 bp, Homo sapiens
agctgtggcagcagccgtggca

SEQ ID NO: 7640841 - DNA, 22 bp, Homo sapiens
agctgtggccagatgtgagcgg

SEQ ID NO: 7640842 - DNA, 22 bp, Homo sapiens
agctgtggccagatgtgagcgg

SEQ ID NO: 7640843 - DNA, 22 bp, Homo sapiens
agctgtggcagcagccgtggca

SEQ ID NO: 7640844 - DNA, 22 bp, Homo sapiens
caggcctggttgagccctgaga

SEQ ID NO: 7640845 - DNA, 22 bp, Homo sapiens
caggcctggttgagccctgaga

SEQ ID NO: 7640846 - DNA, 22 bp, Homo sapiens
caggcctggttgagccctgaga

SEQ ID NO: 7640847 - DNA, 22 bp, Homo sapiens
caggcctggttgagccctgaga

SEQ ID NO: 7640848 - DNA, 22 bp, Homo sapiens
caggcctggttgagccctgaga

SEQ ID NO: 7640849 - DNA, 22 bp, Homo sapiens
caggcctggttgagccctgaga

SEQ ID NO: 7640850 - DNA, 22 bp, Homo sapiens
caggcctgggttcaaatccctt

SEQ ID NO: 7640851 - DNA, 22 bp, Homo sapiens
caggcctggggctggcttccag

SEQ ID NO: 7640852 - DNA, 22 bp, Homo sapiens
caggcctggggctggcttccag

SEQ ID NO: 7640853 - DNA, 22 bp, Homo sapiens
caggcctggggctggcttccag

SEQ ID NO: 7640854 - DNA, 22 bp, Homo sapiens
caggcctgggcttcggggctga

SEQ ID NO: 7640855 - DNA, 22 bp, Homo sapiens
caggcctcaggggctcaggctg

SEQ ID NO: 7640856 - DNA, 22 bp, Homo sapiens
caggcctcagggctgtccgtag

SEQ ID NO: 7640857 - DNA, 22 bp, Homo sapiens
caggcctcaggggctcaggctg

SEQ ID NO: 7640858 - DNA, 22 bp, Homo sapiens
caggcctcagggctgtccgtag

SEQ ID NO: 7640859 - DNA, 22 bp, Homo sapiens
caggcctcagggctgtccgtag

SEQ ID NO: 7640860 - DNA, 22 bp, Homo sapiens
caggcctcagagagtggcgggg

SEQ ID NO: 7640861 - DNA, 22 bp, Homo sapiens
caggcctcagagagtggcgggg

SEQ ID NO: 7640862 - DNA, 22 bp, Homo sapiens
caggcctcagagagtggcgggg

SEQ ID NO: 7640863 - DNA, 22 bp, Homo sapiens
caggcctcagagagtggcgggg

SEQ ID NO: 7640864 - DNA, 22 bp, Homo sapiens
caggccggtgattctggatgta

SEQ ID NO: 7640865 - DNA, 22 bp, Homo sapiens
caggccggtgattctggatgta

SEQ ID NO: 7640866 - DNA, 21 bp, Homo sapiens
caggccgggtgagcaggcagc

SEQ ID NO: 7640867 - DNA, 21 bp, Homo sapiens
caggccgggtgagcaggcagc

SEQ ID NO: 7640868 - DNA, 22 bp, Homo sapiens
caggcctcaccagcggagctgc

SEQ ID NO: 7640869 - DNA, 22 bp, Homo sapiens
caggcctcaccagcggagctgc

SEQ ID NO: 7640870 - DNA, 22 bp, Homo sapiens
caggcctcaccagcggagctgc

SEQ ID NO: 7640871 - DNA, 22 bp, Homo sapiens
caggcctcaccagcggagctgc

SEQ ID NO: 7640872 - DNA, 22 bp, Homo sapiens
caggcctcaccagcggagctgc

SEQ ID NO: 7640873 - DNA, 22 bp, Homo sapiens
caggcctcatggtgtgtccttc

SEQ ID NO: 7640874 - DNA, 22 bp, Homo sapiens
caggcctcatggtgtgtccttc

SEQ ID NO: 7640875 - DNA, 22 bp, Homo sapiens
caggcctcatggtgtgtccttc

SEQ ID NO: 7640876 - DNA, 22 bp, Homo sapiens
caggcctcatggtgtgtccttc

SEQ ID NO: 7640877 - DNA, 22 bp, Homo sapiens
caggcctcatggtgtgtccttc

SEQ ID NO: 7640878 - DNA, 22 bp, Homo sapiens
caggcctccactccacgcagac

SEQ ID NO: 7640879 - DNA, 22 bp, Homo sapiens
caggcctccactccacgcagac

SEQ ID NO: 7640880 - DNA, 22 bp, Homo sapiens
caggcctccactccacgcagac

SEQ ID NO: 7640881 - DNA, 22 bp, Homo sapiens
caggcctcatggtgtgtccttc

SEQ ID NO: 7640882 - DNA, 22 bp, Homo sapiens
caggcctccactccacgcagac

SEQ ID NO: 7640883 - DNA, 22 bp, Homo sapiens
caggcctcaggggctcaggctg

SEQ ID NO: 7640884 - DNA, 22 bp, Homo sapiens
caggcctcaggggctcaggctg

SEQ ID NO: 7640885 - DNA, 22 bp, Homo sapiens
caggcctcaggggctcaggctg

SEQ ID NO: 7640886 - DNA, 22 bp, Homo sapiens
caggcctcaggggctcaggctg

SEQ ID NO: 7640887 - DNA, 22 bp, Homo sapiens
caggcctcaggggctcaggctg

SEQ ID NO: 7640888 - DNA, 22 bp, Homo sapiens
caggcctcaggggctcaggctg

SEQ ID NO: 7640889 - DNA, 22 bp, Homo sapiens
caggcctcaggggctcaggctg

SEQ ID NO: 7640890 - DNA, 22 bp, Homo sapiens
caggcctcaggggctcaggctg

SEQ ID NO: 7640891 - DNA, 22 bp, Homo sapiens
caggcctcaggggctcaggctg

SEQ ID NO: 7640892 - DNA, 21 bp, Homo sapiens
caggccccaggcctggggtgc

SEQ ID NO: 7640893 - DNA, 22 bp, Homo sapiens
caggccccattcctcttgggac

SEQ ID NO: 7640894 - DNA, 22 bp, Homo sapiens
caggccccattcctcttgggac

SEQ ID NO: 7640895 - DNA, 21 bp, Homo sapiens
caggccgggtgagcaggcagc

SEQ ID NO: 7640896 - DNA, 21 bp, Homo sapiens
caggccccaggcctggggtgc

SEQ ID NO: 7640897 - DNA, 21 bp, Homo sapiens
caggccccaggcctggggtgc

SEQ ID NO: 7640898 - DNA, 21 bp, Homo sapiens
caggccccaggcctggggtgc

SEQ ID NO: 7640899 - DNA, 23 bp, Homo sapiens
agctgggaattttctgaagcttt

SEQ ID NO: 7640900 - DNA, 23 bp, Homo sapiens
agctgggaattttctgaagcttt

SEQ ID NO: 7640901 - DNA, 23 bp, Homo sapiens
agctgggaattttctgaagcttt

SEQ ID NO: 7640902 - DNA, 23 bp, Homo sapiens
agctgggaattttctgaagcttt

SEQ ID NO: 7640903 - DNA, 22 bp, Homo sapiens
agctgggacagacaactatgtt

SEQ ID NO: 7640904 - DNA, 22 bp, Homo sapiens
agctgggacagacaactatgtt

SEQ ID NO: 7640905 - DNA, 22 bp, Homo sapiens
agctgggacagacaactatgtt

SEQ ID NO: 7640906 - DNA, 22 bp, Homo sapiens
agctgggacagacaactatgtt

SEQ ID NO: 7640907 - DNA, 22 bp, Homo sapiens
agctgggactcaactgtctggg

SEQ ID NO: 7640908 - DNA, 23 bp, Homo sapiens
agctgggaattttctgaagcttt

SEQ ID NO: 7640909 - DNA, 23 bp, Homo sapiens
agctgggaattttctgaagcttt

SEQ ID NO: 7640910 - DNA, 22 bp, Homo sapiens
agctgggaagagttttctgcag

SEQ ID NO: 7640911 - DNA, 22 bp, Homo sapiens
agctgggaagagttttctgcag

SEQ ID NO: 7640912 - DNA, 22 bp, Homo sapiens
agctgggaagagttttctgcag

SEQ ID NO: 7640913 - DNA, 22 bp, Homo sapiens
agctgggaagagttttctgcag

SEQ ID NO: 7640914 - DNA, 22 bp, Homo sapiens
agctgggaagagttttctgcag

SEQ ID NO: 7640915 - DNA, 22 bp, Homo sapiens
agctggctttgagctgggaggt

SEQ ID NO: 7640916 - DNA, 22 bp, Homo sapiens
agctggcttttgtgaaggtttt

SEQ ID NO: 7640917 - DNA, 22 bp, Homo sapiens
agctgggaagactggaagacag

SEQ ID NO: 7640918 - DNA, 22 bp, Homo sapiens
agctggcttttgtgaaggtttt

SEQ ID NO: 7640919 - DNA, 22 bp, Homo sapiens
agctgggaagactggaagacag

SEQ ID NO: 7640920 - DNA, 22 bp, Homo sapiens
agctgggaagactggaagacag

SEQ ID NO: 7640921 - DNA, 22 bp, Homo sapiens
agctgggaagactggaagacag

SEQ ID NO: 7640922 - DNA, 22 bp, Homo sapiens
agctgggaagactggaagacag

SEQ ID NO: 7640923 - DNA, 22 bp, Homo sapiens
caggaggttgtaagagcaggcc

SEQ ID NO: 7640924 - DNA, 22 bp, Homo sapiens
caggaggttgtaagagcaggcc

SEQ ID NO: 7640925 - DNA, 22 bp, Homo sapiens
caggaggttgtaagagcaggcc

SEQ ID NO: 7640926 - DNA, 22 bp, Homo sapiens
caggaggttgtaagagcaggcc

SEQ ID NO: 7640927 - DNA, 22 bp, Homo sapiens
caggaggttggtagcagtagat

SEQ ID NO: 7640928 - DNA, 22 bp, Homo sapiens
caggagtccagagtgtcatttt

SEQ ID NO: 7640929 - DNA, 22 bp, Homo sapiens
caggagtccagagtgtcatttt

SEQ ID NO: 7640930 - DNA, 22 bp, Homo sapiens
caggaggttgtaagagcaggcc

SEQ ID NO: 7640931 - DNA, 22 bp, Homo sapiens
caggaggttgtaagagcaggcc

SEQ ID NO: 7640932 - DNA, 22 bp, Homo sapiens
caggaggtgaaggagaaccagt

SEQ ID NO: 7640933 - DNA, 22 bp, Homo sapiens
caggaggtacatagattcagat

SEQ ID NO: 7640934 - DNA, 22 bp, Homo sapiens
caggaggtacatagattcagat

SEQ ID NO: 7640935 - DNA, 22 bp, Homo sapiens
caggaggtacatagattcagat

SEQ ID NO: 7640936 - DNA, 22 bp, Homo sapiens
caggagggtgtggaaaactggg

SEQ ID NO: 7640937 - DNA, 22 bp, Homo sapiens
caggaggtgacttccaggggtt

SEQ ID NO: 7640938 - DNA, 22 bp, Homo sapiens
caggaggtgaaggagaaccagt

SEQ ID NO: 7640939 - DNA, 22 bp, Homo sapiens
caggaggtgacttccaggggtt

SEQ ID NO: 7640940 - DNA, 22 bp, Homo sapiens
caggaggtgccctctagtggca

SEQ ID NO: 7640941 - DNA, 22 bp, Homo sapiens
caggaggtgccctctagtggca

SEQ ID NO: 7640942 - DNA, 22 bp, Homo sapiens
caggaggttgagggtgcagtga

SEQ ID NO: 7640943 - DNA, 22 bp, Homo sapiens
caggaggttgagggtgcagtga

SEQ ID NO: 7640944 - DNA, 22 bp, Homo sapiens
agctggcatctgaagtcagggc

SEQ ID NO: 7640945 - DNA, 22 bp, Homo sapiens
agctggcatctgaagtcagggc

SEQ ID NO: 7640946 - DNA, 22 bp, Homo sapiens
agctggcatctgaagtcagggc

SEQ ID NO: 7640947 - DNA, 22 bp, Homo sapiens
agctggcatctgaagtcagggc

SEQ ID NO: 7640948 - DNA, 22 bp, Homo sapiens
agctggcatactttgctaggaa

SEQ ID NO: 7640949 - DNA, 22 bp, Homo sapiens
agctggcatcgagcatttgaac

SEQ ID NO: 7640950 - DNA, 22 bp, Homo sapiens
agctggcatactttgctaggaa

SEQ ID NO: 7640951 - DNA, 22 bp, Homo sapiens
agctggcattctccttgttatt

SEQ ID NO: 7640952 - DNA, 22 bp, Homo sapiens
agctggcattctccttgttatt

SEQ ID NO: 7640953 - DNA, 22 bp, Homo sapiens
agctggcattgaagaatggtta

SEQ ID NO: 7640954 - DNA, 22 bp, Homo sapiens
agctggcattgaagaatggtta

SEQ ID NO: 7640955 - DNA, 22 bp, Homo sapiens
agctggcattgaagaatggtta

SEQ ID NO: 7640956 - DNA, 22 bp, Homo sapiens
agctggcattacaggagcatgc

SEQ ID NO: 7640957 - DNA, 22 bp, Homo sapiens
agctggcattacaggagcatgc

SEQ ID NO: 7640958 - DNA, 22 bp, Homo sapiens
agctggcattacaggagcatgc

SEQ ID NO: 7640959 - DNA, 22 bp, Homo sapiens
agctggcattacaggagcatgc

SEQ ID NO: 7640960 - DNA, 20 bp, Homo sapiens
agctggccaattctattact

SEQ ID NO: 7640961 - DNA, 22 bp, Homo sapiens
agctggcattgcagggagctgc

SEQ ID NO: 7640962 - DNA, 22 bp, Homo sapiens
agctggcattgcagggagctgc

SEQ ID NO: 7640963 - DNA, 22 bp, Homo sapiens
agctggccagcacctccaggtc

SEQ ID NO: 7640964 - DNA, 22 bp, Homo sapiens
agctggccagatgtcccaaaga

SEQ ID NO: 7640965 - DNA, 22 bp, Homo sapiens
agctggccagatgtcccaaaga

SEQ ID NO: 7640966 - DNA, 22 bp, Homo sapiens
agctggcattgcagggagctgc

SEQ ID NO: 7640967 - DNA, 22 bp, Homo sapiens
agctggcattgcagggagctgc

SEQ ID NO: 7640968 - DNA, 22 bp, Homo sapiens
agctggcattgcagggagctgc

SEQ ID NO: 7640969 - DNA, 22 bp, Homo sapiens
agctggcattgcagggagctgc

SEQ ID NO: 7640970 - DNA, 22 bp, Homo sapiens
agctggcattgcagggagctgc

SEQ ID NO: 7640971 - DNA, 22 bp, Homo sapiens
caggagggtgtggaaaactggg

SEQ ID NO: 7640972 - DNA, 22 bp, Homo sapiens
agctggccattgtgagtggcct

SEQ ID NO: 7640973 - DNA, 22 bp, Homo sapiens
agctggccagcacctccaggtc

SEQ ID NO: 7640974 - DNA, 22 bp, Homo sapiens
agctggccagcacctccaggtc

SEQ ID NO: 7640975 - DNA, 22 bp, Homo sapiens
agctggccagcacctccaggtc

SEQ ID NO: 7640976 - DNA, 22 bp, Homo sapiens
agctggccagcacctccaggtc

SEQ ID NO: 7640977 - DNA, 22 bp, Homo sapiens
agctggctggccccttcctgcc

SEQ ID NO: 7640978 - DNA, 22 bp, Homo sapiens
agctggctggccccttcctgcc

SEQ ID NO: 7640979 - DNA, 22 bp, Homo sapiens
agctggctggccccttcctgcc

SEQ ID NO: 7640980 - DNA, 22 bp, Homo sapiens
agctggctggccccttcctgcc

SEQ ID NO: 7640981 - DNA, 22 bp, Homo sapiens
agctggctgccttctccttagg

SEQ ID NO: 7640982 - DNA, 22 bp, Homo sapiens
agctggctgccttctccttagg

SEQ ID NO: 7640983 - DNA, 22 bp, Homo sapiens
agctggctggccccttcctgcc

SEQ ID NO: 7640984 - DNA, 22 bp, Homo sapiens
agctggctggccccttcctgcc

SEQ ID NO: 7640985 - DNA, 22 bp, Homo sapiens
agctggctggccccttcctgcc

SEQ ID NO: 7640986 - DNA, 21 bp, Homo sapiens
agctggcctggtttgagctcc

SEQ ID NO: 7640987 - DNA, 21 bp, Homo sapiens
agctggcctggtttgagctcc

SEQ ID NO: 7640988 - DNA, 20 bp, Homo sapiens
agctggcctgtcctaggcct

SEQ ID NO: 7640989 - DNA, 19 bp, Homo sapiens
agctggctcttctttgtct

SEQ ID NO: 7640990 - DNA, 22 bp, Homo sapiens
agctggctgccttctccttagg

SEQ ID NO: 7640991 - DNA, 22 bp, Homo sapiens
agctggctgccttctccttagg

SEQ ID NO: 7640992 - DNA, 22 bp, Homo sapiens
agctggctgccttctccttagg

SEQ ID NO: 7640993 - DNA, 22 bp, Homo sapiens
agctggctgccttctccttagg

SEQ ID NO: 7640994 - DNA, 22 bp, Homo sapiens
agctggctgccttctccttagg

SEQ ID NO: 7640995 - DNA, 21 bp, Homo sapiens
agctggcctggtttgagctcc

SEQ ID NO: 7640996 - DNA, 22 bp, Homo sapiens
caggagtccatctggcctggtg

SEQ ID NO: 7640997 - DNA, 22 bp, Homo sapiens
caggagtccatctggcctggtg

SEQ ID NO: 7640998 - DNA, 22 bp, Homo sapiens
caggagtccatctggcctggtg

SEQ ID NO: 7640999 - DNA, 22 bp, Homo sapiens
caggagtccatctggcctggtg

SEQ ID NO: 7641000 - DNA, 22 bp, Homo sapiens
caggagtcccaggggtgggcca

SEQ ID NO: 7641001 - DNA, 22 bp, Homo sapiens
caggagtcccaggggtgggcca

SEQ ID NO: 7641002 - DNA, 22 bp, Homo sapiens
caggagtcccaggggtgggcca

SEQ ID NO: 7641003 - DNA, 22 bp, Homo sapiens
caggagtcccccataccgcgtc

SEQ ID NO: 7641004 - DNA, 22 bp, Homo sapiens
caggagtcctgaaatctgatga

SEQ ID NO: 7641005 - DNA, 22 bp, Homo sapiens
caggagtccctctggccagcat

SEQ ID NO: 7641006 - DNA, 22 bp, Homo sapiens
caggagtccctctggccagcat

SEQ ID NO: 7641007 - DNA, 22 bp, Homo sapiens
caggagtccctctggccagcat

SEQ ID NO: 7641008 - DNA, 22 bp, Homo sapiens
caggagtctgttcctcatttgt

SEQ ID NO: 7641009 - DNA, 22 bp, Homo sapiens
caggagtctctcttgagcccag

SEQ ID NO: 7641010 - DNA, 22 bp, Homo sapiens
caggagtctctcttgagcccag

SEQ ID NO: 7641011 - DNA, 22 bp, Homo sapiens
caggagtctctcttgagcccag

SEQ ID NO: 7641012 - DNA, 21 bp, Homo sapiens
agctggcctggtttgagctcc

SEQ ID NO: 7641013 - DNA, 22 bp, Homo sapiens
agctggcctccgggtgcctggg

SEQ ID NO: 7641014 - DNA, 22 bp, Homo sapiens
agctggcttctctgcagacatt

SEQ ID NO: 7641015 - DNA, 22 bp, Homo sapiens
agctggcttctctgcagacatt

SEQ ID NO: 7641016 - DNA, 22 bp, Homo sapiens
agctggcttctctgcagacatt

SEQ ID NO: 7641017 - DNA, 22 bp, Homo sapiens
agctggcttctctgcagacatt

SEQ ID NO: 7641018 - DNA, 22 bp, Homo sapiens
agctggcttctctgcagacatt

SEQ ID NO: 7641019 - DNA, 22 bp, Homo sapiens
agctggcttctctgcagacatt

SEQ ID NO: 7641020 - DNA, 22 bp, Homo sapiens
agctggcttctctgcagacatt

SEQ ID NO: 7641021 - DNA, 22 bp, Homo sapiens
agctggcttcacaggcagtgtg

SEQ ID NO: 7641022 - DNA, 22 bp, Homo sapiens
agctggcttcacaggcagtgtg

SEQ ID NO: 7641023 - DNA, 22 bp, Homo sapiens
agctggcttcacaggcagtgtg

SEQ ID NO: 7641024 - DNA, 22 bp, Homo sapiens
agctggcttcacaggcagtgtg

SEQ ID NO: 7641025 - DNA, 22 bp, Homo sapiens
agctggcttcacaggcagtgtg

SEQ ID NO: 7641026 - DNA, 22 bp, Homo sapiens
agctggcttcacaggcagtgtg

SEQ ID NO: 7641027 - DNA, 22 bp, Homo sapiens
agctggctgggtgccagtctcc

SEQ ID NO: 7641028 - DNA, 22 bp, Homo sapiens
agctggctgggtgccagtctcc

SEQ ID NO: 7641029 - DNA, 22 bp, Homo sapiens
agctggctgggtgccagtctcc

SEQ ID NO: 7641030 - DNA, 22 bp, Homo sapiens
agctggctgggtgccagtctcc

SEQ ID NO: 7641031 - DNA, 22 bp, Homo sapiens
agctggctgggtgccagtctcc

SEQ ID NO: 7641032 - DNA, 22 bp, Homo sapiens
agctggctgggtgccagtctcc

SEQ ID NO: 7641033 - DNA, 22 bp, Homo sapiens
agctggctttgagctgggaggt

SEQ ID NO: 7641034 - DNA, 22 bp, Homo sapiens
agctggctttgagctgggaggt

SEQ ID NO: 7641035 - DNA, 22 bp, Homo sapiens
agctggctttgagctgggaggt

SEQ ID NO: 7641036 - DNA, 22 bp, Homo sapiens
agctggctttgagctgggaggt

SEQ ID NO: 7641037 - DNA, 22 bp, Homo sapiens
agctggctttgagctgggaggt

SEQ ID NO: 7641038 - DNA, 22 bp, Homo sapiens
agctggctttgagctgggaggt

SEQ ID NO: 7641039 - DNA, 22 bp, Homo sapiens
agctggctttgagctgggaggt

SEQ ID NO: 7641040 - DNA, 22 bp, Homo sapiens
agctggctttgagctgggaggt

SEQ ID NO: 7641041 - DNA, 22 bp, Homo sapiens
agctggctttgagctgggaggt

SEQ ID NO: 7641042 - DNA, 22 bp, Homo sapiens
agctggctttatggttggctaa

SEQ ID NO: 7641043 - DNA, 22 bp, Homo sapiens
agctggcttgcatgctaaggag

SEQ ID NO: 7641044 - DNA, 22 bp, Homo sapiens
agctggcttgcatgctaaggag

SEQ ID NO: 7641045 - DNA, 22 bp, Homo sapiens
agctggcttgcatgctaaggag

SEQ ID NO: 7641046 - DNA, 22 bp, Homo sapiens
agctggcttgcatgctaaggag

SEQ ID NO: 7641047 - DNA, 22 bp, Homo sapiens
agctggctttatggttggctaa

SEQ ID NO: 7641048 - DNA, 22 bp, Homo sapiens
agctggctttatggttggctaa

SEQ ID NO: 7641049 - DNA, 22 bp, Homo sapiens
agctggctttatggttggctaa

SEQ ID NO: 7641050 - DNA, 22 bp, Homo sapiens
agctggctttatggttggctaa

SEQ ID NO: 7641051 - DNA, 22 bp, Homo sapiens
agctggctttatggttggctaa

SEQ ID NO: 7641052 - DNA, 22 bp, Homo sapiens
agctggctttatggttggctaa

SEQ ID NO: 7641053 - DNA, 22 bp, Homo sapiens
agctgctccctatcctttcctt

SEQ ID NO: 7641054 - DNA, 22 bp, Homo sapiens
agctgctcctttcctgcaggcg

SEQ ID NO: 7641055 - DNA, 22 bp, Homo sapiens
agctgctcctttcctgcaggcg

SEQ ID NO: 7641056 - DNA, 22 bp, Homo sapiens
agctgctcctttcctgcaggcg

SEQ ID NO: 7641057 - DNA, 22 bp, Homo sapiens
agctgctccttggctgtggttc

SEQ ID NO: 7641058 - DNA, 22 bp, Homo sapiens
agctgctccttggctgtggttc

SEQ ID NO: 7641059 - DNA, 21 bp, Homo sapiens
agctgctccagggagctcagg

SEQ ID NO: 7641060 - DNA, 21 bp, Homo sapiens
agctgctccagggagctcagg

SEQ ID NO: 7641061 - DNA, 21 bp, Homo sapiens
agctgctccagggagctcagg

SEQ ID NO: 7641062 - DNA, 22 bp, Homo sapiens
agctgcctggccggagccactg

SEQ ID NO: 7641063 - DNA, 22 bp, Homo sapiens
agctgcctggccggagccactg

SEQ ID NO: 7641064 - DNA, 22 bp, Homo sapiens
agctgcctggccggagccactg

SEQ ID NO: 7641065 - DNA, 22 bp, Homo sapiens
agctgcctggccggagccactg

SEQ ID NO: 7641066 - DNA, 22 bp, Homo sapiens
agctgcctggccggagccactg

SEQ ID NO: 7641067 - DNA, 22 bp, Homo sapiens
agctgcctggccggagccactg

SEQ ID NO: 7641068 - DNA, 22 bp, Homo sapiens
agctgctccaatttttaccatt

SEQ ID NO: 7641069 - DNA, 22 bp, Homo sapiens
agctgctccaacccagcgggct

SEQ ID NO: 7641070 - DNA, 22 bp, Homo sapiens
agctgctccaacccagcgggct

SEQ ID NO: 7641071 - DNA, 22 bp, Homo sapiens
agctgctcattcccagcacatg

SEQ ID NO: 7641072 - DNA, 22 bp, Homo sapiens
agctgctcattcccagcacatg

SEQ ID NO: 7641073 - DNA, 22 bp, Homo sapiens
caggaaaaggagactttagcac

SEQ ID NO: 7641074 - DNA, 21 bp, Homo sapiens
caggaaaagcggaagtctagc

SEQ ID NO: 7641075 - DNA, 22 bp, Homo sapiens
agctgcctggagtcatttcctg

SEQ ID NO: 7641076 - DNA, 22 bp, Homo sapiens
caggaaaaggagactttagcac

SEQ ID NO: 7641077 - DNA, 22 bp, Homo sapiens
agctgcctggagtcatttcctg

SEQ ID NO: 7641078 - DNA, 22 bp, Homo sapiens
caggaaaaggagactttagcac

SEQ ID NO: 7641079 - DNA, 22 bp, Homo sapiens
caggaaaaggagactttagcac

SEQ ID NO: 7641080 - DNA, 22 bp, Homo sapiens
caggaaaaggagactttagcac

SEQ ID NO: 7641081 - DNA, 21 bp, Homo sapiens
caggaaaagcggaagtctagc

SEQ ID NO: 7641082 - DNA, 21 bp, Homo sapiens
caggaaaagcggaagtctagc

SEQ ID NO: 7641083 - DNA, 21 bp, Homo sapiens
caggaaaagcggaagtctagc

SEQ ID NO: 7641084 - DNA, 21 bp, Homo sapiens
caggaaaagcggaagtctagc

SEQ ID NO: 7641085 - DNA, 21 bp, Homo sapiens
caggaaaagcggaagtctagc

SEQ ID NO: 7641086 - DNA, 22 bp, Homo sapiens
caggaaaaatgccaggagtcag

SEQ ID NO: 7641087 - DNA, 22 bp, Homo sapiens
caggaaaaatgccaggagtcag

SEQ ID NO: 7641088 - DNA, 22 bp, Homo sapiens
caggaaaaatgccaggagtcag

SEQ ID NO: 7641089 - DNA, 22 bp, Homo sapiens
caggaaaaatgccaggagtcag

SEQ ID NO: 7641090 - DNA, 22 bp, Homo sapiens
caggaaaaatgccaggagtcag

SEQ ID NO: 7641091 - DNA, 22 bp, Homo sapiens
agctgctctacatgatggggaa

SEQ ID NO: 7641092 - DNA, 22 bp, Homo sapiens
agctgctctacatgatggggaa

SEQ ID NO: 7641093 - DNA, 22 bp, Homo sapiens
agctgctcgaagccggtggccc

SEQ ID NO: 7641094 - DNA, 22 bp, Homo sapiens
agctgctctcactggacgcctg

SEQ ID NO: 7641095 - DNA, 22 bp, Homo sapiens
agctgctctcactggacgcctg

SEQ ID NO: 7641096 - DNA, 22 bp, Homo sapiens
agctgctcgaagccggtggccc

SEQ ID NO: 7641097 - DNA, 22 bp, Homo sapiens
agctgctcgaagccggtggccc

SEQ ID NO: 7641098 - DNA, 22 bp, Homo sapiens
agctgctcctttcctgcaggcg

SEQ ID NO: 7641099 - DNA, 22 bp, Homo sapiens
agctgctcctttcctgcaggcg

SEQ ID NO: 7641100 - DNA, 22 bp, Homo sapiens
agctgctcttgggtgacttcaa

SEQ ID NO: 7641101 - DNA, 22 bp, Homo sapiens
agctgctctgataaacctactt

SEQ ID NO: 7641102 - DNA, 22 bp, Homo sapiens
agctgctctgggaaacagaagt

SEQ ID NO: 7641103 - DNA, 22 bp, Homo sapiens
agctgctcttcatttcccccca

SEQ ID NO: 7641104 - DNA, 22 bp, Homo sapiens
agctgctctgagccctgattct

SEQ ID NO: 7641105 - DNA, 20 bp, Homo sapiens
agctgctctcatccagacct

SEQ ID NO: 7641106 - DNA, 22 bp, Homo sapiens
agctgctctcagcagttccagg

SEQ ID NO: 7641107 - DNA, 22 bp, Homo sapiens
agctgctctcagcagttccagg

SEQ ID NO: 7641108 - DNA, 22 bp, Homo sapiens
agctgctgaatgacactgcaag

SEQ ID NO: 7641109 - DNA, 22 bp, Homo sapiens
agctgctgaatgacactgcaag

SEQ ID NO: 7641110 - DNA, 22 bp, Homo sapiens
agctgctgaatgacactgcaag

SEQ ID NO: 7641111 - DNA, 22 bp, Homo sapiens
agctgctgaatgacactgcaag

SEQ ID NO: 7641112 - DNA, 22 bp, Homo sapiens
agctgctgaatgacactgcaag

SEQ ID NO: 7641113 - DNA, 22 bp, Homo sapiens
agctgctgaatgacactgcaag

SEQ ID NO: 7641114 - DNA, 22 bp, Homo sapiens
agctgctgaagtgagagaattg

SEQ ID NO: 7641115 - DNA, 22 bp, Homo sapiens
agctgctgaagtgagagaattg

SEQ ID NO: 7641116 - DNA, 22 bp, Homo sapiens
agctgctgaagtgagagaattg

SEQ ID NO: 7641117 - DNA, 22 bp, Homo sapiens
agctgctctttgaaggacactt

SEQ ID NO: 7641118 - DNA, 22 bp, Homo sapiens
agctgctctttgaaggacactt

SEQ ID NO: 7641119 - DNA, 22 bp, Homo sapiens
agctgctctttgaaggacactt

SEQ ID NO: 7641120 - DNA, 22 bp, Homo sapiens
agctgctctttgaaggacactt

SEQ ID NO: 7641121 - DNA, 22 bp, Homo sapiens
agctgctgagccaggctgatgt

SEQ ID NO: 7641122 - DNA, 22 bp, Homo sapiens
agctgctgagccaggctgatgt

SEQ ID NO: 7641123 - DNA, 22 bp, Homo sapiens
agctgctgagccaggctgatgt

SEQ ID NO: 7641124 - DNA, 22 bp, Homo sapiens
agctgctgagagtctgccgggc

SEQ ID NO: 7641125 - DNA, 22 bp, Homo sapiens
agctgctgagagtctgccgggc

SEQ ID NO: 7641126 - DNA, 22 bp, Homo sapiens
agctgctgagagtctgccgggc

SEQ ID NO: 7641127 - DNA, 22 bp, Homo sapiens
agctgctgagagtctgccgggc

SEQ ID NO: 7641128 - DNA, 19 bp, Homo sapiens
caggacagacttcaaagcc

SEQ ID NO: 7641129 - DNA, 19 bp, Homo sapiens
caggacagacttcaaagcc

SEQ ID NO: 7641130 - DNA, 19 bp, Homo sapiens
caggacagacttcaaagcc

SEQ ID NO: 7641131 - DNA, 19 bp, Homo sapiens
caggacagacttcaaagcc

SEQ ID NO: 7641132 - DNA, 19 bp, Homo sapiens
caggacagacttcaaagcc

SEQ ID NO: 7641133 - DNA, 22 bp, Homo sapiens
caggacagaccaagatcgtgct

SEQ ID NO: 7641134 - DNA, 22 bp, Homo sapiens
caggacagaccaagatcgtgct

SEQ ID NO: 7641135 - DNA, 22 bp, Homo sapiens
caggacagaccaagatcgtgct

SEQ ID NO: 7641136 - DNA, 22 bp, Homo sapiens
caggacagacagaatgcctaac

SEQ ID NO: 7641137 - DNA, 22 bp, Homo sapiens
caggacagacagaatgcctaac

SEQ ID NO: 7641138 - DNA, 22 bp, Homo sapiens
caggacagaccaagatcgtgct

SEQ ID NO: 7641139 - DNA, 22 bp, Homo sapiens
caggacagaccaagatcgtgct

SEQ ID NO: 7641140 - DNA, 22 bp, Homo sapiens
caggacagaccaagatcgtgct

SEQ ID NO: 7641141 - DNA, 22 bp, Homo sapiens
caggacagaccaagatcgtgct

SEQ ID NO: 7641142 - DNA, 22 bp, Homo sapiens
caggacagaccaagatcgtgct

SEQ ID NO: 7641143 - DNA, 22 bp, Homo sapiens
caggacagaccaagatcgtgct

SEQ ID NO: 7641144 - DNA, 22 bp, Homo sapiens
caggacagaccaagatcgtgct

SEQ ID NO: 7641145 - DNA, 22 bp, Homo sapiens
caggacagaccaagatcgtgct

SEQ ID NO: 7641146 - DNA, 22 bp, Homo sapiens
caggacagaaataaggaatata

SEQ ID NO: 7641147 - DNA, 22 bp, Homo sapiens
caggacagacagaatgcctaac

SEQ ID NO: 7641148 - DNA, 22 bp, Homo sapiens
caggacagacagaatgcctaac

SEQ ID NO: 7641149 - DNA, 22 bp, Homo sapiens
caggacagacagaatgcctaac

SEQ ID NO: 7641150 - DNA, 22 bp, Homo sapiens
caggacagacagaatgcctaac

SEQ ID NO: 7641151 - DNA, 22 bp, Homo sapiens
caggacagacagaatgcctaac

SEQ ID NO: 7641152 - DNA, 22 bp, Homo sapiens
caggacagaaataaggaatata

SEQ ID NO: 7641153 - DNA, 22 bp, Homo sapiens
caggacagacagaatgcctaac

SEQ ID NO: 7641154 - DNA, 22 bp, Homo sapiens
caggacagacagaatgcctaac

SEQ ID NO: 7641155 - DNA, 22 bp, Homo sapiens
caggacagaaataaggaatata

SEQ ID NO: 7641156 - DNA, 22 bp, Homo sapiens
agctgctgagccaggctgatgt

SEQ ID NO: 7641157 - DNA, 22 bp, Homo sapiens
caggacacttgttcttctctgc

SEQ ID NO: 7641158 - DNA, 22 bp, Homo sapiens
caggacagaaataaggaatata

SEQ ID NO: 7641159 - DNA, 22 bp, Homo sapiens
caggacagaaataaggaatata

SEQ ID NO: 7641160 - DNA, 22 bp, Homo sapiens
caggacagaaataaggaatata

SEQ ID NO: 7641161 - DNA, 22 bp, Homo sapiens
caggacagaaataaggaatata

SEQ ID NO: 7641162 - DNA, 22 bp, Homo sapiens
caggacagaaataaggaatata

SEQ ID NO: 7641163 - DNA, 22 bp, Homo sapiens
caggacagaaataaggaatata

SEQ ID NO: 7641164 - DNA, 22 bp, Homo sapiens
caggacagaaataaggaatata

SEQ ID NO: 7641165 - DNA, 22 bp, Homo sapiens
caggacagagcccagactgtgt

SEQ ID NO: 7641166 - DNA, 22 bp, Homo sapiens
caggacagagcccagactgtgt

SEQ ID NO: 7641167 - DNA, 19 bp, Homo sapiens
caggacagacttcaaagcc

SEQ ID NO: 7641168 - DNA, 22 bp, Homo sapiens
caggacagagcccagactgtgt

SEQ ID NO: 7641169 - DNA, 22 bp, Homo sapiens
caggacagagcccagactgtgt

SEQ ID NO: 7641170 - DNA, 22 bp, Homo sapiens
caggacagagcccagactgtgt

SEQ ID NO: 7641171 - DNA, 22 bp, Homo sapiens
caggacagagcccagactgtgt

SEQ ID NO: 7641172 - DNA, 22 bp, Homo sapiens
caggacagagcccagactgtgt

SEQ ID NO: 7641173 - DNA, 22 bp, Homo sapiens
caggacagagcccagactgtgt

SEQ ID NO: 7641174 - DNA, 22 bp, Homo sapiens
caggacagagcccagactgtgt

SEQ ID NO: 7641175 - DNA, 22 bp, Homo sapiens
caggacagagcccagactgtgt

SEQ ID NO: 7641176 - DNA, 22 bp, Homo sapiens
caggacagagcccagactgtgt

SEQ ID NO: 7641177 - DNA, 22 bp, Homo sapiens
agctggcagtatgactggtgac

SEQ ID NO: 7641178 - DNA, 22 bp, Homo sapiens
agctggcaggtgaagatgattt

SEQ ID NO: 7641179 - DNA, 23 bp, Homo sapiens
agctggaggctgtctactcccaa

SEQ ID NO: 7641180 - DNA, 23 bp, Homo sapiens
agctggaggctgtctactcccaa

SEQ ID NO: 7641181 - DNA, 22 bp, Homo sapiens
agctggcaggtgaagatgattt

SEQ ID NO: 7641182 - DNA, 22 bp, Homo sapiens
caggacagagcccagactgtgt

SEQ ID NO: 7641183 - DNA, 22 bp, Homo sapiens
agctggaggataactcacttct

SEQ ID NO: 7641184 - DNA, 22 bp, Homo sapiens
caggacagagcccagactgtgt

SEQ ID NO: 7641185 - DNA, 22 bp, Homo sapiens
caggacagagcccagactgtgt

SEQ ID NO: 7641186 - DNA, 22 bp, Homo sapiens
agctggaggataactcacttct

SEQ ID NO: 7641187 - DNA, 22 bp, Homo sapiens
agctggcagtcatcctagtgag

SEQ ID NO: 7641188 - DNA, 22 bp, Homo sapiens
agctggcagtcatcctagtgag

SEQ ID NO: 7641189 - DNA, 22 bp, Homo sapiens
agctggcagtatgactggtgac

SEQ ID NO: 7641190 - DNA, 22 bp, Homo sapiens
agctggcagtcatcctagtgag

SEQ ID NO: 7641191 - DNA, 22 bp, Homo sapiens
agctggcagtcatcctagtgag

SEQ ID NO: 7641192 - DNA, 22 bp, Homo sapiens
agctggcagtcggccttgatgc

SEQ ID NO: 7641193 - DNA, 22 bp, Homo sapiens
agctggcatactttgctaggaa

SEQ ID NO: 7641194 - DNA, 22 bp, Homo sapiens
agctggcatactttgctaggaa

SEQ ID NO: 7641195 - DNA, 22 bp, Homo sapiens
agctggcatactttgctaggaa

SEQ ID NO: 7641196 - DNA, 22 bp, Homo sapiens
agctggcatactttgctaggaa

SEQ ID NO: 7641197 - DNA, 22 bp, Homo sapiens
agctggcatactttgctaggaa

SEQ ID NO: 7641198 - DNA, 22 bp, Homo sapiens
agctggcagtcggccttgatgc

SEQ ID NO: 7641199 - DNA, 22 bp, Homo sapiens
agctggcagtcggccttgatgc

SEQ ID NO: 7641200 - DNA, 21 bp, Homo sapiens
agctggcagtgcctggacctc

SEQ ID NO: 7641201 - DNA, 21 bp, Homo sapiens
agctgcagccatgtacatggc

SEQ ID NO: 7641202 - DNA, 21 bp, Homo sapiens
agctgcagcccaaaggcctgt

SEQ ID NO: 7641203 - DNA, 22 bp, Homo sapiens
agctgcaggcccatgctcagtc

SEQ ID NO: 7641204 - DNA, 22 bp, Homo sapiens
agctgcaggcccatgctcagtc

SEQ ID NO: 7641205 - DNA, 22 bp, Homo sapiens
agctgcaggcccatgctcagtc

SEQ ID NO: 7641206 - DNA, 22 bp, Homo sapiens
agctgcagccctcctgcatggc

SEQ ID NO: 7641207 - DNA, 22 bp, Homo sapiens
agctgcaggcctctcctgggga

SEQ ID NO: 7641208 - DNA, 21 bp, Homo sapiens
agctgcaggcctcccagggat

SEQ ID NO: 7641209 - DNA, 22 bp, Homo sapiens
agctgcaggcctctcctgggga

SEQ ID NO: 7641210 - DNA, 22 bp, Homo sapiens
agctgcaggcctctcctgggga

SEQ ID NO: 7641211 - DNA, 22 bp, Homo sapiens
agctgcaggcctctcctgggga

SEQ ID NO: 7641212 - DNA, 22 bp, Homo sapiens
agctgcaggcccatgctcagtc

SEQ ID NO: 7641213 - DNA, 22 bp, Homo sapiens
agctgcaggcccatgctcagtc

SEQ ID NO: 7641214 - DNA, 21 bp, Homo sapiens
agctgcaggcctcccagggat

SEQ ID NO: 7641215 - DNA, 21 bp, Homo sapiens
agctgcaggcctcccagggat

SEQ ID NO: 7641216 - DNA, 21 bp, Homo sapiens
agctgcaggcctcccagggat

SEQ ID NO: 7641217 - DNA, 23 bp, Homo sapiens
agctgaggctgtgggtgtcagag

SEQ ID NO: 7641218 - DNA, 23 bp, Homo sapiens
agctgaggctgtgggtgtcagag

SEQ ID NO: 7641219 - DNA, 22 bp, Homo sapiens
agctgaggctctgagagggaag

SEQ ID NO: 7641220 - DNA, 23 bp, Homo sapiens
agctgaggctgtgggtgtcagag

SEQ ID NO: 7641221 - DNA, 23 bp, Homo sapiens
agctgaggctgtgggtgtcagag

SEQ ID NO: 7641222 - DNA, 23 bp, Homo sapiens
agctgaggctgtgggtgtcagag

SEQ ID NO: 7641223 - DNA, 23 bp, Homo sapiens
agctgaggctgtgggtgtcagag

SEQ ID NO: 7641224 - DNA, 21 bp, Homo sapiens
agctgcagccatgtacatggc

SEQ ID NO: 7641225 - DNA, 22 bp, Homo sapiens
agctgaggctctgagagggaag

SEQ ID NO: 7641226 - DNA, 22 bp, Homo sapiens
agctgaggctctgagagggaag

SEQ ID NO: 7641227 - DNA, 22 bp, Homo sapiens
agctgaggctctgagagggaag

SEQ ID NO: 7641228 - DNA, 22 bp, Homo sapiens
agctgaggctctgagagggaag

SEQ ID NO: 7641229 - DNA, 22 bp, Homo sapiens
agctgaggctctgagagggaag

SEQ ID NO: 7641230 - DNA, 22 bp, Homo sapiens
agctgaggctctgagagggaag

SEQ ID NO: 7641231 - DNA, 23 bp, Homo sapiens
agctgaggctgtgggtgtcagag

SEQ ID NO: 7641232 - DNA, 22 bp, Homo sapiens
agctgaggcatggacaggctgc

SEQ ID NO: 7641233 - DNA, 22 bp, Homo sapiens
agctgaggcatggacaggctgc

SEQ ID NO: 7641234 - DNA, 22 bp, Homo sapiens
agctgaggcatggacaggctgc

SEQ ID NO: 7641235 - DNA, 22 bp, Homo sapiens
agctgaggcatggacaggctgc

SEQ ID NO: 7641236 - DNA, 22 bp, Homo sapiens
agctgaggccacgagtgaaggg

SEQ ID NO: 7641237 - DNA, 22 bp, Homo sapiens
agctgaggcatggacaggctgc

SEQ ID NO: 7641238 - DNA, 22 bp, Homo sapiens
agctgaggcctgatttcgccgt

SEQ ID NO: 7641239 - DNA, 22 bp, Homo sapiens
agctgaggctctgagagggaag

SEQ ID NO: 7641240 - DNA, 22 bp, Homo sapiens
agctgaggcctgatttcgccgt

SEQ ID NO: 7641241 - DNA, 22 bp, Homo sapiens
agctgaggccacgagtgaaggg

SEQ ID NO: 7641242 - DNA, 22 bp, Homo sapiens
agctgaggccacgagtgaaggg

SEQ ID NO: 7641243 - DNA, 22 bp, Homo sapiens
agctgaggccacgagtgaaggg

SEQ ID NO: 7641244 - DNA, 22 bp, Homo sapiens
agctgaggccacgagtgaaggg

SEQ ID NO: 7641245 - DNA, 22 bp, Homo sapiens
agctgaggccacgagtgaaggg

SEQ ID NO: 7641246 - DNA, 22 bp, Homo sapiens
agctgaggcatgatgctatcag

SEQ ID NO: 7641247 - DNA, 22 bp, Homo sapiens
agctgaggcatgatgctatcag

SEQ ID NO: 7641248 - DNA, 23 bp, Homo sapiens
agctgaggcagaggggcattctc

SEQ ID NO: 7641249 - DNA, 22 bp, Homo sapiens
agctgaggcatgatgctatcag

SEQ ID NO: 7641250 - DNA, 22 bp, Homo sapiens
agctgaggcatgatgctatcag

SEQ ID NO: 7641251 - DNA, 22 bp, Homo sapiens
agctgaggcatgatgctatcag

SEQ ID NO: 7641252 - DNA, 22 bp, Homo sapiens
agctgaggcatggacaggctgc

SEQ ID NO: 7641253 - DNA, 22 bp, Homo sapiens
agctgaggcatggacaggctgc

SEQ ID NO: 7641254 - DNA, 22 bp, Homo sapiens
agctgaggcatggacaggctgc

SEQ ID NO: 7641255 - DNA, 22 bp, Homo sapiens
agctgaggcatggacaggctgc

SEQ ID NO: 7641256 - DNA, 22 bp, Homo sapiens
cagcttgcactatattaaggag

SEQ ID NO: 7641257 - DNA, 22 bp, Homo sapiens
cagcttgcacacatattagacg

SEQ ID NO: 7641258 - DNA, 23 bp, Homo sapiens
agctgaggcagaggggcattctc

SEQ ID NO: 7641259 - DNA, 23 bp, Homo sapiens
cagcttctttgggattctttata

SEQ ID NO: 7641260 - DNA, 22 bp, Homo sapiens
cagcttgaaatattaggagatg

SEQ ID NO: 7641261 - DNA, 22 bp, Homo sapiens
cagcttgaaatattaggagatg

SEQ ID NO: 7641262 - DNA, 23 bp, Homo sapiens
cagcttctttgggattctttata

SEQ ID NO: 7641263 - DNA, 23 bp, Homo sapiens
cagcttctttgggattctttata

SEQ ID NO: 7641264 - DNA, 23 bp, Homo sapiens
cagcttctttgggattctttata

SEQ ID NO: 7641265 - DNA, 22 bp, Homo sapiens
cagctttgtgacttcggacaag

SEQ ID NO: 7641266 - DNA, 22 bp, Homo sapiens
cagcttttaggactgtgagaaa

SEQ ID NO: 7641267 - DNA, 22 bp, Homo sapiens
caggaaaaatgccaggagtcag

SEQ ID NO: 7641268 - DNA, 22 bp, Homo sapiens
cagctttttagaatctagggca

SEQ ID NO: 7641269 - DNA, 22 bp, Homo sapiens
cagcttttaggactgtgagaaa

SEQ ID NO: 7641270 - DNA, 22 bp, Homo sapiens
cagcttttgcagacttcttgcc

SEQ ID NO: 7641271 - DNA, 22 bp, Homo sapiens
cagcttttgcagacttcttgcc

SEQ ID NO: 7641272 - DNA, 22 bp, Homo sapiens
cagcttttgcagacttcttgcc

SEQ ID NO: 7641273 - DNA, 22 bp, Homo sapiens
cagctttgtcatttgatttggg

SEQ ID NO: 7641274 - DNA, 22 bp, Homo sapiens
cagctttggagtgtgagtgctg

SEQ ID NO: 7641275 - DNA, 22 bp, Homo sapiens
agctgcagtcaagctgggccac

SEQ ID NO: 7641276 - DNA, 22 bp, Homo sapiens
agctgcaggttcagcattccac

SEQ ID NO: 7641277 - DNA, 22 bp, Homo sapiens
agctgcagggcttgggtttccc

SEQ ID NO: 7641278 - DNA, 22 bp, Homo sapiens
agctgcaggtggacccgtaccg

SEQ ID NO: 7641279 - DNA, 22 bp, Homo sapiens
agctgcaggtggacccgtaccg

SEQ ID NO: 7641280 - DNA, 22 bp, Homo sapiens
agctgcaggttcagcattccac

SEQ ID NO: 7641281 - DNA, 22 bp, Homo sapiens
agctgcaggttcagcattccac

SEQ ID NO: 7641282 - DNA, 22 bp, Homo sapiens
agctgcagtaaagctctccagg

SEQ ID NO: 7641283 - DNA, 22 bp, Homo sapiens
agctgcagtaaagctctccagg

SEQ ID NO: 7641284 - DNA, 22 bp, Homo sapiens
agctgcagtaaagctctccagg

SEQ ID NO: 7641285 - DNA, 22 bp, Homo sapiens
agctgcaggcgccggggccgat

SEQ ID NO: 7641286 - DNA, 22 bp, Homo sapiens
agctgcaggcgccggggccgat

SEQ ID NO: 7641287 - DNA, 22 bp, Homo sapiens
agctgcaggcctctcctgggga

SEQ ID NO: 7641288 - DNA, 22 bp, Homo sapiens
agctgcaggcctctcctgggga

SEQ ID NO: 7641289 - DNA, 22 bp, Homo sapiens
agctgcaggcctctcctgggga

SEQ ID NO: 7641290 - DNA, 21 bp, Homo sapiens
agctgcagtcaagccagaggt

SEQ ID NO: 7641291 - DNA, 21 bp, Homo sapiens
agctgcagtcaagccagaggt

SEQ ID NO: 7641292 - DNA, 21 bp, Homo sapiens
agctgcagtcaagccagaggt

SEQ ID NO: 7641293 - DNA, 21 bp, Homo sapiens
agctgcagtcaagccagaggt

SEQ ID NO: 7641294 - DNA, 22 bp, Homo sapiens
agctgcagtcaagctgggccac

SEQ ID NO: 7641295 - DNA, 22 bp, Homo sapiens
agctgcagtcaagctgggccac

SEQ ID NO: 7641296 - DNA, 22 bp, Homo sapiens
agctgcagtcaagctgggccac

SEQ ID NO: 7641297 - DNA, 22 bp, Homo sapiens
agctgcagtatgaggctggtgg

SEQ ID NO: 7641298 - DNA, 22 bp, Homo sapiens
agctgcagtatgaggctggtgg

SEQ ID NO: 7641299 - DNA, 22 bp, Homo sapiens
agctgcagtaaagctctccagg

SEQ ID NO: 7641300 - DNA, 22 bp, Homo sapiens
agctgcagtatgaggctggtgg

SEQ ID NO: 7641301 - DNA, 22 bp, Homo sapiens
agctgcagtatgaggctggtgg

SEQ ID NO: 7641302 - DNA, 22 bp, Homo sapiens
agctgcagtatgaggctggtgg

SEQ ID NO: 7641303 - DNA, 21 bp, Homo sapiens
agctgcagtcaagccagaggt

SEQ ID NO: 7641304 - DNA, 21 bp, Homo sapiens
agctgcagtcaagccagaggt

SEQ ID NO: 7641305 - DNA, 22 bp, Homo sapiens
agctgcagtatgaggctggtgg

SEQ ID NO: 7641306 - DNA, 21 bp, Homo sapiens
agctgcagtcaagccagaggt

SEQ ID NO: 7641307 - DNA, 21 bp, Homo sapiens
agctgcagtcaagccagaggt

SEQ ID NO: 7641308 - DNA, 18 bp, Homo sapiens
agctctcccccacatgcc

SEQ ID NO: 7641309 - DNA, 22 bp, Homo sapiens
agctctcccatagggcaagatc

SEQ ID NO: 7641310 - DNA, 18 bp, Homo sapiens
agctctcccccacatgcc

SEQ ID NO: 7641311 - DNA, 18 bp, Homo sapiens
agctctcccccacatgcc

SEQ ID NO: 7641312 - DNA, 22 bp, Homo sapiens
agctctcccatagggcaagatc

SEQ ID NO: 7641313 - DNA, 22 bp, Homo sapiens
agctctcccaccttcttcttac

SEQ ID NO: 7641314 - DNA, 22 bp, Homo sapiens
agctcctgtgtgaagcctccct

SEQ ID NO: 7641315 - DNA, 22 bp, Homo sapiens
agctcctgtgtgaagcctccct

SEQ ID NO: 7641316 - DNA, 22 bp, Homo sapiens
agctctctgataaattgataaa

SEQ ID NO: 7641317 - DNA, 22 bp, Homo sapiens
agctctctgataaattgataaa

SEQ ID NO: 7641318 - DNA, 22 bp, Homo sapiens
agctctctgataaattgataaa

SEQ ID NO: 7641319 - DNA, 22 bp, Homo sapiens
agctctcttccagatccacttg

SEQ ID NO: 7641320 - DNA, 23 bp, Homo sapiens
agctctgaaatagggaaagagga

SEQ ID NO: 7641321 - DNA, 22 bp, Homo sapiens
agctctgaaagttatgtcgccg

SEQ ID NO: 7641322 - DNA, 22 bp, Homo sapiens
agctctgaagcttatctgatgt

SEQ ID NO: 7641323 - DNA, 22 bp, Homo sapiens
agctctgacattgattctcagc

SEQ ID NO: 7641324 - DNA, 22 bp, Homo sapiens
agctctgacattgattctcagc

SEQ ID NO: 7641325 - DNA, 22 bp, Homo sapiens
agctctgactgaagagatgcaa

SEQ ID NO: 7641326 - DNA, 22 bp, Homo sapiens
agctctgacaaggattttctgc

SEQ ID NO: 7641327 - DNA, 22 bp, Homo sapiens
agctctgaagcttatctgatgt

SEQ ID NO: 7641328 - DNA, 22 bp, Homo sapiens
agctctgacaaggattttctgc

SEQ ID NO: 7641329 - DNA, 16 bp, Homo sapiens
agctctgagtagagtt

SEQ ID NO: 7641330 - DNA, 22 bp, Homo sapiens
agctctgagaaagttagaaagt

SEQ ID NO: 7641331 - DNA, 22 bp, Homo sapiens
agctctgagaaagttagaaagt

SEQ ID NO: 7641332 - DNA, 22 bp, Homo sapiens
agctctgactgaagagatgcaa

SEQ ID NO: 7641333 - DNA, 22 bp, Homo sapiens
agctctgactgaagagatgcaa

SEQ ID NO: 7641334 - DNA, 22 bp, Homo sapiens
agctctgatctttacaacaaag

SEQ ID NO: 7641335 - DNA, 22 bp, Homo sapiens
agctctgatctttacaacaaag

SEQ ID NO: 7641336 - DNA, 22 bp, Homo sapiens
agctctgatctttacaacaaag

SEQ ID NO: 7641337 - DNA, 22 bp, Homo sapiens
agctctgatgactttacaactt

SEQ ID NO: 7641338 - DNA, 22 bp, Homo sapiens
agctctgattagagacattctt

SEQ ID NO: 7641339 - DNA, 16 bp, Homo sapiens
agctctgagtagagtt

SEQ ID NO: 7641340 - DNA, 22 bp, Homo sapiens
agctctgagttggggaggagca

SEQ ID NO: 7641341 - DNA, 22 bp, Homo sapiens
agctctgatccataatttatac

SEQ ID NO: 7641342 - DNA, 22 bp, Homo sapiens
agctctgatccataatttatac

SEQ ID NO: 7641343 - DNA, 22 bp, Homo sapiens
cagctcctgcctgggcagctgt

SEQ ID NO: 7641344 - DNA, 22 bp, Homo sapiens
cagctcctgcctgggcagctgt

SEQ ID NO: 7641345 - DNA, 22 bp, Homo sapiens
cagctcctgcctgggcagctgt

SEQ ID NO: 7641346 - DNA, 22 bp, Homo sapiens
cagctcctgcagctggctccca

SEQ ID NO: 7641347 - DNA, 22 bp, Homo sapiens
agctctggaagccctggtagtt

SEQ ID NO: 7641348 - DNA, 22 bp, Homo sapiens
agctctggaagccctggtagtt

SEQ ID NO: 7641349 - DNA, 22 bp, Homo sapiens
agctctggaagccctggtagtt

SEQ ID NO: 7641350 - DNA, 22 bp, Homo sapiens
agctctggaactcccggctgct

SEQ ID NO: 7641351 - DNA, 22 bp, Homo sapiens
agctctggaagccctggtagtt

SEQ ID NO: 7641352 - DNA, 22 bp, Homo sapiens
cagctcctgggccatctcctag

SEQ ID NO: 7641353 - DNA, 22 bp, Homo sapiens
cagctcctgcctgggcagctgt

SEQ ID NO: 7641354 - DNA, 22 bp, Homo sapiens
cagctcctgcctgggcagctgt

SEQ ID NO: 7641355 - DNA, 22 bp, Homo sapiens
cagctcctgttggtcttgagga

SEQ ID NO: 7641356 - DNA, 22 bp, Homo sapiens
cagctcctgttggtcttgagga

SEQ ID NO: 7641357 - DNA, 22 bp, Homo sapiens
cagctcctgttggtcttgagga

SEQ ID NO: 7641358 - DNA, 22 bp, Homo sapiens
cagctcctgggccatctcctag

SEQ ID NO: 7641359 - DNA, 22 bp, Homo sapiens
cagctcctgggccatctcctag

SEQ ID NO: 7641360 - DNA, 22 bp, Homo sapiens
cagctcctgggccatctcctag

SEQ ID NO: 7641361 - DNA, 22 bp, Homo sapiens
agctctgcagcccagcaggtgg

SEQ ID NO: 7641362 - DNA, 22 bp, Homo sapiens
agctctgcagcccagcaggtgg

SEQ ID NO: 7641363 - DNA, 22 bp, Homo sapiens
agctctgcaggcacagctgagg

SEQ ID NO: 7641364 - DNA, 22 bp, Homo sapiens
agctctgcagcccagcaggtgg

SEQ ID NO: 7641365 - DNA, 22 bp, Homo sapiens
agctctgcaggcacagctgagg

SEQ ID NO: 7641366 - DNA, 22 bp, Homo sapiens
agctctgcaggcacagctgagg

SEQ ID NO: 7641367 - DNA, 22 bp, Homo sapiens
agctctgcaggcacagctgagg

SEQ ID NO: 7641368 - DNA, 22 bp, Homo sapiens
agctctgccgcctttcaggctg

SEQ ID NO: 7641369 - DNA, 22 bp, Homo sapiens
agctctgccttgacaccttctc

SEQ ID NO: 7641370 - DNA, 22 bp, Homo sapiens
agctctgcctaggttccacgat

SEQ ID NO: 7641371 - DNA, 22 bp, Homo sapiens
agctctgccttgacaccttctc

SEQ ID NO: 7641372 - DNA, 22 bp, Homo sapiens
agctctgccttgacaccttctc

SEQ ID NO: 7641373 - DNA, 22 bp, Homo sapiens
agctctgctactctgtggggtg

SEQ ID NO: 7641374 - DNA, 22 bp, Homo sapiens
agctctgccgcctttcaggctg

SEQ ID NO: 7641375 - DNA, 23 bp, Homo sapiens
agctctgctcgggcatgccctgc

SEQ ID NO: 7641376 - DNA, 23 bp, Homo sapiens
agctctgctcgggcatgccctgc

SEQ ID NO: 7641377 - DNA, 23 bp, Homo sapiens
agctctgctcgggcatgccctgc

SEQ ID NO: 7641378 - DNA, 22 bp, Homo sapiens
agctctggaactcccggctgct

SEQ ID NO: 7641379 - DNA, 22 bp, Homo sapiens
agctctggaactcccggctgct

SEQ ID NO: 7641380 - DNA, 22 bp, Homo sapiens
agctctggaactcccggctgct

SEQ ID NO: 7641381 - DNA, 22 bp, Homo sapiens
agctctggaactcccggctgct

SEQ ID NO: 7641382 - DNA, 22 bp, Homo sapiens
agctctgcttcttgggaagatg

SEQ ID NO: 7641383 - DNA, 22 bp, Homo sapiens
agctctggaactcccggctgct

SEQ ID NO: 7641384 - DNA, 22 bp, Homo sapiens
agctctggaactcccggctgct

SEQ ID NO: 7641385 - DNA, 22 bp, Homo sapiens
cagctctgacacagtacaaaat

SEQ ID NO: 7641386 - DNA, 22 bp, Homo sapiens
cagctctgacacagtacaaaat

SEQ ID NO: 7641387 - DNA, 22 bp, Homo sapiens
cagctgttgtcacctcacatcc

SEQ ID NO: 7641388 - DNA, 22 bp, Homo sapiens
cagctctgacacagtacaaaat

SEQ ID NO: 7641389 - DNA, 22 bp, Homo sapiens
cagctgttgtgatccatttacg

SEQ ID NO: 7641390 - DNA, 22 bp, Homo sapiens
cagctgttgtctctcacatatt

SEQ ID NO: 7641391 - DNA, 22 bp, Homo sapiens
cagctctgacacagtacaaaat

SEQ ID NO: 7641392 - DNA, 22 bp, Homo sapiens
cagctgttgtctctcacatatt

SEQ ID NO: 7641393 - DNA, 22 bp, Homo sapiens
cagctgttgtctctcacatatt

SEQ ID NO: 7641394 - DNA, 22 bp, Homo sapiens
cagctctgaagaaaggtgtcta

SEQ ID NO: 7641395 - DNA, 22 bp, Homo sapiens
cagctctctaaggtcttgcttt

SEQ ID NO: 7641396 - DNA, 22 bp, Homo sapiens
cagctctgaagaaaggtgtcta

SEQ ID NO: 7641397 - DNA, 22 bp, Homo sapiens
cagctctgaagaaaggtgtcta

SEQ ID NO: 7641398 - DNA, 22 bp, Homo sapiens
cagctctgaagaaaggtgtcta

SEQ ID NO: 7641399 - DNA, 22 bp, Homo sapiens
cagctctgaagaaaggtgtcta

SEQ ID NO: 7641400 - DNA, 22 bp, Homo sapiens
cagctctgaagaaaggtgtcta

SEQ ID NO: 7641401 - DNA, 22 bp, Homo sapiens
cagctcctgttggtcttgagga

SEQ ID NO: 7641402 - DNA, 22 bp, Homo sapiens
cagctcctgttggtcttgagga

SEQ ID NO: 7641403 - DNA, 23 bp, Homo sapiens
cagctcgcttttgttccctccct

SEQ ID NO: 7641404 - DNA, 22 bp, Homo sapiens
cagctcgggcctccctctcccg

SEQ ID NO: 7641405 - DNA, 22 bp, Homo sapiens
cagctcctgttggtcttgagga

SEQ ID NO: 7641406 - DNA, 23 bp, Homo sapiens
cagctcgcttttgttccctccct

SEQ ID NO: 7641407 - DNA, 23 bp, Homo sapiens
cagctcgcttttgttccctccct

SEQ ID NO: 7641408 - DNA, 22 bp, Homo sapiens
cagctctcacaccctcctccca

SEQ ID NO: 7641409 - DNA, 22 bp, Homo sapiens
cagctctcacaccctcctccca

SEQ ID NO: 7641410 - DNA, 22 bp, Homo sapiens
cagctctcacaccctcctccca

SEQ ID NO: 7641411 - DNA, 22 bp, Homo sapiens
cagctctcacaccctcctccca

SEQ ID NO: 7641412 - DNA, 22 bp, Homo sapiens
cagctctccaccctcctggttc

SEQ ID NO: 7641413 - DNA, 22 bp, Homo sapiens
cagctctccaccctcctggttc

SEQ ID NO: 7641414 - DNA, 22 bp, Homo sapiens
cagctctcacacttagcttcta

SEQ ID NO: 7641415 - DNA, 22 bp, Homo sapiens
cagctctcacacttagcttcta

SEQ ID NO: 7641416 - DNA, 22 bp, Homo sapiens
cagctctcacacttagcttcta

SEQ ID NO: 7641417 - DNA, 22 bp, Homo sapiens
cagctctcacaccctcctccca

SEQ ID NO: 7641418 - DNA, 22 bp, Homo sapiens
cagctctcacacttagcttcta

SEQ ID NO: 7641419 - DNA, 21 bp, Homo sapiens
cagcttcttctgtgacctggt

SEQ ID NO: 7641420 - DNA, 22 bp, Homo sapiens
cagcttcttcagtcctggagct

SEQ ID NO: 7641421 - DNA, 22 bp, Homo sapiens
cagcttcttcagtcctggagct

SEQ ID NO: 7641422 - DNA, 22 bp, Homo sapiens
cagcttcttcagtcctggagct

SEQ ID NO: 7641423 - DNA, 21 bp, Homo sapiens
cagcttcttctgtgacctggt

SEQ ID NO: 7641424 - DNA, 22 bp, Homo sapiens
cagcttctttgggattctttat

SEQ ID NO: 7641425 - DNA, 22 bp, Homo sapiens
cagcttctttgggattctttat

SEQ ID NO: 7641426 - DNA, 22 bp, Homo sapiens
cagcttctttgggattctttat

SEQ ID NO: 7641427 - DNA, 22 bp, Homo sapiens
cagcttcttagtctttccttgt

SEQ ID NO: 7641428 - DNA, 22 bp, Homo sapiens
cagcttcttcagtcctggagct

SEQ ID NO: 7641429 - DNA, 22 bp, Homo sapiens
cagcttcttcagtcctggagct

SEQ ID NO: 7641430 - DNA, 22 bp, Homo sapiens
cagcttcttagtctttccttgt

SEQ ID NO: 7641431 - DNA, 22 bp, Homo sapiens
cagcttctgtttctagcccctg

SEQ ID NO: 7641432 - DNA, 22 bp, Homo sapiens
cagcttctgtttctagcccctg

SEQ ID NO: 7641433 - DNA, 22 bp, Homo sapiens
cagcttctgtttctagcccctg

SEQ ID NO: 7641434 - DNA, 22 bp, Homo sapiens
cagcttctgtttattgtgtgcc

SEQ ID NO: 7641435 - DNA, 22 bp, Homo sapiens
cagcttctgtctgattagcaag

SEQ ID NO: 7641436 - DNA, 22 bp, Homo sapiens
cagcttctggcgtggagcctga

SEQ ID NO: 7641437 - DNA, 22 bp, Homo sapiens
cagcttctggcgtggagcctga

SEQ ID NO: 7641438 - DNA, 22 bp, Homo sapiens
cagcttctggcgtggagcctga

SEQ ID NO: 7641439 - DNA, 22 bp, Homo sapiens
cagcttctggcgtggagcctga

SEQ ID NO: 7641440 - DNA, 22 bp, Homo sapiens
cagcttctggcgtggagcctga

SEQ ID NO: 7641441 - DNA, 22 bp, Homo sapiens
cagcttctgtcctagaaactgg

SEQ ID NO: 7641442 - DNA, 22 bp, Homo sapiens
cagcttctggcgtggagcctga

SEQ ID NO: 7641443 - DNA, 22 bp, Homo sapiens
cagcttctgctcatggaggggt

SEQ ID NO: 7641444 - DNA, 22 bp, Homo sapiens
cagctgttgtgatccatttacg

SEQ ID NO: 7641445 - DNA, 22 bp, Homo sapiens
agactagagagatataatatgg

SEQ ID NO: 7641446 - DNA, 22 bp, Homo sapiens
agactactctgttttatatctt

SEQ ID NO: 7641447 - DNA, 22 bp, Homo sapiens
agactactctgttttatatctt

SEQ ID NO: 7641448 - DNA, 22 bp, Homo sapiens
agactactctgttttatatctt

SEQ ID NO: 7641449 - DNA, 22 bp, Homo sapiens
agactacatatgccacatgaag

SEQ ID NO: 7641450 - DNA, 22 bp, Homo sapiens
agactacaggagaaactcactc

SEQ ID NO: 7641451 - DNA, 22 bp, Homo sapiens
agactaaattgggatgtgttgt

SEQ ID NO: 7641452 - DNA, 22 bp, Homo sapiens
agactacatatgccacatgaag

SEQ ID NO: 7641453 - DNA, 22 bp, Homo sapiens
agactacaggagaaactcactc

SEQ ID NO: 7641454 - DNA, 22 bp, Homo sapiens
agacggattacctgaggtcagg

SEQ ID NO: 7641455 - DNA, 22 bp, Homo sapiens
agactacatatgccacatgaag

SEQ ID NO: 7641456 - DNA, 22 bp, Homo sapiens
agactcatttgagacgatgatg

SEQ ID NO: 7641457 - DNA, 20 bp, Homo sapiens
agactcagtttctatgctct

SEQ ID NO: 7641458 - DNA, 22 bp, Homo sapiens
agactcaagactgcagaagacg

SEQ ID NO: 7641459 - DNA, 22 bp, Homo sapiens
agactattacctaaaagataca

SEQ ID NO: 7641460 - DNA, 22 bp, Homo sapiens
agactattacctaaaagataca

SEQ ID NO: 7641461 - DNA, 22 bp, Homo sapiens
agactattacctaaaagataca

SEQ ID NO: 7641462 - DNA, 22 bp, Homo sapiens
agactattttgtgataactaat

SEQ ID NO: 7641463 - DNA, 22 bp, Homo sapiens
agactattttgtgataactaat

SEQ ID NO: 7641464 - DNA, 22 bp, Homo sapiens
agactcaagcagataggaatta

SEQ ID NO: 7641465 - DNA, 23 bp, Homo sapiens
agactctgagagtgtgctttgca

SEQ ID NO: 7641466 - DNA, 23 bp, Homo sapiens
agactctgagagtgtgctttgca

SEQ ID NO: 7641467 - DNA, 22 bp, Homo sapiens
agactctgagacatgaaccatc

SEQ ID NO: 7641468 - DNA, 22 bp, Homo sapiens
agactctgaggagccctgagac

SEQ ID NO: 7641469 - DNA, 22 bp, Homo sapiens
agactctgaggagccctgagac

SEQ ID NO: 7641470 - DNA, 22 bp, Homo sapiens
agactctgaggagccctgagac

SEQ ID NO: 7641471 - DNA, 23 bp, Homo sapiens
agactctgagagtgtgctttgca

SEQ ID NO: 7641472 - DNA, 22 bp, Homo sapiens
agactctgataagcaactcttg

SEQ ID NO: 7641473 - DNA, 22 bp, Homo sapiens
atggacaggtggataggtggat

SEQ ID NO: 7641474 - DNA, 22 bp, Homo sapiens
atggacagtactgagtggacta

SEQ ID NO: 7641475 - DNA, 22 bp, Homo sapiens
atggacagtactgagtggacta

SEQ ID NO: 7641476 - DNA, 22 bp, Homo sapiens
atggacagtactgagtggacta

SEQ ID NO: 7641477 - DNA, 22 bp, Homo sapiens
atggacagtactgagtggacta

SEQ ID NO: 7641478 - DNA, 22 bp, Homo sapiens
agactcctgctacataccttcc

SEQ ID NO: 7641479 - DNA, 22 bp, Homo sapiens
agactcctcggaccaatcagcg

SEQ ID NO: 7641480 - DNA, 22 bp, Homo sapiens
agactcctcggaccaatcagcg

SEQ ID NO: 7641481 - DNA, 22 bp, Homo sapiens
agactccaggagggaggctgct

SEQ ID NO: 7641482 - DNA, 22 bp, Homo sapiens
agactccaggagggaggctgct

SEQ ID NO: 7641483 - DNA, 22 bp, Homo sapiens
agactctgaagtcattgcatga

SEQ ID NO: 7641484 - DNA, 22 bp, Homo sapiens
agactctgaagtcattgcatga

SEQ ID NO: 7641485 - DNA, 22 bp, Homo sapiens
agactcctgctacataccttcc

SEQ ID NO: 7641486 - DNA, 22 bp, Homo sapiens
agactctgaaatctaggtgcaa

SEQ ID NO: 7641487 - DNA, 22 bp, Homo sapiens
agacggcacctgggcagcttac

SEQ ID NO: 7641488 - DNA, 22 bp, Homo sapiens
agacggctggcagtgagcggct

SEQ ID NO: 7641489 - DNA, 22 bp, Homo sapiens
agactaaaagaaggaagctacc

SEQ ID NO: 7641490 - DNA, 22 bp, Homo sapiens
agactaaataatgatttactgg

SEQ ID NO: 7641491 - DNA, 22 bp, Homo sapiens
agactaaataatgatttactgg

SEQ ID NO: 7641492 - DNA, 22 bp, Homo sapiens
agacgtcaaatgcagttatcaa

SEQ ID NO: 7641493 - DNA, 22 bp, Homo sapiens
agactaaaagaaggaagctacc

SEQ ID NO: 7641494 - DNA, 22 bp, Homo sapiens
agactaaaagaaggaagctacc

SEQ ID NO: 7641495 - DNA, 22 bp, Homo sapiens
agactaaataatgatttactgg

SEQ ID NO: 7641496 - DNA, 22 bp, Homo sapiens
agactaaataatgatttactgg

SEQ ID NO: 7641497 - DNA, 22 bp, Homo sapiens
agactaaatagttacaggtagg

SEQ ID NO: 7641498 - DNA, 22 bp, Homo sapiens
agactaactttttgctctatca

SEQ ID NO: 7641499 - DNA, 22 bp, Homo sapiens
agactaagcggttcttttcaat

SEQ ID NO: 7641500 - DNA, 22 bp, Homo sapiens
agacggattacctgaggtcagg

SEQ ID NO: 7641501 - DNA, 22 bp, Homo sapiens
agacgcggtggtgcatgcctgt

SEQ ID NO: 7641502 - DNA, 22 bp, Homo sapiens
atggaaatcgatgtctaagtta

SEQ ID NO: 7641503 - DNA, 22 bp, Homo sapiens
atggaaatcgatgtctaagtta

SEQ ID NO: 7641504 - DNA, 22 bp, Homo sapiens
agacgctattttgaggggtcta

SEQ ID NO: 7641505 - DNA, 22 bp, Homo sapiens
agacgctattttgaggggtcta

SEQ ID NO: 7641506 - DNA, 22 bp, Homo sapiens
agacgctattttgaggggtcta

SEQ ID NO: 7641507 - DNA, 23 bp, Homo sapiens
atggaaatagcatgtgtcattta

SEQ ID NO: 7641508 - DNA, 22 bp, Homo sapiens
atggaaatatctttagagctta

SEQ ID NO: 7641509 - DNA, 22 bp, Homo sapiens
atggaaatatctttagagctta

SEQ ID NO: 7641510 - DNA, 22 bp, Homo sapiens
atggaaatatctttagagctta

SEQ ID NO: 7641511 - DNA, 22 bp, Homo sapiens
atggaaatcaggttcatccaag

SEQ ID NO: 7641512 - DNA, 22 bp, Homo sapiens
atggaaatcgatgtctaagtta

SEQ ID NO: 7641513 - DNA, 22 bp, Homo sapiens
atggaaatccaagtcaccgtag

SEQ ID NO: 7641514 - DNA, 22 bp, Homo sapiens
atggaaatccaagtcaccgtag

SEQ ID NO: 7641515 - DNA, 22 bp, Homo sapiens
atggaaatcaggttcatccaag

SEQ ID NO: 7641516 - DNA, 22 bp, Homo sapiens
atggaaatcaggttcatccaag

SEQ ID NO: 7641517 - DNA, 22 bp, Homo sapiens
atggaaatcaggttcatccaag

SEQ ID NO: 7641518 - DNA, 22 bp, Homo sapiens
atgcttgatcttcatagcattt

SEQ ID NO: 7641519 - DNA, 22 bp, Homo sapiens
atgcttggatgctgccatggga

SEQ ID NO: 7641520 - DNA, 22 bp, Homo sapiens
atgcttggatgctgccatggga

SEQ ID NO: 7641521 - DNA, 22 bp, Homo sapiens
atgcttggatgctgccatggga

SEQ ID NO: 7641522 - DNA, 22 bp, Homo sapiens
atgcttgatcttcatagcattt

SEQ ID NO: 7641523 - DNA, 22 bp, Homo sapiens
atgcttgatcttcatagcattt

SEQ ID NO: 7641524 - DNA, 22 bp, Homo sapiens
atgcttgagccagaaacagaaa

SEQ ID NO: 7641525 - DNA, 22 bp, Homo sapiens
atgcttgagccagaaacagaaa

SEQ ID NO: 7641526 - DNA, 22 bp, Homo sapiens
atgcagggttctgggctagaga

SEQ ID NO: 7641527 - DNA, 22 bp, Homo sapiens
atgcagggttctgggctagaga

SEQ ID NO: 7641528 - DNA, 22 bp, Homo sapiens
atgcagggttctgggctagaga

SEQ ID NO: 7641529 - DNA, 23 bp, Homo sapiens
atgcagggttacagggctgactt

SEQ ID NO: 7641530 - DNA, 23 bp, Homo sapiens
atgcagggttacagggctgactt

SEQ ID NO: 7641531 - DNA, 23 bp, Homo sapiens
atgcagggttacagggctgactt

SEQ ID NO: 7641532 - DNA, 22 bp, Homo sapiens
atgcagggtctccgtgtgacga

SEQ ID NO: 7641533 - DNA, 22 bp, Homo sapiens
atgcagggtctccgtgtgacga

SEQ ID NO: 7641534 - DNA, 22 bp, Homo sapiens
atgcaggggcagcagagcctgg

SEQ ID NO: 7641535 - DNA, 22 bp, Homo sapiens
atgcaggggcagcagagcctgg

SEQ ID NO: 7641536 - DNA, 22 bp, Homo sapiens
atgcagggattaaatgactgcc

SEQ ID NO: 7641537 - DNA, 22 bp, Homo sapiens
atgcagggattaaatgactgcc

SEQ ID NO: 7641538 - DNA, 22 bp, Homo sapiens
atgcagggattaaatgactgcc

SEQ ID NO: 7641539 - DNA, 22 bp, Homo sapiens
atgcagggattaaatgactgcc

SEQ ID NO: 7641540 - DNA, 22 bp, Homo sapiens
atgcaggggcagcagagcctgg

SEQ ID NO: 7641541 - DNA, 22 bp, Homo sapiens
atgcaggggcagcagagcctgg

SEQ ID NO: 7641542 - DNA, 22 bp, Homo sapiens
atgcaggggccgcctggccagg

SEQ ID NO: 7641543 - DNA, 22 bp, Homo sapiens
atgcaggggccgcctggccagg

SEQ ID NO: 7641544 - DNA, 22 bp, Homo sapiens
atgcaggggccgcctggccagg

SEQ ID NO: 7641545 - DNA, 22 bp, Homo sapiens
atgcaggggccgcctggccagg

SEQ ID NO: 7641546 - DNA, 22 bp, Homo sapiens
atgcaggggccgcctggccagg

SEQ ID NO: 7641547 - DNA, 22 bp, Homo sapiens
atggaaaagggtctttcatttc

SEQ ID NO: 7641548 - DNA, 22 bp, Homo sapiens
atggaaaagggtctttcatttc

SEQ ID NO: 7641549 - DNA, 22 bp, Homo sapiens
atggaaaagggtctttcatttc

SEQ ID NO: 7641550 - DNA, 22 bp, Homo sapiens
atgcttggcagagttctttttc

SEQ ID NO: 7641551 - DNA, 22 bp, Homo sapiens
atggaaaaggctgatttcatta

SEQ ID NO: 7641552 - DNA, 19 bp, Homo sapiens
atggaaaatgccagactga

SEQ ID NO: 7641553 - DNA, 22 bp, Homo sapiens
atggaaaagggtctttcatttc

SEQ ID NO: 7641554 - DNA, 19 bp, Homo sapiens
atggaaaatgccagactga

SEQ ID NO: 7641555 - DNA, 19 bp, Homo sapiens
atggaaaatgccagactga

SEQ ID NO: 7641556 - DNA, 19 bp, Homo sapiens
atggaaaatgccagactga

SEQ ID NO: 7641557 - DNA, 19 bp, Homo sapiens
atggaaaattgtactcaat

SEQ ID NO: 7641558 - DNA, 19 bp, Homo sapiens
atggaaaattgtactcaat

SEQ ID NO: 7641559 - DNA, 19 bp, Homo sapiens
atggaaaattgtactcaat

SEQ ID NO: 7641560 - DNA, 19 bp, Homo sapiens
atggaaaatgccagactga

SEQ ID NO: 7641561 - DNA, 19 bp, Homo sapiens
atggaaaatgccagactga

SEQ ID NO: 7641562 - DNA, 19 bp, Homo sapiens
atggaaaattgtactcaat

SEQ ID NO: 7641563 - DNA, 19 bp, Homo sapiens
atggaaaattgtactcaat

SEQ ID NO: 7641564 - DNA, 19 bp, Homo sapiens
atggaaaattgtactcaat

SEQ ID NO: 7641565 - DNA, 19 bp, Homo sapiens
atggaaaattgtactcaat

SEQ ID NO: 7641566 - DNA, 19 bp, Homo sapiens
atggaaaattgtactcaat

SEQ ID NO: 7641567 - DNA, 23 bp, Homo sapiens
atggaaatagcatgtgtcattta

SEQ ID NO: 7641568 - DNA, 22 bp, Homo sapiens
atggaaatacagccagagcaga

SEQ ID NO: 7641569 - DNA, 22 bp, Homo sapiens
atggaaatacacaagaggtttc

SEQ ID NO: 7641570 - DNA, 22 bp, Homo sapiens
atggaaagccagtgttccatca

SEQ ID NO: 7641571 - DNA, 22 bp, Homo sapiens
atggaaagctaagccatttacc

SEQ ID NO: 7641572 - DNA, 22 bp, Homo sapiens
atggaaaggctgtggaaactta

SEQ ID NO: 7641573 - DNA, 22 bp, Homo sapiens
atggaaagggaagcaaggaaca

SEQ ID NO: 7641574 - DNA, 22 bp, Homo sapiens
atggagttctgccagcgctgct

SEQ ID NO: 7641575 - DNA, 22 bp, Homo sapiens
atggagttctgccagcgctgct

SEQ ID NO: 7641576 - DNA, 22 bp, Homo sapiens
atggagttctgccagcgctgct

SEQ ID NO: 7641577 - DNA, 22 bp, Homo sapiens
atggagttctgccagcgctgct

SEQ ID NO: 7641578 - DNA, 22 bp, Homo sapiens
atggagttctgccagcgctgct

SEQ ID NO: 7641579 - DNA, 22 bp, Homo sapiens
atggagttctgccagcgctgct

SEQ ID NO: 7641580 - DNA, 22 bp, Homo sapiens
atggagtgtcaccttcctggtt

SEQ ID NO: 7641581 - DNA, 22 bp, Homo sapiens
atggagtgtcaccttcctggtt

SEQ ID NO: 7641582 - DNA, 22 bp, Homo sapiens
atggagtggtacttacttggct

SEQ ID NO: 7641583 - DNA, 22 bp, Homo sapiens
atggagtggtacttacttggct

SEQ ID NO: 7641584 - DNA, 22 bp, Homo sapiens
atggagtgtcaccttcctggtt

SEQ ID NO: 7641585 - DNA, 22 bp, Homo sapiens
atggagtgtcaccttcctggtt

SEQ ID NO: 7641586 - DNA, 22 bp, Homo sapiens
atggagtgtcaccttcctggtt

SEQ ID NO: 7641587 - DNA, 22 bp, Homo sapiens
atggagtgtggccaggcagtaa

SEQ ID NO: 7641588 - DNA, 22 bp, Homo sapiens
atggagtgtggccaggcagtaa

SEQ ID NO: 7641589 - DNA, 22 bp, Homo sapiens
atggagtgctgttgatcaaggt

SEQ ID NO: 7641590 - DNA, 22 bp, Homo sapiens
atggagtgctgttgatcaaggt

SEQ ID NO: 7641591 - DNA, 22 bp, Homo sapiens
atggagtgctgttgatcaaggt

SEQ ID NO: 7641592 - DNA, 22 bp, Homo sapiens
atggagtgctgttgatcaaggt

SEQ ID NO: 7641593 - DNA, 22 bp, Homo sapiens
atggagtgcctgtggcagtggg

SEQ ID NO: 7641594 - DNA, 22 bp, Homo sapiens
atggagtgcctgtggcagtggg

SEQ ID NO: 7641595 - DNA, 22 bp, Homo sapiens
atggagtgggccaattttagtg

SEQ ID NO: 7641596 - DNA, 22 bp, Homo sapiens
atggagtggggactgcagtgga

SEQ ID NO: 7641597 - DNA, 22 bp, Homo sapiens
atggagtggggactgcagtgga

SEQ ID NO: 7641598 - DNA, 22 bp, Homo sapiens
atggagtggggactgcagtgga

SEQ ID NO: 7641599 - DNA, 22 bp, Homo sapiens
atggacagtgctgcttcagagg

SEQ ID NO: 7641600 - DNA, 22 bp, Homo sapiens
atggacagtgctgcttcagagg

SEQ ID NO: 7641601 - DNA, 22 bp, Homo sapiens
atggacagtgtgaagcagatag

SEQ ID NO: 7641602 - DNA, 22 bp, Homo sapiens
atggacagtgtgaagcagatag

SEQ ID NO: 7641603 - DNA, 22 bp, Homo sapiens
atggacagtactgagtggacta

SEQ ID NO: 7641604 - DNA, 22 bp, Homo sapiens
atggacagtactgagtggacta

SEQ ID NO: 7641605 - DNA, 22 bp, Homo sapiens
atggaggtgccaggtgtgaggg

SEQ ID NO: 7641606 - DNA, 22 bp, Homo sapiens
atggaggtgccaggtgtgaggg

SEQ ID NO: 7641607 - DNA, 22 bp, Homo sapiens
atggaggtgccaggtgtgaggg

SEQ ID NO: 7641608 - DNA, 22 bp, Homo sapiens
atggaggtggaagaatgagtta

SEQ ID NO: 7641609 - DNA, 22 bp, Homo sapiens
atggaggtgatgttaatgatgc

SEQ ID NO: 7641610 - DNA, 19 bp, Homo sapiens
atggaggtctttatatctt

SEQ ID NO: 7641611 - DNA, 22 bp, Homo sapiens
atggagtgcctgtggcagtggg

SEQ ID NO: 7641612 - DNA, 22 bp, Homo sapiens
atggagtgcctgtggcagtggg

SEQ ID NO: 7641613 - DNA, 22 bp, Homo sapiens
atggagtctacaaagtgttgga

SEQ ID NO: 7641614 - DNA, 20 bp, Homo sapiens
atggagtgaagagtgaaagc

SEQ ID NO: 7641615 - DNA, 21 bp, Homo sapiens
atggagtcaggggaatgggcc

SEQ ID NO: 7641616 - DNA, 21 bp, Homo sapiens
atggagtcaggggaatgggcc

SEQ ID NO: 7641617 - DNA, 22 bp, Homo sapiens
atggagtctacaaagtgttgga

SEQ ID NO: 7641618 - DNA, 20 bp, Homo sapiens
atggaggtggatgtgactgc

SEQ ID NO: 7641619 - DNA, 20 bp, Homo sapiens
atggaggtggatgtgactgc

SEQ ID NO: 7641620 - DNA, 22 bp, Homo sapiens
atggaggtggaagaatgagtta

SEQ ID NO: 7641621 - DNA, 22 bp, Homo sapiens
atggaggtggaagaatgagtta

SEQ ID NO: 7641622 - DNA, 22 bp, Homo sapiens
atggaggtgtttgataatttgg

SEQ ID NO: 7641623 - DNA, 22 bp, Homo sapiens
atggagtacagggaaatatgat

SEQ ID NO: 7641624 - DNA, 22 bp, Homo sapiens
atggagtacttttttggattag

SEQ ID NO: 7641625 - DNA, 22 bp, Homo sapiens
atggcagcaaagaggccttctt

SEQ ID NO: 7641626 - DNA, 22 bp, Homo sapiens
atggcagcaaagaggccttctt

SEQ ID NO: 7641627 - DNA, 22 bp, Homo sapiens
atggcagcaaatgtctggctgg

SEQ ID NO: 7641628 - DNA, 22 bp, Homo sapiens
atggcagatggctggagcaggt

SEQ ID NO: 7641629 - DNA, 22 bp, Homo sapiens
atggcagatggctggagcaggt

SEQ ID NO: 7641630 - DNA, 22 bp, Homo sapiens
atggcagatggctggagcaggt

SEQ ID NO: 7641631 - DNA, 22 bp, Homo sapiens
atggcagatggctggagcaggt

SEQ ID NO: 7641632 - DNA, 22 bp, Homo sapiens
atggcagatggctggagcaggt

SEQ ID NO: 7641633 - DNA, 22 bp, Homo sapiens
atggcagatggctggagcaggt

SEQ ID NO: 7641634 - DNA, 18 bp, Homo sapiens
atggcagatgataagtgc

SEQ ID NO: 7641635 - DNA, 22 bp, Homo sapiens
atggcagatccacagtttgaag

SEQ ID NO: 7641636 - DNA, 22 bp, Homo sapiens
atggcagagggattgaacagct

SEQ ID NO: 7641637 - DNA, 22 bp, Homo sapiens
atggcagagtcctaagccttta

SEQ ID NO: 7641638 - DNA, 22 bp, Homo sapiens
atggataagtcaaagagtatcc

SEQ ID NO: 7641639 - DNA, 22 bp, Homo sapiens
atggataagtcaaagagtatcc

SEQ ID NO: 7641640 - DNA, 22 bp, Homo sapiens
atggataacccagttcatttct

SEQ ID NO: 7641641 - DNA, 22 bp, Homo sapiens
atggataagaacaaatatctga

SEQ ID NO: 7641642 - DNA, 22 bp, Homo sapiens
atggataagaacaaatatctga

SEQ ID NO: 7641643 - DNA, 22 bp, Homo sapiens
atggataagaacaaatatctga

SEQ ID NO: 7641644 - DNA, 22 bp, Homo sapiens
atggataagtcaaagagtatcc

SEQ ID NO: 7641645 - DNA, 22 bp, Homo sapiens
atggataatggtgatagttgca

SEQ ID NO: 7641646 - DNA, 22 bp, Homo sapiens
atggataatcatgaactttgag

SEQ ID NO: 7641647 - DNA, 22 bp, Homo sapiens
atggataatcatgaactttgag

SEQ ID NO: 7641648 - DNA, 22 bp, Homo sapiens
atggagtttggggtcaaatact

SEQ ID NO: 7641649 - DNA, 22 bp, Homo sapiens
atggataacccagttcatttct

SEQ ID NO: 7641650 - DNA, 22 bp, Homo sapiens
atggagtttggggtcaaatact

SEQ ID NO: 7641651 - DNA, 22 bp, Homo sapiens
atggataaatacttggtggtat

SEQ ID NO: 7641652 - DNA, 22 bp, Homo sapiens
atggagttctgccagcgctgct

SEQ ID NO: 7641653 - DNA, 22 bp, Homo sapiens
atggagttctgccagcgctgct

SEQ ID NO: 7641654 - DNA, 22 bp, Homo sapiens
atggcagcagtccattgcctca

SEQ ID NO: 7641655 - DNA, 22 bp, Homo sapiens
atggcagcagtccattgcctca

SEQ ID NO: 7641656 - DNA, 22 bp, Homo sapiens
atggcagcagggcttgattatg

SEQ ID NO: 7641657 - DNA, 22 bp, Homo sapiens
atggcagcagggcttgattatg

SEQ ID NO: 7641658 - DNA, 22 bp, Homo sapiens
atggcagcagctttagctgtgg

SEQ ID NO: 7641659 - DNA, 22 bp, Homo sapiens
atggcagcagctttagctgtgg

SEQ ID NO: 7641660 - DNA, 22 bp, Homo sapiens
atggcagcagctttagctgtgg

SEQ ID NO: 7641661 - DNA, 19 bp, Homo sapiens
atggcagcagcagctctcc

SEQ ID NO: 7641662 - DNA, 22 bp, Homo sapiens
atggcagcaaatgtctggctgg

SEQ ID NO: 7641663 - DNA, 22 bp, Homo sapiens
atggcagcaaatgtctggctgg

SEQ ID NO: 7641664 - DNA, 19 bp, Homo sapiens
atggcagcagcagctctcc

SEQ ID NO: 7641665 - DNA, 19 bp, Homo sapiens
atggcagcagcagctctcc

SEQ ID NO: 7641666 - DNA, 22 bp, Homo sapiens
atggcagcatgggattggtaga

SEQ ID NO: 7641667 - DNA, 22 bp, Homo sapiens
atggcagcatgggattggtaga

SEQ ID NO: 7641668 - DNA, 22 bp, Homo sapiens
atggcagcatgggattggtaga

SEQ ID NO: 7641669 - DNA, 22 bp, Homo sapiens
atggcagcatgggattggtaga

SEQ ID NO: 7641670 - DNA, 22 bp, Homo sapiens
atggcagcatgggattggtaga

SEQ ID NO: 7641671 - DNA, 22 bp, Homo sapiens
atggcagcatagtggcaagtta

SEQ ID NO: 7641672 - DNA, 22 bp, Homo sapiens
atggcagcatagtggcaagtta

SEQ ID NO: 7641673 - DNA, 22 bp, Homo sapiens
atggcagcagtttggagtcttt

SEQ ID NO: 7641674 - DNA, 22 bp, Homo sapiens
atggcagcagtttggagtcttt

SEQ ID NO: 7641675 - DNA, 22 bp, Homo sapiens
atggcagcagtttggagtcttt

SEQ ID NO: 7641676 - DNA, 22 bp, Homo sapiens
atggcagcagtttggagtcttt

SEQ ID NO: 7641677 - DNA, 22 bp, Homo sapiens
atggcagcatagtggcaagtta

SEQ ID NO: 7641678 - DNA, 22 bp, Homo sapiens
atggcagcatagtggcaagtta

SEQ ID NO: 7641679 - DNA, 22 bp, Homo sapiens
atggcagcatagtggcaagtta

SEQ ID NO: 7641680 - DNA, 22 bp, Homo sapiens
atggcagccagtgttggaggaa

SEQ ID NO: 7641681 - DNA, 22 bp, Homo sapiens
atggcagccagtgttggaggaa

SEQ ID NO: 7641682 - DNA, 22 bp, Homo sapiens
atggcagccagtgttggaggaa

SEQ ID NO: 7641683 - DNA, 22 bp, Homo sapiens
atggcagcatgggattggtaga

SEQ ID NO: 7641684 - DNA, 22 bp, Homo sapiens
atggcagcccacgatggcaatg

SEQ ID NO: 7641685 - DNA, 22 bp, Homo sapiens
atggcagcccacgatggcaatg

SEQ ID NO: 7641686 - DNA, 22 bp, Homo sapiens
atggcagccagtgttggaggaa

SEQ ID NO: 7641687 - DNA, 22 bp, Homo sapiens
atggcagccagtgttggaggaa

SEQ ID NO: 7641688 - DNA, 22 bp, Homo sapiens
atggcagcctgagcagaggaat

SEQ ID NO: 7641689 - DNA, 22 bp, Homo sapiens
atggctcagcgcctttctgtgg

SEQ ID NO: 7641690 - DNA, 22 bp, Homo sapiens
atggctcagcgcctttctgtgg

SEQ ID NO: 7641691 - DNA, 22 bp, Homo sapiens
atggcagcctgaacacttcctg

SEQ ID NO: 7641692 - DNA, 18 bp, Homo sapiens
atggctcaggaatggctt

SEQ ID NO: 7641693 - DNA, 18 bp, Homo sapiens
atggctcaggaatggctt

SEQ ID NO: 7641694 - DNA, 21 bp, Homo sapiens
atggctcaggccatcaatgga

SEQ ID NO: 7641695 - DNA, 22 bp, Homo sapiens
atggctggctgagcctggttat

SEQ ID NO: 7641696 - DNA, 22 bp, Homo sapiens
atggctggtgatactggagtga

SEQ ID NO: 7641697 - DNA, 21 bp, Homo sapiens
atggctggtggctcagcctcc

SEQ ID NO: 7641698 - DNA, 22 bp, Homo sapiens
atggctggtgatactggagtga

SEQ ID NO: 7641699 - DNA, 21 bp, Homo sapiens
atggctggtggctcagcctcc

SEQ ID NO: 7641700 - DNA, 22 bp, Homo sapiens
atggctgggtcaccatcagggt

SEQ ID NO: 7641701 - DNA, 22 bp, Homo sapiens
atggctgggttcttctataggt

SEQ ID NO: 7641702 - DNA, 22 bp, Homo sapiens
atggctggtgatactggagtga

SEQ ID NO: 7641703 - DNA, 22 bp, Homo sapiens
atggctggtctcccatggaaaa

SEQ ID NO: 7641704 - DNA, 22 bp, Homo sapiens
atggctgggatggggtagagaa

SEQ ID NO: 7641705 - DNA, 22 bp, Homo sapiens
atggctgggatttcctttgcgt

SEQ ID NO: 7641706 - DNA, 22 bp, Homo sapiens
atggctgggatggggtagagaa

SEQ ID NO: 7641707 - DNA, 22 bp, Homo sapiens
atggctgggatggggtagagaa

SEQ ID NO: 7641708 - DNA, 22 bp, Homo sapiens
atggctgggaggagagtatgat

SEQ ID NO: 7641709 - DNA, 22 bp, Homo sapiens
atggctgggatttcctttgcgt

SEQ ID NO: 7641710 - DNA, 22 bp, Homo sapiens
atggctgggcttttagtcagat

SEQ ID NO: 7641711 - DNA, 22 bp, Homo sapiens
atggctgggcttttagtcagat

SEQ ID NO: 7641712 - DNA, 22 bp, Homo sapiens
atggctgggtcaccatcagggt

SEQ ID NO: 7641713 - DNA, 22 bp, Homo sapiens
atggctgggtcaccatcagggt

SEQ ID NO: 7641714 - DNA, 22 bp, Homo sapiens
atggctgggtcaccatcagggt

SEQ ID NO: 7641715 - DNA, 22 bp, Homo sapiens
atggctgggcttttagtcagat

SEQ ID NO: 7641716 - DNA, 22 bp, Homo sapiens
atggctgggtcaccatcagggt

SEQ ID NO: 7641717 - DNA, 22 bp, Homo sapiens
atgtaaacttagataagcagta

SEQ ID NO: 7641718 - DNA, 23 bp, Homo sapiens
atgtaaacttcagagtcattgcc

SEQ ID NO: 7641719 - DNA, 22 bp, Homo sapiens
atgtaaaggcagactttaattt

SEQ ID NO: 7641720 - DNA, 22 bp, Homo sapiens
atgtaaactttaccagctctga

SEQ ID NO: 7641721 - DNA, 22 bp, Homo sapiens
atgtaaagtaatctgtcgatca

SEQ ID NO: 7641722 - DNA, 22 bp, Homo sapiens
atgtaaagggcatggtattggg

SEQ ID NO: 7641723 - DNA, 22 bp, Homo sapiens
atgtaaaggcagactttaattt

SEQ ID NO: 7641724 - DNA, 22 bp, Homo sapiens
atgtacacacaagtttgcacgc

SEQ ID NO: 7641725 - DNA, 22 bp, Homo sapiens
atgtacacacaagtttgcacgc

SEQ ID NO: 7641726 - DNA, 22 bp, Homo sapiens
atgtacaatttttgcttagggg

SEQ ID NO: 7641727 - DNA, 22 bp, Homo sapiens
atgtacacacacatctttgcgt

SEQ ID NO: 7641728 - DNA, 22 bp, Homo sapiens
atgtacacatacagtggagtgg

SEQ ID NO: 7641729 - DNA, 22 bp, Homo sapiens
atgtacacatacagtggagtgg

SEQ ID NO: 7641730 - DNA, 22 bp, Homo sapiens
atgtacacatgcatgcatgtgc

SEQ ID NO: 7641731 - DNA, 22 bp, Homo sapiens
atgtacacatgcatgcatgtgc

SEQ ID NO: 7641732 - DNA, 22 bp, Homo sapiens
atgtacacatgcatgcatgtgc

SEQ ID NO: 7641733 - DNA, 22 bp, Homo sapiens
atgtacactttggaagagtcac

SEQ ID NO: 7641734 - DNA, 22 bp, Homo sapiens
atgtacactttggaagagtcac

SEQ ID NO: 7641735 - DNA, 22 bp, Homo sapiens
atgtacaccaggtgaagatgaa

SEQ ID NO: 7641736 - DNA, 22 bp, Homo sapiens
atgtacaccaggtgaagatgaa

SEQ ID NO: 7641737 - DNA, 22 bp, Homo sapiens
atgtaaacactcactgtgcccc

SEQ ID NO: 7641738 - DNA, 22 bp, Homo sapiens
atgtaaacaaagatcttcctgc

SEQ ID NO: 7641739 - DNA, 20 bp, Homo sapiens
atgtaaaattataaggctga

SEQ ID NO: 7641740 - DNA, 20 bp, Homo sapiens
atgtaaaattataaggctga

SEQ ID NO: 7641741 - DNA, 20 bp, Homo sapiens
atgtaaaattataaggctga

SEQ ID NO: 7641742 - DNA, 20 bp, Homo sapiens
atgtaaaattataaggctga

SEQ ID NO: 7641743 - DNA, 20 bp, Homo sapiens
atgtaaaattataaggctga

SEQ ID NO: 7641744 - DNA, 22 bp, Homo sapiens
atgtaaaagattattttcctgt

SEQ ID NO: 7641745 - DNA, 22 bp, Homo sapiens
atgtaaaagattattttcctgt

SEQ ID NO: 7641746 - DNA, 22 bp, Homo sapiens
atgtaaaagattattttcctgt

SEQ ID NO: 7641747 - DNA, 22 bp, Homo sapiens
atgtaaaagattattttcctgt

SEQ ID NO: 7641748 - DNA, 20 bp, Homo sapiens
atgtaaaagacagggagtag

SEQ ID NO: 7641749 - DNA, 22 bp, Homo sapiens
atgtaaaagattattttcctgt

SEQ ID NO: 7641750 - DNA, 22 bp, Homo sapiens
atgtaaaagattattttcctgt

SEQ ID NO: 7641751 - DNA, 20 bp, Homo sapiens
atgtaaaattataaggctga

SEQ ID NO: 7641752 - DNA, 20 bp, Homo sapiens
atgtaaaattataaggctga

SEQ ID NO: 7641753 - DNA, 20 bp, Homo sapiens
atgtaaaattataaggctga

SEQ ID NO: 7641754 - DNA, 22 bp, Homo sapiens
atgtaaaagattattttcctgt

SEQ ID NO: 7641755 - DNA, 22 bp, Homo sapiens
atggtttgtgtggcccagatga

SEQ ID NO: 7641756 - DNA, 22 bp, Homo sapiens
atggtttgtgtggcccagatga

SEQ ID NO: 7641757 - DNA, 22 bp, Homo sapiens
atggttttagaatcaggaaaaa

SEQ ID NO: 7641758 - DNA, 22 bp, Homo sapiens
atggttttcctctgctgcttaa

SEQ ID NO: 7641759 - DNA, 22 bp, Homo sapiens
atggttttatttctctatagct

SEQ ID NO: 7641760 - DNA, 22 bp, Homo sapiens
atggttttgtcctctttggttc

SEQ ID NO: 7641761 - DNA, 22 bp, Homo sapiens
atggttttgtcctctttggttc

SEQ ID NO: 7641762 - DNA, 20 bp, Homo sapiens
atgtaaaagacagggagtag

SEQ ID NO: 7641763 - DNA, 20 bp, Homo sapiens
atgtaaaagacagggagtag

SEQ ID NO: 7641764 - DNA, 20 bp, Homo sapiens
atgtaaaagacagggagtag

SEQ ID NO: 7641765 - DNA, 20 bp, Homo sapiens
atgtaaaagacagggagtag

SEQ ID NO: 7641766 - DNA, 22 bp, Homo sapiens
atgggtgtgaaaatggtcatct

SEQ ID NO: 7641767 - DNA, 22 bp, Homo sapiens
atggtttacagaactcctagca

SEQ ID NO: 7641768 - DNA, 22 bp, Homo sapiens
atggtttacttcatccaatcta

SEQ ID NO: 7641769 - DNA, 22 bp, Homo sapiens
atgggtggccccgtgtgcagtc

SEQ ID NO: 7641770 - DNA, 22 bp, Homo sapiens
atgggtggagggtgacacggat

SEQ ID NO: 7641771 - DNA, 22 bp, Homo sapiens
atgggtggccccgtgtgcagtc

SEQ ID NO: 7641772 - DNA, 22 bp, Homo sapiens
atgggtggccccgtgtgcagtc

SEQ ID NO: 7641773 - DNA, 22 bp, Homo sapiens
atgggtggccccgtgtgcagtc

SEQ ID NO: 7641774 - DNA, 22 bp, Homo sapiens
atgggtggccccgtgtgcagtc

SEQ ID NO: 7641775 - DNA, 22 bp, Homo sapiens
atgggtggccccgtgtgcagtc

SEQ ID NO: 7641776 - DNA, 22 bp, Homo sapiens
atggtttatcctttaccagtcg

SEQ ID NO: 7641777 - DNA, 22 bp, Homo sapiens
atggtttatcctttaccagtcg

SEQ ID NO: 7641778 - DNA, 22 bp, Homo sapiens
atggtttatcctttaccagtcg

SEQ ID NO: 7641779 - DNA, 23 bp, Homo sapiens
atggtttatgtcacacttttgat

SEQ ID NO: 7641780 - DNA, 23 bp, Homo sapiens
atggtttatgttgttgtgaagca

SEQ ID NO: 7641781 - DNA, 22 bp, Homo sapiens
atggtttattagctgcacaggc

SEQ ID NO: 7641782 - DNA, 22 bp, Homo sapiens
atggtttattagctgcacaggc

SEQ ID NO: 7641783 - DNA, 22 bp, Homo sapiens
atggtttattgctttaatgaaa

SEQ ID NO: 7641784 - DNA, 22 bp, Homo sapiens
atggtttcacaaacaaaaggtt

SEQ ID NO: 7641785 - DNA, 22 bp, Homo sapiens
atggtttgtaacccaatactcc

SEQ ID NO: 7641786 - DNA, 22 bp, Homo sapiens
atggctgtgttgttcctctgaa

SEQ ID NO: 7641787 - DNA, 22 bp, Homo sapiens
atggctgtgttgttcctctgaa

SEQ ID NO: 7641788 - DNA, 22 bp, Homo sapiens
atggctgtgttgttcctctgaa

SEQ ID NO: 7641789 - DNA, 22 bp, Homo sapiens
atgggaggaaggaggcccttga

SEQ ID NO: 7641790 - DNA, 22 bp, Homo sapiens
atgggaggaagagaagatgtct

SEQ ID NO: 7641791 - DNA, 22 bp, Homo sapiens
atgggaggaaggaggcccttga

SEQ ID NO: 7641792 - DNA, 22 bp, Homo sapiens
atgggaggaaggaggcccttga

SEQ ID NO: 7641793 - DNA, 22 bp, Homo sapiens
atgggaggatcacttgaggcca

SEQ ID NO: 7641794 - DNA, 22 bp, Homo sapiens
atgggaggatcacttgaggcca

SEQ ID NO: 7641795 - DNA, 22 bp, Homo sapiens
atgggaggatcacttgaggcca

SEQ ID NO: 7641796 - DNA, 22 bp, Homo sapiens
atgggaggatcacttgaggcca

SEQ ID NO: 7641797 - DNA, 22 bp, Homo sapiens
atgggaggaaggaggcccttga

SEQ ID NO: 7641798 - DNA, 22 bp, Homo sapiens
atgggaggatcacttgaggcca

SEQ ID NO: 7641799 - DNA, 22 bp, Homo sapiens
atgggaggatcacttgaggcca

SEQ ID NO: 7641800 - DNA, 22 bp, Homo sapiens
atgggaggatcacttgaggcca

SEQ ID NO: 7641801 - DNA, 22 bp, Homo sapiens
atggctgtgaaatggtaggtgg

SEQ ID NO: 7641802 - DNA, 22 bp, Homo sapiens
atggctgtgaaggtcacaccct

SEQ ID NO: 7641803 - DNA, 22 bp, Homo sapiens
atggctgtgagcaggcagcttc

SEQ ID NO: 7641804 - DNA, 22 bp, Homo sapiens
atggctgtgagcaggcagcttc

SEQ ID NO: 7641805 - DNA, 19 bp, Homo sapiens
atggctgtgttccagtaaa

SEQ ID NO: 7641806 - DNA, 22 bp, Homo sapiens
atggctgtgtgactgagttcta

SEQ ID NO: 7641807 - DNA, 22 bp, Homo sapiens
atggctgtggtatcagacgcag

SEQ ID NO: 7641808 - DNA, 22 bp, Homo sapiens
atggctgtgcagagattgggaa

SEQ ID NO: 7641809 - DNA, 22 bp, Homo sapiens
atggctgtcacgccactgtgag

SEQ ID NO: 7641810 - DNA, 22 bp, Homo sapiens
atggctgtcacgccactgtgag

SEQ ID NO: 7641811 - DNA, 22 bp, Homo sapiens
atggctgtccagtttctagaga

SEQ ID NO: 7641812 - DNA, 22 bp, Homo sapiens
atggctgtccagtttctagaga

SEQ ID NO: 7641813 - DNA, 22 bp, Homo sapiens
atggctgtccagtttctagaga

SEQ ID NO: 7641814 - DNA, 22 bp, Homo sapiens
atggctgtagtcatctgaaggc

SEQ ID NO: 7641815 - DNA, 22 bp, Homo sapiens
atggctgtaaattcagagatgg

SEQ ID NO: 7641816 - DNA, 22 bp, Homo sapiens
atgggaggcagcagagcccagc

SEQ ID NO: 7641817 - DNA, 22 bp, Homo sapiens
atgggaggcaggctcagaaccg

SEQ ID NO: 7641818 - DNA, 22 bp, Homo sapiens
atgggaggcagcagagcccagc

SEQ ID NO: 7641819 - DNA, 22 bp, Homo sapiens
atgggaggcagcagagcccagc

SEQ ID NO: 7641820 - DNA, 22 bp, Homo sapiens
atgggaggcaggctcagaaccg

SEQ ID NO: 7641821 - DNA, 22 bp, Homo sapiens
atgggaggcaggctcagaaccg

SEQ ID NO: 7641822 - DNA, 22 bp, Homo sapiens
atgggaggcaggctcagaaccg

SEQ ID NO: 7641823 - DNA, 22 bp, Homo sapiens
atgggtggagggtgacacggat

SEQ ID NO: 7641824 - DNA, 22 bp, Homo sapiens
atgggaggcaggctcagaaccg

SEQ ID NO: 7641825 - DNA, 22 bp, Homo sapiens
atgggaggcagcagagcccagc

SEQ ID NO: 7641826 - DNA, 22 bp, Homo sapiens
atgggaggcagcagagcccagc

SEQ ID NO: 7641827 - DNA, 22 bp, Homo sapiens
atgggaggcagcagagcccagc

SEQ ID NO: 7641828 - DNA, 22 bp, Homo sapiens
atgggaggcagcagagcccagc

SEQ ID NO: 7641829 - DNA, 22 bp, Homo sapiens
atgggaggcagacactaagttc

SEQ ID NO: 7641830 - DNA, 22 bp, Homo sapiens
atgggaggcagacactaagttc

SEQ ID NO: 7641831 - DNA, 22 bp, Homo sapiens
atgggaggcagacactaagttc

SEQ ID NO: 7641832 - DNA, 22 bp, Homo sapiens
atgggaggatgctcgggtgctc

SEQ ID NO: 7641833 - DNA, 22 bp, Homo sapiens
atgggaggatcacttgaggcca

SEQ ID NO: 7641834 - DNA, 22 bp, Homo sapiens
atgggaggatgctcgggtgctc

SEQ ID NO: 7641835 - DNA, 22 bp, Homo sapiens
atgggaggatgctcgggtgctc

SEQ ID NO: 7641836 - DNA, 22 bp, Homo sapiens
atgggaggatgctcgggtgctc

SEQ ID NO: 7641837 - DNA, 22 bp, Homo sapiens
atgggaggatgctcgggtgctc

SEQ ID NO: 7641838 - DNA, 22 bp, Homo sapiens
atgggaggatgctcgggtgctc

SEQ ID NO: 7641839 - DNA, 22 bp, Homo sapiens
atgggaggcagacactaagttc

SEQ ID NO: 7641840 - DNA, 22 bp, Homo sapiens
atgggaggcagacactaagttc

SEQ ID NO: 7641841 - DNA, 22 bp, Homo sapiens
atgggaggcaaagatcgcagaa

SEQ ID NO: 7641842 - DNA, 22 bp, Homo sapiens
atgggaggcaaagatcgcagaa

SEQ ID NO: 7641843 - DNA, 22 bp, Homo sapiens
atgggaggcaaagatcgcagaa

SEQ ID NO: 7641844 - DNA, 22 bp, Homo sapiens
atgggaggcaaagatcgcagaa

SEQ ID NO: 7641845 - DNA, 22 bp, Homo sapiens
atgggaggcaaagatcgcagaa

SEQ ID NO: 7641846 - DNA, 22 bp, Homo sapiens
atgggaggcaaagatcgcagaa

SEQ ID NO: 7641847 - DNA, 22 bp, Homo sapiens
atgggaggcaaagatcgcagaa

SEQ ID NO: 7641848 - DNA, 22 bp, Homo sapiens
atgggaggcaaagatcgcagaa

SEQ ID NO: 7641849 - DNA, 22 bp, Homo sapiens
atgggaggcaaagatcgcagaa

SEQ ID NO: 7641850 - DNA, 22 bp, Homo sapiens
atgtacatactgcattttcaaa

SEQ ID NO: 7641851 - DNA, 22 bp, Homo sapiens
atgtcaaatcagttttatcaga

SEQ ID NO: 7641852 - DNA, 22 bp, Homo sapiens
atgtacatactgcattttcaaa

SEQ ID NO: 7641853 - DNA, 22 bp, Homo sapiens
atgtcaaatcagttttatcaga

SEQ ID NO: 7641854 - DNA, 22 bp, Homo sapiens
atgtcaaatcagttttatcaga

SEQ ID NO: 7641855 - DNA, 21 bp, Homo sapiens
atgtcaaatgctttattttat

SEQ ID NO: 7641856 - DNA, 23 bp, Homo sapiens
atgtccaaagggattcgtctgat

SEQ ID NO: 7641857 - DNA, 21 bp, Homo sapiens
atgtcaaatgctttattttat

SEQ ID NO: 7641858 - DNA, 22 bp, Homo sapiens
atgtcaaatgctgcaaactcat

SEQ ID NO: 7641859 - DNA, 22 bp, Homo sapiens
atgtcaaatgctgcaaactcat

SEQ ID NO: 7641860 - DNA, 22 bp, Homo sapiens
atgtccaatttcagagtctcat

SEQ ID NO: 7641861 - DNA, 22 bp, Homo sapiens
atgtccaagtcacagattttca

SEQ ID NO: 7641862 - DNA, 21 bp, Homo sapiens
atgtcaaatgctttattttat

SEQ ID NO: 7641863 - DNA, 21 bp, Homo sapiens
atgtcaaatgctttattttat

SEQ ID NO: 7641864 - DNA, 22 bp, Homo sapiens
atgtccaatttctgaggctgct

SEQ ID NO: 7641865 - DNA, 22 bp, Homo sapiens
atgtccagaagggtcccctgtt

SEQ ID NO: 7641866 - DNA, 22 bp, Homo sapiens
atgtccagaagggtcccctgtt

SEQ ID NO: 7641867 - DNA, 22 bp, Homo sapiens
atgtccaatagaagggagaagc

SEQ ID NO: 7641868 - DNA, 22 bp, Homo sapiens
atgtccagagaacatttgcttt

SEQ ID NO: 7641869 - DNA, 22 bp, Homo sapiens
atgtccagaagggtcccctgtt

SEQ ID NO: 7641870 - DNA, 22 bp, Homo sapiens
atgtccagaagggtcccctgtt

SEQ ID NO: 7641871 - DNA, 22 bp, Homo sapiens
atgtccagccaaccactggatt

SEQ ID NO: 7641872 - DNA, 22 bp, Homo sapiens
atgtccagctcatgatactatc

SEQ ID NO: 7641873 - DNA, 22 bp, Homo sapiens
atgtccagccaaccactggatt

SEQ ID NO: 7641874 - DNA, 22 bp, Homo sapiens
atgtccagcatgacacattctc

SEQ ID NO: 7641875 - DNA, 22 bp, Homo sapiens
atgtccagccaaccactggatt

SEQ ID NO: 7641876 - DNA, 22 bp, Homo sapiens
atgtccagccaaccactggatt

SEQ ID NO: 7641877 - DNA, 22 bp, Homo sapiens
atgtccagagtaaagcacattc

SEQ ID NO: 7641878 - DNA, 22 bp, Homo sapiens
atgtccagagtaaagcacattc

SEQ ID NO: 7641879 - DNA, 22 bp, Homo sapiens
atgtccagagtaaagcacattc

SEQ ID NO: 7641880 - DNA, 22 bp, Homo sapiens
atgtccagagtaaagcacattc

SEQ ID NO: 7641881 - DNA, 22 bp, Homo sapiens
atgtccagagtgtcctggaaag

SEQ ID NO: 7641882 - DNA, 22 bp, Homo sapiens
atgtccagagtgtcctggaaag

SEQ ID NO: 7641883 - DNA, 22 bp, Homo sapiens
atgtccagcatgacacattctc

SEQ ID NO: 7641884 - DNA, 22 bp, Homo sapiens
atgtccagaggtgagtcagagc

SEQ ID NO: 7641885 - DNA, 22 bp, Homo sapiens
atgtccagagtaaagcacattc

SEQ ID NO: 7641886 - DNA, 22 bp, Homo sapiens
atgtccagaggtgagtcagagc

SEQ ID NO: 7641887 - DNA, 22 bp, Homo sapiens
atgtccagagggttttattttg

SEQ ID NO: 7641888 - DNA, 22 bp, Homo sapiens
atgtccagagaacatttgcttt

SEQ ID NO: 7641889 - DNA, 22 bp, Homo sapiens
atgtccagagccggcctgctga

SEQ ID NO: 7641890 - DNA, 22 bp, Homo sapiens
atgtccagagccggcctgctga

SEQ ID NO: 7641891 - DNA, 22 bp, Homo sapiens
atgtccagaggcttggtcccca

SEQ ID NO: 7641892 - DNA, 22 bp, Homo sapiens
atgtccagaggcttggtcccca

SEQ ID NO: 7641893 - DNA, 22 bp, Homo sapiens
atgtccagaggcttggtcccca

SEQ ID NO: 7641894 - DNA, 22 bp, Homo sapiens
atgtacataaaatgtataatga

SEQ ID NO: 7641895 - DNA, 22 bp, Homo sapiens
atgtacataaaatgtataatga

SEQ ID NO: 7641896 - DNA, 22 bp, Homo sapiens
atgtacataaaatgtataatga

SEQ ID NO: 7641897 - DNA, 22 bp, Homo sapiens
atgtacataaaatgtataatga

SEQ ID NO: 7641898 - DNA, 22 bp, Homo sapiens
atgtacatactgcattttcaaa

SEQ ID NO: 7641899 - DNA, 22 bp, Homo sapiens
atgtacagtttctagactcaaa

SEQ ID NO: 7641900 - DNA, 22 bp, Homo sapiens
atgtacagtttctagactcaaa

SEQ ID NO: 7641901 - DNA, 22 bp, Homo sapiens
atgtacagtttctagactcaaa

SEQ ID NO: 7641902 - DNA, 22 bp, Homo sapiens
atgtacagtttctagactcaaa

SEQ ID NO: 7641903 - DNA, 22 bp, Homo sapiens
atgtacagtttctagactcaaa

SEQ ID NO: 7641904 - DNA, 22 bp, Homo sapiens
atgtacagtttctagactcaaa

SEQ ID NO: 7641905 - DNA, 22 bp, Homo sapiens
atgtacagtttctagactcaaa

SEQ ID NO: 7641906 - DNA, 22 bp, Homo sapiens
atgtacaggatggtgctcatct

SEQ ID NO: 7641907 - DNA, 22 bp, Homo sapiens
atgtacagtttctagactcaaa

SEQ ID NO: 7641908 - DNA, 22 bp, Homo sapiens
atgtacagtggaaactaacaaa

SEQ ID NO: 7641909 - DNA, 22 bp, Homo sapiens
atgtacagtggaaactaacaaa

SEQ ID NO: 7641910 - DNA, 22 bp, Homo sapiens
atgtacagtggaaactaacaaa

SEQ ID NO: 7641911 - DNA, 22 bp, Homo sapiens
atgtacagtggaaactaacaaa

SEQ ID NO: 7641912 - DNA, 22 bp, Homo sapiens
atgtacagtggaaactaacaaa

SEQ ID NO: 7641913 - DNA, 22 bp, Homo sapiens
atgtacagtggaaactaacaaa

SEQ ID NO: 7641914 - DNA, 22 bp, Homo sapiens
atgtacagtggaaactaacaaa

SEQ ID NO: 7641915 - DNA, 22 bp, Homo sapiens
atgtacagccacttcacagtta

SEQ ID NO: 7641916 - DNA, 22 bp, Homo sapiens
atgtacagccacttcacagtta

SEQ ID NO: 7641917 - DNA, 22 bp, Homo sapiens
atgtacagccacttcacagtta

SEQ ID NO: 7641918 - DNA, 22 bp, Homo sapiens
atgtacagccacttcacagtta

SEQ ID NO: 7641919 - DNA, 22 bp, Homo sapiens
atgtacaggatggtgctcatct

SEQ ID NO: 7641920 - DNA, 22 bp, Homo sapiens
atgtacaggatggtgctcatct

SEQ ID NO: 7641921 - DNA, 22 bp, Homo sapiens
atgtacaggatggtgctcatct

SEQ ID NO: 7641922 - DNA, 22 bp, Homo sapiens
atgtacagccacttcacagtta

SEQ ID NO: 7641923 - DNA, 22 bp, Homo sapiens
atgtacagtgataagagggcag

SEQ ID NO: 7641924 - DNA, 22 bp, Homo sapiens
atgtacagtgataagagggcag

SEQ ID NO: 7641925 - DNA, 22 bp, Homo sapiens
atgtacagtgataagagggcag

SEQ ID NO: 7641926 - DNA, 22 bp, Homo sapiens
atgtacaggtcttggcaaaggg

SEQ ID NO: 7641927 - DNA, 22 bp, Homo sapiens
atgtacagtgataagagggcag

SEQ ID NO: 7641928 - DNA, 22 bp, Homo sapiens
atgtacagtgataagagggcag

SEQ ID NO: 7641929 - DNA, 22 bp, Homo sapiens
atgtacaggatggtgctcatct

SEQ ID NO: 7641930 - DNA, 22 bp, Homo sapiens
atgtacaggatggtgctcatct

SEQ ID NO: 7641931 - DNA, 22 bp, Homo sapiens
atgtacaggtcttggcaaaggg

SEQ ID NO: 7641932 - DNA, 22 bp, Homo sapiens
atgtacaggtcttggcaaaggg

SEQ ID NO: 7641933 - DNA, 22 bp, Homo sapiens
atgtacaggtcttggcaaaggg

SEQ ID NO: 7641934 - DNA, 22 bp, Homo sapiens
atgtacaggatggtgctcatct

SEQ ID NO: 7641935 - DNA, 22 bp, Homo sapiens
atgtctgtcccctagccctgat

SEQ ID NO: 7641936 - DNA, 22 bp, Homo sapiens
atgtctgtcatcttccaggaag

SEQ ID NO: 7641937 - DNA, 22 bp, Homo sapiens
atgtctgtccaaccctgcaggg

SEQ ID NO: 7641938 - DNA, 22 bp, Homo sapiens
atgtctgtcccctagccctgat

SEQ ID NO: 7641939 - DNA, 22 bp, Homo sapiens
atgtctgtccaaccctgcaggg

SEQ ID NO: 7641940 - DNA, 22 bp, Homo sapiens
atgtctgtcatcttccaggaag

SEQ ID NO: 7641941 - DNA, 22 bp, Homo sapiens
atgtctgtacgagttacaatgg

SEQ ID NO: 7641942 - DNA, 22 bp, Homo sapiens
atgtctgtatgtggagaggggt

SEQ ID NO: 7641943 - DNA, 22 bp, Homo sapiens
atgtctgtcatcttccaggaag

SEQ ID NO: 7641944 - DNA, 22 bp, Homo sapiens
atgtctgtatgtggagaggggt

SEQ ID NO: 7641945 - DNA, 22 bp, Homo sapiens
atgtctgtacgagttacaatgg

SEQ ID NO: 7641946 - DNA, 19 bp, Homo sapiens
atgtcccaccgcccctgag

SEQ ID NO: 7641947 - DNA, 22 bp, Homo sapiens
atgtcccagctgagagacaact

SEQ ID NO: 7641948 - DNA, 22 bp, Homo sapiens
atgtcccaagatacagctagag

SEQ ID NO: 7641949 - DNA, 22 bp, Homo sapiens
atgtccatgctttgctccagaa

SEQ ID NO: 7641950 - DNA, 22 bp, Homo sapiens
atgtccagtttctacacacata

SEQ ID NO: 7641951 - DNA, 22 bp, Homo sapiens
atgtccatgctttgctccagaa

SEQ ID NO: 7641952 - DNA, 22 bp, Homo sapiens
atgtcccaagatacagctagag

SEQ ID NO: 7641953 - DNA, 22 bp, Homo sapiens
atgtccagggcacacagcagtg

SEQ ID NO: 7641954 - DNA, 22 bp, Homo sapiens
atgtccaggatctatccccaga

SEQ ID NO: 7641955 - DNA, 22 bp, Homo sapiens
atgtccaggatctatccccaga

SEQ ID NO: 7641956 - DNA, 22 bp, Homo sapiens
atgtccaggaagtcttaactca

SEQ ID NO: 7641957 - DNA, 22 bp, Homo sapiens
atgtccagctcatgatactatc

SEQ ID NO: 7641958 - DNA, 22 bp, Homo sapiens
atgtccagctcatgatactatc

SEQ ID NO: 7641959 - DNA, 22 bp, Homo sapiens
atgtccagggcacacagcagtg

SEQ ID NO: 7641960 - DNA, 22 bp, Homo sapiens
atgtccagggctttagcggggc

SEQ ID NO: 7641961 - DNA, 22 bp, Homo sapiens
atgtccagggggcttgactggt

SEQ ID NO: 7641962 - DNA, 22 bp, Homo sapiens
atgtccagggggcttgactggt

SEQ ID NO: 7641963 - DNA, 22 bp, Homo sapiens
atgtccagggcacacagcagtg

SEQ ID NO: 7641964 - DNA, 22 bp, Homo sapiens
atgtccagggctttagcggggc

SEQ ID NO: 7641965 - DNA, 22 bp, Homo sapiens
atgtccagggggcttgactggt

SEQ ID NO: 7641966 - DNA, 22 bp, Homo sapiens
atgtccagtacttctaaatggt

SEQ ID NO: 7641967 - DNA, 22 bp, Homo sapiens
atgtccagtacttctaaatggt

SEQ ID NO: 7641968 - DNA, 22 bp, Homo sapiens
atgtccagtacttctaaatggt

SEQ ID NO: 7641969 - DNA, 20 bp, Homo sapiens
atgtccagtgactggaccat

SEQ ID NO: 7641970 - DNA, 20 bp, Homo sapiens
atgtccagtgactggaccat

SEQ ID NO: 7641971 - DNA, 20 bp, Homo sapiens
atgtccagtgactggaccat

SEQ ID NO: 7641972 - DNA, 23 bp, Homo sapiens
atgtccagtttacttcaggatga

SEQ ID NO: 7641973 - DNA, 23 bp, Homo sapiens
atgtccagtttacttcaggatga

SEQ ID NO: 7641974 - DNA, 20 bp, Homo sapiens
atgtccagtgactggaccat

SEQ ID NO: 7641975 - DNA, 23 bp, Homo sapiens
atgtccagtttacttcaggatga

SEQ ID NO: 7641976 - DNA, 23 bp, Homo sapiens
atgtccagtttacttcaggatga

SEQ ID NO: 7641977 - DNA, 22 bp, Homo sapiens
atgtccagtttctacacacata

SEQ ID NO: 7641978 - DNA, 22 bp, Homo sapiens
atgtccagtttctacacacata

SEQ ID NO: 7641979 - DNA, 22 bp, Homo sapiens
atgtccagtttctacacacata

SEQ ID NO: 7641980 - DNA, 22 bp, Homo sapiens
atgtctgtttatccttcaagat

SEQ ID NO: 7641981 - DNA, 22 bp, Homo sapiens
atgtctgtttatccttcaagat

SEQ ID NO: 7641982 - DNA, 22 bp, Homo sapiens
atgtctgtttgctgagcccggc

SEQ ID NO: 7641983 - DNA, 22 bp, Homo sapiens
atgtctgttttcatatcagata

SEQ ID NO: 7641984 - DNA, 22 bp, Homo sapiens
atgtctgtttatccttcaagat

SEQ ID NO: 7641985 - DNA, 22 bp, Homo sapiens
atgtctgtttgctgagcccggc

SEQ ID NO: 7641986 - DNA, 22 bp, Homo sapiens
atgtctgttttcatatcagata

SEQ ID NO: 7641987 - DNA, 22 bp, Homo sapiens
atgtctgttttcatatcagata

SEQ ID NO: 7641988 - DNA, 22 bp, Homo sapiens
atgtcttcatagcttatatcca

SEQ ID NO: 7641989 - DNA, 22 bp, Homo sapiens
atgtcttctaagctctaagctg

SEQ ID NO: 7641990 - DNA, 19 bp, Homo sapiens
atgtctgttgaatttcata

SEQ ID NO: 7641991 - DNA, 22 bp, Homo sapiens
atgtctgtttatccttcaagat

SEQ ID NO: 7641992 - DNA, 19 bp, Homo sapiens
atgtctgttgaatttcata

SEQ ID NO: 7641993 - DNA, 19 bp, Homo sapiens
atgtctgttgaatttcata

SEQ ID NO: 7641994 - DNA, 21 bp, Homo sapiens
atgtctgttctgattggtgcg

SEQ ID NO: 7641995 - DNA, 22 bp, Homo sapiens
atgtctgtggcattatatgttt

SEQ ID NO: 7641996 - DNA, 22 bp, Homo sapiens
atgtctgttaatcgaccctaat

SEQ ID NO: 7641997 - DNA, 21 bp, Homo sapiens
atgtctgttctttctggcagg

SEQ ID NO: 7641998 - DNA, 22 bp, Homo sapiens
atgtctgttcattattaactgc

SEQ ID NO: 7641999 - DNA, 21 bp, Homo sapiens
atgtctgttctttctggcagg

SEQ ID NO: 7642000 - DNA, 22 bp, Homo sapiens
atgtctgtggcattatatgttt

SEQ ID NO: 7642001 - DNA, 22 bp, Homo sapiens
atgtctgtggcattatatgttt

SEQ ID NO: 7642002 - DNA, 22 bp, Homo sapiens
atgtctgtgtgatcttggataa

SEQ ID NO: 7642003 - DNA, 22 bp, Homo sapiens
atgtctgtggcattatatgttt

SEQ ID NO: 7642004 - DNA, 22 bp, Homo sapiens
atgtctgtgttatctgtagaat

SEQ ID NO: 7642005 - DNA, 22 bp, Homo sapiens
atgtctgtgtgatcttggataa

SEQ ID NO: 7642006 - DNA, 22 bp, Homo sapiens
atgtctgttaatcgaccctaat

SEQ ID NO: 7642007 - DNA, 22 bp, Homo sapiens
atgtctgttcattattaactgc

SEQ ID NO: 7642008 - DNA, 22 bp, Homo sapiens
atgtctgtctatagccatgaga

SEQ ID NO: 7642009 - DNA, 22 bp, Homo sapiens
atgtctgtctttgtactccaca

SEQ ID NO: 7642010 - DNA, 18 bp, Homo sapiens
atgtctgtgcactggata

SEQ ID NO: 7642011 - DNA, 22 bp, Homo sapiens
atgtctgtctttgtactccaca

SEQ ID NO: 7642012 - DNA, 22 bp, Homo sapiens
atgtctgtctttgtactccaca

SEQ ID NO: 7642013 - DNA, 22 bp, Homo sapiens
atgtctgtggcaattgttgatg

SEQ ID NO: 7642014 - DNA, 18 bp, Homo sapiens
atgtctgtgcactggata

SEQ ID NO: 7642015 - DNA, 18 bp, Homo sapiens
atgtctgtgcactggata

SEQ ID NO: 7642016 - DNA, 22 bp, Homo sapiens
atgtctgtcccctagccctgat

SEQ ID NO: 7642017 - DNA, 18 bp, Homo sapiens
atgtctgtgcactggata

SEQ ID NO: 7642018 - DNA, 22 bp, Homo sapiens
atgtctgtggcaattgttgatg

SEQ ID NO: 7642019 - DNA, 22 bp, Homo sapiens
atgtctgtggcaattgttgatg

SEQ ID NO: 7642020 - DNA, 22 bp, Homo sapiens
atgcaggatgcagaggggcccg

SEQ ID NO: 7642021 - DNA, 22 bp, Homo sapiens
atgcaggagttggaaaaaatga

SEQ ID NO: 7642022 - DNA, 22 bp, Homo sapiens
atgcaggagttggaaaaaatga

SEQ ID NO: 7642023 - DNA, 22 bp, Homo sapiens
atgcaggagttggaaaaaatga

SEQ ID NO: 7642024 - DNA, 22 bp, Homo sapiens
agacagtgctatcccatctgtg

SEQ ID NO: 7642025 - DNA, 22 bp, Homo sapiens
agacagtgctatcccatctgtg

SEQ ID NO: 7642026 - DNA, 22 bp, Homo sapiens
atgcaggagttcgaggctgtat

SEQ ID NO: 7642027 - DNA, 22 bp, Homo sapiens
agacagtgcaagaagagcaggc

SEQ ID NO: 7642028 - DNA, 22 bp, Homo sapiens
agacagtgctatcccatctgtg

SEQ ID NO: 7642029 - DNA, 22 bp, Homo sapiens
agacagtgcaagaagagcaggc

SEQ ID NO: 7642030 - DNA, 22 bp, Homo sapiens
agacagtgcaagaagagcaggc

SEQ ID NO: 7642031 - DNA, 22 bp, Homo sapiens
agacagtgattcttcacatttc

SEQ ID NO: 7642032 - DNA, 22 bp, Homo sapiens
agacagtgattcttcacatttc

SEQ ID NO: 7642033 - DNA, 22 bp, Homo sapiens
agacagtgatgtaagcaggagt

SEQ ID NO: 7642034 - DNA, 22 bp, Homo sapiens
agacagtgatgtaagcaggagt

SEQ ID NO: 7642035 - DNA, 22 bp, Homo sapiens
agacagtgatgtaagcaggagt

SEQ ID NO: 7642036 - DNA, 22 bp, Homo sapiens
agacagtgcaagaagagcaggc

SEQ ID NO: 7642037 - DNA, 22 bp, Homo sapiens
agacagtgcaagaagagcaggc

SEQ ID NO: 7642038 - DNA, 22 bp, Homo sapiens
agacagtgcaagaagagcaggc

SEQ ID NO: 7642039 - DNA, 22 bp, Homo sapiens
atgcaggatgtcaacgcatcct

SEQ ID NO: 7642040 - DNA, 22 bp, Homo sapiens
atgcaggatgtcaacgcatcct

SEQ ID NO: 7642041 - DNA, 22 bp, Homo sapiens
atgcaggatgtcaacgcatcct

SEQ ID NO: 7642042 - DNA, 22 bp, Homo sapiens
atgcaggattagaaagttgcct

SEQ ID NO: 7642043 - DNA, 22 bp, Homo sapiens
atgcaggatgtcaacgcatcct

SEQ ID NO: 7642044 - DNA, 22 bp, Homo sapiens
atgcaggcagacactgtgggca

SEQ ID NO: 7642045 - DNA, 22 bp, Homo sapiens
atgcaggattagaaagttgcct

SEQ ID NO: 7642046 - DNA, 22 bp, Homo sapiens
atgcaggattagaaagttgcct

SEQ ID NO: 7642047 - DNA, 22 bp, Homo sapiens
atgcaggattagaaagttgcct

SEQ ID NO: 7642048 - DNA, 22 bp, Homo sapiens
atgcaggcagacactgtgggca

SEQ ID NO: 7642049 - DNA, 22 bp, Homo sapiens
atgcaggcagacactgtgggca

SEQ ID NO: 7642050 - DNA, 21 bp, Homo sapiens
atgcaggctgctcagaagcaa

SEQ ID NO: 7642051 - DNA, 21 bp, Homo sapiens
atgcaggctgctcagaagcaa

SEQ ID NO: 7642052 - DNA, 22 bp, Homo sapiens
atgcaggctcatgaatctgttt

SEQ ID NO: 7642053 - DNA, 21 bp, Homo sapiens
atgcaggctgctcagaagcaa

SEQ ID NO: 7642054 - DNA, 22 bp, Homo sapiens
atgcagggacctttgctttggt

SEQ ID NO: 7642055 - DNA, 22 bp, Homo sapiens
atgcagggacctttgctttggt

SEQ ID NO: 7642056 - DNA, 22 bp, Homo sapiens
atgcagggaggtaagaggtgcc

SEQ ID NO: 7642057 - DNA, 22 bp, Homo sapiens
atgcagggaggtaagaggtgcc

SEQ ID NO: 7642058 - DNA, 22 bp, Homo sapiens
atgcagggaggtaagaggtgcc

SEQ ID NO: 7642059 - DNA, 22 bp, Homo sapiens
atgcagggaggtaagaggtgcc

SEQ ID NO: 7642060 - DNA, 22 bp, Homo sapiens
atgcagggaggtaagaggtgcc

SEQ ID NO: 7642061 - DNA, 22 bp, Homo sapiens
agacagtaataaaataggtaag

SEQ ID NO: 7642062 - DNA, 22 bp, Homo sapiens
agacagtatgatatatgaatac

SEQ ID NO: 7642063 - DNA, 22 bp, Homo sapiens
agacagtatgatatatgaatac

SEQ ID NO: 7642064 - DNA, 22 bp, Homo sapiens
agacagtatgatatatgaatac

SEQ ID NO: 7642065 - DNA, 21 bp, Homo sapiens
agacagtaactcttctactcc

SEQ ID NO: 7642066 - DNA, 21 bp, Homo sapiens
agacagtaactcttctactcc

SEQ ID NO: 7642067 - DNA, 22 bp, Homo sapiens
agacagtaataaaataggtaag

SEQ ID NO: 7642068 - DNA, 17 bp, Homo sapiens
agacaggttatagttga

SEQ ID NO: 7642069 - DNA, 22 bp, Homo sapiens
agacaggtagcaggacagatat

SEQ ID NO: 7642070 - DNA, 22 bp, Homo sapiens
agacaggcatgaggctggattg

SEQ ID NO: 7642071 - DNA, 21 bp, Homo sapiens
agacaggtcagggagaggtga

SEQ ID NO: 7642072 - DNA, 21 bp, Homo sapiens
agacaggtcagggagaggtga

SEQ ID NO: 7642073 - DNA, 21 bp, Homo sapiens
agacaggtcagggagaggtga

SEQ ID NO: 7642074 - DNA, 22 bp, Homo sapiens
agacaggtgctcgcccaagtcc

SEQ ID NO: 7642075 - DNA, 22 bp, Homo sapiens
agacaggtgttttacaacttcg

SEQ ID NO: 7642076 - DNA, 22 bp, Homo sapiens
agacaggtgttttacaacttcg

SEQ ID NO: 7642077 - DNA, 22 bp, Homo sapiens
agacagtgatgtaagcaggagt

SEQ ID NO: 7642078 - DNA, 22 bp, Homo sapiens
agacagtgatgtaagcaggagt

SEQ ID NO: 7642079 - DNA, 22 bp, Homo sapiens
agacagtgatgtaagcaggagt

SEQ ID NO: 7642080 - DNA, 22 bp, Homo sapiens
agacagtgatgtaagcaggagt

SEQ ID NO: 7642081 - DNA, 22 bp, Homo sapiens
agacagtgatggacaggcagac

SEQ ID NO: 7642082 - DNA, 22 bp, Homo sapiens
agacagtgataccttgggatgt

SEQ ID NO: 7642083 - DNA, 22 bp, Homo sapiens
agacagtgatggacaggcagac

SEQ ID NO: 7642084 - DNA, 22 bp, Homo sapiens
agacagtgatggacaggcagac

SEQ ID NO: 7642085 - DNA, 22 bp, Homo sapiens
agacagtgatggacaggcagac

SEQ ID NO: 7642086 - DNA, 22 bp, Homo sapiens
agacagtgaggcagagcttccg

SEQ ID NO: 7642087 - DNA, 22 bp, Homo sapiens
agacagtgaggcagagcttccg

SEQ ID NO: 7642088 - DNA, 22 bp, Homo sapiens
agacagtgagaatgagttgaaa

SEQ ID NO: 7642089 - DNA, 22 bp, Homo sapiens
agacagtgagaatgagttgaaa

SEQ ID NO: 7642090 - DNA, 22 bp, Homo sapiens
agacagtatgatatatgaatac

SEQ ID NO: 7642091 - DNA, 22 bp, Homo sapiens
agacagtgagaatgagttgaaa

SEQ ID NO: 7642092 - DNA, 17 bp, Homo sapiens
agacagtgagtgccttg

SEQ ID NO: 7642093 - DNA, 17 bp, Homo sapiens
agacagtgagtgccttg

SEQ ID NO: 7642094 - DNA, 17 bp, Homo sapiens
agacagtgagtgccttg

SEQ ID NO: 7642095 - DNA, 17 bp, Homo sapiens
agacagtgagtgccttg

SEQ ID NO: 7642096 - DNA, 17 bp, Homo sapiens
agacagtgagtgccttg

SEQ ID NO: 7642097 - DNA, 22 bp, Homo sapiens
agacagtgataccttgggatgt

SEQ ID NO: 7642098 - DNA, 22 bp, Homo sapiens
agacagtgataccttgggatgt

SEQ ID NO: 7642099 - DNA, 22 bp, Homo sapiens
agacaggcagggcatggaaaaa

SEQ ID NO: 7642100 - DNA, 22 bp, Homo sapiens
agacaggcatgaggctggattg

SEQ ID NO: 7642101 - DNA, 22 bp, Homo sapiens
agacaggcatgaggctggattg

SEQ ID NO: 7642102 - DNA, 22 bp, Homo sapiens
agacaggcagcagatggagtgt

SEQ ID NO: 7642103 - DNA, 22 bp, Homo sapiens
agacaggcagcagatggagtgt

SEQ ID NO: 7642104 - DNA, 22 bp, Homo sapiens
agacaggcagcagatggagtgt

SEQ ID NO: 7642105 - DNA, 19 bp, Homo sapiens
agacacatcacatttctcc

SEQ ID NO: 7642106 - DNA, 22 bp, Homo sapiens
agacacatcttaggttgtcagg

SEQ ID NO: 7642107 - DNA, 22 bp, Homo sapiens
agacaggcagaggctgcagagg

SEQ ID NO: 7642108 - DNA, 22 bp, Homo sapiens
agacacatcttaggttgtcagg

SEQ ID NO: 7642109 - DNA, 22 bp, Homo sapiens
agacacatcttaggttgtcagg

SEQ ID NO: 7642110 - DNA, 23 bp, Homo sapiens
agacacataggagcagctattgg

SEQ ID NO: 7642111 - DNA, 23 bp, Homo sapiens
agacacataggagcagctattgg

SEQ ID NO: 7642112 - DNA, 23 bp, Homo sapiens
agacacataggagcagctattgg

SEQ ID NO: 7642113 - DNA, 22 bp, Homo sapiens
agacacataggaccacactgtg

SEQ ID NO: 7642114 - DNA, 22 bp, Homo sapiens
agacacataggaccacactgtg

SEQ ID NO: 7642115 - DNA, 22 bp, Homo sapiens
agacacataggaccacactgtg

SEQ ID NO: 7642116 - DNA, 22 bp, Homo sapiens
agacacataggaccacactgtg

SEQ ID NO: 7642117 - DNA, 22 bp, Homo sapiens
agacacagtttgggatgggttg

SEQ ID NO: 7642118 - DNA, 22 bp, Homo sapiens
agacacagtgctgggtgctgag

SEQ ID NO: 7642119 - DNA, 22 bp, Homo sapiens
agacacagtgctgggtgctgag

SEQ ID NO: 7642120 - DNA, 22 bp, Homo sapiens
agacacagtgttgaaggctagt

SEQ ID NO: 7642121 - DNA, 22 bp, Homo sapiens
agacacagtgttgaaggctagt

SEQ ID NO: 7642122 - DNA, 22 bp, Homo sapiens
agacacagtgttgaaggctagt

SEQ ID NO: 7642123 - DNA, 22 bp, Homo sapiens
agacacagtgttgaaggctagt

SEQ ID NO: 7642124 - DNA, 22 bp, Homo sapiens
agacacagtttgggatgggttg

SEQ ID NO: 7642125 - DNA, 22 bp, Homo sapiens
agacacagtttgggatgggttg

SEQ ID NO: 7642126 - DNA, 22 bp, Homo sapiens
agacacagtttgggatgggttg

SEQ ID NO: 7642127 - DNA, 22 bp, Homo sapiens
agacacagtttgggatgggttg

SEQ ID NO: 7642128 - DNA, 22 bp, Homo sapiens
agacacagtctgtctggaggag

SEQ ID NO: 7642129 - DNA, 22 bp, Homo sapiens
agacacagtgagtttctttccc

SEQ ID NO: 7642130 - DNA, 22 bp, Homo sapiens
agacacagtgagtttctttccc

SEQ ID NO: 7642131 - DNA, 22 bp, Homo sapiens
agacacagtgagtttctttccc

SEQ ID NO: 7642132 - DNA, 22 bp, Homo sapiens
agacacagtctgtctggaggag

SEQ ID NO: 7642133 - DNA, 22 bp, Homo sapiens
agacacagtctgtctggaggag

SEQ ID NO: 7642134 - DNA, 22 bp, Homo sapiens
agacacagtgctgggtgctgag

SEQ ID NO: 7642135 - DNA, 22 bp, Homo sapiens
agacacagtgctgggtgctgag

SEQ ID NO: 7642136 - DNA, 22 bp, Homo sapiens
agacacagtgctgggtgctgag

SEQ ID NO: 7642137 - DNA, 22 bp, Homo sapiens
agacacagtgctgggtgctgag

SEQ ID NO: 7642138 - DNA, 22 bp, Homo sapiens
agacacagtgctgggtgctgag

SEQ ID NO: 7642139 - DNA, 22 bp, Homo sapiens
agacacagtataagcacaacaa

SEQ ID NO: 7642140 - DNA, 22 bp, Homo sapiens
agacacagtataagcacaacaa

SEQ ID NO: 7642141 - DNA, 22 bp, Homo sapiens
agacacagtataagcacaacaa

SEQ ID NO: 7642142 - DNA, 22 bp, Homo sapiens
agacacaggtgtaatttctgct

SEQ ID NO: 7642143 - DNA, 22 bp, Homo sapiens
agacacaggtgtaatttctgct

SEQ ID NO: 7642144 - DNA, 22 bp, Homo sapiens
agacacaggtgtaatttctgct

SEQ ID NO: 7642145 - DNA, 22 bp, Homo sapiens
agacacaggtgtaatttctgct

SEQ ID NO: 7642146 - DNA, 22 bp, Homo sapiens
agacacaggtgtaatttctgct

SEQ ID NO: 7642147 - DNA, 22 bp, Homo sapiens
agacacagtacttgccctcatg

SEQ ID NO: 7642148 - DNA, 22 bp, Homo sapiens
agacacagtacttgccctcatg

SEQ ID NO: 7642149 - DNA, 22 bp, Homo sapiens
agacacagtctgtctggaggag

SEQ ID NO: 7642150 - DNA, 22 bp, Homo sapiens
agacacagtctgtctggaggag

SEQ ID NO: 7642151 - DNA, 22 bp, Homo sapiens
agacacagtataagcacaacaa

SEQ ID NO: 7642152 - DNA, 22 bp, Homo sapiens
agacacagtctgtctggaggag

SEQ ID NO: 7642153 - DNA, 22 bp, Homo sapiens
agacacagtctgtctggaggag

SEQ ID NO: 7642154 - DNA, 22 bp, Homo sapiens
agacacagtctgtctggaggag

SEQ ID NO: 7642155 - DNA, 22 bp, Homo sapiens
agacacagtctgtctggaggag

SEQ ID NO: 7642156 - DNA, 22 bp, Homo sapiens
agacacagtctgtctggaggag

SEQ ID NO: 7642157 - DNA, 22 bp, Homo sapiens
agacacagtctgtctggaggag

SEQ ID NO: 7642158 - DNA, 22 bp, Homo sapiens
agacacaggattctgcatttct

SEQ ID NO: 7642159 - DNA, 22 bp, Homo sapiens
agacacaggattctgcatttct

SEQ ID NO: 7642160 - DNA, 22 bp, Homo sapiens
agacacagctgcaggaggtggg

SEQ ID NO: 7642161 - DNA, 22 bp, Homo sapiens
agacacagctgcaggaggtggg

SEQ ID NO: 7642162 - DNA, 21 bp, Homo sapiens
agacacaggggttgctggggt

SEQ ID NO: 7642163 - DNA, 21 bp, Homo sapiens
agacacaggggttgctggggt

SEQ ID NO: 7642164 - DNA, 21 bp, Homo sapiens
agacacaggggttgctggggt

SEQ ID NO: 7642165 - DNA, 21 bp, Homo sapiens
agacacaggggttgctggggt

SEQ ID NO: 7642166 - DNA, 22 bp, Homo sapiens
agacacagctgcaggaggtggg

SEQ ID NO: 7642167 - DNA, 22 bp, Homo sapiens
agacacagctgcaggaggtggg

SEQ ID NO: 7642168 - DNA, 22 bp, Homo sapiens
agacacagctgcaggaggtggg

SEQ ID NO: 7642169 - DNA, 22 bp, Homo sapiens
agacacagctgcaggaggtggg

SEQ ID NO: 7642170 - DNA, 22 bp, Homo sapiens
agacacagctgcaggaggtggg

SEQ ID NO: 7642171 - DNA, 22 bp, Homo sapiens
agacacagctaccataatacca

SEQ ID NO: 7642172 - DNA, 22 bp, Homo sapiens
agacacagcagtgcctgcctca

SEQ ID NO: 7642173 - DNA, 22 bp, Homo sapiens
agacacagcagtgcctgcctca

SEQ ID NO: 7642174 - DNA, 22 bp, Homo sapiens
agacacagctaccataatacca

SEQ ID NO: 7642175 - DNA, 22 bp, Homo sapiens
agacacagctaccataatacca

SEQ ID NO: 7642176 - DNA, 22 bp, Homo sapiens
agacacagctaccataatacca

SEQ ID NO: 7642177 - DNA, 22 bp, Homo sapiens
agaatgcagtttgaaataaggt

SEQ ID NO: 7642178 - DNA, 22 bp, Homo sapiens
agaatgcagcttgccagtatct

SEQ ID NO: 7642179 - DNA, 22 bp, Homo sapiens
agaatgcagtttgaaataaggt

SEQ ID NO: 7642180 - DNA, 22 bp, Homo sapiens
agaatgcagtttgaaataaggt

SEQ ID NO: 7642181 - DNA, 22 bp, Homo sapiens
agaatgcagtttgaaataaggt

SEQ ID NO: 7642182 - DNA, 22 bp, Homo sapiens
agaatgcatctaaaagcagaga

SEQ ID NO: 7642183 - DNA, 22 bp, Homo sapiens
agaatgcagtttgaaataaggt

SEQ ID NO: 7642184 - DNA, 22 bp, Homo sapiens
agaatgcatctaaaagcagaga

SEQ ID NO: 7642185 - DNA, 22 bp, Homo sapiens
agaatgcatctaaaagcagaga

SEQ ID NO: 7642186 - DNA, 22 bp, Homo sapiens
agaatgcatctaaaagcagaga

SEQ ID NO: 7642187 - DNA, 22 bp, Homo sapiens
agaatgcatctaaaagcagaga

SEQ ID NO: 7642188 - DNA, 22 bp, Homo sapiens
agaatgcatctaaaagcagaga

SEQ ID NO: 7642189 - DNA, 19 bp, Homo sapiens
agaatgcatttctgctgtc

SEQ ID NO: 7642190 - DNA, 22 bp, Homo sapiens
agaatgcaagataaactttatt

SEQ ID NO: 7642191 - DNA, 17 bp, Homo sapiens
agaatgcaaagcaggct

SEQ ID NO: 7642192 - DNA, 22 bp, Homo sapiens
agaatgcaagataaactttatt

SEQ ID NO: 7642193 - DNA, 22 bp, Homo sapiens
agaatgcaaatgatcccacaca

SEQ ID NO: 7642194 - DNA, 22 bp, Homo sapiens
agaatgcaagataaactttatt

SEQ ID NO: 7642195 - DNA, 22 bp, Homo sapiens
agaatgcagcttgccagtatct

SEQ ID NO: 7642196 - DNA, 17 bp, Homo sapiens
agaatgcaaagcaggct

SEQ ID NO: 7642197 - DNA, 17 bp, Homo sapiens
agaatgcaaagcaggct

SEQ ID NO: 7642198 - DNA, 22 bp, Homo sapiens
agaatgattttggacaatatgg

SEQ ID NO: 7642199 - DNA, 22 bp, Homo sapiens
agaatctttcctcattgctgtc

SEQ ID NO: 7642200 - DNA, 22 bp, Homo sapiens
agaatctttctgaatgactgtg

SEQ ID NO: 7642201 - DNA, 22 bp, Homo sapiens
agaatgaattaatcaactggaa

SEQ ID NO: 7642202 - DNA, 20 bp, Homo sapiens
agaatcagagtggaaaggaa

SEQ ID NO: 7642203 - DNA, 22 bp, Homo sapiens
agaatcaggaagacagcctggc

SEQ ID NO: 7642204 - DNA, 22 bp, Homo sapiens
agaatcaggaagacagcctggc

SEQ ID NO: 7642205 - DNA, 22 bp, Homo sapiens
agaatcaggacctgtggctgtc

SEQ ID NO: 7642206 - DNA, 22 bp, Homo sapiens
agaatcttgtttcttgtgtgtt

SEQ ID NO: 7642207 - DNA, 22 bp, Homo sapiens
agaatgatagctagtatttact

SEQ ID NO: 7642208 - DNA, 22 bp, Homo sapiens
agaatgatagctagtatttact

SEQ ID NO: 7642209 - DNA, 22 bp, Homo sapiens
agaatgaattaatcaactggaa

SEQ ID NO: 7642210 - DNA, 22 bp, Homo sapiens
agaatgaattaatcaactggaa

SEQ ID NO: 7642211 - DNA, 22 bp, Homo sapiens
agaatctttctgaatgactgtg

SEQ ID NO: 7642212 - DNA, 22 bp, Homo sapiens
agaatgataatgccatgatgga

SEQ ID NO: 7642213 - DNA, 22 bp, Homo sapiens
agaatgataatgccatgatgga

SEQ ID NO: 7642214 - DNA, 22 bp, Homo sapiens
agaatgctccagagctgaaaga

SEQ ID NO: 7642215 - DNA, 22 bp, Homo sapiens
agaatgctcttcaaaatctagc

SEQ ID NO: 7642216 - DNA, 22 bp, Homo sapiens
agaatgcttcctttgaaactga

SEQ ID NO: 7642217 - DNA, 22 bp, Homo sapiens
agaatgcattttgtgtagctat

SEQ ID NO: 7642218 - DNA, 19 bp, Homo sapiens
agaatgcatttctgctgtc

SEQ ID NO: 7642219 - DNA, 19 bp, Homo sapiens
agaatgcatttctgctgtc

SEQ ID NO: 7642220 - DNA, 22 bp, Homo sapiens
agaatgcattttgtgtagctat

SEQ ID NO: 7642221 - DNA, 22 bp, Homo sapiens
agaatgcattttgtgtagctat

SEQ ID NO: 7642222 - DNA, 22 bp, Homo sapiens
agaatgcattttgtgtagctat

SEQ ID NO: 7642223 - DNA, 22 bp, Homo sapiens
agaatgcattttgtgtagctat

SEQ ID NO: 7642224 - DNA, 20 bp, Homo sapiens
agaatgctttttgcattgca

SEQ ID NO: 7642225 - DNA, 22 bp, Homo sapiens
agaatgctttggatatattgga

SEQ ID NO: 7642226 - DNA, 22 bp, Homo sapiens
agaatgctttggatatattgga

SEQ ID NO: 7642227 - DNA, 22 bp, Homo sapiens
agaatgctttggatatattgga

SEQ ID NO: 7642228 - DNA, 22 bp, Homo sapiens
agaatgcttcctttgaaactga

SEQ ID NO: 7642229 - DNA, 22 bp, Homo sapiens
agaatgtagtcttggagattta

SEQ ID NO: 7642230 - DNA, 22 bp, Homo sapiens
agaatgtagtcttggagattta

SEQ ID NO: 7642231 - DNA, 22 bp, Homo sapiens
agaatgtcaacagcctctcaag

SEQ ID NO: 7642232 - DNA, 22 bp, Homo sapiens
agaatgtaagaatgcaaagatt

SEQ ID NO: 7642233 - DNA, 22 bp, Homo sapiens
agaatgggggctacaggccaca

SEQ ID NO: 7642234 - DNA, 22 bp, Homo sapiens
agaatgtttctgtggttcacaa

SEQ ID NO: 7642235 - DNA, 22 bp, Homo sapiens
agaatgttttcatgagaatgaa

SEQ ID NO: 7642236 - DNA, 22 bp, Homo sapiens
agaatgtgttttaacatgggaa

SEQ ID NO: 7642237 - DNA, 22 bp, Homo sapiens
agaatgtgttttaacatgggaa

SEQ ID NO: 7642238 - DNA, 22 bp, Homo sapiens
agaatgtgttttaacatgggaa

SEQ ID NO: 7642239 - DNA, 22 bp, Homo sapiens
agaatgtgttattagagaagga

SEQ ID NO: 7642240 - DNA, 22 bp, Homo sapiens
agaatgtgttattagagaagga

SEQ ID NO: 7642241 - DNA, 22 bp, Homo sapiens
agaatgtgtgcaagcaagtgtg

SEQ ID NO: 7642242 - DNA, 22 bp, Homo sapiens
agaatgtgttattagagaagga

SEQ ID NO: 7642243 - DNA, 22 bp, Homo sapiens
agaatgtgggcacgtatgttct

SEQ ID NO: 7642244 - DNA, 22 bp, Homo sapiens
agaatgtgggcacgtatgttct

SEQ ID NO: 7642245 - DNA, 22 bp, Homo sapiens
agaatgtgatatagtgatatgt

SEQ ID NO: 7642246 - DNA, 22 bp, Homo sapiens
agaatgtgggggaaaagagtgt

SEQ ID NO: 7642247 - DNA, 22 bp, Homo sapiens
agaatgtgaagacccggtttgt

SEQ ID NO: 7642248 - DNA, 22 bp, Homo sapiens
agaatgtcaacagcctctcaag

SEQ ID NO: 7642249 - DNA, 22 bp, Homo sapiens
agaatgtgaagattttgaatta

SEQ ID NO: 7642250 - DNA, 22 bp, Homo sapiens
agaatgtgatatagtgatatgt

SEQ ID NO: 7642251 - DNA, 22 bp, Homo sapiens
agaatgtgatatagtgatatgt

SEQ ID NO: 7642252 - DNA, 22 bp, Homo sapiens
agaatgtgatatagtgatatgt

SEQ ID NO: 7642253 - DNA, 22 bp, Homo sapiens
agacaatatataattttagttg

SEQ ID NO: 7642254 - DNA, 22 bp, Homo sapiens
agacaatacatttattcccttt

SEQ ID NO: 7642255 - DNA, 22 bp, Homo sapiens
agacaatatataattttagttg

SEQ ID NO: 7642256 - DNA, 20 bp, Homo sapiens
agaattcttaccctttgatg

SEQ ID NO: 7642257 - DNA, 22 bp, Homo sapiens
agaattctggagttgggaggaa

SEQ ID NO: 7642258 - DNA, 22 bp, Homo sapiens
agaattctgttcttcgggtgtg

SEQ ID NO: 7642259 - DNA, 21 bp, Homo sapiens
agaattcttaagtattctaat

SEQ ID NO: 7642260 - DNA, 22 bp, Homo sapiens
agaattctccttcagggcagga

SEQ ID NO: 7642261 - DNA, 22 bp, Homo sapiens
agaattctcttccattgaaaca

SEQ ID NO: 7642262 - DNA, 22 bp, Homo sapiens
agaattctgacaatagaattgg

SEQ ID NO: 7642263 - DNA, 22 bp, Homo sapiens
agaattctccacgctcagggtc

SEQ ID NO: 7642264 - DNA, 23 bp, Homo sapiens
agaattccagtttcttatgtcac

SEQ ID NO: 7642265 - DNA, 20 bp, Homo sapiens
agaattcccaagcatgacca

SEQ ID NO: 7642266 - DNA, 22 bp, Homo sapiens
agaattcctcctctgggacact

SEQ ID NO: 7642267 - DNA, 22 bp, Homo sapiens
agaattcctctaggatctgccc

SEQ ID NO: 7642268 - DNA, 22 bp, Homo sapiens
agaattctccttcagggcagga

SEQ ID NO: 7642269 - DNA, 22 bp, Homo sapiens
agaattacagcttttagaatag

SEQ ID NO: 7642270 - DNA, 21 bp, Homo sapiens
agaattaaattggatttgtgt

SEQ ID NO: 7642271 - DNA, 22 bp, Homo sapiens
agaattacataaatacatgaat

SEQ ID NO: 7642272 - DNA, 22 bp, Homo sapiens
agaattagaggccatgtacttg

SEQ ID NO: 7642273 - DNA, 18 bp, Homo sapiens
agaattaccaaagtgctt

SEQ ID NO: 7642274 - DNA, 18 bp, Homo sapiens
agaattattcttgtcctc

SEQ ID NO: 7642275 - DNA, 18 bp, Homo sapiens
agaattattcttgtcctc

SEQ ID NO: 7642276 - DNA, 22 bp, Homo sapiens
agaattagtcacaattatagga

SEQ ID NO: 7642277 - DNA, 22 bp, Homo sapiens
agaattaggtaagttcatctga

SEQ ID NO: 7642278 - DNA, 22 bp, Homo sapiens
agaattagtcacaattatagga

SEQ ID NO: 7642279 - DNA, 22 bp, Homo sapiens
agaattcataggaagtttccta

SEQ ID NO: 7642280 - DNA, 22 bp, Homo sapiens
agaattcagaatgcatttctaa

SEQ ID NO: 7642281 - DNA, 22 bp, Homo sapiens
agaattcagaatgcatttctaa

SEQ ID NO: 7642282 - DNA, 22 bp, Homo sapiens
agaattcataggaagtttccta

SEQ ID NO: 7642283 - DNA, 23 bp, Homo sapiens
agaattccagtttcttatgtcac

SEQ ID NO: 7642284 - DNA, 18 bp, Homo sapiens
agaattattcttgtcctc

SEQ ID NO: 7642285 - DNA, 22 bp, Homo sapiens
agacacagaacacaaaagcata

SEQ ID NO: 7642286 - DNA, 22 bp, Homo sapiens
agacacagaacacaaaagcata

SEQ ID NO: 7642287 - DNA, 22 bp, Homo sapiens
agacacagaacacaaaagcata

SEQ ID NO: 7642288 - DNA, 22 bp, Homo sapiens
agacacagaacacaaaagcata

SEQ ID NO: 7642289 - DNA, 22 bp, Homo sapiens
agacacagaacacaaaagcata

SEQ ID NO: 7642290 - DNA, 19 bp, Homo sapiens
agacacacttacgtggaat

SEQ ID NO: 7642291 - DNA, 19 bp, Homo sapiens
agacacacttacgtggaat

SEQ ID NO: 7642292 - DNA, 19 bp, Homo sapiens
agacacacttacgtggaat

SEQ ID NO: 7642293 - DNA, 22 bp, Homo sapiens
agacaatttttggttttgcaag

SEQ ID NO: 7642294 - DNA, 19 bp, Homo sapiens
agacacacttacgtggaat

SEQ ID NO: 7642295 - DNA, 22 bp, Homo sapiens
agacaatttcaaagtaatatta

SEQ ID NO: 7642296 - DNA, 22 bp, Homo sapiens
agacaatttttggttttgcaag

SEQ ID NO: 7642297 - DNA, 22 bp, Homo sapiens
agacaatatataattttagttg

SEQ ID NO: 7642298 - DNA, 22 bp, Homo sapiens
agacaatatataattttagttg

SEQ ID NO: 7642299 - DNA, 22 bp, Homo sapiens
agacaatttcaaagtaatatta

SEQ ID NO: 7642300 - DNA, 22 bp, Homo sapiens
agacaatttcaaagtaatatta

SEQ ID NO: 7642301 - DNA, 22 bp, Homo sapiens
agacacagaagttgctgttggg

SEQ ID NO: 7642302 - DNA, 22 bp, Homo sapiens
agacacagaagttgctgttggg

SEQ ID NO: 7642303 - DNA, 22 bp, Homo sapiens
agacacagaagttgctgttggg

SEQ ID NO: 7642304 - DNA, 22 bp, Homo sapiens
agacacagatggtacctgagcc

SEQ ID NO: 7642305 - DNA, 22 bp, Homo sapiens
agacacagatggtacctgagcc

SEQ ID NO: 7642306 - DNA, 22 bp, Homo sapiens
agacacagatggtacctgagcc

SEQ ID NO: 7642307 - DNA, 22 bp, Homo sapiens
agacacagaagttgctgttggg

SEQ ID NO: 7642308 - DNA, 22 bp, Homo sapiens
agacacagaagttgctgttggg

SEQ ID NO: 7642309 - DNA, 22 bp, Homo sapiens
agacacagcagtgcctgcctca

SEQ ID NO: 7642310 - DNA, 22 bp, Homo sapiens
agacacagcaataactactgtt

SEQ ID NO: 7642311 - DNA, 22 bp, Homo sapiens
agacacagcaataactactgtt

SEQ ID NO: 7642312 - DNA, 22 bp, Homo sapiens
agacacagcaataactactgtt

SEQ ID NO: 7642313 - DNA, 22 bp, Homo sapiens
agacacagcaataactactgtt

SEQ ID NO: 7642314 - DNA, 22 bp, Homo sapiens
agacacagcaataactactgtt

SEQ ID NO: 7642315 - DNA, 22 bp, Homo sapiens
agacacagcaataactactgtt

SEQ ID NO: 7642316 - DNA, 22 bp, Homo sapiens
agacacagattttggaaaagat

SEQ ID NO: 7642317 - DNA, 22 bp, Homo sapiens
agacacagatggtacctgagcc

SEQ ID NO: 7642318 - DNA, 22 bp, Homo sapiens
agacacagatggtacctgagcc

SEQ ID NO: 7642319 - DNA, 22 bp, Homo sapiens
agacacagattttggaaaagat

SEQ ID NO: 7642320 - DNA, 22 bp, Homo sapiens
agacacagattttggaaaagat

SEQ ID NO: 7642321 - DNA, 22 bp, Homo sapiens
agaaggccctgtgtggtctgag

SEQ ID NO: 7642322 - DNA, 22 bp, Homo sapiens
agaaggccctgtgtggtctgag

SEQ ID NO: 7642323 - DNA, 22 bp, Homo sapiens
agaaggccagaaaattccttta

SEQ ID NO: 7642324 - DNA, 22 bp, Homo sapiens
agaaggccccatgaacactgca

SEQ ID NO: 7642325 - DNA, 22 bp, Homo sapiens
agaaggccccatgaacactgca

SEQ ID NO: 7642326 - DNA, 22 bp, Homo sapiens
agaaggccccatgaacactgca

SEQ ID NO: 7642327 - DNA, 22 bp, Homo sapiens
agaaggccagatggacggggct

SEQ ID NO: 7642328 - DNA, 22 bp, Homo sapiens
agaaggcctagagtaagacatt

SEQ ID NO: 7642329 - DNA, 22 bp, Homo sapiens
agaaggcctagagtaagacatt

SEQ ID NO: 7642330 - DNA, 22 bp, Homo sapiens
agaaggcctaacttgggggcaa

SEQ ID NO: 7642331 - DNA, 22 bp, Homo sapiens
agaaggcctaacttgggggcaa

SEQ ID NO: 7642332 - DNA, 22 bp, Homo sapiens
agaaggcctaacttgggggcaa

SEQ ID NO: 7642333 - DNA, 22 bp, Homo sapiens
agaaggctaaagtaacttagta

SEQ ID NO: 7642334 - DNA, 22 bp, Homo sapiens
agaaggctaaagtaacttagta

SEQ ID NO: 7642335 - DNA, 22 bp, Homo sapiens
agaaggctaaagtaacttagta

SEQ ID NO: 7642336 - DNA, 22 bp, Homo sapiens
agaaggctaaagaaacagattg

SEQ ID NO: 7642337 - DNA, 22 bp, Homo sapiens
agaaggctaaagaaacagattg

SEQ ID NO: 7642338 - DNA, 22 bp, Homo sapiens
agaaggctcactaagagtgact

SEQ ID NO: 7642339 - DNA, 22 bp, Homo sapiens
agaaggctcatccctcacccca

SEQ ID NO: 7642340 - DNA, 22 bp, Homo sapiens
agaaggctcatccctcacccca

SEQ ID NO: 7642341 - DNA, 22 bp, Homo sapiens
agaaggctcatttgactgcatt

SEQ ID NO: 7642342 - DNA, 22 bp, Homo sapiens
agaaggctcatttgactgcatt

SEQ ID NO: 7642343 - DNA, 22 bp, Homo sapiens
agaaggctagagacttgcccaa

SEQ ID NO: 7642344 - DNA, 22 bp, Homo sapiens
agaaggctagagacttgcccaa

SEQ ID NO: 7642345 - DNA, 22 bp, Homo sapiens
agaaggctcactaagagtgact

SEQ ID NO: 7642346 - DNA, 22 bp, Homo sapiens
agaaggctcactaagagtgact

SEQ ID NO: 7642347 - DNA, 22 bp, Homo sapiens
atctttagtagaggaatatatt

SEQ ID NO: 7642348 - DNA, 22 bp, Homo sapiens
atctttagtgtgaatttattga

SEQ ID NO: 7642349 - DNA, 22 bp, Homo sapiens
atctttagtgtgaatttattga

SEQ ID NO: 7642350 - DNA, 22 bp, Homo sapiens
atctttatatatctcctctgaa

SEQ ID NO: 7642351 - DNA, 22 bp, Homo sapiens
atctttatatatctcctctgaa

SEQ ID NO: 7642352 - DNA, 22 bp, Homo sapiens
atctttatatatctcctctgaa

SEQ ID NO: 7642353 - DNA, 21 bp, Homo sapiens
atctttattacgcagagaaga

SEQ ID NO: 7642354 - DNA, 22 bp, Homo sapiens
agaaggcatcagaagtgtgtag

SEQ ID NO: 7642355 - DNA, 21 bp, Homo sapiens
atctttattacgcagagaaga

SEQ ID NO: 7642356 - DNA, 21 bp, Homo sapiens
atctttattacgcagagaaga

SEQ ID NO: 7642357 - DNA, 22 bp, Homo sapiens
agaaggccagaaaattccttta

SEQ ID NO: 7642358 - DNA, 22 bp, Homo sapiens
agaaggccagatggacggggct

SEQ ID NO: 7642359 - DNA, 22 bp, Homo sapiens
agaaggccagatggacggggct

SEQ ID NO: 7642360 - DNA, 22 bp, Homo sapiens
agaaggccagatggacggggct

SEQ ID NO: 7642361 - DNA, 22 bp, Homo sapiens
agaaggccaatagggtgcactg

SEQ ID NO: 7642362 - DNA, 22 bp, Homo sapiens
agaaggccaatagggtgcactg

SEQ ID NO: 7642363 - DNA, 22 bp, Homo sapiens
agaaggccaagaagaagcctat

SEQ ID NO: 7642364 - DNA, 22 bp, Homo sapiens
agaaggccaagaagaagcctat

SEQ ID NO: 7642365 - DNA, 22 bp, Homo sapiens
agaaggccaagaagaagcctat

SEQ ID NO: 7642366 - DNA, 20 bp, Homo sapiens
agaaggcattcctcattctt

SEQ ID NO: 7642367 - DNA, 20 bp, Homo sapiens
agaaggcattcctcattctt

SEQ ID NO: 7642368 - DNA, 22 bp, Homo sapiens
agaagtttggtccttttcaagg

SEQ ID NO: 7642369 - DNA, 22 bp, Homo sapiens
agaagtttggtccttttcaagg

SEQ ID NO: 7642370 - DNA, 22 bp, Homo sapiens
agaaggctggccatggtgccct

SEQ ID NO: 7642371 - DNA, 22 bp, Homo sapiens
agaaggctggccatggtgccct

SEQ ID NO: 7642372 - DNA, 22 bp, Homo sapiens
agaaggctgagactgggatgaa

SEQ ID NO: 7642373 - DNA, 22 bp, Homo sapiens
agaaggctggccatggtgccct

SEQ ID NO: 7642374 - DNA, 22 bp, Homo sapiens
agaaggctgagactgggatgaa

SEQ ID NO: 7642375 - DNA, 22 bp, Homo sapiens
agaaggctgagactgggatgaa

SEQ ID NO: 7642376 - DNA, 22 bp, Homo sapiens
agaaggctggccatggtgccct

SEQ ID NO: 7642377 - DNA, 22 bp, Homo sapiens
agaaggctggccatggtgccct

SEQ ID NO: 7642378 - DNA, 22 bp, Homo sapiens
agaaggctggccatggtgccct

SEQ ID NO: 7642379 - DNA, 22 bp, Homo sapiens
agaaggctccaagtagagtttg

SEQ ID NO: 7642380 - DNA, 22 bp, Homo sapiens
agaaggctccaagtagagtttg

SEQ ID NO: 7642381 - DNA, 19 bp, Homo sapiens
agaaggctcctgttggaga

SEQ ID NO: 7642382 - DNA, 19 bp, Homo sapiens
agaaggctcctgttggaga

SEQ ID NO: 7642383 - DNA, 19 bp, Homo sapiens
agaaggctcctgttggaga

SEQ ID NO: 7642384 - DNA, 19 bp, Homo sapiens
agaaggctcctgttggaga

SEQ ID NO: 7642385 - DNA, 22 bp, Homo sapiens
agaaggctcatttgactgcatt

SEQ ID NO: 7642386 - DNA, 22 bp, Homo sapiens
agaaggctcatttgactgcatt

SEQ ID NO: 7642387 - DNA, 22 bp, Homo sapiens
agaaggctgagactgggatgaa

SEQ ID NO: 7642388 - DNA, 22 bp, Homo sapiens
agaaggctgagactgggatgaa

SEQ ID NO: 7642389 - DNA, 22 bp, Homo sapiens
agaaggctgaagaagatccgtt

SEQ ID NO: 7642390 - DNA, 22 bp, Homo sapiens
agaaggctgaagaagatccgtt

SEQ ID NO: 7642391 - DNA, 19 bp, Homo sapiens
agaaggctcctgttggaga

SEQ ID NO: 7642392 - DNA, 19 bp, Homo sapiens
agaaggctcctgttggaga

SEQ ID NO: 7642393 - DNA, 20 bp, Homo sapiens
agaaggctccttttgccaag

SEQ ID NO: 7642394 - DNA, 20 bp, Homo sapiens
agaaggctccttttgccaag

SEQ ID NO: 7642395 - DNA, 22 bp, Homo sapiens
agaagtttgttatgtaaacaaa

SEQ ID NO: 7642396 - DNA, 22 bp, Homo sapiens
agaagtttgttatgtaaacaaa

SEQ ID NO: 7642397 - DNA, 22 bp, Homo sapiens
agaagtttgttatgtaaacaaa

SEQ ID NO: 7642398 - DNA, 22 bp, Homo sapiens
agaagtttgttatgtaaacaaa

SEQ ID NO: 7642399 - DNA, 22 bp, Homo sapiens
agaatacaattgttcagtaata

SEQ ID NO: 7642400 - DNA, 22 bp, Homo sapiens
agaatacaattgttcagtaata

SEQ ID NO: 7642401 - DNA, 22 bp, Homo sapiens
agaatacaattgttcagtaata

SEQ ID NO: 7642402 - DNA, 22 bp, Homo sapiens
agaatacaattgttcagtaata

SEQ ID NO: 7642403 - DNA, 22 bp, Homo sapiens
agaatacaattgttcagtaata

SEQ ID NO: 7642404 - DNA, 22 bp, Homo sapiens
agaatacaattgttcagtaata

SEQ ID NO: 7642405 - DNA, 22 bp, Homo sapiens
agaatacaattgttcagtaata

SEQ ID NO: 7642406 - DNA, 22 bp, Homo sapiens
agaatacaattgttcagtaata

SEQ ID NO: 7642407 - DNA, 22 bp, Homo sapiens
agaatacagtatgcaaaaagat

SEQ ID NO: 7642408 - DNA, 22 bp, Homo sapiens
agaatacagtatgcaaaaagat

SEQ ID NO: 7642409 - DNA, 23 bp, Homo sapiens
agaatacaggctttgtataggca

SEQ ID NO: 7642410 - DNA, 22 bp, Homo sapiens
agaatacagtaggagcctgggc

SEQ ID NO: 7642411 - DNA, 22 bp, Homo sapiens
agaatacagtaggagcctgggc

SEQ ID NO: 7642412 - DNA, 19 bp, Homo sapiens
atctttgggtcctgaaggg

SEQ ID NO: 7642413 - DNA, 19 bp, Homo sapiens
atctttgggtcctgaaggg

SEQ ID NO: 7642414 - DNA, 19 bp, Homo sapiens
atctttgggtcctgaaggg

SEQ ID NO: 7642415 - DNA, 22 bp, Homo sapiens
atctttgggtacaaacttgcct

SEQ ID NO: 7642416 - DNA, 19 bp, Homo sapiens
atctttgggtcctgaaggg

SEQ ID NO: 7642417 - DNA, 22 bp, Homo sapiens
atctttggggcatccaggaaaa

SEQ ID NO: 7642418 - DNA, 22 bp, Homo sapiens
agaatataaagataattctgtt

SEQ ID NO: 7642419 - DNA, 22 bp, Homo sapiens
atctttgggcaatgatgaggga

SEQ ID NO: 7642420 - DNA, 22 bp, Homo sapiens
atctttgggtacaaacttgcct

SEQ ID NO: 7642421 - DNA, 22 bp, Homo sapiens
atctttgggtacaaacttgcct

SEQ ID NO: 7642422 - DNA, 22 bp, Homo sapiens
atctttggggcatccaggaaaa

SEQ ID NO: 7642423 - DNA, 22 bp, Homo sapiens
atctttggtactattcttatca

SEQ ID NO: 7642424 - DNA, 22 bp, Homo sapiens
atctttggtactattcttatca

SEQ ID NO: 7642425 - DNA, 22 bp, Homo sapiens
atctttggtactattcttatca

SEQ ID NO: 7642426 - DNA, 22 bp, Homo sapiens
atctttggtactattcttatca

SEQ ID NO: 7642427 - DNA, 22 bp, Homo sapiens
atctttggtcttgagtgcatct

SEQ ID NO: 7642428 - DNA, 22 bp, Homo sapiens
atctttggtactattcttatca

SEQ ID NO: 7642429 - DNA, 22 bp, Homo sapiens
atctttggtgcatgatactttg

SEQ ID NO: 7642430 - DNA, 22 bp, Homo sapiens
atctttggtgcatgatactttg

SEQ ID NO: 7642431 - DNA, 22 bp, Homo sapiens
atctttggtcttgagtgcatct

SEQ ID NO: 7642432 - DNA, 22 bp, Homo sapiens
atctttggtgcttggtgctccc

SEQ ID NO: 7642433 - DNA, 22 bp, Homo sapiens
atctttggtgcttggtgctccc

SEQ ID NO: 7642434 - DNA, 22 bp, Homo sapiens
atctttggtgcttggtgctccc

SEQ ID NO: 7642435 - DNA, 22 bp, Homo sapiens
atctttggtgcttggtgctccc

SEQ ID NO: 7642436 - DNA, 22 bp, Homo sapiens
atctttggtgcatgatactttg

SEQ ID NO: 7642437 - DNA, 22 bp, Homo sapiens
atctttggtgcatgatactttg

SEQ ID NO: 7642438 - DNA, 22 bp, Homo sapiens
atctttgtcactctactgtcta

SEQ ID NO: 7642439 - DNA, 22 bp, Homo sapiens
atctttgtcactctactgtcta

SEQ ID NO: 7642440 - DNA, 22 bp, Homo sapiens
atctttgtgaatctcaacttgg

SEQ ID NO: 7642441 - DNA, 22 bp, Homo sapiens
atctttgtgaatctcaacttgg

SEQ ID NO: 7642442 - DNA, 22 bp, Homo sapiens
agaatcactggaattgtttttt

SEQ ID NO: 7642443 - DNA, 22 bp, Homo sapiens
agaatcagatgaagactcctgc

SEQ ID NO: 7642444 - DNA, 22 bp, Homo sapiens
agaatataaagataattctgtt

SEQ ID NO: 7642445 - DNA, 22 bp, Homo sapiens
agaatagttttacttttctatg

SEQ ID NO: 7642446 - DNA, 22 bp, Homo sapiens
agaatagttttacttttctatg

SEQ ID NO: 7642447 - DNA, 22 bp, Homo sapiens
agaatataaagataattctgtt

SEQ ID NO: 7642448 - DNA, 22 bp, Homo sapiens
agaatagagaaaaaggttattt

SEQ ID NO: 7642449 - DNA, 22 bp, Homo sapiens
agaatagagaaaaaggttattt

SEQ ID NO: 7642450 - DNA, 22 bp, Homo sapiens
agaatagaattctcatagaatt

SEQ ID NO: 7642451 - DNA, 22 bp, Homo sapiens
agaatagaattctcatagaatt

SEQ ID NO: 7642452 - DNA, 22 bp, Homo sapiens
agaatagaattctcatagaatt

SEQ ID NO: 7642453 - DNA, 22 bp, Homo sapiens
agaatactaggcttcagaaagg

SEQ ID NO: 7642454 - DNA, 22 bp, Homo sapiens
agaatactaggcttcagaaagg

SEQ ID NO: 7642455 - DNA, 22 bp, Homo sapiens
agaatactaggcttcagaaagg

SEQ ID NO: 7642456 - DNA, 22 bp, Homo sapiens
agaatacttgggaatgggttaa

SEQ ID NO: 7642457 - DNA, 22 bp, Homo sapiens
agaataccataatatagaaaga

SEQ ID NO: 7642458 - DNA, 22 bp, Homo sapiens
agaatacccatcccttcaactc

SEQ ID NO: 7642459 - DNA, 22 bp, Homo sapiens
agaatactaggcttcagaaagg

SEQ ID NO: 7642460 - DNA, 22 bp, Homo sapiens
agaatactaggcttcagaaagg

SEQ ID NO: 7642461 - DNA, 22 bp, Homo sapiens
agaatactaggcttcagaaagg

SEQ ID NO: 7642462 - DNA, 22 bp, Homo sapiens
agaatactaggcttcagaaagg

SEQ ID NO: 7642463 - DNA, 22 bp, Homo sapiens
agaataccataatatagaaaga

SEQ ID NO: 7642464 - DNA, 22 bp, Homo sapiens
agaatacatctagtgctgcatg

SEQ ID NO: 7642465 - DNA, 22 bp, Homo sapiens
agaatacatctagtgctgcatg

SEQ ID NO: 7642466 - DNA, 22 bp, Homo sapiens
agaatacatctagtgctgcatg

SEQ ID NO: 7642467 - DNA, 22 bp, Homo sapiens
agaatacatctagtgctgcatg

SEQ ID NO: 7642468 - DNA, 22 bp, Homo sapiens
agaatacatctagtgctgcatg

SEQ ID NO: 7642469 - DNA, 22 bp, Homo sapiens
agaatacatcaatctattttct

SEQ ID NO: 7642470 - DNA, 22 bp, Homo sapiens
agaatacatcaatctattttct

SEQ ID NO: 7642471 - DNA, 22 bp, Homo sapiens
agaatacatcaatctattttct

SEQ ID NO: 7642472 - DNA, 22 bp, Homo sapiens
agaatacagttcagtaatggat

SEQ ID NO: 7642473 - DNA, 22 bp, Homo sapiens
agaatacagtatgcaaaaagat

SEQ ID NO: 7642474 - DNA, 22 bp, Homo sapiens
agaatacagtatgcaaaaagat

SEQ ID NO: 7642475 - DNA, 22 bp, Homo sapiens
agaatacagttcagtaatggat

SEQ ID NO: 7642476 - DNA, 22 bp, Homo sapiens
agaatacagttcagtaatggat

SEQ ID NO: 7642477 - DNA, 22 bp, Homo sapiens
agaatacagtatgcaaaaagat

SEQ ID NO: 7642478 - DNA, 22 bp, Homo sapiens
agaatacagtatgcaaaaagat

SEQ ID NO: 7642479 - DNA, 22 bp, Homo sapiens
agaatacagtatgcaaaaagat

SEQ ID NO: 7642480 - DNA, 22 bp, Homo sapiens
agaatacagtatgcaaaaagat

SEQ ID NO: 7642481 - DNA, 22 bp, Homo sapiens
agaatacagtatgcaaaaagat

SEQ ID NO: 7642482 - DNA, 22 bp, Homo sapiens
agaagattatgaattagagcag

SEQ ID NO: 7642483 - DNA, 22 bp, Homo sapiens
agaagattattagagactttgt

SEQ ID NO: 7642484 - DNA, 22 bp, Homo sapiens
agaagattattagagactttgt

SEQ ID NO: 7642485 - DNA, 22 bp, Homo sapiens
agaagattattagagactttgt

SEQ ID NO: 7642486 - DNA, 22 bp, Homo sapiens
agaagatgtcactgcagacagc

SEQ ID NO: 7642487 - DNA, 20 bp, Homo sapiens
agaagaggatacaaccaggc

SEQ ID NO: 7642488 - DNA, 20 bp, Homo sapiens
agaagaggatacaaccaggc

SEQ ID NO: 7642489 - DNA, 22 bp, Homo sapiens
agaagaggggtgtccctgtggc

SEQ ID NO: 7642490 - DNA, 22 bp, Homo sapiens
agaagaggggtgtccctgtggc

SEQ ID NO: 7642491 - DNA, 22 bp, Homo sapiens
agaagaggggtgtccctgtggc

SEQ ID NO: 7642492 - DNA, 22 bp, Homo sapiens
agaagagtagtaacagaaatta

SEQ ID NO: 7642493 - DNA, 20 bp, Homo sapiens
agaagaggatacaaccaggc

SEQ ID NO: 7642494 - DNA, 22 bp, Homo sapiens
agaagagtagtaacagaaatta

SEQ ID NO: 7642495 - DNA, 22 bp, Homo sapiens
agaagatgactttggagttgga

SEQ ID NO: 7642496 - DNA, 22 bp, Homo sapiens
agaagatgactttggagttgga

SEQ ID NO: 7642497 - DNA, 20 bp, Homo sapiens
agaagaggatacaaccaggc

SEQ ID NO: 7642498 - DNA, 20 bp, Homo sapiens
agaagaggatacaaccaggc

SEQ ID NO: 7642499 - DNA, 20 bp, Homo sapiens
agaagaggatacaaccaggc

SEQ ID NO: 7642500 - DNA, 20 bp, Homo sapiens
agaagaggatacaaccaggc

SEQ ID NO: 7642501 - DNA, 20 bp, Homo sapiens
agaagaggatacaaccaggc

SEQ ID NO: 7642502 - DNA, 22 bp, Homo sapiens
agaagagcctggggaccatggc

SEQ ID NO: 7642503 - DNA, 22 bp, Homo sapiens
agaagagcctggggaccatggc

SEQ ID NO: 7642504 - DNA, 22 bp, Homo sapiens
agaagagccctttaagggggaa

SEQ ID NO: 7642505 - DNA, 22 bp, Homo sapiens
agaagagccctttaagggggaa

SEQ ID NO: 7642506 - DNA, 21 bp, Homo sapiens
agaagagaagcaggaccctct

SEQ ID NO: 7642507 - DNA, 21 bp, Homo sapiens
agaagagaagcaggaccctct

SEQ ID NO: 7642508 - DNA, 21 bp, Homo sapiens
agaagagaagcaggaccctct

SEQ ID NO: 7642509 - DNA, 21 bp, Homo sapiens
agaagagaagcaggaccctct

SEQ ID NO: 7642510 - DNA, 21 bp, Homo sapiens
agaagagaagcaggaccctct

SEQ ID NO: 7642511 - DNA, 21 bp, Homo sapiens
agaagagaagcaggaccctct

SEQ ID NO: 7642512 - DNA, 21 bp, Homo sapiens
agaagagaagcaggaccctct

SEQ ID NO: 7642513 - DNA, 22 bp, Homo sapiens
agaagagagtcctaccccatac

SEQ ID NO: 7642514 - DNA, 22 bp, Homo sapiens
agaagagagtcctaccccatac

SEQ ID NO: 7642515 - DNA, 22 bp, Homo sapiens
agaagagagtcctaccccatac

SEQ ID NO: 7642516 - DNA, 22 bp, Homo sapiens
agaagagagtcctaccccatac

SEQ ID NO: 7642517 - DNA, 22 bp, Homo sapiens
agaagagagtcctaccccatac

SEQ ID NO: 7642518 - DNA, 22 bp, Homo sapiens
agaagagagtcctaccccatac

SEQ ID NO: 7642519 - DNA, 22 bp, Homo sapiens
agaagaatttctctcatgattt

SEQ ID NO: 7642520 - DNA, 22 bp, Homo sapiens
agaagaatttctctcatgattt

SEQ ID NO: 7642521 - DNA, 22 bp, Homo sapiens
agaagaatttctctcatgattt

SEQ ID NO: 7642522 - DNA, 22 bp, Homo sapiens
agaagaatacttgatgttcatg

SEQ ID NO: 7642523 - DNA, 22 bp, Homo sapiens
agaagaatacttgatgttcatg

SEQ ID NO: 7642524 - DNA, 22 bp, Homo sapiens
agaagaatacttgatgttcatg

SEQ ID NO: 7642525 - DNA, 22 bp, Homo sapiens
agaagaatacttgatgttcatg

SEQ ID NO: 7642526 - DNA, 22 bp, Homo sapiens
agaagaatacttgatgttcatg

SEQ ID NO: 7642527 - DNA, 22 bp, Homo sapiens
agaagaatacttgatgttcatg

SEQ ID NO: 7642528 - DNA, 22 bp, Homo sapiens
agaagaacttagctttctatct

SEQ ID NO: 7642529 - DNA, 22 bp, Homo sapiens
agaagaaatgtgaaggccactg

SEQ ID NO: 7642530 - DNA, 22 bp, Homo sapiens
agaagaaatgtgaaggccactg

SEQ ID NO: 7642531 - DNA, 22 bp, Homo sapiens
agaagaaatgtgaaggccactg

SEQ ID NO: 7642532 - DNA, 22 bp, Homo sapiens
agaagaaatgtgaaggccactg

SEQ ID NO: 7642533 - DNA, 22 bp, Homo sapiens
agaagaaatgtgaaggccactg

SEQ ID NO: 7642534 - DNA, 22 bp, Homo sapiens
agaagaaatgtgaaggccactg

SEQ ID NO: 7642535 - DNA, 22 bp, Homo sapiens
agaagaaatgtgaaggccactg

SEQ ID NO: 7642536 - DNA, 22 bp, Homo sapiens
agaagaaatgtgaaggccactg

SEQ ID NO: 7642537 - DNA, 22 bp, Homo sapiens
agaagagaactgccaaacactt

SEQ ID NO: 7642538 - DNA, 22 bp, Homo sapiens
agaagagaaatagtgccactgt

SEQ ID NO: 7642539 - DNA, 22 bp, Homo sapiens
agaagagaaatagtgccactgt

SEQ ID NO: 7642540 - DNA, 22 bp, Homo sapiens
agaagagaaatagtgccactgt

SEQ ID NO: 7642541 - DNA, 22 bp, Homo sapiens
agaagagaactgccaaacactt

SEQ ID NO: 7642542 - DNA, 22 bp, Homo sapiens
agaagagaactgccaaacactt

SEQ ID NO: 7642543 - DNA, 22 bp, Homo sapiens
agaagagaactgccaaacactt

SEQ ID NO: 7642544 - DNA, 22 bp, Homo sapiens
agaagagaactgccaaacactt

SEQ ID NO: 7642545 - DNA, 22 bp, Homo sapiens
agaagagaactgccaaacactt

SEQ ID NO: 7642546 - DNA, 22 bp, Homo sapiens
agaagagaactgccaaacactt

SEQ ID NO: 7642547 - DNA, 22 bp, Homo sapiens
agaagagaactgccaaacactt

SEQ ID NO: 7642548 - DNA, 22 bp, Homo sapiens
agaagacagagtctacattcta

SEQ ID NO: 7642549 - DNA, 22 bp, Homo sapiens
agaagacagagtctacattcta

SEQ ID NO: 7642550 - DNA, 22 bp, Homo sapiens
agaagacagagtctacattcta

SEQ ID NO: 7642551 - DNA, 22 bp, Homo sapiens
agaagacagagtctacattcta

SEQ ID NO: 7642552 - DNA, 22 bp, Homo sapiens
agaagacagagtctacattcta

SEQ ID NO: 7642553 - DNA, 22 bp, Homo sapiens
agaagacagagtctacattcta

SEQ ID NO: 7642554 - DNA, 22 bp, Homo sapiens
agaagaatttctctcatgattt

SEQ ID NO: 7642555 - DNA, 22 bp, Homo sapiens
agaagagaaatagtgccactgt

SEQ ID NO: 7642556 - DNA, 22 bp, Homo sapiens
agaagagaaatagtgccactgt

SEQ ID NO: 7642557 - DNA, 22 bp, Homo sapiens
agaagagaaatagtgccactgt

SEQ ID NO: 7642558 - DNA, 22 bp, Homo sapiens
agaagacagagtctacattcta

SEQ ID NO: 7642559 - DNA, 22 bp, Homo sapiens
agaagacagagtctacattcta

SEQ ID NO: 7642560 - DNA, 22 bp, Homo sapiens
agaagacagagtctacattcta

SEQ ID NO: 7642561 - DNA, 22 bp, Homo sapiens
atctttaggaacctaacctatt

SEQ ID NO: 7642562 - DNA, 22 bp, Homo sapiens
atctttagcattactttattca

SEQ ID NO: 7642563 - DNA, 22 bp, Homo sapiens
atctttaggcaagttacttaac

SEQ ID NO: 7642564 - DNA, 22 bp, Homo sapiens
atctttagcattactttattca

SEQ ID NO: 7642565 - DNA, 19 bp, Homo sapiens
atctttagcaactttcaaa

SEQ ID NO: 7642566 - DNA, 22 bp, Homo sapiens
atctttaggcaagttacttaac

SEQ ID NO: 7642567 - DNA, 22 bp, Homo sapiens
atctttaggcaagttacttaac

SEQ ID NO: 7642568 - DNA, 19 bp, Homo sapiens
atctttagggatgtggctt

SEQ ID NO: 7642569 - DNA, 22 bp, Homo sapiens
atctttagtagaggaatatatt

SEQ ID NO: 7642570 - DNA, 22 bp, Homo sapiens
atctttactttcagtgctgagc

SEQ ID NO: 7642571 - DNA, 22 bp, Homo sapiens
atctttaccaccaaagaatgct

SEQ ID NO: 7642572 - DNA, 22 bp, Homo sapiens
atctttagacaggaagcaatca

SEQ ID NO: 7642573 - DNA, 22 bp, Homo sapiens
atctttagcattactttattca

SEQ ID NO: 7642574 - DNA, 19 bp, Homo sapiens
atctttagcaactttcaaa

SEQ ID NO: 7642575 - DNA, 19 bp, Homo sapiens
atctttagcaactttcaaa

SEQ ID NO: 7642576 - DNA, 19 bp, Homo sapiens
atctttagcaactttcaaa

SEQ ID NO: 7642577 - DNA, 22 bp, Homo sapiens
atctttagattagaaactctaa

SEQ ID NO: 7642578 - DNA, 22 bp, Homo sapiens
atctttagagtcatctgagtgt

SEQ ID NO: 7642579 - DNA, 22 bp, Homo sapiens
atctttaatttggatcagggcc

SEQ ID NO: 7642580 - DNA, 22 bp, Homo sapiens
atctttaatttggatcagggcc

SEQ ID NO: 7642581 - DNA, 22 bp, Homo sapiens
atctttaatttggatcagggcc

SEQ ID NO: 7642582 - DNA, 22 bp, Homo sapiens
atctttaaagacatgtgaactt

SEQ ID NO: 7642583 - DNA, 22 bp, Homo sapiens
atctttacaagaaattctttta

SEQ ID NO: 7642584 - DNA, 22 bp, Homo sapiens
atctttacaagaaattctttta

SEQ ID NO: 7642585 - DNA, 22 bp, Homo sapiens
atctttacagtgtaagtgcaga

SEQ ID NO: 7642586 - DNA, 22 bp, Homo sapiens
atctttaccaccaaagaatgct

SEQ ID NO: 7642587 - DNA, 22 bp, Homo sapiens
atctttaccaccaaagaatgct

SEQ ID NO: 7642588 - DNA, 22 bp, Homo sapiens
atcttgttctcccttgttctta

SEQ ID NO: 7642589 - DNA, 18 bp, Homo sapiens
atcttgtttttggattaa

SEQ ID NO: 7642590 - DNA, 22 bp, Homo sapiens
atctttaaagacatgtgaactt

SEQ ID NO: 7642591 - DNA, 22 bp, Homo sapiens
atctttaaagacatgtgaactt

SEQ ID NO: 7642592 - DNA, 22 bp, Homo sapiens
atctttaaagacatgtgaactt

SEQ ID NO: 7642593 - DNA, 22 bp, Homo sapiens
atcttgttaaagtgcagattct

SEQ ID NO: 7642594 - DNA, 22 bp, Homo sapiens
atcttgttaaagtgcagatttt

SEQ ID NO: 7642595 - DNA, 22 bp, Homo sapiens
agaagatttaggttgacgctat

SEQ ID NO: 7642596 - DNA, 22 bp, Homo sapiens
agaagatttaggttgacgctat

SEQ ID NO: 7642597 - DNA, 22 bp, Homo sapiens
agaagcaaggtctgtcagtata

SEQ ID NO: 7642598 - DNA, 22 bp, Homo sapiens
agaagcaaggtctgtcagtata

SEQ ID NO: 7642599 - DNA, 22 bp, Homo sapiens
agaagatttaggttgacgctat

SEQ ID NO: 7642600 - DNA, 22 bp, Homo sapiens
agaagcaaggtctgtcagtata

SEQ ID NO: 7642601 - DNA, 23 bp, Homo sapiens
agaagcaatgctttttttcctct

SEQ ID NO: 7642602 - DNA, 23 bp, Homo sapiens
agaagcaatgctttttttcctct

SEQ ID NO: 7642603 - DNA, 18 bp, Homo sapiens
agaagcacaagatgtctt

SEQ ID NO: 7642604 - DNA, 18 bp, Homo sapiens
agaagcacaagatgtctt

SEQ ID NO: 7642605 - DNA, 22 bp, Homo sapiens
agaagcaaggtctgtcagtata

SEQ ID NO: 7642606 - DNA, 23 bp, Homo sapiens
agaagcaatgctttttttcctct

SEQ ID NO: 7642607 - DNA, 18 bp, Homo sapiens
agaagcacaagatgtctt

SEQ ID NO: 7642608 - DNA, 22 bp, Homo sapiens
agaagcacaccagtagacaggg

SEQ ID NO: 7642609 - DNA, 22 bp, Homo sapiens
agaagcacaccagtagacaggg

SEQ ID NO: 7642610 - DNA, 22 bp, Homo sapiens
agaagcacaccagtagacaggg

SEQ ID NO: 7642611 - DNA, 22 bp, Homo sapiens
agaagcacaccagtagacaggg

SEQ ID NO: 7642612 - DNA, 22 bp, Homo sapiens
agaagcacacctgacctctagc

SEQ ID NO: 7642613 - DNA, 22 bp, Homo sapiens
agaagcacacctgacctctagc

SEQ ID NO: 7642614 - DNA, 22 bp, Homo sapiens
agaagcacaggtaaagtgattt

SEQ ID NO: 7642615 - DNA, 22 bp, Homo sapiens
agaagcacaggtaaagtgattt

SEQ ID NO: 7642616 - DNA, 22 bp, Homo sapiens
agaagcacaggtaaagtgattt

SEQ ID NO: 7642617 - DNA, 22 bp, Homo sapiens
agaagcacaggtaaagtgattt

SEQ ID NO: 7642618 - DNA, 22 bp, Homo sapiens
agaagcacaggtaaagtgattt

SEQ ID NO: 7642619 - DNA, 22 bp, Homo sapiens
atcttatgttgtattcaaaatc

SEQ ID NO: 7642620 - DNA, 22 bp, Homo sapiens
atcttatgagacccataaagat

SEQ ID NO: 7642621 - DNA, 22 bp, Homo sapiens
atcttatgttgtattcaaaatc

SEQ ID NO: 7642622 - DNA, 22 bp, Homo sapiens
atcttatgagacccataaagat

SEQ ID NO: 7642623 - DNA, 19 bp, Homo sapiens
agaagcaccagtcattcct

SEQ ID NO: 7642624 - DNA, 19 bp, Homo sapiens
agaagcaccagtcattcct

SEQ ID NO: 7642625 - DNA, 22 bp, Homo sapiens
atcttgggccacaatgagccga

SEQ ID NO: 7642626 - DNA, 22 bp, Homo sapiens
atcttgggccacaatgagccga

SEQ ID NO: 7642627 - DNA, 20 bp, Homo sapiens
atcttgggattgagattgcc

SEQ ID NO: 7642628 - DNA, 20 bp, Homo sapiens
atcttgggattgagattgcc

SEQ ID NO: 7642629 - DNA, 22 bp, Homo sapiens
atcttattgctgttgccagata

SEQ ID NO: 7642630 - DNA, 22 bp, Homo sapiens
atcttgggcccctgtaagatgg

SEQ ID NO: 7642631 - DNA, 22 bp, Homo sapiens
atcttggggactgtctcttgta

SEQ ID NO: 7642632 - DNA, 22 bp, Homo sapiens
atcttgtgactggtttttaaat

SEQ ID NO: 7642633 - DNA, 22 bp, Homo sapiens
atcttgtgactggtttttaaat

SEQ ID NO: 7642634 - DNA, 22 bp, Homo sapiens
atcttgtgctgacaaaacacat

SEQ ID NO: 7642635 - DNA, 22 bp, Homo sapiens
atcttgtgtgatgatgagaaag

SEQ ID NO: 7642636 - DNA, 22 bp, Homo sapiens
atcttgttaaaaagcagattct

SEQ ID NO: 7642637 - DNA, 22 bp, Homo sapiens
atcttggtgcgacaacaaacta

SEQ ID NO: 7642638 - DNA, 22 bp, Homo sapiens
atcttgttaaaatgcagaaact

SEQ ID NO: 7642639 - DNA, 22 bp, Homo sapiens
atcttgttaaaatgcagattct

SEQ ID NO: 7642640 - DNA, 22 bp, Homo sapiens
attctgtatttctaataagatc

SEQ ID NO: 7642641 - DNA, 22 bp, Homo sapiens
attctgtatttctaataagatc

SEQ ID NO: 7642642 - DNA, 22 bp, Homo sapiens
attctgtatggggaaactagag

SEQ ID NO: 7642643 - DNA, 22 bp, Homo sapiens
attctgtatggggaaactagag

SEQ ID NO: 7642644 - DNA, 22 bp, Homo sapiens
attctgtatggggaaactagag

SEQ ID NO: 7642645 - DNA, 22 bp, Homo sapiens
attctgtatttggatataaggg

SEQ ID NO: 7642646 - DNA, 22 bp, Homo sapiens
attctgtatttggatataaggg

SEQ ID NO: 7642647 - DNA, 21 bp, Homo sapiens
agagggagagtggcccttcca

SEQ ID NO: 7642648 - DNA, 21 bp, Homo sapiens
agagggagagtggcccttcca

SEQ ID NO: 7642649 - DNA, 21 bp, Homo sapiens
agagggagagtggcccttcca

SEQ ID NO: 7642650 - DNA, 22 bp, Homo sapiens
attctgtcagatcttactggat

SEQ ID NO: 7642651 - DNA, 21 bp, Homo sapiens
agagggagagtggcccttcca

SEQ ID NO: 7642652 - DNA, 23 bp, Homo sapiens
agagggagatgtttttctcaaga

SEQ ID NO: 7642653 - DNA, 23 bp, Homo sapiens
agagggagatgtttttctcaaga

SEQ ID NO: 7642654 - DNA, 23 bp, Homo sapiens
agagggagatgtttttctcaaga

SEQ ID NO: 7642655 - DNA, 23 bp, Homo sapiens
agagggagatgtttttctcaaga

SEQ ID NO: 7642656 - DNA, 23 bp, Homo sapiens
agagggagatgtttttctcaaga

SEQ ID NO: 7642657 - DNA, 21 bp, Homo sapiens
agagggagagtggcccttcca

SEQ ID NO: 7642658 - DNA, 21 bp, Homo sapiens
agagggagagtggcccttcca

SEQ ID NO: 7642659 - DNA, 22 bp, Homo sapiens
attctgtagggcttgctgacac

SEQ ID NO: 7642660 - DNA, 22 bp, Homo sapiens
attctgtatggaaaagcactat

SEQ ID NO: 7642661 - DNA, 22 bp, Homo sapiens
attctgtatggaaaagcactat

SEQ ID NO: 7642662 - DNA, 22 bp, Homo sapiens
attctgtaattgaactgtgttg

SEQ ID NO: 7642663 - DNA, 22 bp, Homo sapiens
attctgggtttttgtcttctgt

SEQ ID NO: 7642664 - DNA, 22 bp, Homo sapiens
attctgggttcatgagtgagct

SEQ ID NO: 7642665 - DNA, 22 bp, Homo sapiens
attctgggtgactacgtgatca

SEQ ID NO: 7642666 - DNA, 22 bp, Homo sapiens
attctggggctggttattttga

SEQ ID NO: 7642667 - DNA, 22 bp, Homo sapiens
attctgggtctgggtgtgatca

SEQ ID NO: 7642668 - DNA, 22 bp, Homo sapiens
attctgggcaagccttcttata

SEQ ID NO: 7642669 - DNA, 22 bp, Homo sapiens
attctgggcgcctatggctgca

SEQ ID NO: 7642670 - DNA, 22 bp, Homo sapiens
attctgggcgcctatggctgca

SEQ ID NO: 7642671 - DNA, 22 bp, Homo sapiens
attctctgtgcagatttaagac

SEQ ID NO: 7642672 - DNA, 22 bp, Homo sapiens
attctctgtggtgatgctggtg

SEQ ID NO: 7642673 - DNA, 22 bp, Homo sapiens
attctggacaaggcaagctcct

SEQ ID NO: 7642674 - DNA, 22 bp, Homo sapiens
attctctgttcaaggatggtga

SEQ ID NO: 7642675 - DNA, 22 bp, Homo sapiens
attctggacaaggcaagctcct

SEQ ID NO: 7642676 - DNA, 22 bp, Homo sapiens
attctggacaaggcaagctcct

SEQ ID NO: 7642677 - DNA, 22 bp, Homo sapiens
attctggaattctaagattctg

SEQ ID NO: 7642678 - DNA, 22 bp, Homo sapiens
attcagggaggaaaggggcctc

SEQ ID NO: 7642679 - DNA, 22 bp, Homo sapiens
attcagcttcaatgtcttcacc

SEQ ID NO: 7642680 - DNA, 22 bp, Homo sapiens
attcagctgatggtatttaaat

SEQ ID NO: 7642681 - DNA, 22 bp, Homo sapiens
attcagctgatggtatttaaat

SEQ ID NO: 7642682 - DNA, 22 bp, Homo sapiens
attcagcattggcaccatggat

SEQ ID NO: 7642683 - DNA, 22 bp, Homo sapiens
attcagcattggcaccatggat

SEQ ID NO: 7642684 - DNA, 22 bp, Homo sapiens
attcagctctgaatcagcagac

SEQ ID NO: 7642685 - DNA, 22 bp, Homo sapiens
attcagctgactttgattcatt

SEQ ID NO: 7642686 - DNA, 22 bp, Homo sapiens
attctgggaactttgtctctca

SEQ ID NO: 7642687 - DNA, 22 bp, Homo sapiens
attctgggagtgtaggatggtt

SEQ ID NO: 7642688 - DNA, 22 bp, Homo sapiens
attctggccttggctctgtcac

SEQ ID NO: 7642689 - DNA, 22 bp, Homo sapiens
attctgggaactttgtctctca

SEQ ID NO: 7642690 - DNA, 22 bp, Homo sapiens
attctgggaactttgtctctca

SEQ ID NO: 7642691 - DNA, 22 bp, Homo sapiens
attctggattatcagtccacca

SEQ ID NO: 7642692 - DNA, 22 bp, Homo sapiens
attctggattatcagtccacca

SEQ ID NO: 7642693 - DNA, 22 bp, Homo sapiens
attctggatattacttatctat

SEQ ID NO: 7642694 - DNA, 22 bp, Homo sapiens
attctggattatcagtccacca

SEQ ID NO: 7642695 - DNA, 22 bp, Homo sapiens
attctggacaatgagaaactgg

SEQ ID NO: 7642696 - DNA, 22 bp, Homo sapiens
attctggatattacttatctat

SEQ ID NO: 7642697 - DNA, 22 bp, Homo sapiens
attctggacaatgagaaactgg

SEQ ID NO: 7642698 - DNA, 22 bp, Homo sapiens
attctggacaaggcaagctcct

SEQ ID NO: 7642699 - DNA, 22 bp, Homo sapiens
attctggacaaggcaagctcct

SEQ ID NO: 7642700 - DNA, 22 bp, Homo sapiens
attctggacaatgagaaactgg

SEQ ID NO: 7642701 - DNA, 22 bp, Homo sapiens
attctggacaaggcaagctcct

SEQ ID NO: 7642702 - DNA, 22 bp, Homo sapiens
attctggacaatgagaaactgg

SEQ ID NO: 7642703 - DNA, 22 bp, Homo sapiens
attctggacaatgagaaactgg

SEQ ID NO: 7642704 - DNA, 22 bp, Homo sapiens
agagggcaagtgtagtccagta

SEQ ID NO: 7642705 - DNA, 22 bp, Homo sapiens
agagggatcaccctgtttctgg

SEQ ID NO: 7642706 - DNA, 22 bp, Homo sapiens
agagggatcaccctgtttctgg

SEQ ID NO: 7642707 - DNA, 22 bp, Homo sapiens
agagggagtgaaatggaataga

SEQ ID NO: 7642708 - DNA, 22 bp, Homo sapiens
agagggagtgaaatggaataga

SEQ ID NO: 7642709 - DNA, 22 bp, Homo sapiens
agagggagtgaaatggaataga

SEQ ID NO: 7642710 - DNA, 22 bp, Homo sapiens
agagggagtgaaatggaataga

SEQ ID NO: 7642711 - DNA, 22 bp, Homo sapiens
agagggatcaccctgtttctgg

SEQ ID NO: 7642712 - DNA, 22 bp, Homo sapiens
agagggatcaccctgtttctgg

SEQ ID NO: 7642713 - DNA, 22 bp, Homo sapiens
agagggatcaccctgtttctgg

SEQ ID NO: 7642714 - DNA, 22 bp, Homo sapiens
agagggatcaccctgtttctgg

SEQ ID NO: 7642715 - DNA, 22 bp, Homo sapiens
agagggatcaccctgtttctgg

SEQ ID NO: 7642716 - DNA, 22 bp, Homo sapiens
agagggatcaccctgtttctgg

SEQ ID NO: 7642717 - DNA, 22 bp, Homo sapiens
agagggagctttatttttctgt

SEQ ID NO: 7642718 - DNA, 22 bp, Homo sapiens
agagggagcccagtcatagctg

SEQ ID NO: 7642719 - DNA, 22 bp, Homo sapiens
agagggagctttatttttctgt

SEQ ID NO: 7642720 - DNA, 22 bp, Homo sapiens
agagggagctttatttttctgt

SEQ ID NO: 7642721 - DNA, 22 bp, Homo sapiens
agagggagctttatttttctgt

SEQ ID NO: 7642722 - DNA, 22 bp, Homo sapiens
agagggagctttatttttctgt

SEQ ID NO: 7642723 - DNA, 22 bp, Homo sapiens
agagggagtgaaatggaataga

SEQ ID NO: 7642724 - DNA, 22 bp, Homo sapiens
agagggagtgaaatggaataga

SEQ ID NO: 7642725 - DNA, 22 bp, Homo sapiens
agagggagtgaaatggaataga

SEQ ID NO: 7642726 - DNA, 22 bp, Homo sapiens
agagggagtgaaatggaataga

SEQ ID NO: 7642727 - DNA, 22 bp, Homo sapiens
agagggagtgaaatggaataga

SEQ ID NO: 7642728 - DNA, 22 bp, Homo sapiens
agagggagcccagtcatagctg

SEQ ID NO: 7642729 - DNA, 22 bp, Homo sapiens
agagggagcccagtcatagctg

SEQ ID NO: 7642730 - DNA, 22 bp, Homo sapiens
agagggagcccagtcatagctg

SEQ ID NO: 7642731 - DNA, 23 bp, Homo sapiens
agagggagatgtttttctcaaga

SEQ ID NO: 7642732 - DNA, 23 bp, Homo sapiens
agagggagatgtttttctcaaga

SEQ ID NO: 7642733 - DNA, 22 bp, Homo sapiens
agagggagcccagtcatagctg

SEQ ID NO: 7642734 - DNA, 22 bp, Homo sapiens
agagggagcccagtcatagctg

SEQ ID NO: 7642735 - DNA, 22 bp, Homo sapiens
agagggagcccagtcatagctg

SEQ ID NO: 7642736 - DNA, 22 bp, Homo sapiens
agagggagcccagtcatagctg

SEQ ID NO: 7642737 - DNA, 22 bp, Homo sapiens
agagggagcccagtcatagctg

SEQ ID NO: 7642738 - DNA, 22 bp, Homo sapiens
agagggagcccagtcatagctg

SEQ ID NO: 7642739 - DNA, 22 bp, Homo sapiens
agagggtgctggagagacattg

SEQ ID NO: 7642740 - DNA, 22 bp, Homo sapiens
agagggtgctggagagacattg

SEQ ID NO: 7642741 - DNA, 22 bp, Homo sapiens
agagggtgctggagagacattg

SEQ ID NO: 7642742 - DNA, 22 bp, Homo sapiens
agagggtgctggagagacattg

SEQ ID NO: 7642743 - DNA, 22 bp, Homo sapiens
agagggtgctggagagacattg

SEQ ID NO: 7642744 - DNA, 23 bp, Homo sapiens
agagggtgcaacatggggatcta

SEQ ID NO: 7642745 - DNA, 23 bp, Homo sapiens
agagggtgcaacatggggatcta

SEQ ID NO: 7642746 - DNA, 23 bp, Homo sapiens
agagggtgcaacatggggatcta

SEQ ID NO: 7642747 - DNA, 23 bp, Homo sapiens
agagggtgcaacatggggatcta

SEQ ID NO: 7642748 - DNA, 23 bp, Homo sapiens
agagggtgcaacatggggatcta

SEQ ID NO: 7642749 - DNA, 22 bp, Homo sapiens
agagggtgagcaggtacacatg

SEQ ID NO: 7642750 - DNA, 22 bp, Homo sapiens
agagggtgagcaggtacacatg

SEQ ID NO: 7642751 - DNA, 22 bp, Homo sapiens
agagggtgagcaggtacacatg

SEQ ID NO: 7642752 - DNA, 22 bp, Homo sapiens
agagggtgagcaggtacacatg

SEQ ID NO: 7642753 - DNA, 22 bp, Homo sapiens
agagggtgggcacgtgatggat

SEQ ID NO: 7642754 - DNA, 22 bp, Homo sapiens
agagggtgggcacgtgatggat

SEQ ID NO: 7642755 - DNA, 22 bp, Homo sapiens
agagggtgggcacgtgatggat

SEQ ID NO: 7642756 - DNA, 22 bp, Homo sapiens
agagggtgggcacgtgatggat

SEQ ID NO: 7642757 - DNA, 22 bp, Homo sapiens
agagggtgggcacgtgatggat

SEQ ID NO: 7642758 - DNA, 22 bp, Homo sapiens
agagggtgggcacgtgatggat

SEQ ID NO: 7642759 - DNA, 22 bp, Homo sapiens
agagggtgctggagagacattg

SEQ ID NO: 7642760 - DNA, 22 bp, Homo sapiens
agagggtgctggagagacattg

SEQ ID NO: 7642761 - DNA, 22 bp, Homo sapiens
agagggtgctggagagacattg

SEQ ID NO: 7642762 - DNA, 22 bp, Homo sapiens
agaggggctcatatcctgtcat

SEQ ID NO: 7642763 - DNA, 22 bp, Homo sapiens
agaggggctcatatcctgtcat

SEQ ID NO: 7642764 - DNA, 22 bp, Homo sapiens
agagggcagcagcaacaactct

SEQ ID NO: 7642765 - DNA, 22 bp, Homo sapiens
agagggcaagtgtagtccagta

SEQ ID NO: 7642766 - DNA, 22 bp, Homo sapiens
agagggcagcagcaacaactct

SEQ ID NO: 7642767 - DNA, 22 bp, Homo sapiens
agagggcagcagcaacaactct

SEQ ID NO: 7642768 - DNA, 22 bp, Homo sapiens
agaggggctcatatcctgtcat

SEQ ID NO: 7642769 - DNA, 22 bp, Homo sapiens
agaggggctcatatcctgtcat

SEQ ID NO: 7642770 - DNA, 22 bp, Homo sapiens
agaggggctcatatcctgtcat

SEQ ID NO: 7642771 - DNA, 22 bp, Homo sapiens
agaggggctcatatcctgtcat

SEQ ID NO: 7642772 - DNA, 22 bp, Homo sapiens
agaggggctcatatcctgtcat

SEQ ID NO: 7642773 - DNA, 22 bp, Homo sapiens
agagggtgaatgagatagaaaa

SEQ ID NO: 7642774 - DNA, 22 bp, Homo sapiens
agagggtgaatgagatagaaaa

SEQ ID NO: 7642775 - DNA, 22 bp, Homo sapiens
agagggtgaatgagatagaaaa

SEQ ID NO: 7642776 - DNA, 22 bp, Homo sapiens
agagggtgaatgagatagaaaa

SEQ ID NO: 7642777 - DNA, 22 bp, Homo sapiens
agagggtgaatgagatagaaaa

SEQ ID NO: 7642778 - DNA, 22 bp, Homo sapiens
agagggtgaatgagatagaaaa

SEQ ID NO: 7642779 - DNA, 22 bp, Homo sapiens
agagggtagaagacagggttgc

SEQ ID NO: 7642780 - DNA, 22 bp, Homo sapiens
agagggtatgagtggggctaaa

SEQ ID NO: 7642781 - DNA, 22 bp, Homo sapiens
agagggtgaatgagatagaaaa

SEQ ID NO: 7642782 - DNA, 22 bp, Homo sapiens
attataaagaacatgtgtgtgg

SEQ ID NO: 7642783 - DNA, 22 bp, Homo sapiens
attataaagaacatgtgtgtgg

SEQ ID NO: 7642784 - DNA, 22 bp, Homo sapiens
attataaagaacatgtgtgtgg

SEQ ID NO: 7642785 - DNA, 22 bp, Homo sapiens
attataaagaacatgtgtgtgg

SEQ ID NO: 7642786 - DNA, 22 bp, Homo sapiens
attataaagaacatgtgtgtgg

SEQ ID NO: 7642787 - DNA, 22 bp, Homo sapiens
attataaagaacatgtgtgtgg

SEQ ID NO: 7642788 - DNA, 22 bp, Homo sapiens
attataaagaacatgtgtgtgg

SEQ ID NO: 7642789 - DNA, 22 bp, Homo sapiens
attataaagaacatgtgtgtgg

SEQ ID NO: 7642790 - DNA, 22 bp, Homo sapiens
attataaagaacatgtgtgtgg

SEQ ID NO: 7642791 - DNA, 22 bp, Homo sapiens
attataaagaacatgtgtgtgg

SEQ ID NO: 7642792 - DNA, 22 bp, Homo sapiens
attataaagaacatgtgtgtgg

SEQ ID NO: 7642793 - DNA, 22 bp, Homo sapiens
attataaagaacatgtgtgtgg

SEQ ID NO: 7642794 - DNA, 22 bp, Homo sapiens
attataaagaacatgtgtgtgg

SEQ ID NO: 7642795 - DNA, 22 bp, Homo sapiens
attataaagaacatgtgtgtgg

SEQ ID NO: 7642796 - DNA, 22 bp, Homo sapiens
attataaagaacatgtgtgtgg

SEQ ID NO: 7642797 - DNA, 22 bp, Homo sapiens
attataaacctttgagggtggg

SEQ ID NO: 7642798 - DNA, 22 bp, Homo sapiens
attataaacctttgagggtggg

SEQ ID NO: 7642799 - DNA, 22 bp, Homo sapiens
attataaacctttgagggtggg

SEQ ID NO: 7642800 - DNA, 22 bp, Homo sapiens
attataaacctttgagggtggg

SEQ ID NO: 7642801 - DNA, 22 bp, Homo sapiens
attataaatattttctaggggt

SEQ ID NO: 7642802 - DNA, 22 bp, Homo sapiens
attataaatattttctaggggt

SEQ ID NO: 7642803 - DNA, 22 bp, Homo sapiens
attataaatattttctaggggt

SEQ ID NO: 7642804 - DNA, 22 bp, Homo sapiens
attatacaaggctggtgcctaa

SEQ ID NO: 7642805 - DNA, 22 bp, Homo sapiens
attatacaaggctggtgcctaa

SEQ ID NO: 7642806 - DNA, 22 bp, Homo sapiens
attataaatattttctaggggt

SEQ ID NO: 7642807 - DNA, 22 bp, Homo sapiens
attataaatattttctaggggt

SEQ ID NO: 7642808 - DNA, 22 bp, Homo sapiens
attataaatattttctaggggt

SEQ ID NO: 7642809 - DNA, 22 bp, Homo sapiens
attataaagaacatgtgtgtgg

SEQ ID NO: 7642810 - DNA, 22 bp, Homo sapiens
attataaatattttctaggggt

SEQ ID NO: 7642811 - DNA, 22 bp, Homo sapiens
attataaatattttctaggggt

SEQ ID NO: 7642812 - DNA, 22 bp, Homo sapiens
attataaatattttctaggggt

SEQ ID NO: 7642813 - DNA, 22 bp, Homo sapiens
attatacattttgtgtagagat

SEQ ID NO: 7642814 - DNA, 22 bp, Homo sapiens
attatacattttgtgtagagat

SEQ ID NO: 7642815 - DNA, 22 bp, Homo sapiens
attatacattttgtgtagagat

SEQ ID NO: 7642816 - DNA, 22 bp, Homo sapiens
attatacattttgtgtagagat

SEQ ID NO: 7642817 - DNA, 22 bp, Homo sapiens
attatacattttgtgtagagat

SEQ ID NO: 7642818 - DNA, 22 bp, Homo sapiens
attatacattttgtgtagagat

SEQ ID NO: 7642819 - DNA, 22 bp, Homo sapiens
attatacattttgtgtagagat

SEQ ID NO: 7642820 - DNA, 22 bp, Homo sapiens
attcacactttacttctttcca

SEQ ID NO: 7642821 - DNA, 22 bp, Homo sapiens
attcacactttacttctttcca

SEQ ID NO: 7642822 - DNA, 22 bp, Homo sapiens
attcacagaatagttttaccag

SEQ ID NO: 7642823 - DNA, 22 bp, Homo sapiens
attcacagaatagttttaccag

SEQ ID NO: 7642824 - DNA, 22 bp, Homo sapiens
attcacagaatagttttaccag

SEQ ID NO: 7642825 - DNA, 22 bp, Homo sapiens
attcacagaatagttttaccag

SEQ ID NO: 7642826 - DNA, 22 bp, Homo sapiens
attcacagagtggttagtggta

SEQ ID NO: 7642827 - DNA, 22 bp, Homo sapiens
attcacagagtggttagtggta

SEQ ID NO: 7642828 - DNA, 20 bp, Homo sapiens
attcacaggcacaaaaccct

SEQ ID NO: 7642829 - DNA, 22 bp, Homo sapiens
attcacagagtggttagtggta

SEQ ID NO: 7642830 - DNA, 22 bp, Homo sapiens
attcacagagtggttagtggta

SEQ ID NO: 7642831 - DNA, 22 bp, Homo sapiens
attcacagagtggttagtggta

SEQ ID NO: 7642832 - DNA, 22 bp, Homo sapiens
attcacactgtatacacaggat

SEQ ID NO: 7642833 - DNA, 22 bp, Homo sapiens
attcacactgtatacacaggat

SEQ ID NO: 7642834 - DNA, 22 bp, Homo sapiens
attcacactgtatacacaggat

SEQ ID NO: 7642835 - DNA, 22 bp, Homo sapiens
attcacactgtatacacaggat

SEQ ID NO: 7642836 - DNA, 22 bp, Homo sapiens
attcacactgtatacacaggat

SEQ ID NO: 7642837 - DNA, 22 bp, Homo sapiens
attcaaagtaataaccagaact

SEQ ID NO: 7642838 - DNA, 22 bp, Homo sapiens
attcacaattagaagtagataa

SEQ ID NO: 7642839 - DNA, 22 bp, Homo sapiens
attcacaattagaagtagataa

SEQ ID NO: 7642840 - DNA, 22 bp, Homo sapiens
attcaaagtaataaccagaact

SEQ ID NO: 7642841 - DNA, 22 bp, Homo sapiens
attcaaagtaataaccagaact

SEQ ID NO: 7642842 - DNA, 22 bp, Homo sapiens
attcaaagtaataaccagaact

SEQ ID NO: 7642843 - DNA, 22 bp, Homo sapiens
attcacaattagaagtagataa

SEQ ID NO: 7642844 - DNA, 22 bp, Homo sapiens
attcacaattagaagtagataa

SEQ ID NO: 7642845 - DNA, 22 bp, Homo sapiens
attcacaattagaagtagataa

SEQ ID NO: 7642846 - DNA, 22 bp, Homo sapiens
attcaaagcccagtaaacattg

SEQ ID NO: 7642847 - DNA, 22 bp, Homo sapiens
attcaaagcccagtaaacattg

SEQ ID NO: 7642848 - DNA, 22 bp, Homo sapiens
attcaaagcccagtaaacattg

SEQ ID NO: 7642849 - DNA, 22 bp, Homo sapiens
attcaaagcccagtaaacattg

SEQ ID NO: 7642850 - DNA, 22 bp, Homo sapiens
attatagagggttacagttaat

SEQ ID NO: 7642851 - DNA, 22 bp, Homo sapiens
attcaaagatcatgatctctac

SEQ ID NO: 7642852 - DNA, 22 bp, Homo sapiens
attatagagggttacagttaat

SEQ ID NO: 7642853 - DNA, 22 bp, Homo sapiens
attatagagggttacagttaat

SEQ ID NO: 7642854 - DNA, 22 bp, Homo sapiens
attcagcaaacatttattatct

SEQ ID NO: 7642855 - DNA, 22 bp, Homo sapiens
attcagcaaacatttattatct

SEQ ID NO: 7642856 - DNA, 22 bp, Homo sapiens
attcagcaaacatttattgtgt

SEQ ID NO: 7642857 - DNA, 22 bp, Homo sapiens
attcagcaaacatttattatct

SEQ ID NO: 7642858 - DNA, 22 bp, Homo sapiens
attcagattggtttaagctagt

SEQ ID NO: 7642859 - DNA, 22 bp, Homo sapiens
attcagcaaacatttattatct

SEQ ID NO: 7642860 - DNA, 22 bp, Homo sapiens
attcagatcatatttatagctt

SEQ ID NO: 7642861 - DNA, 22 bp, Homo sapiens
attcagattggtttaagctagt

SEQ ID NO: 7642862 - DNA, 22 bp, Homo sapiens
attcagattggtttaagctagt

SEQ ID NO: 7642863 - DNA, 22 bp, Homo sapiens
attcagcacaatttggccaata

SEQ ID NO: 7642864 - DNA, 22 bp, Homo sapiens
attcagcacaatttggccaata

SEQ ID NO: 7642865 - DNA, 22 bp, Homo sapiens
attcagcaagctatgggacagg

SEQ ID NO: 7642866 - DNA, 22 bp, Homo sapiens
attcagcaaacatttattgtgt

SEQ ID NO: 7642867 - DNA, 22 bp, Homo sapiens
attcagcaaacatttattgtgt

SEQ ID NO: 7642868 - DNA, 22 bp, Homo sapiens
attcagcattcatttccaactt

SEQ ID NO: 7642869 - DNA, 22 bp, Homo sapiens
attcagcattcatttccaactt

SEQ ID NO: 7642870 - DNA, 22 bp, Homo sapiens
attcagcattcattatgcgcca

SEQ ID NO: 7642871 - DNA, 22 bp, Homo sapiens
attcagcatgcaattaggtaat

SEQ ID NO: 7642872 - DNA, 22 bp, Homo sapiens
attcagcataatcagtagcttg

SEQ ID NO: 7642873 - DNA, 22 bp, Homo sapiens
attcagcacatctttgtacagc

SEQ ID NO: 7642874 - DNA, 22 bp, Homo sapiens
attcagcacatctttgtacagc

SEQ ID NO: 7642875 - DNA, 22 bp, Homo sapiens
attcagcagttcctgcttcagt

SEQ ID NO: 7642876 - DNA, 22 bp, Homo sapiens
attcagcagttcctgcttcagt

SEQ ID NO: 7642877 - DNA, 22 bp, Homo sapiens
attcagcagttcctgcttcagt

SEQ ID NO: 7642878 - DNA, 22 bp, Homo sapiens
attcagcagttcctgcttcagt

SEQ ID NO: 7642879 - DNA, 22 bp, Homo sapiens
attcagcataatcagtagcttg

SEQ ID NO: 7642880 - DNA, 22 bp, Homo sapiens
attcacagtatggacgaaatga

SEQ ID NO: 7642881 - DNA, 21 bp, Homo sapiens
attcacaggtatcctctccct

SEQ ID NO: 7642882 - DNA, 21 bp, Homo sapiens
attcacaggtatcctctccct

SEQ ID NO: 7642883 - DNA, 22 bp, Homo sapiens
attcacagtatggacgaaatga

SEQ ID NO: 7642884 - DNA, 22 bp, Homo sapiens
attcacagtatggacgaaatga

SEQ ID NO: 7642885 - DNA, 22 bp, Homo sapiens
attcacagtatggacgaaatga

SEQ ID NO: 7642886 - DNA, 22 bp, Homo sapiens
attcacagtatggacgaaatga

SEQ ID NO: 7642887 - DNA, 22 bp, Homo sapiens
attcacagggggagaagggtat

SEQ ID NO: 7642888 - DNA, 22 bp, Homo sapiens
attcacagggggagaagggtat

SEQ ID NO: 7642889 - DNA, 21 bp, Homo sapiens
attcacaggtatcctctccct

SEQ ID NO: 7642890 - DNA, 21 bp, Homo sapiens
attcacaggtatcctctccct

SEQ ID NO: 7642891 - DNA, 22 bp, Homo sapiens
attcacagggggagaagggtat

SEQ ID NO: 7642892 - DNA, 22 bp, Homo sapiens
attcacagggggagaagggtat

SEQ ID NO: 7642893 - DNA, 22 bp, Homo sapiens
attcacagggacaatgggagag

SEQ ID NO: 7642894 - DNA, 22 bp, Homo sapiens
attcacagggacaatgggagag

SEQ ID NO: 7642895 - DNA, 20 bp, Homo sapiens
attcacaggcacaaaaccct

SEQ ID NO: 7642896 - DNA, 22 bp, Homo sapiens
attcacagggacaatgggagag

SEQ ID NO: 7642897 - DNA, 20 bp, Homo sapiens
attcacaggcacaaaaccct

SEQ ID NO: 7642898 - DNA, 22 bp, Homo sapiens
attcacagggctttccgcatgg

SEQ ID NO: 7642899 - DNA, 22 bp, Homo sapiens
attcacagggacaatgggagag

SEQ ID NO: 7642900 - DNA, 22 bp, Homo sapiens
attcacagggctttccgcatgg

SEQ ID NO: 7642901 - DNA, 22 bp, Homo sapiens
attcacagggctttccgcatgg

SEQ ID NO: 7642902 - DNA, 22 bp, Homo sapiens
attcacagggctttccgcatgg

SEQ ID NO: 7642903 - DNA, 22 bp, Homo sapiens
attcacagggctttccgcatgg

SEQ ID NO: 7642904 - DNA, 22 bp, Homo sapiens
attcagagtctgcacaacagca

SEQ ID NO: 7642905 - DNA, 22 bp, Homo sapiens
attcacagtttcctcatattct

SEQ ID NO: 7642906 - DNA, 22 bp, Homo sapiens
attcacagtttcctcatattct

SEQ ID NO: 7642907 - DNA, 22 bp, Homo sapiens
attcacagtttcctcatattct

SEQ ID NO: 7642908 - DNA, 22 bp, Homo sapiens
attcacagtttcctcatattct

SEQ ID NO: 7642909 - DNA, 22 bp, Homo sapiens
attcacagtttcctcatattct

SEQ ID NO: 7642910 - DNA, 22 bp, Homo sapiens
attcacagtttcctcatattct

SEQ ID NO: 7642911 - DNA, 22 bp, Homo sapiens
attcacagttcattagctgtaa

SEQ ID NO: 7642912 - DNA, 22 bp, Homo sapiens
attcacagttactgctgaacca

SEQ ID NO: 7642913 - DNA, 22 bp, Homo sapiens
attcacagttactgctgaacca

SEQ ID NO: 7642914 - DNA, 22 bp, Homo sapiens
attcacagttactgctgaacca

SEQ ID NO: 7642915 - DNA, 22 bp, Homo sapiens
attcacagttactgctgaacca

SEQ ID NO: 7642916 - DNA, 22 bp, Homo sapiens
attcacagttactgctgaacca

SEQ ID NO: 7642917 - DNA, 22 bp, Homo sapiens
attcacagttcattagctgtaa

SEQ ID NO: 7642918 - DNA, 22 bp, Homo sapiens
attcacagttcattagctgtaa

SEQ ID NO: 7642919 - DNA, 22 bp, Homo sapiens
attcacagttactgctgaacca

SEQ ID NO: 7642920 - DNA, 22 bp, Homo sapiens
attcacagttcattagctgtaa

SEQ ID NO: 7642921 - DNA, 22 bp, Homo sapiens
atgttaaatagccatttgtttg

SEQ ID NO: 7642922 - DNA, 22 bp, Homo sapiens
atgttaaatagccatttgtttg

SEQ ID NO: 7642923 - DNA, 22 bp, Homo sapiens
atgttaaatggtttattattaa

SEQ ID NO: 7642924 - DNA, 22 bp, Homo sapiens
atgttaaatggtttattattaa

SEQ ID NO: 7642925 - DNA, 22 bp, Homo sapiens
atgttaaatggtttattattaa

SEQ ID NO: 7642926 - DNA, 20 bp, Homo sapiens
atgttaaatagcatttagag

SEQ ID NO: 7642927 - DNA, 20 bp, Homo sapiens
atgttaaatagcatttagag

SEQ ID NO: 7642928 - DNA, 22 bp, Homo sapiens
atgttaaatagccatttgtttg

SEQ ID NO: 7642929 - DNA, 20 bp, Homo sapiens
atgttaaatagcatttagag

SEQ ID NO: 7642930 - DNA, 20 bp, Homo sapiens
atgttaaatagcatttagag

SEQ ID NO: 7642931 - DNA, 20 bp, Homo sapiens
atgttaaatagcatttagag

SEQ ID NO: 7642932 - DNA, 23 bp, Homo sapiens
atgttaagaaggtagttaggata

SEQ ID NO: 7642933 - DNA, 23 bp, Homo sapiens
atgttaagaaggtagttaggata

SEQ ID NO: 7642934 - DNA, 22 bp, Homo sapiens
atgttaactgaagccattctcg

SEQ ID NO: 7642935 - DNA, 22 bp, Homo sapiens
atgttaagaatgcagacaaatg

SEQ ID NO: 7642936 - DNA, 22 bp, Homo sapiens
atgttaagaatgcagacaaatg

SEQ ID NO: 7642937 - DNA, 22 bp, Homo sapiens
atgttaagaatgcagacaaatg

SEQ ID NO: 7642938 - DNA, 23 bp, Homo sapiens
atgttaagtgaaataggccagga

SEQ ID NO: 7642939 - DNA, 23 bp, Homo sapiens
atgttaagtgaaataggccagga

SEQ ID NO: 7642940 - DNA, 22 bp, Homo sapiens
atgttaagtgtaccatatatca

SEQ ID NO: 7642941 - DNA, 22 bp, Homo sapiens
atgttaaatggtttattattaa

SEQ ID NO: 7642942 - DNA, 22 bp, Homo sapiens
atgttaaatggtttattattaa

SEQ ID NO: 7642943 - DNA, 22 bp, Homo sapiens
atgttacaaatcctacaggtag

SEQ ID NO: 7642944 - DNA, 22 bp, Homo sapiens
atgttaagtttagcaggctagg

SEQ ID NO: 7642945 - DNA, 22 bp, Homo sapiens
atgttaagttactgaaatgaga

SEQ ID NO: 7642946 - DNA, 22 bp, Homo sapiens
atgttaagttactgaaatgaga

SEQ ID NO: 7642947 - DNA, 17 bp, Homo sapiens
atgttaatttcacattt

SEQ ID NO: 7642948 - DNA, 17 bp, Homo sapiens
atgttaatttcacattt

SEQ ID NO: 7642949 - DNA, 22 bp, Homo sapiens
atgttaagtttagcaggctagg

SEQ ID NO: 7642950 - DNA, 22 bp, Homo sapiens
atgttacaaccctgaggagccg

SEQ ID NO: 7642951 - DNA, 22 bp, Homo sapiens
atgttacaaccctgaggagccg

SEQ ID NO: 7642952 - DNA, 22 bp, Homo sapiens
atgttacaatccaacaaaatta

SEQ ID NO: 7642953 - DNA, 22 bp, Homo sapiens
atgttacaatccaacaaaatta

SEQ ID NO: 7642954 - DNA, 22 bp, Homo sapiens
atgttacaaatcctacaggtag

SEQ ID NO: 7642955 - DNA, 22 bp, Homo sapiens
atgttacaatccaacaaaatta

SEQ ID NO: 7642956 - DNA, 22 bp, Homo sapiens
atgttacaatccaacaaaatta

SEQ ID NO: 7642957 - DNA, 23 bp, Homo sapiens
atgtttgcagtaacccatcctgg

SEQ ID NO: 7642958 - DNA, 22 bp, Homo sapiens
atgtttgactgagtttggcaga

SEQ ID NO: 7642959 - DNA, 22 bp, Homo sapiens
atgtttgactgagtttggcaga

SEQ ID NO: 7642960 - DNA, 22 bp, Homo sapiens
atgtttgcttaattggagaaat

SEQ ID NO: 7642961 - DNA, 19 bp, Homo sapiens
atgtttgcttgagtaataa

SEQ ID NO: 7642962 - DNA, 22 bp, Homo sapiens
atgtttgcattcttattatcgt

SEQ ID NO: 7642963 - DNA, 22 bp, Homo sapiens
atgtttctgaagtttacagata

SEQ ID NO: 7642964 - DNA, 22 bp, Homo sapiens
atgtttctgaagtttacagata

SEQ ID NO: 7642965 - DNA, 22 bp, Homo sapiens
atgtttctgagtgtatatacat

SEQ ID NO: 7642966 - DNA, 22 bp, Homo sapiens
atgtttctgagtgtatatacat

SEQ ID NO: 7642967 - DNA, 22 bp, Homo sapiens
atgtttctgagtgtatatacat

SEQ ID NO: 7642968 - DNA, 22 bp, Homo sapiens
atgtttctgagtgtatatacat

SEQ ID NO: 7642969 - DNA, 22 bp, Homo sapiens
atgtttgaaattgtaagtatat

SEQ ID NO: 7642970 - DNA, 22 bp, Homo sapiens
atgtttctgtcctacgagataa

SEQ ID NO: 7642971 - DNA, 22 bp, Homo sapiens
atgtttctgtcctacgagataa

SEQ ID NO: 7642972 - DNA, 22 bp, Homo sapiens
atgttacaatccaacaaaatta

SEQ ID NO: 7642973 - DNA, 22 bp, Homo sapiens
atgttacaatccaacaaaatta

SEQ ID NO: 7642974 - DNA, 22 bp, Homo sapiens
atgttacaatccaacaaaatta

SEQ ID NO: 7642975 - DNA, 22 bp, Homo sapiens
atgttacaatccaacaaaatta

SEQ ID NO: 7642976 - DNA, 22 bp, Homo sapiens
atgttacaatccaacaaaatta

SEQ ID NO: 7642977 - DNA, 22 bp, Homo sapiens
atgttacaatccaacaaaatta

SEQ ID NO: 7642978 - DNA, 22 bp, Homo sapiens
atgttacaattcaaaatgctgc

SEQ ID NO: 7642979 - DNA, 22 bp, Homo sapiens
atgttacaattcaaaatgctgc

SEQ ID NO: 7642980 - DNA, 22 bp, Homo sapiens
atgttacaattcaaaatgctgc

SEQ ID NO: 7642981 - DNA, 22 bp, Homo sapiens
atgttacaattcaaaatgctgc

SEQ ID NO: 7642982 - DNA, 22 bp, Homo sapiens
atgttacaattcaaaatgctgc

SEQ ID NO: 7642983 - DNA, 22 bp, Homo sapiens
atgttacaattcaaaatgctgc

SEQ ID NO: 7642984 - DNA, 22 bp, Homo sapiens
atgttacacataggcataaatg

SEQ ID NO: 7642985 - DNA, 22 bp, Homo sapiens
atgttacacataggcataaatg

SEQ ID NO: 7642986 - DNA, 22 bp, Homo sapiens
atgttacaattcaaaatgctgc

SEQ ID NO: 7642987 - DNA, 22 bp, Homo sapiens
atgttacacataggcataaatg

SEQ ID NO: 7642988 - DNA, 22 bp, Homo sapiens
atgtttatgttgggctatattt

SEQ ID NO: 7642989 - DNA, 22 bp, Homo sapiens
atgtttatgttgggctatattt

SEQ ID NO: 7642990 - DNA, 22 bp, Homo sapiens
atgtttatgttgggctatattt

SEQ ID NO: 7642991 - DNA, 22 bp, Homo sapiens
atgtttctgaagtttacagata

SEQ ID NO: 7642992 - DNA, 22 bp, Homo sapiens
atgtttatgttgggctatattt

SEQ ID NO: 7642993 - DNA, 22 bp, Homo sapiens
atgtttatgttgggctatattt

SEQ ID NO: 7642994 - DNA, 22 bp, Homo sapiens
atgttacacataggcataaatg

SEQ ID NO: 7642995 - DNA, 22 bp, Homo sapiens
atgttacacataggcataaatg

SEQ ID NO: 7642996 - DNA, 22 bp, Homo sapiens
atgtgtgctacaggtgtgggaa

SEQ ID NO: 7642997 - DNA, 21 bp, Homo sapiens
atgtgtgctagaggactactg

SEQ ID NO: 7642998 - DNA, 22 bp, Homo sapiens
atgtgtgctacaggtgtgggaa

SEQ ID NO: 7642999 - DNA, 22 bp, Homo sapiens
atgtgtgctcttgagccttcac

SEQ ID NO: 7643000 - DNA, 21 bp, Homo sapiens
atgtgtgctagaggactactg

SEQ ID NO: 7643001 - DNA, 22 bp, Homo sapiens
atgtgtgtaaacaagtataatt

SEQ ID NO: 7643002 - DNA, 22 bp, Homo sapiens
atgtgtgtaaacaagtataatt

SEQ ID NO: 7643003 - DNA, 22 bp, Homo sapiens
atgtgtgtaaacaagtataatt

SEQ ID NO: 7643004 - DNA, 23 bp, Homo sapiens
atgtgtgggaggtcagagagcca

SEQ ID NO: 7643005 - DNA, 22 bp, Homo sapiens
atgtgtggtttaagaattgaat

SEQ ID NO: 7643006 - DNA, 23 bp, Homo sapiens
atgtgtgggaggtcagagagcca

SEQ ID NO: 7643007 - DNA, 23 bp, Homo sapiens
atgtgtgggaggtcagagagcca

SEQ ID NO: 7643008 - DNA, 22 bp, Homo sapiens
atgtgtgtacacacgtgactct

SEQ ID NO: 7643009 - DNA, 22 bp, Homo sapiens
atgtgtgtacacacgtgactct

SEQ ID NO: 7643010 - DNA, 22 bp, Homo sapiens
atgttaaagatggtgggaaatt

SEQ ID NO: 7643011 - DNA, 22 bp, Homo sapiens
atgttaaagatggtgggaaatt

SEQ ID NO: 7643012 - DNA, 22 bp, Homo sapiens
atgttaaagatggtgggaaatt

SEQ ID NO: 7643013 - DNA, 22 bp, Homo sapiens
atgttaaagatggtgggaaatt

SEQ ID NO: 7643014 - DNA, 22 bp, Homo sapiens
atgttaaataatcccttaaagc

SEQ ID NO: 7643015 - DNA, 22 bp, Homo sapiens
atgttaaataatcccttaaagc

SEQ ID NO: 7643016 - DNA, 22 bp, Homo sapiens
atgttaaataatcccttaaagc

SEQ ID NO: 7643017 - DNA, 22 bp, Homo sapiens
atgtgtgtacacacgtgactct

SEQ ID NO: 7643018 - DNA, 22 bp, Homo sapiens
atgtgtgtacacacgtgactct

SEQ ID NO: 7643019 - DNA, 22 bp, Homo sapiens
atgtgtgtacacacgtgactct

SEQ ID NO: 7643020 - DNA, 22 bp, Homo sapiens
atgtgtgtacacacgtgactct

SEQ ID NO: 7643021 - DNA, 22 bp, Homo sapiens
atgtgtgtacacacgtgactct

SEQ ID NO: 7643022 - DNA, 22 bp, Homo sapiens
atgtgtgtacacacgtgactct

SEQ ID NO: 7643023 - DNA, 22 bp, Homo sapiens
atgtgtgtaaacaagtataatt

SEQ ID NO: 7643024 - DNA, 22 bp, Homo sapiens
atgtgtgtaaacaagtataatt

SEQ ID NO: 7643025 - DNA, 22 bp, Homo sapiens
atgtgtgtaaacaagtataatt

SEQ ID NO: 7643026 - DNA, 22 bp, Homo sapiens
atgtgtgtaaacaagtataatt

SEQ ID NO: 7643027 - DNA, 22 bp, Homo sapiens
atgtcttctaagctctaagctg

SEQ ID NO: 7643028 - DNA, 22 bp, Homo sapiens
atgtctgttttcatatcagata

SEQ ID NO: 7643029 - DNA, 22 bp, Homo sapiens
atgtcttctctgtaggtaaatt

SEQ ID NO: 7643030 - DNA, 22 bp, Homo sapiens
atgtgtatccatctgtctattt

SEQ ID NO: 7643031 - DNA, 22 bp, Homo sapiens
atgtgtatctaaggtgttctat

SEQ ID NO: 7643032 - DNA, 22 bp, Homo sapiens
atgtgtatccatctgtctattt

SEQ ID NO: 7643033 - DNA, 22 bp, Homo sapiens
atgtgtatccatctgtctattt

SEQ ID NO: 7643034 - DNA, 22 bp, Homo sapiens
atgtgtcttggagttttaatgt

SEQ ID NO: 7643035 - DNA, 22 bp, Homo sapiens
atgtgtctttcaaggtatagaa

SEQ ID NO: 7643036 - DNA, 22 bp, Homo sapiens
atgtgtcttggagttttaatgt

SEQ ID NO: 7643037 - DNA, 22 bp, Homo sapiens
atgtgtcttggagttttaatgt

SEQ ID NO: 7643038 - DNA, 18 bp, Homo sapiens
atgtgtctttcttgtttg

SEQ ID NO: 7643039 - DNA, 22 bp, Homo sapiens
atgtgtctttcaaggtatagaa

SEQ ID NO: 7643040 - DNA, 22 bp, Homo sapiens
atgtgtctttcaaggtatagaa

SEQ ID NO: 7643041 - DNA, 22 bp, Homo sapiens
atgtgtctttgagactctgcta

SEQ ID NO: 7643042 - DNA, 18 bp, Homo sapiens
atgtgtctttcttgtttg

SEQ ID NO: 7643043 - DNA, 18 bp, Homo sapiens
atgtgtctttcttgtttg

SEQ ID NO: 7643044 - DNA, 18 bp, Homo sapiens
atgtgtctttcttgtttg

SEQ ID NO: 7643045 - DNA, 22 bp, Homo sapiens
atgtgtctttgagactctgcta

SEQ ID NO: 7643046 - DNA, 22 bp, Homo sapiens
atgtgtctttgagactctgcta

SEQ ID NO: 7643047 - DNA, 22 bp, Homo sapiens
atgtgtgcaatgctattttggc

SEQ ID NO: 7643048 - DNA, 22 bp, Homo sapiens
atgtgtgcatattctgccacct

SEQ ID NO: 7643049 - DNA, 22 bp, Homo sapiens
atgtgtgcatcaatgatagatc

SEQ ID NO: 7643050 - DNA, 22 bp, Homo sapiens
atgtgtgcatattctgccacct

SEQ ID NO: 7643051 - DNA, 22 bp, Homo sapiens
atgtgtgcatgttagagagagt

SEQ ID NO: 7643052 - DNA, 22 bp, Homo sapiens
atgtgtgcatgttagagagagt

SEQ ID NO: 7643053 - DNA, 22 bp, Homo sapiens
atgtgtgccccttttactcttt

SEQ ID NO: 7643054 - DNA, 22 bp, Homo sapiens
atgtgtgccccttttactcttt

SEQ ID NO: 7643055 - DNA, 22 bp, Homo sapiens
atgtgtgcctgagtgatggact

SEQ ID NO: 7643056 - DNA, 22 bp, Homo sapiens
atgtgtgcgggaaggaaagtga

SEQ ID NO: 7643057 - DNA, 22 bp, Homo sapiens
atgtgtgctacaggtgtgggaa

SEQ ID NO: 7643058 - DNA, 22 bp, Homo sapiens
attacagtagcaaaagaccgga

SEQ ID NO: 7643059 - DNA, 22 bp, Homo sapiens
attaaatactgcaggctaagca

SEQ ID NO: 7643060 - DNA, 22 bp, Homo sapiens
attaaatactgcaggctaagca

SEQ ID NO: 7643061 - DNA, 22 bp, Homo sapiens
attaaatactgcaggctaagca

SEQ ID NO: 7643062 - DNA, 22 bp, Homo sapiens
attaaatactgcaggctaagca

SEQ ID NO: 7643063 - DNA, 22 bp, Homo sapiens
attaaatactgcaggctaagca

SEQ ID NO: 7643064 - DNA, 22 bp, Homo sapiens
attaaatactgcaggctaagca

SEQ ID NO: 7643065 - DNA, 22 bp, Homo sapiens
attaaagtgaagttctcagatg

SEQ ID NO: 7643066 - DNA, 22 bp, Homo sapiens
attaaatactgcaggctaagca

SEQ ID NO: 7643067 - DNA, 22 bp, Homo sapiens
attaaatactgcaggctaagca

SEQ ID NO: 7643068 - DNA, 22 bp, Homo sapiens
attaaatactgcaggctaagca

SEQ ID NO: 7643069 - DNA, 22 bp, Homo sapiens
attaaagttgaaattgaactga

SEQ ID NO: 7643070 - DNA, 22 bp, Homo sapiens
attacagtgccacctcgtggtc

SEQ ID NO: 7643071 - DNA, 22 bp, Homo sapiens
attacagtggacagctatgcac

SEQ ID NO: 7643072 - DNA, 22 bp, Homo sapiens
attacagtgccacctcgtggtc

SEQ ID NO: 7643073 - DNA, 22 bp, Homo sapiens
attacagtaggattggaaagga

SEQ ID NO: 7643074 - DNA, 22 bp, Homo sapiens
attagatgtgtttaagtagaga

SEQ ID NO: 7643075 - DNA, 22 bp, Homo sapiens
attagattgtaaatgttttcac

SEQ ID NO: 7643076 - DNA, 22 bp, Homo sapiens
attagattgtaaatgttttcac

SEQ ID NO: 7643077 - DNA, 22 bp, Homo sapiens
attacagtggacagctatgcac

SEQ ID NO: 7643078 - DNA, 22 bp, Homo sapiens
attagatgtgaccttagataaa

SEQ ID NO: 7643079 - DNA, 22 bp, Homo sapiens
attagcaaaacaacttttctat

SEQ ID NO: 7643080 - DNA, 22 bp, Homo sapiens
attagcaaaacaacttttctat

SEQ ID NO: 7643081 - DNA, 22 bp, Homo sapiens
attagattgtaaatgttttcac

SEQ ID NO: 7643082 - DNA, 22 bp, Homo sapiens
attagcaaattctaattcacta

SEQ ID NO: 7643083 - DNA, 22 bp, Homo sapiens
attagcaacatggtgaatatgt

SEQ ID NO: 7643084 - DNA, 22 bp, Homo sapiens
attagcaacatggtgaatatgt

SEQ ID NO: 7643085 - DNA, 22 bp, Homo sapiens
attagcaagttgttatcctttg

SEQ ID NO: 7643086 - DNA, 22 bp, Homo sapiens
attagcaaggttcatgagaaga

SEQ ID NO: 7643087 - DNA, 22 bp, Homo sapiens
attagcaagttgttatcctttg

SEQ ID NO: 7643088 - DNA, 22 bp, Homo sapiens
attagcaaggttcatgagaaga

SEQ ID NO: 7643089 - DNA, 22 bp, Homo sapiens
attagcaaggcagcatcaggca

SEQ ID NO: 7643090 - DNA, 22 bp, Homo sapiens
attagcaaggcagcatcaggca

SEQ ID NO: 7643091 - DNA, 22 bp, Homo sapiens
attagcaactcttatgtaagca

SEQ ID NO: 7643092 - DNA, 22 bp, Homo sapiens
attagcaactgtcttgaaaaca

SEQ ID NO: 7643093 - DNA, 22 bp, Homo sapiens
attagcaattgtttcattgatc

SEQ ID NO: 7643094 - DNA, 22 bp, Homo sapiens
attagcaattgccctgtgcaat

SEQ ID NO: 7643095 - DNA, 22 bp, Homo sapiens
attagcaatcacgcagtcattt

SEQ ID NO: 7643096 - DNA, 22 bp, Homo sapiens
attagcaagttttccagctaat

SEQ ID NO: 7643097 - DNA, 22 bp, Homo sapiens
attagcaatctgaaaattgcgg

SEQ ID NO: 7643098 - DNA, 22 bp, Homo sapiens
attagcatattaaatagtcatt

SEQ ID NO: 7643099 - DNA, 22 bp, Homo sapiens
attagcatattaaatagtcatt

SEQ ID NO: 7643100 - DNA, 22 bp, Homo sapiens
attagcatattaaatagtcatt

SEQ ID NO: 7643101 - DNA, 22 bp, Homo sapiens
attagcagctttctggtctcta

SEQ ID NO: 7643102 - DNA, 22 bp, Homo sapiens
attagcacataagaggtatagg

SEQ ID NO: 7643103 - DNA, 22 bp, Homo sapiens
attagcacataagaggtatagg

SEQ ID NO: 7643104 - DNA, 22 bp, Homo sapiens
attagctgtgaagaagatgctt

SEQ ID NO: 7643105 - DNA, 22 bp, Homo sapiens
attagctgtgacgaggcattgt

SEQ ID NO: 7643106 - DNA, 22 bp, Homo sapiens
attataaacctttgagggtggg

SEQ ID NO: 7643107 - DNA, 22 bp, Homo sapiens
attataaacctttgagggtggg

SEQ ID NO: 7643108 - DNA, 22 bp, Homo sapiens
attataaacctttgagggtggg

SEQ ID NO: 7643109 - DNA, 22 bp, Homo sapiens
attataaacctttgagggtggg

SEQ ID NO: 7643110 - DNA, 22 bp, Homo sapiens
attataaacctttgagggtggg

SEQ ID NO: 7643111 - DNA, 22 bp, Homo sapiens
attagctgttgtgaaaggggtg

SEQ ID NO: 7643112 - DNA, 22 bp, Homo sapiens
attagctgtgacgaggcattgt

SEQ ID NO: 7643113 - DNA, 22 bp, Homo sapiens
attagctgacctctaaggagcc

SEQ ID NO: 7643114 - DNA, 20 bp, Homo sapiens
attagctcaggtgaggtcat

SEQ ID NO: 7643115 - DNA, 20 bp, Homo sapiens
attagctcaggtgaggtcat

SEQ ID NO: 7643116 - DNA, 22 bp, Homo sapiens
attagctatatgctatgtgcca

SEQ ID NO: 7643117 - DNA, 22 bp, Homo sapiens
attagcattgctactctcaaga

SEQ ID NO: 7643118 - DNA, 22 bp, Homo sapiens
attagcattgctactctcaaga

SEQ ID NO: 7643119 - DNA, 19 bp, Homo sapiens
attagcatgcttgaggatg

SEQ ID NO: 7643120 - DNA, 22 bp, Homo sapiens
attagcatgccaagcttttaga

SEQ ID NO: 7643121 - DNA, 22 bp, Homo sapiens
attaaagtgaagttctcagatg

SEQ ID NO: 7643122 - DNA, 22 bp, Homo sapiens
attaaagtgaagttctcagatg

SEQ ID NO: 7643123 - DNA, 22 bp, Homo sapiens
attaaagtgaagttctcagatg

SEQ ID NO: 7643124 - DNA, 22 bp, Homo sapiens
attaaagtgaagttctcagatg

SEQ ID NO: 7643125 - DNA, 22 bp, Homo sapiens
attaaagtgaagttctcagatg

SEQ ID NO: 7643126 - DNA, 22 bp, Homo sapiens
attaaagctatccagtcatgaa

SEQ ID NO: 7643127 - DNA, 22 bp, Homo sapiens
attaaagctatccagtcatgaa

SEQ ID NO: 7643128 - DNA, 22 bp, Homo sapiens
attaaagacagcagatggatgg

SEQ ID NO: 7643129 - DNA, 22 bp, Homo sapiens
attaaagacagcagatggatgg

SEQ ID NO: 7643130 - DNA, 22 bp, Homo sapiens
attaaagaaacccagcatgtga

SEQ ID NO: 7643131 - DNA, 22 bp, Homo sapiens
attaaagaaacccagcatgtga

SEQ ID NO: 7643132 - DNA, 22 bp, Homo sapiens
attaaagaaacccagcatgtga

SEQ ID NO: 7643133 - DNA, 22 bp, Homo sapiens
attaaagaaacccagcatgtga

SEQ ID NO: 7643134 - DNA, 22 bp, Homo sapiens
attaaagaaacccagcatgtga

SEQ ID NO: 7643135 - DNA, 22 bp, Homo sapiens
attaaagaaacccagcatgtga

SEQ ID NO: 7643136 - DNA, 22 bp, Homo sapiens
attaaactgagcaaattaacat

SEQ ID NO: 7643137 - DNA, 22 bp, Homo sapiens
attaaactgagcaaattaacat

SEQ ID NO: 7643138 - DNA, 22 bp, Homo sapiens
attaaactgagcaaattaacat

SEQ ID NO: 7643139 - DNA, 22 bp, Homo sapiens
attaaactgagcaaattaacat

SEQ ID NO: 7643140 - DNA, 22 bp, Homo sapiens
attaaacaatgtaaagttcttg

SEQ ID NO: 7643141 - DNA, 22 bp, Homo sapiens
attaaacaatgtaaagttcttg

SEQ ID NO: 7643142 - DNA, 22 bp, Homo sapiens
attaaacaatgtaaagttcttg

SEQ ID NO: 7643143 - DNA, 22 bp, Homo sapiens
attaaacaatgtaaagttcttg

SEQ ID NO: 7643144 - DNA, 22 bp, Homo sapiens
attaaacaatgtaaagttcttg

SEQ ID NO: 7643145 - DNA, 22 bp, Homo sapiens
attaaacaatgtaaagttcttg

SEQ ID NO: 7643146 - DNA, 22 bp, Homo sapiens
attaaacaatgtaaagttcttg

SEQ ID NO: 7643147 - DNA, 22 bp, Homo sapiens
attaaacaatgtaaagttcttg

SEQ ID NO: 7643148 - DNA, 22 bp, Homo sapiens
atgttttaccctttgcacaaac

SEQ ID NO: 7643149 - DNA, 22 bp, Homo sapiens
attaaacaatgtaaagttcttg

SEQ ID NO: 7643150 - DNA, 22 bp, Homo sapiens
atgttttaccctttgcacaaac

SEQ ID NO: 7643151 - DNA, 22 bp, Homo sapiens
atgttttaccctttgcacaaac

SEQ ID NO: 7643152 - DNA, 22 bp, Homo sapiens
atgttttaccctttgcacaaac

SEQ ID NO: 7643153 - DNA, 22 bp, Homo sapiens
atgttttaccctttgcacaaac

SEQ ID NO: 7643154 - DNA, 22 bp, Homo sapiens
atgttttaccctttgcacaaac

SEQ ID NO: 7643155 - DNA, 22 bp, Homo sapiens
atgtttgtcaggattgtaatta

SEQ ID NO: 7643156 - DNA, 22 bp, Homo sapiens
atgtttgtcaggattgtaatta

SEQ ID NO: 7643157 - DNA, 22 bp, Homo sapiens
atgtttgtcaggattgtaatta

SEQ ID NO: 7643158 - DNA, 22 bp, Homo sapiens
atgtttgtcaggattgtaatta

SEQ ID NO: 7643159 - DNA, 22 bp, Homo sapiens
atgtttgtaggtaagtgacact

SEQ ID NO: 7643160 - DNA, 22 bp, Homo sapiens
atgtttgtaggtaagtgacact

SEQ ID NO: 7643161 - DNA, 22 bp, Homo sapiens
atgtttgtgttacactctgcag

SEQ ID NO: 7643162 - DNA, 22 bp, Homo sapiens
atgtttgtgttacactctgcag

SEQ ID NO: 7643163 - DNA, 22 bp, Homo sapiens
atgtttgtgttacactctgcag

SEQ ID NO: 7643164 - DNA, 22 bp, Homo sapiens
atgtttgtgttacactctgcag

SEQ ID NO: 7643165 - DNA, 22 bp, Homo sapiens
atgtttgtgggataaacaaatg

SEQ ID NO: 7643166 - DNA, 22 bp, Homo sapiens
atgtttgtgggataaacaaatg

SEQ ID NO: 7643167 - DNA, 22 bp, Homo sapiens
atgtttgtgggataaacaaatg

SEQ ID NO: 7643168 - DNA, 22 bp, Homo sapiens
atgtttgtccctgacatcctct

SEQ ID NO: 7643169 - DNA, 22 bp, Homo sapiens
atgtttgtcaggattgtaatta

SEQ ID NO: 7643170 - DNA, 22 bp, Homo sapiens
atgtttgttgaatgaagaaagg

SEQ ID NO: 7643171 - DNA, 22 bp, Homo sapiens
atgtttgttgaacatctactgc

SEQ ID NO: 7643172 - DNA, 22 bp, Homo sapiens
atgtttgttgatcatttatgaa

SEQ ID NO: 7643173 - DNA, 22 bp, Homo sapiens
atgtttgttgatcatttatgaa

SEQ ID NO: 7643174 - DNA, 22 bp, Homo sapiens
atgtttgttgatcatttatgaa

SEQ ID NO: 7643175 - DNA, 22 bp, Homo sapiens
atgttttaaatatgtgtgtaaa

SEQ ID NO: 7643176 - DNA, 22 bp, Homo sapiens
atgttttaaatatgtgtgtaaa

SEQ ID NO: 7643177 - DNA, 22 bp, Homo sapiens
atgttttaaatatgtgtgtaaa

SEQ ID NO: 7643178 - DNA, 22 bp, Homo sapiens
atgttttaaatatgtgtgtaaa

SEQ ID NO: 7643179 - DNA, 22 bp, Homo sapiens
atgtttgttgatcatttatgaa

SEQ ID NO: 7643180 - DNA, 22 bp, Homo sapiens
atgtttgtgtttcccattcagg

SEQ ID NO: 7643181 - DNA, 22 bp, Homo sapiens
atgtttgtgtttgctatgcggt

SEQ ID NO: 7643182 - DNA, 22 bp, Homo sapiens
atgtttgtgtttcccattcagg

SEQ ID NO: 7643183 - DNA, 22 bp, Homo sapiens
atgtttgttgaacatctactgc

SEQ ID NO: 7643184 - DNA, 22 bp, Homo sapiens
atgtttgttgaacatctactgc

SEQ ID NO: 7643185 - DNA, 22 bp, Homo sapiens
atgtttgttgaacatctactgc

SEQ ID NO: 7643186 - DNA, 22 bp, Homo sapiens
atgtttgttgaacatctactgc

SEQ ID NO: 7643187 - DNA, 22 bp, Homo sapiens
agatgaagactcaggagcaggt

SEQ ID NO: 7643188 - DNA, 22 bp, Homo sapiens
agatgaagactcaggagcaggt

SEQ ID NO: 7643189 - DNA, 22 bp, Homo sapiens
agatgaagactcaggagcaggt

SEQ ID NO: 7643190 - DNA, 22 bp, Homo sapiens
agatgaaatttgtgttgagttg

SEQ ID NO: 7643191 - DNA, 22 bp, Homo sapiens
agatgaaatttgtgttgagttg

SEQ ID NO: 7643192 - DNA, 22 bp, Homo sapiens
agatgaaatttgtgttgagttg

SEQ ID NO: 7643193 - DNA, 23 bp, Homo sapiens
agatgaaagcttcccatcacagt

SEQ ID NO: 7643194 - DNA, 23 bp, Homo sapiens
agatgaaagcttcccatcacagt

SEQ ID NO: 7643195 - DNA, 23 bp, Homo sapiens
agatgaaagcttcccatcacagt

SEQ ID NO: 7643196 - DNA, 23 bp, Homo sapiens
agatgaaagcttcccatcacagt

SEQ ID NO: 7643197 - DNA, 23 bp, Homo sapiens
agatgaaagcttcccatcacagt

SEQ ID NO: 7643198 - DNA, 23 bp, Homo sapiens
agatgaaagcttcccatcacagt

SEQ ID NO: 7643199 - DNA, 23 bp, Homo sapiens
agatgaaagcttcccatcacagt

SEQ ID NO: 7643200 - DNA, 22 bp, Homo sapiens
atttcattgaagttaattcttc

SEQ ID NO: 7643201 - DNA, 22 bp, Homo sapiens
atttcattgaagttaattcttc

SEQ ID NO: 7643202 - DNA, 22 bp, Homo sapiens
atttcattgaagttaattcttc

SEQ ID NO: 7643203 - DNA, 22 bp, Homo sapiens
atttcattgaagttaattcttc

SEQ ID NO: 7643204 - DNA, 22 bp, Homo sapiens
atttcattgaagttaattcttc

SEQ ID NO: 7643205 - DNA, 22 bp, Homo sapiens
agatgaattgatgttggacaga

SEQ ID NO: 7643206 - DNA, 22 bp, Homo sapiens
agatgaatccacacatggcaaa

SEQ ID NO: 7643207 - DNA, 22 bp, Homo sapiens
agatgaatccacacatggcaaa

SEQ ID NO: 7643208 - DNA, 22 bp, Homo sapiens
agatgacaaatcaggggacggg

SEQ ID NO: 7643209 - DNA, 22 bp, Homo sapiens
atttcattgaagttaattcttc

SEQ ID NO: 7643210 - DNA, 22 bp, Homo sapiens
agatgaagatgccactaagacc

SEQ ID NO: 7643211 - DNA, 22 bp, Homo sapiens
agatgaagatgccactaagacc

SEQ ID NO: 7643212 - DNA, 18 bp, Homo sapiens
agatgaaagcaaatgaca

SEQ ID NO: 7643213 - DNA, 18 bp, Homo sapiens
agatgaaagcaaatgaca

SEQ ID NO: 7643214 - DNA, 18 bp, Homo sapiens
agatgaaagcaaatgaca

SEQ ID NO: 7643215 - DNA, 22 bp, Homo sapiens
agatgaaagatttttatagaga

SEQ ID NO: 7643216 - DNA, 18 bp, Homo sapiens
agatgaaagcaaatgaca

SEQ ID NO: 7643217 - DNA, 18 bp, Homo sapiens
agatgaaagcaaatgaca

SEQ ID NO: 7643218 - DNA, 18 bp, Homo sapiens
agatgaaagcaaatgaca

SEQ ID NO: 7643219 - DNA, 22 bp, Homo sapiens
agatgaaaagataagcagcaat

SEQ ID NO: 7643220 - DNA, 22 bp, Homo sapiens
agatgaaaatacgtgactttaa

SEQ ID NO: 7643221 - DNA, 22 bp, Homo sapiens
agatgaaaatacgtgactttaa

SEQ ID NO: 7643222 - DNA, 22 bp, Homo sapiens
agatgaaaatacgtgactttaa

SEQ ID NO: 7643223 - DNA, 22 bp, Homo sapiens
agatgaaaatacgtgactttaa

SEQ ID NO: 7643224 - DNA, 22 bp, Homo sapiens
agatgaaaatacgtgactttaa

SEQ ID NO: 7643225 - DNA, 22 bp, Homo sapiens
agatgaaagatttttatagaga

SEQ ID NO: 7643226 - DNA, 22 bp, Homo sapiens
agatgaaagatttttatagaga

SEQ ID NO: 7643227 - DNA, 22 bp, Homo sapiens
agatgaaagatttttatagaga

SEQ ID NO: 7643228 - DNA, 22 bp, Homo sapiens
agatgaaagatttttatagaga

SEQ ID NO: 7643229 - DNA, 22 bp, Homo sapiens
agatgaaagatttttatagaga

SEQ ID NO: 7643230 - DNA, 22 bp, Homo sapiens
agatgaaagatttttatagaga

SEQ ID NO: 7643231 - DNA, 22 bp, Homo sapiens
atttattgaagcttattacgtt

SEQ ID NO: 7643232 - DNA, 22 bp, Homo sapiens
atttattgaagcttattacgtt

SEQ ID NO: 7643233 - DNA, 22 bp, Homo sapiens
atttattgaagcttattacgtt

SEQ ID NO: 7643234 - DNA, 22 bp, Homo sapiens
atttattgaagcttattacgtt

SEQ ID NO: 7643235 - DNA, 21 bp, Homo sapiens
agatccagtgccataaggccc

SEQ ID NO: 7643236 - DNA, 22 bp, Homo sapiens
agatccagggttggatttgcat

SEQ ID NO: 7643237 - DNA, 22 bp, Homo sapiens
agatccagggttggatttgcat

SEQ ID NO: 7643238 - DNA, 22 bp, Homo sapiens
atttattgaagcttattacgtt

SEQ ID NO: 7643239 - DNA, 22 bp, Homo sapiens
agatgaaaagataagcagcaat

SEQ ID NO: 7643240 - DNA, 22 bp, Homo sapiens
agatgaaaagataagcagcaat

SEQ ID NO: 7643241 - DNA, 22 bp, Homo sapiens
agatcttttggttattataaga

SEQ ID NO: 7643242 - DNA, 22 bp, Homo sapiens
agatcttttggttattataaga

SEQ ID NO: 7643243 - DNA, 22 bp, Homo sapiens
agatgaaaagataagcagcaat

SEQ ID NO: 7643244 - DNA, 22 bp, Homo sapiens
agatgaaaagataagcagcaat

SEQ ID NO: 7643245 - DNA, 22 bp, Homo sapiens
agatgaaaatacgtgactttaa

SEQ ID NO: 7643246 - DNA, 22 bp, Homo sapiens
agatgaaaagataagcagcaat

SEQ ID NO: 7643247 - DNA, 22 bp, Homo sapiens
atttccagaatagaaggttctc

SEQ ID NO: 7643248 - DNA, 22 bp, Homo sapiens
atttccaccggctcaggaagtt

SEQ ID NO: 7643249 - DNA, 22 bp, Homo sapiens
atttccaccggctcaggaagtt

SEQ ID NO: 7643250 - DNA, 22 bp, Homo sapiens
atttccagaccaggtctcaccc

SEQ ID NO: 7643251 - DNA, 22 bp, Homo sapiens
agatgggcgccctggactgagg

SEQ ID NO: 7643252 - DNA, 21 bp, Homo sapiens
atttccacataatcataagac

SEQ ID NO: 7643253 - DNA, 22 bp, Homo sapiens
atttccaccatctctctgggcc

SEQ ID NO: 7643254 - DNA, 22 bp, Homo sapiens
atttccaccatctctctgggcc

SEQ ID NO: 7643255 - DNA, 22 bp, Homo sapiens
atttccaccggctcaggaagtt

SEQ ID NO: 7643256 - DNA, 22 bp, Homo sapiens
atttccacataagggaaataag

SEQ ID NO: 7643257 - DNA, 22 bp, Homo sapiens
atttccaatttcatccatgtcc

SEQ ID NO: 7643258 - DNA, 22 bp, Homo sapiens
atttccaactacccctccattt

SEQ ID NO: 7643259 - DNA, 22 bp, Homo sapiens
atttccaagaaagctttaggat

SEQ ID NO: 7643260 - DNA, 22 bp, Homo sapiens
atttccaactacccctccattt

SEQ ID NO: 7643261 - DNA, 22 bp, Homo sapiens
atttccaactacccctccattt

SEQ ID NO: 7643262 - DNA, 21 bp, Homo sapiens
atttccaagggtacctaagat

SEQ ID NO: 7643263 - DNA, 19 bp, Homo sapiens
atttccaagaattggagag

SEQ ID NO: 7643264 - DNA, 19 bp, Homo sapiens
atttccaagaattggagag

SEQ ID NO: 7643265 - DNA, 19 bp, Homo sapiens
atttccaagaattggagag

SEQ ID NO: 7643266 - DNA, 22 bp, Homo sapiens
agatggtaggtggcaggactga

SEQ ID NO: 7643267 - DNA, 22 bp, Homo sapiens
agatggtaatcacatttatctg

SEQ ID NO: 7643268 - DNA, 22 bp, Homo sapiens
agatgggcgcgctgctctgatg

SEQ ID NO: 7643269 - DNA, 19 bp, Homo sapiens
agatggggaagagtgtgag

SEQ ID NO: 7643270 - DNA, 22 bp, Homo sapiens
agatggtgagggcagaagtaac

SEQ ID NO: 7643271 - DNA, 22 bp, Homo sapiens
agatggtgatagagctgggatt

SEQ ID NO: 7643272 - DNA, 22 bp, Homo sapiens
agatggtgatagagctgggatt

SEQ ID NO: 7643273 - DNA, 20 bp, Homo sapiens
agatggtgaaggccagggag

SEQ ID NO: 7643274 - DNA, 20 bp, Homo sapiens
agatggtgaaggccagggag

SEQ ID NO: 7643275 - DNA, 22 bp, Homo sapiens
agatgtaccaggtattacagga

SEQ ID NO: 7643276 - DNA, 22 bp, Homo sapiens
agatgtaagaccttcatgaggg

SEQ ID NO: 7643277 - DNA, 22 bp, Homo sapiens
agatgtaagaccttcatgaggg

SEQ ID NO: 7643278 - DNA, 22 bp, Homo sapiens
agatgtaagaccttcatgaggg

SEQ ID NO: 7643279 - DNA, 22 bp, Homo sapiens
agatgtaagttgtttaaaagga

SEQ ID NO: 7643280 - DNA, 22 bp, Homo sapiens
agatgtaagaccttcatgaggg

SEQ ID NO: 7643281 - DNA, 22 bp, Homo sapiens
agatggttttgtctttatgatt

SEQ ID NO: 7643282 - DNA, 22 bp, Homo sapiens
agatggttgtcgcaaatgaatg

SEQ ID NO: 7643283 - DNA, 22 bp, Homo sapiens
agatgtaaactctcatgtcatt

SEQ ID NO: 7643284 - DNA, 22 bp, Homo sapiens
agatgtaaactctcatgtcatt

SEQ ID NO: 7643285 - DNA, 22 bp, Homo sapiens
agatgtaaactctcatgtcatt

SEQ ID NO: 7643286 - DNA, 22 bp, Homo sapiens
agatgtaacggtaggtggcatt

SEQ ID NO: 7643287 - DNA, 22 bp, Homo sapiens
agatgtaacggtaggtggcatt

SEQ ID NO: 7643288 - DNA, 22 bp, Homo sapiens
agatggttatcttttctttgta

SEQ ID NO: 7643289 - DNA, 22 bp, Homo sapiens
agatggttcagaattataaaga

SEQ ID NO: 7643290 - DNA, 22 bp, Homo sapiens
agatggttatcttttctttgta

SEQ ID NO: 7643291 - DNA, 22 bp, Homo sapiens
agatggttctcagaaactcaac

SEQ ID NO: 7643292 - DNA, 22 bp, Homo sapiens
agatggttggtccataggccta

SEQ ID NO: 7643293 - DNA, 22 bp, Homo sapiens
agatggttatctaagtgaaaaa

SEQ ID NO: 7643294 - DNA, 22 bp, Homo sapiens
agatggtgtttccccaggtgga

SEQ ID NO: 7643295 - DNA, 20 bp, Homo sapiens
agatggtgggctggaacacc

SEQ ID NO: 7643296 - DNA, 22 bp, Homo sapiens
agatggtggactatctgacttg

SEQ ID NO: 7643297 - DNA, 20 bp, Homo sapiens
agatggtgggctggaacacc

SEQ ID NO: 7643298 - DNA, 22 bp, Homo sapiens
atttgcttctagtcagttccat

SEQ ID NO: 7643299 - DNA, 22 bp, Homo sapiens
atttgcttctagtcagttccat

SEQ ID NO: 7643300 - DNA, 22 bp, Homo sapiens
atttgcttcctaatactcatat

SEQ ID NO: 7643301 - DNA, 22 bp, Homo sapiens
atttgcttcctaatactcatat

SEQ ID NO: 7643302 - DNA, 22 bp, Homo sapiens
atttgcttctagtcagttccat

SEQ ID NO: 7643303 - DNA, 22 bp, Homo sapiens
atttgcttctgctaaacaactt

SEQ ID NO: 7643304 - DNA, 22 bp, Homo sapiens
atttgcttctgctaaacaactt

SEQ ID NO: 7643305 - DNA, 22 bp, Homo sapiens
atttgcttctgtgaaatcaagt

SEQ ID NO: 7643306 - DNA, 22 bp, Homo sapiens
atttgcttctgtgaaatcaagt

SEQ ID NO: 7643307 - DNA, 22 bp, Homo sapiens
atttgcttctgtgaaatcaagt

SEQ ID NO: 7643308 - DNA, 22 bp, Homo sapiens
atttgcttctgctaaacaactt

SEQ ID NO: 7643309 - DNA, 22 bp, Homo sapiens
atttgcttctgctaaacaactt

SEQ ID NO: 7643310 - DNA, 22 bp, Homo sapiens
atttgcttctgtgaaatcaagt

SEQ ID NO: 7643311 - DNA, 22 bp, Homo sapiens
atttgcttctgtgaaatcaagt

SEQ ID NO: 7643312 - DNA, 22 bp, Homo sapiens
atttgcttatctccacagttgt

SEQ ID NO: 7643313 - DNA, 22 bp, Homo sapiens
atttgcttatctccacagttgt

SEQ ID NO: 7643314 - DNA, 22 bp, Homo sapiens
atttgcttatctccacagttgt

SEQ ID NO: 7643315 - DNA, 22 bp, Homo sapiens
atttgcttagattcagcacttt

SEQ ID NO: 7643316 - DNA, 22 bp, Homo sapiens
atttgcttatctccacagttgt

SEQ ID NO: 7643317 - DNA, 22 bp, Homo sapiens
atttgcttatctccacagttgt

SEQ ID NO: 7643318 - DNA, 22 bp, Homo sapiens
atttgcttatctccacagttgt

SEQ ID NO: 7643319 - DNA, 22 bp, Homo sapiens
atttgcttcatagatctgtgga

SEQ ID NO: 7643320 - DNA, 22 bp, Homo sapiens
atttgcttcatagatctgtgga

SEQ ID NO: 7643321 - DNA, 22 bp, Homo sapiens
atttgcttatctccacagttgt

SEQ ID NO: 7643322 - DNA, 22 bp, Homo sapiens
atttgcttcatagatctgtgga

SEQ ID NO: 7643323 - DNA, 22 bp, Homo sapiens
atttgcttcctaatactcatat

SEQ ID NO: 7643324 - DNA, 22 bp, Homo sapiens
atttgcttgtgctatgaaagtt

SEQ ID NO: 7643325 - DNA, 22 bp, Homo sapiens
atttgcttgtgctatgaaagtt

SEQ ID NO: 7643326 - DNA, 22 bp, Homo sapiens
atttgcttgtgctatgaaagtt

SEQ ID NO: 7643327 - DNA, 19 bp, Homo sapiens
atttgcttgtctgctctgc

SEQ ID NO: 7643328 - DNA, 19 bp, Homo sapiens
atttgcttgtctgctctgc

SEQ ID NO: 7643329 - DNA, 19 bp, Homo sapiens
atttgcttgtctgctctgc

SEQ ID NO: 7643330 - DNA, 19 bp, Homo sapiens
atttgcttgtctgctctgc

SEQ ID NO: 7643331 - DNA, 22 bp, Homo sapiens
atttgcttgtgctatgaaagtt

SEQ ID NO: 7643332 - DNA, 22 bp, Homo sapiens
atttgcttgtgctatgaaagtt

SEQ ID NO: 7643333 - DNA, 22 bp, Homo sapiens
atttgcttgtcctggtgactgt

SEQ ID NO: 7643334 - DNA, 22 bp, Homo sapiens
atttgcttgtcctggtgactgt

SEQ ID NO: 7643335 - DNA, 22 bp, Homo sapiens
atttgcttgtcctggtgactgt

SEQ ID NO: 7643336 - DNA, 22 bp, Homo sapiens
atttgcttgtaaatgtatgcct

SEQ ID NO: 7643337 - DNA, 22 bp, Homo sapiens
atttgcttgtaaatgtatgcct

SEQ ID NO: 7643338 - DNA, 22 bp, Homo sapiens
atttgcttgtaaatgtatgcct

SEQ ID NO: 7643339 - DNA, 22 bp, Homo sapiens
atttgcttgtaaatgtatgcct

SEQ ID NO: 7643340 - DNA, 22 bp, Homo sapiens
atttgcttgtaaatgtatgcct

SEQ ID NO: 7643341 - DNA, 22 bp, Homo sapiens
atttgcttgtaaatgtatgcct

SEQ ID NO: 7643342 - DNA, 22 bp, Homo sapiens
atttgcttgactatggcttgca

SEQ ID NO: 7643343 - DNA, 22 bp, Homo sapiens
atttgcttggtcttctctccgt

SEQ ID NO: 7643344 - DNA, 22 bp, Homo sapiens
atttgcttcttgcttccagcac

SEQ ID NO: 7643345 - DNA, 22 bp, Homo sapiens
atttgcttcttgcttccagcac

SEQ ID NO: 7643346 - DNA, 22 bp, Homo sapiens
atttgcttctgtgaaatcaagt

SEQ ID NO: 7643347 - DNA, 22 bp, Homo sapiens
atttgcttgactatggcttgca

SEQ ID NO: 7643348 - DNA, 22 bp, Homo sapiens
atttgcttgactatggcttgca

SEQ ID NO: 7643349 - DNA, 22 bp, Homo sapiens
atttgcttgactatggcttgca

SEQ ID NO: 7643350 - DNA, 22 bp, Homo sapiens
atttgcttgactatggcttgca

SEQ ID NO: 7643351 - DNA, 22 bp, Homo sapiens
agatgtctgtaattctaagcat

SEQ ID NO: 7643352 - DNA, 22 bp, Homo sapiens
agatgtgactgggcaagttact

SEQ ID NO: 7643353 - DNA, 19 bp, Homo sapiens
agatgtctatttgactatc

SEQ ID NO: 7643354 - DNA, 22 bp, Homo sapiens
agatgtctcactcagttctcat

SEQ ID NO: 7643355 - DNA, 22 bp, Homo sapiens
agatgtagtagtgggtctttta

SEQ ID NO: 7643356 - DNA, 22 bp, Homo sapiens
agatgtcagctcacatgccacc

SEQ ID NO: 7643357 - DNA, 22 bp, Homo sapiens
agatgtcagctcacatgccacc

SEQ ID NO: 7643358 - DNA, 22 bp, Homo sapiens
agatgtgagaatcaagtgacca

SEQ ID NO: 7643359 - DNA, 22 bp, Homo sapiens
agatgtgagtggctgtacagtg

SEQ ID NO: 7643360 - DNA, 22 bp, Homo sapiens
agatgtgagaatcaagtgacca

SEQ ID NO: 7643361 - DNA, 22 bp, Homo sapiens
agatgtgcctccaaggggtgca

SEQ ID NO: 7643362 - DNA, 22 bp, Homo sapiens
agatgtgcctccaaggggtgca

SEQ ID NO: 7643363 - DNA, 22 bp, Homo sapiens
agatgtggaaagaagttagaag

SEQ ID NO: 7643364 - DNA, 22 bp, Homo sapiens
agatgtggaacactagactgct

SEQ ID NO: 7643365 - DNA, 22 bp, Homo sapiens
atttgctggtgaatgtatagct

SEQ ID NO: 7643366 - DNA, 22 bp, Homo sapiens
atttgctggtgaatgtatagct

SEQ ID NO: 7643367 - DNA, 20 bp, Homo sapiens
atttgctgtcagtccctagg

SEQ ID NO: 7643368 - DNA, 22 bp, Homo sapiens
atttgctggtgaaatagtgaca

SEQ ID NO: 7643369 - DNA, 22 bp, Homo sapiens
atttgctggtgaaatagtgaca

SEQ ID NO: 7643370 - DNA, 22 bp, Homo sapiens
atttgctgccagtgtacactta

SEQ ID NO: 7643371 - DNA, 22 bp, Homo sapiens
atttgctgtgtgctttagagac

SEQ ID NO: 7643372 - DNA, 20 bp, Homo sapiens
atttgcttaccttgtttcta

SEQ ID NO: 7643373 - DNA, 20 bp, Homo sapiens
atttgcttaccttgtttcta

SEQ ID NO: 7643374 - DNA, 20 bp, Homo sapiens
atttgcttaccttgtttcta

SEQ ID NO: 7643375 - DNA, 22 bp, Homo sapiens
atttgcttagattcagcacttt

SEQ ID NO: 7643376 - DNA, 22 bp, Homo sapiens
atttgcttagattcagcacttt

SEQ ID NO: 7643377 - DNA, 22 bp, Homo sapiens
atttgcttagattcagcacttt

SEQ ID NO: 7643378 - DNA, 22 bp, Homo sapiens
atttgctgatcatctagctaat

SEQ ID NO: 7643379 - DNA, 19 bp, Homo sapiens
atttgctgcaatgcttcac

SEQ ID NO: 7643380 - DNA, 22 bp, Homo sapiens
agatgtggatcctagggtagaa

SEQ ID NO: 7643381 - DNA, 20 bp, Homo sapiens
atttgctgagctttttctcc

SEQ ID NO: 7643382 - DNA, 20 bp, Homo sapiens
atttgctgagctttttctcc

SEQ ID NO: 7643383 - DNA, 22 bp, Homo sapiens
agatgtggatcctagggtagaa

SEQ ID NO: 7643384 - DNA, 22 bp, Homo sapiens
agatgtggatcctagggtagaa

SEQ ID NO: 7643385 - DNA, 19 bp, Homo sapiens
agatgtggagtttgatttc

SEQ ID NO: 7643386 - DNA, 19 bp, Homo sapiens
agatgtggagtttgatttc

SEQ ID NO: 7643387 - DNA, 22 bp, Homo sapiens
agatgtggaaagaagttagaag

SEQ ID NO: 7643388 - DNA, 22 bp, Homo sapiens
agatgtggaaagaagttagaag

SEQ ID NO: 7643389 - DNA, 22 bp, Homo sapiens
agatgtggaacactagactgct

SEQ ID NO: 7643390 - DNA, 20 bp, Homo sapiens
agcaaacaggctccaccaga

SEQ ID NO: 7643391 - DNA, 20 bp, Homo sapiens
agcaaacaggctccaccaga

SEQ ID NO: 7643392 - DNA, 22 bp, Homo sapiens
agcaaacagatgtctcctttag

SEQ ID NO: 7643393 - DNA, 22 bp, Homo sapiens
agcaaacagatgtctcctttag

SEQ ID NO: 7643394 - DNA, 20 bp, Homo sapiens
agcaaacaggctccaccaga

SEQ ID NO: 7643395 - DNA, 22 bp, Homo sapiens
agcaaacacaagaggtaatttc

SEQ ID NO: 7643396 - DNA, 22 bp, Homo sapiens
agcaaacacaagaggtaatttc

SEQ ID NO: 7643397 - DNA, 22 bp, Homo sapiens
agcaaacacaagaggtaatttc

SEQ ID NO: 7643398 - DNA, 22 bp, Homo sapiens
agcaaacagatgtctcctttag

SEQ ID NO: 7643399 - DNA, 22 bp, Homo sapiens
agcaaacagatgtctcctttag

SEQ ID NO: 7643400 - DNA, 22 bp, Homo sapiens
agcaaacagatgtctcctttag

SEQ ID NO: 7643401 - DNA, 22 bp, Homo sapiens
agcaaacacaagaggtaatttc

SEQ ID NO: 7643402 - DNA, 20 bp, Homo sapiens
agcaaaatgcaagattttca

SEQ ID NO: 7643403 - DNA, 20 bp, Homo sapiens
agcaaaatgcaagattttca

SEQ ID NO: 7643404 - DNA, 20 bp, Homo sapiens
agcaaaatgcaagattttca

SEQ ID NO: 7643405 - DNA, 20 bp, Homo sapiens
agcaaaatgcaagattttca

SEQ ID NO: 7643406 - DNA, 22 bp, Homo sapiens
agcaaaataaggtaatttattg

SEQ ID NO: 7643407 - DNA, 20 bp, Homo sapiens
agcaaaatgcaagattttca

SEQ ID NO: 7643408 - DNA, 22 bp, Homo sapiens
agcaaaataaggtaatttattg

SEQ ID NO: 7643409 - DNA, 22 bp, Homo sapiens
agcaaaataaggtaatttattg

SEQ ID NO: 7643410 - DNA, 22 bp, Homo sapiens
agcaaaataaggtaatttattg

SEQ ID NO: 7643411 - DNA, 22 bp, Homo sapiens
agcaaaataaggtaatttattg

SEQ ID NO: 7643412 - DNA, 22 bp, Homo sapiens
agcaaaataaggtaatttattg

SEQ ID NO: 7643413 - DNA, 22 bp, Homo sapiens
agcaaaataaggtaatttattg

SEQ ID NO: 7643414 - DNA, 22 bp, Homo sapiens
agcaaacattcagcagattggc

SEQ ID NO: 7643415 - DNA, 22 bp, Homo sapiens
agcaaacattcagcagattggc

SEQ ID NO: 7643416 - DNA, 22 bp, Homo sapiens
agcaaacattcagcagattggc

SEQ ID NO: 7643417 - DNA, 22 bp, Homo sapiens
agcaaacagtttctggggatct

SEQ ID NO: 7643418 - DNA, 22 bp, Homo sapiens
agcaaacagtttctggggatct

SEQ ID NO: 7643419 - DNA, 22 bp, Homo sapiens
agcaaacattcagcagattggc

SEQ ID NO: 7643420 - DNA, 22 bp, Homo sapiens
agcaaacagtgtgctaagaaat

SEQ ID NO: 7643421 - DNA, 22 bp, Homo sapiens
agcaaacagtgtgctaagaaat

SEQ ID NO: 7643422 - DNA, 22 bp, Homo sapiens
agcaaacagtgtgctaagaaat

SEQ ID NO: 7643423 - DNA, 22 bp, Homo sapiens
agcaaacagtgtgctaagaaat

SEQ ID NO: 7643424 - DNA, 22 bp, Homo sapiens
agcaaacagtttctggggatct

SEQ ID NO: 7643425 - DNA, 22 bp, Homo sapiens
agcaaacagtgtgctaagaaat

SEQ ID NO: 7643426 - DNA, 22 bp, Homo sapiens
agcaaacagtgtgctaagaaat

SEQ ID NO: 7643427 - DNA, 22 bp, Homo sapiens
agcaaacagtgtgctaagaaat

SEQ ID NO: 7643428 - DNA, 22 bp, Homo sapiens
agcaaacagtgtgctaagaaat

SEQ ID NO: 7643429 - DNA, 20 bp, Homo sapiens
agcaaacaggctccaccaga

SEQ ID NO: 7643430 - DNA, 20 bp, Homo sapiens
agcaaacaggctccaccaga

SEQ ID NO: 7643431 - DNA, 22 bp, Homo sapiens
agcaaacagtgtgctaagaaat

SEQ ID NO: 7643432 - DNA, 22 bp, Homo sapiens
agcaaacagtgtgctaagaaat

SEQ ID NO: 7643433 - DNA, 22 bp, Homo sapiens
agcaaacagtgtgctaagaaat

SEQ ID NO: 7643434 - DNA, 22 bp, Homo sapiens
agcaaacagtgtgctaagaaat

SEQ ID NO: 7643435 - DNA, 17 bp, Homo sapiens
agcaaaagtatcaaagc

SEQ ID NO: 7643436 - DNA, 17 bp, Homo sapiens
agcaaaagtatcaaagc

SEQ ID NO: 7643437 - DNA, 17 bp, Homo sapiens
agcaaaagtatcaaagc

SEQ ID NO: 7643438 - DNA, 17 bp, Homo sapiens
agcaaaagtatcaaagc

SEQ ID NO: 7643439 - DNA, 17 bp, Homo sapiens
agcaaaagtatcaaagc

SEQ ID NO: 7643440 - DNA, 17 bp, Homo sapiens
agcaaaagtatcaaagc

SEQ ID NO: 7643441 - DNA, 22 bp, Homo sapiens
agatttcaggttggggcagaag

SEQ ID NO: 7643442 - DNA, 22 bp, Homo sapiens
agatttcaggttggggcagaag

SEQ ID NO: 7643443 - DNA, 22 bp, Homo sapiens
agatttccagaccaatttctca

SEQ ID NO: 7643444 - DNA, 22 bp, Homo sapiens
agatttccatctttttcatgtg

SEQ ID NO: 7643445 - DNA, 22 bp, Homo sapiens
agcaaaagatagattaacaaga

SEQ ID NO: 7643446 - DNA, 22 bp, Homo sapiens
agcaaaataaggtaatttattg

SEQ ID NO: 7643447 - DNA, 17 bp, Homo sapiens
agcaaaagtatcaaagc

SEQ ID NO: 7643448 - DNA, 17 bp, Homo sapiens
agcaaaagtatcaaagc

SEQ ID NO: 7643449 - DNA, 17 bp, Homo sapiens
agcaaaagtatcaaagc

SEQ ID NO: 7643450 - DNA, 17 bp, Homo sapiens
agcaaaagtatcaaagc

SEQ ID NO: 7643451 - DNA, 17 bp, Homo sapiens
agcaaaagtatcaaagc

SEQ ID NO: 7643452 - DNA, 17 bp, Homo sapiens
agcaaaagtatcaaagc

SEQ ID NO: 7643453 - DNA, 22 bp, Homo sapiens
atttgctttaaggtataaaagg

SEQ ID NO: 7643454 - DNA, 22 bp, Homo sapiens
atttgctttaaggtataaaagg

SEQ ID NO: 7643455 - DNA, 22 bp, Homo sapiens
atttgctttaaggtataaaagg

SEQ ID NO: 7643456 - DNA, 22 bp, Homo sapiens
atttgctttaaggtataaaagg

SEQ ID NO: 7643457 - DNA, 22 bp, Homo sapiens
atttgcttgttcaccagtactt

SEQ ID NO: 7643458 - DNA, 22 bp, Homo sapiens
atttgcttgttcaccagtactt

SEQ ID NO: 7643459 - DNA, 22 bp, Homo sapiens
atttgcttgttcaccagtactt

SEQ ID NO: 7643460 - DNA, 22 bp, Homo sapiens
atttgctttcaggtataaaagg

SEQ ID NO: 7643461 - DNA, 22 bp, Homo sapiens
atttgctttcaggtataaaagg

SEQ ID NO: 7643462 - DNA, 22 bp, Homo sapiens
atttgctttcagccttaaggat

SEQ ID NO: 7643463 - DNA, 22 bp, Homo sapiens
atttgctttcagccttaaggat

SEQ ID NO: 7643464 - DNA, 22 bp, Homo sapiens
atttgctttcagccttaaggat

SEQ ID NO: 7643465 - DNA, 22 bp, Homo sapiens
agatttcaatgtgagcattagt

SEQ ID NO: 7643466 - DNA, 22 bp, Homo sapiens
agatttcacatgctgctctatt

SEQ ID NO: 7643467 - DNA, 22 bp, Homo sapiens
agatttcagatgctcggcagtt

SEQ ID NO: 7643468 - DNA, 22 bp, Homo sapiens
agatttcacatgctgctctatt

SEQ ID NO: 7643469 - DNA, 22 bp, Homo sapiens
agatttcacatgctgctctatt

SEQ ID NO: 7643470 - DNA, 22 bp, Homo sapiens
atttgctttcccttccctgaca

SEQ ID NO: 7643471 - DNA, 22 bp, Homo sapiens
atttgctttcccttccctgaca

SEQ ID NO: 7643472 - DNA, 22 bp, Homo sapiens
atttgctttcccttccctgaca

SEQ ID NO: 7643473 - DNA, 22 bp, Homo sapiens
atttgctttcaggtataaaagg

SEQ ID NO: 7643474 - DNA, 22 bp, Homo sapiens
atttgctttcaggtataaaagg

SEQ ID NO: 7643475 - DNA, 22 bp, Homo sapiens
atttaagggatttggagaccaa

SEQ ID NO: 7643476 - DNA, 22 bp, Homo sapiens
atttaagattgcgtattcatgt

SEQ ID NO: 7643477 - DNA, 22 bp, Homo sapiens
atttaagggatttggagaccaa

SEQ ID NO: 7643478 - DNA, 22 bp, Homo sapiens
atttaataccacttggtgcttt

SEQ ID NO: 7643479 - DNA, 22 bp, Homo sapiens
atttaataccacttggtgcttt

SEQ ID NO: 7643480 - DNA, 22 bp, Homo sapiens
atttaagggatttggagaccaa

SEQ ID NO: 7643481 - DNA, 22 bp, Homo sapiens
atttaagggatttggagaccaa

SEQ ID NO: 7643482 - DNA, 23 bp, Homo sapiens
atttaatgctgagttgaatgtta

SEQ ID NO: 7643483 - DNA, 22 bp, Homo sapiens
atttaatgaggctgggggtgga

SEQ ID NO: 7643484 - DNA, 22 bp, Homo sapiens
atttaatgaggctgggggtgga

SEQ ID NO: 7643485 - DNA, 23 bp, Homo sapiens
atttaatgctgagttgaatgtta

SEQ ID NO: 7643486 - DNA, 18 bp, Homo sapiens
atttaatgaactgaaagc

SEQ ID NO: 7643487 - DNA, 18 bp, Homo sapiens
atttaatgaactgaaagc

SEQ ID NO: 7643488 - DNA, 18 bp, Homo sapiens
atttaatgaactgaaagc

SEQ ID NO: 7643489 - DNA, 18 bp, Homo sapiens
atttaatgaactgaaagc

SEQ ID NO: 7643490 - DNA, 22 bp, Homo sapiens
atttaataccacttggtgcttt

SEQ ID NO: 7643491 - DNA, 18 bp, Homo sapiens
atttaatgaactgaaagc

SEQ ID NO: 7643492 - DNA, 22 bp, Homo sapiens
atttaatgggtagacattgtta

SEQ ID NO: 7643493 - DNA, 22 bp, Homo sapiens
atttaatgggtagacattgtta

SEQ ID NO: 7643494 - DNA, 22 bp, Homo sapiens
atttaatgggtagacattgtta

SEQ ID NO: 7643495 - DNA, 22 bp, Homo sapiens
agagtggcccgttggcctgaac

SEQ ID NO: 7643496 - DNA, 23 bp, Homo sapiens
atttaatgctgagttgaatgtta

SEQ ID NO: 7643497 - DNA, 22 bp, Homo sapiens
atttaatgggtagacattgtta

SEQ ID NO: 7643498 - DNA, 22 bp, Homo sapiens
atttaatgggtagacattgtta

SEQ ID NO: 7643499 - DNA, 22 bp, Homo sapiens
atttaatgggtagacattgtta

SEQ ID NO: 7643500 - DNA, 23 bp, Homo sapiens
atttaatgctgagttgaatgtta

SEQ ID NO: 7643501 - DNA, 22 bp, Homo sapiens
agagtggcttctttgacatgct

SEQ ID NO: 7643502 - DNA, 22 bp, Homo sapiens
agagtggcctggcctggggcat

SEQ ID NO: 7643503 - DNA, 17 bp, Homo sapiens
agagtggctaaggctca

SEQ ID NO: 7643504 - DNA, 23 bp, Homo sapiens
agagtggcctactcacactcatt

SEQ ID NO: 7643505 - DNA, 23 bp, Homo sapiens
agagtggcctactcacactcatt

SEQ ID NO: 7643506 - DNA, 22 bp, Homo sapiens
agagtggcctggcctggggcat

SEQ ID NO: 7643507 - DNA, 18 bp, Homo sapiens
attgttaatagagtactt

SEQ ID NO: 7643508 - DNA, 22 bp, Homo sapiens
atttaagaggctgctagagtat

SEQ ID NO: 7643509 - DNA, 22 bp, Homo sapiens
atttaagaggctgctagagtat

SEQ ID NO: 7643510 - DNA, 22 bp, Homo sapiens
atttaagaggctgctagagtat

SEQ ID NO: 7643511 - DNA, 22 bp, Homo sapiens
atttaagattgcgtattcatgt

SEQ ID NO: 7643512 - DNA, 22 bp, Homo sapiens
atttaagattgcgtattcatgt

SEQ ID NO: 7643513 - DNA, 22 bp, Homo sapiens
atttaagattgcgtattcatgt

SEQ ID NO: 7643514 - DNA, 22 bp, Homo sapiens
atttaagattgcgtattcatgt

SEQ ID NO: 7643515 - DNA, 22 bp, Homo sapiens
atttaagattgcgtattcatgt

SEQ ID NO: 7643516 - DNA, 22 bp, Homo sapiens
atttaagattgcgtattcatgt

SEQ ID NO: 7643517 - DNA, 22 bp, Homo sapiens
atttaacaagacagagaactgg

SEQ ID NO: 7643518 - DNA, 22 bp, Homo sapiens
atttaacaagacagagaactgg

SEQ ID NO: 7643519 - DNA, 22 bp, Homo sapiens
atttaagactgacttcaccagt

SEQ ID NO: 7643520 - DNA, 22 bp, Homo sapiens
atttaagactgacttcaccagt

SEQ ID NO: 7643521 - DNA, 22 bp, Homo sapiens
atttaagactgacttcaccagt

SEQ ID NO: 7643522 - DNA, 22 bp, Homo sapiens
atttaagactgacttcaccagt

SEQ ID NO: 7643523 - DNA, 22 bp, Homo sapiens
atttaagactgacttcaccagt

SEQ ID NO: 7643524 - DNA, 18 bp, Homo sapiens
attgttaatagagtactt

SEQ ID NO: 7643525 - DNA, 22 bp, Homo sapiens
atttaaattttctgatggagag

SEQ ID NO: 7643526 - DNA, 22 bp, Homo sapiens
atttaaattttctgatggagag

SEQ ID NO: 7643527 - DNA, 22 bp, Homo sapiens
atttaaattttctgatggagag

SEQ ID NO: 7643528 - DNA, 22 bp, Homo sapiens
atttaaattttctgatggagag

SEQ ID NO: 7643529 - DNA, 22 bp, Homo sapiens
atttaaattttctgatggagag

SEQ ID NO: 7643530 - DNA, 22 bp, Homo sapiens
atttaaattttctgatggagag

SEQ ID NO: 7643531 - DNA, 22 bp, Homo sapiens
atttaacaagacagagaactgg

SEQ ID NO: 7643532 - DNA, 22 bp, Homo sapiens
atttaacaagacagagaactgg

SEQ ID NO: 7643533 - DNA, 22 bp, Homo sapiens
attgttaataactattacattg

SEQ ID NO: 7643534 - DNA, 18 bp, Homo sapiens
attgttaatagagtactt

SEQ ID NO: 7643535 - DNA, 22 bp, Homo sapiens
attgttaataactattacattg

SEQ ID NO: 7643536 - DNA, 19 bp, Homo sapiens
attcttctcttcctgctgt

SEQ ID NO: 7643537 - DNA, 19 bp, Homo sapiens
attcttctcttcctgctgt

SEQ ID NO: 7643538 - DNA, 19 bp, Homo sapiens
attcttctcttcctgctgt

SEQ ID NO: 7643539 - DNA, 22 bp, Homo sapiens
attgttaataactattacattg

SEQ ID NO: 7643540 - DNA, 22 bp, Homo sapiens
attgttaataactattacattg

SEQ ID NO: 7643541 - DNA, 19 bp, Homo sapiens
attcttctcaaatatccat

SEQ ID NO: 7643542 - DNA, 22 bp, Homo sapiens
attcttctaatatgatcgtgtt

SEQ ID NO: 7643543 - DNA, 22 bp, Homo sapiens
attcttctaatatgatcgtgtt

SEQ ID NO: 7643544 - DNA, 19 bp, Homo sapiens
attcttctcaaatatccat

SEQ ID NO: 7643545 - DNA, 19 bp, Homo sapiens
attcttctcaaatatccat

SEQ ID NO: 7643546 - DNA, 19 bp, Homo sapiens
attcttctcaaatatccat

SEQ ID NO: 7643547 - DNA, 22 bp, Homo sapiens
attcttctctgggttgggttca

SEQ ID NO: 7643548 - DNA, 22 bp, Homo sapiens
attcttctctgggttgggttca

SEQ ID NO: 7643549 - DNA, 22 bp, Homo sapiens
attcttctcccttagggcccag

SEQ ID NO: 7643550 - DNA, 19 bp, Homo sapiens
attcttctcaaatatccat

SEQ ID NO: 7643551 - DNA, 19 bp, Homo sapiens
attcttctcaaatatccat

SEQ ID NO: 7643552 - DNA, 22 bp, Homo sapiens
attcttctcccttagggcccag

SEQ ID NO: 7643553 - DNA, 22 bp, Homo sapiens
attcttcatttactgttacttg

SEQ ID NO: 7643554 - DNA, 22 bp, Homo sapiens
attcttcatttactgttacttg

SEQ ID NO: 7643555 - DNA, 22 bp, Homo sapiens
attcttcatttactgttacttg

SEQ ID NO: 7643556 - DNA, 22 bp, Homo sapiens
attcttcctcatcaatctgtag

SEQ ID NO: 7643557 - DNA, 22 bp, Homo sapiens
attcttctaatatgatcgtgtt

SEQ ID NO: 7643558 - DNA, 22 bp, Homo sapiens
attcttcattgttgattcatgt

SEQ ID NO: 7643559 - DNA, 22 bp, Homo sapiens
attcttcattgttgattcatgt

SEQ ID NO: 7643560 - DNA, 22 bp, Homo sapiens
attcttcattgttgattcatgt

SEQ ID NO: 7643561 - DNA, 22 bp, Homo sapiens
attcttcatttactgttacttg

SEQ ID NO: 7643562 - DNA, 22 bp, Homo sapiens
attcttcatttactgttacttg

SEQ ID NO: 7643563 - DNA, 22 bp, Homo sapiens
attcttcatgttgaagctgtca

SEQ ID NO: 7643564 - DNA, 22 bp, Homo sapiens
attcttcatggctgtgagtcct

SEQ ID NO: 7643565 - DNA, 22 bp, Homo sapiens
attcttcatgttgaagctgtca

SEQ ID NO: 7643566 - DNA, 22 bp, Homo sapiens
attcttcatgttgaagctgtca

SEQ ID NO: 7643567 - DNA, 22 bp, Homo sapiens
attcttcatcagagatgcacta

SEQ ID NO: 7643568 - DNA, 22 bp, Homo sapiens
attcttcatcagagatgcacta

SEQ ID NO: 7643569 - DNA, 22 bp, Homo sapiens
attcttcatggctgtgagtcct

SEQ ID NO: 7643570 - DNA, 22 bp, Homo sapiens
attcttcatggctgtgagtcct

SEQ ID NO: 7643571 - DNA, 23 bp, Homo sapiens
attcttcattatcttctagaaaa

SEQ ID NO: 7643572 - DNA, 23 bp, Homo sapiens
attcttcattatcttctagaaaa

SEQ ID NO: 7643573 - DNA, 23 bp, Homo sapiens
attcttcattatcttctagaaaa

SEQ ID NO: 7643574 - DNA, 23 bp, Homo sapiens
attcttcattatcttctagaaaa

SEQ ID NO: 7643575 - DNA, 23 bp, Homo sapiens
attcttcattatcttctagaaaa

SEQ ID NO: 7643576 - DNA, 22 bp, Homo sapiens
attcttcattgttgattcatgt

SEQ ID NO: 7643577 - DNA, 22 bp, Homo sapiens
attcttcattgttgattcatgt

SEQ ID NO: 7643578 - DNA, 22 bp, Homo sapiens
attcttcattgttgattcatgt

SEQ ID NO: 7643579 - DNA, 22 bp, Homo sapiens
attcttcattgttgattcatgt

SEQ ID NO: 7643580 - DNA, 22 bp, Homo sapiens
attcttcatacctactgaggtt

SEQ ID NO: 7643581 - DNA, 22 bp, Homo sapiens
attcttcatcactaccttgtga

SEQ ID NO: 7643582 - DNA, 22 bp, Homo sapiens
attcttcatcactaccttgtga

SEQ ID NO: 7643583 - DNA, 22 bp, Homo sapiens
attcttcatacagacaagtcct

SEQ ID NO: 7643584 - DNA, 22 bp, Homo sapiens
agaggtatgtgtcagtgcttat

SEQ ID NO: 7643585 - DNA, 22 bp, Homo sapiens
attcttcatacagacaagtcct

SEQ ID NO: 7643586 - DNA, 22 bp, Homo sapiens
attcttcatacagacaagtcct

SEQ ID NO: 7643587 - DNA, 22 bp, Homo sapiens
agaggtaattatagcctggccg

SEQ ID NO: 7643588 - DNA, 22 bp, Homo sapiens
agaggtatatattctccatatt

SEQ ID NO: 7643589 - DNA, 22 bp, Homo sapiens
agaggtatatattctccatatt

SEQ ID NO: 7643590 - DNA, 22 bp, Homo sapiens
agaggtatatattctccatatt

SEQ ID NO: 7643591 - DNA, 22 bp, Homo sapiens
agaggtagaggttgcagtgagc

SEQ ID NO: 7643592 - DNA, 22 bp, Homo sapiens
agaggtagaggttgcagtgagc

SEQ ID NO: 7643593 - DNA, 22 bp, Homo sapiens
agaggtagaggttgcagtgagc

SEQ ID NO: 7643594 - DNA, 22 bp, Homo sapiens
agaggtagaaaataatggagag

SEQ ID NO: 7643595 - DNA, 22 bp, Homo sapiens
agaggtaaagagaggggaaatt

SEQ ID NO: 7643596 - DNA, 22 bp, Homo sapiens
agaggtaaagagaggggaaatt

SEQ ID NO: 7643597 - DNA, 22 bp, Homo sapiens
agagggttgaacctataaacta

SEQ ID NO: 7643598 - DNA, 22 bp, Homo sapiens
agagggtggtgaggcctggttc

SEQ ID NO: 7643599 - DNA, 22 bp, Homo sapiens
agagggtggtgaggcctggttc

SEQ ID NO: 7643600 - DNA, 22 bp, Homo sapiens
agaggtagaaaataatggagag

SEQ ID NO: 7643601 - DNA, 22 bp, Homo sapiens
agaggtagaaaataatggagag

SEQ ID NO: 7643602 - DNA, 22 bp, Homo sapiens
agaggtagaaaataatggagag

SEQ ID NO: 7643603 - DNA, 22 bp, Homo sapiens
agaggtaagcagtggcaagtgc

SEQ ID NO: 7643604 - DNA, 22 bp, Homo sapiens
agaggtagaaaataatggagag

SEQ ID NO: 7643605 - DNA, 22 bp, Homo sapiens
agagggtgggcacgtgatggat

SEQ ID NO: 7643606 - DNA, 22 bp, Homo sapiens
agagggtgggcacgtgatggat

SEQ ID NO: 7643607 - DNA, 22 bp, Homo sapiens
agagggtgggcacgtgatggat

SEQ ID NO: 7643608 - DNA, 22 bp, Homo sapiens
agagggtgggcacgtgatggat

SEQ ID NO: 7643609 - DNA, 22 bp, Homo sapiens
agagggtggtgaggcctggttc

SEQ ID NO: 7643610 - DNA, 22 bp, Homo sapiens
agagggtggtgaggcctggttc

SEQ ID NO: 7643611 - DNA, 22 bp, Homo sapiens
agagggtggtgaggcctggttc

SEQ ID NO: 7643612 - DNA, 22 bp, Homo sapiens
agagggtggtgaggcctggttc

SEQ ID NO: 7643613 - DNA, 22 bp, Homo sapiens
agagggtggtgaggcctggttc

SEQ ID NO: 7643614 - DNA, 22 bp, Homo sapiens
atttattctccagatggcgaga

SEQ ID NO: 7643615 - DNA, 22 bp, Homo sapiens
atttattgaacactgactatgt

SEQ ID NO: 7643616 - DNA, 22 bp, Homo sapiens
atttattctccagatggcgaga

SEQ ID NO: 7643617 - DNA, 22 bp, Homo sapiens
atttattgaacactgactatgt

SEQ ID NO: 7643618 - DNA, 22 bp, Homo sapiens
atttattgaacactgactatgt

SEQ ID NO: 7643619 - DNA, 22 bp, Homo sapiens
atttattgaacactgactatgt

SEQ ID NO: 7643620 - DNA, 22 bp, Homo sapiens
atttattgaacactgactatgt

SEQ ID NO: 7643621 - DNA, 22 bp, Homo sapiens
atttattgaacactgactatgt

SEQ ID NO: 7643622 - DNA, 22 bp, Homo sapiens
atttattgaacactgactatgt

SEQ ID NO: 7643623 - DNA, 22 bp, Homo sapiens
atttattgaacactgactatgt

SEQ ID NO: 7643624 - DNA, 22 bp, Homo sapiens
atttattattgtggttacttct

SEQ ID NO: 7643625 - DNA, 22 bp, Homo sapiens
atttattattgtggttacttct

SEQ ID NO: 7643626 - DNA, 22 bp, Homo sapiens
atttattattgtggttacttct

SEQ ID NO: 7643627 - DNA, 22 bp, Homo sapiens
atttattattgtggttacttct

SEQ ID NO: 7643628 - DNA, 22 bp, Homo sapiens
atttattattgtggttacttct

SEQ ID NO: 7643629 - DNA, 22 bp, Homo sapiens
atttattattgtggttacttct

SEQ ID NO: 7643630 - DNA, 22 bp, Homo sapiens
atttattattgtggttacttct

SEQ ID NO: 7643631 - DNA, 22 bp, Homo sapiens
atttattattgtggttacttct

SEQ ID NO: 7643632 - DNA, 22 bp, Homo sapiens
atttattatgggatttggctca

SEQ ID NO: 7643633 - DNA, 22 bp, Homo sapiens
atttattatgggatttggctca

SEQ ID NO: 7643634 - DNA, 22 bp, Homo sapiens
atttattattgtggttacttct

SEQ ID NO: 7643635 - DNA, 22 bp, Homo sapiens
atttattattgtggttacttct

SEQ ID NO: 7643636 - DNA, 22 bp, Homo sapiens
atttattattgtggttacttct

SEQ ID NO: 7643637 - DNA, 22 bp, Homo sapiens
atttattattgtggttacttct

SEQ ID NO: 7643638 - DNA, 22 bp, Homo sapiens
atttattattgtggttacttct

SEQ ID NO: 7643639 - DNA, 22 bp, Homo sapiens
atttattattgtggttacttct

SEQ ID NO: 7643640 - DNA, 22 bp, Homo sapiens
atttaggaatgttctgcacaaa

SEQ ID NO: 7643641 - DNA, 22 bp, Homo sapiens
atttaggtagctgtctaagtgt

SEQ ID NO: 7643642 - DNA, 22 bp, Homo sapiens
atttaggaatgttctgcacaaa

SEQ ID NO: 7643643 - DNA, 22 bp, Homo sapiens
atttagcttacctcgttactga

SEQ ID NO: 7643644 - DNA, 22 bp, Homo sapiens
atttagcagtcctcctcacaat

SEQ ID NO: 7643645 - DNA, 22 bp, Homo sapiens
atttagcacctccatctcaaca

SEQ ID NO: 7643646 - DNA, 22 bp, Homo sapiens
atttagcacacggcctggtaca

SEQ ID NO: 7643647 - DNA, 22 bp, Homo sapiens
atttagcacctccatctcaaca

SEQ ID NO: 7643648 - DNA, 22 bp, Homo sapiens
atttagcacctccatctcaaca

SEQ ID NO: 7643649 - DNA, 17 bp, Homo sapiens
atttagcaagtagacag

SEQ ID NO: 7643650 - DNA, 22 bp, Homo sapiens
atttagcacacggcctggtaca

SEQ ID NO: 7643651 - DNA, 22 bp, Homo sapiens
atttagtaagtacttgttgaat

SEQ ID NO: 7643652 - DNA, 22 bp, Homo sapiens
atttagtaagtacttgttgaat

SEQ ID NO: 7643653 - DNA, 22 bp, Homo sapiens
atttagtagagaaattaagaaa

SEQ ID NO: 7643654 - DNA, 22 bp, Homo sapiens
atttagtgaccagcactagaaa

SEQ ID NO: 7643655 - DNA, 22 bp, Homo sapiens
atttagtgacctgaactgaaac

SEQ ID NO: 7643656 - DNA, 22 bp, Homo sapiens
atttagtgtatcaatgtgatat

SEQ ID NO: 7643657 - DNA, 22 bp, Homo sapiens
atttattatgggatttggctca

SEQ ID NO: 7643658 - DNA, 22 bp, Homo sapiens
atttattatgggatttggctca

SEQ ID NO: 7643659 - DNA, 22 bp, Homo sapiens
atttagtttaggaaaagtaggt

SEQ ID NO: 7643660 - DNA, 22 bp, Homo sapiens
atttagtttaggaaaagtaggt

SEQ ID NO: 7643661 - DNA, 22 bp, Homo sapiens
atttagtgtgtattgctattat

SEQ ID NO: 7643662 - DNA, 22 bp, Homo sapiens
atttattatgggatttggctca

SEQ ID NO: 7643663 - DNA, 22 bp, Homo sapiens
atttattatgggatttggctca

SEQ ID NO: 7643664 - DNA, 22 bp, Homo sapiens
atttattatgggatttggctca

SEQ ID NO: 7643665 - DNA, 17 bp, Homo sapiens
atttagcaagtagacag

SEQ ID NO: 7643666 - DNA, 22 bp, Homo sapiens
atttagcaagcaggcaaattca

SEQ ID NO: 7643667 - DNA, 17 bp, Homo sapiens
atttagcaagtagacag

SEQ ID NO: 7643668 - DNA, 22 bp, Homo sapiens
atttagcaagagtacaaaataa

SEQ ID NO: 7643669 - DNA, 22 bp, Homo sapiens
atttagcaagagtacaaaataa

SEQ ID NO: 7643670 - DNA, 22 bp, Homo sapiens
atttagcaagagtacaaaataa

SEQ ID NO: 7643671 - DNA, 22 bp, Homo sapiens
atttagcaagagtacaaaataa

SEQ ID NO: 7643672 - DNA, 22 bp, Homo sapiens
atttagcaagagtacaaaataa

SEQ ID NO: 7643673 - DNA, 22 bp, Homo sapiens
atttagcaagagtacaaaataa

SEQ ID NO: 7643674 - DNA, 22 bp, Homo sapiens
atttagcaaaaaatgatgaagc

SEQ ID NO: 7643675 - DNA, 22 bp, Homo sapiens
atttagcaagagtacaaaataa

SEQ ID NO: 7643676 - DNA, 22 bp, Homo sapiens
atttagagtgttcactctgagc

SEQ ID NO: 7643677 - DNA, 22 bp, Homo sapiens
atttagagtgttcactctgagc

SEQ ID NO: 7643678 - DNA, 22 bp, Homo sapiens
atttagagtgaaacattatgca

SEQ ID NO: 7643679 - DNA, 22 bp, Homo sapiens
atttagacaccagcttgtaagg

SEQ ID NO: 7643680 - DNA, 22 bp, Homo sapiens
atttagagaataagacataaat

SEQ ID NO: 7643681 - DNA, 22 bp, Homo sapiens
agagtggggacagggcctgtcc

SEQ ID NO: 7643682 - DNA, 22 bp, Homo sapiens
agagtggggacagggcctgtcc

SEQ ID NO: 7643683 - DNA, 22 bp, Homo sapiens
agagtggggacagggcctgtcc

SEQ ID NO: 7643684 - DNA, 23 bp, Homo sapiens
atttacaggttaaatgaaatcag

SEQ ID NO: 7643685 - DNA, 22 bp, Homo sapiens
agagtggggacagggcctgtcc

SEQ ID NO: 7643686 - DNA, 22 bp, Homo sapiens
agagtggggacagggcctgtcc

SEQ ID NO: 7643687 - DNA, 23 bp, Homo sapiens
atttacaggttaaatgaaatcag

SEQ ID NO: 7643688 - DNA, 23 bp, Homo sapiens
atttacaggttaaatgaaatcag

SEQ ID NO: 7643689 - DNA, 22 bp, Homo sapiens
atttagaagttggagggcaaga

SEQ ID NO: 7643690 - DNA, 22 bp, Homo sapiens
atttagaagttggagggcaaga

SEQ ID NO: 7643691 - DNA, 22 bp, Homo sapiens
atttagacaacaagccttctcc

SEQ ID NO: 7643692 - DNA, 22 bp, Homo sapiens
atttagacacaaaagtgccatg

SEQ ID NO: 7643693 - DNA, 22 bp, Homo sapiens
atttagacaacaagccttctcc

SEQ ID NO: 7643694 - DNA, 23 bp, Homo sapiens
atttacaggttaaatgaaatcag

SEQ ID NO: 7643695 - DNA, 23 bp, Homo sapiens
atttacaggttaaatgaaatcag

SEQ ID NO: 7643696 - DNA, 22 bp, Homo sapiens
atttagactctcacctccacct

SEQ ID NO: 7643697 - DNA, 22 bp, Homo sapiens
atttagactctcacctccacct

SEQ ID NO: 7643698 - DNA, 22 bp, Homo sapiens
atttagacttcttgcaggtaat

SEQ ID NO: 7643699 - DNA, 22 bp, Homo sapiens
atttagacttcccagcactgtg

SEQ ID NO: 7643700 - DNA, 22 bp, Homo sapiens
atttagacatgtatctgatagc

SEQ ID NO: 7643701 - DNA, 22 bp, Homo sapiens
atttagacatgtatctgatagc

SEQ ID NO: 7643702 - DNA, 22 bp, Homo sapiens
atttagacaccagcttgtaagg

SEQ ID NO: 7643703 - DNA, 22 bp, Homo sapiens
atttagacacaaaagtgccatg

SEQ ID NO: 7643704 - DNA, 22 bp, Homo sapiens
atttagacaccagcttgtaagg

SEQ ID NO: 7643705 - DNA, 22 bp, Homo sapiens
agagtgggcctctgagtcccag

SEQ ID NO: 7643706 - DNA, 22 bp, Homo sapiens
agagtgggcctagctgtaaaag

SEQ ID NO: 7643707 - DNA, 22 bp, Homo sapiens
agagtgggcctagctgtaaaag

SEQ ID NO: 7643708 - DNA, 22 bp, Homo sapiens
agagtgggcaggagcctcgact

SEQ ID NO: 7643709 - DNA, 22 bp, Homo sapiens
agagtgggcaggagcctcgact

SEQ ID NO: 7643710 - DNA, 22 bp, Homo sapiens
agagtgggcaggagcctcgact

SEQ ID NO: 7643711 - DNA, 22 bp, Homo sapiens
agagtgggcctctgagtcccag

SEQ ID NO: 7643712 - DNA, 22 bp, Homo sapiens
agagtgggcctctgagtcccag

SEQ ID NO: 7643713 - DNA, 22 bp, Homo sapiens
agagtgggcaggagcctcgact

SEQ ID NO: 7643714 - DNA, 22 bp, Homo sapiens
agagtgggcctctgagtcccag

SEQ ID NO: 7643715 - DNA, 22 bp, Homo sapiens
agagtggggaaggtgttgagaa

SEQ ID NO: 7643716 - DNA, 22 bp, Homo sapiens
agagtggggaaggtgttgagaa

SEQ ID NO: 7643717 - DNA, 22 bp, Homo sapiens
agagtggggaaggtgttgagaa

SEQ ID NO: 7643718 - DNA, 22 bp, Homo sapiens
agagtggggaaggtgttgagaa

SEQ ID NO: 7643719 - DNA, 22 bp, Homo sapiens
agagtgggcctctgagtcccag

SEQ ID NO: 7643720 - DNA, 22 bp, Homo sapiens
agagtgggcctctgagtcccag

SEQ ID NO: 7643721 - DNA, 22 bp, Homo sapiens
agagtggggaaggtgttgagaa

SEQ ID NO: 7643722 - DNA, 22 bp, Homo sapiens
agagtggggaaggtgttgagaa

SEQ ID NO: 7643723 - DNA, 22 bp, Homo sapiens
agagtggggaaggtgttgagaa

SEQ ID NO: 7643724 - DNA, 22 bp, Homo sapiens
agagtggggaaggtgttgagaa

SEQ ID NO: 7643725 - DNA, 22 bp, Homo sapiens
agagtggcttgctcagctagca

SEQ ID NO: 7643726 - DNA, 22 bp, Homo sapiens
agagtggcttgctcagctagca

SEQ ID NO: 7643727 - DNA, 22 bp, Homo sapiens
agagtggcttgctcagctagca

SEQ ID NO: 7643728 - DNA, 22 bp, Homo sapiens
agagtggcttctttgacatgct

SEQ ID NO: 7643729 - DNA, 22 bp, Homo sapiens
agagtggcttctttgacatgct

SEQ ID NO: 7643730 - DNA, 22 bp, Homo sapiens
agagtgggacacgggcgctgtc

SEQ ID NO: 7643731 - DNA, 22 bp, Homo sapiens
agagtgggacacgggcgctgtc

SEQ ID NO: 7643732 - DNA, 22 bp, Homo sapiens
agagtgggacacgggcgctgtc

SEQ ID NO: 7643733 - DNA, 22 bp, Homo sapiens
agagtgggacacgggcgctgtc

SEQ ID NO: 7643734 - DNA, 22 bp, Homo sapiens
agagtggcttgctcagctagca

SEQ ID NO: 7643735 - DNA, 22 bp, Homo sapiens
agagtgggcaggagcctcgact

SEQ ID NO: 7643736 - DNA, 22 bp, Homo sapiens
agagtgggcaggagcctcgact

SEQ ID NO: 7643737 - DNA, 22 bp, Homo sapiens
agagtgggcaggagcctcgact

SEQ ID NO: 7643738 - DNA, 22 bp, Homo sapiens
agagtgggacacgggcgctgtc

SEQ ID NO: 7643739 - DNA, 22 bp, Homo sapiens
agagtgggacacgggcgctgtc

SEQ ID NO: 7643740 - DNA, 22 bp, Homo sapiens
agagtgggacacgggcgctgtc

SEQ ID NO: 7643741 - DNA, 22 bp, Homo sapiens
agagtgggacacgggcgctgtc

SEQ ID NO: 7643742 - DNA, 22 bp, Homo sapiens
agagtgggacacgggcgctgtc

SEQ ID NO: 7643743 - DNA, 22 bp, Homo sapiens
caaggcagtccctactccctgc

SEQ ID NO: 7643744 - DNA, 22 bp, Homo sapiens
caaggcagtccctactccctgc

SEQ ID NO: 7643745 - DNA, 22 bp, Homo sapiens
caaggcagtccctactccctgc

SEQ ID NO: 7643746 - DNA, 22 bp, Homo sapiens
caaggcagtccctactccctgc

SEQ ID NO: 7643747 - DNA, 22 bp, Homo sapiens
caaggcagtccctactccctgc

SEQ ID NO: 7643748 - DNA, 22 bp, Homo sapiens
caaggcagtgggctaggaacct

SEQ ID NO: 7643749 - DNA, 22 bp, Homo sapiens
caaggcagtgggctaggaacct

SEQ ID NO: 7643750 - DNA, 22 bp, Homo sapiens
caaggcagtgggctaggaacct

SEQ ID NO: 7643751 - DNA, 22 bp, Homo sapiens
caaggcagtgggctaggaacct

SEQ ID NO: 7643752 - DNA, 22 bp, Homo sapiens
caaggcagtccctactccctgc

SEQ ID NO: 7643753 - DNA, 22 bp, Homo sapiens
caaggcagtgggctaggaacct

SEQ ID NO: 7643754 - DNA, 22 bp, Homo sapiens
caaggcagtgggctaggaacct

SEQ ID NO: 7643755 - DNA, 22 bp, Homo sapiens
caaggcagtgggctaggaacct

SEQ ID NO: 7643756 - DNA, 22 bp, Homo sapiens
caaggcagttccccagagggct

SEQ ID NO: 7643757 - DNA, 22 bp, Homo sapiens
caaggcagttccccagagggct

SEQ ID NO: 7643758 - DNA, 22 bp, Homo sapiens
caaggcagttccccagagggct

SEQ ID NO: 7643759 - DNA, 22 bp, Homo sapiens
caaggcagttccccagagggct

SEQ ID NO: 7643760 - DNA, 22 bp, Homo sapiens
caaggcagttccccagagggct

SEQ ID NO: 7643761 - DNA, 22 bp, Homo sapiens
caaggcagtgggctaggaacct

SEQ ID NO: 7643762 - DNA, 22 bp, Homo sapiens
caaggcataacctttttagaat

SEQ ID NO: 7643763 - DNA, 22 bp, Homo sapiens
caaggcataacctttttagaat

SEQ ID NO: 7643764 - DNA, 22 bp, Homo sapiens
caaggcagttccccagagggct

SEQ ID NO: 7643765 - DNA, 22 bp, Homo sapiens
caaggcagttccccagagggct

SEQ ID NO: 7643766 - DNA, 22 bp, Homo sapiens
caaggcaggcagttcacttgag

SEQ ID NO: 7643767 - DNA, 22 bp, Homo sapiens
caaggcaggcagttcacttgag

SEQ ID NO: 7643768 - DNA, 22 bp, Homo sapiens
caaggcaggccagtttcaaggc

SEQ ID NO: 7643769 - DNA, 22 bp, Homo sapiens
caaggcaggccagtttcaaggc

SEQ ID NO: 7643770 - DNA, 22 bp, Homo sapiens
caaggcaggcagttcacttgag

SEQ ID NO: 7643771 - DNA, 22 bp, Homo sapiens
caaggcaggcagttcacttgag

SEQ ID NO: 7643772 - DNA, 22 bp, Homo sapiens
caaggcaggccagtttcaaggc

SEQ ID NO: 7643773 - DNA, 22 bp, Homo sapiens
caaggcaggtctgaggaggttg

SEQ ID NO: 7643774 - DNA, 22 bp, Homo sapiens
caaggcaggtctgaggaggttg

SEQ ID NO: 7643775 - DNA, 22 bp, Homo sapiens
caaggcaggtctgaggaggttg

SEQ ID NO: 7643776 - DNA, 22 bp, Homo sapiens
caaggcaggtctgaggaggttg

SEQ ID NO: 7643777 - DNA, 22 bp, Homo sapiens
caaggcaggtctgaggaggttg

SEQ ID NO: 7643778 - DNA, 22 bp, Homo sapiens
caaggcaggtctgaggaggttg

SEQ ID NO: 7643779 - DNA, 22 bp, Homo sapiens
caaggcaggtctgaggaggttg

SEQ ID NO: 7643780 - DNA, 22 bp, Homo sapiens
caaggcaggtctgaggaggttg

SEQ ID NO: 7643781 - DNA, 22 bp, Homo sapiens
caaggcaggtctgaggaggttg

SEQ ID NO: 7643782 - DNA, 22 bp, Homo sapiens
caaggcaggtctgaggaggttg

SEQ ID NO: 7643783 - DNA, 22 bp, Homo sapiens
caaggcaggtctgaggaggttg

SEQ ID NO: 7643784 - DNA, 22 bp, Homo sapiens
caaggcagtccctactccctgc

SEQ ID NO: 7643785 - DNA, 22 bp, Homo sapiens
caaggcaggtctgaggaggttg

SEQ ID NO: 7643786 - DNA, 22 bp, Homo sapiens
caaggcatactcctttctcagc

SEQ ID NO: 7643787 - DNA, 22 bp, Homo sapiens
caaggcatactcctttctcagc

SEQ ID NO: 7643788 - DNA, 22 bp, Homo sapiens
caaggcagttccccagagggct

SEQ ID NO: 7643789 - DNA, 22 bp, Homo sapiens
caaggcagtccctactccctgc

SEQ ID NO: 7643790 - DNA, 22 bp, Homo sapiens
caaggcatgaaaggagtgagtg

SEQ ID NO: 7643791 - DNA, 22 bp, Homo sapiens
caaggcatgcaatgtcttcagg

SEQ ID NO: 7643792 - DNA, 22 bp, Homo sapiens
caaggcatgcaatgtcttcagg

SEQ ID NO: 7643793 - DNA, 22 bp, Homo sapiens
agcagcagggtgtaattgggca

SEQ ID NO: 7643794 - DNA, 22 bp, Homo sapiens
caaggcatgcaatgtcttcagg

SEQ ID NO: 7643795 - DNA, 22 bp, Homo sapiens
caaggcatgcacaagaaggggg

SEQ ID NO: 7643796 - DNA, 22 bp, Homo sapiens
caaggcatgcacaagaaggggg

SEQ ID NO: 7643797 - DNA, 22 bp, Homo sapiens
caaggcatgtaacaatggcttt

SEQ ID NO: 7643798 - DNA, 22 bp, Homo sapiens
caaggcatgtaacaatggcttt

SEQ ID NO: 7643799 - DNA, 22 bp, Homo sapiens
caaggcatgcaatgtcttcagg

SEQ ID NO: 7643800 - DNA, 22 bp, Homo sapiens
agcagcagggtgtaattgggca

SEQ ID NO: 7643801 - DNA, 22 bp, Homo sapiens
caaggcatgaaaggagtgagtg

SEQ ID NO: 7643802 - DNA, 22 bp, Homo sapiens
agcagcaggtgacctcgatgcc

SEQ ID NO: 7643803 - DNA, 22 bp, Homo sapiens
agcagcatagaagctgggagga

SEQ ID NO: 7643804 - DNA, 22 bp, Homo sapiens
agcagcaggtgacctcgatgcc

SEQ ID NO: 7643805 - DNA, 22 bp, Homo sapiens
agcagcaggtgacctcgatgcc

SEQ ID NO: 7643806 - DNA, 22 bp, Homo sapiens
agcagcatagatgctatccgag

SEQ ID NO: 7643807 - DNA, 22 bp, Homo sapiens
agcagcatagatgctatccgag

SEQ ID NO: 7643808 - DNA, 22 bp, Homo sapiens
agcagcatagaagctgggagga

SEQ ID NO: 7643809 - DNA, 22 bp, Homo sapiens
agcagcatagaagctgggagga

SEQ ID NO: 7643810 - DNA, 22 bp, Homo sapiens
agcagcatagaagctgggagga

SEQ ID NO: 7643811 - DNA, 22 bp, Homo sapiens
agcagcatagaagctgggagga

SEQ ID NO: 7643812 - DNA, 22 bp, Homo sapiens
agcagcatatcagagaaagtca

SEQ ID NO: 7643813 - DNA, 22 bp, Homo sapiens
agcagcatagatgctatccgag

SEQ ID NO: 7643814 - DNA, 22 bp, Homo sapiens
agcagcatatcagagaaagtca

SEQ ID NO: 7643815 - DNA, 22 bp, Homo sapiens
agcagcatatcagagaaagtca

SEQ ID NO: 7643816 - DNA, 22 bp, Homo sapiens
agcagcatattgtgtcttcata

SEQ ID NO: 7643817 - DNA, 22 bp, Homo sapiens
agcagcatattgtgtcttcata

SEQ ID NO: 7643818 - DNA, 22 bp, Homo sapiens
agcagcatattgtgtcttcata

SEQ ID NO: 7643819 - DNA, 22 bp, Homo sapiens
agcagcatattgtgtcttcata

SEQ ID NO: 7643820 - DNA, 22 bp, Homo sapiens
agcagcatcaaccctcccgtgt

SEQ ID NO: 7643821 - DNA, 22 bp, Homo sapiens
agcagcatattgtgtcttcata

SEQ ID NO: 7643822 - DNA, 21 bp, Homo sapiens
agcagcatcagcctcacctga

SEQ ID NO: 7643823 - DNA, 21 bp, Homo sapiens
agcagcatcagcctcacctga

SEQ ID NO: 7643824 - DNA, 22 bp, Homo sapiens
agcagcatcaaccctcccgtgt

SEQ ID NO: 7643825 - DNA, 22 bp, Homo sapiens
agcagcatccccggcctccacc

SEQ ID NO: 7643826 - DNA, 21 bp, Homo sapiens
agcagcatcagcctcacctga

SEQ ID NO: 7643827 - DNA, 22 bp, Homo sapiens
agcagcatccccggcctccacc

SEQ ID NO: 7643828 - DNA, 22 bp, Homo sapiens
agcagcatccccggcctccacc

SEQ ID NO: 7643829 - DNA, 22 bp, Homo sapiens
agcagcatctcttattgcagtg

SEQ ID NO: 7643830 - DNA, 22 bp, Homo sapiens
agcagcatccccggcctccacc

SEQ ID NO: 7643831 - DNA, 22 bp, Homo sapiens
agcagcatctggttctgatgtg

SEQ ID NO: 7643832 - DNA, 22 bp, Homo sapiens
agcagcatctggttctgatgtg

SEQ ID NO: 7643833 - DNA, 22 bp, Homo sapiens
agcagcatctcttattgcagtg

SEQ ID NO: 7643834 - DNA, 22 bp, Homo sapiens
caatgaaattgagatccagaga

SEQ ID NO: 7643835 - DNA, 22 bp, Homo sapiens
caatgaaattgagatccagaga

SEQ ID NO: 7643836 - DNA, 22 bp, Homo sapiens
caatgaaattgagatccagaga

SEQ ID NO: 7643837 - DNA, 22 bp, Homo sapiens
caatgaaattgagatccagaga

SEQ ID NO: 7643838 - DNA, 22 bp, Homo sapiens
caatgaaagcaactgcctataa

SEQ ID NO: 7643839 - DNA, 22 bp, Homo sapiens
caatgaaagcaactgcctataa

SEQ ID NO: 7643840 - DNA, 22 bp, Homo sapiens
caatgaaaatttaagttgcagc

SEQ ID NO: 7643841 - DNA, 22 bp, Homo sapiens
caatgaaaatttaagttgcagc

SEQ ID NO: 7643842 - DNA, 22 bp, Homo sapiens
caatgaaaatttaagttgcagc

SEQ ID NO: 7643843 - DNA, 22 bp, Homo sapiens
caatgaaaatttaagttgcagc

SEQ ID NO: 7643844 - DNA, 22 bp, Homo sapiens
caatgaaaatttaagttgcagc

SEQ ID NO: 7643845 - DNA, 22 bp, Homo sapiens
caatgaaaatttaagttgcagc

SEQ ID NO: 7643846 - DNA, 22 bp, Homo sapiens
caatgaaaatttaagttgcagc

SEQ ID NO: 7643847 - DNA, 22 bp, Homo sapiens
caatgaaaatgaggactcctgt

SEQ ID NO: 7643848 - DNA, 22 bp, Homo sapiens
caatgaaaatgaggactcctgt

SEQ ID NO: 7643849 - DNA, 22 bp, Homo sapiens
caatgaaaatgaggactcctgt

SEQ ID NO: 7643850 - DNA, 22 bp, Homo sapiens
caatctgtacttgaaaaattat

SEQ ID NO: 7643851 - DNA, 22 bp, Homo sapiens
caatctgtacttgaaaaattat

SEQ ID NO: 7643852 - DNA, 22 bp, Homo sapiens
caatctgtgaaatgggaataat

SEQ ID NO: 7643853 - DNA, 22 bp, Homo sapiens
caatctggtgaagcagaaaaat

SEQ ID NO: 7643854 - DNA, 22 bp, Homo sapiens
caatcttacttttgaaaagtga

SEQ ID NO: 7643855 - DNA, 22 bp, Homo sapiens
caatcttacttttgaaaagtga

SEQ ID NO: 7643856 - DNA, 22 bp, Homo sapiens
caatctgtgaaatgggaataat

SEQ ID NO: 7643857 - DNA, 22 bp, Homo sapiens
caatctgttagaaatgcagaca

SEQ ID NO: 7643858 - DNA, 22 bp, Homo sapiens
caatgaaaatgaggactcctgt

SEQ ID NO: 7643859 - DNA, 22 bp, Homo sapiens
caatgaaaatgaggactcctgt

SEQ ID NO: 7643860 - DNA, 22 bp, Homo sapiens
caatcttagagagattctttta

SEQ ID NO: 7643861 - DNA, 22 bp, Homo sapiens
caatcttagagagattctttta

SEQ ID NO: 7643862 - DNA, 22 bp, Homo sapiens
caatcttagtggcttacaaaga

SEQ ID NO: 7643863 - DNA, 20 bp, Homo sapiens
agcagcattgttctagagca

SEQ ID NO: 7643864 - DNA, 20 bp, Homo sapiens
agcagcattgttctagagca

SEQ ID NO: 7643865 - DNA, 20 bp, Homo sapiens
agcagcattgttctagagca

SEQ ID NO: 7643866 - DNA, 20 bp, Homo sapiens
agcagcattgttctagagca

SEQ ID NO: 7643867 - DNA, 20 bp, Homo sapiens
agcagcattgttctagagca

SEQ ID NO: 7643868 - DNA, 22 bp, Homo sapiens
agcagcattctctggtatgggg

SEQ ID NO: 7643869 - DNA, 22 bp, Homo sapiens
agcagcatttaaggatccaagt

SEQ ID NO: 7643870 - DNA, 22 bp, Homo sapiens
agcagcatttaaggatccaagt

SEQ ID NO: 7643871 - DNA, 20 bp, Homo sapiens
agcagcattgttctagagca

SEQ ID NO: 7643872 - DNA, 22 bp, Homo sapiens
agcagcatttaagtttcttcta

SEQ ID NO: 7643873 - DNA, 22 bp, Homo sapiens
agcagcatttaagtttcttcta

SEQ ID NO: 7643874 - DNA, 22 bp, Homo sapiens
agcagcattatgatatatctta

SEQ ID NO: 7643875 - DNA, 22 bp, Homo sapiens
agcagcattatgatatatctta

SEQ ID NO: 7643876 - DNA, 22 bp, Homo sapiens
agcagcattaagggaactgcag

SEQ ID NO: 7643877 - DNA, 22 bp, Homo sapiens
agcagcattcctggcttctatc

SEQ ID NO: 7643878 - DNA, 22 bp, Homo sapiens
agcagcattatgatatatctta

SEQ ID NO: 7643879 - DNA, 22 bp, Homo sapiens
agcagcattatgatatatctta

SEQ ID NO: 7643880 - DNA, 22 bp, Homo sapiens
agcagcattctctggtatgggg

SEQ ID NO: 7643881 - DNA, 22 bp, Homo sapiens
agcagcattcctggcttctatc

SEQ ID NO: 7643882 - DNA, 22 bp, Homo sapiens
agcagcattcctggcttctatc

SEQ ID NO: 7643883 - DNA, 22 bp, Homo sapiens
agcagcatgttgggatgtgaaa

SEQ ID NO: 7643884 - DNA, 22 bp, Homo sapiens
agcagcatgttgggatgtgaaa

SEQ ID NO: 7643885 - DNA, 22 bp, Homo sapiens
agcagcatgttgggatgtgaaa

SEQ ID NO: 7643886 - DNA, 22 bp, Homo sapiens
agcagcatgttgggatgtgaaa

SEQ ID NO: 7643887 - DNA, 22 bp, Homo sapiens
agcagcattaagggaactgcag

SEQ ID NO: 7643888 - DNA, 22 bp, Homo sapiens
agcagcatgttgggatgtgaaa

SEQ ID NO: 7643889 - DNA, 22 bp, Homo sapiens
agcagcatgttgggatgtgaaa

SEQ ID NO: 7643890 - DNA, 22 bp, Homo sapiens
agcagcatgttcattacattat

SEQ ID NO: 7643891 - DNA, 22 bp, Homo sapiens
agcagcatgtatgagggtgaac

SEQ ID NO: 7643892 - DNA, 22 bp, Homo sapiens
agcagcatgtatgagggtgaac

SEQ ID NO: 7643893 - DNA, 22 bp, Homo sapiens
agcagcatgttcattacattat

SEQ ID NO: 7643894 - DNA, 22 bp, Homo sapiens
agcagcatgttcattacattat

SEQ ID NO: 7643895 - DNA, 22 bp, Homo sapiens
agcagcatgttcattacattat

SEQ ID NO: 7643896 - DNA, 22 bp, Homo sapiens
agcagcatgttcattacattat

SEQ ID NO: 7643897 - DNA, 22 bp, Homo sapiens
agcagcatcttctaagtaaggc

SEQ ID NO: 7643898 - DNA, 22 bp, Homo sapiens
agcagcatctggttctgatgtg

SEQ ID NO: 7643899 - DNA, 22 bp, Homo sapiens
agcagcatctggttctgatgtg

SEQ ID NO: 7643900 - DNA, 22 bp, Homo sapiens
agcagcatcttctgttctccgc

SEQ ID NO: 7643901 - DNA, 22 bp, Homo sapiens
agcagcatcttctaagtaaggc

SEQ ID NO: 7643902 - DNA, 22 bp, Homo sapiens
agcagcatgatgacagagtctc

SEQ ID NO: 7643903 - DNA, 22 bp, Homo sapiens
agcagcatgatgacagagtctc

SEQ ID NO: 7643904 - DNA, 22 bp, Homo sapiens
agcagcatgatgacagagtctc

SEQ ID NO: 7643905 - DNA, 22 bp, Homo sapiens
agcagcatcttctgttctccgc

SEQ ID NO: 7643906 - DNA, 22 bp, Homo sapiens
agcagcatcttctgttctccgc

SEQ ID NO: 7643907 - DNA, 22 bp, Homo sapiens
agcagcatggagaaaccgttca

SEQ ID NO: 7643908 - DNA, 22 bp, Homo sapiens
agcagcatgatgacagagtctc

SEQ ID NO: 7643909 - DNA, 22 bp, Homo sapiens
agcagcatgatgacagagtctc

SEQ ID NO: 7643910 - DNA, 22 bp, Homo sapiens
agcagcatggatgggcctcagc

SEQ ID NO: 7643911 - DNA, 22 bp, Homo sapiens
agcagcatggatgggcctcagc

SEQ ID NO: 7643912 - DNA, 22 bp, Homo sapiens
agcagcatggctgactaaagac

SEQ ID NO: 7643913 - DNA, 22 bp, Homo sapiens
agcagcatggatgggcctcagc

SEQ ID NO: 7643914 - DNA, 22 bp, Homo sapiens
agcagcatgtatgagggtgaac

SEQ ID NO: 7643915 - DNA, 22 bp, Homo sapiens
agcagcatggctgactaaagac

SEQ ID NO: 7643916 - DNA, 22 bp, Homo sapiens
agcagcatggctgactaaagac

SEQ ID NO: 7643917 - DNA, 22 bp, Homo sapiens
agcagaagtgccttagcaatca

SEQ ID NO: 7643918 - DNA, 22 bp, Homo sapiens
agcagaatctgtccttggaaga

SEQ ID NO: 7643919 - DNA, 22 bp, Homo sapiens
agcagaatctgggagcagcagt

SEQ ID NO: 7643920 - DNA, 22 bp, Homo sapiens
agcagaatctgggagcagcagt

SEQ ID NO: 7643921 - DNA, 22 bp, Homo sapiens
agcagaatctgggagcagcagt

SEQ ID NO: 7643922 - DNA, 22 bp, Homo sapiens
agcagaagtgccttagcaatca

SEQ ID NO: 7643923 - DNA, 22 bp, Homo sapiens
agcagaatctgtccttggaaga

SEQ ID NO: 7643924 - DNA, 22 bp, Homo sapiens
agcagaatgtgtgtgacaagta

SEQ ID NO: 7643925 - DNA, 22 bp, Homo sapiens
agcagaatgtgtgtgacaagta

SEQ ID NO: 7643926 - DNA, 22 bp, Homo sapiens
agcagaatgcttaaagctagtg

SEQ ID NO: 7643927 - DNA, 22 bp, Homo sapiens
agcagaatggggctgggaatag

SEQ ID NO: 7643928 - DNA, 22 bp, Homo sapiens
agcagaatggggctgggaatag

SEQ ID NO: 7643929 - DNA, 22 bp, Homo sapiens
agcagaatggggctgggaatag

SEQ ID NO: 7643930 - DNA, 22 bp, Homo sapiens
agcagaatgcttaaagctagtg

SEQ ID NO: 7643931 - DNA, 22 bp, Homo sapiens
agcagaatctgtccttggaaga

SEQ ID NO: 7643932 - DNA, 22 bp, Homo sapiens
agcagaatctgtccttggaaga

SEQ ID NO: 7643933 - DNA, 22 bp, Homo sapiens
agcagaattccatgtgagaggg

SEQ ID NO: 7643934 - DNA, 22 bp, Homo sapiens
agcagaatgtgtgtgacaagta

SEQ ID NO: 7643935 - DNA, 18 bp, Homo sapiens
agcagaattctagggttc

SEQ ID NO: 7643936 - DNA, 22 bp, Homo sapiens
agcagaattccatgtgagaggg

SEQ ID NO: 7643937 - DNA, 18 bp, Homo sapiens
agcagaattctagggttc

SEQ ID NO: 7643938 - DNA, 22 bp, Homo sapiens
agcagacaacccagatgaccca

SEQ ID NO: 7643939 - DNA, 22 bp, Homo sapiens
agcagacaacccagatgaccca

SEQ ID NO: 7643940 - DNA, 22 bp, Homo sapiens
agcagacaacccagatgaccca

SEQ ID NO: 7643941 - DNA, 22 bp, Homo sapiens
agcagaattgaatatcgggttc

SEQ ID NO: 7643942 - DNA, 22 bp, Homo sapiens
agcagaattgaatatcgggttc

SEQ ID NO: 7643943 - DNA, 22 bp, Homo sapiens
agcagaattccatgtgagaggg

SEQ ID NO: 7643944 - DNA, 18 bp, Homo sapiens
agcagaattctagggttc

SEQ ID NO: 7643945 - DNA, 22 bp, Homo sapiens
agcagacaattgcctggatgga

SEQ ID NO: 7643946 - DNA, 22 bp, Homo sapiens
agcagacaattgcctggatgga

SEQ ID NO: 7643947 - DNA, 22 bp, Homo sapiens
agcagacaacccagatgaccca

SEQ ID NO: 7643948 - DNA, 22 bp, Homo sapiens
agcagacaacccagatgaccca

SEQ ID NO: 7643949 - DNA, 22 bp, Homo sapiens
agcagacaccaggagtaaagaa

SEQ ID NO: 7643950 - DNA, 22 bp, Homo sapiens
agcagacaccaggagtaaagaa

SEQ ID NO: 7643951 - DNA, 22 bp, Homo sapiens
agcagacaccaggagtaaagaa

SEQ ID NO: 7643952 - DNA, 21 bp, Homo sapiens
agcagacacttgtgaccttcc

SEQ ID NO: 7643953 - DNA, 22 bp, Homo sapiens
agcagacaattgcctggatgga

SEQ ID NO: 7643954 - DNA, 22 bp, Homo sapiens
agcagacaattgcctggatgga

SEQ ID NO: 7643955 - DNA, 22 bp, Homo sapiens
agcagacaattgcctggatgga

SEQ ID NO: 7643956 - DNA, 21 bp, Homo sapiens
agcagacacttgtgaccttcc

SEQ ID NO: 7643957 - DNA, 21 bp, Homo sapiens
agcagacacttgtgaccttcc

SEQ ID NO: 7643958 - DNA, 22 bp, Homo sapiens
caactatatagaaattgattgt

SEQ ID NO: 7643959 - DNA, 22 bp, Homo sapiens
caactatatagaaattgattgt

SEQ ID NO: 7643960 - DNA, 22 bp, Homo sapiens
caactcagactggattaaataa

SEQ ID NO: 7643961 - DNA, 22 bp, Homo sapiens
caactatatagaaattgattgt

SEQ ID NO: 7643962 - DNA, 22 bp, Homo sapiens
caactcatgtccaactttcttt

SEQ ID NO: 7643963 - DNA, 22 bp, Homo sapiens
caactcatgtccaactttcttt

SEQ ID NO: 7643964 - DNA, 22 bp, Homo sapiens
caactcaggcacctcatataag

SEQ ID NO: 7643965 - DNA, 22 bp, Homo sapiens
caactcaggcacctcatataag

SEQ ID NO: 7643966 - DNA, 22 bp, Homo sapiens
caactcaggcacctcatataag

SEQ ID NO: 7643967 - DNA, 22 bp, Homo sapiens
caactcagactggattaaataa

SEQ ID NO: 7643968 - DNA, 22 bp, Homo sapiens
caactcagactggattaaataa

SEQ ID NO: 7643969 - DNA, 22 bp, Homo sapiens
caactgaactgatatcaactat

SEQ ID NO: 7643970 - DNA, 22 bp, Homo sapiens
caactgaaaagattctacgcag

SEQ ID NO: 7643971 - DNA, 22 bp, Homo sapiens
caactgaactgatatcaactat

SEQ ID NO: 7643972 - DNA, 22 bp, Homo sapiens
caactgcacaccaagcttgtgt

SEQ ID NO: 7643973 - DNA, 22 bp, Homo sapiens
caactgcacaccaagcttgtgt

SEQ ID NO: 7643974 - DNA, 22 bp, Homo sapiens
caactgcacaccaagcttgtgt

SEQ ID NO: 7643975 - DNA, 22 bp, Homo sapiens
caactgccatacagctccatgg

SEQ ID NO: 7643976 - DNA, 22 bp, Homo sapiens
caactgagcagtagcgtctgga

SEQ ID NO: 7643977 - DNA, 22 bp, Homo sapiens
caactcctggctgttaggcaca

SEQ ID NO: 7643978 - DNA, 22 bp, Homo sapiens
caactcctccccagcatgccaa

SEQ ID NO: 7643979 - DNA, 22 bp, Homo sapiens
caactcatttattcaattttct

SEQ ID NO: 7643980 - DNA, 22 bp, Homo sapiens
caactcatgtccaactttcttt

SEQ ID NO: 7643981 - DNA, 22 bp, Homo sapiens
caactccctgtggggtactggg

SEQ ID NO: 7643982 - DNA, 22 bp, Homo sapiens
caactcctccccagcatgccaa

SEQ ID NO: 7643983 - DNA, 22 bp, Homo sapiens
caactgttataaatcaacagag

SEQ ID NO: 7643984 - DNA, 22 bp, Homo sapiens
caactgttataaatcaacagag

SEQ ID NO: 7643985 - DNA, 22 bp, Homo sapiens
caactgttataaatcaacagag

SEQ ID NO: 7643986 - DNA, 22 bp, Homo sapiens
caacttattaagaatgggcctg

SEQ ID NO: 7643987 - DNA, 22 bp, Homo sapiens
caacttattttcagtgggcctg

SEQ ID NO: 7643988 - DNA, 17 bp, Homo sapiens
caacttcacaaactgtc

SEQ ID NO: 7643989 - DNA, 22 bp, Homo sapiens
caacttcactgtgcctctagtt

SEQ ID NO: 7643990 - DNA, 22 bp, Homo sapiens
caacttatctaatgttgggata

SEQ ID NO: 7643991 - DNA, 22 bp, Homo sapiens
caactgtaagctccttatgggg

SEQ ID NO: 7643992 - DNA, 22 bp, Homo sapiens
caactgtaagctccttatgggg

SEQ ID NO: 7643993 - DNA, 22 bp, Homo sapiens
caactgtaatattggaagatca

SEQ ID NO: 7643994 - DNA, 22 bp, Homo sapiens
caactgtaatattggaagatca

SEQ ID NO: 7643995 - DNA, 22 bp, Homo sapiens
caactgtagggattgagttttc

SEQ ID NO: 7643996 - DNA, 22 bp, Homo sapiens
caactgtagggattgagttttc

SEQ ID NO: 7643997 - DNA, 22 bp, Homo sapiens
caactggtggtcaaccttctgt

SEQ ID NO: 7643998 - DNA, 22 bp, Homo sapiens
caactggtaatctccacggtca

SEQ ID NO: 7643999 - DNA, 22 bp, Homo sapiens
caactgctgacaccatcactcc

SEQ ID NO: 7644000 - DNA, 19 bp, Homo sapiens
caactgccccctcaaacat

SEQ ID NO: 7644001 - DNA, 22 bp, Homo sapiens
caactgctgacaccatcactcc

SEQ ID NO: 7644002 - DNA, 21 bp, Homo sapiens
agcagagtgctttgactttgt

SEQ ID NO: 7644003 - DNA, 22 bp, Homo sapiens
caacttcagggaaacatgaagc

SEQ ID NO: 7644004 - DNA, 21 bp, Homo sapiens
agcagagtgctttgactttgt

SEQ ID NO: 7644005 - DNA, 22 bp, Homo sapiens
agcagagtgtgaaggcagggct

SEQ ID NO: 7644006 - DNA, 22 bp, Homo sapiens
agcagagtgtgaaggcagggct

SEQ ID NO: 7644007 - DNA, 22 bp, Homo sapiens
agcagagtgtgaaggcagggct

SEQ ID NO: 7644008 - DNA, 22 bp, Homo sapiens
agcagcaacttatttttcttat

SEQ ID NO: 7644009 - DNA, 22 bp, Homo sapiens
agcagcaagcagtgcacgggtt

SEQ ID NO: 7644010 - DNA, 22 bp, Homo sapiens
agcagcaagcagtgcacgggtt

SEQ ID NO: 7644011 - DNA, 22 bp, Homo sapiens
agcagcaacttatttttcttat

SEQ ID NO: 7644012 - DNA, 22 bp, Homo sapiens
agcagcaagcagtgcacgggtt

SEQ ID NO: 7644013 - DNA, 22 bp, Homo sapiens
agcagcaaggaacagaatggac

SEQ ID NO: 7644014 - DNA, 22 bp, Homo sapiens
agcagcaaggaagcgaggatgg

SEQ ID NO: 7644015 - DNA, 22 bp, Homo sapiens
agcagcaaggaagcgaggatgg

SEQ ID NO: 7644016 - DNA, 22 bp, Homo sapiens
agcagcaaggaacagaatggac

SEQ ID NO: 7644017 - DNA, 22 bp, Homo sapiens
caacttcagggaaacatgaagc

SEQ ID NO: 7644018 - DNA, 22 bp, Homo sapiens
agcagagtgccccatcacaagg

SEQ ID NO: 7644019 - DNA, 21 bp, Homo sapiens
agcagagtgctttgactttgt

SEQ ID NO: 7644020 - DNA, 22 bp, Homo sapiens
agcagagtgccccatcacaagg

SEQ ID NO: 7644021 - DNA, 21 bp, Homo sapiens
agcagagtgctttgactttgt

SEQ ID NO: 7644022 - DNA, 22 bp, Homo sapiens
caacttcttggcttcctaatgg

SEQ ID NO: 7644023 - DNA, 22 bp, Homo sapiens
caacttcactgtgcctctagtt

SEQ ID NO: 7644024 - DNA, 22 bp, Homo sapiens
caacttcagggaaacatgaagc

SEQ ID NO: 7644025 - DNA, 22 bp, Homo sapiens
caacttcaccagggttcctaga

SEQ ID NO: 7644026 - DNA, 22 bp, Homo sapiens
agcagcaataataaagtaatac

SEQ ID NO: 7644027 - DNA, 22 bp, Homo sapiens
agcagcaatggaaagcaacaca

SEQ ID NO: 7644028 - DNA, 22 bp, Homo sapiens
agcagcaatggaaagcaacaca

SEQ ID NO: 7644029 - DNA, 22 bp, Homo sapiens
agcagcaatggaaagcaacaca

SEQ ID NO: 7644030 - DNA, 22 bp, Homo sapiens
agcagcaataataaagtaatac

SEQ ID NO: 7644031 - DNA, 22 bp, Homo sapiens
agcagcaataataaagtaatac

SEQ ID NO: 7644032 - DNA, 22 bp, Homo sapiens
agcagcaataataaagtaatac

SEQ ID NO: 7644033 - DNA, 22 bp, Homo sapiens
agcagcaaggaagcgaggatgg

SEQ ID NO: 7644034 - DNA, 22 bp, Homo sapiens
agcagcaagtgtaactgaatat

SEQ ID NO: 7644035 - DNA, 22 bp, Homo sapiens
agcagcaagtgtaactgaatat

SEQ ID NO: 7644036 - DNA, 22 bp, Homo sapiens
agcagcaagtgtaactgaatat

SEQ ID NO: 7644037 - DNA, 22 bp, Homo sapiens
agcagcaagtgtaactgaatat

SEQ ID NO: 7644038 - DNA, 22 bp, Homo sapiens
agcagcaattttcactgtcaat

SEQ ID NO: 7644039 - DNA, 22 bp, Homo sapiens
agcagcaattttcactgtcaat

SEQ ID NO: 7644040 - DNA, 22 bp, Homo sapiens
agcagcaattttcactgtcaat

SEQ ID NO: 7644041 - DNA, 22 bp, Homo sapiens
agcagcacacgggagaaagaca

SEQ ID NO: 7644042 - DNA, 22 bp, Homo sapiens
agcagcaattttcactgtcaat

SEQ ID NO: 7644043 - DNA, 22 bp, Homo sapiens
agcagcaattttcactgtcaat

SEQ ID NO: 7644044 - DNA, 22 bp, Homo sapiens
agcagcaattttcactgtcaat

SEQ ID NO: 7644045 - DNA, 22 bp, Homo sapiens
agcagcaattttcactgtcaat

SEQ ID NO: 7644046 - DNA, 22 bp, Homo sapiens
agcagcaattttcactgtcaat

SEQ ID NO: 7644047 - DNA, 18 bp, Homo sapiens
agcagcaatttgggatga

SEQ ID NO: 7644048 - DNA, 18 bp, Homo sapiens
agcagcaatttgggatga

SEQ ID NO: 7644049 - DNA, 22 bp, Homo sapiens
agcagcaatggaaagcaacaca

SEQ ID NO: 7644050 - DNA, 22 bp, Homo sapiens
agcagcaatggaaagcaacaca

SEQ ID NO: 7644051 - DNA, 22 bp, Homo sapiens
agcagcagaaggtttgcaccca

SEQ ID NO: 7644052 - DNA, 22 bp, Homo sapiens
agcagcagaagggagacccagg

SEQ ID NO: 7644053 - DNA, 22 bp, Homo sapiens
agcagcagaagggagacccagg

SEQ ID NO: 7644054 - DNA, 22 bp, Homo sapiens
agcagcagaagggagacccagg

SEQ ID NO: 7644055 - DNA, 22 bp, Homo sapiens
agcagcagaagggagacccagg

SEQ ID NO: 7644056 - DNA, 22 bp, Homo sapiens
agcagcagaagggagacccagg

SEQ ID NO: 7644057 - DNA, 22 bp, Homo sapiens
caaggcaggcagttcacttgag

SEQ ID NO: 7644058 - DNA, 22 bp, Homo sapiens
caaggcaggcagttcacttgag

SEQ ID NO: 7644059 - DNA, 19 bp, Homo sapiens
agcagcagaagtgtgcctt

SEQ ID NO: 7644060 - DNA, 22 bp, Homo sapiens
caaggcaggaagcctgtcttat

SEQ ID NO: 7644061 - DNA, 22 bp, Homo sapiens
caaggcaggaagcctgtcttat

SEQ ID NO: 7644062 - DNA, 22 bp, Homo sapiens
agcagcagaaagttgatggcag

SEQ ID NO: 7644063 - DNA, 22 bp, Homo sapiens
agcagcagaaagttgatggcag

SEQ ID NO: 7644064 - DNA, 22 bp, Homo sapiens
agcagcagaaagttgatggcag

SEQ ID NO: 7644065 - DNA, 22 bp, Homo sapiens
agcagcacgagtccacaaatcc

SEQ ID NO: 7644066 - DNA, 22 bp, Homo sapiens
agcagcagaaagttgatggcag

SEQ ID NO: 7644067 - DNA, 22 bp, Homo sapiens
agcagcagaaagttgatggcag

SEQ ID NO: 7644068 - DNA, 22 bp, Homo sapiens
agcagcacgagtccacaaatcc

SEQ ID NO: 7644069 - DNA, 22 bp, Homo sapiens
agcagcacctgtcctcgctgct

SEQ ID NO: 7644070 - DNA, 22 bp, Homo sapiens
agcagcacctgtcctcgctgct

SEQ ID NO: 7644071 - DNA, 22 bp, Homo sapiens
agcagcacctggctatctgatc

SEQ ID NO: 7644072 - DNA, 22 bp, Homo sapiens
agcagcacccagagccatgtct

SEQ ID NO: 7644073 - DNA, 22 bp, Homo sapiens
agcagcacctgtcctcgctgct

SEQ ID NO: 7644074 - DNA, 22 bp, Homo sapiens
agcagcacctggctatctgatc

SEQ ID NO: 7644075 - DNA, 22 bp, Homo sapiens
agcagcacctggctatctgatc

SEQ ID NO: 7644076 - DNA, 22 bp, Homo sapiens
agcagcacccagagccatgtct

SEQ ID NO: 7644077 - DNA, 22 bp, Homo sapiens
agcagcacatggggctggcaac

SEQ ID NO: 7644078 - DNA, 22 bp, Homo sapiens
agcagcacacgggagaaagaca

SEQ ID NO: 7644079 - DNA, 22 bp, Homo sapiens
agcagcacatggggctggcaac

SEQ ID NO: 7644080 - DNA, 22 bp, Homo sapiens
agcagcacatggggctggcaac

SEQ ID NO: 7644081 - DNA, 22 bp, Homo sapiens
attttctgtaactatttctata

SEQ ID NO: 7644082 - DNA, 22 bp, Homo sapiens
attttctgtaactatttctata

SEQ ID NO: 7644083 - DNA, 22 bp, Homo sapiens
attttctgtaactatttctata

SEQ ID NO: 7644084 - DNA, 22 bp, Homo sapiens
agcacaaaagcagccacagatg

SEQ ID NO: 7644085 - DNA, 22 bp, Homo sapiens
agcacaaaaacattcccagagt

SEQ ID NO: 7644086 - DNA, 22 bp, Homo sapiens
attttctgagtccagaatttac

SEQ ID NO: 7644087 - DNA, 22 bp, Homo sapiens
attttctgagtccagaatttac

SEQ ID NO: 7644088 - DNA, 22 bp, Homo sapiens
attttctgagtccagaatttac

SEQ ID NO: 7644089 - DNA, 22 bp, Homo sapiens
attttctgagtccagaatttac

SEQ ID NO: 7644090 - DNA, 22 bp, Homo sapiens
attttctggttgaggtttaaca

SEQ ID NO: 7644091 - DNA, 22 bp, Homo sapiens
attttctggttgaggtttaaca

SEQ ID NO: 7644092 - DNA, 22 bp, Homo sapiens
attttctggttgaggtttaaca

SEQ ID NO: 7644093 - DNA, 22 bp, Homo sapiens
attttctgtaaaaaggcactaa

SEQ ID NO: 7644094 - DNA, 23 bp, Homo sapiens
agcacagactagaaaggtctttc

SEQ ID NO: 7644095 - DNA, 23 bp, Homo sapiens
agcacagactagaaaggtctttc

SEQ ID NO: 7644096 - DNA, 23 bp, Homo sapiens
agcacagactagaaaggtctttc

SEQ ID NO: 7644097 - DNA, 19 bp, Homo sapiens
agcacagacaagaccagca

SEQ ID NO: 7644098 - DNA, 19 bp, Homo sapiens
agcacagacaagaccagca

SEQ ID NO: 7644099 - DNA, 19 bp, Homo sapiens
agcacagacaagaccagca

SEQ ID NO: 7644100 - DNA, 19 bp, Homo sapiens
agcacagacaagaccagca

SEQ ID NO: 7644101 - DNA, 19 bp, Homo sapiens
agcacagacaagaccagca

SEQ ID NO: 7644102 - DNA, 22 bp, Homo sapiens
agcacagagaaactaagacatt

SEQ ID NO: 7644103 - DNA, 22 bp, Homo sapiens
agcacagagaaactaagacatt

SEQ ID NO: 7644104 - DNA, 22 bp, Homo sapiens
agcacagagaaactaagacatt

SEQ ID NO: 7644105 - DNA, 22 bp, Homo sapiens
agcacagactggtcccaggtct

SEQ ID NO: 7644106 - DNA, 22 bp, Homo sapiens
agcacagagaaactaagacatt

SEQ ID NO: 7644107 - DNA, 22 bp, Homo sapiens
agcacagagaaactaagacatt

SEQ ID NO: 7644108 - DNA, 22 bp, Homo sapiens
agcacagagaaactaagacatt

SEQ ID NO: 7644109 - DNA, 22 bp, Homo sapiens
agcacagagaaactaagacatt

SEQ ID NO: 7644110 - DNA, 22 bp, Homo sapiens
agcacagactggtcccaggtct

SEQ ID NO: 7644111 - DNA, 22 bp, Homo sapiens
agcacagactggtcccaggtct

SEQ ID NO: 7644112 - DNA, 22 bp, Homo sapiens
agcacagactggtcccaggtct

SEQ ID NO: 7644113 - DNA, 22 bp, Homo sapiens
agcacagactggtcccaggtct

SEQ ID NO: 7644114 - DNA, 22 bp, Homo sapiens
agcacagactggtcccaggtct

SEQ ID NO: 7644115 - DNA, 21 bp, Homo sapiens
attttctctggatgatggtca

SEQ ID NO: 7644116 - DNA, 21 bp, Homo sapiens
attttctctggatgatggtca

SEQ ID NO: 7644117 - DNA, 21 bp, Homo sapiens
attttctctggatgatggtca

SEQ ID NO: 7644118 - DNA, 22 bp, Homo sapiens
attttctctttgtatatgctag

SEQ ID NO: 7644119 - DNA, 22 bp, Homo sapiens
attttctctttgtatatgctag

SEQ ID NO: 7644120 - DNA, 22 bp, Homo sapiens
attttctctttgtatatgctag

SEQ ID NO: 7644121 - DNA, 22 bp, Homo sapiens
attttctctttgtatatgctag

SEQ ID NO: 7644122 - DNA, 22 bp, Homo sapiens
attttctgagcacgtgacagca

SEQ ID NO: 7644123 - DNA, 22 bp, Homo sapiens
attttctctcaaaccttaaaat

SEQ ID NO: 7644124 - DNA, 22 bp, Homo sapiens
attttctctcaaaccttaaaat

SEQ ID NO: 7644125 - DNA, 22 bp, Homo sapiens
attttctctcaaaccttaaaat

SEQ ID NO: 7644126 - DNA, 22 bp, Homo sapiens
attttctctcaaaccttaaaat

SEQ ID NO: 7644127 - DNA, 22 bp, Homo sapiens
attttctcacaatgcagaagga

SEQ ID NO: 7644128 - DNA, 22 bp, Homo sapiens
attttctctcaaaccttaaaat

SEQ ID NO: 7644129 - DNA, 22 bp, Homo sapiens
attttctctcaaaccttaaaat

SEQ ID NO: 7644130 - DNA, 22 bp, Homo sapiens
attttctcacaatgcagaagga

SEQ ID NO: 7644131 - DNA, 22 bp, Homo sapiens
attttctcacaatgcagaagga

SEQ ID NO: 7644132 - DNA, 22 bp, Homo sapiens
attttctcacaatgcagaagga

SEQ ID NO: 7644133 - DNA, 22 bp, Homo sapiens
attttctcacaatcctatgggg

SEQ ID NO: 7644134 - DNA, 22 bp, Homo sapiens
attttctcacaatcctatgggg

SEQ ID NO: 7644135 - DNA, 22 bp, Homo sapiens
attttctattctgctggtttag

SEQ ID NO: 7644136 - DNA, 22 bp, Homo sapiens
attttctatgttgtaattgtta

SEQ ID NO: 7644137 - DNA, 22 bp, Homo sapiens
attttctatgttgtaattgtta

SEQ ID NO: 7644138 - DNA, 22 bp, Homo sapiens
attttctatgttgtaattgtta

SEQ ID NO: 7644139 - DNA, 22 bp, Homo sapiens
attttctatgttgtaattgtta

SEQ ID NO: 7644140 - DNA, 22 bp, Homo sapiens
attttctatgttgtaattgtta

SEQ ID NO: 7644141 - DNA, 22 bp, Homo sapiens
attttctatgttgtaattgtta

SEQ ID NO: 7644142 - DNA, 22 bp, Homo sapiens
attttctatgttgtaattgtta

SEQ ID NO: 7644143 - DNA, 22 bp, Homo sapiens
attttctatgttgtaattgtta

SEQ ID NO: 7644144 - DNA, 22 bp, Homo sapiens
agcaaacattcagcagattggc

SEQ ID NO: 7644145 - DNA, 22 bp, Homo sapiens
agcaaacattcagcagattggc

SEQ ID NO: 7644146 - DNA, 22 bp, Homo sapiens
attttctattctgctggtttag

SEQ ID NO: 7644147 - DNA, 22 bp, Homo sapiens
attttctattctgctggtttag

SEQ ID NO: 7644148 - DNA, 22 bp, Homo sapiens
attttctattctgctggtttag

SEQ ID NO: 7644149 - DNA, 22 bp, Homo sapiens
attttctattctgctggtttag

SEQ ID NO: 7644150 - DNA, 22 bp, Homo sapiens
attttctatgttgtaattgtta

SEQ ID NO: 7644151 - DNA, 22 bp, Homo sapiens
attttctatgttgtaattgtta

SEQ ID NO: 7644152 - DNA, 22 bp, Homo sapiens
attttctatgttgtaattgtta

SEQ ID NO: 7644153 - DNA, 22 bp, Homo sapiens
agcacagagaagatttcaatta

SEQ ID NO: 7644154 - DNA, 22 bp, Homo sapiens
agcacagagaagatttcaatta

SEQ ID NO: 7644155 - DNA, 22 bp, Homo sapiens
agcacagagaaactaagacatt

SEQ ID NO: 7644156 - DNA, 22 bp, Homo sapiens
agcacagagagctctaggtaaa

SEQ ID NO: 7644157 - DNA, 22 bp, Homo sapiens
agcacagagagctctaggtaaa

SEQ ID NO: 7644158 - DNA, 22 bp, Homo sapiens
agcacagagagctctaggtaaa

SEQ ID NO: 7644159 - DNA, 22 bp, Homo sapiens
agcacagagattatttacaaga

SEQ ID NO: 7644160 - DNA, 22 bp, Homo sapiens
agcacagagattatttacaaga

SEQ ID NO: 7644161 - DNA, 19 bp, Homo sapiens
agcacagagagtctatagc

SEQ ID NO: 7644162 - DNA, 22 bp, Homo sapiens
agcacagagctaggagtggagg

SEQ ID NO: 7644163 - DNA, 22 bp, Homo sapiens
agcacagagctaggagtggagg

SEQ ID NO: 7644164 - DNA, 22 bp, Homo sapiens
agcacagagattatttacaaga

SEQ ID NO: 7644165 - DNA, 22 bp, Homo sapiens
agcacagagctaggagtggagg

SEQ ID NO: 7644166 - DNA, 22 bp, Homo sapiens
agcacagagctaggagtggagg

SEQ ID NO: 7644167 - DNA, 22 bp, Homo sapiens
agcacagagctaggagtggagg

SEQ ID NO: 7644168 - DNA, 22 bp, Homo sapiens
agcacagagctaggagtggagg

SEQ ID NO: 7644169 - DNA, 22 bp, Homo sapiens
agcacagagctcggggaatgga

SEQ ID NO: 7644170 - DNA, 22 bp, Homo sapiens
agcacagagctcggggaatgga

SEQ ID NO: 7644171 - DNA, 22 bp, Homo sapiens
agcacagagctcggggaatgga

SEQ ID NO: 7644172 - DNA, 22 bp, Homo sapiens
agcacagagctcggggaatgga

SEQ ID NO: 7644173 - DNA, 22 bp, Homo sapiens
agcacagagctcggggaatgga

SEQ ID NO: 7644174 - DNA, 22 bp, Homo sapiens
agcacagagttgcagagagcgt

SEQ ID NO: 7644175 - DNA, 22 bp, Homo sapiens
agcacagaggtggaagtgtata

SEQ ID NO: 7644176 - DNA, 22 bp, Homo sapiens
agcacagaggtggaagtgtata

SEQ ID NO: 7644177 - DNA, 22 bp, Homo sapiens
agcacagaggtggaagtgtata

SEQ ID NO: 7644178 - DNA, 22 bp, Homo sapiens
agcacagaggtggaagtgtata

SEQ ID NO: 7644179 - DNA, 22 bp, Homo sapiens
agcacagagttgcagagagcgt

SEQ ID NO: 7644180 - DNA, 22 bp, Homo sapiens
agcacagagttgcagagagcgt

SEQ ID NO: 7644181 - DNA, 22 bp, Homo sapiens
agcacagagttgcagagagcgt

SEQ ID NO: 7644182 - DNA, 22 bp, Homo sapiens
agcacagagttgcagagagcgt

SEQ ID NO: 7644183 - DNA, 22 bp, Homo sapiens
agcacagagttgcagagagcgt

SEQ ID NO: 7644184 - DNA, 22 bp, Homo sapiens
agcacagagttgcagagagcgt

SEQ ID NO: 7644185 - DNA, 22 bp, Homo sapiens
agcacagagttgcagagagcgt

SEQ ID NO: 7644186 - DNA, 22 bp, Homo sapiens
agcacagagttgcagagagcgt

SEQ ID NO: 7644187 - DNA, 22 bp, Homo sapiens
agcacagagttgcagagagcgt

SEQ ID NO: 7644188 - DNA, 22 bp, Homo sapiens
agcacagcaagtgggttattaa

SEQ ID NO: 7644189 - DNA, 22 bp, Homo sapiens
agcacagatttgtcaacataga

SEQ ID NO: 7644190 - DNA, 22 bp, Homo sapiens
agcacagatttgtcaacataga

SEQ ID NO: 7644191 - DNA, 22 bp, Homo sapiens
agcacagatttgtcaacataga

SEQ ID NO: 7644192 - DNA, 22 bp, Homo sapiens
agcacagatttgtcaacataga

SEQ ID NO: 7644193 - DNA, 22 bp, Homo sapiens
agcacagattctgaagagtcct

SEQ ID NO: 7644194 - DNA, 22 bp, Homo sapiens
agcacagattctgaagagtcct

SEQ ID NO: 7644195 - DNA, 22 bp, Homo sapiens
agcacagattctgaagagtcct

SEQ ID NO: 7644196 - DNA, 22 bp, Homo sapiens
agcacagatgtactttgagggg

SEQ ID NO: 7644197 - DNA, 22 bp, Homo sapiens
agcacagatgtgagtggaggct

SEQ ID NO: 7644198 - DNA, 22 bp, Homo sapiens
agcacagatgtgagtggaggct

SEQ ID NO: 7644199 - DNA, 22 bp, Homo sapiens
agcacagatgtgagtggaggct

SEQ ID NO: 7644200 - DNA, 22 bp, Homo sapiens
agcacagatgtgagtggaggct

SEQ ID NO: 7644201 - DNA, 22 bp, Homo sapiens
agcacagatgtgagtggaggct

SEQ ID NO: 7644202 - DNA, 22 bp, Homo sapiens
agcacagatgtgagtggaggct

SEQ ID NO: 7644203 - DNA, 22 bp, Homo sapiens
agcacagattctgaagagtcct

SEQ ID NO: 7644204 - DNA, 22 bp, Homo sapiens
agcacagatgtgagtggaggct

SEQ ID NO: 7644205 - DNA, 22 bp, Homo sapiens
agcacagattctgaagagtcct

SEQ ID NO: 7644206 - DNA, 22 bp, Homo sapiens
agcacagattctgaagagtcct

SEQ ID NO: 7644207 - DNA, 22 bp, Homo sapiens
agcacagattctgaagagtcct

SEQ ID NO: 7644208 - DNA, 22 bp, Homo sapiens
agcacagatgtactttgagggg

SEQ ID NO: 7644209 - DNA, 22 bp, Homo sapiens
agcacagatggatgtattcatt

SEQ ID NO: 7644210 - DNA, 22 bp, Homo sapiens
agcacagatggatgtattcatt

SEQ ID NO: 7644211 - DNA, 22 bp, Homo sapiens
agcacagatgcatgatcaccag

SEQ ID NO: 7644212 - DNA, 22 bp, Homo sapiens
agcacagataacatggagtgga

SEQ ID NO: 7644213 - DNA, 22 bp, Homo sapiens
agcacagataacatggagtgga

SEQ ID NO: 7644214 - DNA, 22 bp, Homo sapiens
agcacagataacatggagtgga

SEQ ID NO: 7644215 - DNA, 22 bp, Homo sapiens
agcacagataacatggagtgga

SEQ ID NO: 7644216 - DNA, 22 bp, Homo sapiens
agcacagataacatggagtgga

SEQ ID NO: 7644217 - DNA, 22 bp, Homo sapiens
agcacagataacatggagtgga

SEQ ID NO: 7644218 - DNA, 22 bp, Homo sapiens
agcacagataacatggagtgga

SEQ ID NO: 7644219 - DNA, 22 bp, Homo sapiens
agcacagagttgctcactgccg

SEQ ID NO: 7644220 - DNA, 22 bp, Homo sapiens
agcacagagttgctcactgccg

SEQ ID NO: 7644221 - DNA, 22 bp, Homo sapiens
agcacagagttgcagagagcgt

SEQ ID NO: 7644222 - DNA, 22 bp, Homo sapiens
agcacagagttgcagagagcgt

SEQ ID NO: 7644223 - DNA, 22 bp, Homo sapiens
agcacagagttgcagagagcgt

SEQ ID NO: 7644224 - DNA, 22 bp, Homo sapiens
caaatgtttcttatctattgtt

SEQ ID NO: 7644225 - DNA, 22 bp, Homo sapiens
caaatgtttcttatctattgtt

SEQ ID NO: 7644226 - DNA, 22 bp, Homo sapiens
caaatgtttcttatctattgtt

SEQ ID NO: 7644227 - DNA, 22 bp, Homo sapiens
caaatgttgctgtaatgtttgt

SEQ ID NO: 7644228 - DNA, 22 bp, Homo sapiens
caaatgttgctgtaatgtttgt

SEQ ID NO: 7644229 - DNA, 22 bp, Homo sapiens
caaatgttagtgcccatccctc

SEQ ID NO: 7644230 - DNA, 22 bp, Homo sapiens
caaatgttgactaagagggttt

SEQ ID NO: 7644231 - DNA, 22 bp, Homo sapiens
caaatgttattcattcttgttt

SEQ ID NO: 7644232 - DNA, 22 bp, Homo sapiens
caaatgttattcattcttgttt

SEQ ID NO: 7644233 - DNA, 22 bp, Homo sapiens
caaatgttattcattcttgttt

SEQ ID NO: 7644234 - DNA, 22 bp, Homo sapiens
caaatgtttcttgaacaccaac

SEQ ID NO: 7644235 - DNA, 22 bp, Homo sapiens
caaatgtttcttgaacaccaac

SEQ ID NO: 7644236 - DNA, 22 bp, Homo sapiens
caaatgtttcttgaacaccaac

SEQ ID NO: 7644237 - DNA, 22 bp, Homo sapiens
caaatgtttgcatcacagggca

SEQ ID NO: 7644238 - DNA, 22 bp, Homo sapiens
caaatgtttcttgaacaccaac

SEQ ID NO: 7644239 - DNA, 22 bp, Homo sapiens
caaatgtttgcatcacagggca

SEQ ID NO: 7644240 - DNA, 22 bp, Homo sapiens
caaatgtttggtggcattttgt

SEQ ID NO: 7644241 - DNA, 22 bp, Homo sapiens
caaatgtttggtggcattttgt

SEQ ID NO: 7644242 - DNA, 22 bp, Homo sapiens
caaatgtttggtggcattttgt

SEQ ID NO: 7644243 - DNA, 22 bp, Homo sapiens
caaatgtttggtggcattttgt

SEQ ID NO: 7644244 - DNA, 22 bp, Homo sapiens
caaatgttttttagtataagta

SEQ ID NO: 7644245 - DNA, 22 bp, Homo sapiens
caaatgttttttagtataagta

SEQ ID NO: 7644246 - DNA, 22 bp, Homo sapiens
caaatgtttttattctacaaca

SEQ ID NO: 7644247 - DNA, 22 bp, Homo sapiens
caaatgtttttattctacaaca

SEQ ID NO: 7644248 - DNA, 22 bp, Homo sapiens
caaatgtttggtggcattttgt

SEQ ID NO: 7644249 - DNA, 22 bp, Homo sapiens
caaatgtttggtggcattttgt

SEQ ID NO: 7644250 - DNA, 22 bp, Homo sapiens
caaatgtttttattctacaaca

SEQ ID NO: 7644251 - DNA, 22 bp, Homo sapiens
caaatgtttttattctacaaca

SEQ ID NO: 7644252 - DNA, 22 bp, Homo sapiens
caaatgtttttattctacaaca

SEQ ID NO: 7644253 - DNA, 22 bp, Homo sapiens
caaatgtttttattctacaaca

SEQ ID NO: 7644254 - DNA, 22 bp, Homo sapiens
caaatgtttttattctacaaca

SEQ ID NO: 7644255 - DNA, 22 bp, Homo sapiens
agcagaagtgccttagcaatca

SEQ ID NO: 7644256 - DNA, 17 bp, Homo sapiens
agcagaagtcagaggga

SEQ ID NO: 7644257 - DNA, 22 bp, Homo sapiens
agcagaagtgccttagcaatca

SEQ ID NO: 7644258 - DNA, 22 bp, Homo sapiens
agcagaagtgccttagcaatca

SEQ ID NO: 7644259 - DNA, 22 bp, Homo sapiens
agcagaagtgccttagcaatca

SEQ ID NO: 7644260 - DNA, 17 bp, Homo sapiens
agcagaagtcagaggga

SEQ ID NO: 7644261 - DNA, 17 bp, Homo sapiens
agcagaagtcagaggga

SEQ ID NO: 7644262 - DNA, 17 bp, Homo sapiens
agcagaagtcagaggga

SEQ ID NO: 7644263 - DNA, 17 bp, Homo sapiens
agcagaagtcagaggga

SEQ ID NO: 7644264 - DNA, 17 bp, Homo sapiens
agcagaagtcagaggga

SEQ ID NO: 7644265 - DNA, 22 bp, Homo sapiens
agcagaagaggtcttgttgctg

SEQ ID NO: 7644266 - DNA, 22 bp, Homo sapiens
agcagaagaggtcttgttgctg

SEQ ID NO: 7644267 - DNA, 22 bp, Homo sapiens
agcagaagaaagccacatgact

SEQ ID NO: 7644268 - DNA, 22 bp, Homo sapiens
caaatgttttttagtataagta

SEQ ID NO: 7644269 - DNA, 22 bp, Homo sapiens
caaattaatgtgtctcaaaata

SEQ ID NO: 7644270 - DNA, 22 bp, Homo sapiens
caaattaatgtgtctcaaaata

SEQ ID NO: 7644271 - DNA, 22 bp, Homo sapiens
caaattaatgtgtctcaaaata

SEQ ID NO: 7644272 - DNA, 22 bp, Homo sapiens
caaattaatgtgtctcaaaata

SEQ ID NO: 7644273 - DNA, 22 bp, Homo sapiens
caaattaatgtgtctcaaaata

SEQ ID NO: 7644274 - DNA, 22 bp, Homo sapiens
caaattaatgtgtctcaaaata

SEQ ID NO: 7644275 - DNA, 22 bp, Homo sapiens
caaattaatgtgtctcaaaata

SEQ ID NO: 7644276 - DNA, 22 bp, Homo sapiens
caaattaatgtgtctcaaaata

SEQ ID NO: 7644277 - DNA, 22 bp, Homo sapiens
caaattaatgtgtctcaaaata

SEQ ID NO: 7644278 - DNA, 22 bp, Homo sapiens
caaattaatgtgtctcaaaata

SEQ ID NO: 7644279 - DNA, 22 bp, Homo sapiens
caaattaatgtgtctcaaaata

SEQ ID NO: 7644280 - DNA, 22 bp, Homo sapiens
agcactgtggtggaagcatcaa

SEQ ID NO: 7644281 - DNA, 22 bp, Homo sapiens
agcactgttatgggatgactta

SEQ ID NO: 7644282 - DNA, 22 bp, Homo sapiens
agcactgttatgggatgactta

SEQ ID NO: 7644283 - DNA, 22 bp, Homo sapiens
agcactgtggtggaagcatcaa

SEQ ID NO: 7644284 - DNA, 22 bp, Homo sapiens
agcactgtggtggaagcatcaa

SEQ ID NO: 7644285 - DNA, 22 bp, Homo sapiens
agcacttaagttaattgaactg

SEQ ID NO: 7644286 - DNA, 22 bp, Homo sapiens
agcacttaactgacagtactat

SEQ ID NO: 7644287 - DNA, 22 bp, Homo sapiens
caaatgatccttgcaagctgtg

SEQ ID NO: 7644288 - DNA, 22 bp, Homo sapiens
caaatgatccttgcaagctgtg

SEQ ID NO: 7644289 - DNA, 22 bp, Homo sapiens
caaatgatagagccgattatca

SEQ ID NO: 7644290 - DNA, 22 bp, Homo sapiens
caaatgatccttgcaagctgtg

SEQ ID NO: 7644291 - DNA, 22 bp, Homo sapiens
caaatgatagagccgattatca

SEQ ID NO: 7644292 - DNA, 22 bp, Homo sapiens
caaatgatagagccgattatca

SEQ ID NO: 7644293 - DNA, 22 bp, Homo sapiens
caaatgatactgtttttagtct

SEQ ID NO: 7644294 - DNA, 22 bp, Homo sapiens
caaatgatactgtttttagtct

SEQ ID NO: 7644295 - DNA, 22 bp, Homo sapiens
caaatgatagagccgattatca

SEQ ID NO: 7644296 - DNA, 22 bp, Homo sapiens
caaatgatactgtttttagtct

SEQ ID NO: 7644297 - DNA, 22 bp, Homo sapiens
caaatgatactgtttttagtct

SEQ ID NO: 7644298 - DNA, 22 bp, Homo sapiens
caaatgatactgtttttagtct

SEQ ID NO: 7644299 - DNA, 22 bp, Homo sapiens
agcacagcttagcacctggcac

SEQ ID NO: 7644300 - DNA, 22 bp, Homo sapiens
caaatattccaggtacatccct

SEQ ID NO: 7644301 - DNA, 22 bp, Homo sapiens
caaatattccaggtacatccct

SEQ ID NO: 7644302 - DNA, 22 bp, Homo sapiens
caaatgatacctattactaggc

SEQ ID NO: 7644303 - DNA, 22 bp, Homo sapiens
agcacagcttagcacctggcac

SEQ ID NO: 7644304 - DNA, 22 bp, Homo sapiens
agcacagctgttcaacaggaat

SEQ ID NO: 7644305 - DNA, 22 bp, Homo sapiens
agcacagctggaaaataaatca

SEQ ID NO: 7644306 - DNA, 22 bp, Homo sapiens
agcacagctgctgaatgataca

SEQ ID NO: 7644307 - DNA, 20 bp, Homo sapiens
agcacagcgcggtgttcctt

SEQ ID NO: 7644308 - DNA, 22 bp, Homo sapiens
agcacagcctctggtttctgac

SEQ ID NO: 7644309 - DNA, 22 bp, Homo sapiens
agcacagcctctggtttctgac

SEQ ID NO: 7644310 - DNA, 20 bp, Homo sapiens
agcacagcgcggtgttcctt

SEQ ID NO: 7644311 - DNA, 22 bp, Homo sapiens
agcacagcaccatcctggtacc

SEQ ID NO: 7644312 - DNA, 22 bp, Homo sapiens
agcacagcagcgtctaaccgat

SEQ ID NO: 7644313 - DNA, 21 bp, Homo sapiens
agcacagcatatccaatgtca

SEQ ID NO: 7644314 - DNA, 22 bp, Homo sapiens
agcacagcagcgtctaaccgat

SEQ ID NO: 7644315 - DNA, 21 bp, Homo sapiens
agcacagcatatccaatgtca

SEQ ID NO: 7644316 - DNA, 22 bp, Homo sapiens
agcacagccagctttattggcc

SEQ ID NO: 7644317 - DNA, 21 bp, Homo sapiens
agcacagcatatccaatgtca

SEQ ID NO: 7644318 - DNA, 22 bp, Homo sapiens
agcacagcctctggtttctgac

SEQ ID NO: 7644319 - DNA, 21 bp, Homo sapiens
agcacagcatatccaatgtca

SEQ ID NO: 7644320 - DNA, 22 bp, Homo sapiens
agcacagcctctggtttctgac

SEQ ID NO: 7644321 - DNA, 22 bp, Homo sapiens
agcacagcctctggtttctgac

SEQ ID NO: 7644322 - DNA, 22 bp, Homo sapiens
caaatgttaaatgtgttaagac

SEQ ID NO: 7644323 - DNA, 22 bp, Homo sapiens
caaatgttaagacaggatcaag

SEQ ID NO: 7644324 - DNA, 22 bp, Homo sapiens
caaatgttaagacaggatcaag

SEQ ID NO: 7644325 - DNA, 22 bp, Homo sapiens
caaatgttaaatgtgttaagac

SEQ ID NO: 7644326 - DNA, 22 bp, Homo sapiens
caaatgttaaatgtgttaagac

SEQ ID NO: 7644327 - DNA, 22 bp, Homo sapiens
caaatgttaaatgtgttaagac

SEQ ID NO: 7644328 - DNA, 22 bp, Homo sapiens
caaatgcatagaaagatgaaac

SEQ ID NO: 7644329 - DNA, 22 bp, Homo sapiens
caaatgttaaatgtgttaagac

SEQ ID NO: 7644330 - DNA, 22 bp, Homo sapiens
caaatgttaaatgtgttaagac

SEQ ID NO: 7644331 - DNA, 22 bp, Homo sapiens
caaatgttaaatgtgttaagac

SEQ ID NO: 7644332 - DNA, 22 bp, Homo sapiens
caaatgcatagaaagatgaaac

SEQ ID NO: 7644333 - DNA, 22 bp, Homo sapiens
caaatgcatagaaagatgaaac

SEQ ID NO: 7644334 - DNA, 22 bp, Homo sapiens
caaatgcatagaaagatgaaac

SEQ ID NO: 7644335 - DNA, 22 bp, Homo sapiens
caaatgcatagaaagatgaaac

SEQ ID NO: 7644336 - DNA, 22 bp, Homo sapiens
caaatgcatagaaagatgaaac

SEQ ID NO: 7644337 - DNA, 22 bp, Homo sapiens
caaatgcagtccctttgttgct

SEQ ID NO: 7644338 - DNA, 22 bp, Homo sapiens
caaatgcaggtcataacctgag

SEQ ID NO: 7644339 - DNA, 22 bp, Homo sapiens
caaatgcaggtcataacctgag

SEQ ID NO: 7644340 - DNA, 22 bp, Homo sapiens
caaatgcaggtcataacctgag

SEQ ID NO: 7644341 - DNA, 22 bp, Homo sapiens
caaatgcaggtcataacctgag

SEQ ID NO: 7644342 - DNA, 22 bp, Homo sapiens
caaatgcagtccctttgttgct

SEQ ID NO: 7644343 - DNA, 22 bp, Homo sapiens
caaatgcagtccctttgttgct

SEQ ID NO: 7644344 - DNA, 22 bp, Homo sapiens
caaatgcagtccctttgttgct

SEQ ID NO: 7644345 - DNA, 22 bp, Homo sapiens
caaatgcagtccctttgttgct

SEQ ID NO: 7644346 - DNA, 22 bp, Homo sapiens
caaatgcaaaatataaccctgt

SEQ ID NO: 7644347 - DNA, 22 bp, Homo sapiens
caaatgcaaaatataaccctgt

SEQ ID NO: 7644348 - DNA, 22 bp, Homo sapiens
caaatgcagattcaggagttct

SEQ ID NO: 7644349 - DNA, 22 bp, Homo sapiens
caaatgcaaaatataaccctgt

SEQ ID NO: 7644350 - DNA, 22 bp, Homo sapiens
caaatgcaaaatataaccctgt

SEQ ID NO: 7644351 - DNA, 22 bp, Homo sapiens
caaatgatgcatggctagtgag

SEQ ID NO: 7644352 - DNA, 22 bp, Homo sapiens
caaatgatccttgcaagctgtg

SEQ ID NO: 7644353 - DNA, 22 bp, Homo sapiens
caaatgatgcatggctagtgag

SEQ ID NO: 7644354 - DNA, 22 bp, Homo sapiens
caaatgcaaaatataaccctgt

SEQ ID NO: 7644355 - DNA, 22 bp, Homo sapiens
caaatgcaaaatataaccctgt

SEQ ID NO: 7644356 - DNA, 22 bp, Homo sapiens
caaatgatgcatggctagtgag

SEQ ID NO: 7644357 - DNA, 22 bp, Homo sapiens
caaatgcagattcaggagttct

SEQ ID NO: 7644358 - DNA, 22 bp, Homo sapiens
caaatgcaggtcagcaggtgtc

SEQ ID NO: 7644359 - DNA, 22 bp, Homo sapiens
caaatgcaggtcagcaggtgtc

SEQ ID NO: 7644360 - DNA, 22 bp, Homo sapiens
caaatgcaggtcagcaggtgtc

SEQ ID NO: 7644361 - DNA, 22 bp, Homo sapiens
caaatgcagattcaggagttct

SEQ ID NO: 7644362 - DNA, 22 bp, Homo sapiens
caaatgcagattcaggagttct

SEQ ID NO: 7644363 - DNA, 22 bp, Homo sapiens
caaatgcaggtcagcaggtgtc

SEQ ID NO: 7644364 - DNA, 22 bp, Homo sapiens
caaatgcaggtcataacctgag

SEQ ID NO: 7644365 - DNA, 22 bp, Homo sapiens
caaatgcaggtcagcaggtgtc

SEQ ID NO: 7644366 - DNA, 22 bp, Homo sapiens
caaatgcaggtcagcaggtgtc

SEQ ID NO: 7644367 - DNA, 22 bp, Homo sapiens
caaatgcaggtcataacctgag

SEQ ID NO: 7644368 - DNA, 22 bp, Homo sapiens
caaatgcaggtcataacctgag

SEQ ID NO: 7644369 - DNA, 22 bp, Homo sapiens
caaatgcaggtcagcaggtgtc

SEQ ID NO: 7644370 - DNA, 22 bp, Homo sapiens
caaatgcaggtcagcaggtgtc

SEQ ID NO: 7644371 - DNA, 22 bp, Homo sapiens
cactctggttctgaacaggatc

SEQ ID NO: 7644372 - DNA, 22 bp, Homo sapiens
cactctgggggctgccgctgcc

SEQ ID NO: 7644373 - DNA, 22 bp, Homo sapiens
cactctgggggctgccgctgcc

SEQ ID NO: 7644374 - DNA, 22 bp, Homo sapiens
cactctgggctcttgtttcaga

SEQ ID NO: 7644375 - DNA, 22 bp, Homo sapiens
cactctgctgaaatcgccttgt

SEQ ID NO: 7644376 - DNA, 22 bp, Homo sapiens
cactctggggatgcaaggagag

SEQ ID NO: 7644377 - DNA, 22 bp, Homo sapiens
cactctggggatgcaaggagag

SEQ ID NO: 7644378 - DNA, 22 bp, Homo sapiens
cactctgattccacaaggctcc

SEQ ID NO: 7644379 - DNA, 22 bp, Homo sapiens
cactctgcagctgaagggctgg

SEQ ID NO: 7644380 - DNA, 22 bp, Homo sapiens
cactctgatggtttctgttcaa

SEQ ID NO: 7644381 - DNA, 22 bp, Homo sapiens
cactctgatggtttctgttcaa

SEQ ID NO: 7644382 - DNA, 22 bp, Homo sapiens
cactctgattccacaaggctcc

SEQ ID NO: 7644383 - DNA, 22 bp, Homo sapiens
cactctgcgctgggcgccagcg

SEQ ID NO: 7644384 - DNA, 22 bp, Homo sapiens
cactctgctgaaatcgccttgt

SEQ ID NO: 7644385 - DNA, 22 bp, Homo sapiens
cactctggccactgctaaaggc

SEQ ID NO: 7644386 - DNA, 22 bp, Homo sapiens
cactctgcagctgaagggctgg

SEQ ID NO: 7644387 - DNA, 22 bp, Homo sapiens
cactctgcagctgaagggctgg

SEQ ID NO: 7644388 - DNA, 20 bp, Homo sapiens
cactctgagggagtccatgt

SEQ ID NO: 7644389 - DNA, 22 bp, Homo sapiens
cactctgagcccaagcaggctg

SEQ ID NO: 7644390 - DNA, 20 bp, Homo sapiens
cactctgagggagtccatgt

SEQ ID NO: 7644391 - DNA, 22 bp, Homo sapiens
cactctgagcccaagcaggctg

SEQ ID NO: 7644392 - DNA, 22 bp, Homo sapiens
cactctgagcccaagcaggctg

SEQ ID NO: 7644393 - DNA, 22 bp, Homo sapiens
agcataattcctgacacacaag

SEQ ID NO: 7644394 - DNA, 22 bp, Homo sapiens
agcataattcctgacacacaag

SEQ ID NO: 7644395 - DNA, 22 bp, Homo sapiens
agcataagttggtacagccact

SEQ ID NO: 7644396 - DNA, 22 bp, Homo sapiens
agcataacacccgacactcagg

SEQ ID NO: 7644397 - DNA, 22 bp, Homo sapiens
agcataacacccgacactcagg

SEQ ID NO: 7644398 - DNA, 22 bp, Homo sapiens
agcataagttggtacagccact

SEQ ID NO: 7644399 - DNA, 22 bp, Homo sapiens
agcataagttggtacagccact

SEQ ID NO: 7644400 - DNA, 22 bp, Homo sapiens
agcataaaggtcaacgttttag

SEQ ID NO: 7644401 - DNA, 22 bp, Homo sapiens
agcataaaggtcaacgttttag

SEQ ID NO: 7644402 - DNA, 22 bp, Homo sapiens
agcataaaggtcaacgttttag

SEQ ID NO: 7644403 - DNA, 22 bp, Homo sapiens
agcataagttggtacagccact

SEQ ID NO: 7644404 - DNA, 22 bp, Homo sapiens
agcataagttggtacagccact

SEQ ID NO: 7644405 - DNA, 22 bp, Homo sapiens
agcataagttggtacagccact

SEQ ID NO: 7644406 - DNA, 22 bp, Homo sapiens
agcataagttggtacagccact

SEQ ID NO: 7644407 - DNA, 22 bp, Homo sapiens
agcagtttttataacactggaa

SEQ ID NO: 7644408 - DNA, 22 bp, Homo sapiens
agcagtttttataacactggaa

SEQ ID NO: 7644409 - DNA, 22 bp, Homo sapiens
agcataaaataaatagtttgca

SEQ ID NO: 7644410 - DNA, 22 bp, Homo sapiens
agcataaaataaatagtttgca

SEQ ID NO: 7644411 - DNA, 22 bp, Homo sapiens
agcagttttcctgagctcctca

SEQ ID NO: 7644412 - DNA, 22 bp, Homo sapiens
agcagtttttataacactggaa

SEQ ID NO: 7644413 - DNA, 22 bp, Homo sapiens
agcataaactcagggacacaca

SEQ ID NO: 7644414 - DNA, 23 bp, Homo sapiens
agcataaacctctgtggctttag

SEQ ID NO: 7644415 - DNA, 23 bp, Homo sapiens
agcataaacctctgtggctttag

SEQ ID NO: 7644416 - DNA, 22 bp, Homo sapiens
agcataaactcagggacacaca

SEQ ID NO: 7644417 - DNA, 22 bp, Homo sapiens
agcataaactcagggacacaca

SEQ ID NO: 7644418 - DNA, 22 bp, Homo sapiens
agcataaaggcactagaaagag

SEQ ID NO: 7644419 - DNA, 22 bp, Homo sapiens
agcataaaggacatttgtcact

SEQ ID NO: 7644420 - DNA, 22 bp, Homo sapiens
agcataaaggacatttgtcact

SEQ ID NO: 7644421 - DNA, 22 bp, Homo sapiens
agcataaactcagggacacaca

SEQ ID NO: 7644422 - DNA, 23 bp, Homo sapiens
agcataaacctctgtggctttag

SEQ ID NO: 7644423 - DNA, 22 bp, Homo sapiens
agcataaaggcactagaaagag

SEQ ID NO: 7644424 - DNA, 22 bp, Homo sapiens
agcataaaggcactagaaagag

SEQ ID NO: 7644425 - DNA, 22 bp, Homo sapiens
agcataaaggtcaacgttttag

SEQ ID NO: 7644426 - DNA, 22 bp, Homo sapiens
agcagtttgaatcaatggccag

SEQ ID NO: 7644427 - DNA, 22 bp, Homo sapiens
agcagtttgaatcaatggccag

SEQ ID NO: 7644428 - DNA, 22 bp, Homo sapiens
agcagtttctcttgtatcttca

SEQ ID NO: 7644429 - DNA, 22 bp, Homo sapiens
agcagtttgaatcaatggccag

SEQ ID NO: 7644430 - DNA, 22 bp, Homo sapiens
agcagtttgaatcaatggccag

SEQ ID NO: 7644431 - DNA, 22 bp, Homo sapiens
agcagtttggaaaatactagaa

SEQ ID NO: 7644432 - DNA, 20 bp, Homo sapiens
agcagtttcctaactcagct

SEQ ID NO: 7644433 - DNA, 20 bp, Homo sapiens
agcagtttcctaactcagct

SEQ ID NO: 7644434 - DNA, 22 bp, Homo sapiens
agcagtttatcctcataatgga

SEQ ID NO: 7644435 - DNA, 22 bp, Homo sapiens
agcagtttccacaacctcccct

SEQ ID NO: 7644436 - DNA, 20 bp, Homo sapiens
agcagtttcctaactcagct

SEQ ID NO: 7644437 - DNA, 22 bp, Homo sapiens
agcagttttatgcgattgtttc

SEQ ID NO: 7644438 - DNA, 22 bp, Homo sapiens
agcagttttcctgagctcctca

SEQ ID NO: 7644439 - DNA, 22 bp, Homo sapiens
agcagttttagggagacacatt

SEQ ID NO: 7644440 - DNA, 22 bp, Homo sapiens
agcagttttagggagacacatt

SEQ ID NO: 7644441 - DNA, 22 bp, Homo sapiens
agcagttttagggagacacatt

SEQ ID NO: 7644442 - DNA, 22 bp, Homo sapiens
agcagtttggcccgagcagttc

SEQ ID NO: 7644443 - DNA, 22 bp, Homo sapiens
agcagttttagggagacacatt

SEQ ID NO: 7644444 - DNA, 22 bp, Homo sapiens
agcagttttagggagacacatt

SEQ ID NO: 7644445 - DNA, 22 bp, Homo sapiens
agcagtttggcccgagcagttc

SEQ ID NO: 7644446 - DNA, 22 bp, Homo sapiens
agcagtttggaaaatactagaa

SEQ ID NO: 7644447 - DNA, 22 bp, Homo sapiens
agcagtttggaaaatactagaa

SEQ ID NO: 7644448 - DNA, 22 bp, Homo sapiens
caccagggctctgagctctgaa

SEQ ID NO: 7644449 - DNA, 22 bp, Homo sapiens
caccagggctctgagctctgaa

SEQ ID NO: 7644450 - DNA, 22 bp, Homo sapiens
caccagggccccaggctgtgcc

SEQ ID NO: 7644451 - DNA, 22 bp, Homo sapiens
caccagggccccaggctgtgcc

SEQ ID NO: 7644452 - DNA, 22 bp, Homo sapiens
caccagggccccaggctgtgcc

SEQ ID NO: 7644453 - DNA, 22 bp, Homo sapiens
caccagggcagcagcctagtct

SEQ ID NO: 7644454 - DNA, 22 bp, Homo sapiens
caccagggcagcagcctagtct

SEQ ID NO: 7644455 - DNA, 22 bp, Homo sapiens
caccagggcagcagcctagtct

SEQ ID NO: 7644456 - DNA, 22 bp, Homo sapiens
caccaggtgctggaggacatca

SEQ ID NO: 7644457 - DNA, 22 bp, Homo sapiens
caccaggggcagagaccaaagt

SEQ ID NO: 7644458 - DNA, 22 bp, Homo sapiens
caccagggtacaatttcgcaga

SEQ ID NO: 7644459 - DNA, 22 bp, Homo sapiens
caccaggggcagagaccaaagt

SEQ ID NO: 7644460 - DNA, 22 bp, Homo sapiens
caccagggctctgagctctgaa

SEQ ID NO: 7644461 - DNA, 22 bp, Homo sapiens
caccagggctctgagctctgaa

SEQ ID NO: 7644462 - DNA, 22 bp, Homo sapiens
caccagggctctgagctctgaa

SEQ ID NO: 7644463 - DNA, 22 bp, Homo sapiens
caccagggctctgagctctgaa

SEQ ID NO: 7644464 - DNA, 22 bp, Homo sapiens
caccagggctctgagctctgaa

SEQ ID NO: 7644465 - DNA, 22 bp, Homo sapiens
agcagttatgttctataaagtc

SEQ ID NO: 7644466 - DNA, 22 bp, Homo sapiens
agcagtggctgacagacttacc

SEQ ID NO: 7644467 - DNA, 22 bp, Homo sapiens
agcagtggctgaagatgttcct

SEQ ID NO: 7644468 - DNA, 22 bp, Homo sapiens
agcagtggcctggggctctgtg

SEQ ID NO: 7644469 - DNA, 22 bp, Homo sapiens
caccaggtggaaatgtcacagc

SEQ ID NO: 7644470 - DNA, 22 bp, Homo sapiens
caccaggggcagagaccaaagt

SEQ ID NO: 7644471 - DNA, 22 bp, Homo sapiens
agcagttgtagtcatggaaaat

SEQ ID NO: 7644472 - DNA, 22 bp, Homo sapiens
agcagttgtagtcatggaaaat

SEQ ID NO: 7644473 - DNA, 22 bp, Homo sapiens
agcagtttagctatactgcttg

SEQ ID NO: 7644474 - DNA, 22 bp, Homo sapiens
agcagtttatcctcataatgga

SEQ ID NO: 7644475 - DNA, 22 bp, Homo sapiens
agcagtttatcctcataatgga

SEQ ID NO: 7644476 - DNA, 22 bp, Homo sapiens
agcagtttatcctcataatgga

SEQ ID NO: 7644477 - DNA, 22 bp, Homo sapiens
agcagttgtagtcatggaaaat

SEQ ID NO: 7644478 - DNA, 22 bp, Homo sapiens
agcagttgtagtcatggaaaat

SEQ ID NO: 7644479 - DNA, 22 bp, Homo sapiens
agcagttgagtgggaatcaggc

SEQ ID NO: 7644480 - DNA, 22 bp, Homo sapiens
agcagttcataaacattttgag

SEQ ID NO: 7644481 - DNA, 22 bp, Homo sapiens
caccagggacaatgctaggggt

SEQ ID NO: 7644482 - DNA, 22 bp, Homo sapiens
caccagggacaatgctaggggt

SEQ ID NO: 7644483 - DNA, 22 bp, Homo sapiens
caccagggacaatgctaggggt

SEQ ID NO: 7644484 - DNA, 22 bp, Homo sapiens
caccagggcagcagcctagtct

SEQ ID NO: 7644485 - DNA, 22 bp, Homo sapiens
caccagggacaatgctaggggt

SEQ ID NO: 7644486 - DNA, 22 bp, Homo sapiens
caccaggctggagtgcagtggc

SEQ ID NO: 7644487 - DNA, 22 bp, Homo sapiens
agcaggtggacagaggaagaaa

SEQ ID NO: 7644488 - DNA, 22 bp, Homo sapiens
agcaggtggacagaggaagaaa

SEQ ID NO: 7644489 - DNA, 22 bp, Homo sapiens
agcaggtggacagaggaagaaa

SEQ ID NO: 7644490 - DNA, 22 bp, Homo sapiens
caccagggacaatgctaggggt

SEQ ID NO: 7644491 - DNA, 22 bp, Homo sapiens
caccagggacaatgctaggggt

SEQ ID NO: 7644492 - DNA, 22 bp, Homo sapiens
caccaggctggagtgcagtggc

SEQ ID NO: 7644493 - DNA, 22 bp, Homo sapiens
caccaggctggagtgcagtggc

SEQ ID NO: 7644494 - DNA, 22 bp, Homo sapiens
agcaggtgcgttacttcactct

SEQ ID NO: 7644495 - DNA, 22 bp, Homo sapiens
agcaggtgcgttacttcactct

SEQ ID NO: 7644496 - DNA, 21 bp, Homo sapiens
agcaggtgctgttggaggaaa

SEQ ID NO: 7644497 - DNA, 22 bp, Homo sapiens
agcaggtgcgttacttcactct

SEQ ID NO: 7644498 - DNA, 22 bp, Homo sapiens
agcaggtgccaggtgtacccgc

SEQ ID NO: 7644499 - DNA, 22 bp, Homo sapiens
agcaggtgccaggtgtacccgc

SEQ ID NO: 7644500 - DNA, 21 bp, Homo sapiens
agcaggtgctgttggaggaaa

SEQ ID NO: 7644501 - DNA, 21 bp, Homo sapiens
agcaggtgctgttggaggaaa

SEQ ID NO: 7644502 - DNA, 21 bp, Homo sapiens
agcaggtgctgttggaggaaa

SEQ ID NO: 7644503 - DNA, 21 bp, Homo sapiens
agcaggtgctgttggaggaaa

SEQ ID NO: 7644504 - DNA, 21 bp, Homo sapiens
agcaggtgctgttggaggaaa

SEQ ID NO: 7644505 - DNA, 21 bp, Homo sapiens
agcaggtgctgttggaggaaa

SEQ ID NO: 7644506 - DNA, 22 bp, Homo sapiens
cacatctgctctgggcagcact

SEQ ID NO: 7644507 - DNA, 22 bp, Homo sapiens
cacatctgcgctctgcctcata

SEQ ID NO: 7644508 - DNA, 22 bp, Homo sapiens
cacatctgggttctcttcttca

SEQ ID NO: 7644509 - DNA, 22 bp, Homo sapiens
cacatctgcgctctgcctcata

SEQ ID NO: 7644510 - DNA, 22 bp, Homo sapiens
cacatctgggttctcttcttca

SEQ ID NO: 7644511 - DNA, 22 bp, Homo sapiens
cacatctgggttctcttcttca

SEQ ID NO: 7644512 - DNA, 22 bp, Homo sapiens
cacatctgacttccagtgcagg

SEQ ID NO: 7644513 - DNA, 22 bp, Homo sapiens
cacatctgacttccagtgcagg

SEQ ID NO: 7644514 - DNA, 22 bp, Homo sapiens
cacatctgcgctctgcctcata

SEQ ID NO: 7644515 - DNA, 22 bp, Homo sapiens
cacatctgcgctctgcctcata

SEQ ID NO: 7644516 - DNA, 22 bp, Homo sapiens
cacatctgacttccagtgcagg

SEQ ID NO: 7644517 - DNA, 22 bp, Homo sapiens
cacatctgacttccagtgcagg

SEQ ID NO: 7644518 - DNA, 22 bp, Homo sapiens
cacatcttccagagtagctaaa

SEQ ID NO: 7644519 - DNA, 22 bp, Homo sapiens
cacatgaacatgctggaaaagc

SEQ ID NO: 7644520 - DNA, 22 bp, Homo sapiens
cacatcttccagagtagctaaa

SEQ ID NO: 7644521 - DNA, 22 bp, Homo sapiens
cacatctgggttctcttcttca

SEQ ID NO: 7644522 - DNA, 22 bp, Homo sapiens
cacatcttcttaactccaaagt

SEQ ID NO: 7644523 - DNA, 22 bp, Homo sapiens
cacatgaacatgctggaaaagc

SEQ ID NO: 7644524 - DNA, 23 bp, Homo sapiens
agcaggtaggttgaaattttcct

SEQ ID NO: 7644525 - DNA, 22 bp, Homo sapiens
agcaggtataggaggtatcctg

SEQ ID NO: 7644526 - DNA, 22 bp, Homo sapiens
agcaggtatgacatagatatgt

SEQ ID NO: 7644527 - DNA, 22 bp, Homo sapiens
agcaggtcgccgaagatagctc

SEQ ID NO: 7644528 - DNA, 22 bp, Homo sapiens
agcaggtgatcgcgtgtgctcc

SEQ ID NO: 7644529 - DNA, 22 bp, Homo sapiens
agcaggtgatcgcgtgtgctcc

SEQ ID NO: 7644530 - DNA, 22 bp, Homo sapiens
agcaggtgatcgcgtgtgctcc

SEQ ID NO: 7644531 - DNA, 22 bp, Homo sapiens
agcaggtgatcgcgtgtgctcc

SEQ ID NO: 7644532 - DNA, 22 bp, Homo sapiens
agcaggtgatcgcgtgtgctcc

SEQ ID NO: 7644533 - DNA, 22 bp, Homo sapiens
agcaggtgatgtgagtctggaa

SEQ ID NO: 7644534 - DNA, 22 bp, Homo sapiens
agcaggtgatgtgagtctggaa

SEQ ID NO: 7644535 - DNA, 22 bp, Homo sapiens
agcaggtgatgtgagtctggaa

SEQ ID NO: 7644536 - DNA, 22 bp, Homo sapiens
agcaggtgatgtgagtctggaa

SEQ ID NO: 7644537 - DNA, 22 bp, Homo sapiens
agcaggtgatgtgagtctggaa

SEQ ID NO: 7644538 - DNA, 22 bp, Homo sapiens
agcaggtgcatggcgagcgcgg

SEQ ID NO: 7644539 - DNA, 22 bp, Homo sapiens
agcaggtgcatggcgagcgcgg

SEQ ID NO: 7644540 - DNA, 22 bp, Homo sapiens
cacatctatagggacagcaaca

SEQ ID NO: 7644541 - DNA, 22 bp, Homo sapiens
cacatctactgatattccagga

SEQ ID NO: 7644542 - DNA, 22 bp, Homo sapiens
cacatctactgatattccagga

SEQ ID NO: 7644543 - DNA, 22 bp, Homo sapiens
cacatctcagggctacaggcag

SEQ ID NO: 7644544 - DNA, 22 bp, Homo sapiens
cacatctgaaaagatgcacaag

SEQ ID NO: 7644545 - DNA, 22 bp, Homo sapiens
cacatctatggagacagagagt

SEQ ID NO: 7644546 - DNA, 22 bp, Homo sapiens
cacatctcagggctacaggcag

SEQ ID NO: 7644547 - DNA, 22 bp, Homo sapiens
cacatctactgaatgagcagtg

SEQ ID NO: 7644548 - DNA, 22 bp, Homo sapiens
cacatccttcatactcagctct

SEQ ID NO: 7644549 - DNA, 22 bp, Homo sapiens
cacatcctgtgtaaacttggtg

SEQ ID NO: 7644550 - DNA, 22 bp, Homo sapiens
cacatccgaggagggtgagatg

SEQ ID NO: 7644551 - DNA, 22 bp, Homo sapiens
cacatccttcagctgagcccag

SEQ ID NO: 7644552 - DNA, 22 bp, Homo sapiens
cacatccttcatactcagctct

SEQ ID NO: 7644553 - DNA, 22 bp, Homo sapiens
cacatccttcatactcagctct

SEQ ID NO: 7644554 - DNA, 22 bp, Homo sapiens
cacatatttgatgaagctttgt

SEQ ID NO: 7644555 - DNA, 22 bp, Homo sapiens
cacatcaagcatccatgagttt

SEQ ID NO: 7644556 - DNA, 19 bp, Homo sapiens
cacatcagcagggctgtgg

SEQ ID NO: 7644557 - DNA, 16 bp, Homo sapiens
cacatatatttatatg

SEQ ID NO: 7644558 - DNA, 22 bp, Homo sapiens
agcagggctctgccatgggccc

SEQ ID NO: 7644559 - DNA, 22 bp, Homo sapiens
cacatattgtagttcaccagga

SEQ ID NO: 7644560 - DNA, 22 bp, Homo sapiens
cacatatttgatgaagctttgt

SEQ ID NO: 7644561 - DNA, 22 bp, Homo sapiens
cacatcattcaatggtgatatt

SEQ ID NO: 7644562 - DNA, 22 bp, Homo sapiens
cacatccctggagttacccagt

SEQ ID NO: 7644563 - DNA, 22 bp, Homo sapiens
cacatccctggagttacccagt

SEQ ID NO: 7644564 - DNA, 22 bp, Homo sapiens
cacatcctatcagtcacggttt

SEQ ID NO: 7644565 - DNA, 22 bp, Homo sapiens
cacatcctatcagtcacggttt

SEQ ID NO: 7644566 - DNA, 22 bp, Homo sapiens
cacatcatgttaattcattaca

SEQ ID NO: 7644567 - DNA, 22 bp, Homo sapiens
cacatcatagagactcaatcca

SEQ ID NO: 7644568 - DNA, 22 bp, Homo sapiens
cacatcaggtagacctacagag

SEQ ID NO: 7644569 - DNA, 22 bp, Homo sapiens
cacagtcaatgtagaaatatga

SEQ ID NO: 7644570 - DNA, 22 bp, Homo sapiens
cacagtcaatgtagaaatatga

SEQ ID NO: 7644571 - DNA, 22 bp, Homo sapiens
cacagtcaatgtagaaatatga

SEQ ID NO: 7644572 - DNA, 22 bp, Homo sapiens
cacagtatttgtttttctgagt

SEQ ID NO: 7644573 - DNA, 22 bp, Homo sapiens
cacagtatttgtttttctgagt

SEQ ID NO: 7644574 - DNA, 22 bp, Homo sapiens
cacagtatttgtttttctgagt

SEQ ID NO: 7644575 - DNA, 20 bp, Homo sapiens
cacagtattcttccttaaaa

SEQ ID NO: 7644576 - DNA, 20 bp, Homo sapiens
cacagtattcttccttaaaa

SEQ ID NO: 7644577 - DNA, 22 bp, Homo sapiens
cacagtcaccttatcaggatgt

SEQ ID NO: 7644578 - DNA, 22 bp, Homo sapiens
cacagtcacatatctatgtgtg

SEQ ID NO: 7644579 - DNA, 22 bp, Homo sapiens
cacagtcacatatctatgtgtg

SEQ ID NO: 7644580 - DNA, 22 bp, Homo sapiens
cacagtcacatatctatgtgtg

SEQ ID NO: 7644581 - DNA, 22 bp, Homo sapiens
cacagtcacatatctatgtgtg

SEQ ID NO: 7644582 - DNA, 22 bp, Homo sapiens
cacagtcacatatctatgtgtg

SEQ ID NO: 7644583 - DNA, 23 bp, Homo sapiens
cacagtcatttactttgccatca

SEQ ID NO: 7644584 - DNA, 23 bp, Homo sapiens
cacagtcatttactttgccatca

SEQ ID NO: 7644585 - DNA, 22 bp, Homo sapiens
cacagtcagcctctagtagcat

SEQ ID NO: 7644586 - DNA, 23 bp, Homo sapiens
cacagtcatttactttgccatca

SEQ ID NO: 7644587 - DNA, 22 bp, Homo sapiens
cacagtcaccttatcaggatgt

SEQ ID NO: 7644588 - DNA, 22 bp, Homo sapiens
cacagtcaccttatcaggatgt

SEQ ID NO: 7644589 - DNA, 22 bp, Homo sapiens
cacagtcaccttatcaggatgt

SEQ ID NO: 7644590 - DNA, 22 bp, Homo sapiens
cacagtcaccttatcaggatgt

SEQ ID NO: 7644591 - DNA, 22 bp, Homo sapiens
agcagggcagtgcttcagctct

SEQ ID NO: 7644592 - DNA, 22 bp, Homo sapiens
agcagggcagtgcttcagctct

SEQ ID NO: 7644593 - DNA, 22 bp, Homo sapiens
agcagggcctgagtgacctaac

SEQ ID NO: 7644594 - DNA, 22 bp, Homo sapiens
agcagggcctctggcactggtc

SEQ ID NO: 7644595 - DNA, 22 bp, Homo sapiens
agcagggcagtgcttcagctct

SEQ ID NO: 7644596 - DNA, 22 bp, Homo sapiens
agcagggcctctggcactggtc

SEQ ID NO: 7644597 - DNA, 22 bp, Homo sapiens
agcagggcctctggcactggtc

SEQ ID NO: 7644598 - DNA, 22 bp, Homo sapiens
agcagggcagtgatcagaaagg

SEQ ID NO: 7644599 - DNA, 22 bp, Homo sapiens
cacagtcccattcgagagtaat

SEQ ID NO: 7644600 - DNA, 22 bp, Homo sapiens
cacagtcccattcgagagtaat

SEQ ID NO: 7644601 - DNA, 22 bp, Homo sapiens
cacagtccagactcctggagtt

SEQ ID NO: 7644602 - DNA, 22 bp, Homo sapiens
cacagtccagactcctggagtt

SEQ ID NO: 7644603 - DNA, 22 bp, Homo sapiens
cacagtccagactcctggagtt

SEQ ID NO: 7644604 - DNA, 22 bp, Homo sapiens
cacagtccagactcctggagtt

SEQ ID NO: 7644605 - DNA, 22 bp, Homo sapiens
cacagtccagactcctggagtt

SEQ ID NO: 7644606 - DNA, 22 bp, Homo sapiens
cacagtccagactcctggagtt

SEQ ID NO: 7644607 - DNA, 22 bp, Homo sapiens
agcagggctcacattagtggat

SEQ ID NO: 7644608 - DNA, 22 bp, Homo sapiens
agcagggctcacattagtggat

SEQ ID NO: 7644609 - DNA, 22 bp, Homo sapiens
agcagggctcacattagtggat

SEQ ID NO: 7644610 - DNA, 22 bp, Homo sapiens
agcagggctcacattagtggat

SEQ ID NO: 7644611 - DNA, 22 bp, Homo sapiens
agcagggctccatttcactgcc

SEQ ID NO: 7644612 - DNA, 22 bp, Homo sapiens
agcagggctccatttcactgcc

SEQ ID NO: 7644613 - DNA, 22 bp, Homo sapiens
agcagggctccatttcactgcc

SEQ ID NO: 7644614 - DNA, 22 bp, Homo sapiens
agcagggctccatttcactgcc

SEQ ID NO: 7644615 - DNA, 22 bp, Homo sapiens
agcagggctcctgaaagccgcg

SEQ ID NO: 7644616 - DNA, 22 bp, Homo sapiens
agcagggctctgccatgggccc

SEQ ID NO: 7644617 - DNA, 22 bp, Homo sapiens
agcagggctcctgaaagccgcg

SEQ ID NO: 7644618 - DNA, 22 bp, Homo sapiens
agcagggctctgccatgggccc

SEQ ID NO: 7644619 - DNA, 22 bp, Homo sapiens
agcagggctctgccatgggccc

SEQ ID NO: 7644620 - DNA, 22 bp, Homo sapiens
agcagggctctgccatgggccc

SEQ ID NO: 7644621 - DNA, 22 bp, Homo sapiens
agcagggctctgccatgggccc

SEQ ID NO: 7644622 - DNA, 22 bp, Homo sapiens
agcagggctcctgaaagccgcg

SEQ ID NO: 7644623 - DNA, 22 bp, Homo sapiens
agcagggcctgagtgacctaac

SEQ ID NO: 7644624 - DNA, 22 bp, Homo sapiens
agcagggcctgagtgacctaac

SEQ ID NO: 7644625 - DNA, 22 bp, Homo sapiens
agcagggcctgagtgacctaac

SEQ ID NO: 7644626 - DNA, 22 bp, Homo sapiens
agcagggcctgagtgacctaac

SEQ ID NO: 7644627 - DNA, 22 bp, Homo sapiens
agcagggcctggcactcctggg

SEQ ID NO: 7644628 - DNA, 16 bp, Homo sapiens
agcagggcgggaagga

SEQ ID NO: 7644629 - DNA, 16 bp, Homo sapiens
agcagggcgggaagga

SEQ ID NO: 7644630 - DNA, 22 bp, Homo sapiens
agcagggcctggcactcctggg

SEQ ID NO: 7644631 - DNA, 16 bp, Homo sapiens
agcagggcgggaagga

SEQ ID NO: 7644632 - DNA, 22 bp, Homo sapiens
agcagggcctggcactcctggg

SEQ ID NO: 7644633 - DNA, 22 bp, Homo sapiens
agcagggcctggcactcctggg

SEQ ID NO: 7644634 - DNA, 22 bp, Homo sapiens
cacagggcagtgattgtccaca

SEQ ID NO: 7644635 - DNA, 19 bp, Homo sapiens
cacagggcaggtctcatgt

SEQ ID NO: 7644636 - DNA, 22 bp, Homo sapiens
cacagggcagtgattgtccaca

SEQ ID NO: 7644637 - DNA, 22 bp, Homo sapiens
cacagggcagtgctgcccactc

SEQ ID NO: 7644638 - DNA, 22 bp, Homo sapiens
cacagggcagtgctgcccactc

SEQ ID NO: 7644639 - DNA, 22 bp, Homo sapiens
cacagggcagtgctgcccactc

SEQ ID NO: 7644640 - DNA, 22 bp, Homo sapiens
cacagggcagtgattgtccaca

SEQ ID NO: 7644641 - DNA, 22 bp, Homo sapiens
cacagggcagtgctgcccactc

SEQ ID NO: 7644642 - DNA, 22 bp, Homo sapiens
cacagggcagtgctgcccactc

SEQ ID NO: 7644643 - DNA, 22 bp, Homo sapiens
cacaggctgcccgcagctggga

SEQ ID NO: 7644644 - DNA, 23 bp, Homo sapiens
cacaggctgcgcataagcttctc

SEQ ID NO: 7644645 - DNA, 23 bp, Homo sapiens
cacaggctgcgcataagcttctc

SEQ ID NO: 7644646 - DNA, 22 bp, Homo sapiens
cacaggctgcccgcagctggga

SEQ ID NO: 7644647 - DNA, 22 bp, Homo sapiens
cacagggcaggtactctcagag

SEQ ID NO: 7644648 - DNA, 22 bp, Homo sapiens
cacagggcaggtactctcagag

SEQ ID NO: 7644649 - DNA, 19 bp, Homo sapiens
cacagggcaggtctcatgt

SEQ ID NO: 7644650 - DNA, 19 bp, Homo sapiens
cacagggcaggtctcatgt

SEQ ID NO: 7644651 - DNA, 22 bp, Homo sapiens
cacagggcaggtactctcagag

SEQ ID NO: 7644652 - DNA, 22 bp, Homo sapiens
cacagggccactttcccagtaa

SEQ ID NO: 7644653 - DNA, 22 bp, Homo sapiens
cacagggccactttcccagtaa

SEQ ID NO: 7644654 - DNA, 22 bp, Homo sapiens
cacagggccactttcccagtaa

SEQ ID NO: 7644655 - DNA, 22 bp, Homo sapiens
cacagggcctggggcagctgct

SEQ ID NO: 7644656 - DNA, 22 bp, Homo sapiens
cacagggcctggggcagctgct

SEQ ID NO: 7644657 - DNA, 22 bp, Homo sapiens
cacagggcctggggcagctgct

SEQ ID NO: 7644658 - DNA, 22 bp, Homo sapiens
cacagggccactttcccagtaa

SEQ ID NO: 7644659 - DNA, 22 bp, Homo sapiens
cacagggcctggggcagctgct

SEQ ID NO: 7644660 - DNA, 22 bp, Homo sapiens
cacagggcctggggcagctgct

SEQ ID NO: 7644661 - DNA, 22 bp, Homo sapiens
cacagggccttgtgtgactgca

SEQ ID NO: 7644662 - DNA, 22 bp, Homo sapiens
cacagggccttgtgtgactgca

SEQ ID NO: 7644663 - DNA, 22 bp, Homo sapiens
cacagggccttgtgtgactgca

SEQ ID NO: 7644664 - DNA, 22 bp, Homo sapiens
cacagggcctggggcagctgct

SEQ ID NO: 7644665 - DNA, 22 bp, Homo sapiens
cacagggccttgtgtgactgca

SEQ ID NO: 7644666 - DNA, 22 bp, Homo sapiens
cacagggcctggggcagctgct

SEQ ID NO: 7644667 - DNA, 22 bp, Homo sapiens
cacagggcctggggcagctgct

SEQ ID NO: 7644668 - DNA, 22 bp, Homo sapiens
cacagggcctggggcagctgct

SEQ ID NO: 7644669 - DNA, 22 bp, Homo sapiens
cacagggcctggggcagctgct

SEQ ID NO: 7644670 - DNA, 22 bp, Homo sapiens
cacagtacttaattctctaaat

SEQ ID NO: 7644671 - DNA, 22 bp, Homo sapiens
cacagtacttaattctctaaat

SEQ ID NO: 7644672 - DNA, 22 bp, Homo sapiens
cacagtactgctttgggatgtg

SEQ ID NO: 7644673 - DNA, 22 bp, Homo sapiens
cacagtacgcacccgatacatg

SEQ ID NO: 7644674 - DNA, 22 bp, Homo sapiens
cacagtactgctttgggatgtg

SEQ ID NO: 7644675 - DNA, 22 bp, Homo sapiens
cacagtacttaattctctaaat

SEQ ID NO: 7644676 - DNA, 22 bp, Homo sapiens
cacagtagccatgtctcaagta

SEQ ID NO: 7644677 - DNA, 22 bp, Homo sapiens
cacagtagccatgtctcaagta

SEQ ID NO: 7644678 - DNA, 22 bp, Homo sapiens
cacagtatcttttgagtaagca

SEQ ID NO: 7644679 - DNA, 22 bp, Homo sapiens
cacagtatcttttgagtaagca

SEQ ID NO: 7644680 - DNA, 22 bp, Homo sapiens
cacagtatcttttgagtaagca

SEQ ID NO: 7644681 - DNA, 22 bp, Homo sapiens
cacagtatgatctaaagtaagt

SEQ ID NO: 7644682 - DNA, 22 bp, Homo sapiens
cacagtatgatctaaagtaagt

SEQ ID NO: 7644683 - DNA, 22 bp, Homo sapiens
cacagtatgatctaaagtaagt

SEQ ID NO: 7644684 - DNA, 22 bp, Homo sapiens
cacagtatgatctaaagtaagt

SEQ ID NO: 7644685 - DNA, 22 bp, Homo sapiens
cacagtattcactgggcagatt

SEQ ID NO: 7644686 - DNA, 22 bp, Homo sapiens
cacagtattcactgggcagatt

SEQ ID NO: 7644687 - DNA, 22 bp, Homo sapiens
cacagtatgatctaaagtaagt

SEQ ID NO: 7644688 - DNA, 22 bp, Homo sapiens
cacagtattcactgggcagatt

SEQ ID NO: 7644689 - DNA, 22 bp, Homo sapiens
cacagggctaaatgaagggttg

SEQ ID NO: 7644690 - DNA, 22 bp, Homo sapiens
cacagggcttctcatggggtgc

SEQ ID NO: 7644691 - DNA, 22 bp, Homo sapiens
cacagggcttctcatggggtgc

SEQ ID NO: 7644692 - DNA, 22 bp, Homo sapiens
cacagggctaaatgaagggttg

SEQ ID NO: 7644693 - DNA, 22 bp, Homo sapiens
cacagggccttgtgtgactgca

SEQ ID NO: 7644694 - DNA, 22 bp, Homo sapiens
cacagggctaaatgaagggttg

SEQ ID NO: 7644695 - DNA, 22 bp, Homo sapiens
cacagggctaaatgaagggttg

SEQ ID NO: 7644696 - DNA, 22 bp, Homo sapiens
cacagggctttgatggctgagt

SEQ ID NO: 7644697 - DNA, 22 bp, Homo sapiens
cacagggctttgatggctgagt

SEQ ID NO: 7644698 - DNA, 22 bp, Homo sapiens
cacagggctttgatggctgagt

SEQ ID NO: 7644699 - DNA, 22 bp, Homo sapiens
cacagggcttctcatggggtgc

SEQ ID NO: 7644700 - DNA, 22 bp, Homo sapiens
cacagggcttctcatggggtgc

SEQ ID NO: 7644701 - DNA, 22 bp, Homo sapiens
cacagggctttgatggctgagt

SEQ ID NO: 7644702 - DNA, 22 bp, Homo sapiens
cacagggctttgatggctgagt

SEQ ID NO: 7644703 - DNA, 22 bp, Homo sapiens
agcaggagatggggcgtgatgt

SEQ ID NO: 7644704 - DNA, 22 bp, Homo sapiens
agcaggagatggggcgtgatgt

SEQ ID NO: 7644705 - DNA, 22 bp, Homo sapiens
agcaggagatggggcgtgatgt

SEQ ID NO: 7644706 - DNA, 22 bp, Homo sapiens
agcaggagatggggcgtgatgt

SEQ ID NO: 7644707 - DNA, 22 bp, Homo sapiens
agcaggagatggggcgtgatgt

SEQ ID NO: 7644708 - DNA, 22 bp, Homo sapiens
agcaggagatggggcgtgatgt

SEQ ID NO: 7644709 - DNA, 22 bp, Homo sapiens
agcaggagagcagtgcgtggtc

SEQ ID NO: 7644710 - DNA, 22 bp, Homo sapiens
agcaggagagcagtgcgtggtc

SEQ ID NO: 7644711 - DNA, 22 bp, Homo sapiens
agcaggagagcagtgcgtggtc

SEQ ID NO: 7644712 - DNA, 22 bp, Homo sapiens
agcaggagagcagtgcgtggtc

SEQ ID NO: 7644713 - DNA, 22 bp, Homo sapiens
cacaggctgcccgcagctggga

SEQ ID NO: 7644714 - DNA, 22 bp, Homo sapiens
cacaggctgcccgcagctggga

SEQ ID NO: 7644715 - DNA, 22 bp, Homo sapiens
agcaggagcatttccatgattc

SEQ ID NO: 7644716 - DNA, 22 bp, Homo sapiens
agcaggagcatttccatgattc

SEQ ID NO: 7644717 - DNA, 22 bp, Homo sapiens
agcaggagcatttccatgattc

SEQ ID NO: 7644718 - DNA, 22 bp, Homo sapiens
agcaggagcatttccatgattc

SEQ ID NO: 7644719 - DNA, 22 bp, Homo sapiens
agcaggagatggggcgtgatgt

SEQ ID NO: 7644720 - DNA, 22 bp, Homo sapiens
agcaggagatggggcgtgatgt

SEQ ID NO: 7644721 - DNA, 22 bp, Homo sapiens
agcaggagcatttccatgattc

SEQ ID NO: 7644722 - DNA, 22 bp, Homo sapiens
agcaggagagcagtgcgtggtc

SEQ ID NO: 7644723 - DNA, 22 bp, Homo sapiens
agcaggagagcagtgcgtggtc

SEQ ID NO: 7644724 - DNA, 22 bp, Homo sapiens
agcaggagagcagtgcgtggtc

SEQ ID NO: 7644725 - DNA, 22 bp, Homo sapiens
agcaggagagcagtgcgtggtc

SEQ ID NO: 7644726 - DNA, 22 bp, Homo sapiens
agcaggagacatgggggtggtg

SEQ ID NO: 7644727 - DNA, 22 bp, Homo sapiens
agcaggagagcagtgcgtggtc

SEQ ID NO: 7644728 - DNA, 22 bp, Homo sapiens
agcaggagagcagtgcgtggtc

SEQ ID NO: 7644729 - DNA, 22 bp, Homo sapiens
agcaggagacatgggggtggtg

SEQ ID NO: 7644730 - DNA, 22 bp, Homo sapiens
agcaggagaacactgtggctct

SEQ ID NO: 7644731 - DNA, 22 bp, Homo sapiens
agcaggagaacactgtggctct

SEQ ID NO: 7644732 - DNA, 22 bp, Homo sapiens
agcaggagaacactgtggctct

SEQ ID NO: 7644733 - DNA, 22 bp, Homo sapiens
agcaggagacatgggggtggtg

SEQ ID NO: 7644734 - DNA, 22 bp, Homo sapiens
agcaggagacatgggggtggtg

SEQ ID NO: 7644735 - DNA, 22 bp, Homo sapiens
agcaggagacatgggggtggtg

SEQ ID NO: 7644736 - DNA, 22 bp, Homo sapiens
agcaggagacatgggggtggtg

SEQ ID NO: 7644737 - DNA, 22 bp, Homo sapiens
cacaggaggaggccagagcgta

SEQ ID NO: 7644738 - DNA, 22 bp, Homo sapiens
cacaggaggaggtgcccgggcc

SEQ ID NO: 7644739 - DNA, 22 bp, Homo sapiens
cacaggaggaggccagagcgta

SEQ ID NO: 7644740 - DNA, 22 bp, Homo sapiens
cacaggaggaggtgcccgggcc

SEQ ID NO: 7644741 - DNA, 22 bp, Homo sapiens
cacaggaggaggccagagcgta

SEQ ID NO: 7644742 - DNA, 22 bp, Homo sapiens
cacaggaggaggccagagcgta

SEQ ID NO: 7644743 - DNA, 22 bp, Homo sapiens
cacaggaggaggccagagcgta

SEQ ID NO: 7644744 - DNA, 22 bp, Homo sapiens
cacaggaggaggccagagcgta

SEQ ID NO: 7644745 - DNA, 22 bp, Homo sapiens
cacaggaggaggtgcccgggcc

SEQ ID NO: 7644746 - DNA, 22 bp, Homo sapiens
cacaggaggcaatggtaagatt

SEQ ID NO: 7644747 - DNA, 22 bp, Homo sapiens
cacaggaggaggtgcccgggcc

SEQ ID NO: 7644748 - DNA, 22 bp, Homo sapiens
cacaggaggcaatggtaagatt

SEQ ID NO: 7644749 - DNA, 22 bp, Homo sapiens
cacaggaggcaatggtaagatt

SEQ ID NO: 7644750 - DNA, 22 bp, Homo sapiens
cacaggagggagcgggcagcca

SEQ ID NO: 7644751 - DNA, 22 bp, Homo sapiens
cacaggagggagcgggcagcca

SEQ ID NO: 7644752 - DNA, 22 bp, Homo sapiens
cacaggaggttaggaagtggtc

SEQ ID NO: 7644753 - DNA, 22 bp, Homo sapiens
cacaggaggttaggaagtggtc

SEQ ID NO: 7644754 - DNA, 22 bp, Homo sapiens
cacaggagggagcgggcagcca

SEQ ID NO: 7644755 - DNA, 22 bp, Homo sapiens
cacaggagggagcgggcagcca

SEQ ID NO: 7644756 - DNA, 22 bp, Homo sapiens
cacaggagggagcgggcagcca

SEQ ID NO: 7644757 - DNA, 22 bp, Homo sapiens
cacaggagggagcgggcagcca

SEQ ID NO: 7644758 - DNA, 22 bp, Homo sapiens
cacaggagggagcgggcagcca

SEQ ID NO: 7644759 - DNA, 22 bp, Homo sapiens
cacaggagggagcgggcagcca

SEQ ID NO: 7644760 - DNA, 22 bp, Homo sapiens
cacaggagggagcgggcagcca

SEQ ID NO: 7644761 - DNA, 22 bp, Homo sapiens
cacaggaggttaggaagtggtc

SEQ ID NO: 7644762 - DNA, 22 bp, Homo sapiens
agcaggagaacactgtggctct

SEQ ID NO: 7644763 - DNA, 22 bp, Homo sapiens
agcaggagaacactgtggctct

SEQ ID NO: 7644764 - DNA, 22 bp, Homo sapiens
agcaggagaacactgtggctct

SEQ ID NO: 7644765 - DNA, 22 bp, Homo sapiens
agcaggagaacactgtggctct

SEQ ID NO: 7644766 - DNA, 22 bp, Homo sapiens
agcaggagaacactgtggctct

SEQ ID NO: 7644767 - DNA, 22 bp, Homo sapiens
agcaggagaacactgtggctct

SEQ ID NO: 7644768 - DNA, 22 bp, Homo sapiens
agcaggagaacactgtggctct

SEQ ID NO: 7644769 - DNA, 22 bp, Homo sapiens
agcaggagaacactgtggctct

SEQ ID NO: 7644770 - DNA, 22 bp, Homo sapiens
agcagctgtcccttaacatcag

SEQ ID NO: 7644771 - DNA, 22 bp, Homo sapiens
agcagctgtcccttaacatcag

SEQ ID NO: 7644772 - DNA, 18 bp, Homo sapiens
agcagctgtgccacactg

SEQ ID NO: 7644773 - DNA, 22 bp, Homo sapiens
agcagctgtcccttaacatcag

SEQ ID NO: 7644774 - DNA, 18 bp, Homo sapiens
agcagctgtgccacactg

SEQ ID NO: 7644775 - DNA, 18 bp, Homo sapiens
agcagctgtgccacactg

SEQ ID NO: 7644776 - DNA, 18 bp, Homo sapiens
agcagctgtgccacactg

SEQ ID NO: 7644777 - DNA, 22 bp, Homo sapiens
agcagctgtcccttaacatcag

SEQ ID NO: 7644778 - DNA, 18 bp, Homo sapiens
agcagctgtcagaatgcc

SEQ ID NO: 7644779 - DNA, 22 bp, Homo sapiens
agcagctgtcccttaacatcag

SEQ ID NO: 7644780 - DNA, 22 bp, Homo sapiens
agcagctgtcccttaacatcag

SEQ ID NO: 7644781 - DNA, 19 bp, Homo sapiens
agcagctgtagatagacac

SEQ ID NO: 7644782 - DNA, 19 bp, Homo sapiens
agcagctgtagatagacac

SEQ ID NO: 7644783 - DNA, 19 bp, Homo sapiens
agcagctgtagatagacac

SEQ ID NO: 7644784 - DNA, 18 bp, Homo sapiens
agcagctgtcagaatgcc

SEQ ID NO: 7644785 - DNA, 19 bp, Homo sapiens
agcagctgtagatagacac

SEQ ID NO: 7644786 - DNA, 18 bp, Homo sapiens
agcagctgtcagaatgcc

SEQ ID NO: 7644787 - DNA, 18 bp, Homo sapiens
agcagctgtcagaatgcc

SEQ ID NO: 7644788 - DNA, 18 bp, Homo sapiens
agcagctgtcagaatgcc

SEQ ID NO: 7644789 - DNA, 18 bp, Homo sapiens
agcagctgtcagaatgcc

SEQ ID NO: 7644790 - DNA, 18 bp, Homo sapiens
agcagctgtcagaatgcc

SEQ ID NO: 7644791 - DNA, 23 bp, Homo sapiens
agcagctgtggagttttgcattt

SEQ ID NO: 7644792 - DNA, 23 bp, Homo sapiens
agcagctgtggagttttgcattt

SEQ ID NO: 7644793 - DNA, 23 bp, Homo sapiens
agcagctgtggagttttgcattt

SEQ ID NO: 7644794 - DNA, 23 bp, Homo sapiens
agcagctgtggagttttgcattt

SEQ ID NO: 7644795 - DNA, 22 bp, Homo sapiens
agcagctgtggaaaagtaacta

SEQ ID NO: 7644796 - DNA, 22 bp, Homo sapiens
agcagctgtggaaaagtaacta

SEQ ID NO: 7644797 - DNA, 22 bp, Homo sapiens
agcagctgtggaaaagtaacta

SEQ ID NO: 7644798 - DNA, 22 bp, Homo sapiens
agcagctgtgggcaatatgtaa

SEQ ID NO: 7644799 - DNA, 22 bp, Homo sapiens
agcagctgtgggcaatatgtaa

SEQ ID NO: 7644800 - DNA, 22 bp, Homo sapiens
agcagctgtgggcaatatgtaa

SEQ ID NO: 7644801 - DNA, 23 bp, Homo sapiens
agcagctgtggagttttgcattt

SEQ ID NO: 7644802 - DNA, 23 bp, Homo sapiens
agcagctgtggagttttgcattt

SEQ ID NO: 7644803 - DNA, 22 bp, Homo sapiens
agcagctgtggaaaagtaacta

SEQ ID NO: 7644804 - DNA, 18 bp, Homo sapiens
agcagctgtgccacactg

SEQ ID NO: 7644805 - DNA, 18 bp, Homo sapiens
agcagctgtgccacactg

SEQ ID NO: 7644806 - DNA, 18 bp, Homo sapiens
agcagctgtgccacactg

SEQ ID NO: 7644807 - DNA, 18 bp, Homo sapiens
agcagctgtgccacactg

SEQ ID NO: 7644808 - DNA, 22 bp, Homo sapiens
agcagctgggctcagagctggg

SEQ ID NO: 7644809 - DNA, 22 bp, Homo sapiens
agcagctgggctcagagctggg

SEQ ID NO: 7644810 - DNA, 22 bp, Homo sapiens
agcagctgggctcagagctggg

SEQ ID NO: 7644811 - DNA, 22 bp, Homo sapiens
agcagctgggctcagagctggg

SEQ ID NO: 7644812 - DNA, 21 bp, Homo sapiens
agcagctgggcaacatggagg

SEQ ID NO: 7644813 - DNA, 22 bp, Homo sapiens
agcagctgggctcagagctggg

SEQ ID NO: 7644814 - DNA, 22 bp, Homo sapiens
agcagctgggctcagagctggg

SEQ ID NO: 7644815 - DNA, 21 bp, Homo sapiens
agcagctgggcaacatggagg

SEQ ID NO: 7644816 - DNA, 21 bp, Homo sapiens
agcagctgggcaacatggagg

SEQ ID NO: 7644817 - DNA, 22 bp, Homo sapiens
caatgataatggctgtatttat

SEQ ID NO: 7644818 - DNA, 22 bp, Homo sapiens
agcagctgtactttcatctgtt

SEQ ID NO: 7644819 - DNA, 22 bp, Homo sapiens
agcagctgtactttcatctgtt

SEQ ID NO: 7644820 - DNA, 22 bp, Homo sapiens
agcagctgtactttcatctgtt

SEQ ID NO: 7644821 - DNA, 22 bp, Homo sapiens
agcagctgtactttcatctgtt

SEQ ID NO: 7644822 - DNA, 19 bp, Homo sapiens
agcagctgtagatagacac

SEQ ID NO: 7644823 - DNA, 19 bp, Homo sapiens
agcagctgtagatagacac

SEQ ID NO: 7644824 - DNA, 19 bp, Homo sapiens
agcagctgtagatagacac

SEQ ID NO: 7644825 - DNA, 19 bp, Homo sapiens
agcagctgtagatagacac

SEQ ID NO: 7644826 - DNA, 22 bp, Homo sapiens
agcagctgtactttcatctgtt

SEQ ID NO: 7644827 - DNA, 22 bp, Homo sapiens
caatgacatggataatcatatt

SEQ ID NO: 7644828 - DNA, 22 bp, Homo sapiens
caatgacatggataatcatatt

SEQ ID NO: 7644829 - DNA, 22 bp, Homo sapiens
caatgataatggctgtatttat

SEQ ID NO: 7644830 - DNA, 22 bp, Homo sapiens
caatgacatggataatcatatt

SEQ ID NO: 7644831 - DNA, 22 bp, Homo sapiens
caatgacatggataatcatatt

SEQ ID NO: 7644832 - DNA, 22 bp, Homo sapiens
caatgacatggataatcatatt

SEQ ID NO: 7644833 - DNA, 22 bp, Homo sapiens
caatgacatggataatcatatt

SEQ ID NO: 7644834 - DNA, 22 bp, Homo sapiens
caatgacatctccctgctctaa

SEQ ID NO: 7644835 - DNA, 22 bp, Homo sapiens
caatgacatctccctgctctaa

SEQ ID NO: 7644836 - DNA, 22 bp, Homo sapiens
caatgacactctgcacagtgct

SEQ ID NO: 7644837 - DNA, 22 bp, Homo sapiens
caatgacactctgcacagtgct

SEQ ID NO: 7644838 - DNA, 22 bp, Homo sapiens
caatgaacacagcaatttcata

SEQ ID NO: 7644839 - DNA, 22 bp, Homo sapiens
caatgaacacagcaatttcata

SEQ ID NO: 7644840 - DNA, 22 bp, Homo sapiens
caatgaaattgagatccagaga

SEQ ID NO: 7644841 - DNA, 22 bp, Homo sapiens
caatgacactctgcacagtgct

SEQ ID NO: 7644842 - DNA, 22 bp, Homo sapiens
caatgacactctgcacagtgct

SEQ ID NO: 7644843 - DNA, 22 bp, Homo sapiens
caatgacactctgcacagtgct

SEQ ID NO: 7644844 - DNA, 22 bp, Homo sapiens
caatgacactctgcacagtgct

SEQ ID NO: 7644845 - DNA, 22 bp, Homo sapiens
caatgacaggttcatgactcct

SEQ ID NO: 7644846 - DNA, 22 bp, Homo sapiens
caatgacaggttcatgactcct

SEQ ID NO: 7644847 - DNA, 22 bp, Homo sapiens
caatgacatctccctgctctaa

SEQ ID NO: 7644848 - DNA, 22 bp, Homo sapiens
agcagctgtggggacaagggta

SEQ ID NO: 7644849 - DNA, 22 bp, Homo sapiens
agcagctgtggggacaagggta

SEQ ID NO: 7644850 - DNA, 22 bp, Homo sapiens
agcagctgtggggacaagggta

SEQ ID NO: 7644851 - DNA, 22 bp, Homo sapiens
agcagctgtgggcaatatgtaa

SEQ ID NO: 7644852 - DNA, 22 bp, Homo sapiens
agcagctgtggggacaagggta

SEQ ID NO: 7644853 - DNA, 22 bp, Homo sapiens
agcagctgtggggacaagggta

SEQ ID NO: 7644854 - DNA, 23 bp, Homo sapiens
agcagctgtggtttaccttagta

SEQ ID NO: 7644855 - DNA, 23 bp, Homo sapiens
agcagctgtggtttaccttagta

SEQ ID NO: 7644856 - DNA, 22 bp, Homo sapiens
agcagctgtggggacaagggta

SEQ ID NO: 7644857 - DNA, 22 bp, Homo sapiens
agcagctgtggggacaagggta

SEQ ID NO: 7644858 - DNA, 22 bp, Homo sapiens
agcagctgtggggacaagggta

SEQ ID NO: 7644859 - DNA, 20 bp, Homo sapiens
agcagctgtgttttcatcct

SEQ ID NO: 7644860 - DNA, 22 bp, Homo sapiens
agcagctgttagaaacaggaag

SEQ ID NO: 7644861 - DNA, 22 bp, Homo sapiens
agcagctgttagaaacaggaag

SEQ ID NO: 7644862 - DNA, 20 bp, Homo sapiens
agcagctgtgttttcatcct

SEQ ID NO: 7644863 - DNA, 23 bp, Homo sapiens
agcagctgtggtttaccttagta

SEQ ID NO: 7644864 - DNA, 23 bp, Homo sapiens
agcagctgtggtttaccttagta

SEQ ID NO: 7644865 - DNA, 20 bp, Homo sapiens
agcagctgtgttttcatcct

SEQ ID NO: 7644866 - DNA, 22 bp, Homo sapiens
agcagctgtttgttgaattggt

SEQ ID NO: 7644867 - DNA, 22 bp, Homo sapiens
agcagctgtttgttgaattggt

SEQ ID NO: 7644868 - DNA, 22 bp, Homo sapiens
agcagctgtttgttgaattggt

SEQ ID NO: 7644869 - DNA, 22 bp, Homo sapiens
agcagctgtttgttgaattggt

SEQ ID NO: 7644870 - DNA, 22 bp, Homo sapiens
agcagctgttagaaacaggaag

SEQ ID NO: 7644871 - DNA, 22 bp, Homo sapiens
agcagctgttagaaacaggaag

SEQ ID NO: 7644872 - DNA, 22 bp, Homo sapiens
agcagctgttagaaacaggaag

SEQ ID NO: 7644873 - DNA, 22 bp, Homo sapiens
agcagctgttagaaacaggaag

SEQ ID NO: 7644874 - DNA, 22 bp, Homo sapiens
agcagctgtttgttgaattggt

SEQ ID NO: 7644875 - DNA, 22 bp, Homo sapiens
agcagctgtttgttgaattggt

SEQ ID NO: 7644876 - DNA, 22 bp, Homo sapiens
agcagcttatcttggagaggca

SEQ ID NO: 7644877 - DNA, 22 bp, Homo sapiens
agcagcttatcttggagaggca

SEQ ID NO: 7644878 - DNA, 22 bp, Homo sapiens
agcagcttatcttggagaggca

SEQ ID NO: 7644879 - DNA, 22 bp, Homo sapiens
agcagcttagggaattctccct

SEQ ID NO: 7644880 - DNA, 22 bp, Homo sapiens
agcagcttagggaattctccct

SEQ ID NO: 7644881 - DNA, 22 bp, Homo sapiens
agcagcttacatgtggcctatc

SEQ ID NO: 7644882 - DNA, 19 bp, Homo sapiens
agcagcttaattttgtagc

SEQ ID NO: 7644883 - DNA, 22 bp, Homo sapiens
agcagctgtttgttgaattggt

SEQ ID NO: 7644884 - DNA, 19 bp, Homo sapiens
agcagcttaattttgtagc

SEQ ID NO: 7644885 - DNA, 22 bp, Homo sapiens
cacaggagccctgaggcctccc

SEQ ID NO: 7644886 - DNA, 22 bp, Homo sapiens
cacaggagccctgaggcctccc

SEQ ID NO: 7644887 - DNA, 22 bp, Homo sapiens
cacaggaaggccttctcacaat

SEQ ID NO: 7644888 - DNA, 22 bp, Homo sapiens
cacaggaaggccttctcacaat

SEQ ID NO: 7644889 - DNA, 22 bp, Homo sapiens
cacaggaaggccttctcacaat

SEQ ID NO: 7644890 - DNA, 22 bp, Homo sapiens
cacaggaagctgactgctggca

SEQ ID NO: 7644891 - DNA, 22 bp, Homo sapiens
cacaggaaggccttctcacaat

SEQ ID NO: 7644892 - DNA, 22 bp, Homo sapiens
cacaggagccctgaggcctccc

SEQ ID NO: 7644893 - DNA, 22 bp, Homo sapiens
cacaggagccctgaggcctccc

SEQ ID NO: 7644894 - DNA, 22 bp, Homo sapiens
cacaggagccctgaggcctccc

SEQ ID NO: 7644895 - DNA, 22 bp, Homo sapiens
cacaggagccctgaggcctccc

SEQ ID NO: 7644896 - DNA, 22 bp, Homo sapiens
cacaggagctgtggggcagtgt

SEQ ID NO: 7644897 - DNA, 22 bp, Homo sapiens
cacaggagccctgaggcctccc

SEQ ID NO: 7644898 - DNA, 22 bp, Homo sapiens
cacaggaggaggccagagcgta

SEQ ID NO: 7644899 - DNA, 22 bp, Homo sapiens
cacaggaggaggccagagcgta

SEQ ID NO: 7644900 - DNA, 22 bp, Homo sapiens
cacaggagctgtggggcagtgt

SEQ ID NO: 7644901 - DNA, 22 bp, Homo sapiens
cacaggagctgtggggcagtgt

SEQ ID NO: 7644902 - DNA, 22 bp, Homo sapiens
cacaggagctgtggggcagtgt

SEQ ID NO: 7644903 - DNA, 22 bp, Homo sapiens
cacaggagctgtggggcagtgt

SEQ ID NO: 7644904 - DNA, 22 bp, Homo sapiens
agcagcttcctgctcttcgcct

SEQ ID NO: 7644905 - DNA, 22 bp, Homo sapiens
agcagcttcagaggcgggcgca

SEQ ID NO: 7644906 - DNA, 22 bp, Homo sapiens
agcagcttcctgctcttcgcct

SEQ ID NO: 7644907 - DNA, 22 bp, Homo sapiens
agcagcttcctgtttgcaggca

SEQ ID NO: 7644908 - DNA, 22 bp, Homo sapiens
cacaggaagctgactgctggca

SEQ ID NO: 7644909 - DNA, 22 bp, Homo sapiens
cacaggaagctgactgctggca

SEQ ID NO: 7644910 - DNA, 22 bp, Homo sapiens
cacaggaagctgactgctggca

SEQ ID NO: 7644911 - DNA, 22 bp, Homo sapiens
cacaggaagctgactgctggca

SEQ ID NO: 7644912 - DNA, 22 bp, Homo sapiens
cacaggaagctgactgctggca

SEQ ID NO: 7644913 - DNA, 22 bp, Homo sapiens
cacaggaagctgactgctggca

SEQ ID NO: 7644914 - DNA, 22 bp, Homo sapiens
agcagcttctttcactcctgga

SEQ ID NO: 7644915 - DNA, 22 bp, Homo sapiens
agcagcttctattttcttggtt

SEQ ID NO: 7644916 - DNA, 22 bp, Homo sapiens
agcagcttctttcactcctgga

SEQ ID NO: 7644917 - DNA, 22 bp, Homo sapiens
cagaagagatgaaatagtatta

SEQ ID NO: 7644918 - DNA, 22 bp, Homo sapiens
cagaagactgcagggaagggac

SEQ ID NO: 7644919 - DNA, 22 bp, Homo sapiens
cagaagagatgaaatagtatta

SEQ ID NO: 7644920 - DNA, 22 bp, Homo sapiens
cagaagagatgaaatagtatta

SEQ ID NO: 7644921 - DNA, 22 bp, Homo sapiens
cagaagagatgaaatagtatta

SEQ ID NO: 7644922 - DNA, 22 bp, Homo sapiens
cagaagagatgaaatagtatta

SEQ ID NO: 7644923 - DNA, 22 bp, Homo sapiens
cagaagagatgaaatagtatta

SEQ ID NO: 7644924 - DNA, 22 bp, Homo sapiens
cagaagagatgaaatagtatta

SEQ ID NO: 7644925 - DNA, 22 bp, Homo sapiens
cagaagcagtgagagatgtgca

SEQ ID NO: 7644926 - DNA, 22 bp, Homo sapiens
cagaagaatggtgtctgagctc

SEQ ID NO: 7644927 - DNA, 22 bp, Homo sapiens
cagaagaatggtgtctgagctc

SEQ ID NO: 7644928 - DNA, 22 bp, Homo sapiens
cagaagaatggtgtctgagctc

SEQ ID NO: 7644929 - DNA, 22 bp, Homo sapiens
cagaagaatggtgtctgagctc

SEQ ID NO: 7644930 - DNA, 22 bp, Homo sapiens
cagaagaatggtgtctgagctc

SEQ ID NO: 7644931 - DNA, 23 bp, Homo sapiens
cagaagacagtctcaagacaagg

SEQ ID NO: 7644932 - DNA, 23 bp, Homo sapiens
cagaagacagtctcaagacaagg

SEQ ID NO: 7644933 - DNA, 23 bp, Homo sapiens
cagaagacagtctcaagacaagg

SEQ ID NO: 7644934 - DNA, 22 bp, Homo sapiens
cagaagacagctgtttcactcg

SEQ ID NO: 7644935 - DNA, 22 bp, Homo sapiens
cagaagacagctgtttcactcg

SEQ ID NO: 7644936 - DNA, 22 bp, Homo sapiens
cagaagaaagtggggagacaag

SEQ ID NO: 7644937 - DNA, 22 bp, Homo sapiens
cagaagaaatcattatctggac

SEQ ID NO: 7644938 - DNA, 22 bp, Homo sapiens
cagaagaaatcattatctggac

SEQ ID NO: 7644939 - DNA, 22 bp, Homo sapiens
cagaagaaatcattatctggac

SEQ ID NO: 7644940 - DNA, 22 bp, Homo sapiens
cagaagaaatcattatctggac

SEQ ID NO: 7644941 - DNA, 22 bp, Homo sapiens
cagaagaaatcattatctggac

SEQ ID NO: 7644942 - DNA, 22 bp, Homo sapiens
cagaagaaatcattatctggac

SEQ ID NO: 7644943 - DNA, 22 bp, Homo sapiens
cagaagaaatcattatctggac

SEQ ID NO: 7644944 - DNA, 22 bp, Homo sapiens
cagaagaaagtggggagacaag

SEQ ID NO: 7644945 - DNA, 22 bp, Homo sapiens
cagaagaaagtggggagacaag

SEQ ID NO: 7644946 - DNA, 22 bp, Homo sapiens
cagaacttgctggacagcagat

SEQ ID NO: 7644947 - DNA, 22 bp, Homo sapiens
cagaacttggcaaagccgactg

SEQ ID NO: 7644948 - DNA, 22 bp, Homo sapiens
cagaacttggcaaagccgactg

SEQ ID NO: 7644949 - DNA, 22 bp, Homo sapiens
cagaacttggcaaagccgactg

SEQ ID NO: 7644950 - DNA, 22 bp, Homo sapiens
cagaagaaagtggggagacaag

SEQ ID NO: 7644951 - DNA, 22 bp, Homo sapiens
cagaagaaagtggggagacaag

SEQ ID NO: 7644952 - DNA, 22 bp, Homo sapiens
cagaagaaagtggggagacaag

SEQ ID NO: 7644953 - DNA, 22 bp, Homo sapiens
cagaacttgctggacagcagat

SEQ ID NO: 7644954 - DNA, 22 bp, Homo sapiens
cagaacttgctggacagcagat

SEQ ID NO: 7644955 - DNA, 22 bp, Homo sapiens
cagaacttgatcagagctgaag

SEQ ID NO: 7644956 - DNA, 22 bp, Homo sapiens
cagaacttgatcagagctgaag

SEQ ID NO: 7644957 - DNA, 22 bp, Homo sapiens
cagaacttcatattgacgttag

SEQ ID NO: 7644958 - DNA, 22 bp, Homo sapiens
cagaactgttataacagctgtt

SEQ ID NO: 7644959 - DNA, 22 bp, Homo sapiens
cagaactgggctcgctctggtt

SEQ ID NO: 7644960 - DNA, 22 bp, Homo sapiens
cagaacttcatattgacgttag

SEQ ID NO: 7644961 - DNA, 22 bp, Homo sapiens
cagaactgttataacagctgtt

SEQ ID NO: 7644962 - DNA, 22 bp, Homo sapiens
cagaagcctgcctcagatgcac

SEQ ID NO: 7644963 - DNA, 22 bp, Homo sapiens
cagaagctagcaggaaagtttt

SEQ ID NO: 7644964 - DNA, 22 bp, Homo sapiens
cagaagcctgcctcagatgcac

SEQ ID NO: 7644965 - DNA, 22 bp, Homo sapiens
cagaagcctgcctcagatgcac

SEQ ID NO: 7644966 - DNA, 22 bp, Homo sapiens
cagaagcctaaatagtgcacca

SEQ ID NO: 7644967 - DNA, 22 bp, Homo sapiens
cagaagcctaaatagtgcacca

SEQ ID NO: 7644968 - DNA, 22 bp, Homo sapiens
cagaagcctaaatagtgcacca

SEQ ID NO: 7644969 - DNA, 22 bp, Homo sapiens
cagaagcctgcctcagatgcac

SEQ ID NO: 7644970 - DNA, 22 bp, Homo sapiens
cagaagcctgcctcagatgcac

SEQ ID NO: 7644971 - DNA, 22 bp, Homo sapiens
cagaagcctgcctcagatgcac

SEQ ID NO: 7644972 - DNA, 22 bp, Homo sapiens
cagaagctggtacaaggcctag

SEQ ID NO: 7644973 - DNA, 22 bp, Homo sapiens
cagaagctgcagtgatctggga

SEQ ID NO: 7644974 - DNA, 22 bp, Homo sapiens
cagaagctgcagtgatctggga

SEQ ID NO: 7644975 - DNA, 22 bp, Homo sapiens
cagaagctgcagtgatctggga

SEQ ID NO: 7644976 - DNA, 19 bp, Homo sapiens
cagaagctgcagtcggata

SEQ ID NO: 7644977 - DNA, 19 bp, Homo sapiens
cagaagctgcagtcggata

SEQ ID NO: 7644978 - DNA, 19 bp, Homo sapiens
cagaagctgcagtcggata

SEQ ID NO: 7644979 - DNA, 22 bp, Homo sapiens
cagaagctgaggagtgaggcaa

SEQ ID NO: 7644980 - DNA, 22 bp, Homo sapiens
cagaagcagtgagagatgtgca

SEQ ID NO: 7644981 - DNA, 22 bp, Homo sapiens
cagaagcattccagcaaatagt

SEQ ID NO: 7644982 - DNA, 22 bp, Homo sapiens
cagaagcattccagcaaatagt

SEQ ID NO: 7644983 - DNA, 22 bp, Homo sapiens
cagaagcattccagcaaatagt

SEQ ID NO: 7644984 - DNA, 22 bp, Homo sapiens
cagaagcattccagcaaatagt

SEQ ID NO: 7644985 - DNA, 22 bp, Homo sapiens
cagaagcattccagcaaatagt

SEQ ID NO: 7644986 - DNA, 22 bp, Homo sapiens
cagaagcattccagcaaatagt

SEQ ID NO: 7644987 - DNA, 22 bp, Homo sapiens
cagaagcattccagcaaatagt

SEQ ID NO: 7644988 - DNA, 22 bp, Homo sapiens
cagaagcattccagcaaatagt

SEQ ID NO: 7644989 - DNA, 22 bp, Homo sapiens
cagaagcattccagcaaatagt

SEQ ID NO: 7644990 - DNA, 22 bp, Homo sapiens
cagaagcattgactccttgctc

SEQ ID NO: 7644991 - DNA, 22 bp, Homo sapiens
cagaagcattgactccttgctc

SEQ ID NO: 7644992 - DNA, 22 bp, Homo sapiens
cagaagcattgactccttgctc

SEQ ID NO: 7644993 - DNA, 22 bp, Homo sapiens
cagaagcctaaatagtgcacca

SEQ ID NO: 7644994 - DNA, 22 bp, Homo sapiens
cagaagcctaaatagtgcacca

SEQ ID NO: 7644995 - DNA, 22 bp, Homo sapiens
cagaagcctaaatagtgcacca

SEQ ID NO: 7644996 - DNA, 22 bp, Homo sapiens
agccaggacatctctagctgct

SEQ ID NO: 7644997 - DNA, 22 bp, Homo sapiens
agccaggacgttgctcagctcc

SEQ ID NO: 7644998 - DNA, 22 bp, Homo sapiens
agccaggacgttgctcagctcc

SEQ ID NO: 7644999 - DNA, 22 bp, Homo sapiens
agccaggacgttgctcagctcc

SEQ ID NO: 7645000 - DNA, 22 bp, Homo sapiens
agccaggacgttgctcagctcc

SEQ ID NO: 7645001 - DNA, 22 bp, Homo sapiens
agccaggatcacccggggctgt

SEQ ID NO: 7645002 - DNA, 22 bp, Homo sapiens
agccaggatcacccggggctgt

SEQ ID NO: 7645003 - DNA, 22 bp, Homo sapiens
agccaggatcacccggggctgt

SEQ ID NO: 7645004 - DNA, 22 bp, Homo sapiens
agccaggatcacccggggctgt

SEQ ID NO: 7645005 - DNA, 22 bp, Homo sapiens
agccaggatggtctcgatcggc

SEQ ID NO: 7645006 - DNA, 22 bp, Homo sapiens
agccaggatggtctcgatcggc

SEQ ID NO: 7645007 - DNA, 22 bp, Homo sapiens
agccaggatggtctcgatcggc

SEQ ID NO: 7645008 - DNA, 22 bp, Homo sapiens
agccaggatggtctcgatcggc

SEQ ID NO: 7645009 - DNA, 22 bp, Homo sapiens
agccaggatggtctcgatcggc

SEQ ID NO: 7645010 - DNA, 22 bp, Homo sapiens
agccaggatggtctcgatcggc

SEQ ID NO: 7645011 - DNA, 22 bp, Homo sapiens
agccaggatggtctcgatcggc

SEQ ID NO: 7645012 - DNA, 22 bp, Homo sapiens
agccaggatggtctcgatcggc

SEQ ID NO: 7645013 - DNA, 22 bp, Homo sapiens
agccaggatggtctcgatcggc

SEQ ID NO: 7645014 - DNA, 22 bp, Homo sapiens
agccaggatggtctcgatcggc

SEQ ID NO: 7645015 - DNA, 22 bp, Homo sapiens
agccaggacatctctagctgct

SEQ ID NO: 7645016 - DNA, 22 bp, Homo sapiens
agccagctctgagttgaagtac

SEQ ID NO: 7645017 - DNA, 22 bp, Homo sapiens
agccagctctgagttgaagtac

SEQ ID NO: 7645018 - DNA, 22 bp, Homo sapiens
agccagctgcctttcacatctg

SEQ ID NO: 7645019 - DNA, 22 bp, Homo sapiens
agccagctgcctttcacatctg

SEQ ID NO: 7645020 - DNA, 22 bp, Homo sapiens
agccagctccctcccctgcagg

SEQ ID NO: 7645021 - DNA, 22 bp, Homo sapiens
agccagctccctcccctgcagg

SEQ ID NO: 7645022 - DNA, 22 bp, Homo sapiens
agccagctccctcccctgcagg

SEQ ID NO: 7645023 - DNA, 21 bp, Homo sapiens
agccagctatcacacagcatt

SEQ ID NO: 7645024 - DNA, 22 bp, Homo sapiens
cagaaggagcgctaaggtccca

SEQ ID NO: 7645025 - DNA, 17 bp, Homo sapiens
cagaaggaagcatggca

SEQ ID NO: 7645026 - DNA, 17 bp, Homo sapiens
cagaaggaagcatggca

SEQ ID NO: 7645027 - DNA, 17 bp, Homo sapiens
cagaaggaagcatggca

SEQ ID NO: 7645028 - DNA, 17 bp, Homo sapiens
cagaaggaagcatggca

SEQ ID NO: 7645029 - DNA, 17 bp, Homo sapiens
cagaaggaagcatggca

SEQ ID NO: 7645030 - DNA, 22 bp, Homo sapiens
cagaagctttgtctagtcttga

SEQ ID NO: 7645031 - DNA, 22 bp, Homo sapiens
cagaagctttgtctagtcttga

SEQ ID NO: 7645032 - DNA, 22 bp, Homo sapiens
cagaagctttgtctagtcttga

SEQ ID NO: 7645033 - DNA, 22 bp, Homo sapiens
cagaagctttgctcataaccat

SEQ ID NO: 7645034 - DNA, 22 bp, Homo sapiens
cagaagctggtacaaggcctag

SEQ ID NO: 7645035 - DNA, 22 bp, Homo sapiens
cagaagctttgctcataaccat

SEQ ID NO: 7645036 - DNA, 22 bp, Homo sapiens
agccaggatggtctcgatcggc

SEQ ID NO: 7645037 - DNA, 22 bp, Homo sapiens
agccaggatggtctcgatcggc

SEQ ID NO: 7645038 - DNA, 22 bp, Homo sapiens
agccaggattggctgagcctta

SEQ ID NO: 7645039 - DNA, 22 bp, Homo sapiens
agccaggattggctgagcctta

SEQ ID NO: 7645040 - DNA, 21 bp, Homo sapiens
agccaggcaagcacccccact

SEQ ID NO: 7645041 - DNA, 22 bp, Homo sapiens
agccaggcagactctctttctt

SEQ ID NO: 7645042 - DNA, 22 bp, Homo sapiens
agccaggcagactctctttctt

SEQ ID NO: 7645043 - DNA, 22 bp, Homo sapiens
agccaggcagactctctttctt

SEQ ID NO: 7645044 - DNA, 21 bp, Homo sapiens
agccaggcaagcacccccact

SEQ ID NO: 7645045 - DNA, 21 bp, Homo sapiens
agccaggcaagcacccccact

SEQ ID NO: 7645046 - DNA, 22 bp, Homo sapiens
agccaggattggctgagcctta

SEQ ID NO: 7645047 - DNA, 21 bp, Homo sapiens
agccaggcaagcacccccact

SEQ ID NO: 7645048 - DNA, 21 bp, Homo sapiens
agccaggcaagcacccccact

SEQ ID NO: 7645049 - DNA, 22 bp, Homo sapiens
agccaggattggctgagcctta

SEQ ID NO: 7645050 - DNA, 22 bp, Homo sapiens
cagacagacagccgtggccacc

SEQ ID NO: 7645051 - DNA, 22 bp, Homo sapiens
cagacagacagccgtggccacc

SEQ ID NO: 7645052 - DNA, 22 bp, Homo sapiens
cagacagacagccgtggccacc

SEQ ID NO: 7645053 - DNA, 22 bp, Homo sapiens
cagacagacagccgtggccacc

SEQ ID NO: 7645054 - DNA, 22 bp, Homo sapiens
cagacagacagccgtggccacc

SEQ ID NO: 7645055 - DNA, 22 bp, Homo sapiens
cagacagaaggctccttgaggt

SEQ ID NO: 7645056 - DNA, 22 bp, Homo sapiens
cagacagaaggctccttgaggt

SEQ ID NO: 7645057 - DNA, 22 bp, Homo sapiens
agccaggcagggctctcgctct

SEQ ID NO: 7645058 - DNA, 22 bp, Homo sapiens
agccaggcagggctctcgctct

SEQ ID NO: 7645059 - DNA, 22 bp, Homo sapiens
agccaggcagggctctcgctct

SEQ ID NO: 7645060 - DNA, 22 bp, Homo sapiens
agccaggcagactctctttctt

SEQ ID NO: 7645061 - DNA, 22 bp, Homo sapiens
agccaggcagactctctttctt

SEQ ID NO: 7645062 - DNA, 22 bp, Homo sapiens
cagacagaaggctccttgaggt

SEQ ID NO: 7645063 - DNA, 22 bp, Homo sapiens
agccaggcagggctctcgctct

SEQ ID NO: 7645064 - DNA, 22 bp, Homo sapiens
agccaaggacacggagcctcct

SEQ ID NO: 7645065 - DNA, 22 bp, Homo sapiens
agccaaggaaagccctttgctg

SEQ ID NO: 7645066 - DNA, 22 bp, Homo sapiens
agccaaggaaagccctttgctg

SEQ ID NO: 7645067 - DNA, 22 bp, Homo sapiens
agccaaggaaagccctttgctg

SEQ ID NO: 7645068 - DNA, 22 bp, Homo sapiens
agccacaaaggcttgcctcgga

SEQ ID NO: 7645069 - DNA, 22 bp, Homo sapiens
cactgaaatcgaaaaatgtagg

SEQ ID NO: 7645070 - DNA, 21 bp, Homo sapiens
agccaagccttgggagccagg

SEQ ID NO: 7645071 - DNA, 21 bp, Homo sapiens
agccaagccttgggagccagg

SEQ ID NO: 7645072 - DNA, 21 bp, Homo sapiens
agccaagccttgggagccagg

SEQ ID NO: 7645073 - DNA, 21 bp, Homo sapiens
agccaagccttgggagccagg

SEQ ID NO: 7645074 - DNA, 22 bp, Homo sapiens
agccaagctgatctcctgctga

SEQ ID NO: 7645075 - DNA, 22 bp, Homo sapiens
agccacacctgtcctgccagct

SEQ ID NO: 7645076 - DNA, 22 bp, Homo sapiens
agccacacagcttaatgacaga

SEQ ID NO: 7645077 - DNA, 22 bp, Homo sapiens
agccacacctgtcctgccagct

SEQ ID NO: 7645078 - DNA, 22 bp, Homo sapiens
agccacacagcttaatgacaga

SEQ ID NO: 7645079 - DNA, 22 bp, Homo sapiens
agccacacagcttaatgacaga

SEQ ID NO: 7645080 - DNA, 22 bp, Homo sapiens
agccaattgtccatctttagct

SEQ ID NO: 7645081 - DNA, 22 bp, Homo sapiens
agccacacttgccaggggaagg

SEQ ID NO: 7645082 - DNA, 22 bp, Homo sapiens
agccacacctgtcctgccagct

SEQ ID NO: 7645083 - DNA, 22 bp, Homo sapiens
agccacacctgtcctgccagct

SEQ ID NO: 7645084 - DNA, 22 bp, Homo sapiens
cactgaaaggcaatgctgacag

SEQ ID NO: 7645085 - DNA, 22 bp, Homo sapiens
cactgaaaggcaatgctgacag

SEQ ID NO: 7645086 - DNA, 22 bp, Homo sapiens
cactgaaatattaatatcttat

SEQ ID NO: 7645087 - DNA, 22 bp, Homo sapiens
cactgaaatattaatatcttat

SEQ ID NO: 7645088 - DNA, 22 bp, Homo sapiens
cactgaaaggaaaccagagcat

SEQ ID NO: 7645089 - DNA, 22 bp, Homo sapiens
cactgaaaggaaaccagagcat

SEQ ID NO: 7645090 - DNA, 22 bp, Homo sapiens
cactgaaaggcaatgctgacag

SEQ ID NO: 7645091 - DNA, 22 bp, Homo sapiens
cactgaaatattaatatcttat

SEQ ID NO: 7645092 - DNA, 22 bp, Homo sapiens
cactgaaaggcaatgctgacag

SEQ ID NO: 7645093 - DNA, 22 bp, Homo sapiens
cactgaaatattaatatcttat

SEQ ID NO: 7645094 - DNA, 22 bp, Homo sapiens
cactgaaatcgaaaaatgtagg

SEQ ID NO: 7645095 - DNA, 22 bp, Homo sapiens
cactgaaatattaatatcttat

SEQ ID NO: 7645096 - DNA, 22 bp, Homo sapiens
cactgaaatcgaaaaatgtagg

SEQ ID NO: 7645097 - DNA, 22 bp, Homo sapiens
cactctgtgattgcagcattcc

SEQ ID NO: 7645098 - DNA, 22 bp, Homo sapiens
cactctggttctgaacaggatc

SEQ ID NO: 7645099 - DNA, 22 bp, Homo sapiens
cactctgtgattgcagcattcc

SEQ ID NO: 7645100 - DNA, 22 bp, Homo sapiens
cactgaaaattagctttcctga

SEQ ID NO: 7645101 - DNA, 22 bp, Homo sapiens
cactctgtgattgcagcattcc

SEQ ID NO: 7645102 - DNA, 22 bp, Homo sapiens
cactgaaaggaaaccagagcat

SEQ ID NO: 7645103 - DNA, 22 bp, Homo sapiens
cactgaaacaggtattgctggt

SEQ ID NO: 7645104 - DNA, 22 bp, Homo sapiens
cactgaaacaggtattgctggt

SEQ ID NO: 7645105 - DNA, 22 bp, Homo sapiens
cactgaaaattagctttcctga

SEQ ID NO: 7645106 - DNA, 22 bp, Homo sapiens
cactgaaaattagctttcctga

SEQ ID NO: 7645107 - DNA, 22 bp, Homo sapiens
cactgaaaattagctttcctga

SEQ ID NO: 7645108 - DNA, 22 bp, Homo sapiens
cactgaaacaggtattgctggt

SEQ ID NO: 7645109 - DNA, 22 bp, Homo sapiens
cactgaaacaggtattgctggt

SEQ ID NO: 7645110 - DNA, 19 bp, Homo sapiens
agccacagaacttgcagga

SEQ ID NO: 7645111 - DNA, 19 bp, Homo sapiens
agccacagaacttgcagga

SEQ ID NO: 7645112 - DNA, 19 bp, Homo sapiens
agccacagaacttgcagga

SEQ ID NO: 7645113 - DNA, 19 bp, Homo sapiens
agccacagaacttgcagga

SEQ ID NO: 7645114 - DNA, 22 bp, Homo sapiens
agccacacttgccaggggaagg

SEQ ID NO: 7645115 - DNA, 19 bp, Homo sapiens
agccacagaacttgcagga

SEQ ID NO: 7645116 - DNA, 19 bp, Homo sapiens
agccacagaacttgcagga

SEQ ID NO: 7645117 - DNA, 19 bp, Homo sapiens
agccacagaacttgcagga

SEQ ID NO: 7645118 - DNA, 19 bp, Homo sapiens
agccacagaacttgcagga

SEQ ID NO: 7645119 - DNA, 19 bp, Homo sapiens
agccacagaacttgcagga

SEQ ID NO: 7645120 - DNA, 19 bp, Homo sapiens
agccacagaacttgcagga

SEQ ID NO: 7645121 - DNA, 22 bp, Homo sapiens
agccacagagagggagctgcaa

SEQ ID NO: 7645122 - DNA, 22 bp, Homo sapiens
agccacagagagggagctgcaa

SEQ ID NO: 7645123 - DNA, 22 bp, Homo sapiens
agccacagagagggagctgcaa

SEQ ID NO: 7645124 - DNA, 22 bp, Homo sapiens
agccacagagagggagctgcaa

SEQ ID NO: 7645125 - DNA, 22 bp, Homo sapiens
agccacagagagggagctgcaa

SEQ ID NO: 7645126 - DNA, 22 bp, Homo sapiens
agccacagagagggagctgcaa

SEQ ID NO: 7645127 - DNA, 22 bp, Homo sapiens
agccacagagagggagctgcaa

SEQ ID NO: 7645128 - DNA, 19 bp, Homo sapiens
agccacagaacttgcagga

SEQ ID NO: 7645129 - DNA, 19 bp, Homo sapiens
agccacagaacttgcagga

SEQ ID NO: 7645130 - DNA, 19 bp, Homo sapiens
agccacagaacttgcagga

SEQ ID NO: 7645131 - DNA, 22 bp, Homo sapiens
agccacagagcaggagaccttt

SEQ ID NO: 7645132 - DNA, 22 bp, Homo sapiens
agccacagagcaggagaccttt

SEQ ID NO: 7645133 - DNA, 22 bp, Homo sapiens
agccacagagcaggagaccttt

SEQ ID NO: 7645134 - DNA, 22 bp, Homo sapiens
agccacagaggttgatgtggtt

SEQ ID NO: 7645135 - DNA, 22 bp, Homo sapiens
agccacagaggttgatgtggtt

SEQ ID NO: 7645136 - DNA, 22 bp, Homo sapiens
agccacagaggttgatgtggtt

SEQ ID NO: 7645137 - DNA, 22 bp, Homo sapiens
agccacagaggttgatgtggtt

SEQ ID NO: 7645138 - DNA, 22 bp, Homo sapiens
agccacagaggttgatgtggtt

SEQ ID NO: 7645139 - DNA, 22 bp, Homo sapiens
agccacagaggttgatgtggtt

SEQ ID NO: 7645140 - DNA, 22 bp, Homo sapiens
agccacagaggttgatgtggtt

SEQ ID NO: 7645141 - DNA, 22 bp, Homo sapiens
agccacagagagggagctgcaa

SEQ ID NO: 7645142 - DNA, 22 bp, Homo sapiens
agccacagagagggagctgcaa

SEQ ID NO: 7645143 - DNA, 22 bp, Homo sapiens
agccacagagagggagctgcaa

SEQ ID NO: 7645144 - DNA, 22 bp, Homo sapiens
agccacagagagggagctgcaa

SEQ ID NO: 7645145 - DNA, 22 bp, Homo sapiens
agccacagagagggagctgcaa

SEQ ID NO: 7645146 - DNA, 22 bp, Homo sapiens
agccacagagcaggagaccttt

SEQ ID NO: 7645147 - DNA, 22 bp, Homo sapiens
agccacagagcaggagaccttt

SEQ ID NO: 7645148 - DNA, 22 bp, Homo sapiens
agccacagagcaggagaccttt

SEQ ID NO: 7645149 - DNA, 22 bp, Homo sapiens
agccacagagcaggagaccttt

SEQ ID NO: 7645150 - DNA, 22 bp, Homo sapiens
agccacagcacattgtaagaaa

SEQ ID NO: 7645151 - DNA, 22 bp, Homo sapiens
agccacagcacattgtaagaaa

SEQ ID NO: 7645152 - DNA, 22 bp, Homo sapiens
agccacagcaacaagtgcaatt

SEQ ID NO: 7645153 - DNA, 22 bp, Homo sapiens
agccacagcaacaagtgcaatt

SEQ ID NO: 7645154 - DNA, 22 bp, Homo sapiens
agccacagcaacaagtgcaatt

SEQ ID NO: 7645155 - DNA, 22 bp, Homo sapiens
agccacagcaacaagtgcaatt

SEQ ID NO: 7645156 - DNA, 22 bp, Homo sapiens
agccacagaggttgatgtggtt

SEQ ID NO: 7645157 - DNA, 22 bp, Homo sapiens
agccacagcaacaagtgcaatt

SEQ ID NO: 7645158 - DNA, 22 bp, Homo sapiens
agccacagcacattgtaagaaa

SEQ ID NO: 7645159 - DNA, 22 bp, Homo sapiens
agccacagcatgtgtgtatgta

SEQ ID NO: 7645160 - DNA, 22 bp, Homo sapiens
agccacagcatgtgtgtatgta

SEQ ID NO: 7645161 - DNA, 22 bp, Homo sapiens
agccacagcacattgtaagaaa

SEQ ID NO: 7645162 - DNA, 22 bp, Homo sapiens
agccacagcacattgtaagaaa

SEQ ID NO: 7645163 - DNA, 22 bp, Homo sapiens
agccacagcacattgtaagaaa

SEQ ID NO: 7645164 - DNA, 22 bp, Homo sapiens
agccacagcacattgtaagaaa

SEQ ID NO: 7645165 - DNA, 22 bp, Homo sapiens
agccacagcacattgtaagaaa

SEQ ID NO: 7645166 - DNA, 22 bp, Homo sapiens
agccacagcccacaggactctt

SEQ ID NO: 7645167 - DNA, 22 bp, Homo sapiens
agccacagcccacaggactctt

SEQ ID NO: 7645168 - DNA, 23 bp, Homo sapiens
agccacagccagagctatctcca

SEQ ID NO: 7645169 - DNA, 23 bp, Homo sapiens
agccacagccagagctatctcca

SEQ ID NO: 7645170 - DNA, 23 bp, Homo sapiens
agccacagccagagctatctcca

SEQ ID NO: 7645171 - DNA, 23 bp, Homo sapiens
agccacagccagagctatctcca

SEQ ID NO: 7645172 - DNA, 23 bp, Homo sapiens
agccacagccagagctatctcca

SEQ ID NO: 7645173 - DNA, 23 bp, Homo sapiens
agccacagccagagctatctcca

SEQ ID NO: 7645174 - DNA, 22 bp, Homo sapiens
agccacagcatgtgtgtatgta

SEQ ID NO: 7645175 - DNA, 22 bp, Homo sapiens
agccacagcatgtgtgtatgta

SEQ ID NO: 7645176 - DNA, 22 bp, Homo sapiens
agccacagcctgacttaactgt

SEQ ID NO: 7645177 - DNA, 22 bp, Homo sapiens
agccacagcctgacttaactgt

SEQ ID NO: 7645178 - DNA, 22 bp, Homo sapiens
agccacagcctgacttaactgt

SEQ ID NO: 7645179 - DNA, 22 bp, Homo sapiens
agccacagcctgacttaactgt

SEQ ID NO: 7645180 - DNA, 22 bp, Homo sapiens
agccacagcccacaggactctt

SEQ ID NO: 7645181 - DNA, 22 bp, Homo sapiens
agccacagcccacaggactctt

SEQ ID NO: 7645182 - DNA, 22 bp, Homo sapiens
agccacagcccacaggactctt

SEQ ID NO: 7645183 - DNA, 23 bp, Homo sapiens
cagaaatgacagtaagcaccctg

SEQ ID NO: 7645184 - DNA, 23 bp, Homo sapiens
cagaaatgacagtaagcaccctg

SEQ ID NO: 7645185 - DNA, 22 bp, Homo sapiens
cagaaatgacaaagtaagagga

SEQ ID NO: 7645186 - DNA, 23 bp, Homo sapiens
cagaaatctgaaatctagaaatg

SEQ ID NO: 7645187 - DNA, 22 bp, Homo sapiens
agccacaggaaacagagacagc

SEQ ID NO: 7645188 - DNA, 22 bp, Homo sapiens
agccacagctccttggtggaga

SEQ ID NO: 7645189 - DNA, 23 bp, Homo sapiens
cagaaatctgaaatctagaaatg

SEQ ID NO: 7645190 - DNA, 22 bp, Homo sapiens
cagaaatgacaaagtaagagga

SEQ ID NO: 7645191 - DNA, 22 bp, Homo sapiens
cagaaatgacaaagtaagagga

SEQ ID NO: 7645192 - DNA, 22 bp, Homo sapiens
cagaaatgacaaagtaagagga

SEQ ID NO: 7645193 - DNA, 22 bp, Homo sapiens
agccacagcgaacctctcttcc

SEQ ID NO: 7645194 - DNA, 22 bp, Homo sapiens
agccacagcgaacctctcttcc

SEQ ID NO: 7645195 - DNA, 22 bp, Homo sapiens
agccacagcgaacctctcttcc

SEQ ID NO: 7645196 - DNA, 22 bp, Homo sapiens
agccacagcctgacttaactgt

SEQ ID NO: 7645197 - DNA, 22 bp, Homo sapiens
agccacagctccttggtggaga

SEQ ID NO: 7645198 - DNA, 22 bp, Homo sapiens
agccacagctccttggtggaga

SEQ ID NO: 7645199 - DNA, 22 bp, Homo sapiens
agccacagctccttggtggaga

SEQ ID NO: 7645200 - DNA, 22 bp, Homo sapiens
agccacagctccttggtggaga

SEQ ID NO: 7645201 - DNA, 22 bp, Homo sapiens
cagaacattgttttctcatctg

SEQ ID NO: 7645202 - DNA, 23 bp, Homo sapiens
cagaaatgacagtaagcaccctg

SEQ ID NO: 7645203 - DNA, 23 bp, Homo sapiens
cagaaatgacagtaagcaccctg

SEQ ID NO: 7645204 - DNA, 22 bp, Homo sapiens
cagaaccaggaactgatggaga

SEQ ID NO: 7645205 - DNA, 22 bp, Homo sapiens
cagaacctgaacgtgaggtgga

SEQ ID NO: 7645206 - DNA, 22 bp, Homo sapiens
cagaacctgagagcacaatcct

SEQ ID NO: 7645207 - DNA, 22 bp, Homo sapiens
cagaacctgagagcacaatcct

SEQ ID NO: 7645208 - DNA, 22 bp, Homo sapiens
cagaactgacctctgattctag

SEQ ID NO: 7645209 - DNA, 22 bp, Homo sapiens
cagaactgacctctgattctag

SEQ ID NO: 7645210 - DNA, 22 bp, Homo sapiens
cagaactgacctctgattctag

SEQ ID NO: 7645211 - DNA, 22 bp, Homo sapiens
cagaactgggcagggagcagag

SEQ ID NO: 7645212 - DNA, 22 bp, Homo sapiens
cagaactgggctcgctctggtt

SEQ ID NO: 7645213 - DNA, 22 bp, Homo sapiens
cagaactgggctcgctctggtt

SEQ ID NO: 7645214 - DNA, 22 bp, Homo sapiens
cagaactgggcagggagcagag

SEQ ID NO: 7645215 - DNA, 22 bp, Homo sapiens
cagaactgggcagggagcagag

SEQ ID NO: 7645216 - DNA, 22 bp, Homo sapiens
cagaactgacctctgattctag

SEQ ID NO: 7645217 - DNA, 22 bp, Homo sapiens
cagaactgagtctcatggccat

SEQ ID NO: 7645218 - DNA, 22 bp, Homo sapiens
cagaactggcctttcatcagtc

SEQ ID NO: 7645219 - DNA, 22 bp, Homo sapiens
cagaactggcctttcatcagtc

SEQ ID NO: 7645220 - DNA, 22 bp, Homo sapiens
agccagtgatgaagactctgga

SEQ ID NO: 7645221 - DNA, 19 bp, Homo sapiens
agccagtgagcctctgggt

SEQ ID NO: 7645222 - DNA, 22 bp, Homo sapiens
agccagtgatgaagactctgga

SEQ ID NO: 7645223 - DNA, 22 bp, Homo sapiens
agccagtgcaacagcagtgaag

SEQ ID NO: 7645224 - DNA, 22 bp, Homo sapiens
agccagtgattctgatgtactg

SEQ ID NO: 7645225 - DNA, 22 bp, Homo sapiens
cagagagggagcagtagtctct

SEQ ID NO: 7645226 - DNA, 22 bp, Homo sapiens
cagagagggagcagtagtctct

SEQ ID NO: 7645227 - DNA, 22 bp, Homo sapiens
cagagagggagcagtagtctct

SEQ ID NO: 7645228 - DNA, 22 bp, Homo sapiens
cagagagggagcagtagtctct

SEQ ID NO: 7645229 - DNA, 22 bp, Homo sapiens
cagagagggagcagtagtctct

SEQ ID NO: 7645230 - DNA, 22 bp, Homo sapiens
cagagaggatggattccatagc

SEQ ID NO: 7645231 - DNA, 22 bp, Homo sapiens
cagagagggcggccctggcttc

SEQ ID NO: 7645232 - DNA, 22 bp, Homo sapiens
cagagagggcggccctggcttc

SEQ ID NO: 7645233 - DNA, 22 bp, Homo sapiens
cagagagggcggccctggcttc

SEQ ID NO: 7645234 - DNA, 22 bp, Homo sapiens
cagagagggcggccctggcttc

SEQ ID NO: 7645235 - DNA, 22 bp, Homo sapiens
cagagagggcggccctggcttc

SEQ ID NO: 7645236 - DNA, 22 bp, Homo sapiens
cagagagggagcagtagtctct

SEQ ID NO: 7645237 - DNA, 22 bp, Homo sapiens
cagagagggagcagtagtctct

SEQ ID NO: 7645238 - DNA, 22 bp, Homo sapiens
cagagagggagcagtagtctct

SEQ ID NO: 7645239 - DNA, 22 bp, Homo sapiens
cagagagggagcagtagtctct

SEQ ID NO: 7645240 - DNA, 22 bp, Homo sapiens
cagagagggagcagtagtctct

SEQ ID NO: 7645241 - DNA, 22 bp, Homo sapiens
cagagagggagcagtagtctct

SEQ ID NO: 7645242 - DNA, 22 bp, Homo sapiens
agccagtcggggccatgctggg

SEQ ID NO: 7645243 - DNA, 22 bp, Homo sapiens
agccagtagatcgggaggatgt

SEQ ID NO: 7645244 - DNA, 22 bp, Homo sapiens
agccagtactgtgcaaggataa

SEQ ID NO: 7645245 - DNA, 19 bp, Homo sapiens
agccagtgagcctctgggt

SEQ ID NO: 7645246 - DNA, 22 bp, Homo sapiens
agccagtgacatacgattggga

SEQ ID NO: 7645247 - DNA, 19 bp, Homo sapiens
agccagtgagcctctgggt

SEQ ID NO: 7645248 - DNA, 21 bp, Homo sapiens
agccagtctgccagagaagcc

SEQ ID NO: 7645249 - DNA, 21 bp, Homo sapiens
agccagtctgttttctagtgc

SEQ ID NO: 7645250 - DNA, 22 bp, Homo sapiens
cagagagtggcagttactgaag

SEQ ID NO: 7645251 - DNA, 22 bp, Homo sapiens
cagagagtggcagttactgaag

SEQ ID NO: 7645252 - DNA, 22 bp, Homo sapiens
cagagataccattgctaaaatt

SEQ ID NO: 7645253 - DNA, 22 bp, Homo sapiens
cagagagtggcagttactgaag

SEQ ID NO: 7645254 - DNA, 22 bp, Homo sapiens
cagagatgaggtcgttactcag

SEQ ID NO: 7645255 - DNA, 22 bp, Homo sapiens
cagagatgaggtcgttactcag

SEQ ID NO: 7645256 - DNA, 22 bp, Homo sapiens
cagagatgaggtcgttactcag

SEQ ID NO: 7645257 - DNA, 22 bp, Homo sapiens
cagagatggcggctgttgtgtt

SEQ ID NO: 7645258 - DNA, 22 bp, Homo sapiens
cagagatggcggctgttgtgtt

SEQ ID NO: 7645259 - DNA, 22 bp, Homo sapiens
cagagatggggccagctgctcc

SEQ ID NO: 7645260 - DNA, 22 bp, Homo sapiens
cagagatggggccagctgctcc

SEQ ID NO: 7645261 - DNA, 22 bp, Homo sapiens
cagagatggggccagctgctcc

SEQ ID NO: 7645262 - DNA, 22 bp, Homo sapiens
cagagatggggccagctgctcc

SEQ ID NO: 7645263 - DNA, 22 bp, Homo sapiens
cagagatggggccagctgctcc

SEQ ID NO: 7645264 - DNA, 22 bp, Homo sapiens
cagagagggcggccctggcttc

SEQ ID NO: 7645265 - DNA, 22 bp, Homo sapiens
cagagagggcggccctggcttc

SEQ ID NO: 7645266 - DNA, 22 bp, Homo sapiens
cagagagggcggccctggcttc

SEQ ID NO: 7645267 - DNA, 22 bp, Homo sapiens
cagagagggcggccctggcttc

SEQ ID NO: 7645268 - DNA, 22 bp, Homo sapiens
cagagagggcggccctggcttc

SEQ ID NO: 7645269 - DNA, 22 bp, Homo sapiens
cagagagggcggccctggcttc

SEQ ID NO: 7645270 - DNA, 22 bp, Homo sapiens
cagagagggcggccctggcttc

SEQ ID NO: 7645271 - DNA, 22 bp, Homo sapiens
cagagagggcggccctggcttc

SEQ ID NO: 7645272 - DNA, 22 bp, Homo sapiens
cagagagggcggccctggcttc

SEQ ID NO: 7645273 - DNA, 22 bp, Homo sapiens
cagagcaacaccctttacatcg

SEQ ID NO: 7645274 - DNA, 22 bp, Homo sapiens
cagagcaacaccctttacatcg

SEQ ID NO: 7645275 - DNA, 22 bp, Homo sapiens
cagagcaacaccctttacatcg

SEQ ID NO: 7645276 - DNA, 22 bp, Homo sapiens
cagagcaacaccctttacatcg

SEQ ID NO: 7645277 - DNA, 22 bp, Homo sapiens
cagagcacacatgcatagagtg

SEQ ID NO: 7645278 - DNA, 22 bp, Homo sapiens
cagagcacagagcttgggacaa

SEQ ID NO: 7645279 - DNA, 22 bp, Homo sapiens
cagagcacacatgcatagagtg

SEQ ID NO: 7645280 - DNA, 22 bp, Homo sapiens
cagagcaccagtgggagacaag

SEQ ID NO: 7645281 - DNA, 22 bp, Homo sapiens
cagagcaccagtgggagacaag

SEQ ID NO: 7645282 - DNA, 22 bp, Homo sapiens
agcccagccggattcccagttc

SEQ ID NO: 7645283 - DNA, 22 bp, Homo sapiens
cagagatgggtcgcagagatgg

SEQ ID NO: 7645284 - DNA, 22 bp, Homo sapiens
cagagatgggtcgcagagatgg

SEQ ID NO: 7645285 - DNA, 22 bp, Homo sapiens
cagagatggggccagctgctcc

SEQ ID NO: 7645286 - DNA, 22 bp, Homo sapiens
cagagatgggtcgcagagatgg

SEQ ID NO: 7645287 - DNA, 22 bp, Homo sapiens
cagagatgggtcgcagagatgg

SEQ ID NO: 7645288 - DNA, 22 bp, Homo sapiens
cagagatgtgatccagctgtct

SEQ ID NO: 7645289 - DNA, 22 bp, Homo sapiens
cagagattattataactaatta

SEQ ID NO: 7645290 - DNA, 22 bp, Homo sapiens
cagagatgtgatccagctgtct

SEQ ID NO: 7645291 - DNA, 22 bp, Homo sapiens
cagagatgtgatccagctgtct

SEQ ID NO: 7645292 - DNA, 22 bp, Homo sapiens
cagagatgtgatccagctgtct

SEQ ID NO: 7645293 - DNA, 22 bp, Homo sapiens
cagagatgtgatccagctgtct

SEQ ID NO: 7645294 - DNA, 22 bp, Homo sapiens
cagacagacctgcaagggcaca

SEQ ID NO: 7645295 - DNA, 22 bp, Homo sapiens
cagacagacctgcaagggcaca

SEQ ID NO: 7645296 - DNA, 22 bp, Homo sapiens
cagacagagctcacaagtcttt

SEQ ID NO: 7645297 - DNA, 22 bp, Homo sapiens
cagacagacctgcaagggcaca

SEQ ID NO: 7645298 - DNA, 22 bp, Homo sapiens
cagacagacctgcaagggcaca

SEQ ID NO: 7645299 - DNA, 22 bp, Homo sapiens
cagacagaggctgtatgagggc

SEQ ID NO: 7645300 - DNA, 22 bp, Homo sapiens
cagacagaggctgtatgagggc

SEQ ID NO: 7645301 - DNA, 22 bp, Homo sapiens
cagacagagctcacaagtcttt

SEQ ID NO: 7645302 - DNA, 22 bp, Homo sapiens
cagacagagctcacaagtcttt

SEQ ID NO: 7645303 - DNA, 22 bp, Homo sapiens
cagacagagctcacaagtcttt

SEQ ID NO: 7645304 - DNA, 22 bp, Homo sapiens
cagacagagctcacaagtcttt

SEQ ID NO: 7645305 - DNA, 22 bp, Homo sapiens
cagacagcaaatctgcttgcat

SEQ ID NO: 7645306 - DNA, 22 bp, Homo sapiens
cagacagcaaatctgcttgcat

SEQ ID NO: 7645307 - DNA, 22 bp, Homo sapiens
cagacagcaaatctgcttgcat

SEQ ID NO: 7645308 - DNA, 22 bp, Homo sapiens
cagacagcaaatctgcttgcat

SEQ ID NO: 7645309 - DNA, 22 bp, Homo sapiens
cagacagagtcttcccatcagt

SEQ ID NO: 7645310 - DNA, 22 bp, Homo sapiens
cagacagagtcttcccatcagt

SEQ ID NO: 7645311 - DNA, 17 bp, Homo sapiens
cagacagatatcctggg

SEQ ID NO: 7645312 - DNA, 23 bp, Homo sapiens
agccaggggatcttgggccctgg

SEQ ID NO: 7645313 - DNA, 23 bp, Homo sapiens
agccaggggatcttgggccctgg

SEQ ID NO: 7645314 - DNA, 22 bp, Homo sapiens
cagacagctgctttcttgctgt

SEQ ID NO: 7645315 - DNA, 22 bp, Homo sapiens
cagacagctgctttcttgctgt

SEQ ID NO: 7645316 - DNA, 22 bp, Homo sapiens
cagacagctgctttcttgctgt

SEQ ID NO: 7645317 - DNA, 22 bp, Homo sapiens
cagacagctgctttcttgctgt

SEQ ID NO: 7645318 - DNA, 22 bp, Homo sapiens
cagacagcgagcggaggggctt

SEQ ID NO: 7645319 - DNA, 22 bp, Homo sapiens
cagacagcgagcggaggggctt

SEQ ID NO: 7645320 - DNA, 22 bp, Homo sapiens
cagacagcaggcctggatgtgt

SEQ ID NO: 7645321 - DNA, 22 bp, Homo sapiens
cagacagcaggcctggatgtgt

SEQ ID NO: 7645322 - DNA, 22 bp, Homo sapiens
cagacagcaaatctgcttgcat

SEQ ID NO: 7645323 - DNA, 22 bp, Homo sapiens
agccaggggattcatcagggac

SEQ ID NO: 7645324 - DNA, 22 bp, Homo sapiens
agccaggggattcatcagggac

SEQ ID NO: 7645325 - DNA, 22 bp, Homo sapiens
agccaggggattcatcagggac

SEQ ID NO: 7645326 - DNA, 23 bp, Homo sapiens
agccaggggatcttgggccctgg

SEQ ID NO: 7645327 - DNA, 22 bp, Homo sapiens
agccagggttagaagatagtca

SEQ ID NO: 7645328 - DNA, 22 bp, Homo sapiens
agccagggttagaagatagtca

SEQ ID NO: 7645329 - DNA, 22 bp, Homo sapiens
agccagggttagaagatagtca

SEQ ID NO: 7645330 - DNA, 22 bp, Homo sapiens
agccagggttagaagatagtca

SEQ ID NO: 7645331 - DNA, 22 bp, Homo sapiens
agccaggggattcatcagggac

SEQ ID NO: 7645332 - DNA, 20 bp, Homo sapiens
agccagggttctggatgcac

SEQ ID NO: 7645333 - DNA, 20 bp, Homo sapiens
agccagggttctggatgcac

SEQ ID NO: 7645334 - DNA, 20 bp, Homo sapiens
agccagggttctggatgcac

SEQ ID NO: 7645335 - DNA, 20 bp, Homo sapiens
agccagggttctggatgcac

SEQ ID NO: 7645336 - DNA, 20 bp, Homo sapiens
agccagggttctggatgcac

SEQ ID NO: 7645337 - DNA, 20 bp, Homo sapiens
agccagggttctggatgcac

SEQ ID NO: 7645338 - DNA, 20 bp, Homo sapiens
agccagggttctggatgcac

SEQ ID NO: 7645339 - DNA, 20 bp, Homo sapiens
agccagggttctggatgcac

SEQ ID NO: 7645340 - DNA, 20 bp, Homo sapiens
agccagggttctggatgcac

SEQ ID NO: 7645341 - DNA, 20 bp, Homo sapiens
agccagggttctggatgcac

SEQ ID NO: 7645342 - DNA, 22 bp, Homo sapiens
agccaggtaataaaggtcaaca

SEQ ID NO: 7645343 - DNA, 22 bp, Homo sapiens
agccaggtcagctcaccctgct

SEQ ID NO: 7645344 - DNA, 22 bp, Homo sapiens
agccaggtcaggaaaggtccca

SEQ ID NO: 7645345 - DNA, 22 bp, Homo sapiens
agccaggtctaaggacatcagg

SEQ ID NO: 7645346 - DNA, 22 bp, Homo sapiens
agccaggtctaaggacatcagg

SEQ ID NO: 7645347 - DNA, 22 bp, Homo sapiens
agccaggtcagctcaccctgct

SEQ ID NO: 7645348 - DNA, 22 bp, Homo sapiens
agccaggtactcttgtgaccat

SEQ ID NO: 7645349 - DNA, 22 bp, Homo sapiens
agccaggtactcttgtgaccat

SEQ ID NO: 7645350 - DNA, 22 bp, Homo sapiens
agccaggtcagctcaccctgct

SEQ ID NO: 7645351 - DNA, 22 bp, Homo sapiens
agccaggtcagctcaccctgct

SEQ ID NO: 7645352 - DNA, 17 bp, Homo sapiens
agccaggtacaagtcca

SEQ ID NO: 7645353 - DNA, 17 bp, Homo sapiens
agccaggtacaagtcca

SEQ ID NO: 7645354 - DNA, 22 bp, Homo sapiens
agccaggtaataaaggtcaaca

SEQ ID NO: 7645355 - DNA, 17 bp, Homo sapiens
agccaggtacaagtcca

SEQ ID NO: 7645356 - DNA, 22 bp, Homo sapiens
agccaggtttctttagctgtca

SEQ ID NO: 7645357 - DNA, 22 bp, Homo sapiens
agccaggttgggccttttcttt

SEQ ID NO: 7645358 - DNA, 22 bp, Homo sapiens
agccaggttgggccttttcttt

SEQ ID NO: 7645359 - DNA, 22 bp, Homo sapiens
agccaggtttctttagctgtca

SEQ ID NO: 7645360 - DNA, 22 bp, Homo sapiens
agccaggtttctttagctgtca

SEQ ID NO: 7645361 - DNA, 22 bp, Homo sapiens
agccaggttaaaccacagtcaa

SEQ ID NO: 7645362 - DNA, 22 bp, Homo sapiens
agccaggttgggccttttcttt

SEQ ID NO: 7645363 - DNA, 22 bp, Homo sapiens
agccaggttaaaccacagtcaa

SEQ ID NO: 7645364 - DNA, 18 bp, Homo sapiens
agccaggtggaatggaac

SEQ ID NO: 7645365 - DNA, 22 bp, Homo sapiens
agccaggtgcagtggcacacac

SEQ ID NO: 7645366 - DNA, 22 bp, Homo sapiens
agccaggtgcagtggcacacac

SEQ ID NO: 7645367 - DNA, 22 bp, Homo sapiens
agccaggtgcagtggcacacac

SEQ ID NO: 7645368 - DNA, 18 bp, Homo sapiens
agccaggtggaatggaac

SEQ ID NO: 7645369 - DNA, 18 bp, Homo sapiens
agccaggtggaatggaac

SEQ ID NO: 7645370 - DNA, 22 bp, Homo sapiens
agccaggttaaaccacagtcaa

SEQ ID NO: 7645371 - DNA, 22 bp, Homo sapiens
agccaggttaaaccacagtcaa

SEQ ID NO: 7645372 - DNA, 22 bp, Homo sapiens
agcccaggaggtggaggttgca

SEQ ID NO: 7645373 - DNA, 22 bp, Homo sapiens
agcccaggaggtggaggttgca

SEQ ID NO: 7645374 - DNA, 22 bp, Homo sapiens
agcccaggaggtggaggttgca

SEQ ID NO: 7645375 - DNA, 22 bp, Homo sapiens
agcccaggaggtggaggttgca

SEQ ID NO: 7645376 - DNA, 22 bp, Homo sapiens
agcccaggaggtggaggttgca

SEQ ID NO: 7645377 - DNA, 22 bp, Homo sapiens
agcccaggagtccttaaggacc

SEQ ID NO: 7645378 - DNA, 22 bp, Homo sapiens
agcccaggagtccttaaggacc

SEQ ID NO: 7645379 - DNA, 22 bp, Homo sapiens
agcccaggaggtggaggttgca

SEQ ID NO: 7645380 - DNA, 22 bp, Homo sapiens
agcccaggaggtggaggttgca

SEQ ID NO: 7645381 - DNA, 22 bp, Homo sapiens
agcccaggaggtggaggttgca

SEQ ID NO: 7645382 - DNA, 22 bp, Homo sapiens
agcccaggagcctttggagggt

SEQ ID NO: 7645383 - DNA, 22 bp, Homo sapiens
agcccaggagcctttggagggt

SEQ ID NO: 7645384 - DNA, 22 bp, Homo sapiens
agcccaggagcctttggagggt

SEQ ID NO: 7645385 - DNA, 22 bp, Homo sapiens
agcccaggagcctttggagggt

SEQ ID NO: 7645386 - DNA, 22 bp, Homo sapiens
agcccaggagcctttggagggt

SEQ ID NO: 7645387 - DNA, 22 bp, Homo sapiens
agcccaggagcctttggagggt

SEQ ID NO: 7645388 - DNA, 22 bp, Homo sapiens
agcccaggagcctttggagggt

SEQ ID NO: 7645389 - DNA, 22 bp, Homo sapiens
agcccaggagcctttggagggt

SEQ ID NO: 7645390 - DNA, 22 bp, Homo sapiens
agcccaggagcctttggagggt

SEQ ID NO: 7645391 - DNA, 22 bp, Homo sapiens
agcccagcctgattctacaccc

SEQ ID NO: 7645392 - DNA, 22 bp, Homo sapiens
agcccagcctgattctacaccc

SEQ ID NO: 7645393 - DNA, 22 bp, Homo sapiens
agcccagcctgattctacaccc

SEQ ID NO: 7645394 - DNA, 22 bp, Homo sapiens
agcccagcctgattctacaccc

SEQ ID NO: 7645395 - DNA, 22 bp, Homo sapiens
agcccaggaagttgaggcttgc

SEQ ID NO: 7645396 - DNA, 22 bp, Homo sapiens
agcccaggaagttgaggcttgc

SEQ ID NO: 7645397 - DNA, 22 bp, Homo sapiens
agcccaggaagttgaggcttgc

SEQ ID NO: 7645398 - DNA, 22 bp, Homo sapiens
agcccaggaagttgaggcttgc

SEQ ID NO: 7645399 - DNA, 22 bp, Homo sapiens
agcccaggaatctgcatcttga

SEQ ID NO: 7645400 - DNA, 22 bp, Homo sapiens
agcccaggaatctgcatcttga

SEQ ID NO: 7645401 - DNA, 22 bp, Homo sapiens
agcccaggaatctgcatcttga

SEQ ID NO: 7645402 - DNA, 22 bp, Homo sapiens
agcccaggaatctgcatcttga

SEQ ID NO: 7645403 - DNA, 22 bp, Homo sapiens
agcccaggaatctgcatcttga

SEQ ID NO: 7645404 - DNA, 22 bp, Homo sapiens
agcccaggaagttgaggcttgc

SEQ ID NO: 7645405 - DNA, 22 bp, Homo sapiens
agcccaggaagttgaggcttgc

SEQ ID NO: 7645406 - DNA, 22 bp, Homo sapiens
agcccaggaagttgaggcttgc

SEQ ID NO: 7645407 - DNA, 22 bp, Homo sapiens
agcccaggaagttgaggcttgc

SEQ ID NO: 7645408 - DNA, 22 bp, Homo sapiens
agcccaggaagttgaggcttgc

SEQ ID NO: 7645409 - DNA, 22 bp, Homo sapiens
agcccaggaagttgaggcttgc

SEQ ID NO: 7645410 - DNA, 22 bp, Homo sapiens
cagagctggagcttgaatggag

SEQ ID NO: 7645411 - DNA, 22 bp, Homo sapiens
cagagctggagaagtggattta

SEQ ID NO: 7645412 - DNA, 22 bp, Homo sapiens
cagagctggagcttgaatggag

SEQ ID NO: 7645413 - DNA, 22 bp, Homo sapiens
cagagctggagcttgaatggag

SEQ ID NO: 7645414 - DNA, 22 bp, Homo sapiens
cagagctggagggaaccctggc

SEQ ID NO: 7645415 - DNA, 22 bp, Homo sapiens
cagagctggagggaaccctggc

SEQ ID NO: 7645416 - DNA, 22 bp, Homo sapiens
cagagctggagcttgaatggag

SEQ ID NO: 7645417 - DNA, 22 bp, Homo sapiens
cagagctggagcttgaatggag

SEQ ID NO: 7645418 - DNA, 22 bp, Homo sapiens
cagagctgcttcccagtttgtg

SEQ ID NO: 7645419 - DNA, 22 bp, Homo sapiens
cagagctgcttcccagtttgtg

SEQ ID NO: 7645420 - DNA, 22 bp, Homo sapiens
cagagctgcttcccagtttgtg

SEQ ID NO: 7645421 - DNA, 22 bp, Homo sapiens
cagagctgcttcccagtttgtg

SEQ ID NO: 7645422 - DNA, 22 bp, Homo sapiens
cagagctggacttaaatatatt

SEQ ID NO: 7645423 - DNA, 22 bp, Homo sapiens
agcccaggagtttgaggctgtg

SEQ ID NO: 7645424 - DNA, 22 bp, Homo sapiens
agcccaggagtttgaggctgtg

SEQ ID NO: 7645425 - DNA, 22 bp, Homo sapiens
agcccaggagtttgaggctgtg

SEQ ID NO: 7645426 - DNA, 22 bp, Homo sapiens
agcccaggagtttgaggctgtg

SEQ ID NO: 7645427 - DNA, 22 bp, Homo sapiens
agcccaggagtttgaggctgtg

SEQ ID NO: 7645428 - DNA, 22 bp, Homo sapiens
agcccaggagtttgaggctgtg

SEQ ID NO: 7645429 - DNA, 22 bp, Homo sapiens
agcccaggagtttgaggctgtg

SEQ ID NO: 7645430 - DNA, 22 bp, Homo sapiens
agcccaggagtttgaggctgtg

SEQ ID NO: 7645431 - DNA, 22 bp, Homo sapiens
agcccaggagtttgaggctgtg

SEQ ID NO: 7645432 - DNA, 22 bp, Homo sapiens
agcccaggagtttgaggctgtg

SEQ ID NO: 7645433 - DNA, 22 bp, Homo sapiens
agcccaggagtttgaggctgtg

SEQ ID NO: 7645434 - DNA, 22 bp, Homo sapiens
agcccaggagtttgaggctgtg

SEQ ID NO: 7645435 - DNA, 22 bp, Homo sapiens
agcccaggagtttgaggctgtg

SEQ ID NO: 7645436 - DNA, 22 bp, Homo sapiens
agcccaggagtttgaggctgtg

SEQ ID NO: 7645437 - DNA, 22 bp, Homo sapiens
agcccaggagtttgaggctgtg

SEQ ID NO: 7645438 - DNA, 22 bp, Homo sapiens
agcccaggagtccttaaggacc

SEQ ID NO: 7645439 - DNA, 22 bp, Homo sapiens
agcccaggagtttgaggctgtg

SEQ ID NO: 7645440 - DNA, 22 bp, Homo sapiens
agcccaggagtccttaaggacc

SEQ ID NO: 7645441 - DNA, 22 bp, Homo sapiens
agcccaggagtccttaaggacc

SEQ ID NO: 7645442 - DNA, 22 bp, Homo sapiens
agcccaggagtccttaaggacc

SEQ ID NO: 7645443 - DNA, 22 bp, Homo sapiens
agcccaggagtccttaaggacc

SEQ ID NO: 7645444 - DNA, 23 bp, Homo sapiens
cagagctggctcagagctgcctg

SEQ ID NO: 7645445 - DNA, 23 bp, Homo sapiens
cagagctggctcagagctgcctg

SEQ ID NO: 7645446 - DNA, 23 bp, Homo sapiens
cagagctggctcagagctgcctg

SEQ ID NO: 7645447 - DNA, 22 bp, Homo sapiens
cagagctggcggtgagaagaca

SEQ ID NO: 7645448 - DNA, 19 bp, Homo sapiens
agcccccagacagcaggcc

SEQ ID NO: 7645449 - DNA, 23 bp, Homo sapiens
cagagctggctcagagctgcctg

SEQ ID NO: 7645450 - DNA, 22 bp, Homo sapiens
agccccttctgtctccaggatc

SEQ ID NO: 7645451 - DNA, 22 bp, Homo sapiens
agccccttgcacttccccacgc

SEQ ID NO: 7645452 - DNA, 22 bp, Homo sapiens
agcccctgtttttccagtcaga

SEQ ID NO: 7645453 - DNA, 19 bp, Homo sapiens
agcccccagacagcaggcc

SEQ ID NO: 7645454 - DNA, 19 bp, Homo sapiens
agcccccagacagcaggcc

SEQ ID NO: 7645455 - DNA, 19 bp, Homo sapiens
agcccccagacagcaggcc

SEQ ID NO: 7645456 - DNA, 19 bp, Homo sapiens
agcccccagacagcaggcc

SEQ ID NO: 7645457 - DNA, 22 bp, Homo sapiens
cagagctggcggtgagaagaca

SEQ ID NO: 7645458 - DNA, 22 bp, Homo sapiens
cagagctggcggtgagaagaca

SEQ ID NO: 7645459 - DNA, 22 bp, Homo sapiens
cagagctggcggtgagaagaca

SEQ ID NO: 7645460 - DNA, 22 bp, Homo sapiens
cagagctggcctgtgatttttg

SEQ ID NO: 7645461 - DNA, 22 bp, Homo sapiens
cagagctggcggtgagaagaca

SEQ ID NO: 7645462 - DNA, 23 bp, Homo sapiens
cagagctggctcagagctgcctg

SEQ ID NO: 7645463 - DNA, 23 bp, Homo sapiens
cagagctggctcagagctgcctg

SEQ ID NO: 7645464 - DNA, 23 bp, Homo sapiens
cagagctggctcagagctgcctg

SEQ ID NO: 7645465 - DNA, 22 bp, Homo sapiens
cagagctggcggtgagaagaca

SEQ ID NO: 7645466 - DNA, 22 bp, Homo sapiens
cagagctggcggtgagaagaca

SEQ ID NO: 7645467 - DNA, 22 bp, Homo sapiens
cagagctggagggaaccctggc

SEQ ID NO: 7645468 - DNA, 22 bp, Homo sapiens
cagagctggagggaaccctggc

SEQ ID NO: 7645469 - DNA, 22 bp, Homo sapiens
cagagctggagggaaccctggc

SEQ ID NO: 7645470 - DNA, 22 bp, Homo sapiens
cagagctggcctgtgatttttg

SEQ ID NO: 7645471 - DNA, 22 bp, Homo sapiens
cagagctggagggaaccctggc

SEQ ID NO: 7645472 - DNA, 22 bp, Homo sapiens
cagagctggcctgtgatttttg

SEQ ID NO: 7645473 - DNA, 22 bp, Homo sapiens
cagagctggcctgtgatttttg

SEQ ID NO: 7645474 - DNA, 22 bp, Homo sapiens
agccctaaattatctttatttt

SEQ ID NO: 7645475 - DNA, 22 bp, Homo sapiens
agcccggcttccccggttgcta

SEQ ID NO: 7645476 - DNA, 22 bp, Homo sapiens
agcccggcttccccggttgcta

SEQ ID NO: 7645477 - DNA, 22 bp, Homo sapiens
agcccggcttccccggttgcta

SEQ ID NO: 7645478 - DNA, 22 bp, Homo sapiens
agccctagagaaccagcctgtg

SEQ ID NO: 7645479 - DNA, 22 bp, Homo sapiens
agccctaaattatctttatttt

SEQ ID NO: 7645480 - DNA, 22 bp, Homo sapiens
agccctagagctggaggtcagt

SEQ ID NO: 7645481 - DNA, 22 bp, Homo sapiens
agccctagagaaccagcctgtg

SEQ ID NO: 7645482 - DNA, 22 bp, Homo sapiens
agccctagagaaccagcctgtg

SEQ ID NO: 7645483 - DNA, 22 bp, Homo sapiens
agccctagagaaccagcctgtg

SEQ ID NO: 7645484 - DNA, 22 bp, Homo sapiens
agccctagagctggaggtcagt

SEQ ID NO: 7645485 - DNA, 22 bp, Homo sapiens
agccctcaggctttgctgggcc

SEQ ID NO: 7645486 - DNA, 22 bp, Homo sapiens
agccctcaggctttgctgggcc

SEQ ID NO: 7645487 - DNA, 22 bp, Homo sapiens
agccctcatggaacagctccta

SEQ ID NO: 7645488 - DNA, 22 bp, Homo sapiens
agccctcatggaacagctccta

SEQ ID NO: 7645489 - DNA, 22 bp, Homo sapiens
agccctcatggaacagctccta

SEQ ID NO: 7645490 - DNA, 22 bp, Homo sapiens
agccctcatggaacagctccta

SEQ ID NO: 7645491 - DNA, 22 bp, Homo sapiens
agccctcatggaacagctccta

SEQ ID NO: 7645492 - DNA, 22 bp, Homo sapiens
agccctcatggaacagctccta

SEQ ID NO: 7645493 - DNA, 22 bp, Homo sapiens
agccctccaaaggttgggggag

SEQ ID NO: 7645494 - DNA, 22 bp, Homo sapiens
agcccggcttccccggttgcta

SEQ ID NO: 7645495 - DNA, 22 bp, Homo sapiens
agcccggcttccccggttgcta

SEQ ID NO: 7645496 - DNA, 22 bp, Homo sapiens
agcccggcttccccggttgcta

SEQ ID NO: 7645497 - DNA, 22 bp, Homo sapiens
agcccggcttccccggttgcta

SEQ ID NO: 7645498 - DNA, 22 bp, Homo sapiens
agcccgcatctcgctaaagata

SEQ ID NO: 7645499 - DNA, 22 bp, Homo sapiens
agcccgcatctcgctaaagata

SEQ ID NO: 7645500 - DNA, 22 bp, Homo sapiens
agcccgagcgcacctgtggaaa

SEQ ID NO: 7645501 - DNA, 22 bp, Homo sapiens
agccccttgtgggcgcacagca

SEQ ID NO: 7645502 - DNA, 23 bp, Homo sapiens
agcccctttaagtccggctgatg

SEQ ID NO: 7645503 - DNA, 22 bp, Homo sapiens
agcccgagcgcacctgtggaaa

SEQ ID NO: 7645504 - DNA, 22 bp, Homo sapiens
agccccttggaacacagggctg

SEQ ID NO: 7645505 - DNA, 22 bp, Homo sapiens
agccccttggaacacagggctg

SEQ ID NO: 7645506 - DNA, 19 bp, Homo sapiens
agccccttggtactgtcct

SEQ ID NO: 7645507 - DNA, 22 bp, Homo sapiens
agccccttgtgggcgcacagca

SEQ ID NO: 7645508 - DNA, 22 bp, Homo sapiens
agccccttgctgccctctagag

SEQ ID NO: 7645509 - DNA, 22 bp, Homo sapiens
agccccttgctgccctctagag

SEQ ID NO: 7645510 - DNA, 22 bp, Homo sapiens
agccccttgcacttccccacgc

SEQ ID NO: 7645511 - DNA, 22 bp, Homo sapiens
agccccttgcacttccccacgc

SEQ ID NO: 7645512 - DNA, 22 bp, Homo sapiens
cagcacagggcttgagaggtgt

SEQ ID NO: 7645513 - DNA, 22 bp, Homo sapiens
cagcacagggcttgagaggtgt

SEQ ID NO: 7645514 - DNA, 22 bp, Homo sapiens
cagcacagggacaatagcagat

SEQ ID NO: 7645515 - DNA, 22 bp, Homo sapiens
cagcacagggacaatagcagat

SEQ ID NO: 7645516 - DNA, 22 bp, Homo sapiens
cagcacagggacaatagcagat

SEQ ID NO: 7645517 - DNA, 22 bp, Homo sapiens
cagcacagggacaatagcagat

SEQ ID NO: 7645518 - DNA, 22 bp, Homo sapiens
cagcacagggacaatagcagat

SEQ ID NO: 7645519 - DNA, 22 bp, Homo sapiens
cagcacaggcctgtctttgtct

SEQ ID NO: 7645520 - DNA, 22 bp, Homo sapiens
cagcacaggcctgtctttgtct

SEQ ID NO: 7645521 - DNA, 22 bp, Homo sapiens
cagcacagggacaatagcagat

SEQ ID NO: 7645522 - DNA, 22 bp, Homo sapiens
cagcacagggacaatagcagat

SEQ ID NO: 7645523 - DNA, 22 bp, Homo sapiens
cagcacaggcctgtctttgtct

SEQ ID NO: 7645524 - DNA, 22 bp, Homo sapiens
cagcacaggcccctctctccca

SEQ ID NO: 7645525 - DNA, 22 bp, Homo sapiens
cagcacaggcccctctctccca

SEQ ID NO: 7645526 - DNA, 22 bp, Homo sapiens
cagcacaggaatatggtggaca

SEQ ID NO: 7645527 - DNA, 22 bp, Homo sapiens
cagcacaggcccctctctccca

SEQ ID NO: 7645528 - DNA, 22 bp, Homo sapiens
cagcacaggcccctctctccca

SEQ ID NO: 7645529 - DNA, 22 bp, Homo sapiens
cagcacaggaagtgggccttca

SEQ ID NO: 7645530 - DNA, 22 bp, Homo sapiens
cagcacaggaagtgggccttca

SEQ ID NO: 7645531 - DNA, 22 bp, Homo sapiens
cagcacaggaagtgggccttca

SEQ ID NO: 7645532 - DNA, 22 bp, Homo sapiens
cagcacagctgaggggctgtct

SEQ ID NO: 7645533 - DNA, 22 bp, Homo sapiens
cagcacagctgaggggctgtct

SEQ ID NO: 7645534 - DNA, 22 bp, Homo sapiens
cagcacagctgaggggctgtct

SEQ ID NO: 7645535 - DNA, 22 bp, Homo sapiens
cagcacaggaatatggtggaca

SEQ ID NO: 7645536 - DNA, 22 bp, Homo sapiens
cagcacaggaatatggtggaca

SEQ ID NO: 7645537 - DNA, 22 bp, Homo sapiens
cagcacaggaatatggtggaca

SEQ ID NO: 7645538 - DNA, 22 bp, Homo sapiens
cagcacaggaagtgggccttca

SEQ ID NO: 7645539 - DNA, 22 bp, Homo sapiens
cagcacaggcaggggaactata

SEQ ID NO: 7645540 - DNA, 22 bp, Homo sapiens
cagcacaggcaggggaactata

SEQ ID NO: 7645541 - DNA, 22 bp, Homo sapiens
cagcacaggtcagttttttaag

SEQ ID NO: 7645542 - DNA, 22 bp, Homo sapiens
cagcacagggcttgagaggtgt

SEQ ID NO: 7645543 - DNA, 22 bp, Homo sapiens
cagcacagtacaaggcacggat

SEQ ID NO: 7645544 - DNA, 22 bp, Homo sapiens
cagcacaggtcagttttttaag

SEQ ID NO: 7645545 - DNA, 22 bp, Homo sapiens
cagcacagggcttgagaggtgt

SEQ ID NO: 7645546 - DNA, 22 bp, Homo sapiens
cagcacagggcttgagaggtgt

SEQ ID NO: 7645547 - DNA, 22 bp, Homo sapiens
cagcacagggcttgagaggtgt

SEQ ID NO: 7645548 - DNA, 22 bp, Homo sapiens
cagcacagtacaaggcacggat

SEQ ID NO: 7645549 - DNA, 22 bp, Homo sapiens
cagcacagtacaaggcacggat

SEQ ID NO: 7645550 - DNA, 22 bp, Homo sapiens
cagcacagtacaaggcacggat

SEQ ID NO: 7645551 - DNA, 22 bp, Homo sapiens
cagcacagtacaaggcacggat

SEQ ID NO: 7645552 - DNA, 22 bp, Homo sapiens
cagcacagtacaaggcacggat

SEQ ID NO: 7645553 - DNA, 22 bp, Homo sapiens
cagcacagggcttgagaggtgt

SEQ ID NO: 7645554 - DNA, 22 bp, Homo sapiens
cagcacaggtcagttttttaag

SEQ ID NO: 7645555 - DNA, 22 bp, Homo sapiens
agcctcagcacgcagctctgtg

SEQ ID NO: 7645556 - DNA, 22 bp, Homo sapiens
agcctcagcacgcagctctgtg

SEQ ID NO: 7645557 - DNA, 22 bp, Homo sapiens
agcctcagcacgcagctctgtg

SEQ ID NO: 7645558 - DNA, 22 bp, Homo sapiens
agcctcagcacgcagctctgtg

SEQ ID NO: 7645559 - DNA, 22 bp, Homo sapiens
cagcacagtacaaggcacggat

SEQ ID NO: 7645560 - DNA, 22 bp, Homo sapiens
cagcacagtacaaggcacggat

SEQ ID NO: 7645561 - DNA, 22 bp, Homo sapiens
agcctcagcacgcagctctgtg

SEQ ID NO: 7645562 - DNA, 23 bp, Homo sapiens
agcctcagccggtggcagaagtg

SEQ ID NO: 7645563 - DNA, 22 bp, Homo sapiens
agcctcagcacgcagctctgtg

SEQ ID NO: 7645564 - DNA, 22 bp, Homo sapiens
agcctcagcacgcagctctgtg

SEQ ID NO: 7645565 - DNA, 23 bp, Homo sapiens
agcctcagccggtggcagaagtg

SEQ ID NO: 7645566 - DNA, 23 bp, Homo sapiens
agcctcagccggtggcagaagtg

SEQ ID NO: 7645567 - DNA, 23 bp, Homo sapiens
agcctcagccggtggcagaagtg

SEQ ID NO: 7645568 - DNA, 23 bp, Homo sapiens
agcctcagccggtggcagaagtg

SEQ ID NO: 7645569 - DNA, 23 bp, Homo sapiens
agcctcagccggtggcagaagtg

SEQ ID NO: 7645570 - DNA, 23 bp, Homo sapiens
agcctcagccggtggcagaagtg

SEQ ID NO: 7645571 - DNA, 23 bp, Homo sapiens
agcctcagccggtggcagaagtg

SEQ ID NO: 7645572 - DNA, 22 bp, Homo sapiens
agcctcagggctctgcgcagac

SEQ ID NO: 7645573 - DNA, 22 bp, Homo sapiens
agcctcagggctctgcgcagac

SEQ ID NO: 7645574 - DNA, 22 bp, Homo sapiens
agcctcagggctctgcgcagac

SEQ ID NO: 7645575 - DNA, 22 bp, Homo sapiens
agcctcagggctctgcgcagac

SEQ ID NO: 7645576 - DNA, 22 bp, Homo sapiens
agcctcagggctctgcgcagac

SEQ ID NO: 7645577 - DNA, 23 bp, Homo sapiens
agcctcagccggtggcagaagtg

SEQ ID NO: 7645578 - DNA, 23 bp, Homo sapiens
agcctcagccggtggcagaagtg

SEQ ID NO: 7645579 - DNA, 21 bp, Homo sapiens
agcctcaggttgttggttctt

SEQ ID NO: 7645580 - DNA, 21 bp, Homo sapiens
agcctcaggttgttggttctt

SEQ ID NO: 7645581 - DNA, 22 bp, Homo sapiens
agcctcagggctctgcgcagac

SEQ ID NO: 7645582 - DNA, 22 bp, Homo sapiens
agcctcagggctctgcgcagac

SEQ ID NO: 7645583 - DNA, 22 bp, Homo sapiens
cagaggctcaccagcctttcac

SEQ ID NO: 7645584 - DNA, 22 bp, Homo sapiens
cagaggctcaccagcctttcac

SEQ ID NO: 7645585 - DNA, 22 bp, Homo sapiens
cagaggctcaccagcctttcac

SEQ ID NO: 7645586 - DNA, 22 bp, Homo sapiens
cagaggctagactgtgcttcct

SEQ ID NO: 7645587 - DNA, 22 bp, Homo sapiens
cagaggctcagatggccctggc

SEQ ID NO: 7645588 - DNA, 22 bp, Homo sapiens
cagaggctcagatggccctggc

SEQ ID NO: 7645589 - DNA, 22 bp, Homo sapiens
cagaggctcagatggccctggc

SEQ ID NO: 7645590 - DNA, 22 bp, Homo sapiens
cagaggctcagatggccctggc

SEQ ID NO: 7645591 - DNA, 22 bp, Homo sapiens
cagaggctcagatggccctggc

SEQ ID NO: 7645592 - DNA, 22 bp, Homo sapiens
cagaggctcaccagcctttcac

SEQ ID NO: 7645593 - DNA, 22 bp, Homo sapiens
cagaggctcaccagcctttcac

SEQ ID NO: 7645594 - DNA, 22 bp, Homo sapiens
cagaggctcagatggccctggc

SEQ ID NO: 7645595 - DNA, 22 bp, Homo sapiens
cagaggctcttcctcactgccc

SEQ ID NO: 7645596 - DNA, 22 bp, Homo sapiens
cagaggctcttcctcactgccc

SEQ ID NO: 7645597 - DNA, 22 bp, Homo sapiens
cagcaagaatcagacaacctca

SEQ ID NO: 7645598 - DNA, 19 bp, Homo sapiens
cagcaagaatgaaggcata

SEQ ID NO: 7645599 - DNA, 22 bp, Homo sapiens
cagaggctcttcctcactgccc

SEQ ID NO: 7645600 - DNA, 22 bp, Homo sapiens
cagaggctcttcctcactgccc

SEQ ID NO: 7645601 - DNA, 22 bp, Homo sapiens
cagaggctcagatggccctggc

SEQ ID NO: 7645602 - DNA, 22 bp, Homo sapiens
cagaggctcagatggccctggc

SEQ ID NO: 7645603 - DNA, 20 bp, Homo sapiens
cagcacagagcttggctcta

SEQ ID NO: 7645604 - DNA, 22 bp, Homo sapiens
cagcacacagtgactcgcacct

SEQ ID NO: 7645605 - DNA, 20 bp, Homo sapiens
cagcacagagcttggctcta

SEQ ID NO: 7645606 - DNA, 20 bp, Homo sapiens
cagcacagagcttggctcta

SEQ ID NO: 7645607 - DNA, 22 bp, Homo sapiens
cagcacacagtgactcgcacct

SEQ ID NO: 7645608 - DNA, 22 bp, Homo sapiens
cagcacacagtgactcgcacct

SEQ ID NO: 7645609 - DNA, 22 bp, Homo sapiens
cagcacacagtgactcgcacct

SEQ ID NO: 7645610 - DNA, 19 bp, Homo sapiens
cagcaagaatgaaggcata

SEQ ID NO: 7645611 - DNA, 19 bp, Homo sapiens
cagcaagaatgaaggcata

SEQ ID NO: 7645612 - DNA, 19 bp, Homo sapiens
cagcaagaatgaaggcata

SEQ ID NO: 7645613 - DNA, 19 bp, Homo sapiens
cagcaagaatgaaggcata

SEQ ID NO: 7645614 - DNA, 22 bp, Homo sapiens
cagcaagacaaggaacaaactg

SEQ ID NO: 7645615 - DNA, 22 bp, Homo sapiens
cagcaagacaaggaacaaactg

SEQ ID NO: 7645616 - DNA, 22 bp, Homo sapiens
cagcacagctgaggggctgtct

SEQ ID NO: 7645617 - DNA, 22 bp, Homo sapiens
cagcacagctgaggggctgtct

SEQ ID NO: 7645618 - DNA, 22 bp, Homo sapiens
cagcacagcacagcggtgactc

SEQ ID NO: 7645619 - DNA, 22 bp, Homo sapiens
cagcacagcacagcggtgactc

SEQ ID NO: 7645620 - DNA, 22 bp, Homo sapiens
cagcacagcacagcggtgactc

SEQ ID NO: 7645621 - DNA, 22 bp, Homo sapiens
cagcacagcacagcggtgactc

SEQ ID NO: 7645622 - DNA, 22 bp, Homo sapiens
cagcacagcacagcggtgactc

SEQ ID NO: 7645623 - DNA, 22 bp, Homo sapiens
cagcacagcacagcggtgactc

SEQ ID NO: 7645624 - DNA, 22 bp, Homo sapiens
cagcacagagtattttattgat

SEQ ID NO: 7645625 - DNA, 22 bp, Homo sapiens
cagcacagagtattttattgat

SEQ ID NO: 7645626 - DNA, 20 bp, Homo sapiens
cagcacagagcttggctcta

SEQ ID NO: 7645627 - DNA, 22 bp, Homo sapiens
cagaggctaagggtagcttggg

SEQ ID NO: 7645628 - DNA, 22 bp, Homo sapiens
cagaggctaagggtagcttggg

SEQ ID NO: 7645629 - DNA, 22 bp, Homo sapiens
cagaggctaagggtagcttggg

SEQ ID NO: 7645630 - DNA, 22 bp, Homo sapiens
cagaggctaagggtagcttggg

SEQ ID NO: 7645631 - DNA, 22 bp, Homo sapiens
cagaggctaagatgagtgggtg

SEQ ID NO: 7645632 - DNA, 22 bp, Homo sapiens
cagaggctaagatgagtgggtg

SEQ ID NO: 7645633 - DNA, 22 bp, Homo sapiens
cagaggctaagggtagcttggg

SEQ ID NO: 7645634 - DNA, 22 bp, Homo sapiens
cagaggctaagggtagcttggg

SEQ ID NO: 7645635 - DNA, 22 bp, Homo sapiens
cagaggctagactgtgcttcct

SEQ ID NO: 7645636 - DNA, 22 bp, Homo sapiens
cagaggctagactgtgcttcct

SEQ ID NO: 7645637 - DNA, 22 bp, Homo sapiens
cagaggctaagatgagtgggtg

SEQ ID NO: 7645638 - DNA, 22 bp, Homo sapiens
cagaggctaagatgagtgggtg

SEQ ID NO: 7645639 - DNA, 22 bp, Homo sapiens
cagaggctaagatgagtgggtg

SEQ ID NO: 7645640 - DNA, 22 bp, Homo sapiens
cagaggctaagatgagtgggtg

SEQ ID NO: 7645641 - DNA, 22 bp, Homo sapiens
cagaggctaagatgagtgggtg

SEQ ID NO: 7645642 - DNA, 22 bp, Homo sapiens
cagaggctaagatgagtgggtg

SEQ ID NO: 7645643 - DNA, 22 bp, Homo sapiens
cagaggctaagatgagtgggtg

SEQ ID NO: 7645644 - DNA, 22 bp, Homo sapiens
cagaggctaagatgagtgggtg

SEQ ID NO: 7645645 - DNA, 22 bp, Homo sapiens
cagaggctaagatgagtgggtg

SEQ ID NO: 7645646 - DNA, 22 bp, Homo sapiens
cagaggctaagagtgtccaaag

SEQ ID NO: 7645647 - DNA, 22 bp, Homo sapiens
agccctccatctgtgctcaggc

SEQ ID NO: 7645648 - DNA, 22 bp, Homo sapiens
agccctccatctgtgctcaggc

SEQ ID NO: 7645649 - DNA, 22 bp, Homo sapiens
agccctccaaaggttgggggag

SEQ ID NO: 7645650 - DNA, 22 bp, Homo sapiens
agccctccaaaggttgggggag

SEQ ID NO: 7645651 - DNA, 22 bp, Homo sapiens
agccctccatctgtgctcaggc

SEQ ID NO: 7645652 - DNA, 22 bp, Homo sapiens
agccctcctcacatcagcgtcc

SEQ ID NO: 7645653 - DNA, 18 bp, Homo sapiens
agccctccaggtgattct

SEQ ID NO: 7645654 - DNA, 22 bp, Homo sapiens
agccctccatctgtgctcaggc

SEQ ID NO: 7645655 - DNA, 22 bp, Homo sapiens
agccctccatctgtgctcaggc

SEQ ID NO: 7645656 - DNA, 22 bp, Homo sapiens
cagaggcgaggcagctgaacct

SEQ ID NO: 7645657 - DNA, 22 bp, Homo sapiens
cagaggcgaggcagctgaacct

SEQ ID NO: 7645658 - DNA, 22 bp, Homo sapiens
cagaggctaagagtgtccaaag

SEQ ID NO: 7645659 - DNA, 22 bp, Homo sapiens
cagaggctaagagtgtccaaag

SEQ ID NO: 7645660 - DNA, 22 bp, Homo sapiens
cagaggcctttctacagtgata

SEQ ID NO: 7645661 - DNA, 22 bp, Homo sapiens
agccctcctcacatcagcgtcc

SEQ ID NO: 7645662 - DNA, 22 bp, Homo sapiens
agccctcctcacatcagcgtcc

SEQ ID NO: 7645663 - DNA, 22 bp, Homo sapiens
cagaggcgaggcagctgaacct

SEQ ID NO: 7645664 - DNA, 22 bp, Homo sapiens
cagaggcctttctacagtgata

SEQ ID NO: 7645665 - DNA, 22 bp, Homo sapiens
cagcagcagtgttctagaatct

SEQ ID NO: 7645666 - DNA, 22 bp, Homo sapiens
cagcagcagtgttctagaatct

SEQ ID NO: 7645667 - DNA, 22 bp, Homo sapiens
cagcagcagtggctgcagaaca

SEQ ID NO: 7645668 - DNA, 22 bp, Homo sapiens
cagcagcatcaggtctgtggtt

SEQ ID NO: 7645669 - DNA, 22 bp, Homo sapiens
cagcagcatcaggtctgtggtt

SEQ ID NO: 7645670 - DNA, 22 bp, Homo sapiens
cagcagcatcaggtctgtggtt

SEQ ID NO: 7645671 - DNA, 22 bp, Homo sapiens
cagcagcatcaggtctgtggtt

SEQ ID NO: 7645672 - DNA, 22 bp, Homo sapiens
cagcagcatcaggtctgtggtt

SEQ ID NO: 7645673 - DNA, 22 bp, Homo sapiens
cagcagcatgaattcgagccac

SEQ ID NO: 7645674 - DNA, 22 bp, Homo sapiens
cagcagcatgaattcgagccac

SEQ ID NO: 7645675 - DNA, 22 bp, Homo sapiens
cagcagcatcaggtctgtggtt

SEQ ID NO: 7645676 - DNA, 22 bp, Homo sapiens
cagcagcatgaattcgagccac

SEQ ID NO: 7645677 - DNA, 22 bp, Homo sapiens
cagcagcatgaattcgagccac

SEQ ID NO: 7645678 - DNA, 22 bp, Homo sapiens
cagcagcatgaattcgagccac

SEQ ID NO: 7645679 - DNA, 22 bp, Homo sapiens
cagcagcatgaattcgagccac

SEQ ID NO: 7645680 - DNA, 22 bp, Homo sapiens
cagcagcatcaggtctgtggtt

SEQ ID NO: 7645681 - DNA, 22 bp, Homo sapiens
agccttcagtaaatccactgtg

SEQ ID NO: 7645682 - DNA, 23 bp, Homo sapiens
agccttcaggcaatgtcagtaga

SEQ ID NO: 7645683 - DNA, 22 bp, Homo sapiens
agccttcagtaagggcttagca

SEQ ID NO: 7645684 - DNA, 22 bp, Homo sapiens
agccttcagtaaatccactgtg

SEQ ID NO: 7645685 - DNA, 22 bp, Homo sapiens
agccttcagtaaatccactgtg

SEQ ID NO: 7645686 - DNA, 22 bp, Homo sapiens
agccttccaggtagatggcaca

SEQ ID NO: 7645687 - DNA, 22 bp, Homo sapiens
agccttcagtaagggcttagca

SEQ ID NO: 7645688 - DNA, 22 bp, Homo sapiens
agccttcataatcttgggcttt

SEQ ID NO: 7645689 - DNA, 22 bp, Homo sapiens
cagcagcattgctctggattcc

SEQ ID NO: 7645690 - DNA, 22 bp, Homo sapiens
agcctggtttaagcattttata

SEQ ID NO: 7645691 - DNA, 22 bp, Homo sapiens
agcctggtttaagcattttata

SEQ ID NO: 7645692 - DNA, 22 bp, Homo sapiens
cagcagaggttttgctccatga

SEQ ID NO: 7645693 - DNA, 22 bp, Homo sapiens
cagcagaggttttgctccatga

SEQ ID NO: 7645694 - DNA, 22 bp, Homo sapiens
cagcagaggttttgctccatga

SEQ ID NO: 7645695 - DNA, 22 bp, Homo sapiens
cagcagaggttttgctccatga

SEQ ID NO: 7645696 - DNA, 22 bp, Homo sapiens
cagcagaggttttgctccatga

SEQ ID NO: 7645697 - DNA, 22 bp, Homo sapiens
cagcagaggttttgctccatga

SEQ ID NO: 7645698 - DNA, 22 bp, Homo sapiens
cagcagaggttttgctccatga

SEQ ID NO: 7645699 - DNA, 22 bp, Homo sapiens
cagcagaggttttgctccatga

SEQ ID NO: 7645700 - DNA, 22 bp, Homo sapiens
cagcagaggttttgctccatga

SEQ ID NO: 7645701 - DNA, 22 bp, Homo sapiens
cagcagaggttttgctccatga

SEQ ID NO: 7645702 - DNA, 22 bp, Homo sapiens
cagcagcagccccaggaaggtt

SEQ ID NO: 7645703 - DNA, 22 bp, Homo sapiens
cagcagcagcttagtggtcccc

SEQ ID NO: 7645704 - DNA, 22 bp, Homo sapiens
cagcagcagcttagtggtcccc

SEQ ID NO: 7645705 - DNA, 22 bp, Homo sapiens
cagcagcagcttagtggtcccc

SEQ ID NO: 7645706 - DNA, 22 bp, Homo sapiens
cagcagcagccccaggaaggtt

SEQ ID NO: 7645707 - DNA, 22 bp, Homo sapiens
cagcagcagcttagtggtcccc

SEQ ID NO: 7645708 - DNA, 22 bp, Homo sapiens
cagcagcagcttagtggtcccc

SEQ ID NO: 7645709 - DNA, 22 bp, Homo sapiens
cagcagcaggcgcacggccgtc

SEQ ID NO: 7645710 - DNA, 22 bp, Homo sapiens
cagcagcaggcgcacggccgtc

SEQ ID NO: 7645711 - DNA, 22 bp, Homo sapiens
cagcagcaggcgcacggccgtc

SEQ ID NO: 7645712 - DNA, 22 bp, Homo sapiens
cagcagcagtggctgcagaaca

SEQ ID NO: 7645713 - DNA, 22 bp, Homo sapiens
cagcagcaggcgcacggccgtc

SEQ ID NO: 7645714 - DNA, 22 bp, Homo sapiens
cagcagcaggcgcacggccgtc

SEQ ID NO: 7645715 - DNA, 22 bp, Homo sapiens
cagcagcagtggctgcagaaca

SEQ ID NO: 7645716 - DNA, 22 bp, Homo sapiens
cagcagcagtggctgcagaaca

SEQ ID NO: 7645717 - DNA, 22 bp, Homo sapiens
cagcagcagtggctgcagaaca

SEQ ID NO: 7645718 - DNA, 22 bp, Homo sapiens
cagcagcagtggctgcagaaca

SEQ ID NO: 7645719 - DNA, 22 bp, Homo sapiens
cagcagcagtggctgcagaaca

SEQ ID NO: 7645720 - DNA, 22 bp, Homo sapiens
cagcagcagtggctgcagaaca

SEQ ID NO: 7645721 - DNA, 22 bp, Homo sapiens
cagcagcagtggctgcagaaca

SEQ ID NO: 7645722 - DNA, 22 bp, Homo sapiens
cagcagcagtggctgcagaaca

SEQ ID NO: 7645723 - DNA, 22 bp, Homo sapiens
cagcagcagtggctgcagaaca

SEQ ID NO: 7645724 - DNA, 22 bp, Homo sapiens
cagcagcagtggctgcagaaca

SEQ ID NO: 7645725 - DNA, 22 bp, Homo sapiens
cagcagagggagccattgaaat

SEQ ID NO: 7645726 - DNA, 22 bp, Homo sapiens
cagcagagggagccattgaaat

SEQ ID NO: 7645727 - DNA, 22 bp, Homo sapiens
cagcagagggagccattgaaat

SEQ ID NO: 7645728 - DNA, 22 bp, Homo sapiens
cagcagagggagccattgaaat

SEQ ID NO: 7645729 - DNA, 22 bp, Homo sapiens
cagcagagggagccattgaaat

SEQ ID NO: 7645730 - DNA, 22 bp, Homo sapiens
cagcagagggagccattgaaat

SEQ ID NO: 7645731 - DNA, 22 bp, Homo sapiens
cagcagaggtggttcacattgt

SEQ ID NO: 7645732 - DNA, 22 bp, Homo sapiens
cagcagaggtggttcacattgt

SEQ ID NO: 7645733 - DNA, 22 bp, Homo sapiens
cagcagaggtggttcacattgt

SEQ ID NO: 7645734 - DNA, 22 bp, Homo sapiens
cagcagaggtggttcacattgt

SEQ ID NO: 7645735 - DNA, 22 bp, Homo sapiens
cagcagaggtggttcacattgt

SEQ ID NO: 7645736 - DNA, 22 bp, Homo sapiens
cagcagaggtggttcacattgt

SEQ ID NO: 7645737 - DNA, 22 bp, Homo sapiens
cagcagaggtggttcacattgt

SEQ ID NO: 7645738 - DNA, 22 bp, Homo sapiens
cagcagaggttggaacagttct

SEQ ID NO: 7645739 - DNA, 22 bp, Homo sapiens
cagcagaggttggaacagttct

SEQ ID NO: 7645740 - DNA, 22 bp, Homo sapiens
cagcagaggttggaacagttct

SEQ ID NO: 7645741 - DNA, 22 bp, Homo sapiens
cagcagaggttggaacagttct

SEQ ID NO: 7645742 - DNA, 22 bp, Homo sapiens
cagcagaggttggaacagttct

SEQ ID NO: 7645743 - DNA, 22 bp, Homo sapiens
cagcagaggttggaacagttct

SEQ ID NO: 7645744 - DNA, 22 bp, Homo sapiens
cagcagaggttggaacagttct

SEQ ID NO: 7645745 - DNA, 22 bp, Homo sapiens
cagcagaggttggaacagttct

SEQ ID NO: 7645746 - DNA, 22 bp, Homo sapiens
cagcagaggttggaacagttct

SEQ ID NO: 7645747 - DNA, 22 bp, Homo sapiens
cagcagaggtggttcacattgt

SEQ ID NO: 7645748 - DNA, 22 bp, Homo sapiens
cagcagaggtggttcacattgt

SEQ ID NO: 7645749 - DNA, 22 bp, Homo sapiens
cagcagaggtggttcacattgt

SEQ ID NO: 7645750 - DNA, 22 bp, Homo sapiens
cagcagaggaaagcaaatctaa

SEQ ID NO: 7645751 - DNA, 22 bp, Homo sapiens
cagcagaggaaagcaaatctaa

SEQ ID NO: 7645752 - DNA, 22 bp, Homo sapiens
cagcagaggaaagcaaatctaa

SEQ ID NO: 7645753 - DNA, 22 bp, Homo sapiens
cagcagaggaaagcaaatctaa

SEQ ID NO: 7645754 - DNA, 22 bp, Homo sapiens
cagcagagcttattaactaaaa

SEQ ID NO: 7645755 - DNA, 22 bp, Homo sapiens
cagcagagcttattaactaaaa

SEQ ID NO: 7645756 - DNA, 22 bp, Homo sapiens
cagcagagcttattaactaaaa

SEQ ID NO: 7645757 - DNA, 22 bp, Homo sapiens
cagcagaggaaagcaaatctaa

SEQ ID NO: 7645758 - DNA, 22 bp, Homo sapiens
cagcagaggaaagcaaatctaa

SEQ ID NO: 7645759 - DNA, 22 bp, Homo sapiens
cagcagaggaaagcaaatctaa

SEQ ID NO: 7645760 - DNA, 22 bp, Homo sapiens
cagcagaggaaagcaaatctaa

SEQ ID NO: 7645761 - DNA, 22 bp, Homo sapiens
cagcagaggaaagcaaatctaa

SEQ ID NO: 7645762 - DNA, 22 bp, Homo sapiens
cagcagaggaaagcaaatctaa

SEQ ID NO: 7645763 - DNA, 22 bp, Homo sapiens
cagcagaggcacgtctgtgaat

SEQ ID NO: 7645764 - DNA, 22 bp, Homo sapiens
cagcagaggcacgtctgtgaat

SEQ ID NO: 7645765 - DNA, 22 bp, Homo sapiens
cagcagaggcacgtctgtgaat

SEQ ID NO: 7645766 - DNA, 22 bp, Homo sapiens
cagcagagggagccattgaaat

SEQ ID NO: 7645767 - DNA, 22 bp, Homo sapiens
cagcagagggagccattgaaat

SEQ ID NO: 7645768 - DNA, 22 bp, Homo sapiens
cagcagaggcacgtctgtgaat

SEQ ID NO: 7645769 - DNA, 22 bp, Homo sapiens
cagcagaggcacgtctgtgaat

SEQ ID NO: 7645770 - DNA, 22 bp, Homo sapiens
cagcagaggcacgtctgtgaat

SEQ ID NO: 7645771 - DNA, 22 bp, Homo sapiens
cagcagaggcacgtctgtgaat

SEQ ID NO: 7645772 - DNA, 22 bp, Homo sapiens
cagcagaggcacgtctgtgaat

SEQ ID NO: 7645773 - DNA, 22 bp, Homo sapiens
cagcagagcttatgttgggtca

SEQ ID NO: 7645774 - DNA, 22 bp, Homo sapiens
cagcagagcttatgttgggtca

SEQ ID NO: 7645775 - DNA, 20 bp, Homo sapiens
cagcagaaatggggtgggaa

SEQ ID NO: 7645776 - DNA, 20 bp, Homo sapiens
cagcagaaatggggtgggaa

SEQ ID NO: 7645777 - DNA, 20 bp, Homo sapiens
cagcagaaatggggtgggaa

SEQ ID NO: 7645778 - DNA, 22 bp, Homo sapiens
cagcagagcttattaactaaaa

SEQ ID NO: 7645779 - DNA, 22 bp, Homo sapiens
cagcagagcttattaactaaaa

SEQ ID NO: 7645780 - DNA, 22 bp, Homo sapiens
cagcagagcttatgttgggtca

SEQ ID NO: 7645781 - DNA, 22 bp, Homo sapiens
cagcagagcttattaactaaaa

SEQ ID NO: 7645782 - DNA, 22 bp, Homo sapiens
cagcagagcttattaactaaaa

SEQ ID NO: 7645783 - DNA, 22 bp, Homo sapiens
agcctccatctcccatctgtga

SEQ ID NO: 7645784 - DNA, 22 bp, Homo sapiens
agcctccatctcccatctgtga

SEQ ID NO: 7645785 - DNA, 22 bp, Homo sapiens
agcctccatctcccatctgtga

SEQ ID NO: 7645786 - DNA, 22 bp, Homo sapiens
cagcagaaacccagcaaagcca

SEQ ID NO: 7645787 - DNA, 22 bp, Homo sapiens
cagcagaaatggattttgagat

SEQ ID NO: 7645788 - DNA, 22 bp, Homo sapiens
cagcagaaatggattttgagat

SEQ ID NO: 7645789 - DNA, 22 bp, Homo sapiens
cagcagaaatggattttgagat

SEQ ID NO: 7645790 - DNA, 22 bp, Homo sapiens
agcctccacagatgcaaagggc

SEQ ID NO: 7645791 - DNA, 22 bp, Homo sapiens
agcctccacagatgcaaagggc

SEQ ID NO: 7645792 - DNA, 22 bp, Homo sapiens
agcctccatcccatgcacaaag

SEQ ID NO: 7645793 - DNA, 22 bp, Homo sapiens
agcctccagtagctgaagagac

SEQ ID NO: 7645794 - DNA, 22 bp, Homo sapiens
agcctccagtagctgaagagac

SEQ ID NO: 7645795 - DNA, 22 bp, Homo sapiens
agcctccacagatgcaaagggc

SEQ ID NO: 7645796 - DNA, 22 bp, Homo sapiens
agcctccacagatgcaaagggc

SEQ ID NO: 7645797 - DNA, 22 bp, Homo sapiens
agcctccaaatgtcaggtcccg

SEQ ID NO: 7645798 - DNA, 22 bp, Homo sapiens
agcctccaaatgtcaggtcccg

SEQ ID NO: 7645799 - DNA, 22 bp, Homo sapiens
agcctcagtttcaggcctcctc

SEQ ID NO: 7645800 - DNA, 22 bp, Homo sapiens
agcctccaaatgtcaggtcccg

SEQ ID NO: 7645801 - DNA, 22 bp, Homo sapiens
agcctccaaatgtcaggtcccg

SEQ ID NO: 7645802 - DNA, 22 bp, Homo sapiens
agcctcagtgtcaccatctacc

SEQ ID NO: 7645803 - DNA, 22 bp, Homo sapiens
agcctcagtgtcaccatctacc

SEQ ID NO: 7645804 - DNA, 21 bp, Homo sapiens
agcctcaggttgttggttctt

SEQ ID NO: 7645805 - DNA, 22 bp, Homo sapiens
agcctcagtgtcaccatctacc

SEQ ID NO: 7645806 - DNA, 22 bp, Homo sapiens
agcctcagtgtcaccatctacc

SEQ ID NO: 7645807 - DNA, 22 bp, Homo sapiens
agcctcagtttcaggcctcctc

SEQ ID NO: 7645808 - DNA, 22 bp, Homo sapiens
agcctcagtgtcaccatctacc

SEQ ID NO: 7645809 - DNA, 22 bp, Homo sapiens
agcctcagtttcaggcctcctc

SEQ ID NO: 7645810 - DNA, 22 bp, Homo sapiens
agcctcagtttcaggcctcctc

SEQ ID NO: 7645811 - DNA, 22 bp, Homo sapiens
agctccccacgtctctgtcttt

SEQ ID NO: 7645812 - DNA, 22 bp, Homo sapiens
agctccccacgtctctgtcttt

SEQ ID NO: 7645813 - DNA, 22 bp, Homo sapiens
agctcccagtctcctctccatg

SEQ ID NO: 7645814 - DNA, 22 bp, Homo sapiens
agctcccctcgtttctctccat

SEQ ID NO: 7645815 - DNA, 22 bp, Homo sapiens
agctcccattatcttctgaaac

SEQ ID NO: 7645816 - DNA, 22 bp, Homo sapiens
agctccctgagatgccacagca

SEQ ID NO: 7645817 - DNA, 22 bp, Homo sapiens
agctcccctcgtttctctccat

SEQ ID NO: 7645818 - DNA, 22 bp, Homo sapiens
agctccctgagatgccacagca

SEQ ID NO: 7645819 - DNA, 22 bp, Homo sapiens
agctccctgagatgccacagca

SEQ ID NO: 7645820 - DNA, 22 bp, Homo sapiens
agctccctgagatgccacagca

SEQ ID NO: 7645821 - DNA, 22 bp, Homo sapiens
agctccctgagatgccacagca

SEQ ID NO: 7645822 - DNA, 22 bp, Homo sapiens
agctcccagggctgggcaagtt

SEQ ID NO: 7645823 - DNA, 22 bp, Homo sapiens
agctcccagggctgggcaagtt

SEQ ID NO: 7645824 - DNA, 22 bp, Homo sapiens
agctcccagtctcctctccatg

SEQ ID NO: 7645825 - DNA, 22 bp, Homo sapiens
agctcccagtctcctctccatg

SEQ ID NO: 7645826 - DNA, 22 bp, Homo sapiens
agctcccagtctcctctccatg

SEQ ID NO: 7645827 - DNA, 22 bp, Homo sapiens
cagccagctggcactgtgagta

SEQ ID NO: 7645828 - DNA, 22 bp, Homo sapiens
cagccagctcaggaaggatttt

SEQ ID NO: 7645829 - DNA, 22 bp, Homo sapiens
cagccagctggcactgtgagta

SEQ ID NO: 7645830 - DNA, 22 bp, Homo sapiens
cagccagctggcactgtgagta

SEQ ID NO: 7645831 - DNA, 22 bp, Homo sapiens
agctccagggaaagagtggatc

SEQ ID NO: 7645832 - DNA, 22 bp, Homo sapiens
agctccagggaaagagtggatc

SEQ ID NO: 7645833 - DNA, 23 bp, Homo sapiens
agctccagggaacaggcagtagg

SEQ ID NO: 7645834 - DNA, 22 bp, Homo sapiens
agctccagggaaagagtggatc

SEQ ID NO: 7645835 - DNA, 22 bp, Homo sapiens
agctccagggaaagagtggatc

SEQ ID NO: 7645836 - DNA, 23 bp, Homo sapiens
agctccagggaacaggcagtagg

SEQ ID NO: 7645837 - DNA, 22 bp, Homo sapiens
agctcccagcagagctggccac

SEQ ID NO: 7645838 - DNA, 23 bp, Homo sapiens
agctccagggaacaggcagtagg

SEQ ID NO: 7645839 - DNA, 23 bp, Homo sapiens
agctccagggaacaggcagtagg

SEQ ID NO: 7645840 - DNA, 22 bp, Homo sapiens
agctcccaggcagtcatgagga

SEQ ID NO: 7645841 - DNA, 22 bp, Homo sapiens
agctcccaggcagtcatgagga

SEQ ID NO: 7645842 - DNA, 22 bp, Homo sapiens
agctcccaggcagtcatgagga

SEQ ID NO: 7645843 - DNA, 22 bp, Homo sapiens
agctcccaggcagtcatgagga

SEQ ID NO: 7645844 - DNA, 22 bp, Homo sapiens
cagccagctgaatgtaccatga

SEQ ID NO: 7645845 - DNA, 22 bp, Homo sapiens
cagccagctggcactgtgagta

SEQ ID NO: 7645846 - DNA, 22 bp, Homo sapiens
cagccagcctctcaaccatgca

SEQ ID NO: 7645847 - DNA, 22 bp, Homo sapiens
cagccagcctctcaaccatgca

SEQ ID NO: 7645848 - DNA, 22 bp, Homo sapiens
cagccagctcaggaaggatttt

SEQ ID NO: 7645849 - DNA, 22 bp, Homo sapiens
cagccagctcaggaaggatttt

SEQ ID NO: 7645850 - DNA, 22 bp, Homo sapiens
cagccagatcagggcaggggtt

SEQ ID NO: 7645851 - DNA, 22 bp, Homo sapiens
cagccagcctctcaaccatgca

SEQ ID NO: 7645852 - DNA, 22 bp, Homo sapiens
cagccagatcagggcaggggtt

SEQ ID NO: 7645853 - DNA, 22 bp, Homo sapiens
cagccagatcagggcaggggtt

SEQ ID NO: 7645854 - DNA, 22 bp, Homo sapiens
cagccagatcagggcaggggtt

SEQ ID NO: 7645855 - DNA, 22 bp, Homo sapiens
cagccagatcaaactcagatgt

SEQ ID NO: 7645856 - DNA, 22 bp, Homo sapiens
cagccagatcaaactcagatgt

SEQ ID NO: 7645857 - DNA, 22 bp, Homo sapiens
cagccagatcagggcaggggtt

SEQ ID NO: 7645858 - DNA, 22 bp, Homo sapiens
cagccagagaggaaggaatgca

SEQ ID NO: 7645859 - DNA, 22 bp, Homo sapiens
cagccagaggctgcgaggggcc

SEQ ID NO: 7645860 - DNA, 22 bp, Homo sapiens
cagccagagaggaaggaatgca

SEQ ID NO: 7645861 - DNA, 22 bp, Homo sapiens
cagccagagaggaaggaatgca

SEQ ID NO: 7645862 - DNA, 22 bp, Homo sapiens
cagccagagaaagggcactgcc

SEQ ID NO: 7645863 - DNA, 22 bp, Homo sapiens
cagccagagaggaaggaatgca

SEQ ID NO: 7645864 - DNA, 22 bp, Homo sapiens
cagccagaggctgcgaggggcc

SEQ ID NO: 7645865 - DNA, 22 bp, Homo sapiens
cagccagaggggccagagtcgg

SEQ ID NO: 7645866 - DNA, 22 bp, Homo sapiens
cagccagaggggccagagtcgg

SEQ ID NO: 7645867 - DNA, 22 bp, Homo sapiens
cagccagaggctgcgaggggcc

SEQ ID NO: 7645868 - DNA, 22 bp, Homo sapiens
cagccagaggctgcgaggggcc

SEQ ID NO: 7645869 - DNA, 22 bp, Homo sapiens
cagccagagaggaaggaatgca

SEQ ID NO: 7645870 - DNA, 22 bp, Homo sapiens
cagccagaggggccagagtcgg

SEQ ID NO: 7645871 - DNA, 22 bp, Homo sapiens
cagccagatcaaactcagatgt

SEQ ID NO: 7645872 - DNA, 22 bp, Homo sapiens
cagccagatcaaactcagatgt

SEQ ID NO: 7645873 - DNA, 22 bp, Homo sapiens
cagccagaggggccagagtcgg

SEQ ID NO: 7645874 - DNA, 22 bp, Homo sapiens
cagccagaggggccagagtcgg

SEQ ID NO: 7645875 - DNA, 22 bp, Homo sapiens
cagccctggcgcccccagatct

SEQ ID NO: 7645876 - DNA, 22 bp, Homo sapiens
cagccctggcctcttcgctttc

SEQ ID NO: 7645877 - DNA, 22 bp, Homo sapiens
cagccctggcgcccccagatct

SEQ ID NO: 7645878 - DNA, 22 bp, Homo sapiens
cagccctggcgcccccagatct

SEQ ID NO: 7645879 - DNA, 22 bp, Homo sapiens
cagccctggcgcccccagatct

SEQ ID NO: 7645880 - DNA, 22 bp, Homo sapiens
cagccctggccccaggtggtct

SEQ ID NO: 7645881 - DNA, 22 bp, Homo sapiens
cagccctggcctcttcgctttc

SEQ ID NO: 7645882 - DNA, 22 bp, Homo sapiens
cagccctggcctcttcgctttc

SEQ ID NO: 7645883 - DNA, 22 bp, Homo sapiens
cagccctggcctcttcgctttc

SEQ ID NO: 7645884 - DNA, 20 bp, Homo sapiens
agctcctctgcccattcttc

SEQ ID NO: 7645885 - DNA, 22 bp, Homo sapiens
agctcctgaaaagcgcttgctt

SEQ ID NO: 7645886 - DNA, 22 bp, Homo sapiens
agctcctgaaaagcgcttgctt

SEQ ID NO: 7645887 - DNA, 22 bp, Homo sapiens
agctcctcctgtgccaggccag

SEQ ID NO: 7645888 - DNA, 22 bp, Homo sapiens
agctcctctagatctgccactt

SEQ ID NO: 7645889 - DNA, 22 bp, Homo sapiens
agctcctctagatctgccactt

SEQ ID NO: 7645890 - DNA, 22 bp, Homo sapiens
agctcctcctgtgccaggccag

SEQ ID NO: 7645891 - DNA, 22 bp, Homo sapiens
agctcctcctgtgccaggccag

SEQ ID NO: 7645892 - DNA, 20 bp, Homo sapiens
agctcctcatcactggaggt

SEQ ID NO: 7645893 - DNA, 22 bp, Homo sapiens
agctcctcctgagtgtctggga

SEQ ID NO: 7645894 - DNA, 22 bp, Homo sapiens
agctcctcctgagtgtctggga

SEQ ID NO: 7645895 - DNA, 22 bp, Homo sapiens
agctcctactctatgccagaca

SEQ ID NO: 7645896 - DNA, 22 bp, Homo sapiens
agctcctatgagaaatatctgt

SEQ ID NO: 7645897 - DNA, 22 bp, Homo sapiens
agctcctactctatgccagaca

SEQ ID NO: 7645898 - DNA, 19 bp, Homo sapiens
agctcctcacctctcgcgg

SEQ ID NO: 7645899 - DNA, 20 bp, Homo sapiens
agctcctcatcactggaggt

SEQ ID NO: 7645900 - DNA, 19 bp, Homo sapiens
agctcctcacctctcgcgg

SEQ ID NO: 7645901 - DNA, 20 bp, Homo sapiens
agctcctcatcactggaggt

SEQ ID NO: 7645902 - DNA, 22 bp, Homo sapiens
agctccctgcacgaccctgccc

SEQ ID NO: 7645903 - DNA, 21 bp, Homo sapiens
agctccctgtttcctcactct

SEQ ID NO: 7645904 - DNA, 21 bp, Homo sapiens
agctccctgtttcctcactct

SEQ ID NO: 7645905 - DNA, 21 bp, Homo sapiens
agctccctgtttcctcactct

SEQ ID NO: 7645906 - DNA, 22 bp, Homo sapiens
agctcctactctatgccagaca

SEQ ID NO: 7645907 - DNA, 21 bp, Homo sapiens
agctccctgtttcctcactct

SEQ ID NO: 7645908 - DNA, 21 bp, Homo sapiens
agctccctgtttcctcactct

SEQ ID NO: 7645909 - DNA, 21 bp, Homo sapiens
agctccctgtttcctcactct

SEQ ID NO: 7645910 - DNA, 22 bp, Homo sapiens
cagccctgggtccctgccctgg

SEQ ID NO: 7645911 - DNA, 22 bp, Homo sapiens
cagccctgggatcttagtgcct

SEQ ID NO: 7645912 - DNA, 22 bp, Homo sapiens
cagccctgggtccctgccctgg

SEQ ID NO: 7645913 - DNA, 22 bp, Homo sapiens
cagccctgggtccctgccctgg

SEQ ID NO: 7645914 - DNA, 22 bp, Homo sapiens
cagccctgggtccctgccctgg

SEQ ID NO: 7645915 - DNA, 22 bp, Homo sapiens
cagccctgggatcttagtgcct

SEQ ID NO: 7645916 - DNA, 22 bp, Homo sapiens
cagccctgggatcttagtgcct

SEQ ID NO: 7645917 - DNA, 22 bp, Homo sapiens
cagccctgggatcttagtgcct

SEQ ID NO: 7645918 - DNA, 22 bp, Homo sapiens
cagccctgggagttggggccga

SEQ ID NO: 7645919 - DNA, 22 bp, Homo sapiens
cagccctgggagttggggccga

SEQ ID NO: 7645920 - DNA, 22 bp, Homo sapiens
cagccctgggagttggggccga

SEQ ID NO: 7645921 - DNA, 22 bp, Homo sapiens
cagccctgggagttggggccga

SEQ ID NO: 7645922 - DNA, 22 bp, Homo sapiens
cagccctgggtccctgccctgg

SEQ ID NO: 7645923 - DNA, 22 bp, Homo sapiens
cagccctgggtccctgccctgg

SEQ ID NO: 7645924 - DNA, 22 bp, Homo sapiens
cagccctgggtccctgccctgg

SEQ ID NO: 7645925 - DNA, 22 bp, Homo sapiens
cagccctgggtccctgccctgg

SEQ ID NO: 7645926 - DNA, 22 bp, Homo sapiens
cagccctgggtccctgccctgg

SEQ ID NO: 7645927 - DNA, 22 bp, Homo sapiens
cagccctgggtccctgccctgg

SEQ ID NO: 7645928 - DNA, 22 bp, Homo sapiens
agctcctgtgtgaagcctccct

SEQ ID NO: 7645929 - DNA, 22 bp, Homo sapiens
agctcctgtgtgaagcctccct

SEQ ID NO: 7645930 - DNA, 22 bp, Homo sapiens
cagccctggcgcccccagatct

SEQ ID NO: 7645931 - DNA, 22 bp, Homo sapiens
cagccctggctagggcgagggc

SEQ ID NO: 7645932 - DNA, 22 bp, Homo sapiens
cagccctggctagggcgagggc

SEQ ID NO: 7645933 - DNA, 22 bp, Homo sapiens
cagccctggctagggcgagggc

SEQ ID NO: 7645934 - DNA, 22 bp, Homo sapiens
cagccctggctagggcgagggc

SEQ ID NO: 7645935 - DNA, 22 bp, Homo sapiens
cagccctggcgcccccagatct

SEQ ID NO: 7645936 - DNA, 22 bp, Homo sapiens
cagccctggcgcccccagatct

SEQ ID NO: 7645937 - DNA, 22 bp, Homo sapiens
cagccctggcgcccccagatct

SEQ ID NO: 7645938 - DNA, 22 bp, Homo sapiens
cagccctggcgcccccagatct

SEQ ID NO: 7645939 - DNA, 22 bp, Homo sapiens
cagccctgggagttggggccga

SEQ ID NO: 7645940 - DNA, 22 bp, Homo sapiens
cagccctgggagttggggccga

SEQ ID NO: 7645941 - DNA, 22 bp, Homo sapiens
cagccctgggagttggggccga

SEQ ID NO: 7645942 - DNA, 22 bp, Homo sapiens
cagccctggctagggcgagggc

SEQ ID NO: 7645943 - DNA, 22 bp, Homo sapiens
cagccctgggagttggggccga

SEQ ID NO: 7645944 - DNA, 22 bp, Homo sapiens
cagccctggctagggcgagggc

SEQ ID NO: 7645945 - DNA, 22 bp, Homo sapiens
cagccctggctagggcgagggc

SEQ ID NO: 7645946 - DNA, 22 bp, Homo sapiens
cagccctggctagggcgagggc

SEQ ID NO: 7645947 - DNA, 22 bp, Homo sapiens
agcctttatactgtgtaaggca

SEQ ID NO: 7645948 - DNA, 22 bp, Homo sapiens
agcctttacaagcattagctca

SEQ ID NO: 7645949 - DNA, 22 bp, Homo sapiens
agcctttaaggaaaatgaataa

SEQ ID NO: 7645950 - DNA, 22 bp, Homo sapiens
agcctttaagctgccacagctg

SEQ ID NO: 7645951 - DNA, 22 bp, Homo sapiens
cagcaggaccattgaggcatca

SEQ ID NO: 7645952 - DNA, 22 bp, Homo sapiens
cagcaggaccattgaggcatca

SEQ ID NO: 7645953 - DNA, 22 bp, Homo sapiens
cagcaggaccattgaggcatca

SEQ ID NO: 7645954 - DNA, 22 bp, Homo sapiens
cagcaggacccaggaatcctgc

SEQ ID NO: 7645955 - DNA, 22 bp, Homo sapiens
cagcaggagcagtcagactcct

SEQ ID NO: 7645956 - DNA, 22 bp, Homo sapiens
cagcaggacgtccaagtgctat

SEQ ID NO: 7645957 - DNA, 22 bp, Homo sapiens
cagcaggacgtccaagtgctat

SEQ ID NO: 7645958 - DNA, 22 bp, Homo sapiens
cagcaggacgtccaagtgctat

SEQ ID NO: 7645959 - DNA, 22 bp, Homo sapiens
cagcaggacgtccaagtgctat

SEQ ID NO: 7645960 - DNA, 22 bp, Homo sapiens
cagcaggacgtccaagtgctat

SEQ ID NO: 7645961 - DNA, 22 bp, Homo sapiens
cagcaggacccaggaatcctgc

SEQ ID NO: 7645962 - DNA, 22 bp, Homo sapiens
cagcaggacccaggaatcctgc

SEQ ID NO: 7645963 - DNA, 22 bp, Homo sapiens
cagcaggacccaggaatcctgc

SEQ ID NO: 7645964 - DNA, 22 bp, Homo sapiens
cagcaggacgtccaagtgctat

SEQ ID NO: 7645965 - DNA, 22 bp, Homo sapiens
cagcaggaggcatggcttccct

SEQ ID NO: 7645966 - DNA, 22 bp, Homo sapiens
cagcaggaggcatggcttccct

SEQ ID NO: 7645967 - DNA, 23 bp, Homo sapiens
cagcaggagggtgcctgggctgc

SEQ ID NO: 7645968 - DNA, 23 bp, Homo sapiens
cagcaggagggtgcctgggctgc

SEQ ID NO: 7645969 - DNA, 23 bp, Homo sapiens
cagcaggagggtgcctgggctgc

SEQ ID NO: 7645970 - DNA, 23 bp, Homo sapiens
cagcaggagggtgcctgggctgc

SEQ ID NO: 7645971 - DNA, 23 bp, Homo sapiens
cagcaggagggtgcctgggctgc

SEQ ID NO: 7645972 - DNA, 23 bp, Homo sapiens
cagcaggagggtgcctgggctgc

SEQ ID NO: 7645973 - DNA, 23 bp, Homo sapiens
cagcaggagggtgcctgggctgc

SEQ ID NO: 7645974 - DNA, 22 bp, Homo sapiens
cagcaggaggcatggcttccct

SEQ ID NO: 7645975 - DNA, 23 bp, Homo sapiens
cagcaggagggtgcctgggctgc

SEQ ID NO: 7645976 - DNA, 22 bp, Homo sapiens
cagcaggaggcatggcttccct

SEQ ID NO: 7645977 - DNA, 22 bp, Homo sapiens
cagcaggaggcatggcttccct

SEQ ID NO: 7645978 - DNA, 22 bp, Homo sapiens
cagcaggaggcatggcttccct

SEQ ID NO: 7645979 - DNA, 22 bp, Homo sapiens
cagcaggagcagtcagactcct

SEQ ID NO: 7645980 - DNA, 22 bp, Homo sapiens
cagcaggagcagtcagactcct

SEQ ID NO: 7645981 - DNA, 22 bp, Homo sapiens
cagcaggagcagtcagactcct

SEQ ID NO: 7645982 - DNA, 22 bp, Homo sapiens
cagcaggagcagtcagactcct

SEQ ID NO: 7645983 - DNA, 22 bp, Homo sapiens
cagcaggagcagtcagactcct

SEQ ID NO: 7645984 - DNA, 22 bp, Homo sapiens
cagcaggagcagtcagactcct

SEQ ID NO: 7645985 - DNA, 22 bp, Homo sapiens
cagcaggagcagtcagactcct

SEQ ID NO: 7645986 - DNA, 22 bp, Homo sapiens
agccttgcagaataatttgaag

SEQ ID NO: 7645987 - DNA, 22 bp, Homo sapiens
agccttgcaaaatttttggcaa

SEQ ID NO: 7645988 - DNA, 22 bp, Homo sapiens
agccttgcagaataatttgaag

SEQ ID NO: 7645989 - DNA, 22 bp, Homo sapiens
agccttgcatgatttcattcat

SEQ ID NO: 7645990 - DNA, 22 bp, Homo sapiens
agccttgcatgatttcattcat

SEQ ID NO: 7645991 - DNA, 22 bp, Homo sapiens
agccttgcctgggaaactgggt

SEQ ID NO: 7645992 - DNA, 22 bp, Homo sapiens
agccttgctgcaattgttaaaa

SEQ ID NO: 7645993 - DNA, 22 bp, Homo sapiens
agccttgctttttcagtagcac

SEQ ID NO: 7645994 - DNA, 22 bp, Homo sapiens
agccttcggccagagggtggcc

SEQ ID NO: 7645995 - DNA, 22 bp, Homo sapiens
agccttctaggatgtcatctgc

SEQ ID NO: 7645996 - DNA, 22 bp, Homo sapiens
agccttcccttagagaatgagc

SEQ ID NO: 7645997 - DNA, 22 bp, Homo sapiens
agccttctaggatgtcatctgc

SEQ ID NO: 7645998 - DNA, 22 bp, Homo sapiens
agccttctctgaaattctgttt

SEQ ID NO: 7645999 - DNA, 22 bp, Homo sapiens
agccttcggccagagggtggcc

SEQ ID NO: 7646000 - DNA, 22 bp, Homo sapiens
agccttctctgaaattctgttt

SEQ ID NO: 7646001 - DNA, 22 bp, Homo sapiens
agcctttaagcagcgcagcatt

SEQ ID NO: 7646002 - DNA, 22 bp, Homo sapiens
agcctttaactggataaagtgt

SEQ ID NO: 7646003 - DNA, 22 bp, Homo sapiens
agcctttaactggataaagtgt

SEQ ID NO: 7646004 - DNA, 22 bp, Homo sapiens
agcctttaacacttcacattga

SEQ ID NO: 7646005 - DNA, 22 bp, Homo sapiens
agcctttaacacttcacattga

SEQ ID NO: 7646006 - DNA, 22 bp, Homo sapiens
agccttgtttgtagttaatagt

SEQ ID NO: 7646007 - DNA, 22 bp, Homo sapiens
agccttgttgctaccagatgcc

SEQ ID NO: 7646008 - DNA, 22 bp, Homo sapiens
agccttggtcccgcgtcagcca

SEQ ID NO: 7646009 - DNA, 22 bp, Homo sapiens
agccttgtagaccattttaagg

SEQ ID NO: 7646010 - DNA, 22 bp, Homo sapiens
agccttgtagaccattttaagg

SEQ ID NO: 7646011 - DNA, 22 bp, Homo sapiens
agccttggtcccgcgtcagcca

SEQ ID NO: 7646012 - DNA, 22 bp, Homo sapiens
agccttgttggtctgagtttgg

SEQ ID NO: 7646013 - DNA, 22 bp, Homo sapiens
agcctttaacacttcacattga

SEQ ID NO: 7646014 - DNA, 23 bp, Homo sapiens
agccttggaggttgaggctgcag

SEQ ID NO: 7646015 - DNA, 23 bp, Homo sapiens
agccttggaggttgaggctgcag

SEQ ID NO: 7646016 - DNA, 23 bp, Homo sapiens
agccttggaggttgaggctgcag

SEQ ID NO: 7646017 - DNA, 22 bp, Homo sapiens
agccttggactgaatactttag

SEQ ID NO: 7646018 - DNA, 22 bp, Homo sapiens
agccttggactgaatactttag

SEQ ID NO: 7646019 - DNA, 22 bp, Homo sapiens
agccttggtcccgcgtcagcca

SEQ ID NO: 7646020 - DNA, 22 bp, Homo sapiens
agccttgggcaatttggacact

SEQ ID NO: 7646021 - DNA, 22 bp, Homo sapiens
agccttgggcaatttggacact

SEQ ID NO: 7646022 - DNA, 22 bp, Homo sapiens
agccttgggcaatttggacact

SEQ ID NO: 7646023 - DNA, 22 bp, Homo sapiens
agccttggccgtaaggtatgct

SEQ ID NO: 7646024 - DNA, 22 bp, Homo sapiens
agccttggatgagctttatcat

SEQ ID NO: 7646025 - DNA, 22 bp, Homo sapiens
agccttggccgtaaggtatgct

SEQ ID NO: 7646026 - DNA, 22 bp, Homo sapiens
agctcaatgcaacctccgcctc

SEQ ID NO: 7646027 - DNA, 22 bp, Homo sapiens
agctcaagttttcaaatattat

SEQ ID NO: 7646028 - DNA, 22 bp, Homo sapiens
agctaggagattttgtgaggct

SEQ ID NO: 7646029 - DNA, 22 bp, Homo sapiens
agctaggataagcagagactgg

SEQ ID NO: 7646030 - DNA, 22 bp, Homo sapiens
agctaggagattttgtgaggct

SEQ ID NO: 7646031 - DNA, 22 bp, Homo sapiens
agctcacacctcatcagggtgg

SEQ ID NO: 7646032 - DNA, 22 bp, Homo sapiens
agctcaatttaaggcttggctt

SEQ ID NO: 7646033 - DNA, 22 bp, Homo sapiens
agctcaatgcaacctccgcctc

SEQ ID NO: 7646034 - DNA, 22 bp, Homo sapiens
agctcaatgcaacctccgcctc

SEQ ID NO: 7646035 - DNA, 18 bp, Homo sapiens
agctcacagatctgtttt

SEQ ID NO: 7646036 - DNA, 22 bp, Homo sapiens
agctcacagcctagcactgtga

SEQ ID NO: 7646037 - DNA, 22 bp, Homo sapiens
agctcacagaaatcctgcagga

SEQ ID NO: 7646038 - DNA, 23 bp, Homo sapiens
cagcaggagggtgcctgggctgc

SEQ ID NO: 7646039 - DNA, 23 bp, Homo sapiens
cagcaggagggtgcctgggctgc

SEQ ID NO: 7646040 - DNA, 22 bp, Homo sapiens
cagcaggaggtgagatgtgacc

SEQ ID NO: 7646041 - DNA, 22 bp, Homo sapiens
cagcaggaggtgagatgtgacc

SEQ ID NO: 7646042 - DNA, 22 bp, Homo sapiens
cagcaggaggtgagatgtgacc

SEQ ID NO: 7646043 - DNA, 22 bp, Homo sapiens
cagcaggaggtgagtagcaggt

SEQ ID NO: 7646044 - DNA, 22 bp, Homo sapiens
cagcaggaggtgagatgtgacc

SEQ ID NO: 7646045 - DNA, 22 bp, Homo sapiens
cagcaggaggtgagatgtgacc

SEQ ID NO: 7646046 - DNA, 22 bp, Homo sapiens
cagcaggaggtgagtagcaggt

SEQ ID NO: 7646047 - DNA, 22 bp, Homo sapiens
cagcaggaggtgagtagcaggt

SEQ ID NO: 7646048 - DNA, 22 bp, Homo sapiens
cagcaggaggtgagtagcaggt

SEQ ID NO: 7646049 - DNA, 22 bp, Homo sapiens
cagcaggaggtgagtagcaggt

SEQ ID NO: 7646050 - DNA, 22 bp, Homo sapiens
cagcaggaggtgagtagcaggt

SEQ ID NO: 7646051 - DNA, 22 bp, Homo sapiens
cagcaggataggtttctttgga

SEQ ID NO: 7646052 - DNA, 22 bp, Homo sapiens
cagcaggataggtttctttgga

SEQ ID NO: 7646053 - DNA, 22 bp, Homo sapiens
cagcaggaggtgagtagcaggt

SEQ ID NO: 7646054 - DNA, 22 bp, Homo sapiens
agctcagaagggaggaaatgag

SEQ ID NO: 7646055 - DNA, 22 bp, Homo sapiens
agctcagaagcctatgcatagt

SEQ ID NO: 7646056 - DNA, 22 bp, Homo sapiens
agctcagaactgcagacatgtg

SEQ ID NO: 7646057 - DNA, 22 bp, Homo sapiens
agctcagaagcctatgcatagt

SEQ ID NO: 7646058 - DNA, 22 bp, Homo sapiens
agctcagaagggaggaaatgag

SEQ ID NO: 7646059 - DNA, 22 bp, Homo sapiens
agctcagaagcctatgcatagt

SEQ ID NO: 7646060 - DNA, 22 bp, Homo sapiens
agctcagaagcctatgcatagt

SEQ ID NO: 7646061 - DNA, 22 bp, Homo sapiens
cagccagaacctaggatgagct

SEQ ID NO: 7646062 - DNA, 22 bp, Homo sapiens
agctcagaagggaggaaatgag

SEQ ID NO: 7646063 - DNA, 22 bp, Homo sapiens
cagccagagaaagggcactgcc

SEQ ID NO: 7646064 - DNA, 22 bp, Homo sapiens
cagccagaacctaggatgagct

SEQ ID NO: 7646065 - DNA, 22 bp, Homo sapiens
cagccagagaaagggcactgcc

SEQ ID NO: 7646066 - DNA, 22 bp, Homo sapiens
cagccagagaaagggcactgcc

SEQ ID NO: 7646067 - DNA, 22 bp, Homo sapiens
agctcagaactgcagacatgtg

SEQ ID NO: 7646068 - DNA, 22 bp, Homo sapiens
agctcagaagcctatgcatagt

SEQ ID NO: 7646069 - DNA, 22 bp, Homo sapiens
agctcagaactgcagacatgtg

SEQ ID NO: 7646070 - DNA, 22 bp, Homo sapiens
agctcagaactgcagacatgtg

SEQ ID NO: 7646071 - DNA, 22 bp, Homo sapiens
agctcagaactgcagacatgtg

SEQ ID NO: 7646072 - DNA, 22 bp, Homo sapiens
agctcagaactgcagacatgtg

SEQ ID NO: 7646073 - DNA, 22 bp, Homo sapiens
agctcagaactgcagacatgtg

SEQ ID NO: 7646074 - DNA, 22 bp, Homo sapiens
agctcagaactgcagacatgtg

SEQ ID NO: 7646075 - DNA, 22 bp, Homo sapiens
agctcagaactgcagacatgtg

SEQ ID NO: 7646076 - DNA, 22 bp, Homo sapiens
agctcagaaatgccagtaggta

SEQ ID NO: 7646077 - DNA, 22 bp, Homo sapiens
agctcagaaatgccagtaggta

SEQ ID NO: 7646078 - DNA, 22 bp, Homo sapiens
agctcagaaatgccagtaggta

SEQ ID NO: 7646079 - DNA, 22 bp, Homo sapiens
agctcagaaatgccagtaggta

SEQ ID NO: 7646080 - DNA, 22 bp, Homo sapiens
agctcagaacctcctcatccca

SEQ ID NO: 7646081 - DNA, 22 bp, Homo sapiens
agctcagaacctcctcatccca

SEQ ID NO: 7646082 - DNA, 22 bp, Homo sapiens
agctcagaactgcagacatgtg

SEQ ID NO: 7646083 - DNA, 22 bp, Homo sapiens
agctcagaacctcctcatccca

SEQ ID NO: 7646084 - DNA, 22 bp, Homo sapiens
agctcaccacaacctccgcctc

SEQ ID NO: 7646085 - DNA, 22 bp, Homo sapiens
agctcacattctcatcagatgt

SEQ ID NO: 7646086 - DNA, 22 bp, Homo sapiens
agctcacattctcatcagatgt

SEQ ID NO: 7646087 - DNA, 21 bp, Homo sapiens
agctcacagttctgtcctgtc

SEQ ID NO: 7646088 - DNA, 22 bp, Homo sapiens
agctcacagggagaaacgacca

SEQ ID NO: 7646089 - DNA, 21 bp, Homo sapiens
agctcacagttctgtcctgtc

SEQ ID NO: 7646090 - DNA, 22 bp, Homo sapiens
agctcacagcctagcactgtga

SEQ ID NO: 7646091 - DNA, 22 bp, Homo sapiens
agctcacagcctagcactgtga

SEQ ID NO: 7646092 - DNA, 22 bp, Homo sapiens
agctcacagggagaaacgacca

SEQ ID NO: 7646093 - DNA, 22 bp, Homo sapiens
agctcacagggagaaacgacca

SEQ ID NO: 7646094 - DNA, 22 bp, Homo sapiens
agaaacatattcagtgagtaat

SEQ ID NO: 7646095 - DNA, 22 bp, Homo sapiens
agaaacatattcagtgagtaat

SEQ ID NO: 7646096 - DNA, 22 bp, Homo sapiens
agaaacatattcagtgagtaat

SEQ ID NO: 7646097 - DNA, 22 bp, Homo sapiens
agaaacagcattagcatcaatt

SEQ ID NO: 7646098 - DNA, 22 bp, Homo sapiens
agaaacagcattagcatcaatt

SEQ ID NO: 7646099 - DNA, 22 bp, Homo sapiens
agaaacatcattggaacacaag

SEQ ID NO: 7646100 - DNA, 22 bp, Homo sapiens
agaaacatcattggaacacaag

SEQ ID NO: 7646101 - DNA, 22 bp, Homo sapiens
agaaacatcattggaacacaag

SEQ ID NO: 7646102 - DNA, 22 bp, Homo sapiens
agaaacatcattggaacacaag

SEQ ID NO: 7646103 - DNA, 22 bp, Homo sapiens
agaaacatcattggaacacaag

SEQ ID NO: 7646104 - DNA, 22 bp, Homo sapiens
agaaacatcattggaacacaag

SEQ ID NO: 7646105 - DNA, 22 bp, Homo sapiens
agaaacatcattggaacacaag

SEQ ID NO: 7646106 - DNA, 22 bp, Homo sapiens
agaaacatcattggaacacaag

SEQ ID NO: 7646107 - DNA, 22 bp, Homo sapiens
agaaacatcattggaacacaag

SEQ ID NO: 7646108 - DNA, 22 bp, Homo sapiens
agaaacatcattgtttggtatt

SEQ ID NO: 7646109 - DNA, 22 bp, Homo sapiens
agaaacatcattggaacacaag

SEQ ID NO: 7646110 - DNA, 22 bp, Homo sapiens
agaaacatcctgctttccattt

SEQ ID NO: 7646111 - DNA, 22 bp, Homo sapiens
agaaacatcctgctttccattt

SEQ ID NO: 7646112 - DNA, 22 bp, Homo sapiens
agaaacatcctgctttccattt

SEQ ID NO: 7646113 - DNA, 22 bp, Homo sapiens
agaaacatcattgtttggtatt

SEQ ID NO: 7646114 - DNA, 22 bp, Homo sapiens
agaaacatcattgtttggtatt

SEQ ID NO: 7646115 - DNA, 22 bp, Homo sapiens
agaaacagaagggaaagctttt

SEQ ID NO: 7646116 - DNA, 22 bp, Homo sapiens
agaaacagaagggaaagctttt

SEQ ID NO: 7646117 - DNA, 22 bp, Homo sapiens
agaaacagaagggaaagctttt

SEQ ID NO: 7646118 - DNA, 22 bp, Homo sapiens
agaaacagaagggaaagctttt

SEQ ID NO: 7646119 - DNA, 20 bp, Homo sapiens
agaaacagcacaattctgtt

SEQ ID NO: 7646120 - DNA, 20 bp, Homo sapiens
agaaacagcacaattctgtt

SEQ ID NO: 7646121 - DNA, 22 bp, Homo sapiens
agaaacagaagggaaagctttt

SEQ ID NO: 7646122 - DNA, 22 bp, Homo sapiens
agaaacagcattagcatcaatt

SEQ ID NO: 7646123 - DNA, 22 bp, Homo sapiens
agaaacagcattagcatcaatt

SEQ ID NO: 7646124 - DNA, 22 bp, Homo sapiens
agaaacagcattagcatcaatt

SEQ ID NO: 7646125 - DNA, 22 bp, Homo sapiens
agaaacagcattagcatcaatt

SEQ ID NO: 7646126 - DNA, 20 bp, Homo sapiens
agaaacagcacaattctgtt

SEQ ID NO: 7646127 - DNA, 20 bp, Homo sapiens
agaaacagcacaattctgtt

SEQ ID NO: 7646128 - DNA, 20 bp, Homo sapiens
agaaacagcacaattctgtt

SEQ ID NO: 7646129 - DNA, 22 bp, Homo sapiens
agaaacagcattagcatcaatt

SEQ ID NO: 7646130 - DNA, 22 bp, Homo sapiens
agaaacagcattagcatcaatt

SEQ ID NO: 7646131 - DNA, 22 bp, Homo sapiens
agaaacagcattagcatcaatt

SEQ ID NO: 7646132 - DNA, 22 bp, Homo sapiens
agaaacatcctgctttccattt

SEQ ID NO: 7646133 - DNA, 22 bp, Homo sapiens
agaaacatcgcttagtcctcat

SEQ ID NO: 7646134 - DNA, 22 bp, Homo sapiens
agaaacatcctgctttccattt

SEQ ID NO: 7646135 - DNA, 22 bp, Homo sapiens
agaaacatcctgctttccattt

SEQ ID NO: 7646136 - DNA, 22 bp, Homo sapiens
agaaacatcgcttagtcctcat

SEQ ID NO: 7646137 - DNA, 22 bp, Homo sapiens
agaaacatcgcttagtcctcat

SEQ ID NO: 7646138 - DNA, 22 bp, Homo sapiens
agaaacatcgcttagtcctcat

SEQ ID NO: 7646139 - DNA, 22 bp, Homo sapiens
agaaacatcgcttagtcctcat

SEQ ID NO: 7646140 - DNA, 22 bp, Homo sapiens
agaaacatcgcttagtcctcat

SEQ ID NO: 7646141 - DNA, 21 bp, Homo sapiens
agaaacatgatcaaaggaacc

SEQ ID NO: 7646142 - DNA, 21 bp, Homo sapiens
agaaacatgatcaaaggaacc

SEQ ID NO: 7646143 - DNA, 21 bp, Homo sapiens
agaaacatgatcaaaggaacc

SEQ ID NO: 7646144 - DNA, 21 bp, Homo sapiens
agaaacatgatcaaaggaacc

SEQ ID NO: 7646145 - DNA, 22 bp, Homo sapiens
agaaacatcttggcaactggaa

SEQ ID NO: 7646146 - DNA, 22 bp, Homo sapiens
agaaacatcttggcaactggaa

SEQ ID NO: 7646147 - DNA, 22 bp, Homo sapiens
agaaacatttagattatatgtc

SEQ ID NO: 7646148 - DNA, 22 bp, Homo sapiens
agaaacatttagattatatgtc

SEQ ID NO: 7646149 - DNA, 22 bp, Homo sapiens
agaaacatttagattatatgtc

SEQ ID NO: 7646150 - DNA, 22 bp, Homo sapiens
agaaacatttagattatatgtc

SEQ ID NO: 7646151 - DNA, 22 bp, Homo sapiens
atcaattttgaggatacaagaa

SEQ ID NO: 7646152 - DNA, 22 bp, Homo sapiens
agaaacatttagattatatgtc

SEQ ID NO: 7646153 - DNA, 22 bp, Homo sapiens
agaaacatttagattatatgtc

SEQ ID NO: 7646154 - DNA, 22 bp, Homo sapiens
agaaacatttagattatatgtc

SEQ ID NO: 7646155 - DNA, 22 bp, Homo sapiens
atcacaaaggctgcttcatgat

SEQ ID NO: 7646156 - DNA, 22 bp, Homo sapiens
atcacaaaggctgcttcatgat

SEQ ID NO: 7646157 - DNA, 22 bp, Homo sapiens
atcacaaaggctgcttcatgat

SEQ ID NO: 7646158 - DNA, 22 bp, Homo sapiens
atcacaaaggctgcttcatgat

SEQ ID NO: 7646159 - DNA, 22 bp, Homo sapiens
atcacattgccagtgattaccc

SEQ ID NO: 7646160 - DNA, 22 bp, Homo sapiens
atcacattgccagtgattaccc

SEQ ID NO: 7646161 - DNA, 21 bp, Homo sapiens
atcacattggctgttattatt

SEQ ID NO: 7646162 - DNA, 21 bp, Homo sapiens
atcacattggctgttattatt

SEQ ID NO: 7646163 - DNA, 21 bp, Homo sapiens
atcacattggctgttattatt

SEQ ID NO: 7646164 - DNA, 22 bp, Homo sapiens
atcaccaggcaaaatgtcagag

SEQ ID NO: 7646165 - DNA, 23 bp, Homo sapiens
atcaccagcggaagctgcagacc

SEQ ID NO: 7646166 - DNA, 23 bp, Homo sapiens
atcaccagcggaagctgcagacc

SEQ ID NO: 7646167 - DNA, 22 bp, Homo sapiens
atcaccaggcaaaatgtcagag

SEQ ID NO: 7646168 - DNA, 22 bp, Homo sapiens
atcaccagtaagttttcagttt

SEQ ID NO: 7646169 - DNA, 21 bp, Homo sapiens
atcaccagcagaagctgcaga

SEQ ID NO: 7646170 - DNA, 22 bp, Homo sapiens
atcaccactacaaacatcattg

SEQ ID NO: 7646171 - DNA, 21 bp, Homo sapiens
atcaccagcagaagctgcaga

SEQ ID NO: 7646172 - DNA, 22 bp, Homo sapiens
atcaccaggcaaaatgtcagag

SEQ ID NO: 7646173 - DNA, 23 bp, Homo sapiens
atcaccagcggaagctgcagacc

SEQ ID NO: 7646174 - DNA, 22 bp, Homo sapiens
atcacattgttagcatagactg

SEQ ID NO: 7646175 - DNA, 22 bp, Homo sapiens
atcacattgttagcatagactg

SEQ ID NO: 7646176 - DNA, 22 bp, Homo sapiens
atcacattgttagcatagactg

SEQ ID NO: 7646177 - DNA, 22 bp, Homo sapiens
atcacattgttagcatagactg

SEQ ID NO: 7646178 - DNA, 22 bp, Homo sapiens
atcacatttatagtggcacgca

SEQ ID NO: 7646179 - DNA, 22 bp, Homo sapiens
atcacaaaggctgcttcatgat

SEQ ID NO: 7646180 - DNA, 22 bp, Homo sapiens
atcacatttatagtggcacgca

SEQ ID NO: 7646181 - DNA, 21 bp, Homo sapiens
atcaccagcagaagctgcaga

SEQ ID NO: 7646182 - DNA, 22 bp, Homo sapiens
atcaccactacaaacatcattg

SEQ ID NO: 7646183 - DNA, 22 bp, Homo sapiens
atcaccaaggctttaggaattt

SEQ ID NO: 7646184 - DNA, 22 bp, Homo sapiens
atcacgtgctgagagtgttatt

SEQ ID NO: 7646185 - DNA, 22 bp, Homo sapiens
atcacgtgaagtccataatagt

SEQ ID NO: 7646186 - DNA, 22 bp, Homo sapiens
atcacccaagctggagtgcagt

SEQ ID NO: 7646187 - DNA, 22 bp, Homo sapiens
atcacccaggctggagtgcagt

SEQ ID NO: 7646188 - DNA, 22 bp, Homo sapiens
atcaccattgaaaaacaggttt

SEQ ID NO: 7646189 - DNA, 22 bp, Homo sapiens
atcactgatacctttattttca

SEQ ID NO: 7646190 - DNA, 22 bp, Homo sapiens
atcactgatacctttattttca

SEQ ID NO: 7646191 - DNA, 22 bp, Homo sapiens
atcactgagcttcagtgctggc

SEQ ID NO: 7646192 - DNA, 22 bp, Homo sapiens
atcactgagcttcagtgctggc

SEQ ID NO: 7646193 - DNA, 21 bp, Homo sapiens
atcactgaatgccttcaagga

SEQ ID NO: 7646194 - DNA, 22 bp, Homo sapiens
atcactgaaatactgaaattac

SEQ ID NO: 7646195 - DNA, 22 bp, Homo sapiens
atcactatgggcattatattta

SEQ ID NO: 7646196 - DNA, 22 bp, Homo sapiens
atcactatgggcattatattta

SEQ ID NO: 7646197 - DNA, 22 bp, Homo sapiens
atcacgtggtttgagagtacgc

SEQ ID NO: 7646198 - DNA, 22 bp, Homo sapiens
atcacgtggtttgagagtacgc

SEQ ID NO: 7646199 - DNA, 22 bp, Homo sapiens
atcactagagttacattgccag

SEQ ID NO: 7646200 - DNA, 22 bp, Homo sapiens
atcagaggtactttccattttt

SEQ ID NO: 7646201 - DNA, 22 bp, Homo sapiens
atcagagggtgagatggagaaa

SEQ ID NO: 7646202 - DNA, 20 bp, Homo sapiens
atcagaggatagggaagtgg

SEQ ID NO: 7646203 - DNA, 20 bp, Homo sapiens
atcagaggatagggaagtgg

SEQ ID NO: 7646204 - DNA, 20 bp, Homo sapiens
atcagaggatagggaagtgg

SEQ ID NO: 7646205 - DNA, 22 bp, Homo sapiens
atcagaggttatgtggagggga

SEQ ID NO: 7646206 - DNA, 22 bp, Homo sapiens
atcagaggttatgtggagggga

SEQ ID NO: 7646207 - DNA, 22 bp, Homo sapiens
atcagaggtgagggagagcccc

SEQ ID NO: 7646208 - DNA, 22 bp, Homo sapiens
atcagaggtggaactggggact

SEQ ID NO: 7646209 - DNA, 22 bp, Homo sapiens
atcagaggtggaactggggact

SEQ ID NO: 7646210 - DNA, 22 bp, Homo sapiens
atcagaggtgagggagagcccc

SEQ ID NO: 7646211 - DNA, 22 bp, Homo sapiens
atcagaggtactttccattttt

SEQ ID NO: 7646212 - DNA, 22 bp, Homo sapiens
atcagagtgtaagttctttcct

SEQ ID NO: 7646213 - DNA, 22 bp, Homo sapiens
atcagaggtgttgaaacatgac

SEQ ID NO: 7646214 - DNA, 22 bp, Homo sapiens
atcagagtcagaggctagagct

SEQ ID NO: 7646215 - DNA, 21 bp, Homo sapiens
atcagagtacgcatgcgctga

SEQ ID NO: 7646216 - DNA, 22 bp, Homo sapiens
atcagagtgggtctggcatgag

SEQ ID NO: 7646217 - DNA, 22 bp, Homo sapiens
atcactgttatctagaagcaca

SEQ ID NO: 7646218 - DNA, 22 bp, Homo sapiens
atcactgtggcccaaaacctca

SEQ ID NO: 7646219 - DNA, 22 bp, Homo sapiens
atcactgtgtatgtatatgcag

SEQ ID NO: 7646220 - DNA, 22 bp, Homo sapiens
atcagaggaagacgacggaatg

SEQ ID NO: 7646221 - DNA, 22 bp, Homo sapiens
atcagaggaagacgacggaatg

SEQ ID NO: 7646222 - DNA, 22 bp, Homo sapiens
atcactgatgaagttagaccta

SEQ ID NO: 7646223 - DNA, 22 bp, Homo sapiens
atcactgcacacctgaggtata

SEQ ID NO: 7646224 - DNA, 20 bp, Homo sapiens
atcactggagaaggaaacct

SEQ ID NO: 7646225 - DNA, 22 bp, Homo sapiens
atcactggagtgaaaggcaaac

SEQ ID NO: 7646226 - DNA, 22 bp, Homo sapiens
atcactgggcttctaatcactg

SEQ ID NO: 7646227 - DNA, 22 bp, Homo sapiens
atcactgtggcccaaaacctca

SEQ ID NO: 7646228 - DNA, 22 bp, Homo sapiens
atcactgtggaaaactgtatgg

SEQ ID NO: 7646229 - DNA, 22 bp, Homo sapiens
atcactgtcgtcatctgagatt

SEQ ID NO: 7646230 - DNA, 22 bp, Homo sapiens
atcactgtcgtcatctgagatt

SEQ ID NO: 7646231 - DNA, 22 bp, Homo sapiens
atcactgtggaaaactgtatgg

SEQ ID NO: 7646232 - DNA, 22 bp, Homo sapiens
atcatttatgccccaattagat

SEQ ID NO: 7646233 - DNA, 22 bp, Homo sapiens
atcatttatgccccaattagat

SEQ ID NO: 7646234 - DNA, 22 bp, Homo sapiens
atcatttatgccccaattagat

SEQ ID NO: 7646235 - DNA, 22 bp, Homo sapiens
atcatttatgccccaattagat

SEQ ID NO: 7646236 - DNA, 22 bp, Homo sapiens
atcatttagtggggcattggaa

SEQ ID NO: 7646237 - DNA, 22 bp, Homo sapiens
atcatttacaatgaaagcctga

SEQ ID NO: 7646238 - DNA, 22 bp, Homo sapiens
atcatttatgccccaattagat

SEQ ID NO: 7646239 - DNA, 22 bp, Homo sapiens
atcatttatgccccaattagat

SEQ ID NO: 7646240 - DNA, 22 bp, Homo sapiens
atcatttagtggggcattggaa

SEQ ID NO: 7646241 - DNA, 22 bp, Homo sapiens
atcatttacaatgaaagcctga

SEQ ID NO: 7646242 - DNA, 22 bp, Homo sapiens
atcatttacaatgaaagcctga

SEQ ID NO: 7646243 - DNA, 22 bp, Homo sapiens
atcatttacaatgaaagcctga

SEQ ID NO: 7646244 - DNA, 22 bp, Homo sapiens
atcatttacaaactcagcattg

SEQ ID NO: 7646245 - DNA, 22 bp, Homo sapiens
atcatttacaaactcagcattg

SEQ ID NO: 7646246 - DNA, 22 bp, Homo sapiens
atcatttacaaactcagcattg

SEQ ID NO: 7646247 - DNA, 22 bp, Homo sapiens
atcatttacaaactcagcattg

SEQ ID NO: 7646248 - DNA, 21 bp, Homo sapiens
atcattctggaaaattcaagc

SEQ ID NO: 7646249 - DNA, 21 bp, Homo sapiens
atcattctggaaaattcaagc

SEQ ID NO: 7646250 - DNA, 21 bp, Homo sapiens
atcattctggaaaattcaagc

SEQ ID NO: 7646251 - DNA, 22 bp, Homo sapiens
atcattgaatataagtgctatt

SEQ ID NO: 7646252 - DNA, 22 bp, Homo sapiens
atcattgagattttttacaact

SEQ ID NO: 7646253 - DNA, 22 bp, Homo sapiens
atcattgaaatgtagtttcatc

SEQ ID NO: 7646254 - DNA, 19 bp, Homo sapiens
atcattgatcttcacccct

SEQ ID NO: 7646255 - DNA, 22 bp, Homo sapiens
atcattggaggcactgtgcagt

SEQ ID NO: 7646256 - DNA, 22 bp, Homo sapiens
atcattgggctccattactaga

SEQ ID NO: 7646257 - DNA, 22 bp, Homo sapiens
atcattggaggcactgtgcagt

SEQ ID NO: 7646258 - DNA, 22 bp, Homo sapiens
atcatttaaaacaagtctctat

SEQ ID NO: 7646259 - DNA, 22 bp, Homo sapiens
atcattgtaaataatgctgcca

SEQ ID NO: 7646260 - DNA, 23 bp, Homo sapiens
atcattctccaatctggagcagg

SEQ ID NO: 7646261 - DNA, 23 bp, Homo sapiens
atcattctccaatctggagcagg

SEQ ID NO: 7646262 - DNA, 20 bp, Homo sapiens
atcatctttacaatgtcagt

SEQ ID NO: 7646263 - DNA, 22 bp, Homo sapiens
atcattctgatggtcaatgcta

SEQ ID NO: 7646264 - DNA, 22 bp, Homo sapiens
atcattctgatggtcaatgcta

SEQ ID NO: 7646265 - DNA, 22 bp, Homo sapiens
atcattctgatggtcaatgcta

SEQ ID NO: 7646266 - DNA, 23 bp, Homo sapiens
atcattctccaatctggagcagg

SEQ ID NO: 7646267 - DNA, 22 bp, Homo sapiens
atcattctctgcttgagcactc

SEQ ID NO: 7646268 - DNA, 22 bp, Homo sapiens
atcattctctgcttgagcactc

SEQ ID NO: 7646269 - DNA, 22 bp, Homo sapiens
atcagcaaggcaatcactgcag

SEQ ID NO: 7646270 - DNA, 22 bp, Homo sapiens
atcagcaaggcaatcactgcag

SEQ ID NO: 7646271 - DNA, 19 bp, Homo sapiens
atcagcaaggtaggatgtg

SEQ ID NO: 7646272 - DNA, 20 bp, Homo sapiens
atcatctttacaatgtcagt

SEQ ID NO: 7646273 - DNA, 20 bp, Homo sapiens
atcatctttacaatgtcagt

SEQ ID NO: 7646274 - DNA, 22 bp, Homo sapiens
atcagcaagtcctgttaattct

SEQ ID NO: 7646275 - DNA, 22 bp, Homo sapiens
atcatcttgctttctgtttact

SEQ ID NO: 7646276 - DNA, 22 bp, Homo sapiens
atcagcaagattgtgtcttgta

SEQ ID NO: 7646277 - DNA, 22 bp, Homo sapiens
atcagcaagatgtaatttctat

SEQ ID NO: 7646278 - DNA, 22 bp, Homo sapiens
atcagcaagatgtaatttctat

SEQ ID NO: 7646279 - DNA, 22 bp, Homo sapiens
atcagcaagcatggttaggtgt

SEQ ID NO: 7646280 - DNA, 22 bp, Homo sapiens
atcagcaagattgtgtcttgta

SEQ ID NO: 7646281 - DNA, 22 bp, Homo sapiens
atcagcaagcatttattgagtg

SEQ ID NO: 7646282 - DNA, 22 bp, Homo sapiens
atcagcaagatgtaatttctat

SEQ ID NO: 7646283 - DNA, 20 bp, Homo sapiens
atcagcaactgccactcagt

SEQ ID NO: 7646284 - DNA, 20 bp, Homo sapiens
atcagcaactgccactcagt

SEQ ID NO: 7646285 - DNA, 21 bp, Homo sapiens
atcagcaaatgcctgtctccc

SEQ ID NO: 7646286 - DNA, 21 bp, Homo sapiens
atcagcaaatgcctgtctccc

SEQ ID NO: 7646287 - DNA, 22 bp, Homo sapiens
atcagcaaaaatgccttcagaa

SEQ ID NO: 7646288 - DNA, 22 bp, Homo sapiens
atcagcaaaaatgccttcagaa

SEQ ID NO: 7646289 - DNA, 22 bp, Homo sapiens
atcagcaaaaatgccttcagaa

SEQ ID NO: 7646290 - DNA, 22 bp, Homo sapiens
atcatttgcctcaagtgaaagt

SEQ ID NO: 7646291 - DNA, 22 bp, Homo sapiens
atcatttccctttagatcacaa

SEQ ID NO: 7646292 - DNA, 22 bp, Homo sapiens
atcatttgcctcaagtgaaagt

SEQ ID NO: 7646293 - DNA, 22 bp, Homo sapiens
atcatttggggaattgtggaca

SEQ ID NO: 7646294 - DNA, 22 bp, Homo sapiens
atcatttgaacagaatttgttt

SEQ ID NO: 7646295 - DNA, 22 bp, Homo sapiens
atcatttgaacagaatttgttt

SEQ ID NO: 7646296 - DNA, 22 bp, Homo sapiens
atcatttccctttagatcacaa

SEQ ID NO: 7646297 - DNA, 22 bp, Homo sapiens
atcatttatgccccaattagat

SEQ ID NO: 7646298 - DNA, 22 bp, Homo sapiens
atcatttccctttagatcacaa

SEQ ID NO: 7646299 - DNA, 22 bp, Homo sapiens
atccacttgccactgtatagtt

SEQ ID NO: 7646300 - DNA, 22 bp, Homo sapiens
atcattttatggctgagaggac

SEQ ID NO: 7646301 - DNA, 22 bp, Homo sapiens
atcattttatggctgagaggac

SEQ ID NO: 7646302 - DNA, 22 bp, Homo sapiens
atcattttatggctgagaggac

SEQ ID NO: 7646303 - DNA, 22 bp, Homo sapiens
atcatttgtgcatagtaacaga

SEQ ID NO: 7646304 - DNA, 22 bp, Homo sapiens
atcatttgtgcatagtaacaga

SEQ ID NO: 7646305 - DNA, 22 bp, Homo sapiens
atccagagactggggctgggat

SEQ ID NO: 7646306 - DNA, 22 bp, Homo sapiens
atccagagacccaaggacagaa

SEQ ID NO: 7646307 - DNA, 22 bp, Homo sapiens
atccagagacccaaggacagaa

SEQ ID NO: 7646308 - DNA, 22 bp, Homo sapiens
atccagagacccaaggacagaa

SEQ ID NO: 7646309 - DNA, 22 bp, Homo sapiens
atccagagacccaaggacagaa

SEQ ID NO: 7646310 - DNA, 22 bp, Homo sapiens
atccagagacccaaggacagaa

SEQ ID NO: 7646311 - DNA, 22 bp, Homo sapiens
atccagagacccaaggacagaa

SEQ ID NO: 7646312 - DNA, 22 bp, Homo sapiens
atccagacagtctggtgccaga

SEQ ID NO: 7646313 - DNA, 22 bp, Homo sapiens
atccagaacacctgtatcacca

SEQ ID NO: 7646314 - DNA, 22 bp, Homo sapiens
atccagaacacctgtatcacca

SEQ ID NO: 7646315 - DNA, 22 bp, Homo sapiens
atccagaagcatgtgtaatttg

SEQ ID NO: 7646316 - DNA, 22 bp, Homo sapiens
atccagaagcatgtgtaatttg

SEQ ID NO: 7646317 - DNA, 22 bp, Homo sapiens
atccagaagcatgtgtaatttg

SEQ ID NO: 7646318 - DNA, 22 bp, Homo sapiens
atccagaatgtcttgctggaga

SEQ ID NO: 7646319 - DNA, 22 bp, Homo sapiens
atccagaatgtcttgctggaga

SEQ ID NO: 7646320 - DNA, 22 bp, Homo sapiens
atccagaatgtcttgctggaga

SEQ ID NO: 7646321 - DNA, 22 bp, Homo sapiens
atccagaagcatgtgtaatttg

SEQ ID NO: 7646322 - DNA, 22 bp, Homo sapiens
atccagaacacctgtatcacca

SEQ ID NO: 7646323 - DNA, 22 bp, Homo sapiens
atccagaacacctgtatcacca

SEQ ID NO: 7646324 - DNA, 22 bp, Homo sapiens
atccacttggctggttgttcta

SEQ ID NO: 7646325 - DNA, 22 bp, Homo sapiens
atccacttggctggttgttcta

SEQ ID NO: 7646326 - DNA, 22 bp, Homo sapiens
atccagagttgctgtatatctt

SEQ ID NO: 7646327 - DNA, 22 bp, Homo sapiens
atccagccagtgtggatgactt

SEQ ID NO: 7646328 - DNA, 23 bp, Homo sapiens
atccagcctgggggtttaaccac

SEQ ID NO: 7646329 - DNA, 23 bp, Homo sapiens
atccagcctgggggtttaaccac

SEQ ID NO: 7646330 - DNA, 22 bp, Homo sapiens
atccagcacttgttcatgtgaa

SEQ ID NO: 7646331 - DNA, 22 bp, Homo sapiens
atccagccagtgtggatgactt

SEQ ID NO: 7646332 - DNA, 22 bp, Homo sapiens
agaaccttccatcactccctac

SEQ ID NO: 7646333 - DNA, 22 bp, Homo sapiens
agaaccttccatcactccctac

SEQ ID NO: 7646334 - DNA, 22 bp, Homo sapiens
agaagaaatgaggccgttctgc

SEQ ID NO: 7646335 - DNA, 22 bp, Homo sapiens
agaagaaatgaggccgttctgc

SEQ ID NO: 7646336 - DNA, 22 bp, Homo sapiens
agaagaaatgaggccgttctgc

SEQ ID NO: 7646337 - DNA, 22 bp, Homo sapiens
agaagaaatgaggccgttctgc

SEQ ID NO: 7646338 - DNA, 22 bp, Homo sapiens
agaacctttctttagaaattca

SEQ ID NO: 7646339 - DNA, 22 bp, Homo sapiens
agaacctttctttagaaattca

SEQ ID NO: 7646340 - DNA, 22 bp, Homo sapiens
agaagaaatgaggccgttctgc

SEQ ID NO: 7646341 - DNA, 22 bp, Homo sapiens
atccagaggcactgccctttgt

SEQ ID NO: 7646342 - DNA, 22 bp, Homo sapiens
atccagagaggttaggtgacat

SEQ ID NO: 7646343 - DNA, 22 bp, Homo sapiens
atccagagaggttaggtgacat

SEQ ID NO: 7646344 - DNA, 22 bp, Homo sapiens
atccagagggtagcaggattag

SEQ ID NO: 7646345 - DNA, 22 bp, Homo sapiens
atccagagggtagcaggattag

SEQ ID NO: 7646346 - DNA, 22 bp, Homo sapiens
atccagagaggttaggtgacat

SEQ ID NO: 7646347 - DNA, 22 bp, Homo sapiens
atccagagtaatacagaatgca

SEQ ID NO: 7646348 - DNA, 22 bp, Homo sapiens
atccagagactggggctgggat

SEQ ID NO: 7646349 - DNA, 22 bp, Homo sapiens
atccagagacccaaggacagaa

SEQ ID NO: 7646350 - DNA, 22 bp, Homo sapiens
atccagagactggggctgggat

SEQ ID NO: 7646351 - DNA, 22 bp, Homo sapiens
atccagagaggttaggtgacat

SEQ ID NO: 7646352 - DNA, 22 bp, Homo sapiens
atccagagactggggctgggat

SEQ ID NO: 7646353 - DNA, 22 bp, Homo sapiens
atccagagaggttaggtgacat

SEQ ID NO: 7646354 - DNA, 22 bp, Homo sapiens
atccagagtggccttctttcca

SEQ ID NO: 7646355 - DNA, 22 bp, Homo sapiens
atccagagtggccttctttcca

SEQ ID NO: 7646356 - DNA, 22 bp, Homo sapiens
atccagagtaatacagaatgca

SEQ ID NO: 7646357 - DNA, 22 bp, Homo sapiens
atccagagtaatacagaatgca

SEQ ID NO: 7646358 - DNA, 22 bp, Homo sapiens
atccagagtaatacagaatgca

SEQ ID NO: 7646359 - DNA, 22 bp, Homo sapiens
atccagagtgtaattctccatg

SEQ ID NO: 7646360 - DNA, 22 bp, Homo sapiens
atccagagtgtaattctccatg

SEQ ID NO: 7646361 - DNA, 22 bp, Homo sapiens
atccagagtgtaattctccatg

SEQ ID NO: 7646362 - DNA, 22 bp, Homo sapiens
atccagagttatatccaagcag

SEQ ID NO: 7646363 - DNA, 22 bp, Homo sapiens
atccagagttatatccaagcag

SEQ ID NO: 7646364 - DNA, 22 bp, Homo sapiens
atccagagttatatccaagcag

SEQ ID NO: 7646365 - DNA, 22 bp, Homo sapiens
atccagagttgctgtatatctt

SEQ ID NO: 7646366 - DNA, 22 bp, Homo sapiens
atccagcacttgttcatgtgaa

SEQ ID NO: 7646367 - DNA, 22 bp, Homo sapiens
atccagagttatatccaagcag

SEQ ID NO: 7646368 - DNA, 22 bp, Homo sapiens
atagtttacaaaaatgatgcat

SEQ ID NO: 7646369 - DNA, 22 bp, Homo sapiens
atataatagtttcataaaggct

SEQ ID NO: 7646370 - DNA, 22 bp, Homo sapiens
atataatagtttcataaaggct

SEQ ID NO: 7646371 - DNA, 22 bp, Homo sapiens
atataatagtttcataaaggct

SEQ ID NO: 7646372 - DNA, 22 bp, Homo sapiens
atataatagtttcataaaggct

SEQ ID NO: 7646373 - DNA, 22 bp, Homo sapiens
acttggttgatgtcataaggtt

SEQ ID NO: 7646374 - DNA, 22 bp, Homo sapiens
acttggttctaactagtgtata

SEQ ID NO: 7646375 - DNA, 22 bp, Homo sapiens
acttggttctaactagtgtata

SEQ ID NO: 7646376 - DNA, 22 bp, Homo sapiens
atagtttacaaaaatgatgcat

SEQ ID NO: 7646377 - DNA, 22 bp, Homo sapiens
atagtttacaaaaatgatgcat

SEQ ID NO: 7646378 - DNA, 22 bp, Homo sapiens
acttggtggaacgtgtatttta

SEQ ID NO: 7646379 - DNA, 23 bp, Homo sapiens
acttgggcctcacaaatgttagc

SEQ ID NO: 7646380 - DNA, 23 bp, Homo sapiens
acttgggcctcacaaatgttagc

SEQ ID NO: 7646381 - DNA, 22 bp, Homo sapiens
acttgggctggagtgccgagga

SEQ ID NO: 7646382 - DNA, 22 bp, Homo sapiens
acttgggctggagtgccgagga

SEQ ID NO: 7646383 - DNA, 22 bp, Homo sapiens
acttgggctggagtgccgagga

SEQ ID NO: 7646384 - DNA, 22 bp, Homo sapiens
acttgggatttcagatgctgtg

SEQ ID NO: 7646385 - DNA, 22 bp, Homo sapiens
acttgggatttcagatgctgtg

SEQ ID NO: 7646386 - DNA, 22 bp, Homo sapiens
acttgggccatcccatagtcaa

SEQ ID NO: 7646387 - DNA, 22 bp, Homo sapiens
acttgggccatcccatagtcaa

SEQ ID NO: 7646388 - DNA, 22 bp, Homo sapiens
acttgggatggtggccagagcg

SEQ ID NO: 7646389 - DNA, 22 bp, Homo sapiens
acttgggatggtggccagagcg

SEQ ID NO: 7646390 - DNA, 22 bp, Homo sapiens
acttgggatggtggccagagcg

SEQ ID NO: 7646391 - DNA, 22 bp, Homo sapiens
acttgggagggtgtgggcagct

SEQ ID NO: 7646392 - DNA, 22 bp, Homo sapiens
acttgggagggtgtgggcagct

SEQ ID NO: 7646393 - DNA, 22 bp, Homo sapiens
acttgggagggtgtgggcagct

SEQ ID NO: 7646394 - DNA, 22 bp, Homo sapiens
acttgggaggctgaaggacatt

SEQ ID NO: 7646395 - DNA, 22 bp, Homo sapiens
acttgggaggctgaaggacatt

SEQ ID NO: 7646396 - DNA, 22 bp, Homo sapiens
atataattctcaggtttgacta

SEQ ID NO: 7646397 - DNA, 22 bp, Homo sapiens
atataattctcaggtttgacta

SEQ ID NO: 7646398 - DNA, 22 bp, Homo sapiens
atataattaatttagctgcctc

SEQ ID NO: 7646399 - DNA, 22 bp, Homo sapiens
atataattctcaggtttgacta

SEQ ID NO: 7646400 - DNA, 22 bp, Homo sapiens
atataatagtttcataaaggct

SEQ ID NO: 7646401 - DNA, 22 bp, Homo sapiens
atataatagtttcataaaggct

SEQ ID NO: 7646402 - DNA, 22 bp, Homo sapiens
atataatagtttcataaaggct

SEQ ID NO: 7646403 - DNA, 22 bp, Homo sapiens
atataatttagaaggggaaaca

SEQ ID NO: 7646404 - DNA, 22 bp, Homo sapiens
atataattgttctgaagtgttt

SEQ ID NO: 7646405 - DNA, 22 bp, Homo sapiens
atataattgttctgaagtgttt

SEQ ID NO: 7646406 - DNA, 22 bp, Homo sapiens
atataatttttggttagctcaa

SEQ ID NO: 7646407 - DNA, 22 bp, Homo sapiens
atataatttttggttagctcaa

SEQ ID NO: 7646408 - DNA, 22 bp, Homo sapiens
atataattctcaggtttgacta

SEQ ID NO: 7646409 - DNA, 22 bp, Homo sapiens
atataattctcaggtttgacta

SEQ ID NO: 7646410 - DNA, 22 bp, Homo sapiens
atataattgttctgaagtgttt

SEQ ID NO: 7646411 - DNA, 22 bp, Homo sapiens
atataattgttctgaagtgttt

SEQ ID NO: 7646412 - DNA, 22 bp, Homo sapiens
atataattgttctgaagtgttt

SEQ ID NO: 7646413 - DNA, 22 bp, Homo sapiens
atatacaaagggcaacctcgct

SEQ ID NO: 7646414 - DNA, 22 bp, Homo sapiens
atatacaaagggcaacctcgct

SEQ ID NO: 7646415 - DNA, 22 bp, Homo sapiens
atatacaaagggcaacctcgct

SEQ ID NO: 7646416 - DNA, 22 bp, Homo sapiens
atatacaaagggcaacctcgct

SEQ ID NO: 7646417 - DNA, 22 bp, Homo sapiens
atatacaaagggcaacctcgct

SEQ ID NO: 7646418 - DNA, 22 bp, Homo sapiens
atatacaaagggcaacctcgct

SEQ ID NO: 7646419 - DNA, 22 bp, Homo sapiens
atataatttttggttagctcaa

SEQ ID NO: 7646420 - DNA, 22 bp, Homo sapiens
atatacaaagggcaacctcgct

SEQ ID NO: 7646421 - DNA, 22 bp, Homo sapiens
atatacaaagggcaacctcgct

SEQ ID NO: 7646422 - DNA, 22 bp, Homo sapiens
atatacaaagggcaacctcgct

SEQ ID NO: 7646423 - DNA, 22 bp, Homo sapiens
atatacaaagggcaacctcgct

SEQ ID NO: 7646424 - DNA, 22 bp, Homo sapiens
atataatttttggttagctcaa

SEQ ID NO: 7646425 - DNA, 22 bp, Homo sapiens
atatacacatctttttaaatat

SEQ ID NO: 7646426 - DNA, 22 bp, Homo sapiens
atatacacatctttttaaatat

SEQ ID NO: 7646427 - DNA, 22 bp, Homo sapiens
atatacacatctttttaaatat

SEQ ID NO: 7646428 - DNA, 22 bp, Homo sapiens
atatacacatctttttaaatat

SEQ ID NO: 7646429 - DNA, 22 bp, Homo sapiens
atatacacatctttttaaatat

SEQ ID NO: 7646430 - DNA, 22 bp, Homo sapiens
atatacacatctttttaaatat

SEQ ID NO: 7646431 - DNA, 22 bp, Homo sapiens
atatacacagagcttatggtga

SEQ ID NO: 7646432 - DNA, 22 bp, Homo sapiens
atatacacagagcttatggtga

SEQ ID NO: 7646433 - DNA, 22 bp, Homo sapiens
atatacacatctttttaaatat

SEQ ID NO: 7646434 - DNA, 22 bp, Homo sapiens
atatacacatctttttaaatat

SEQ ID NO: 7646435 - DNA, 22 bp, Homo sapiens
atatacacagagcttatggtga

SEQ ID NO: 7646436 - DNA, 22 bp, Homo sapiens
atatacacagagcttatggtga

SEQ ID NO: 7646437 - DNA, 22 bp, Homo sapiens
actttgtataagacaataaaga

SEQ ID NO: 7646438 - DNA, 22 bp, Homo sapiens
actttgtataagacaataaaga

SEQ ID NO: 7646439 - DNA, 22 bp, Homo sapiens
atatataacctggataaggctt

SEQ ID NO: 7646440 - DNA, 22 bp, Homo sapiens
atatataacctggataaggctt

SEQ ID NO: 7646441 - DNA, 22 bp, Homo sapiens
atatataacctggataaggctt

SEQ ID NO: 7646442 - DNA, 22 bp, Homo sapiens
atatataacctggataaggctt

SEQ ID NO: 7646443 - DNA, 22 bp, Homo sapiens
atatataacctggataaggctt

SEQ ID NO: 7646444 - DNA, 22 bp, Homo sapiens
atatataacctggataaggctt

SEQ ID NO: 7646445 - DNA, 22 bp, Homo sapiens
atatattgtatctttcatgggg

SEQ ID NO: 7646446 - DNA, 22 bp, Homo sapiens
atatattgtatctttcatgggg

SEQ ID NO: 7646447 - DNA, 22 bp, Homo sapiens
atatattgtatctttcatgggg

SEQ ID NO: 7646448 - DNA, 22 bp, Homo sapiens
atatattggtgtcagaaagagt

SEQ ID NO: 7646449 - DNA, 22 bp, Homo sapiens
atatattacaaaagaggaagga

SEQ ID NO: 7646450 - DNA, 22 bp, Homo sapiens
atatattacaaaagaggaagga

SEQ ID NO: 7646451 - DNA, 22 bp, Homo sapiens
atatattcttaaagaatctgac

SEQ ID NO: 7646452 - DNA, 22 bp, Homo sapiens
actttgtaggtttcagtgaaac

SEQ ID NO: 7646453 - DNA, 22 bp, Homo sapiens
actttgtaatagtttaaggtca

SEQ ID NO: 7646454 - DNA, 22 bp, Homo sapiens
actttgtaaattgttgtgactc

SEQ ID NO: 7646455 - DNA, 22 bp, Homo sapiens
actttgtaaattgttgtgactc

SEQ ID NO: 7646456 - DNA, 22 bp, Homo sapiens
actttggtttccctgttcgtaa

SEQ ID NO: 7646457 - DNA, 22 bp, Homo sapiens
actttgtaaattgttgtgactc

SEQ ID NO: 7646458 - DNA, 22 bp, Homo sapiens
actttgtaaattgttgtgactc

SEQ ID NO: 7646459 - DNA, 22 bp, Homo sapiens
actttgtaaattgttgtgactc

SEQ ID NO: 7646460 - DNA, 22 bp, Homo sapiens
actttgtaataactcctgagtt

SEQ ID NO: 7646461 - DNA, 22 bp, Homo sapiens
actttggtgcgaagtcacttta

SEQ ID NO: 7646462 - DNA, 22 bp, Homo sapiens
actttggttataggagccaaaa

SEQ ID NO: 7646463 - DNA, 22 bp, Homo sapiens
actttggttataggagccaaaa

SEQ ID NO: 7646464 - DNA, 22 bp, Homo sapiens
actttggtgcgaagtcacttta

SEQ ID NO: 7646465 - DNA, 22 bp, Homo sapiens
actttggtgcgaagtcacttta

SEQ ID NO: 7646466 - DNA, 20 bp, Homo sapiens
actttggttattgggaccat

SEQ ID NO: 7646467 - DNA, 20 bp, Homo sapiens
actttggttattgggaccat

SEQ ID NO: 7646468 - DNA, 20 bp, Homo sapiens
actttggttattgggaccat

SEQ ID NO: 7646469 - DNA, 22 bp, Homo sapiens
actttggttcacagctgttcat

SEQ ID NO: 7646470 - DNA, 22 bp, Homo sapiens
actttggttcacagctgttcat

SEQ ID NO: 7646471 - DNA, 22 bp, Homo sapiens
actttgggcacagtgaggccag

SEQ ID NO: 7646472 - DNA, 22 bp, Homo sapiens
atatacacatgtgtatacattt

SEQ ID NO: 7646473 - DNA, 22 bp, Homo sapiens
atatacacatgtgtatacattt

SEQ ID NO: 7646474 - DNA, 22 bp, Homo sapiens
atatacacatgtgtatacattt

SEQ ID NO: 7646475 - DNA, 22 bp, Homo sapiens
atatacacatgtgtatacattt

SEQ ID NO: 7646476 - DNA, 22 bp, Homo sapiens
atatacacatgtgtatacattt

SEQ ID NO: 7646477 - DNA, 22 bp, Homo sapiens
atatacacatgtgtatacattt

SEQ ID NO: 7646478 - DNA, 22 bp, Homo sapiens
atatacacatgtgtatacattt

SEQ ID NO: 7646479 - DNA, 22 bp, Homo sapiens
atatacacatgtgtatacattt

SEQ ID NO: 7646480 - DNA, 22 bp, Homo sapiens
atatacacatctttttaaatat

SEQ ID NO: 7646481 - DNA, 20 bp, Homo sapiens
actttggggtctttctcaga

SEQ ID NO: 7646482 - DNA, 22 bp, Homo sapiens
actttgggtaagccaggtgcta

SEQ ID NO: 7646483 - DNA, 22 bp, Homo sapiens
actttgggtaagccaggtgcta

SEQ ID NO: 7646484 - DNA, 20 bp, Homo sapiens
actttggggtctttctcaga

SEQ ID NO: 7646485 - DNA, 22 bp, Homo sapiens
actttggggatctacggctgga

SEQ ID NO: 7646486 - DNA, 21 bp, Homo sapiens
actttgggcactttcctgccc

SEQ ID NO: 7646487 - DNA, 22 bp, Homo sapiens
actttggggaacttttctcctc

SEQ ID NO: 7646488 - DNA, 22 bp, Homo sapiens
actttggggaacttttctcctc

SEQ ID NO: 7646489 - DNA, 21 bp, Homo sapiens
actttgggcactttcctgccc

SEQ ID NO: 7646490 - DNA, 22 bp, Homo sapiens
actttgggtaagttgattaatc

SEQ ID NO: 7646491 - DNA, 22 bp, Homo sapiens
actttgggtaagttgattaatc

SEQ ID NO: 7646492 - DNA, 22 bp, Homo sapiens
actttgggtaagccaggtgcta

SEQ ID NO: 7646493 - DNA, 22 bp, Homo sapiens
actttgggtaagccaggtgcta

SEQ ID NO: 7646494 - DNA, 22 bp, Homo sapiens
actttggtcccatgtgtgtaaa

SEQ ID NO: 7646495 - DNA, 22 bp, Homo sapiens
actttggtcccatgtgtgtaaa

SEQ ID NO: 7646496 - DNA, 17 bp, Homo sapiens
actttggtcctgtgctc

SEQ ID NO: 7646497 - DNA, 22 bp, Homo sapiens
actttggtcccatgtgtgtaaa

SEQ ID NO: 7646498 - DNA, 17 bp, Homo sapiens
actttggtcctgtgctc

SEQ ID NO: 7646499 - DNA, 22 bp, Homo sapiens
actttggtctctgcccctggtg

SEQ ID NO: 7646500 - DNA, 22 bp, Homo sapiens
actttggtctctgcccctggtg

SEQ ID NO: 7646501 - DNA, 22 bp, Homo sapiens
actttggtgaatcagttttgtt

SEQ ID NO: 7646502 - DNA, 22 bp, Homo sapiens
actttggtgaatcagttttgtt

SEQ ID NO: 7646503 - DNA, 22 bp, Homo sapiens
actttggtcttagaggaggaat

SEQ ID NO: 7646504 - DNA, 22 bp, Homo sapiens
actttggtcttagaggaggaat

SEQ ID NO: 7646505 - DNA, 22 bp, Homo sapiens
actttggtcttagaggaggaat

SEQ ID NO: 7646506 - DNA, 22 bp, Homo sapiens
actttggtgatacagatacggc

SEQ ID NO: 7646507 - DNA, 22 bp, Homo sapiens
actttggtgatacagatacggc

SEQ ID NO: 7646508 - DNA, 22 bp, Homo sapiens
actttggtgatacagatacggc

SEQ ID NO: 7646509 - DNA, 19 bp, Homo sapiens
actttggtgattagaggga

SEQ ID NO: 7646510 - DNA, 19 bp, Homo sapiens
actttggtgattagaggga

SEQ ID NO: 7646511 - DNA, 19 bp, Homo sapiens
actttggtgattagaggga

SEQ ID NO: 7646512 - DNA, 22 bp, Homo sapiens
atatatttactctcctgttgca

SEQ ID NO: 7646513 - DNA, 22 bp, Homo sapiens
atatatttactctcctgttgca

SEQ ID NO: 7646514 - DNA, 22 bp, Homo sapiens
atatatttactctcctgttgca

SEQ ID NO: 7646515 - DNA, 22 bp, Homo sapiens
atatatttactctcctgttgca

SEQ ID NO: 7646516 - DNA, 22 bp, Homo sapiens
atatatttactctcctgttgca

SEQ ID NO: 7646517 - DNA, 22 bp, Homo sapiens
atatatttactctcctgttgca

SEQ ID NO: 7646518 - DNA, 22 bp, Homo sapiens
atatatttgagaatattcatga

SEQ ID NO: 7646519 - DNA, 22 bp, Homo sapiens
atatatttgagaatattcatga

SEQ ID NO: 7646520 - DNA, 22 bp, Homo sapiens
atatatttgagaatattcatga

SEQ ID NO: 7646521 - DNA, 22 bp, Homo sapiens
atatatttgagaatattcatga

SEQ ID NO: 7646522 - DNA, 22 bp, Homo sapiens
atatatttgagaatattcatga

SEQ ID NO: 7646523 - DNA, 22 bp, Homo sapiens
atatatttgagaatattcatga

SEQ ID NO: 7646524 - DNA, 22 bp, Homo sapiens
atatatttgagaatattcatga

SEQ ID NO: 7646525 - DNA, 22 bp, Homo sapiens
atatatttgagaatattcatga

SEQ ID NO: 7646526 - DNA, 22 bp, Homo sapiens
atatatttgagaatattcatga

SEQ ID NO: 7646527 - DNA, 22 bp, Homo sapiens
atatatttgagaatattcatga

SEQ ID NO: 7646528 - DNA, 22 bp, Homo sapiens
atatatttgagaatattcatga

SEQ ID NO: 7646529 - DNA, 22 bp, Homo sapiens
atatatttgagaatattcatga

SEQ ID NO: 7646530 - DNA, 22 bp, Homo sapiens
atatatttgagaatattcatga

SEQ ID NO: 7646531 - DNA, 22 bp, Homo sapiens
atatatttgagaatattcatga

SEQ ID NO: 7646532 - DNA, 22 bp, Homo sapiens
atatatttgagaatattcatga

SEQ ID NO: 7646533 - DNA, 22 bp, Homo sapiens
atatatttgagaatattcatga

SEQ ID NO: 7646534 - DNA, 22 bp, Homo sapiens
atatatttgagaatattcatga

SEQ ID NO: 7646535 - DNA, 22 bp, Homo sapiens
atatatttgagaatattcatga

SEQ ID NO: 7646536 - DNA, 22 bp, Homo sapiens
atatatttgagaatattcatga

SEQ ID NO: 7646537 - DNA, 22 bp, Homo sapiens
atatatttgagaatattcatga

SEQ ID NO: 7646538 - DNA, 22 bp, Homo sapiens
atatatttgagaatattcatga

SEQ ID NO: 7646539 - DNA, 22 bp, Homo sapiens
atatatttgagaatattcatga

SEQ ID NO: 7646540 - DNA, 22 bp, Homo sapiens
atatatttgagaatattcatga

SEQ ID NO: 7646541 - DNA, 22 bp, Homo sapiens
atatatttgagaatattcatga

SEQ ID NO: 7646542 - DNA, 22 bp, Homo sapiens
atatatttgagaatattcatga

SEQ ID NO: 7646543 - DNA, 22 bp, Homo sapiens
atatatttgagaatattcatga

SEQ ID NO: 7646544 - DNA, 22 bp, Homo sapiens
atatattttgaatagcctctgt

SEQ ID NO: 7646545 - DNA, 22 bp, Homo sapiens
atatattttgaatagcctctgt

SEQ ID NO: 7646546 - DNA, 22 bp, Homo sapiens
atatattttgaatagcctctgt

SEQ ID NO: 7646547 - DNA, 22 bp, Homo sapiens
atatattttgaatagcctctgt

SEQ ID NO: 7646548 - DNA, 22 bp, Homo sapiens
atatccatattacaagcagaaa

SEQ ID NO: 7646549 - DNA, 21 bp, Homo sapiens
atatcctgtaactttgctgca

SEQ ID NO: 7646550 - DNA, 22 bp, Homo sapiens
atatccttgagacgtggctact

SEQ ID NO: 7646551 - DNA, 19 bp, Homo sapiens
atatccttgagaaagggaa

SEQ ID NO: 7646552 - DNA, 22 bp, Homo sapiens
atatcctttactgtgtcacaga

SEQ ID NO: 7646553 - DNA, 22 bp, Homo sapiens
atatattttgaatagcctctgt

SEQ ID NO: 7646554 - DNA, 22 bp, Homo sapiens
atatccagcagcaggtgagtat

SEQ ID NO: 7646555 - DNA, 22 bp, Homo sapiens
atatccatagtaaaagtcatta

SEQ ID NO: 7646556 - DNA, 22 bp, Homo sapiens
atatccatagtaaaagtcatta

SEQ ID NO: 7646557 - DNA, 22 bp, Homo sapiens
atatcctttactgtgtcacaga

SEQ ID NO: 7646558 - DNA, 22 bp, Homo sapiens
atatcctttactgtgtcacaga

SEQ ID NO: 7646559 - DNA, 22 bp, Homo sapiens
atatcctttgtgtaggcaattt

SEQ ID NO: 7646560 - DNA, 22 bp, Homo sapiens
atatccttttcggaagagcagc

SEQ ID NO: 7646561 - DNA, 22 bp, Homo sapiens
atatcctttgtgtaggcaattt

SEQ ID NO: 7646562 - DNA, 22 bp, Homo sapiens
atatctcattaccttgctgttc

SEQ ID NO: 7646563 - DNA, 22 bp, Homo sapiens
atatctgtggagggcttacaaa

SEQ ID NO: 7646564 - DNA, 22 bp, Homo sapiens
atatcttctttattttgtgagg

SEQ ID NO: 7646565 - DNA, 22 bp, Homo sapiens
atatcttctttattttgtgagg

SEQ ID NO: 7646566 - DNA, 22 bp, Homo sapiens
atatcttggccccaggatttta

SEQ ID NO: 7646567 - DNA, 22 bp, Homo sapiens
atatcttggccccaggatttta

SEQ ID NO: 7646568 - DNA, 22 bp, Homo sapiens
atatctttcaaagccaaaagta

SEQ ID NO: 7646569 - DNA, 21 bp, Homo sapiens
atatcttcttcaaaccactca

SEQ ID NO: 7646570 - DNA, 22 bp, Homo sapiens
atatctgtggagggcttacaaa

SEQ ID NO: 7646571 - DNA, 22 bp, Homo sapiens
atatctgtggagggcttacaaa

SEQ ID NO: 7646572 - DNA, 18 bp, Homo sapiens
atatctgtgggatggaga

SEQ ID NO: 7646573 - DNA, 22 bp, Homo sapiens
atatgaaaatgttttagctgta

SEQ ID NO: 7646574 - DNA, 22 bp, Homo sapiens
atatgaaaatgttttagctgta

SEQ ID NO: 7646575 - DNA, 22 bp, Homo sapiens
atatgaaaagaagtcaccattg

SEQ ID NO: 7646576 - DNA, 22 bp, Homo sapiens
atatgaaaagaagtcaccattg

SEQ ID NO: 7646577 - DNA, 22 bp, Homo sapiens
atatgaaaagaagtcaccattg

SEQ ID NO: 7646578 - DNA, 22 bp, Homo sapiens
atatgaaaagaagtcaccattg

SEQ ID NO: 7646579 - DNA, 22 bp, Homo sapiens
atatgaaaagaagtcaccattg

SEQ ID NO: 7646580 - DNA, 22 bp, Homo sapiens
atatgaaaagaagtcaccattg

SEQ ID NO: 7646581 - DNA, 22 bp, Homo sapiens
atatcttttagagcaagcttgt

SEQ ID NO: 7646582 - DNA, 22 bp, Homo sapiens
atatctttcaaagccaaaagta

SEQ ID NO: 7646583 - DNA, 22 bp, Homo sapiens
atatctttcaaagccaaaagta

SEQ ID NO: 7646584 - DNA, 22 bp, Homo sapiens
atatctttgtttttgccaagat

SEQ ID NO: 7646585 - DNA, 22 bp, Homo sapiens
atatctttgtttttgccaagat

SEQ ID NO: 7646586 - DNA, 22 bp, Homo sapiens
atatctttgtatggttcagcag

SEQ ID NO: 7646587 - DNA, 22 bp, Homo sapiens
atatctttgtttttgccaagat

SEQ ID NO: 7646588 - DNA, 22 bp, Homo sapiens
atatctttgtttttgccaagat

SEQ ID NO: 7646589 - DNA, 22 bp, Homo sapiens
atatcttttagagcaagcttgt

SEQ ID NO: 7646590 - DNA, 22 bp, Homo sapiens
atatctttgtttttgccaagat

SEQ ID NO: 7646591 - DNA, 22 bp, Homo sapiens
atatcttttagagcaagcttgt

SEQ ID NO: 7646592 - DNA, 22 bp, Homo sapiens
atatcttttagagcaagcttgt

SEQ ID NO: 7646593 - DNA, 22 bp, Homo sapiens
atatgaaagtaagcatgtgtgt

SEQ ID NO: 7646594 - DNA, 22 bp, Homo sapiens
atatgaaagtaagcatgtgtgt

SEQ ID NO: 7646595 - DNA, 22 bp, Homo sapiens
atatgaaagtaagcatgtgtgt

SEQ ID NO: 7646596 - DNA, 22 bp, Homo sapiens
atatgaaagtaagcatgtgtgt

SEQ ID NO: 7646597 - DNA, 22 bp, Homo sapiens
atatgaaaatgttttagctgta

SEQ ID NO: 7646598 - DNA, 22 bp, Homo sapiens
atatgaaaatgttttagctgta

SEQ ID NO: 7646599 - DNA, 22 bp, Homo sapiens
agaaaataaattgatggtggaa

SEQ ID NO: 7646600 - DNA, 22 bp, Homo sapiens
agaaaataaattgatggtggaa

SEQ ID NO: 7646601 - DNA, 22 bp, Homo sapiens
agaaaataaattgatggtggaa

SEQ ID NO: 7646602 - DNA, 22 bp, Homo sapiens
agaaaataaattgatggtggaa

SEQ ID NO: 7646603 - DNA, 22 bp, Homo sapiens
agaaaattagattttactgtgt

SEQ ID NO: 7646604 - DNA, 22 bp, Homo sapiens
agaaaattagattttactgtgt

SEQ ID NO: 7646605 - DNA, 22 bp, Homo sapiens
agaaaatttaaagagacacaca

SEQ ID NO: 7646606 - DNA, 22 bp, Homo sapiens
agaaaatttaaagagacacaca

SEQ ID NO: 7646607 - DNA, 22 bp, Homo sapiens
agaaaatttaaagagacacaca

SEQ ID NO: 7646608 - DNA, 22 bp, Homo sapiens
agaaaattagattttactgtgt

SEQ ID NO: 7646609 - DNA, 22 bp, Homo sapiens
agaaaattagattttactgtgt

SEQ ID NO: 7646610 - DNA, 22 bp, Homo sapiens
agaaaattagattttactgtgt

SEQ ID NO: 7646611 - DNA, 22 bp, Homo sapiens
agaaaatttaaagagacacaca

SEQ ID NO: 7646612 - DNA, 22 bp, Homo sapiens
agaaaatttaaagagacacaca

SEQ ID NO: 7646613 - DNA, 22 bp, Homo sapiens
agaaaatttaaagagacacaca

SEQ ID NO: 7646614 - DNA, 22 bp, Homo sapiens
agaaaatttaaagagacacaca

SEQ ID NO: 7646615 - DNA, 22 bp, Homo sapiens
agaaaatttaaagagacacaca

SEQ ID NO: 7646616 - DNA, 22 bp, Homo sapiens
agaaaatttaaagagacacaca

SEQ ID NO: 7646617 - DNA, 22 bp, Homo sapiens
agaaacaacttgtttctcttgc

SEQ ID NO: 7646618 - DNA, 22 bp, Homo sapiens
agaaacaacttgtttctcttgc

SEQ ID NO: 7646619 - DNA, 22 bp, Homo sapiens
agaaacaacttgtttctcttgc

SEQ ID NO: 7646620 - DNA, 22 bp, Homo sapiens
agaaacaacttgtttctcttgc

SEQ ID NO: 7646621 - DNA, 22 bp, Homo sapiens
agaaaatttattcatgttagtt

SEQ ID NO: 7646622 - DNA, 22 bp, Homo sapiens
agaaaatttattcatgttagtt

SEQ ID NO: 7646623 - DNA, 22 bp, Homo sapiens
agaaaatttattcatgttagtt

SEQ ID NO: 7646624 - DNA, 22 bp, Homo sapiens
agaaaatttattcatgttagtt

SEQ ID NO: 7646625 - DNA, 22 bp, Homo sapiens
agaaaatttattcatgttagtt

SEQ ID NO: 7646626 - DNA, 22 bp, Homo sapiens
agaaaatttattcatgttagtt

SEQ ID NO: 7646627 - DNA, 22 bp, Homo sapiens
agaaacaacttgtttctcttgc

SEQ ID NO: 7646628 - DNA, 22 bp, Homo sapiens
agaaacaacttgtttctcttgc

SEQ ID NO: 7646629 - DNA, 22 bp, Homo sapiens
agaaacaacttgtttctcttgc

SEQ ID NO: 7646630 - DNA, 22 bp, Homo sapiens
agaaacaacttgtttctcttgc

SEQ ID NO: 7646631 - DNA, 22 bp, Homo sapiens
agaaacaacttgtttctcttgc

SEQ ID NO: 7646632 - DNA, 22 bp, Homo sapiens
agaaacaaggtgtaggttgacc

SEQ ID NO: 7646633 - DNA, 22 bp, Homo sapiens
agaaacaaggtgtaggttgacc

SEQ ID NO: 7646634 - DNA, 22 bp, Homo sapiens
agaaacaaggtgtaggttgacc

SEQ ID NO: 7646635 - DNA, 22 bp, Homo sapiens
agaaacaaggtgtaggttgacc

SEQ ID NO: 7646636 - DNA, 22 bp, Homo sapiens
agaaacaaggtgtaggttgacc

SEQ ID NO: 7646637 - DNA, 22 bp, Homo sapiens
agaaacaaggtgtaggttgacc

SEQ ID NO: 7646638 - DNA, 22 bp, Homo sapiens
agaaacagaagggaaagctttt

SEQ ID NO: 7646639 - DNA, 22 bp, Homo sapiens
agaaacagaagggaaagctttt

SEQ ID NO: 7646640 - DNA, 22 bp, Homo sapiens
agaaacagaaccaggtgtcatt

SEQ ID NO: 7646641 - DNA, 22 bp, Homo sapiens
agaaacagaaccaggtgtcatt

SEQ ID NO: 7646642 - DNA, 22 bp, Homo sapiens
agaaacagaaccaggtgtcatt

SEQ ID NO: 7646643 - DNA, 22 bp, Homo sapiens
agaaacagaaccaggtgtcatt

SEQ ID NO: 7646644 - DNA, 22 bp, Homo sapiens
agaaacagaaccaggtgtcatt

SEQ ID NO: 7646645 - DNA, 22 bp, Homo sapiens
agaaacagaaccaggtgtcatt

SEQ ID NO: 7646646 - DNA, 22 bp, Homo sapiens
agaaacaaggtgtaggttgacc

SEQ ID NO: 7646647 - DNA, 22 bp, Homo sapiens
agaaacaaggtgtaggttgacc

SEQ ID NO: 7646648 - DNA, 22 bp, Homo sapiens
actgtgtattcctatatagtaa

SEQ ID NO: 7646649 - DNA, 22 bp, Homo sapiens
actgtgtattcctatatagtaa

SEQ ID NO: 7646650 - DNA, 22 bp, Homo sapiens
actgtgtattcctatatagtaa

SEQ ID NO: 7646651 - DNA, 22 bp, Homo sapiens
actgtgtattctaatgactaaa

SEQ ID NO: 7646652 - DNA, 20 bp, Homo sapiens
actgtgtaaacatgattcat

SEQ ID NO: 7646653 - DNA, 20 bp, Homo sapiens
actgtgtaaacatgattcat

SEQ ID NO: 7646654 - DNA, 20 bp, Homo sapiens
actgtgtaaacatgattcat

SEQ ID NO: 7646655 - DNA, 22 bp, Homo sapiens
actgtgtaaatctgaaagtcta

SEQ ID NO: 7646656 - DNA, 22 bp, Homo sapiens
actgtgtaaatctgaaagtcta

SEQ ID NO: 7646657 - DNA, 22 bp, Homo sapiens
actgtgtatgatatgtactggg

SEQ ID NO: 7646658 - DNA, 22 bp, Homo sapiens
actgtgggtcccagctgtgtct

SEQ ID NO: 7646659 - DNA, 22 bp, Homo sapiens
actgtgggtgagggcaaatcaa

SEQ ID NO: 7646660 - DNA, 18 bp, Homo sapiens
actgtggtttatgtgtag

SEQ ID NO: 7646661 - DNA, 18 bp, Homo sapiens
actgtggtttatgtgtag

SEQ ID NO: 7646662 - DNA, 22 bp, Homo sapiens
agtttccttggattcaatttgg

SEQ ID NO: 7646663 - DNA, 22 bp, Homo sapiens
agtttccttggattcaatttgg

SEQ ID NO: 7646664 - DNA, 22 bp, Homo sapiens
agtttcctcatgttaatatgga

SEQ ID NO: 7646665 - DNA, 22 bp, Homo sapiens
agtttcctcatgttaatatgga

SEQ ID NO: 7646666 - DNA, 22 bp, Homo sapiens
agtttcctgggagattcttaca

SEQ ID NO: 7646667 - DNA, 22 bp, Homo sapiens
agtttctaacatatagcattgg

SEQ ID NO: 7646668 - DNA, 22 bp, Homo sapiens
agtttccttgggcatttgttta

SEQ ID NO: 7646669 - DNA, 22 bp, Homo sapiens
agtttctaacatatagcattgg

SEQ ID NO: 7646670 - DNA, 22 bp, Homo sapiens
agtttccttgggcatttgttta

SEQ ID NO: 7646671 - DNA, 22 bp, Homo sapiens
agtttccttgggcatttgttta

SEQ ID NO: 7646672 - DNA, 22 bp, Homo sapiens
actgtgccttcttattgggtcc

SEQ ID NO: 7646673 - DNA, 22 bp, Homo sapiens
agtttctaacatatagcattgg

SEQ ID NO: 7646674 - DNA, 22 bp, Homo sapiens
agtttctaacatatagcattgg

SEQ ID NO: 7646675 - DNA, 22 bp, Homo sapiens
actgtgccacaattcaccaggg

SEQ ID NO: 7646676 - DNA, 22 bp, Homo sapiens
actgtgcctttcacttgcactt

SEQ ID NO: 7646677 - DNA, 22 bp, Homo sapiens
actgtgccttcttattgggtcc

SEQ ID NO: 7646678 - DNA, 22 bp, Homo sapiens
actgtggggttcctggtacttg

SEQ ID NO: 7646679 - DNA, 22 bp, Homo sapiens
actgtgctatctactgaattat

SEQ ID NO: 7646680 - DNA, 23 bp, Homo sapiens
agtttccacccagggtagaaggg

SEQ ID NO: 7646681 - DNA, 22 bp, Homo sapiens
agtttccactggagacactgtg

SEQ ID NO: 7646682 - DNA, 22 bp, Homo sapiens
agtttccagcacagggcaagct

SEQ ID NO: 7646683 - DNA, 22 bp, Homo sapiens
agtttccagcacagggcaagct

SEQ ID NO: 7646684 - DNA, 22 bp, Homo sapiens
agtttccactggagacactgtg

SEQ ID NO: 7646685 - DNA, 22 bp, Homo sapiens
agtttccatcccacacttgctt

SEQ ID NO: 7646686 - DNA, 22 bp, Homo sapiens
agtttccaggcaggagctaatt

SEQ ID NO: 7646687 - DNA, 22 bp, Homo sapiens
agtttccaggcaggagctaatt

SEQ ID NO: 7646688 - DNA, 22 bp, Homo sapiens
agtttccaggcaggagctaatt

SEQ ID NO: 7646689 - DNA, 22 bp, Homo sapiens
agtttcccccttcacagcttaa

SEQ ID NO: 7646690 - DNA, 19 bp, Homo sapiens
agtttccctggagacatca

SEQ ID NO: 7646691 - DNA, 21 bp, Homo sapiens
agtttcctcatctgcatagga

SEQ ID NO: 7646692 - DNA, 21 bp, Homo sapiens
agtttcctcaactgcagaagg

SEQ ID NO: 7646693 - DNA, 21 bp, Homo sapiens
agtttcctcaactgcagaagg

SEQ ID NO: 7646694 - DNA, 21 bp, Homo sapiens
agtttcctcaactgcagaagg

SEQ ID NO: 7646695 - DNA, 21 bp, Homo sapiens
agtttcctcaactgcagaagg

SEQ ID NO: 7646696 - DNA, 21 bp, Homo sapiens
agtttcctcatctgcatagga

SEQ ID NO: 7646697 - DNA, 21 bp, Homo sapiens
agtttcctcatctgcatagga

SEQ ID NO: 7646698 - DNA, 22 bp, Homo sapiens
agtttcctcatctgtaaaatga

SEQ ID NO: 7646699 - DNA, 22 bp, Homo sapiens
agtttcctcatgttaatatgga

SEQ ID NO: 7646700 - DNA, 22 bp, Homo sapiens
agtttcctcatctgtaaaatga

SEQ ID NO: 7646701 - DNA, 22 bp, Homo sapiens
agtttcctcatgttaatatgga

SEQ ID NO: 7646702 - DNA, 22 bp, Homo sapiens
agtttcctcatctgtaaaatga

SEQ ID NO: 7646703 - DNA, 22 bp, Homo sapiens
agtttcatgtagccatatttac

SEQ ID NO: 7646704 - DNA, 22 bp, Homo sapiens
agtttcattgagatgtttgcta

SEQ ID NO: 7646705 - DNA, 22 bp, Homo sapiens
agtttcattgagatgtttgcta

SEQ ID NO: 7646706 - DNA, 21 bp, Homo sapiens
actgtgactgggtgtatgggt

SEQ ID NO: 7646707 - DNA, 22 bp, Homo sapiens
actgtgactgagcattcacatg

SEQ ID NO: 7646708 - DNA, 20 bp, Homo sapiens
actgtgaatgctgaattagc

SEQ ID NO: 7646709 - DNA, 23 bp, Homo sapiens
agtttccacccagggtagaaggg

SEQ ID NO: 7646710 - DNA, 22 bp, Homo sapiens
actgtgagcagcgacctgagga

SEQ ID NO: 7646711 - DNA, 22 bp, Homo sapiens
agtttccaaagcatgttcacac

SEQ ID NO: 7646712 - DNA, 22 bp, Homo sapiens
agtttccaaagcatgttcacac

SEQ ID NO: 7646713 - DNA, 22 bp, Homo sapiens
agtttccaaatattgttttagc

SEQ ID NO: 7646714 - DNA, 22 bp, Homo sapiens
agtttccaaaaggagacaggga

SEQ ID NO: 7646715 - DNA, 22 bp, Homo sapiens
agtttccaaaaggagacaggga

SEQ ID NO: 7646716 - DNA, 22 bp, Homo sapiens
agtttcatttcttagtaccagt

SEQ ID NO: 7646717 - DNA, 22 bp, Homo sapiens
agtttccaaaaggagacaggga

SEQ ID NO: 7646718 - DNA, 22 bp, Homo sapiens
agtttccaaaaggagacaggga

SEQ ID NO: 7646719 - DNA, 22 bp, Homo sapiens
agtttcatttcttagtaccagt

SEQ ID NO: 7646720 - DNA, 22 bp, Homo sapiens
agtttcatttcttagtaccagt

SEQ ID NO: 7646721 - DNA, 22 bp, Homo sapiens
agtttcatttcttagtaccagt

SEQ ID NO: 7646722 - DNA, 22 bp, Homo sapiens
actgtcttgtgttaaagaacca

SEQ ID NO: 7646723 - DNA, 22 bp, Homo sapiens
actgtcttgctatgagctccca

SEQ ID NO: 7646724 - DNA, 22 bp, Homo sapiens
actgtcttgctatgagctccca

SEQ ID NO: 7646725 - DNA, 22 bp, Homo sapiens
actgtcttgctatgagctccca

SEQ ID NO: 7646726 - DNA, 22 bp, Homo sapiens
actgtcttccaggtctggaggt

SEQ ID NO: 7646727 - DNA, 22 bp, Homo sapiens
actgtcttgttccaagactaaa

SEQ ID NO: 7646728 - DNA, 22 bp, Homo sapiens
actgtcttgttccaagactaaa

SEQ ID NO: 7646729 - DNA, 22 bp, Homo sapiens
actgtcttgttccaagactaaa

SEQ ID NO: 7646730 - DNA, 22 bp, Homo sapiens
actgtcttgtgttaaagaacca

SEQ ID NO: 7646731 - DNA, 17 bp, Homo sapiens
actgtcttttacaccct

SEQ ID NO: 7646732 - DNA, 22 bp, Homo sapiens
actgtctttgagctggaggagg

SEQ ID NO: 7646733 - DNA, 22 bp, Homo sapiens
actgtctttattagaatcttat

SEQ ID NO: 7646734 - DNA, 22 bp, Homo sapiens
actgtctttattagaatcttat

SEQ ID NO: 7646735 - DNA, 22 bp, Homo sapiens
actgtctttattagaatcttat

SEQ ID NO: 7646736 - DNA, 22 bp, Homo sapiens
actgtgaaagctaacatcttag

SEQ ID NO: 7646737 - DNA, 17 bp, Homo sapiens
actgtcttttacaccct

SEQ ID NO: 7646738 - DNA, 22 bp, Homo sapiens
actgtgaaagctaacatcttag

SEQ ID NO: 7646739 - DNA, 22 bp, Homo sapiens
actgtgaacggactgaagccca

SEQ ID NO: 7646740 - DNA, 22 bp, Homo sapiens
actgtgaacggactgaagccca

SEQ ID NO: 7646741 - DNA, 22 bp, Homo sapiens
actgtgaacggactgaagccca

SEQ ID NO: 7646742 - DNA, 22 bp, Homo sapiens
actgtgaacggactgaagccca

SEQ ID NO: 7646743 - DNA, 22 bp, Homo sapiens
actgtgaacggactgaagccca

SEQ ID NO: 7646744 - DNA, 22 bp, Homo sapiens
actgtgaacggactgaagccca

SEQ ID NO: 7646745 - DNA, 22 bp, Homo sapiens
actgtgaacggactgaagccca

SEQ ID NO: 7646746 - DNA, 22 bp, Homo sapiens
actgtgaacggactgaagccca

SEQ ID NO: 7646747 - DNA, 22 bp, Homo sapiens
actgtgaacggactgaagccca

SEQ ID NO: 7646748 - DNA, 21 bp, Homo sapiens
actgtgaagatgctataaact

SEQ ID NO: 7646749 - DNA, 21 bp, Homo sapiens
actgtgaagatgctataaact

SEQ ID NO: 7646750 - DNA, 21 bp, Homo sapiens
actgtgaagatgctataaact

SEQ ID NO: 7646751 - DNA, 22 bp, Homo sapiens
actgtgaatcactactagtaga

SEQ ID NO: 7646752 - DNA, 22 bp, Homo sapiens
actgtgaatcactactagtaga

SEQ ID NO: 7646753 - DNA, 22 bp, Homo sapiens
actgtgaatcactactagtaga

SEQ ID NO: 7646754 - DNA, 22 bp, Homo sapiens
actgtgaatcactactagtaga

SEQ ID NO: 7646755 - DNA, 20 bp, Homo sapiens
actgtgaatgctgaattagc

SEQ ID NO: 7646756 - DNA, 22 bp, Homo sapiens
actgtgaatcactactagtaga

SEQ ID NO: 7646757 - DNA, 20 bp, Homo sapiens
actgtgaatgctgaattagc

SEQ ID NO: 7646758 - DNA, 22 bp, Homo sapiens
actgtctgctggcccctggtta

SEQ ID NO: 7646759 - DNA, 22 bp, Homo sapiens
actgtcatgatcgaagatgtca

SEQ ID NO: 7646760 - DNA, 22 bp, Homo sapiens
actgtctggaggcagagaggga

SEQ ID NO: 7646761 - DNA, 22 bp, Homo sapiens
actgtctgctggcccctggtta

SEQ ID NO: 7646762 - DNA, 20 bp, Homo sapiens
actgtctggggacctcatta

SEQ ID NO: 7646763 - DNA, 22 bp, Homo sapiens
actgtctgtacttcttgcaagg

SEQ ID NO: 7646764 - DNA, 22 bp, Homo sapiens
actgtctggatggaagccagcg

SEQ ID NO: 7646765 - DNA, 22 bp, Homo sapiens
actgtctggatggaagccagcg

SEQ ID NO: 7646766 - DNA, 20 bp, Homo sapiens
actgtctggggacctcatta

SEQ ID NO: 7646767 - DNA, 22 bp, Homo sapiens
actgtctggaggcagagaggga

SEQ ID NO: 7646768 - DNA, 22 bp, Homo sapiens
actgtcttcaaatgaatatatt

SEQ ID NO: 7646769 - DNA, 22 bp, Homo sapiens
actgtcttcaaatgaatatatt

SEQ ID NO: 7646770 - DNA, 23 bp, Homo sapiens
actgtctgtgcttttttagggct

SEQ ID NO: 7646771 - DNA, 22 bp, Homo sapiens
actgtctgtgccagatgctggg

SEQ ID NO: 7646772 - DNA, 22 bp, Homo sapiens
actgtctgtgccagatgctggg

SEQ ID NO: 7646773 - DNA, 22 bp, Homo sapiens
actgtctgtgccagatgctggg

SEQ ID NO: 7646774 - DNA, 22 bp, Homo sapiens
actgtctgtctcccaattatgc

SEQ ID NO: 7646775 - DNA, 22 bp, Homo sapiens
actgtctgtctcccaattatgc

SEQ ID NO: 7646776 - DNA, 22 bp, Homo sapiens
actgtctgtacttcttgcaagg

SEQ ID NO: 7646777 - DNA, 22 bp, Homo sapiens
actgtctgtagacatttttggt

SEQ ID NO: 7646778 - DNA, 22 bp, Homo sapiens
actgtctgtcctgctctccgtg

SEQ ID NO: 7646779 - DNA, 22 bp, Homo sapiens
actgtctgtcctgctctccgtg

SEQ ID NO: 7646780 - DNA, 22 bp, Homo sapiens
actgtaaattacataagaacag

SEQ ID NO: 7646781 - DNA, 22 bp, Homo sapiens
actgtaaattacataagaacag

SEQ ID NO: 7646782 - DNA, 22 bp, Homo sapiens
actgtaaattacataagaacag

SEQ ID NO: 7646783 - DNA, 22 bp, Homo sapiens
actgtaaattacataagaacag

SEQ ID NO: 7646784 - DNA, 22 bp, Homo sapiens
actgtaaattacataagaacag

SEQ ID NO: 7646785 - DNA, 22 bp, Homo sapiens
actgtaaattttggttgcaggt

SEQ ID NO: 7646786 - DNA, 22 bp, Homo sapiens
actgtaaattttggttgcaggt

SEQ ID NO: 7646787 - DNA, 22 bp, Homo sapiens
actgtcatcttgtaagcaatgt

SEQ ID NO: 7646788 - DNA, 22 bp, Homo sapiens
actgtcatgacgtttgtcaccc

SEQ ID NO: 7646789 - DNA, 22 bp, Homo sapiens
actgtcatgatcgaagatgtca

SEQ ID NO: 7646790 - DNA, 22 bp, Homo sapiens
actgtaaagaggtgtatcttta

SEQ ID NO: 7646791 - DNA, 22 bp, Homo sapiens
actgtaaagaggtgtatcttta

SEQ ID NO: 7646792 - DNA, 22 bp, Homo sapiens
actgtaaagaggtgtatcttta

SEQ ID NO: 7646793 - DNA, 22 bp, Homo sapiens
actgtaaaggtgattagaagtt

SEQ ID NO: 7646794 - DNA, 22 bp, Homo sapiens
actgtaaagcttttctcatgcg

SEQ ID NO: 7646795 - DNA, 22 bp, Homo sapiens
actgtaaagcttttctcatgcg

SEQ ID NO: 7646796 - DNA, 22 bp, Homo sapiens
actgtaaagcttttctcatgcg

SEQ ID NO: 7646797 - DNA, 22 bp, Homo sapiens
actgtaaaggtgattagaagtt

SEQ ID NO: 7646798 - DNA, 22 bp, Homo sapiens
actgtaaagttacgatcaagtt

SEQ ID NO: 7646799 - DNA, 22 bp, Homo sapiens
actgtaaaggtgattagaagtt

SEQ ID NO: 7646800 - DNA, 22 bp, Homo sapiens
actgtaaaggtttgtagcccag

SEQ ID NO: 7646801 - DNA, 22 bp, Homo sapiens
agtttactctggtgacaattta

SEQ ID NO: 7646802 - DNA, 22 bp, Homo sapiens
agtttactctggtgacaattta

SEQ ID NO: 7646803 - DNA, 22 bp, Homo sapiens
agtttacccactgttgaaatta

SEQ ID NO: 7646804 - DNA, 22 bp, Homo sapiens
agtttacccactgttgaaatta

SEQ ID NO: 7646805 - DNA, 22 bp, Homo sapiens
agtttactctggtgacaattta

SEQ ID NO: 7646806 - DNA, 22 bp, Homo sapiens
agtttacttgaatgatgaattc

SEQ ID NO: 7646807 - DNA, 22 bp, Homo sapiens
agtttagaaaatctgtttcttc

SEQ ID NO: 7646808 - DNA, 22 bp, Homo sapiens
agtttacatgacgtgtatttca

SEQ ID NO: 7646809 - DNA, 22 bp, Homo sapiens
agtttacatgacgtgtatttca

SEQ ID NO: 7646810 - DNA, 22 bp, Homo sapiens
agtttacatgacgtgtatttca

SEQ ID NO: 7646811 - DNA, 22 bp, Homo sapiens
agtttacatgacgtgtatttca

SEQ ID NO: 7646812 - DNA, 22 bp, Homo sapiens
agtttacatgacgtgtatttca

SEQ ID NO: 7646813 - DNA, 22 bp, Homo sapiens
agtttacatgacgtgtatttca

SEQ ID NO: 7646814 - DNA, 22 bp, Homo sapiens
agtttacatatttgtcggagtc

SEQ ID NO: 7646815 - DNA, 22 bp, Homo sapiens
agtttacatcttcaatctcatt

SEQ ID NO: 7646816 - DNA, 22 bp, Homo sapiens
agtttacatcttcaatctcatt

SEQ ID NO: 7646817 - DNA, 22 bp, Homo sapiens
agtttacataaaaaggcagagg

SEQ ID NO: 7646818 - DNA, 22 bp, Homo sapiens
agtttacataaaaaggcagagg

SEQ ID NO: 7646819 - DNA, 22 bp, Homo sapiens
agtttacataaaaaggcagagg

SEQ ID NO: 7646820 - DNA, 22 bp, Homo sapiens
agtttacataaaaaggcagagg

SEQ ID NO: 7646821 - DNA, 22 bp, Homo sapiens
agtttacatcttcaatctcatt

SEQ ID NO: 7646822 - DNA, 22 bp, Homo sapiens
agtttacatcttcaatctcatt

SEQ ID NO: 7646823 - DNA, 22 bp, Homo sapiens
agtttacatcttcaatctcatt

SEQ ID NO: 7646824 - DNA, 22 bp, Homo sapiens
agtttacatcttcaatctcatt

SEQ ID NO: 7646825 - DNA, 22 bp, Homo sapiens
agtttacatcttcaatctcatt

SEQ ID NO: 7646826 - DNA, 22 bp, Homo sapiens
agtttacatcttcaatctcatt

SEQ ID NO: 7646827 - DNA, 22 bp, Homo sapiens
agtttacatcttcaatctcatt

SEQ ID NO: 7646828 - DNA, 22 bp, Homo sapiens
agtttagtataccagtacatct

SEQ ID NO: 7646829 - DNA, 22 bp, Homo sapiens
agtttataaaacattgcgtggc

SEQ ID NO: 7646830 - DNA, 22 bp, Homo sapiens
agtttagtttgttcttggctca

SEQ ID NO: 7646831 - DNA, 22 bp, Homo sapiens
agtttagtttgttcttggctca

SEQ ID NO: 7646832 - DNA, 22 bp, Homo sapiens
agtttatagcccagattcatgg

SEQ ID NO: 7646833 - DNA, 22 bp, Homo sapiens
agtttatagcccagattcatgg

SEQ ID NO: 7646834 - DNA, 22 bp, Homo sapiens
agtttatagcccagattcatgg

SEQ ID NO: 7646835 - DNA, 22 bp, Homo sapiens
agtttatagcccagattcatgg

SEQ ID NO: 7646836 - DNA, 22 bp, Homo sapiens
agtttatgaaacacagatttga

SEQ ID NO: 7646837 - DNA, 18 bp, Homo sapiens
agtttatgagccactgcc

SEQ ID NO: 7646838 - DNA, 22 bp, Homo sapiens
agtttagacaaagtcttgcatt

SEQ ID NO: 7646839 - DNA, 22 bp, Homo sapiens
agtttagaagaggaacttgtta

SEQ ID NO: 7646840 - DNA, 22 bp, Homo sapiens
agtttagaaaatctgtttcttc

SEQ ID NO: 7646841 - DNA, 22 bp, Homo sapiens
agtttagaagaggaacttgtta

SEQ ID NO: 7646842 - DNA, 22 bp, Homo sapiens
agtttagaagaggaacttgtta

SEQ ID NO: 7646843 - DNA, 22 bp, Homo sapiens
agtttagacaaagtcttgcatt

SEQ ID NO: 7646844 - DNA, 21 bp, Homo sapiens
agtttagaccaagcctttcca

SEQ ID NO: 7646845 - DNA, 20 bp, Homo sapiens
agtttagaggccaacaagcc

SEQ ID NO: 7646846 - DNA, 22 bp, Homo sapiens
agtttagagttcaaattagttc

SEQ ID NO: 7646847 - DNA, 22 bp, Homo sapiens
agtttagagttcaaattagttc

SEQ ID NO: 7646848 - DNA, 22 bp, Homo sapiens
agtttagcatttgaagttattc

SEQ ID NO: 7646849 - DNA, 22 bp, Homo sapiens
agtttaggaaacaattacctta

SEQ ID NO: 7646850 - DNA, 22 bp, Homo sapiens
agtttaggaaacaattacctta

SEQ ID NO: 7646851 - DNA, 22 bp, Homo sapiens
agtttaggcaggctcctatggt

SEQ ID NO: 7646852 - DNA, 22 bp, Homo sapiens
agtttaggcaggctcctatggt

SEQ ID NO: 7646853 - DNA, 22 bp, Homo sapiens
actgtaaaatgagatatgtata

SEQ ID NO: 7646854 - DNA, 22 bp, Homo sapiens
actgtaaaatgagatatgtata

SEQ ID NO: 7646855 - DNA, 22 bp, Homo sapiens
actgtaaaatgagatatgtata

SEQ ID NO: 7646856 - DNA, 22 bp, Homo sapiens
actgtaaaatacataagtattg

SEQ ID NO: 7646857 - DNA, 22 bp, Homo sapiens
actgtaaaatacataagtattg

SEQ ID NO: 7646858 - DNA, 22 bp, Homo sapiens
actgtaaaatacataagtattg

SEQ ID NO: 7646859 - DNA, 22 bp, Homo sapiens
actgtaaaactgctttggaaac

SEQ ID NO: 7646860 - DNA, 22 bp, Homo sapiens
actgtaaaatacataagtattg

SEQ ID NO: 7646861 - DNA, 22 bp, Homo sapiens
actgtaaaatacataagtattg

SEQ ID NO: 7646862 - DNA, 22 bp, Homo sapiens
actgtaaaatacataagtattg

SEQ ID NO: 7646863 - DNA, 22 bp, Homo sapiens
actgtaaaagaaggtctttgca

SEQ ID NO: 7646864 - DNA, 22 bp, Homo sapiens
actgtaaaatacataagtattg

SEQ ID NO: 7646865 - DNA, 22 bp, Homo sapiens
actgtaaaatgagatatgtata

SEQ ID NO: 7646866 - DNA, 22 bp, Homo sapiens
actgtaaagaagtaagtatggg

SEQ ID NO: 7646867 - DNA, 22 bp, Homo sapiens
actgtaaagaagtaagtatggg

SEQ ID NO: 7646868 - DNA, 22 bp, Homo sapiens
actgtaaagagaactgtgggct

SEQ ID NO: 7646869 - DNA, 22 bp, Homo sapiens
actgtaaaatgagatatgtata

SEQ ID NO: 7646870 - DNA, 22 bp, Homo sapiens
actgtaaaatgagatatgtata

SEQ ID NO: 7646871 - DNA, 22 bp, Homo sapiens
actgtaaaatgagatatgtata

SEQ ID NO: 7646872 - DNA, 22 bp, Homo sapiens
actgtaaaatgagatatgtata

SEQ ID NO: 7646873 - DNA, 22 bp, Homo sapiens
actgtaaaacaggtttcatcat

SEQ ID NO: 7646874 - DNA, 22 bp, Homo sapiens
actgtaaaacaggtttcatcat

SEQ ID NO: 7646875 - DNA, 22 bp, Homo sapiens
actgtaaaacaggtttcatcat

SEQ ID NO: 7646876 - DNA, 22 bp, Homo sapiens
actgtaaaactgctttggaaac

SEQ ID NO: 7646877 - DNA, 22 bp, Homo sapiens
actggtttttctcatgaaaatg

SEQ ID NO: 7646878 - DNA, 22 bp, Homo sapiens
actggtttttctcatgaaaatg

SEQ ID NO: 7646879 - DNA, 22 bp, Homo sapiens
actggttttggaaatcagtaca

SEQ ID NO: 7646880 - DNA, 22 bp, Homo sapiens
actggtttttccatatgagatg

SEQ ID NO: 7646881 - DNA, 22 bp, Homo sapiens
actggtttttccatatgagatg

SEQ ID NO: 7646882 - DNA, 17 bp, Homo sapiens
actggttttggcagcat

SEQ ID NO: 7646883 - DNA, 22 bp, Homo sapiens
actggttttccaggttacttct

SEQ ID NO: 7646884 - DNA, 22 bp, Homo sapiens
actggttttccaggttacttct

SEQ ID NO: 7646885 - DNA, 22 bp, Homo sapiens
actggtttgtctattgtcattc

SEQ ID NO: 7646886 - DNA, 22 bp, Homo sapiens
actggtttgtctattgtcattc

SEQ ID NO: 7646887 - DNA, 22 bp, Homo sapiens
agtttatgtaaaattagtaatg

SEQ ID NO: 7646888 - DNA, 22 bp, Homo sapiens
agtttatgataactggtgacct

SEQ ID NO: 7646889 - DNA, 19 bp, Homo sapiens
agtttatgcagatactggt

SEQ ID NO: 7646890 - DNA, 22 bp, Homo sapiens
agtttacactatgaaaagacta

SEQ ID NO: 7646891 - DNA, 22 bp, Homo sapiens
agtttacactatgaaaagacta

SEQ ID NO: 7646892 - DNA, 22 bp, Homo sapiens
agtttacactatgaaaagacta

SEQ ID NO: 7646893 - DNA, 22 bp, Homo sapiens
agtttacactatgaaaagacta

SEQ ID NO: 7646894 - DNA, 22 bp, Homo sapiens
agtttacactatgaaaagacta

SEQ ID NO: 7646895 - DNA, 22 bp, Homo sapiens
agtttacacttttgattcttat

SEQ ID NO: 7646896 - DNA, 22 bp, Homo sapiens
agtttacacttttgattcttat

SEQ ID NO: 7646897 - DNA, 22 bp, Homo sapiens
agtttacacttttgattcttat

SEQ ID NO: 7646898 - DNA, 22 bp, Homo sapiens
agtttacagatgctacaggagc

SEQ ID NO: 7646899 - DNA, 22 bp, Homo sapiens
agtttacagatgctacaggagc

SEQ ID NO: 7646900 - DNA, 22 bp, Homo sapiens
agtttacagatgctacaggagc

SEQ ID NO: 7646901 - DNA, 22 bp, Homo sapiens
agtttacagatgctacaggagc

SEQ ID NO: 7646902 - DNA, 22 bp, Homo sapiens
agtttacagatgctacaggagc

SEQ ID NO: 7646903 - DNA, 22 bp, Homo sapiens
agtttacagttctcatcgcaac

SEQ ID NO: 7646904 - DNA, 22 bp, Homo sapiens
agtttacagttctcatcgcaac

SEQ ID NO: 7646905 - DNA, 22 bp, Homo sapiens
agtttacagttctcatcgcaac

SEQ ID NO: 7646906 - DNA, 22 bp, Homo sapiens
agtttacagatgctacaggagc

SEQ ID NO: 7646907 - DNA, 22 bp, Homo sapiens
agtttacagatgctacaggagc

SEQ ID NO: 7646908 - DNA, 22 bp, Homo sapiens
agtttacagatgctacaggagc

SEQ ID NO: 7646909 - DNA, 22 bp, Homo sapiens
agttgccttcccccagagccaa

SEQ ID NO: 7646910 - DNA, 22 bp, Homo sapiens
agttgctacctctctgtgctcc

SEQ ID NO: 7646911 - DNA, 22 bp, Homo sapiens
agttgctatcgtgaagcacgtg

SEQ ID NO: 7646912 - DNA, 21 bp, Homo sapiens
agtttacaactgtccagcccc

SEQ ID NO: 7646913 - DNA, 22 bp, Homo sapiens
agttgctcaatgtggctgtgga

SEQ ID NO: 7646914 - DNA, 22 bp, Homo sapiens
actggcagtttgagaatgcatt

SEQ ID NO: 7646915 - DNA, 22 bp, Homo sapiens
agttgcagccttcaggagaccc

SEQ ID NO: 7646916 - DNA, 21 bp, Homo sapiens
agttgcataggccagccatcc

SEQ ID NO: 7646917 - DNA, 22 bp, Homo sapiens
actggcagtgtcgtttacatga

SEQ ID NO: 7646918 - DNA, 19 bp, Homo sapiens
actggcagtttctgcatgg

SEQ ID NO: 7646919 - DNA, 22 bp, Homo sapiens
actggcagtgtcgtttacatga

SEQ ID NO: 7646920 - DNA, 22 bp, Homo sapiens
actggcagtttgagaatgcatt

SEQ ID NO: 7646921 - DNA, 22 bp, Homo sapiens
actggcagtttgagaatgcatt

SEQ ID NO: 7646922 - DNA, 19 bp, Homo sapiens
actggcagtttctgcatgg

SEQ ID NO: 7646923 - DNA, 22 bp, Homo sapiens
actggcaggctgctggccggcg

SEQ ID NO: 7646924 - DNA, 22 bp, Homo sapiens
actggcaggctgctggccggcg

SEQ ID NO: 7646925 - DNA, 22 bp, Homo sapiens
actggcaggctgctggccggcg

SEQ ID NO: 7646926 - DNA, 19 bp, Homo sapiens
actggcagctgtagtctgt

SEQ ID NO: 7646927 - DNA, 22 bp, Homo sapiens
actggcagctgtaggatgcatg

SEQ ID NO: 7646928 - DNA, 22 bp, Homo sapiens
actggcagctgtaggatgcatg

SEQ ID NO: 7646929 - DNA, 22 bp, Homo sapiens
actggcagctgtaggatgcatg

SEQ ID NO: 7646930 - DNA, 20 bp, Homo sapiens
actggcagcctgcctgctgt

SEQ ID NO: 7646931 - DNA, 20 bp, Homo sapiens
actggcagcctgcctgctgt

SEQ ID NO: 7646932 - DNA, 20 bp, Homo sapiens
actggcagcctgcctgctgt

SEQ ID NO: 7646933 - DNA, 22 bp, Homo sapiens
actggcagtagagggagcgcat

SEQ ID NO: 7646934 - DNA, 22 bp, Homo sapiens
actggcagtagagggagcgcat

SEQ ID NO: 7646935 - DNA, 22 bp, Homo sapiens
actggcaggtccatcgcccttt

SEQ ID NO: 7646936 - DNA, 22 bp, Homo sapiens
actggcagggggagccccgaga

SEQ ID NO: 7646937 - DNA, 19 bp, Homo sapiens
actggcagggctgcggtgg

SEQ ID NO: 7646938 - DNA, 19 bp, Homo sapiens
actggcagggctgcggtgg

SEQ ID NO: 7646939 - DNA, 19 bp, Homo sapiens
actggcagggctgcggtgg

SEQ ID NO: 7646940 - DNA, 22 bp, Homo sapiens
actggcagtagagggagcgcat

SEQ ID NO: 7646941 - DNA, 22 bp, Homo sapiens
actggcagtggcagcagaaaga

SEQ ID NO: 7646942 - DNA, 22 bp, Homo sapiens
actggcagtggcagcagaaaga

SEQ ID NO: 7646943 - DNA, 22 bp, Homo sapiens
actggcagtggcagcagaaaga

SEQ ID NO: 7646944 - DNA, 22 bp, Homo sapiens
actggcagtggcagcagaaaga

SEQ ID NO: 7646945 - DNA, 22 bp, Homo sapiens
actgtgtgaggctgggtgagtc

SEQ ID NO: 7646946 - DNA, 22 bp, Homo sapiens
actgtgtgaggctgggtgagtc

SEQ ID NO: 7646947 - DNA, 20 bp, Homo sapiens
actgtgtgatctggaaagct

SEQ ID NO: 7646948 - DNA, 20 bp, Homo sapiens
actgtgtgatctggaaagct

SEQ ID NO: 7646949 - DNA, 22 bp, Homo sapiens
actgtgtgctggacatgatgtt

SEQ ID NO: 7646950 - DNA, 22 bp, Homo sapiens
actgtgtgccctgacgccaggg

SEQ ID NO: 7646951 - DNA, 22 bp, Homo sapiens
actgtgtgccctgacgccaggg

SEQ ID NO: 7646952 - DNA, 20 bp, Homo sapiens
actgtgtgatctggaaagct

SEQ ID NO: 7646953 - DNA, 22 bp, Homo sapiens
actgtgtgctggacatgatgtt

SEQ ID NO: 7646954 - DNA, 22 bp, Homo sapiens
actgtgtgctggacatgatgtt

SEQ ID NO: 7646955 - DNA, 22 bp, Homo sapiens
actgtgtggaaatttgtgaggg

SEQ ID NO: 7646956 - DNA, 22 bp, Homo sapiens
actgtgtggaaatttgtgaggg

SEQ ID NO: 7646957 - DNA, 22 bp, Homo sapiens
actgtgtgctggacatgatgtt

SEQ ID NO: 7646958 - DNA, 19 bp, Homo sapiens
actgtgtggaagtgtgatt

SEQ ID NO: 7646959 - DNA, 19 bp, Homo sapiens
actgtgtggaagtgtgatt

SEQ ID NO: 7646960 - DNA, 22 bp, Homo sapiens
actgtgtggaaatttgtgaggg

SEQ ID NO: 7646961 - DNA, 22 bp, Homo sapiens
actgtgtctagcaccacgtgtc

SEQ ID NO: 7646962 - DNA, 22 bp, Homo sapiens
actgtgtgaaacatcaatgtgt

SEQ ID NO: 7646963 - DNA, 18 bp, Homo sapiens
actgtgtgaattagctcc

SEQ ID NO: 7646964 - DNA, 22 bp, Homo sapiens
actgtgtcctatttccttgaca

SEQ ID NO: 7646965 - DNA, 22 bp, Homo sapiens
actgtgtcctatttccttgaca

SEQ ID NO: 7646966 - DNA, 22 bp, Homo sapiens
actgtgtcctatttccttgaca

SEQ ID NO: 7646967 - DNA, 22 bp, Homo sapiens
actgtgtcctcatgtggcagaa

SEQ ID NO: 7646968 - DNA, 22 bp, Homo sapiens
actgtgtcctcatgtggcagaa

SEQ ID NO: 7646969 - DNA, 22 bp, Homo sapiens
actgttagccttccataacaca

SEQ ID NO: 7646970 - DNA, 20 bp, Homo sapiens
actgttagtatacttgtgcc

SEQ ID NO: 7646971 - DNA, 22 bp, Homo sapiens
actgttagatgctaagcaaatg

SEQ ID NO: 7646972 - DNA, 22 bp, Homo sapiens
actgttacagggcactgaacat

SEQ ID NO: 7646973 - DNA, 22 bp, Homo sapiens
actgttaagtatgaagtaaggc

SEQ ID NO: 7646974 - DNA, 22 bp, Homo sapiens
actgttaattcaatcaacaggt

SEQ ID NO: 7646975 - DNA, 22 bp, Homo sapiens
actgttacagagcaggaaattg

SEQ ID NO: 7646976 - DNA, 21 bp, Homo sapiens
actgttaagacgtagctgggg

SEQ ID NO: 7646977 - DNA, 22 bp, Homo sapiens
actgttaacggtatgatgctcg

SEQ ID NO: 7646978 - DNA, 22 bp, Homo sapiens
actgttaaagtaattaattgtc

SEQ ID NO: 7646979 - DNA, 22 bp, Homo sapiens
actgtgtttctgaaacaagagg

SEQ ID NO: 7646980 - DNA, 22 bp, Homo sapiens
actgtgtttctgaaacaagagg

SEQ ID NO: 7646981 - DNA, 22 bp, Homo sapiens
actgttaaagtaattaattgtc

SEQ ID NO: 7646982 - DNA, 22 bp, Homo sapiens
actgtgttgtctcaacctgacc

SEQ ID NO: 7646983 - DNA, 22 bp, Homo sapiens
actgtgtttcacctgagtatgg

SEQ ID NO: 7646984 - DNA, 22 bp, Homo sapiens
actgtgttgtctcaacctgacc

SEQ ID NO: 7646985 - DNA, 22 bp, Homo sapiens
actgtgttcacacttacaaatg

SEQ ID NO: 7646986 - DNA, 22 bp, Homo sapiens
actgtgttaaatacagagatgg

SEQ ID NO: 7646987 - DNA, 22 bp, Homo sapiens
actgtgttaaatacagagatgg

SEQ ID NO: 7646988 - DNA, 22 bp, Homo sapiens
actgtgttcaattaaaaagctt

SEQ ID NO: 7646989 - DNA, 22 bp, Homo sapiens
actgtgttaaatacagagatgg

SEQ ID NO: 7646990 - DNA, 22 bp, Homo sapiens
actgtgtggaccactctgaggc

SEQ ID NO: 7646991 - DNA, 19 bp, Homo sapiens
actgtgtggaagtgtgatt

SEQ ID NO: 7646992 - DNA, 22 bp, Homo sapiens
actgtgtgggccgctcactggg

SEQ ID NO: 7646993 - DNA, 22 bp, Homo sapiens
actgtgtggaccactctgaggc

SEQ ID NO: 7646994 - DNA, 22 bp, Homo sapiens
acttcaaatctcttgaaagcaa

SEQ ID NO: 7646995 - DNA, 19 bp, Homo sapiens
acttcaaatcttagagaaa

SEQ ID NO: 7646996 - DNA, 19 bp, Homo sapiens
acttcaaatcttagagaaa

SEQ ID NO: 7646997 - DNA, 22 bp, Homo sapiens
acttcaaattctgggggaagag

SEQ ID NO: 7646998 - DNA, 22 bp, Homo sapiens
acttcaaatgtgacaatgtgaa

SEQ ID NO: 7646999 - DNA, 22 bp, Homo sapiens
acttcaaatgtgacaatgtgaa

SEQ ID NO: 7647000 - DNA, 22 bp, Homo sapiens
acttcaaatgtgacaatgtgaa

SEQ ID NO: 7647001 - DNA, 22 bp, Homo sapiens
acttcaaatgtgacaatgtgaa

SEQ ID NO: 7647002 - DNA, 22 bp, Homo sapiens
acttcaaacaattaacagagaa

SEQ ID NO: 7647003 - DNA, 22 bp, Homo sapiens
acttcaaacaattaacagagaa

SEQ ID NO: 7647004 - DNA, 22 bp, Homo sapiens
acttcaaatctcttgaaagcaa

SEQ ID NO: 7647005 - DNA, 22 bp, Homo sapiens
acttcaaacaattaacagagaa

SEQ ID NO: 7647006 - DNA, 22 bp, Homo sapiens
acttcaaacaattaacagagaa

SEQ ID NO: 7647007 - DNA, 22 bp, Homo sapiens
acttcaaacaattaacagagaa

SEQ ID NO: 7647008 - DNA, 22 bp, Homo sapiens
acttcaaacaattaacagagaa

SEQ ID NO: 7647009 - DNA, 22 bp, Homo sapiens
acttcaaaatgagtttcctggt

SEQ ID NO: 7647010 - DNA, 22 bp, Homo sapiens
acttcaaaatgagtttcctggt

SEQ ID NO: 7647011 - DNA, 22 bp, Homo sapiens
acttcaaaatgagtttcctggt

SEQ ID NO: 7647012 - DNA, 22 bp, Homo sapiens
acttcaaaaataagtgagaggt

SEQ ID NO: 7647013 - DNA, 22 bp, Homo sapiens
acttatttcttggatgatcctg

SEQ ID NO: 7647014 - DNA, 22 bp, Homo sapiens
acttatttcatggatcataatg

SEQ ID NO: 7647015 - DNA, 22 bp, Homo sapiens
acttagaattaaatatttttgg

SEQ ID NO: 7647016 - DNA, 22 bp, Homo sapiens
actgttatgggtgtcagcttaa

SEQ ID NO: 7647017 - DNA, 22 bp, Homo sapiens
acttagaattaaatatttttgg

SEQ ID NO: 7647018 - DNA, 22 bp, Homo sapiens
actgttatgatttacacagtcc

SEQ ID NO: 7647019 - DNA, 22 bp, Homo sapiens
actgttatgatttacacagtcc

SEQ ID NO: 7647020 - DNA, 20 bp, Homo sapiens
actgttagtatacttgtgcc

SEQ ID NO: 7647021 - DNA, 22 bp, Homo sapiens
acttcacatttgcaagtcttgg

SEQ ID NO: 7647022 - DNA, 22 bp, Homo sapiens
acttcagagaaagagggaattc

SEQ ID NO: 7647023 - DNA, 22 bp, Homo sapiens
acttcagaaaatgttgaatgtt

SEQ ID NO: 7647024 - DNA, 22 bp, Homo sapiens
acttcagagaaagagggaattc

SEQ ID NO: 7647025 - DNA, 22 bp, Homo sapiens
acttcagagactttatggtcca

SEQ ID NO: 7647026 - DNA, 22 bp, Homo sapiens
acttcagagactttatggtcca

SEQ ID NO: 7647027 - DNA, 22 bp, Homo sapiens
acttcagagactttatggtcca

SEQ ID NO: 7647028 - DNA, 22 bp, Homo sapiens
acttcagagttagttatagacc

SEQ ID NO: 7647029 - DNA, 22 bp, Homo sapiens
acttcagagttagttatagacc

SEQ ID NO: 7647030 - DNA, 22 bp, Homo sapiens
acttcacaggttttcataaaac

SEQ ID NO: 7647031 - DNA, 22 bp, Homo sapiens
acttcacattagctaaaaggga

SEQ ID NO: 7647032 - DNA, 22 bp, Homo sapiens
acttcacaggttttcataaaac

SEQ ID NO: 7647033 - DNA, 22 bp, Homo sapiens
acttcacagatatttatttggt

SEQ ID NO: 7647034 - DNA, 22 bp, Homo sapiens
acttcacaggttttcataaaac

SEQ ID NO: 7647035 - DNA, 22 bp, Homo sapiens
acttcacaggttttcataaaac

SEQ ID NO: 7647036 - DNA, 22 bp, Homo sapiens
acttcaaattttcagaagaaat

SEQ ID NO: 7647037 - DNA, 22 bp, Homo sapiens
acttcaaattttcagaagaaat

SEQ ID NO: 7647038 - DNA, 22 bp, Homo sapiens
acttcaaattttcagaagaaat

SEQ ID NO: 7647039 - DNA, 22 bp, Homo sapiens
acttcaaattttcagaagaaat

SEQ ID NO: 7647040 - DNA, 22 bp, Homo sapiens
acttcaaattttcagaagaaat

SEQ ID NO: 7647041 - DNA, 22 bp, Homo sapiens
acttcacaaagagatcatctaa

SEQ ID NO: 7647042 - DNA, 22 bp, Homo sapiens
acttcacaaagagatcatctaa

SEQ ID NO: 7647043 - DNA, 17 bp, Homo sapiens
acttcaagttcagtgac

SEQ ID NO: 7647044 - DNA, 17 bp, Homo sapiens
acttcaagttcagtgac

SEQ ID NO: 7647045 - DNA, 17 bp, Homo sapiens
acttcaagttcagtgac

SEQ ID NO: 7647046 - DNA, 22 bp, Homo sapiens
acttcacagaaattttatgagg

SEQ ID NO: 7647047 - DNA, 22 bp, Homo sapiens
acttcacacagcaaatttatct

SEQ ID NO: 7647048 - DNA, 22 bp, Homo sapiens
acttcacagaaattttatgagg

SEQ ID NO: 7647049 - DNA, 22 bp, Homo sapiens
acttcacaaagagatcatctaa

SEQ ID NO: 7647050 - DNA, 22 bp, Homo sapiens
acttcacaaagagatcatctaa

SEQ ID NO: 7647051 - DNA, 22 bp, Homo sapiens
acttcacaaagagatcatctaa

SEQ ID NO: 7647052 - DNA, 22 bp, Homo sapiens
acttcacaaagagatcatctaa

SEQ ID NO: 7647053 - DNA, 22 bp, Homo sapiens
acttcacaactgtacatggcag

SEQ ID NO: 7647054 - DNA, 22 bp, Homo sapiens
acttcacaactgtacatggcag

SEQ ID NO: 7647055 - DNA, 22 bp, Homo sapiens
acttgcatgttatttttatagg

SEQ ID NO: 7647056 - DNA, 22 bp, Homo sapiens
acttgcattatatttatcacaa

SEQ ID NO: 7647057 - DNA, 22 bp, Homo sapiens
acttgcatgttatttttatagg

SEQ ID NO: 7647058 - DNA, 22 bp, Homo sapiens
acttgcatgtgtaaatcttcct

SEQ ID NO: 7647059 - DNA, 22 bp, Homo sapiens
acttgcatgctatttgttgaac

SEQ ID NO: 7647060 - DNA, 22 bp, Homo sapiens
acttgcatgatcctgagagtat

SEQ ID NO: 7647061 - DNA, 22 bp, Homo sapiens
acttgcatgattttatgttgat

SEQ ID NO: 7647062 - DNA, 22 bp, Homo sapiens
acttgcatgattaatttggtga

SEQ ID NO: 7647063 - DNA, 22 bp, Homo sapiens
acttgccccagaattgctgctg

SEQ ID NO: 7647064 - DNA, 22 bp, Homo sapiens
acttgccccagaattgctgctg

SEQ ID NO: 7647065 - DNA, 22 bp, Homo sapiens
acttgccataaatgaaaatact

SEQ ID NO: 7647066 - DNA, 22 bp, Homo sapiens
acttgcatttaaatattgaata

SEQ ID NO: 7647067 - DNA, 22 bp, Homo sapiens
acttgccccagaattgctgctg

SEQ ID NO: 7647068 - DNA, 22 bp, Homo sapiens
acttgcatttcaggcacttgtg

SEQ ID NO: 7647069 - DNA, 22 bp, Homo sapiens
acttgccaagttctgtgctgtt

SEQ ID NO: 7647070 - DNA, 22 bp, Homo sapiens
acttgccaagttctgtgctgtt

SEQ ID NO: 7647071 - DNA, 22 bp, Homo sapiens
acttggaaagatgcaacacagt

SEQ ID NO: 7647072 - DNA, 22 bp, Homo sapiens
acttggaaccgaggacctttat

SEQ ID NO: 7647073 - DNA, 22 bp, Homo sapiens
acttggaaccgaggacctttat

SEQ ID NO: 7647074 - DNA, 20 bp, Homo sapiens
acttggaactcatttttctt

SEQ ID NO: 7647075 - DNA, 20 bp, Homo sapiens
acttggaactcatttttctt

SEQ ID NO: 7647076 - DNA, 22 bp, Homo sapiens
acttggaaagatgcaacacagt

SEQ ID NO: 7647077 - DNA, 20 bp, Homo sapiens
acttgcttttgtcaggaaaa

SEQ ID NO: 7647078 - DNA, 22 bp, Homo sapiens
acttggaaagatgcaacacagt

SEQ ID NO: 7647079 - DNA, 22 bp, Homo sapiens
acttggaaaattcaaaatggca

SEQ ID NO: 7647080 - DNA, 22 bp, Homo sapiens
acttggaaaattcaaaatggca

SEQ ID NO: 7647081 - DNA, 22 bp, Homo sapiens
acttgcttagtttgcaacagag

SEQ ID NO: 7647082 - DNA, 22 bp, Homo sapiens
acttgctggtggcatttacagt

SEQ ID NO: 7647083 - DNA, 22 bp, Homo sapiens
acttgcttagtttgcaacagag

SEQ ID NO: 7647084 - DNA, 22 bp, Homo sapiens
acttgctcaatgcttgaagcca

SEQ ID NO: 7647085 - DNA, 22 bp, Homo sapiens
acttgctcaatgcttgaagcca

SEQ ID NO: 7647086 - DNA, 22 bp, Homo sapiens
acttgcctgttacatttctagt

SEQ ID NO: 7647087 - DNA, 22 bp, Homo sapiens
acttgcctaaggtcatgcaact

SEQ ID NO: 7647088 - DNA, 22 bp, Homo sapiens
acttgccccagaattgctgctg

SEQ ID NO: 7647089 - DNA, 22 bp, Homo sapiens
acttggccttatttccacagaa

SEQ ID NO: 7647090 - DNA, 21 bp, Homo sapiens
acttggccaggcccccacctg

SEQ ID NO: 7647091 - DNA, 21 bp, Homo sapiens
acttggcagaacgcagaaggc

SEQ ID NO: 7647092 - DNA, 22 bp, Homo sapiens
acttggcaagtatctataaagt

SEQ ID NO: 7647093 - DNA, 21 bp, Homo sapiens
acttggcagaacgcagaaggc

SEQ ID NO: 7647094 - DNA, 22 bp, Homo sapiens
acttggagggagctgggtggaa

SEQ ID NO: 7647095 - DNA, 22 bp, Homo sapiens
acttggagggagctgggtggaa

SEQ ID NO: 7647096 - DNA, 22 bp, Homo sapiens
acttggatatgttcactagacc

SEQ ID NO: 7647097 - DNA, 22 bp, Homo sapiens
acttggagagataatcccatat

SEQ ID NO: 7647098 - DNA, 23 bp, Homo sapiens
acttggaagcagtgaacaacttt

SEQ ID NO: 7647099 - DNA, 23 bp, Homo sapiens
acttggaagcagtgaacaacttt

SEQ ID NO: 7647100 - DNA, 23 bp, Homo sapiens
acttggaagcagtgaacaacttt

SEQ ID NO: 7647101 - DNA, 23 bp, Homo sapiens
acttggaagcagtgaacaacttt

SEQ ID NO: 7647102 - DNA, 22 bp, Homo sapiens
acttggagggagctgggtggaa

SEQ ID NO: 7647103 - DNA, 22 bp, Homo sapiens
acttggagagcattgctgggga

SEQ ID NO: 7647104 - DNA, 22 bp, Homo sapiens
acttggagagataatcccatat

SEQ ID NO: 7647105 - DNA, 22 bp, Homo sapiens
acttggagagataatcccatat

SEQ ID NO: 7647106 - DNA, 22 bp, Homo sapiens
acttggagagcattgctgggga

SEQ ID NO: 7647107 - DNA, 22 bp, Homo sapiens
acttggagagcattgctgggga

SEQ ID NO: 7647108 - DNA, 22 bp, Homo sapiens
acttggagagcattgctgggga

SEQ ID NO: 7647109 - DNA, 22 bp, Homo sapiens
acttggctattttcattcatca

SEQ ID NO: 7647110 - DNA, 22 bp, Homo sapiens
acttggctagtgatgcagggtg

SEQ ID NO: 7647111 - DNA, 22 bp, Homo sapiens
acttggctcagataccatgccc

SEQ ID NO: 7647112 - DNA, 22 bp, Homo sapiens
acttggctcagataccatgccc

SEQ ID NO: 7647113 - DNA, 22 bp, Homo sapiens
acttggctattttcattcatca

SEQ ID NO: 7647114 - DNA, 22 bp, Homo sapiens
acttggctagagccaggaggct

SEQ ID NO: 7647115 - DNA, 22 bp, Homo sapiens
acttggccttatttccacagaa

SEQ ID NO: 7647116 - DNA, 21 bp, Homo sapiens
acttggccaggcccccacctg

SEQ ID NO: 7647117 - DNA, 22 bp, Homo sapiens
acttggctcagataccatgccc

SEQ ID NO: 7647118 - DNA, 22 bp, Homo sapiens
acttggctcagataccatgccc

SEQ ID NO: 7647119 - DNA, 22 bp, Homo sapiens
acttggctgggagagttgaaga

SEQ ID NO: 7647120 - DNA, 22 bp, Homo sapiens
acttggctgcagagaacgtgtg

SEQ ID NO: 7647121 - DNA, 22 bp, Homo sapiens
acttggcttcaaggttaaggtc

SEQ ID NO: 7647122 - DNA, 22 bp, Homo sapiens
acttggcttaaagtagtgatcg

SEQ ID NO: 7647123 - DNA, 22 bp, Homo sapiens
acttggctgggagagttgaaga

SEQ ID NO: 7647124 - DNA, 22 bp, Homo sapiens
acttgggaaaggaagaattgca

SEQ ID NO: 7647125 - DNA, 22 bp, Homo sapiens
acttgggaaagaagtttcaccg

SEQ ID NO: 7647126 - DNA, 22 bp, Homo sapiens
acttggcttttccatctctgca

SEQ ID NO: 7647127 - DNA, 22 bp, Homo sapiens
acttgggaaagaagtttcaccg

SEQ ID NO: 7647128 - DNA, 22 bp, Homo sapiens
acttggcttttccatctctgca

SEQ ID NO: 7647129 - DNA, 22 bp, Homo sapiens
acttggcttttccatctctgca

SEQ ID NO: 7647130 - DNA, 21 bp, Homo sapiens
acttggctttgttagaactag

SEQ ID NO: 7647131 - DNA, 22 bp, Homo sapiens
acttggctttagtagtaactga

SEQ ID NO: 7647132 - DNA, 22 bp, Homo sapiens
acttggctttaggcatccacat

SEQ ID NO: 7647133 - DNA, 22 bp, Homo sapiens
acttggctttagtagtaactga

SEQ ID NO: 7647134 - DNA, 22 bp, Homo sapiens
acttcatagaatgagcttggaa

SEQ ID NO: 7647135 - DNA, 22 bp, Homo sapiens
acttcataaattagactaatgg

SEQ ID NO: 7647136 - DNA, 22 bp, Homo sapiens
acttcatatggacagcaaacta

SEQ ID NO: 7647137 - DNA, 22 bp, Homo sapiens
acttcatatggacagcaaacta

SEQ ID NO: 7647138 - DNA, 22 bp, Homo sapiens
acttcatagaatgagcttggaa

SEQ ID NO: 7647139 - DNA, 22 bp, Homo sapiens
acttcagtttccctcaacaaga

SEQ ID NO: 7647140 - DNA, 22 bp, Homo sapiens
acttcagtgtggtataaaacgt

SEQ ID NO: 7647141 - DNA, 22 bp, Homo sapiens
acttcagtaggtgatatgtgca

SEQ ID NO: 7647142 - DNA, 22 bp, Homo sapiens
acttcagcccagaggaagggat

SEQ ID NO: 7647143 - DNA, 22 bp, Homo sapiens
acttcagtgtggtataaaacgt

SEQ ID NO: 7647144 - DNA, 22 bp, Homo sapiens
acttcagtaggtgatatgtgca

SEQ ID NO: 7647145 - DNA, 22 bp, Homo sapiens
acttcatgaactaagggatcgg

SEQ ID NO: 7647146 - DNA, 22 bp, Homo sapiens
acttcatgaacatgtggcctgt

SEQ ID NO: 7647147 - DNA, 22 bp, Homo sapiens
acttcatattgtttccactaga

SEQ ID NO: 7647148 - DNA, 22 bp, Homo sapiens
acttcatattgtttccactaga

SEQ ID NO: 7647149 - DNA, 22 bp, Homo sapiens
acttcatattgtttccactaga

SEQ ID NO: 7647150 - DNA, 22 bp, Homo sapiens
acttcatgaacatgtggcctgt

SEQ ID NO: 7647151 - DNA, 22 bp, Homo sapiens
acttcatgcagaagagagctgt

SEQ ID NO: 7647152 - DNA, 22 bp, Homo sapiens
acttcatgctttagagagatga

SEQ ID NO: 7647153 - DNA, 23 bp, Homo sapiens
acttcatggcactgtcttagagg

SEQ ID NO: 7647154 - DNA, 22 bp, Homo sapiens
acttcatgtttctattagctca

SEQ ID NO: 7647155 - DNA, 22 bp, Homo sapiens
acttcatgttgtttacaactta

SEQ ID NO: 7647156 - DNA, 22 bp, Homo sapiens
acttcattcattttcacgaatg

SEQ ID NO: 7647157 - DNA, 22 bp, Homo sapiens
acttcattcattttcacgaatg

SEQ ID NO: 7647158 - DNA, 22 bp, Homo sapiens
acttcattgctaagaacaaggt

SEQ ID NO: 7647159 - DNA, 22 bp, Homo sapiens
acttcattgctaagaacaaggt

SEQ ID NO: 7647160 - DNA, 22 bp, Homo sapiens
acttcatgtactgttcaaggcc

SEQ ID NO: 7647161 - DNA, 22 bp, Homo sapiens
acttcatgtagtccatcaggtt

SEQ ID NO: 7647162 - DNA, 22 bp, Homo sapiens
acttcatgttgctcttggctat

SEQ ID NO: 7647163 - DNA, 22 bp, Homo sapiens
acttcatgttgtttacaactta

SEQ ID NO: 7647164 - DNA, 22 bp, Homo sapiens
acttcatgttgtttacaactta

SEQ ID NO: 7647165 - DNA, 22 bp, Homo sapiens
acttcattgtaatattatagca

SEQ ID NO: 7647166 - DNA, 22 bp, Homo sapiens
acttcatttcatttgcacagtg

SEQ ID NO: 7647167 - DNA, 22 bp, Homo sapiens
acttcatttcatttgcacagtg

SEQ ID NO: 7647168 - DNA, 22 bp, Homo sapiens
acttccaaagaagtgattacag

SEQ ID NO: 7647169 - DNA, 22 bp, Homo sapiens
acttccaaagaagtgattacag

SEQ ID NO: 7647170 - DNA, 22 bp, Homo sapiens
acttccaaaacacagcatggca

SEQ ID NO: 7647171 - DNA, 22 bp, Homo sapiens
acttcattgtaatattatagca

SEQ ID NO: 7647172 - DNA, 22 bp, Homo sapiens
acttccaaaacacagcatggca

SEQ ID NO: 7647173 - DNA, 22 bp, Homo sapiens
acttgcagctaccatcattcca

SEQ ID NO: 7647174 - DNA, 22 bp, Homo sapiens
acttgcaaagtgagggagtgtt

SEQ ID NO: 7647175 - DNA, 22 bp, Homo sapiens
acttgcatgatattcaacagag

SEQ ID NO: 7647176 - DNA, 22 bp, Homo sapiens
acttgcatatatccctccacat

SEQ ID NO: 7647177 - DNA, 22 bp, Homo sapiens
acttgcaggatcctctgcctga

SEQ ID NO: 7647178 - DNA, 22 bp, Homo sapiens
acttcttttcaaatcatgcaaa

SEQ ID NO: 7647179 - DNA, 22 bp, Homo sapiens
acttcttttcaaatcatgcaaa

SEQ ID NO: 7647180 - DNA, 22 bp, Homo sapiens
acttctttcacaatgtttctag

SEQ ID NO: 7647181 - DNA, 22 bp, Homo sapiens
acttccagatggccccatctaa

SEQ ID NO: 7647182 - DNA, 22 bp, Homo sapiens
acttctttcacaatgtttctag

SEQ ID NO: 7647183 - DNA, 22 bp, Homo sapiens
acttgatttttataataaatgg

SEQ ID NO: 7647184 - DNA, 22 bp, Homo sapiens
acttgattttgaacctttctac

SEQ ID NO: 7647185 - DNA, 22 bp, Homo sapiens
acttgatttttataataaatgg

SEQ ID NO: 7647186 - DNA, 22 bp, Homo sapiens
acttgatttttataataaatgg

SEQ ID NO: 7647187 - DNA, 22 bp, Homo sapiens
acttccagaaatgatttaattt

SEQ ID NO: 7647188 - DNA, 22 bp, Homo sapiens
acttccagaattagaatttaag

SEQ ID NO: 7647189 - DNA, 22 bp, Homo sapiens
acttccagaattagaatttaag

SEQ ID NO: 7647190 - DNA, 22 bp, Homo sapiens
acttccagacctgtgcttgctc

SEQ ID NO: 7647191 - DNA, 22 bp, Homo sapiens
acttccagacctgtgcttgctc

SEQ ID NO: 7647192 - DNA, 22 bp, Homo sapiens
acttccagacctgtgcttgctc

SEQ ID NO: 7647193 - DNA, 22 bp, Homo sapiens
acttctttcacaatgtttctag

SEQ ID NO: 7647194 - DNA, 22 bp, Homo sapiens
acttccagatggccccatctaa

SEQ ID NO: 7647195 - DNA, 22 bp, Homo sapiens
acttctttcacaatgtttctag

SEQ ID NO: 7647196 - DNA, 22 bp, Homo sapiens
acttccagagggtgtggaaata

SEQ ID NO: 7647197 - DNA, 22 bp, Homo sapiens
acttccagagggtgtggaaata

SEQ ID NO: 7647198 - DNA, 22 bp, Homo sapiens
acttccaagtttattcatgtga

SEQ ID NO: 7647199 - DNA, 22 bp, Homo sapiens
acttccaagtgacattcatatc

SEQ ID NO: 7647200 - DNA, 22 bp, Homo sapiens
acttccaagtgacattcatatc

SEQ ID NO: 7647201 - DNA, 17 bp, Homo sapiens
acttccaagcattgctg

SEQ ID NO: 7647202 - DNA, 22 bp, Homo sapiens
acttccaagtttattcatgtga

SEQ ID NO: 7647203 - DNA, 22 bp, Homo sapiens
acttccagaacaggtacatttt

SEQ ID NO: 7647204 - DNA, 22 bp, Homo sapiens
acttccaaataccatcacattg

SEQ ID NO: 7647205 - DNA, 22 bp, Homo sapiens
acttccaaataccatcacattg

SEQ ID NO: 7647206 - DNA, 22 bp, Homo sapiens
acttccaaataccatcacattg

SEQ ID NO: 7647207 - DNA, 22 bp, Homo sapiens
acttccaaataccatcacattg

SEQ ID NO: 7647208 - DNA, 22 bp, Homo sapiens
acttccaacttcagtcctgagc

SEQ ID NO: 7647209 - DNA, 22 bp, Homo sapiens
acttccaacttcagtcctgagc

SEQ ID NO: 7647210 - DNA, 22 bp, Homo sapiens
aggtagcaagacacctgctttt

SEQ ID NO: 7647211 - DNA, 22 bp, Homo sapiens
aggtagattacttaccttttct

SEQ ID NO: 7647212 - DNA, 22 bp, Homo sapiens
aggtagaggcctccaggcagca

SEQ ID NO: 7647213 - DNA, 22 bp, Homo sapiens
aggtagaggcctccaggcagca

SEQ ID NO: 7647214 - DNA, 22 bp, Homo sapiens
aggtagcagcctagcagggact

SEQ ID NO: 7647215 - DNA, 22 bp, Homo sapiens
aggtagcacagcctgagtccag

SEQ ID NO: 7647216 - DNA, 22 bp, Homo sapiens
aggtagcacagcctgagtccag

SEQ ID NO: 7647217 - DNA, 22 bp, Homo sapiens
aggtagcatattccagacttgt

SEQ ID NO: 7647218 - DNA, 22 bp, Homo sapiens
aggtagagctccagtagaaaat

SEQ ID NO: 7647219 - DNA, 22 bp, Homo sapiens
aggtagagctccagtagaaaat

SEQ ID NO: 7647220 - DNA, 22 bp, Homo sapiens
aggtagaaggaccagaatttat

SEQ ID NO: 7647221 - DNA, 22 bp, Homo sapiens
aggtagaggcctccaggcagca

SEQ ID NO: 7647222 - DNA, 22 bp, Homo sapiens
aggtagaggcctccaggcagca

SEQ ID NO: 7647223 - DNA, 22 bp, Homo sapiens
aggtagagctccagtagaaaat

SEQ ID NO: 7647224 - DNA, 22 bp, Homo sapiens
aggtagaaggaccagaatttat

SEQ ID NO: 7647225 - DNA, 22 bp, Homo sapiens
aggtagaagagcaaggaataac

SEQ ID NO: 7647226 - DNA, 22 bp, Homo sapiens
aggtagaaggaccagaatttat

SEQ ID NO: 7647227 - DNA, 22 bp, Homo sapiens
aggtagaagagcaaggaataac

SEQ ID NO: 7647228 - DNA, 22 bp, Homo sapiens
aggtaccaaaagcctttttctg

SEQ ID NO: 7647229 - DNA, 22 bp, Homo sapiens
aggtactgtgagttagcctgtt

SEQ ID NO: 7647230 - DNA, 22 bp, Homo sapiens
aggtactgaaaaaatgtttgca

SEQ ID NO: 7647231 - DNA, 22 bp, Homo sapiens
aggtactgaaaaaatgtttgca

SEQ ID NO: 7647232 - DNA, 22 bp, Homo sapiens
aggtacgggtctgagagccatg

SEQ ID NO: 7647233 - DNA, 22 bp, Homo sapiens
aggtactaccagggattttcag

SEQ ID NO: 7647234 - DNA, 21 bp, Homo sapiens
aggtactaatgaaaagtgatt

SEQ ID NO: 7647235 - DNA, 22 bp, Homo sapiens
aggtacatttgataaaaatagc

SEQ ID NO: 7647236 - DNA, 22 bp, Homo sapiens
aggtacatggggtgtgtgcacg

SEQ ID NO: 7647237 - DNA, 22 bp, Homo sapiens
aggtacatggggtgtgtgcacg

SEQ ID NO: 7647238 - DNA, 22 bp, Homo sapiens
aggtacatggggtgtgtgcacg

SEQ ID NO: 7647239 - DNA, 22 bp, Homo sapiens
aggtacatggggtgtgtgcacg

SEQ ID NO: 7647240 - DNA, 22 bp, Homo sapiens
aggtacatggggtgtgtgcacg

SEQ ID NO: 7647241 - DNA, 22 bp, Homo sapiens
aggtacatggggtgtgtgcacg

SEQ ID NO: 7647242 - DNA, 22 bp, Homo sapiens
aggtacatggggtgtgtgcacg

SEQ ID NO: 7647243 - DNA, 22 bp, Homo sapiens
aggtacatggggtgtgtgcacg

SEQ ID NO: 7647244 - DNA, 22 bp, Homo sapiens
aggtacagtagacagacagtta

SEQ ID NO: 7647245 - DNA, 22 bp, Homo sapiens
aggtacagtagacagacagtta

SEQ ID NO: 7647246 - DNA, 23 bp, Homo sapiens
aggtacatatacttggaggtcag

SEQ ID NO: 7647247 - DNA, 22 bp, Homo sapiens
aggtacatgaggctaatagact

SEQ ID NO: 7647248 - DNA, 22 bp, Homo sapiens
aggtacatgaagcttgtgttgg

SEQ ID NO: 7647249 - DNA, 22 bp, Homo sapiens
aggtacatgaagcttgtgttgg

SEQ ID NO: 7647250 - DNA, 22 bp, Homo sapiens
aggtagctaaaacaggcttttg

SEQ ID NO: 7647251 - DNA, 22 bp, Homo sapiens
aggtagcgcaatttcctgggac

SEQ ID NO: 7647252 - DNA, 22 bp, Homo sapiens
aggtagctagtcctttaagtta

SEQ ID NO: 7647253 - DNA, 22 bp, Homo sapiens
aggtagctatccagacgctgaa

SEQ ID NO: 7647254 - DNA, 22 bp, Homo sapiens
aggtagctatccagacgctgaa

SEQ ID NO: 7647255 - DNA, 23 bp, Homo sapiens
acctggctgctcaacctgcaggg

SEQ ID NO: 7647256 - DNA, 23 bp, Homo sapiens
acctggctgctcaacctgcaggg

SEQ ID NO: 7647257 - DNA, 23 bp, Homo sapiens
acctggctgctcaacctgcaggg

SEQ ID NO: 7647258 - DNA, 22 bp, Homo sapiens
acctggctgagaacgtgcagct

SEQ ID NO: 7647259 - DNA, 23 bp, Homo sapiens
acctggctgctcaacctgcaggg

SEQ ID NO: 7647260 - DNA, 22 bp, Homo sapiens
acctggttcctcctcactgctg

SEQ ID NO: 7647261 - DNA, 22 bp, Homo sapiens
acctgtcaacccatcacctagg

SEQ ID NO: 7647262 - DNA, 23 bp, Homo sapiens
acctggctgctcaacctgcaggg

SEQ ID NO: 7647263 - DNA, 22 bp, Homo sapiens
acctggctggttgtgattccca

SEQ ID NO: 7647264 - DNA, 19 bp, Homo sapiens
acctggctggcgcacttgt

SEQ ID NO: 7647265 - DNA, 22 bp, Homo sapiens
acctgtgttttccctcagtttc

SEQ ID NO: 7647266 - DNA, 22 bp, Homo sapiens
acctgtgttttccctcagtttc

SEQ ID NO: 7647267 - DNA, 22 bp, Homo sapiens
acctgtttaccctgggctcccc

SEQ ID NO: 7647268 - DNA, 22 bp, Homo sapiens
acctgtgggcagaacctagtgc

SEQ ID NO: 7647269 - DNA, 22 bp, Homo sapiens
acctgtgggcagaacctagtgc

SEQ ID NO: 7647270 - DNA, 20 bp, Homo sapiens
acctgtggtgctgatgacag

SEQ ID NO: 7647271 - DNA, 22 bp, Homo sapiens
acctgtgtttctgtagtggtca

SEQ ID NO: 7647272 - DNA, 22 bp, Homo sapiens
acctgtgcaaagactggtcagg

SEQ ID NO: 7647273 - DNA, 22 bp, Homo sapiens
acctgtgacccttctttgcttc

SEQ ID NO: 7647274 - DNA, 22 bp, Homo sapiens
acctgtgctttcaaggagctca

SEQ ID NO: 7647275 - DNA, 22 bp, Homo sapiens
acctgtctgggctacatttgca

SEQ ID NO: 7647276 - DNA, 22 bp, Homo sapiens
acctgtctgggctacatttgca

SEQ ID NO: 7647277 - DNA, 23 bp, Homo sapiens
acctgtctgcctcccaccatcaa

SEQ ID NO: 7647278 - DNA, 23 bp, Homo sapiens
acctgtctgcctcccaccatcaa

SEQ ID NO: 7647279 - DNA, 22 bp, Homo sapiens
acctgtctgcatgatctaaaac

SEQ ID NO: 7647280 - DNA, 22 bp, Homo sapiens
acctgtctgcatgatctaaaac

SEQ ID NO: 7647281 - DNA, 22 bp, Homo sapiens
acctgtctgcatgatctaaaac

SEQ ID NO: 7647282 - DNA, 22 bp, Homo sapiens
acctgtcatgtcaatgttcagt

SEQ ID NO: 7647283 - DNA, 22 bp, Homo sapiens
acctgtcatgtcaatgttcagt

SEQ ID NO: 7647284 - DNA, 22 bp, Homo sapiens
acctgtctataaaagtgaatac

SEQ ID NO: 7647285 - DNA, 22 bp, Homo sapiens
acctgtctataaaagtgaatac

SEQ ID NO: 7647286 - DNA, 22 bp, Homo sapiens
acctgtctataaaagtgaatac

SEQ ID NO: 7647287 - DNA, 22 bp, Homo sapiens
aggtacagtagacagacagtta

SEQ ID NO: 7647288 - DNA, 21 bp, Homo sapiens
aggtacaggtcttgtgagtct

SEQ ID NO: 7647289 - DNA, 21 bp, Homo sapiens
aggtacaggtcttgtgagtct

SEQ ID NO: 7647290 - DNA, 22 bp, Homo sapiens
aggtacagtagacagacagtta

SEQ ID NO: 7647291 - DNA, 22 bp, Homo sapiens
aggtacagtagacagacagtta

SEQ ID NO: 7647292 - DNA, 22 bp, Homo sapiens
acctggagcttccaactcaact

SEQ ID NO: 7647293 - DNA, 22 bp, Homo sapiens
acctggagatccatggtgtcga

SEQ ID NO: 7647294 - DNA, 20 bp, Homo sapiens
acctggagagattattacca

SEQ ID NO: 7647295 - DNA, 17 bp, Homo sapiens
acctggagaccaagtcc

SEQ ID NO: 7647296 - DNA, 20 bp, Homo sapiens
acctggagacagcactctgg

SEQ ID NO: 7647297 - DNA, 20 bp, Homo sapiens
acctggagacagcactctgg

SEQ ID NO: 7647298 - DNA, 20 bp, Homo sapiens
acctggagacagcactctgg

SEQ ID NO: 7647299 - DNA, 22 bp, Homo sapiens
acctggagaaagcctctccctg

SEQ ID NO: 7647300 - DNA, 22 bp, Homo sapiens
acctggagaaagcctctccctg

SEQ ID NO: 7647301 - DNA, 20 bp, Homo sapiens
acctggagacagcactctgg

SEQ ID NO: 7647302 - DNA, 22 bp, Homo sapiens
acctggacacctgctgtcatct

SEQ ID NO: 7647303 - DNA, 22 bp, Homo sapiens
acctggacacctgctgtcatct

SEQ ID NO: 7647304 - DNA, 22 bp, Homo sapiens
acctggacacctgctgtcatct

SEQ ID NO: 7647305 - DNA, 22 bp, Homo sapiens
acctggacacctgctgtcatct

SEQ ID NO: 7647306 - DNA, 22 bp, Homo sapiens
acctggacacctgctgtcatct

SEQ ID NO: 7647307 - DNA, 22 bp, Homo sapiens
acctggaagtgggtgctatggc

SEQ ID NO: 7647308 - DNA, 22 bp, Homo sapiens
acctggacacctgctgtcatct

SEQ ID NO: 7647309 - DNA, 22 bp, Homo sapiens
acctggacacctgctgtcatct

SEQ ID NO: 7647310 - DNA, 22 bp, Homo sapiens
acctggacacctgctgtcatct

SEQ ID NO: 7647311 - DNA, 22 bp, Homo sapiens
acctggacacctgctgtcatct

SEQ ID NO: 7647312 - DNA, 22 bp, Homo sapiens
acctgccttctcaaggacatga

SEQ ID NO: 7647313 - DNA, 22 bp, Homo sapiens
acctgccttctcaaggacatga

SEQ ID NO: 7647314 - DNA, 22 bp, Homo sapiens
acctgccttctcaaggacatga

SEQ ID NO: 7647315 - DNA, 22 bp, Homo sapiens
acctgctcaactggcttctcgc

SEQ ID NO: 7647316 - DNA, 22 bp, Homo sapiens
acctgctcaactggcttctcgc

SEQ ID NO: 7647317 - DNA, 22 bp, Homo sapiens
acctgctgaggagggggaatta

SEQ ID NO: 7647318 - DNA, 22 bp, Homo sapiens
acctgctgaggagggggaatta

SEQ ID NO: 7647319 - DNA, 22 bp, Homo sapiens
acctgctgtgattctaattggc

SEQ ID NO: 7647320 - DNA, 18 bp, Homo sapiens
acctgctgagtctaagca

SEQ ID NO: 7647321 - DNA, 22 bp, Homo sapiens
acctgctgtcttgggggaatgc

SEQ ID NO: 7647322 - DNA, 22 bp, Homo sapiens
acctgctgtcttgggggaatgc

SEQ ID NO: 7647323 - DNA, 22 bp, Homo sapiens
acctgcttgagccagtatgaga

SEQ ID NO: 7647324 - DNA, 22 bp, Homo sapiens
acctggaacttggtcatttttc

SEQ ID NO: 7647325 - DNA, 22 bp, Homo sapiens
acctgctttgtagtgtttgctg

SEQ ID NO: 7647326 - DNA, 22 bp, Homo sapiens
acctgctttattcctcctgcct

SEQ ID NO: 7647327 - DNA, 22 bp, Homo sapiens
acctgctttgtagtgtttgctg

SEQ ID NO: 7647328 - DNA, 22 bp, Homo sapiens
acctccctggccttctgattcc

SEQ ID NO: 7647329 - DNA, 22 bp, Homo sapiens
acctccctggccttctgattcc

SEQ ID NO: 7647330 - DNA, 22 bp, Homo sapiens
acctccctgcctcttggcgtca

SEQ ID NO: 7647331 - DNA, 22 bp, Homo sapiens
acctccctgcctcttggcgtca

SEQ ID NO: 7647332 - DNA, 20 bp, Homo sapiens
acctccctctgtgggtggga

SEQ ID NO: 7647333 - DNA, 22 bp, Homo sapiens
acctccctgcctcttggcgtca

SEQ ID NO: 7647334 - DNA, 22 bp, Homo sapiens
acctccctgcctcttggcgtca

SEQ ID NO: 7647335 - DNA, 22 bp, Homo sapiens
acctccctgggttatcggggca

SEQ ID NO: 7647336 - DNA, 22 bp, Homo sapiens
acctccctgggttatcggggca

SEQ ID NO: 7647337 - DNA, 22 bp, Homo sapiens
acctgcccacacttccttccca

SEQ ID NO: 7647338 - DNA, 22 bp, Homo sapiens
acctgcccacatatatatgtat

SEQ ID NO: 7647339 - DNA, 22 bp, Homo sapiens
acctgcccacatatatatgtat

SEQ ID NO: 7647340 - DNA, 22 bp, Homo sapiens
acctgcccacttcccatgacat

SEQ ID NO: 7647341 - DNA, 22 bp, Homo sapiens
acctgcccacttcccatgacat

SEQ ID NO: 7647342 - DNA, 22 bp, Homo sapiens
acctgcccagactcagatccta

SEQ ID NO: 7647343 - DNA, 22 bp, Homo sapiens
acctgcccatgaaaatggggag

SEQ ID NO: 7647344 - DNA, 22 bp, Homo sapiens
acctgcccagactcagatccta

SEQ ID NO: 7647345 - DNA, 22 bp, Homo sapiens
acctgcccggggacattccttt

SEQ ID NO: 7647346 - DNA, 22 bp, Homo sapiens
acctgcccggggacattccttt

SEQ ID NO: 7647347 - DNA, 22 bp, Homo sapiens
acctgcccggggacattccttt

SEQ ID NO: 7647348 - DNA, 22 bp, Homo sapiens
acctgcccggggacattccttt

SEQ ID NO: 7647349 - DNA, 22 bp, Homo sapiens
acctgccttctcaaggacatga

SEQ ID NO: 7647350 - DNA, 22 bp, Homo sapiens
acctgccttctcaaggacatga

SEQ ID NO: 7647351 - DNA, 22 bp, Homo sapiens
acctgccttctcaaggacatga

SEQ ID NO: 7647352 - DNA, 22 bp, Homo sapiens
agggtggtatttaacaactgga

SEQ ID NO: 7647353 - DNA, 22 bp, Homo sapiens
agggtggtatttaacaactgga

SEQ ID NO: 7647354 - DNA, 22 bp, Homo sapiens
agggtggggtgctacatcttta

SEQ ID NO: 7647355 - DNA, 22 bp, Homo sapiens
agggtggggtgctacatcttta

SEQ ID NO: 7647356 - DNA, 22 bp, Homo sapiens
agggtggggtgctacatcttta

SEQ ID NO: 7647357 - DNA, 22 bp, Homo sapiens
agggtggtggcgatgaggacat

SEQ ID NO: 7647358 - DNA, 22 bp, Homo sapiens
agggtggtggcgatgaggacat

SEQ ID NO: 7647359 - DNA, 22 bp, Homo sapiens
agggtggtggcgatgaggacat

SEQ ID NO: 7647360 - DNA, 22 bp, Homo sapiens
agggtgtcagccacggaatggg

SEQ ID NO: 7647361 - DNA, 22 bp, Homo sapiens
agggtggggtgctacatcttta

SEQ ID NO: 7647362 - DNA, 20 bp, Homo sapiens
agggtggggacgttctgact

SEQ ID NO: 7647363 - DNA, 20 bp, Homo sapiens
agggtggggacgttctgact

SEQ ID NO: 7647364 - DNA, 20 bp, Homo sapiens
agggtggggacgttctgact

SEQ ID NO: 7647365 - DNA, 22 bp, Homo sapiens
agggtggggtgctacatcttta

SEQ ID NO: 7647366 - DNA, 22 bp, Homo sapiens
agggtggggtgctacatcttta

SEQ ID NO: 7647367 - DNA, 22 bp, Homo sapiens
agggtggggtgctacatcttta

SEQ ID NO: 7647368 - DNA, 22 bp, Homo sapiens
agggtggggtgctacatcttta

SEQ ID NO: 7647369 - DNA, 22 bp, Homo sapiens
agggtggggtgctacatcttta

SEQ ID NO: 7647370 - DNA, 22 bp, Homo sapiens
agggtggggtgctacatcttta

SEQ ID NO: 7647371 - DNA, 22 bp, Homo sapiens
agggttaattggtgtcctgagg

SEQ ID NO: 7647372 - DNA, 22 bp, Homo sapiens
acctcccagctctgagcttggg

SEQ ID NO: 7647373 - DNA, 19 bp, Homo sapiens
agggttacccgctgccacc

SEQ ID NO: 7647374 - DNA, 22 bp, Homo sapiens
acctccccacatggtagtgagt

SEQ ID NO: 7647375 - DNA, 22 bp, Homo sapiens
acctccccacatggtagtgagt

SEQ ID NO: 7647376 - DNA, 22 bp, Homo sapiens
acctccccacatggtagtgagt

SEQ ID NO: 7647377 - DNA, 22 bp, Homo sapiens
acctcccagctctgagcttggg

SEQ ID NO: 7647378 - DNA, 19 bp, Homo sapiens
agggttacccgctgccacc

SEQ ID NO: 7647379 - DNA, 22 bp, Homo sapiens
acctcccagctctgagcttggg

SEQ ID NO: 7647380 - DNA, 22 bp, Homo sapiens
agggtgtgctgttgggtctttc

SEQ ID NO: 7647381 - DNA, 22 bp, Homo sapiens
agggtgtgctgttgggtctttc

SEQ ID NO: 7647382 - DNA, 22 bp, Homo sapiens
agggtgtcagccacggaatggg

SEQ ID NO: 7647383 - DNA, 20 bp, Homo sapiens
agggtgtgggccttagccat

SEQ ID NO: 7647384 - DNA, 20 bp, Homo sapiens
agggtgtgggccttagccat

SEQ ID NO: 7647385 - DNA, 22 bp, Homo sapiens
agggtgtgttctcctatgagaa

SEQ ID NO: 7647386 - DNA, 22 bp, Homo sapiens
agggtgtgttctcctatgagaa

SEQ ID NO: 7647387 - DNA, 22 bp, Homo sapiens
acctccctcgccgtccactctg

SEQ ID NO: 7647388 - DNA, 22 bp, Homo sapiens
acctccctcgccgtccactctg

SEQ ID NO: 7647389 - DNA, 22 bp, Homo sapiens
acctccctcgccgtccactctg

SEQ ID NO: 7647390 - DNA, 22 bp, Homo sapiens
acctccctcgccgtccactctg

SEQ ID NO: 7647391 - DNA, 21 bp, Homo sapiens
acctccctcgagcaaccagca

SEQ ID NO: 7647392 - DNA, 21 bp, Homo sapiens
acctccctcgagcaaccagca

SEQ ID NO: 7647393 - DNA, 21 bp, Homo sapiens
acctccctcgagcaaccagca

SEQ ID NO: 7647394 - DNA, 21 bp, Homo sapiens
acctccctcgagcaaccagca

SEQ ID NO: 7647395 - DNA, 22 bp, Homo sapiens
acctccctccatctggacacta

SEQ ID NO: 7647396 - DNA, 20 bp, Homo sapiens
acctccctctgtgggtggga

SEQ ID NO: 7647397 - DNA, 20 bp, Homo sapiens
acctccctctgtgggtggga

SEQ ID NO: 7647398 - DNA, 22 bp, Homo sapiens
acctccctcgccgtccactctg

SEQ ID NO: 7647399 - DNA, 20 bp, Homo sapiens
acctccctctgtgggtggga

SEQ ID NO: 7647400 - DNA, 22 bp, Homo sapiens
acctccctcgccgtccactctg

SEQ ID NO: 7647401 - DNA, 22 bp, Homo sapiens
acctccctaacccttttggctc

SEQ ID NO: 7647402 - DNA, 22 bp, Homo sapiens
acctccctaacccttttggctc

SEQ ID NO: 7647403 - DNA, 22 bp, Homo sapiens
acctccctaacccttttggctc

SEQ ID NO: 7647404 - DNA, 22 bp, Homo sapiens
acctccctaagggtccagctta

SEQ ID NO: 7647405 - DNA, 22 bp, Homo sapiens
acctccctaagggtccagctta

SEQ ID NO: 7647406 - DNA, 22 bp, Homo sapiens
acctccctccatctggacacta

SEQ ID NO: 7647407 - DNA, 22 bp, Homo sapiens
acctccctccatctggacacta

SEQ ID NO: 7647408 - DNA, 22 bp, Homo sapiens
acctccctaagggtccagctta

SEQ ID NO: 7647409 - DNA, 22 bp, Homo sapiens
acctccctaagggtccagctta

SEQ ID NO: 7647410 - DNA, 22 bp, Homo sapiens
acctcccctcaccaatctggtt

SEQ ID NO: 7647411 - DNA, 22 bp, Homo sapiens
acctcccctcaccaatctggtt

SEQ ID NO: 7647412 - DNA, 22 bp, Homo sapiens
acctcccctcaccaatctggtt

SEQ ID NO: 7647413 - DNA, 22 bp, Homo sapiens
acctcccctcaccaatctggtt

SEQ ID NO: 7647414 - DNA, 22 bp, Homo sapiens
acctcccctgactcgaaaccca

SEQ ID NO: 7647415 - DNA, 22 bp, Homo sapiens
acctcccctgactcgaaaccca

SEQ ID NO: 7647416 - DNA, 22 bp, Homo sapiens
acctcccctgactcgaaaccca

SEQ ID NO: 7647417 - DNA, 22 bp, Homo sapiens
acctcccctgactcgaaaccca

SEQ ID NO: 7647418 - DNA, 22 bp, Homo sapiens
acctcccctgactcgaaaccca

SEQ ID NO: 7647419 - DNA, 22 bp, Homo sapiens
acctcccctgactcgaaaccca

SEQ ID NO: 7647420 - DNA, 22 bp, Homo sapiens
acctccccgggagcagcctcct

SEQ ID NO: 7647421 - DNA, 22 bp, Homo sapiens
acctccccgggagcagcctcct

SEQ ID NO: 7647422 - DNA, 22 bp, Homo sapiens
acctccccgggagcagcctcct

SEQ ID NO: 7647423 - DNA, 22 bp, Homo sapiens
acctccccgggagcagcctcct

SEQ ID NO: 7647424 - DNA, 22 bp, Homo sapiens
acctccccgggagcagcctcct

SEQ ID NO: 7647425 - DNA, 22 bp, Homo sapiens
acctccccgggagcagcctcct

SEQ ID NO: 7647426 - DNA, 22 bp, Homo sapiens
acctcccctcaccaatctggtt

SEQ ID NO: 7647427 - DNA, 22 bp, Homo sapiens
acctcccctcaccaatctggtt

SEQ ID NO: 7647428 - DNA, 22 bp, Homo sapiens
acctcccctcaccaatctggtt

SEQ ID NO: 7647429 - DNA, 22 bp, Homo sapiens
acctcccctcaccaatctggtt

SEQ ID NO: 7647430 - DNA, 22 bp, Homo sapiens
acctccccgggagcagcctcct

SEQ ID NO: 7647431 - DNA, 22 bp, Homo sapiens
acctccccgggagcagcctcct

SEQ ID NO: 7647432 - DNA, 22 bp, Homo sapiens
acctccccgggagcagcctcct

SEQ ID NO: 7647433 - DNA, 22 bp, Homo sapiens
acctccccattaggtcacccac

SEQ ID NO: 7647434 - DNA, 22 bp, Homo sapiens
acctccccacatggtagtgagt

SEQ ID NO: 7647435 - DNA, 22 bp, Homo sapiens
acctccccacatggtagtgagt

SEQ ID NO: 7647436 - DNA, 22 bp, Homo sapiens
acctccccacatggtagtgagt

SEQ ID NO: 7647437 - DNA, 22 bp, Homo sapiens
acctccccattaggtcacccac

SEQ ID NO: 7647438 - DNA, 22 bp, Homo sapiens
acctccccacatggtagtgagt

SEQ ID NO: 7647439 - DNA, 18 bp, Homo sapiens
acctccccattttctgaa

SEQ ID NO: 7647440 - DNA, 18 bp, Homo sapiens
acctccccattttctgaa

SEQ ID NO: 7647441 - DNA, 18 bp, Homo sapiens
acctccccattttctgaa

SEQ ID NO: 7647442 - DNA, 18 bp, Homo sapiens
acctccccattttctgaa

SEQ ID NO: 7647443 - DNA, 22 bp, Homo sapiens
acctccccattaggtcacccac

SEQ ID NO: 7647444 - DNA, 22 bp, Homo sapiens
acctccccattaggtcacccac

SEQ ID NO: 7647445 - DNA, 22 bp, Homo sapiens
acctccccattaggtcacccac

SEQ ID NO: 7647446 - DNA, 22 bp, Homo sapiens
acctccccattaggtcacccac

SEQ ID NO: 7647447 - DNA, 22 bp, Homo sapiens
acctccccattaggtcacccac

SEQ ID NO: 7647448 - DNA, 18 bp, Homo sapiens
acctccccattttctgaa

SEQ ID NO: 7647449 - DNA, 22 bp, Homo sapiens
agggtgggctagactcttcccc

SEQ ID NO: 7647450 - DNA, 22 bp, Homo sapiens
agggtgggctagactcttcccc

SEQ ID NO: 7647451 - DNA, 22 bp, Homo sapiens
agggtgggctagactcttcccc

SEQ ID NO: 7647452 - DNA, 22 bp, Homo sapiens
agggtgggctagactcttcccc

SEQ ID NO: 7647453 - DNA, 22 bp, Homo sapiens
agggtgcctggaagccactcac

SEQ ID NO: 7647454 - DNA, 22 bp, Homo sapiens
agggtgcgttctatgagaatct

SEQ ID NO: 7647455 - DNA, 20 bp, Homo sapiens
agggtggggacgttctgact

SEQ ID NO: 7647456 - DNA, 20 bp, Homo sapiens
agggtggggacgttctgact

SEQ ID NO: 7647457 - DNA, 20 bp, Homo sapiens
agggtggggacgttctgact

SEQ ID NO: 7647458 - DNA, 20 bp, Homo sapiens
agggtggggacgttctgact

SEQ ID NO: 7647459 - DNA, 20 bp, Homo sapiens
agggtggggacgttctgact

SEQ ID NO: 7647460 - DNA, 20 bp, Homo sapiens
agggtggggacgttctgact

SEQ ID NO: 7647461 - DNA, 20 bp, Homo sapiens
agggtggggacgttctgact

SEQ ID NO: 7647462 - DNA, 20 bp, Homo sapiens
agggtggggacgttctgact

SEQ ID NO: 7647463 - DNA, 20 bp, Homo sapiens
agggtggggacgttctgact

SEQ ID NO: 7647464 - DNA, 22 bp, Homo sapiens
agggcttgtttcctgtttcata

SEQ ID NO: 7647465 - DNA, 22 bp, Homo sapiens
agggctttaatgattattttct

SEQ ID NO: 7647466 - DNA, 22 bp, Homo sapiens
agggctttacttctcagttcta

SEQ ID NO: 7647467 - DNA, 22 bp, Homo sapiens
agggctttacttctcagttcta

SEQ ID NO: 7647468 - DNA, 22 bp, Homo sapiens
agggctttcggcactctgaggg

SEQ ID NO: 7647469 - DNA, 22 bp, Homo sapiens
agggctttcggcactctgaggg

SEQ ID NO: 7647470 - DNA, 22 bp, Homo sapiens
agggtgcctggaagccactcac

SEQ ID NO: 7647471 - DNA, 22 bp, Homo sapiens
agggcttgtggtcgtggctgtg

SEQ ID NO: 7647472 - DNA, 22 bp, Homo sapiens
agggcttgtagggtggctgtag

SEQ ID NO: 7647473 - DNA, 22 bp, Homo sapiens
agggcttgccattgcctgttag

SEQ ID NO: 7647474 - DNA, 22 bp, Homo sapiens
agggcttgctgatttaaagagc

SEQ ID NO: 7647475 - DNA, 22 bp, Homo sapiens
agggcttgttaacatagagatt

SEQ ID NO: 7647476 - DNA, 22 bp, Homo sapiens
agggcttgtggtcgtggctgtg

SEQ ID NO: 7647477 - DNA, 22 bp, Homo sapiens
agggcttgtggtcgtggctgtg

SEQ ID NO: 7647478 - DNA, 22 bp, Homo sapiens
agggcttgtggtcgtggctgtg

SEQ ID NO: 7647479 - DNA, 22 bp, Homo sapiens
agggcttgttaacatagagatt

SEQ ID NO: 7647480 - DNA, 22 bp, Homo sapiens
agggcttgttaacatagagatt

SEQ ID NO: 7647481 - DNA, 22 bp, Homo sapiens
agggcttgttaacatagagatt

SEQ ID NO: 7647482 - DNA, 22 bp, Homo sapiens
agggcttgttaacatagagatt

SEQ ID NO: 7647483 - DNA, 22 bp, Homo sapiens
agggctgtcagactgaggaggc

SEQ ID NO: 7647484 - DNA, 22 bp, Homo sapiens
agggctgtcagactgaggaggc

SEQ ID NO: 7647485 - DNA, 22 bp, Homo sapiens
agggctgtgtccctaggggagc

SEQ ID NO: 7647486 - DNA, 22 bp, Homo sapiens
agggctgtgtttgcaccctctg

SEQ ID NO: 7647487 - DNA, 22 bp, Homo sapiens
agggcttgcagaaatgagaaat

SEQ ID NO: 7647488 - DNA, 22 bp, Homo sapiens
agggcttgcagaaatgagaaat

SEQ ID NO: 7647489 - DNA, 22 bp, Homo sapiens
agggcttgcagaaatgagaaat

SEQ ID NO: 7647490 - DNA, 22 bp, Homo sapiens
agggcttgacaagggctggagc

SEQ ID NO: 7647491 - DNA, 22 bp, Homo sapiens
agggcttgacaagggctggagc

SEQ ID NO: 7647492 - DNA, 22 bp, Homo sapiens
agggcttgacaagggctggagc

SEQ ID NO: 7647493 - DNA, 22 bp, Homo sapiens
agggcttgacaagggctggagc

SEQ ID NO: 7647494 - DNA, 22 bp, Homo sapiens
agggctgtttttggcacctggg

SEQ ID NO: 7647495 - DNA, 22 bp, Homo sapiens
agggctgtttttcagtgtgtga

SEQ ID NO: 7647496 - DNA, 22 bp, Homo sapiens
agggctgtttttggcacctggg

SEQ ID NO: 7647497 - DNA, 22 bp, Homo sapiens
agggctgtttttggcacctggg

SEQ ID NO: 7647498 - DNA, 22 bp, Homo sapiens
accctcagagtaggcactgctg

SEQ ID NO: 7647499 - DNA, 22 bp, Homo sapiens
accctcagagtaggcactgctg

SEQ ID NO: 7647500 - DNA, 22 bp, Homo sapiens
accctcagctggagattgaatt

SEQ ID NO: 7647501 - DNA, 22 bp, Homo sapiens
accctcagagtaggcactgctg

SEQ ID NO: 7647502 - DNA, 22 bp, Homo sapiens
accctcagctggagattgaatt

SEQ ID NO: 7647503 - DNA, 22 bp, Homo sapiens
agggctggtatgtccatgaaag

SEQ ID NO: 7647504 - DNA, 22 bp, Homo sapiens
accctcaggcagaatgtattct

SEQ ID NO: 7647505 - DNA, 22 bp, Homo sapiens
accctcagcttcttggattaat

SEQ ID NO: 7647506 - DNA, 22 bp, Homo sapiens
agggctggtatgtccatgaaag

SEQ ID NO: 7647507 - DNA, 22 bp, Homo sapiens
agggctggtatgtccatgaaag

SEQ ID NO: 7647508 - DNA, 22 bp, Homo sapiens
agggctggtatgtccatgaaag

SEQ ID NO: 7647509 - DNA, 22 bp, Homo sapiens
agggctggtatgtccatgaaag

SEQ ID NO: 7647510 - DNA, 22 bp, Homo sapiens
agggctggtatgtccatgaaag

SEQ ID NO: 7647511 - DNA, 22 bp, Homo sapiens
agggctggtatgtccatgaaag

SEQ ID NO: 7647512 - DNA, 22 bp, Homo sapiens
agggctggtatgtccatgaaag

SEQ ID NO: 7647513 - DNA, 22 bp, Homo sapiens
agggctggtatgtccatgaaag

SEQ ID NO: 7647514 - DNA, 22 bp, Homo sapiens
agggctggtatgtccatgaaag

SEQ ID NO: 7647515 - DNA, 22 bp, Homo sapiens
agggctggtatgtccatgaaag

SEQ ID NO: 7647516 - DNA, 22 bp, Homo sapiens
actaaaaactactgccaatagc

SEQ ID NO: 7647517 - DNA, 22 bp, Homo sapiens
actaaaaactactgccaatagc

SEQ ID NO: 7647518 - DNA, 19 bp, Homo sapiens
actaaaaatgatgtttgag

SEQ ID NO: 7647519 - DNA, 19 bp, Homo sapiens
actaaaaatgatgtttgag

SEQ ID NO: 7647520 - DNA, 19 bp, Homo sapiens
actaaaaatgatgtttgag

SEQ ID NO: 7647521 - DNA, 22 bp, Homo sapiens
actaaaaactactgccaatagc

SEQ ID NO: 7647522 - DNA, 22 bp, Homo sapiens
actaaaaactactgccaatagc

SEQ ID NO: 7647523 - DNA, 22 bp, Homo sapiens
actaaaaactactgccaatagc

SEQ ID NO: 7647524 - DNA, 22 bp, Homo sapiens
actaaaaactactgccaatagc

SEQ ID NO: 7647525 - DNA, 22 bp, Homo sapiens
actaaaaactactgccaatagc

SEQ ID NO: 7647526 - DNA, 22 bp, Homo sapiens
actaaaaactactgccaatagc

SEQ ID NO: 7647527 - DNA, 22 bp, Homo sapiens
actaaaaactactgccaatagc

SEQ ID NO: 7647528 - DNA, 22 bp, Homo sapiens
acgttttattcccatgcagcat

SEQ ID NO: 7647529 - DNA, 22 bp, Homo sapiens
acgtttgttgatggattactag

SEQ ID NO: 7647530 - DNA, 22 bp, Homo sapiens
acgttttattcccatgcagcat

SEQ ID NO: 7647531 - DNA, 22 bp, Homo sapiens
acgttatatctgaaaaaagtga

SEQ ID NO: 7647532 - DNA, 22 bp, Homo sapiens
acgtttatggagtgcctatcat

SEQ ID NO: 7647533 - DNA, 22 bp, Homo sapiens
acgtttgctttctttggcctgg

SEQ ID NO: 7647534 - DNA, 22 bp, Homo sapiens
acgttaaacatttagcatagta

SEQ ID NO: 7647535 - DNA, 22 bp, Homo sapiens
acgttaaacatttagcatagta

SEQ ID NO: 7647536 - DNA, 22 bp, Homo sapiens
acgtgtgtttaacaaacctgca

SEQ ID NO: 7647537 - DNA, 22 bp, Homo sapiens
acgtgtgttggtcagggggccc

SEQ ID NO: 7647538 - DNA, 22 bp, Homo sapiens
acgtgtgtttaacaaacctgca

SEQ ID NO: 7647539 - DNA, 20 bp, Homo sapiens
acgtgtgtgtgcacgcgcgc

SEQ ID NO: 7647540 - DNA, 22 bp, Homo sapiens
acgtgtgtgacattgggaacgt

SEQ ID NO: 7647541 - DNA, 22 bp, Homo sapiens
acgtgtgttggtcagggggccc

SEQ ID NO: 7647542 - DNA, 22 bp, Homo sapiens
acgtgtgtgacattgggaacgt

SEQ ID NO: 7647543 - DNA, 20 bp, Homo sapiens
acgtgtgtgtgcacgcgcgc

SEQ ID NO: 7647544 - DNA, 17 bp, Homo sapiens
acgtggccataattaaa

SEQ ID NO: 7647545 - DNA, 22 bp, Homo sapiens
acgggctgggacggggaagctc

SEQ ID NO: 7647546 - DNA, 22 bp, Homo sapiens
acgggccttctcttcaggcgag

SEQ ID NO: 7647547 - DNA, 22 bp, Homo sapiens
acgtgtgtatgagtgtacatat

SEQ ID NO: 7647548 - DNA, 22 bp, Homo sapiens
acgtgtgtatgagtgtacatat

SEQ ID NO: 7647549 - DNA, 22 bp, Homo sapiens
acgtggcggccgccgtgagcgg

SEQ ID NO: 7647550 - DNA, 22 bp, Homo sapiens
acgtggcggccgccgtgagcgg

SEQ ID NO: 7647551 - DNA, 22 bp, Homo sapiens
acgtggcggccgccgtgagcgg

SEQ ID NO: 7647552 - DNA, 22 bp, Homo sapiens
acgtggcggccgccgtgagcgg

SEQ ID NO: 7647553 - DNA, 22 bp, Homo sapiens
actaaagaagccaaagttttct

SEQ ID NO: 7647554 - DNA, 22 bp, Homo sapiens
actaaagaacagttcgttcatg

SEQ ID NO: 7647555 - DNA, 22 bp, Homo sapiens
actaaactgttcatcagcatct

SEQ ID NO: 7647556 - DNA, 22 bp, Homo sapiens
actaaagatgtctaaatatatt

SEQ ID NO: 7647557 - DNA, 22 bp, Homo sapiens
actaaagatgtctaaatatatt

SEQ ID NO: 7647558 - DNA, 22 bp, Homo sapiens
actaaagaagccaaagttttct

SEQ ID NO: 7647559 - DNA, 22 bp, Homo sapiens
actaaagatgtctaaatatatt

SEQ ID NO: 7647560 - DNA, 22 bp, Homo sapiens
actaaagtatggaagtgaataa

SEQ ID NO: 7647561 - DNA, 22 bp, Homo sapiens
actaaagtatggaagtgaataa

SEQ ID NO: 7647562 - DNA, 22 bp, Homo sapiens
actaaagtcagactgcattgat

SEQ ID NO: 7647563 - DNA, 22 bp, Homo sapiens
actaaagtcagactgcattgat

SEQ ID NO: 7647564 - DNA, 22 bp, Homo sapiens
actaaagtcagactgcattgat

SEQ ID NO: 7647565 - DNA, 22 bp, Homo sapiens
actaaagctcacagagttgaac

SEQ ID NO: 7647566 - DNA, 22 bp, Homo sapiens
actaaagtatctcctatttcat

SEQ ID NO: 7647567 - DNA, 22 bp, Homo sapiens
actaaagctcacagagttgaac

SEQ ID NO: 7647568 - DNA, 22 bp, Homo sapiens
actaaacacatgagattcctgc

SEQ ID NO: 7647569 - DNA, 22 bp, Homo sapiens
actaaactgaagcatgaaaagg

SEQ ID NO: 7647570 - DNA, 22 bp, Homo sapiens
actaaaacatagccagtcagtg

SEQ ID NO: 7647571 - DNA, 22 bp, Homo sapiens
actaaaacatagccagtcagtg

SEQ ID NO: 7647572 - DNA, 22 bp, Homo sapiens
actaaaacagtggctagtagac

SEQ ID NO: 7647573 - DNA, 19 bp, Homo sapiens
actaaaaatgatgtttgag

SEQ ID NO: 7647574 - DNA, 19 bp, Homo sapiens
actaaaaatgatgtttgag

SEQ ID NO: 7647575 - DNA, 19 bp, Homo sapiens
actaaaaatgatgtttgag

SEQ ID NO: 7647576 - DNA, 19 bp, Homo sapiens
actaaaaatgatgtttgag

SEQ ID NO: 7647577 - DNA, 19 bp, Homo sapiens
actaaaaatgatgtttgag

SEQ ID NO: 7647578 - DNA, 22 bp, Homo sapiens
actaaaacagtggctagtagac

SEQ ID NO: 7647579 - DNA, 19 bp, Homo sapiens
actaaaaatgatgtttgag

SEQ ID NO: 7647580 - DNA, 22 bp, Homo sapiens
acctgttttcagaaaatgcaga

SEQ ID NO: 7647581 - DNA, 22 bp, Homo sapiens
acctgttttcagaaaatgcaga

SEQ ID NO: 7647582 - DNA, 22 bp, Homo sapiens
acctgtttgttaagaaagcttc

SEQ ID NO: 7647583 - DNA, 22 bp, Homo sapiens
acctgttttcctatctagattg

SEQ ID NO: 7647584 - DNA, 22 bp, Homo sapiens
acctgttttcctatctagattg

SEQ ID NO: 7647585 - DNA, 22 bp, Homo sapiens
acctgttttagtctttaatcat

SEQ ID NO: 7647586 - DNA, 22 bp, Homo sapiens
acctgtttgttaagaaagcttc

SEQ ID NO: 7647587 - DNA, 22 bp, Homo sapiens
acctgttttagtctttaatcat

SEQ ID NO: 7647588 - DNA, 22 bp, Homo sapiens
acctgtttggaggaggtgttag

SEQ ID NO: 7647589 - DNA, 22 bp, Homo sapiens
acctgtttctctctgagttact

SEQ ID NO: 7647590 - DNA, 22 bp, Homo sapiens
acctgtttgtgtccattagtga

SEQ ID NO: 7647591 - DNA, 22 bp, Homo sapiens
acctgtttgtgtttggactgca

SEQ ID NO: 7647592 - DNA, 22 bp, Homo sapiens
acctgtttagaaagcttatgag

SEQ ID NO: 7647593 - DNA, 22 bp, Homo sapiens
acctgtttacctgcacctgttt

SEQ ID NO: 7647594 - DNA, 22 bp, Homo sapiens
acctgtttacctgcacctgttt

SEQ ID NO: 7647595 - DNA, 22 bp, Homo sapiens
acctgtttagaaagcttatgag

SEQ ID NO: 7647596 - DNA, 22 bp, Homo sapiens
accttaaaggccgaagtaaaga

SEQ ID NO: 7647597 - DNA, 22 bp, Homo sapiens
accttaaaggccgaagtaaaga

SEQ ID NO: 7647598 - DNA, 22 bp, Homo sapiens
accttaaaggccgaagtaaaga

SEQ ID NO: 7647599 - DNA, 22 bp, Homo sapiens
accttaaaggccgaagtaaaga

SEQ ID NO: 7647600 - DNA, 22 bp, Homo sapiens
accttaaatgtgacatagtcta

SEQ ID NO: 7647601 - DNA, 22 bp, Homo sapiens
accttaaaactgacacatggag

SEQ ID NO: 7647602 - DNA, 22 bp, Homo sapiens
accttaaaactgacacatggag

SEQ ID NO: 7647603 - DNA, 22 bp, Homo sapiens
accttaaaactgacacatggag

SEQ ID NO: 7647604 - DNA, 22 bp, Homo sapiens
accttaaaactgacacatggag

SEQ ID NO: 7647605 - DNA, 22 bp, Homo sapiens
accttaaactttacagccaagt

SEQ ID NO: 7647606 - DNA, 22 bp, Homo sapiens
accttaaactttacagccaagt

SEQ ID NO: 7647607 - DNA, 22 bp, Homo sapiens
accttaaaggccgaagtaaaga

SEQ ID NO: 7647608 - DNA, 22 bp, Homo sapiens
accttaaaggccgaagtaaaga

SEQ ID NO: 7647609 - DNA, 22 bp, Homo sapiens
accttaaaggccgaagtaaaga

SEQ ID NO: 7647610 - DNA, 19 bp, Homo sapiens
accttacagaaacaggcat

SEQ ID NO: 7647611 - DNA, 22 bp, Homo sapiens
accttaaatgtgacatagtcta

SEQ ID NO: 7647612 - DNA, 22 bp, Homo sapiens
accttacatgcttttttcctca

SEQ ID NO: 7647613 - DNA, 22 bp, Homo sapiens
accttacccagaggggcatgac

SEQ ID NO: 7647614 - DNA, 22 bp, Homo sapiens
accttagaaaatcaaaattaga

SEQ ID NO: 7647615 - DNA, 22 bp, Homo sapiens
accttaagatcaaacattcttt

SEQ ID NO: 7647616 - DNA, 22 bp, Homo sapiens
acgggccttctcttcaggcgag

SEQ ID NO: 7647617 - DNA, 22 bp, Homo sapiens
acgggccttctcttcaggcgag

SEQ ID NO: 7647618 - DNA, 22 bp, Homo sapiens
acgggcagacagagctactcgc

SEQ ID NO: 7647619 - DNA, 22 bp, Homo sapiens
acgggcagacagagctactcgc

SEQ ID NO: 7647620 - DNA, 22 bp, Homo sapiens
accttccaggaatctgccagat

SEQ ID NO: 7647621 - DNA, 21 bp, Homo sapiens
acgggaatgaacatggtggag

SEQ ID NO: 7647622 - DNA, 21 bp, Homo sapiens
accttcagtgttctcagctgc

SEQ ID NO: 7647623 - DNA, 23 bp, Homo sapiens
acgggagggctgtttgcttggtg

SEQ ID NO: 7647624 - DNA, 21 bp, Homo sapiens
accttcagtgttctcagctgc

SEQ ID NO: 7647625 - DNA, 22 bp, Homo sapiens
accttcaggtgagcacacagat

SEQ ID NO: 7647626 - DNA, 21 bp, Homo sapiens
accttcagtgttctcagctgc

SEQ ID NO: 7647627 - DNA, 19 bp, Homo sapiens
accttcagagtggcacaaa

SEQ ID NO: 7647628 - DNA, 19 bp, Homo sapiens
accttcagagtggcacaaa

SEQ ID NO: 7647629 - DNA, 19 bp, Homo sapiens
accttcagagtggcacaaa

SEQ ID NO: 7647630 - DNA, 22 bp, Homo sapiens
accttcaggtgagcacacagat

SEQ ID NO: 7647631 - DNA, 22 bp, Homo sapiens
accttcacctccacaccttggg

SEQ ID NO: 7647632 - DNA, 22 bp, Homo sapiens
accttcaattatttttgttcca

SEQ ID NO: 7647633 - DNA, 22 bp, Homo sapiens
accttcagacatcaactatctc

SEQ ID NO: 7647634 - DNA, 19 bp, Homo sapiens
accttcagagtggcacaaa

SEQ ID NO: 7647635 - DNA, 22 bp, Homo sapiens
accttcaatgaaaataatagtc

SEQ ID NO: 7647636 - DNA, 22 bp, Homo sapiens
accttcaagtatgtgggctgaa

SEQ ID NO: 7647637 - DNA, 22 bp, Homo sapiens
accttcaagtatgtgggctgaa

SEQ ID NO: 7647638 - DNA, 22 bp, Homo sapiens
accttcaagattgtgggtcaat

SEQ ID NO: 7647639 - DNA, 22 bp, Homo sapiens
accttcaagtatgtgggctgaa

SEQ ID NO: 7647640 - DNA, 22 bp, Homo sapiens
accttcaagaaacatttccttg

SEQ ID NO: 7647641 - DNA, 22 bp, Homo sapiens
accttcaagattgtgggtcaat

SEQ ID NO: 7647642 - DNA, 21 bp, Homo sapiens
accttcaagccagaggtggtc

SEQ ID NO: 7647643 - DNA, 21 bp, Homo sapiens
accttcaagccagaggtggtc

SEQ ID NO: 7647644 - DNA, 22 bp, Homo sapiens
accttcaaactagatagaagtt

SEQ ID NO: 7647645 - DNA, 22 bp, Homo sapiens
accttattttgaaatagattgt

SEQ ID NO: 7647646 - DNA, 22 bp, Homo sapiens
accttcaactcaaagtgtccca

SEQ ID NO: 7647647 - DNA, 22 bp, Homo sapiens
accttcaactcaaagtgtccca

SEQ ID NO: 7647648 - DNA, 22 bp, Homo sapiens
accttattttgaaatagattgt

SEQ ID NO: 7647649 - DNA, 22 bp, Homo sapiens
accttatttggaaatataatta

SEQ ID NO: 7647650 - DNA, 22 bp, Homo sapiens
accttatttggaaatataatta

SEQ ID NO: 7647651 - DNA, 22 bp, Homo sapiens
accttatttggaaatataatta

SEQ ID NO: 7647652 - DNA, 22 bp, Homo sapiens
accttattcttgcccttagatg

SEQ ID NO: 7647653 - DNA, 22 bp, Homo sapiens
actagtttattacagttccact

SEQ ID NO: 7647654 - DNA, 22 bp, Homo sapiens
actagtttattacagttccact

SEQ ID NO: 7647655 - DNA, 22 bp, Homo sapiens
actagtttattacagttccact

SEQ ID NO: 7647656 - DNA, 22 bp, Homo sapiens
actagtgtccttatataagagg

SEQ ID NO: 7647657 - DNA, 22 bp, Homo sapiens
actagtttatgctcagatgtct

SEQ ID NO: 7647658 - DNA, 22 bp, Homo sapiens
actagtttatgctcagatgtct

SEQ ID NO: 7647659 - DNA, 22 bp, Homo sapiens
actagtttatgctcagatgtct

SEQ ID NO: 7647660 - DNA, 22 bp, Homo sapiens
actatactgtctcttatagata

SEQ ID NO: 7647661 - DNA, 22 bp, Homo sapiens
actatacattgaatgttaaggt

SEQ ID NO: 7647662 - DNA, 22 bp, Homo sapiens
actagtgtccttatataagagg

SEQ ID NO: 7647663 - DNA, 22 bp, Homo sapiens
actagtgcacattgtttctcaa

SEQ ID NO: 7647664 - DNA, 22 bp, Homo sapiens
actagtgcagtcgggtaatcgc

SEQ ID NO: 7647665 - DNA, 22 bp, Homo sapiens
actagtgtccttatataagagg

SEQ ID NO: 7647666 - DNA, 22 bp, Homo sapiens
actaaatagttttgacagaaca

SEQ ID NO: 7647667 - DNA, 22 bp, Homo sapiens
actaaatatttgagaggtgtag

SEQ ID NO: 7647668 - DNA, 18 bp, Homo sapiens
actagtgagcaagctagg

SEQ ID NO: 7647669 - DNA, 22 bp, Homo sapiens
actaaatagttttgacagaaca

SEQ ID NO: 7647670 - DNA, 22 bp, Homo sapiens
actaaatagttttgacagaaca

SEQ ID NO: 7647671 - DNA, 22 bp, Homo sapiens
actaaatagttttgacagaaca

SEQ ID NO: 7647672 - DNA, 22 bp, Homo sapiens
actaaatagttttgacagaaca

SEQ ID NO: 7647673 - DNA, 22 bp, Homo sapiens
actaaagttcacggtcagcttt

SEQ ID NO: 7647674 - DNA, 22 bp, Homo sapiens
actaaagtgttggagaatgagg

SEQ ID NO: 7647675 - DNA, 22 bp, Homo sapiens
actaaagttcacggtcagcttt

SEQ ID NO: 7647676 - DNA, 22 bp, Homo sapiens
actaaagtgttggagaatgagg

SEQ ID NO: 7647677 - DNA, 22 bp, Homo sapiens
actaaagtgttggagaatgagg

SEQ ID NO: 7647678 - DNA, 22 bp, Homo sapiens
actaaagtgttggagaatgagg

SEQ ID NO: 7647679 - DNA, 22 bp, Homo sapiens
actaaagtgttggagaatgagg

SEQ ID NO: 7647680 - DNA, 22 bp, Homo sapiens
actaaagtcagactgcattgat

SEQ ID NO: 7647681 - DNA, 22 bp, Homo sapiens
actaaagtcatcaaagaacttt

SEQ ID NO: 7647682 - DNA, 22 bp, Homo sapiens
actaaagtcatcaaagaacttt

SEQ ID NO: 7647683 - DNA, 22 bp, Homo sapiens
actaaagtcatcaaagaacttt

SEQ ID NO: 7647684 - DNA, 22 bp, Homo sapiens
actaaagtcctgttgtagcata

SEQ ID NO: 7647685 - DNA, 22 bp, Homo sapiens
actaaatagttttgacagaaca

SEQ ID NO: 7647686 - DNA, 22 bp, Homo sapiens
actaaatagttttgacagaaca

SEQ ID NO: 7647687 - DNA, 22 bp, Homo sapiens
actaaatagttttgacagaaca

SEQ ID NO: 7647688 - DNA, 22 bp, Homo sapiens
actaaatagcctctggtagttg

SEQ ID NO: 7647689 - DNA, 22 bp, Homo sapiens
actaaatagcctctggtagttg

SEQ ID NO: 7647690 - DNA, 22 bp, Homo sapiens
actaaatacacacatttgttca

SEQ ID NO: 7647691 - DNA, 22 bp, Homo sapiens
actaaatacacacatttgttca

SEQ ID NO: 7647692 - DNA, 22 bp, Homo sapiens
actaaatacacacatttgttca

SEQ ID NO: 7647693 - DNA, 20 bp, Homo sapiens
actatagcatattcagaaag

SEQ ID NO: 7647694 - DNA, 22 bp, Homo sapiens
actatagctcgggttataatgt

SEQ ID NO: 7647695 - DNA, 22 bp, Homo sapiens
actatagctcgggttataatgt

SEQ ID NO: 7647696 - DNA, 22 bp, Homo sapiens
actatagatgctggcgaggctg

SEQ ID NO: 7647697 - DNA, 22 bp, Homo sapiens
actatactgtctcttatagata

SEQ ID NO: 7647698 - DNA, 22 bp, Homo sapiens
actatactgtctcttatagata

SEQ ID NO: 7647699 - DNA, 22 bp, Homo sapiens
actatagactgagtttgttcta

SEQ ID NO: 7647700 - DNA, 22 bp, Homo sapiens
actatatacacattatcttgtt

SEQ ID NO: 7647701 - DNA, 22 bp, Homo sapiens
actatatacacattatcttgtt

SEQ ID NO: 7647702 - DNA, 22 bp, Homo sapiens
actatcaacatcattgctctag

SEQ ID NO: 7647703 - DNA, 22 bp, Homo sapiens
actatcaacatcattgctctag

SEQ ID NO: 7647704 - DNA, 22 bp, Homo sapiens
actatatacacattatcttgtt

SEQ ID NO: 7647705 - DNA, 22 bp, Homo sapiens
actatatacacattatcttgtt

SEQ ID NO: 7647706 - DNA, 22 bp, Homo sapiens
actatatacacattatcttgtt

SEQ ID NO: 7647707 - DNA, 22 bp, Homo sapiens
actatatacacattatcttgtt

SEQ ID NO: 7647708 - DNA, 21 bp, Homo sapiens
actatgtcatttaagtcactg

SEQ ID NO: 7647709 - DNA, 22 bp, Homo sapiens
actatgtattgtatgggctggt

SEQ ID NO: 7647710 - DNA, 22 bp, Homo sapiens
actattagcatatcatgaatgg

SEQ ID NO: 7647711 - DNA, 22 bp, Homo sapiens
actattagcatatcatgaatgg

SEQ ID NO: 7647712 - DNA, 18 bp, Homo sapiens
actatgctgaataaatgg

SEQ ID NO: 7647713 - DNA, 18 bp, Homo sapiens
actatgctgaataaatgg

SEQ ID NO: 7647714 - DNA, 22 bp, Homo sapiens
actatgctcattgttaatattt

SEQ ID NO: 7647715 - DNA, 22 bp, Homo sapiens
actatgtacccaaagatctgat

SEQ ID NO: 7647716 - DNA, 22 bp, Homo sapiens
actatgtacccaaagatctgat

SEQ ID NO: 7647717 - DNA, 22 bp, Homo sapiens
actatgtaaactggcgtgggag

SEQ ID NO: 7647718 - DNA, 22 bp, Homo sapiens
actatgtaggctcaacttccac

SEQ ID NO: 7647719 - DNA, 22 bp, Homo sapiens
actatgtatactagatgtgtaa

SEQ ID NO: 7647720 - DNA, 22 bp, Homo sapiens
actatgaaagtataatattgaa

SEQ ID NO: 7647721 - DNA, 22 bp, Homo sapiens
actatgaaagtataatattgaa

SEQ ID NO: 7647722 - DNA, 22 bp, Homo sapiens
actatcttccttatgcctatca

SEQ ID NO: 7647723 - DNA, 22 bp, Homo sapiens
actatgaatagccagatagtga

SEQ ID NO: 7647724 - DNA, 20 bp, Homo sapiens
actatgaagttagccctcca

SEQ ID NO: 7647725 - DNA, 22 bp, Homo sapiens
actatgaatagccagatagtga

SEQ ID NO: 7647726 - DNA, 22 bp, Homo sapiens
actatgaatccacattgatttt

SEQ ID NO: 7647727 - DNA, 22 bp, Homo sapiens
actatgatgtattttgcatcta

SEQ ID NO: 7647728 - DNA, 19 bp, Homo sapiens
actatgcatttatttgttt

SEQ ID NO: 7647729 - DNA, 22 bp, Homo sapiens
actatgccatgtgaggataaag

SEQ ID NO: 7647730 - DNA, 22 bp, Homo sapiens
actatgctcactacctggggga

SEQ ID NO: 7647731 - DNA, 18 bp, Homo sapiens
actcacagcagaagaagg

SEQ ID NO: 7647732 - DNA, 22 bp, Homo sapiens
actcacagcagactatgaggga

SEQ ID NO: 7647733 - DNA, 18 bp, Homo sapiens
actcacagcagaagaagg

SEQ ID NO: 7647734 - DNA, 22 bp, Homo sapiens
actcacagcagactatgaggga

SEQ ID NO: 7647735 - DNA, 18 bp, Homo sapiens
actcacagcagaagaagg

SEQ ID NO: 7647736 - DNA, 22 bp, Homo sapiens
actcacagactgcaggtttatt

SEQ ID NO: 7647737 - DNA, 22 bp, Homo sapiens
actcacagaataggcatgatgg

SEQ ID NO: 7647738 - DNA, 22 bp, Homo sapiens
actcacagaataggcatgatgg

SEQ ID NO: 7647739 - DNA, 22 bp, Homo sapiens
actcacaagtgatgtgaatggc

SEQ ID NO: 7647740 - DNA, 22 bp, Homo sapiens
actcaatgttctcatagcacct

SEQ ID NO: 7647741 - DNA, 22 bp, Homo sapiens
actcacagaataggcatgatgg

SEQ ID NO: 7647742 - DNA, 23 bp, Homo sapiens
actcacaaagcaggatcatgttg

SEQ ID NO: 7647743 - DNA, 22 bp, Homo sapiens
actcaatcatttcctgtcacag

SEQ ID NO: 7647744 - DNA, 22 bp, Homo sapiens
actcaatcatttcctgtcacag

SEQ ID NO: 7647745 - DNA, 22 bp, Homo sapiens
actcaatgttctcatagcacct

SEQ ID NO: 7647746 - DNA, 23 bp, Homo sapiens
actcacaaagcaggatcatgttg

SEQ ID NO: 7647747 - DNA, 22 bp, Homo sapiens
actcacaagtgatgtgaatggc

SEQ ID NO: 7647748 - DNA, 19 bp, Homo sapiens
actcaggcttcctctgagg

SEQ ID NO: 7647749 - DNA, 19 bp, Homo sapiens
actcagggaaaggagaatt

SEQ ID NO: 7647750 - DNA, 22 bp, Homo sapiens
actcacaggactctgcatatag

SEQ ID NO: 7647751 - DNA, 22 bp, Homo sapiens
actcacagcatgagcttggcag

SEQ ID NO: 7647752 - DNA, 22 bp, Homo sapiens
actcacagcatgagcttggcag

SEQ ID NO: 7647753 - DNA, 22 bp, Homo sapiens
actcacagcatgagcttggcag

SEQ ID NO: 7647754 - DNA, 22 bp, Homo sapiens
actcacaggactctgcatatag

SEQ ID NO: 7647755 - DNA, 19 bp, Homo sapiens
actcaggcttcctctgagg

SEQ ID NO: 7647756 - DNA, 22 bp, Homo sapiens
actcattgaaacttaagatcta

SEQ ID NO: 7647757 - DNA, 22 bp, Homo sapiens
actcatgtcctaggagtaaagc

SEQ ID NO: 7647758 - DNA, 22 bp, Homo sapiens
actcatttaaacatttactgaa

SEQ ID NO: 7647759 - DNA, 22 bp, Homo sapiens
actcatttaaacatttactgaa

SEQ ID NO: 7647760 - DNA, 22 bp, Homo sapiens
actcattgaaacttaagatcta

SEQ ID NO: 7647761 - DNA, 22 bp, Homo sapiens
actcattgggaaagtgctctct

SEQ ID NO: 7647762 - DNA, 20 bp, Homo sapiens
actcaaatcacctgcctcaa

SEQ ID NO: 7647763 - DNA, 22 bp, Homo sapiens
actcaaatagctgcccctagtg

SEQ ID NO: 7647764 - DNA, 23 bp, Homo sapiens
actcaaatttcgcttggagttca

SEQ ID NO: 7647765 - DNA, 22 bp, Homo sapiens
actcaaatttgtcaactgaagc

SEQ ID NO: 7647766 - DNA, 22 bp, Homo sapiens
actcaaatttgtcaactgaagc

SEQ ID NO: 7647767 - DNA, 22 bp, Homo sapiens
actcaaatttgtcaactgaagc

SEQ ID NO: 7647768 - DNA, 22 bp, Homo sapiens
actcaaatttgtcaactgaagc

SEQ ID NO: 7647769 - DNA, 22 bp, Homo sapiens
actcaaatttgtcaactgaagc

SEQ ID NO: 7647770 - DNA, 22 bp, Homo sapiens
actcaacagggaacaagatcag

SEQ ID NO: 7647771 - DNA, 22 bp, Homo sapiens
actcaacagggaacaagatcag

SEQ ID NO: 7647772 - DNA, 19 bp, Homo sapiens
actcaagtctaatgaaatc

SEQ ID NO: 7647773 - DNA, 22 bp, Homo sapiens
actcaagtagatattaacaaaa

SEQ ID NO: 7647774 - DNA, 19 bp, Homo sapiens
actcaagtctaatgaaatc

SEQ ID NO: 7647775 - DNA, 21 bp, Homo sapiens
actcaagtggagatgccaggt

SEQ ID NO: 7647776 - DNA, 22 bp, Homo sapiens
actcaacagggaacaagatcag

SEQ ID NO: 7647777 - DNA, 22 bp, Homo sapiens
actcaacagggaacaagatcag

SEQ ID NO: 7647778 - DNA, 22 bp, Homo sapiens
actcaagatagggaaagtacaa

SEQ ID NO: 7647779 - DNA, 22 bp, Homo sapiens
actcaagatagggaaagtacaa

SEQ ID NO: 7647780 - DNA, 22 bp, Homo sapiens
actcaagatagggaaagtacaa

SEQ ID NO: 7647781 - DNA, 18 bp, Homo sapiens
actcaagggtggagagaa

SEQ ID NO: 7647782 - DNA, 18 bp, Homo sapiens
actattgaggtattcttg

SEQ ID NO: 7647783 - DNA, 22 bp, Homo sapiens
actattgcaatacgtgtcagca

SEQ ID NO: 7647784 - DNA, 22 bp, Homo sapiens
actattcaggctccatctggta

SEQ ID NO: 7647785 - DNA, 22 bp, Homo sapiens
actattcatgtttcctaactat

SEQ ID NO: 7647786 - DNA, 22 bp, Homo sapiens
actattcaagtgctcattcaga

SEQ ID NO: 7647787 - DNA, 22 bp, Homo sapiens
actattcaagtgctcattcaga

SEQ ID NO: 7647788 - DNA, 22 bp, Homo sapiens
actattcaagtgctcattcaga

SEQ ID NO: 7647789 - DNA, 22 bp, Homo sapiens
actattcacagattcagtgttc

SEQ ID NO: 7647790 - DNA, 22 bp, Homo sapiens
actatttactcaaatgaggttg

SEQ ID NO: 7647791 - DNA, 22 bp, Homo sapiens
actatttctagatgctctgata

SEQ ID NO: 7647792 - DNA, 22 bp, Homo sapiens
actatttgtaaagagcaaacgg

SEQ ID NO: 7647793 - DNA, 22 bp, Homo sapiens
actatttgtaaagagcaaacgg

SEQ ID NO: 7647794 - DNA, 23 bp, Homo sapiens
actcaaaatttggcatttgagga

SEQ ID NO: 7647795 - DNA, 22 bp, Homo sapiens
actcaaatagcaacggtgagaa

SEQ ID NO: 7647796 - DNA, 20 bp, Homo sapiens
agtctctgcaacatagtgca

SEQ ID NO: 7647797 - DNA, 20 bp, Homo sapiens
agtctctgcaacatagtgca

SEQ ID NO: 7647798 - DNA, 20 bp, Homo sapiens
agtctctgcaacatagtgca

SEQ ID NO: 7647799 - DNA, 20 bp, Homo sapiens
agtctctgcaacatagtgca

SEQ ID NO: 7647800 - DNA, 22 bp, Homo sapiens
agtctctgaggttcagatgcct

SEQ ID NO: 7647801 - DNA, 22 bp, Homo sapiens
agtctctgaggttcagatgcct

SEQ ID NO: 7647802 - DNA, 22 bp, Homo sapiens
agtctctgaggttcagatgcct

SEQ ID NO: 7647803 - DNA, 22 bp, Homo sapiens
agtctctgaggttcagatgcct

SEQ ID NO: 7647804 - DNA, 22 bp, Homo sapiens
agtctctgaggttcagatgcct

SEQ ID NO: 7647805 - DNA, 19 bp, Homo sapiens
agtctctgaggcctaagtt

SEQ ID NO: 7647806 - DNA, 19 bp, Homo sapiens
agtctctgaggcctaagtt

SEQ ID NO: 7647807 - DNA, 19 bp, Homo sapiens
agtctctgaggcctaagtt

SEQ ID NO: 7647808 - DNA, 22 bp, Homo sapiens
agtctacaacgcaagcaacatg

SEQ ID NO: 7647809 - DNA, 22 bp, Homo sapiens
agtctacaacgcaagcaacatg

SEQ ID NO: 7647810 - DNA, 22 bp, Homo sapiens
agtctacaaagggaagcccttt

SEQ ID NO: 7647811 - DNA, 22 bp, Homo sapiens
agtctacaaatcaccttgtcct

SEQ ID NO: 7647812 - DNA, 22 bp, Homo sapiens
agtctacaacgcaagcaacatg

SEQ ID NO: 7647813 - DNA, 21 bp, Homo sapiens
agtctacaactagggaagctg

SEQ ID NO: 7647814 - DNA, 22 bp, Homo sapiens
agtcgctgttggtcgtggcact

SEQ ID NO: 7647815 - DNA, 22 bp, Homo sapiens
agtctaatgtttgtaaaatcat

SEQ ID NO: 7647816 - DNA, 22 bp, Homo sapiens
agtcgcagacatggtccccttt

SEQ ID NO: 7647817 - DNA, 23 bp, Homo sapiens
agtcctttttataaaattgagga

SEQ ID NO: 7647818 - DNA, 23 bp, Homo sapiens
agtcctttttataaaattgagga

SEQ ID NO: 7647819 - DNA, 22 bp, Homo sapiens
actccagggctgaacgaggccc

SEQ ID NO: 7647820 - DNA, 22 bp, Homo sapiens
actccagggctgaacgaggccc

SEQ ID NO: 7647821 - DNA, 22 bp, Homo sapiens
actccagggctgaacgaggccc

SEQ ID NO: 7647822 - DNA, 22 bp, Homo sapiens
actccaggggttgctatttaca

SEQ ID NO: 7647823 - DNA, 22 bp, Homo sapiens
actccagggctgaacgaggccc

SEQ ID NO: 7647824 - DNA, 22 bp, Homo sapiens
actccagggctccatcccttgt

SEQ ID NO: 7647825 - DNA, 22 bp, Homo sapiens
actccagggctccaccccagat

SEQ ID NO: 7647826 - DNA, 22 bp, Homo sapiens
actccagggctccatcccttgt

SEQ ID NO: 7647827 - DNA, 20 bp, Homo sapiens
agtctctgtagtgcctgaga

SEQ ID NO: 7647828 - DNA, 20 bp, Homo sapiens
agtctctgtagtgcctgaga

SEQ ID NO: 7647829 - DNA, 20 bp, Homo sapiens
agtctctgtagtgcctgaga

SEQ ID NO: 7647830 - DNA, 20 bp, Homo sapiens
agtctctgtagtgcctgaga

SEQ ID NO: 7647831 - DNA, 20 bp, Homo sapiens
agtctctgtagtgcctgaga

SEQ ID NO: 7647832 - DNA, 20 bp, Homo sapiens
agtctctgtagtgcctgaga

SEQ ID NO: 7647833 - DNA, 22 bp, Homo sapiens
agtctctgtgagctcccaatgg

SEQ ID NO: 7647834 - DNA, 22 bp, Homo sapiens
agtctctgttccagggcttcag

SEQ ID NO: 7647835 - DNA, 22 bp, Homo sapiens
agtctctgttccagggcttcag

SEQ ID NO: 7647836 - DNA, 22 bp, Homo sapiens
agtctctgtcgtagatcagcgt

SEQ ID NO: 7647837 - DNA, 22 bp, Homo sapiens
agtctctgtcgtagatcagcgt

SEQ ID NO: 7647838 - DNA, 22 bp, Homo sapiens
agtctcttaaagacagtgttga

SEQ ID NO: 7647839 - DNA, 22 bp, Homo sapiens
agtctcttaatgggcagaaagt

SEQ ID NO: 7647840 - DNA, 22 bp, Homo sapiens
agtctcttaatgggcagaaagt

SEQ ID NO: 7647841 - DNA, 22 bp, Homo sapiens
agtctctgcatgcctgctgtgc

SEQ ID NO: 7647842 - DNA, 22 bp, Homo sapiens
agtctctgcatgcctgctgtgc

SEQ ID NO: 7647843 - DNA, 22 bp, Homo sapiens
agtctctgccagcttgtcctct

SEQ ID NO: 7647844 - DNA, 22 bp, Homo sapiens
agtctctgccagcttgtcctct

SEQ ID NO: 7647845 - DNA, 22 bp, Homo sapiens
agtctctgcatgatgcagcaca

SEQ ID NO: 7647846 - DNA, 22 bp, Homo sapiens
agtctctgcacagtaagaagca

SEQ ID NO: 7647847 - DNA, 22 bp, Homo sapiens
agtctctgcatgatgcagcaca

SEQ ID NO: 7647848 - DNA, 22 bp, Homo sapiens
agtctctgctggttgtgcctat

SEQ ID NO: 7647849 - DNA, 22 bp, Homo sapiens
agtctctgctggttgtgcctat

SEQ ID NO: 7647850 - DNA, 22 bp, Homo sapiens
agtctctgccagcttgtcctct

SEQ ID NO: 7647851 - DNA, 22 bp, Homo sapiens
agtctctggactgggagatggc

SEQ ID NO: 7647852 - DNA, 22 bp, Homo sapiens
agtctctgctggttgtgcctat

SEQ ID NO: 7647853 - DNA, 22 bp, Homo sapiens
agtctctggactgggagatggc

SEQ ID NO: 7647854 - DNA, 22 bp, Homo sapiens
actccagatgataagggacagt

SEQ ID NO: 7647855 - DNA, 22 bp, Homo sapiens
actccagatgataagggacagt

SEQ ID NO: 7647856 - DNA, 22 bp, Homo sapiens
actccagatgataagggacagt

SEQ ID NO: 7647857 - DNA, 22 bp, Homo sapiens
actccagaggcagctgtgctga

SEQ ID NO: 7647858 - DNA, 22 bp, Homo sapiens
actccagaggcagctgtgctga

SEQ ID NO: 7647859 - DNA, 22 bp, Homo sapiens
actccagagctcacatgtctaa

SEQ ID NO: 7647860 - DNA, 22 bp, Homo sapiens
actccagagctcacatgtctaa

SEQ ID NO: 7647861 - DNA, 22 bp, Homo sapiens
actccagacacagacactatga

SEQ ID NO: 7647862 - DNA, 22 bp, Homo sapiens
actccaggaaacttaggggaaa

SEQ ID NO: 7647863 - DNA, 22 bp, Homo sapiens
actccaggaaacttaggggaaa

SEQ ID NO: 7647864 - DNA, 22 bp, Homo sapiens
actccaggcatctgcttctgct

SEQ ID NO: 7647865 - DNA, 22 bp, Homo sapiens
actccaggcatctgcttctgct

SEQ ID NO: 7647866 - DNA, 22 bp, Homo sapiens
actccaggatgtagaatcagag

SEQ ID NO: 7647867 - DNA, 22 bp, Homo sapiens
actccagggaggtgagtgtgcg

SEQ ID NO: 7647868 - DNA, 22 bp, Homo sapiens
actccaggcatctgcttctgct

SEQ ID NO: 7647869 - DNA, 22 bp, Homo sapiens
actccaggcatctgcttctgct

SEQ ID NO: 7647870 - DNA, 22 bp, Homo sapiens
actccaggcatctgcttctgct

SEQ ID NO: 7647871 - DNA, 22 bp, Homo sapiens
actccagggctccaccccagat

SEQ ID NO: 7647872 - DNA, 19 bp, Homo sapiens
actccagggatgacagaag

SEQ ID NO: 7647873 - DNA, 19 bp, Homo sapiens
actccagggatgacagaag

SEQ ID NO: 7647874 - DNA, 20 bp, Homo sapiens
actcatttccagcatctgat

SEQ ID NO: 7647875 - DNA, 22 bp, Homo sapiens
actcatttaaacatttactgaa

SEQ ID NO: 7647876 - DNA, 22 bp, Homo sapiens
actcatttgacactttaaactg

SEQ ID NO: 7647877 - DNA, 22 bp, Homo sapiens
actcatttgcatgatgtgctat

SEQ ID NO: 7647878 - DNA, 22 bp, Homo sapiens
actcatttgcatgatgtgctat

SEQ ID NO: 7647879 - DNA, 22 bp, Homo sapiens
actcatttgcatgatgtgctat

SEQ ID NO: 7647880 - DNA, 22 bp, Homo sapiens
actcattttataacactgtagt

SEQ ID NO: 7647881 - DNA, 21 bp, Homo sapiens
actcatttgtctgcatctaat

SEQ ID NO: 7647882 - DNA, 21 bp, Homo sapiens
actcatttgtctgcatctaat

SEQ ID NO: 7647883 - DNA, 22 bp, Homo sapiens
actcatttgacactttaaactg

SEQ ID NO: 7647884 - DNA, 22 bp, Homo sapiens
actcatttgcatgatgtgctat

SEQ ID NO: 7647885 - DNA, 21 bp, Homo sapiens
actcatttgtctgcatctaat

SEQ ID NO: 7647886 - DNA, 22 bp, Homo sapiens
actcatttttactgcaattgag

SEQ ID NO: 7647887 - DNA, 22 bp, Homo sapiens
actcattttataacactgtagt

SEQ ID NO: 7647888 - DNA, 22 bp, Homo sapiens
actcattttataacactgtagt

SEQ ID NO: 7647889 - DNA, 22 bp, Homo sapiens
actccacatttgaacacagttc

SEQ ID NO: 7647890 - DNA, 22 bp, Homo sapiens
actccagaatcctagggtcagc

SEQ ID NO: 7647891 - DNA, 22 bp, Homo sapiens
actccagaatcctagggtcagc

SEQ ID NO: 7647892 - DNA, 22 bp, Homo sapiens
actccagaatcctagggtcagc

SEQ ID NO: 7647893 - DNA, 22 bp, Homo sapiens
actccacaccacgggggccgcc

SEQ ID NO: 7647894 - DNA, 22 bp, Homo sapiens
actccacatttgaacacagttc

SEQ ID NO: 7647895 - DNA, 22 bp, Homo sapiens
actccacatttgaacacagttc

SEQ ID NO: 7647896 - DNA, 22 bp, Homo sapiens
actccacatttgaacacagttc

SEQ ID NO: 7647897 - DNA, 22 bp, Homo sapiens
actccacatttgaacacagttc

SEQ ID NO: 7647898 - DNA, 22 bp, Homo sapiens
actccacaccacgggggccgcc

SEQ ID NO: 7647899 - DNA, 22 bp, Homo sapiens
actccacaccacgggggccgcc

SEQ ID NO: 7647900 - DNA, 22 bp, Homo sapiens
actccacaccacgggggccgcc

SEQ ID NO: 7647901 - DNA, 22 bp, Homo sapiens
actccacaccacgggggccgcc

SEQ ID NO: 7647902 - DNA, 22 bp, Homo sapiens
actccacaccacgggggccgcc

SEQ ID NO: 7647903 - DNA, 22 bp, Homo sapiens
actccacaccacgggggccgcc

SEQ ID NO: 7647904 - DNA, 22 bp, Homo sapiens
actccacaccacgggggccgcc

SEQ ID NO: 7647905 - DNA, 22 bp, Homo sapiens
actccacaccacgggggccgcc

SEQ ID NO: 7647906 - DNA, 22 bp, Homo sapiens
actccacaccacgggggccgcc

SEQ ID NO: 7647907 - DNA, 22 bp, Homo sapiens
actccaaggccacatgcattcc

SEQ ID NO: 7647908 - DNA, 21 bp, Homo sapiens
actccaaacaagttaagctgt

SEQ ID NO: 7647909 - DNA, 22 bp, Homo sapiens
actccacaccacgggggccgcc

SEQ ID NO: 7647910 - DNA, 22 bp, Homo sapiens
actccaaggccacatgcattcc

SEQ ID NO: 7647911 - DNA, 22 bp, Homo sapiens
actccaaggccacatgcattcc

SEQ ID NO: 7647912 - DNA, 22 bp, Homo sapiens
actgaagaacgcatcagtggtt

SEQ ID NO: 7647913 - DNA, 22 bp, Homo sapiens
actgaagacattactggtctaa

SEQ ID NO: 7647914 - DNA, 22 bp, Homo sapiens
actgaagacattactggtctaa

SEQ ID NO: 7647915 - DNA, 22 bp, Homo sapiens
actgaagacctcctgtcagcgg

SEQ ID NO: 7647916 - DNA, 22 bp, Homo sapiens
actgaagacctcctgtcagcgg

SEQ ID NO: 7647917 - DNA, 22 bp, Homo sapiens
actgaagagaagcattttctgc

SEQ ID NO: 7647918 - DNA, 22 bp, Homo sapiens
actgaagagaagcattttctgc

SEQ ID NO: 7647919 - DNA, 22 bp, Homo sapiens
actgaagagcgtgctatgctca

SEQ ID NO: 7647920 - DNA, 22 bp, Homo sapiens
actgaagagaagcattttctgc

SEQ ID NO: 7647921 - DNA, 22 bp, Homo sapiens
actgaagagcgtgctatgctca

SEQ ID NO: 7647922 - DNA, 22 bp, Homo sapiens
actgaagagcgtgctatgctca

SEQ ID NO: 7647923 - DNA, 18 bp, Homo sapiens
actgaagatgcaagacct

SEQ ID NO: 7647924 - DNA, 22 bp, Homo sapiens
actgaagagcgtgctatgctca

SEQ ID NO: 7647925 - DNA, 18 bp, Homo sapiens
actgaagatgcaagacct

SEQ ID NO: 7647926 - DNA, 18 bp, Homo sapiens
actgaagatgcaagacct

SEQ ID NO: 7647927 - DNA, 18 bp, Homo sapiens
actgaagatgcaagacct

SEQ ID NO: 7647928 - DNA, 22 bp, Homo sapiens
actgaagacattactggtctaa

SEQ ID NO: 7647929 - DNA, 22 bp, Homo sapiens
actgaagaacgcatcagtggtt

SEQ ID NO: 7647930 - DNA, 22 bp, Homo sapiens
actgaagaacgcatcagtggtt

SEQ ID NO: 7647931 - DNA, 22 bp, Homo sapiens
actgaactccagcctgggtggc

SEQ ID NO: 7647932 - DNA, 22 bp, Homo sapiens
actgaacttggtgaatgccaca

SEQ ID NO: 7647933 - DNA, 22 bp, Homo sapiens
actgaagaacgcatcagtggtt

SEQ ID NO: 7647934 - DNA, 22 bp, Homo sapiens
actgaacagcctttcaaactta

SEQ ID NO: 7647935 - DNA, 22 bp, Homo sapiens
actgaacatatgcaagaccatt

SEQ ID NO: 7647936 - DNA, 22 bp, Homo sapiens
actgaacatatgcaagaccatt

SEQ ID NO: 7647937 - DNA, 22 bp, Homo sapiens
actgaacatatgcaagaccatt

SEQ ID NO: 7647938 - DNA, 22 bp, Homo sapiens
actgaacatatgcaagaccatt

SEQ ID NO: 7647939 - DNA, 23 bp, Homo sapiens
actgaagatgtcttagtggccct

SEQ ID NO: 7647940 - DNA, 23 bp, Homo sapiens
actgaagatgtcttagtggccct

SEQ ID NO: 7647941 - DNA, 23 bp, Homo sapiens
actgaagatgtcttagtggccct

SEQ ID NO: 7647942 - DNA, 19 bp, Homo sapiens
actgaagcagggactgaaa

SEQ ID NO: 7647943 - DNA, 17 bp, Homo sapiens
actgaagcatttatgat

SEQ ID NO: 7647944 - DNA, 22 bp, Homo sapiens
actgaagcttgggtggaactta

SEQ ID NO: 7647945 - DNA, 22 bp, Homo sapiens
actgaagccagagggaggacat

SEQ ID NO: 7647946 - DNA, 22 bp, Homo sapiens
actgaagccagagggaggacat

SEQ ID NO: 7647947 - DNA, 22 bp, Homo sapiens
actgaagctgggcgatgcctcc

SEQ ID NO: 7647948 - DNA, 22 bp, Homo sapiens
actgaaggaaagcctttgcatg

SEQ ID NO: 7647949 - DNA, 22 bp, Homo sapiens
actgaaggaaagcctttgcatg

SEQ ID NO: 7647950 - DNA, 22 bp, Homo sapiens
actgaaggaaacttttgtgttt

SEQ ID NO: 7647951 - DNA, 22 bp, Homo sapiens
actgaaggaagcgggcaggggt

SEQ ID NO: 7647952 - DNA, 22 bp, Homo sapiens
actgaaggaaagcctttgcatg

SEQ ID NO: 7647953 - DNA, 22 bp, Homo sapiens
actgaaggctttcccaaggtca

SEQ ID NO: 7647954 - DNA, 22 bp, Homo sapiens
actgaaggctttcccaaggtca

SEQ ID NO: 7647955 - DNA, 22 bp, Homo sapiens
actgaaggcttaactctttcat

SEQ ID NO: 7647956 - DNA, 22 bp, Homo sapiens
actgaagggtaatgtgggagcc

SEQ ID NO: 7647957 - DNA, 22 bp, Homo sapiens
actgaagggtaatgtgggagcc

SEQ ID NO: 7647958 - DNA, 22 bp, Homo sapiens
actgaaacatatatttgagttt

SEQ ID NO: 7647959 - DNA, 23 bp, Homo sapiens
actgaaaggatcctagcagagac

SEQ ID NO: 7647960 - DNA, 22 bp, Homo sapiens
actgaaacactgagtgaattgt

SEQ ID NO: 7647961 - DNA, 22 bp, Homo sapiens
actgaaacatatatttgagttt

SEQ ID NO: 7647962 - DNA, 22 bp, Homo sapiens
actgaaacatatatttgagttt

SEQ ID NO: 7647963 - DNA, 22 bp, Homo sapiens
actgaaaatgaattagaaacag

SEQ ID NO: 7647964 - DNA, 22 bp, Homo sapiens
actgaaaatgaattagaaacag

SEQ ID NO: 7647965 - DNA, 22 bp, Homo sapiens
actgaaagtccagcatggtaca

SEQ ID NO: 7647966 - DNA, 22 bp, Homo sapiens
actgaaatactgctcttggatt

SEQ ID NO: 7647967 - DNA, 22 bp, Homo sapiens
actgaaagtccagcatggtaca

SEQ ID NO: 7647968 - DNA, 22 bp, Homo sapiens
actgaaatactgctcttggatt

SEQ ID NO: 7647969 - DNA, 22 bp, Homo sapiens
actgaaatactgctcttggatt

SEQ ID NO: 7647970 - DNA, 22 bp, Homo sapiens
actgaaatactgctcttggatt

SEQ ID NO: 7647971 - DNA, 22 bp, Homo sapiens
actcttcattcaagtatgcaaa

SEQ ID NO: 7647972 - DNA, 22 bp, Homo sapiens
actcttcattcaagtatgcaaa

SEQ ID NO: 7647973 - DNA, 22 bp, Homo sapiens
actcttcattcaagtatgcaaa

SEQ ID NO: 7647974 - DNA, 22 bp, Homo sapiens
actcttcatgctatgctcaact

SEQ ID NO: 7647975 - DNA, 22 bp, Homo sapiens
actgaaaatgaattagaaacag

SEQ ID NO: 7647976 - DNA, 22 bp, Homo sapiens
actgaaaatgaattagaaacag

SEQ ID NO: 7647977 - DNA, 22 bp, Homo sapiens
actgaaaatgaattagaaacag

SEQ ID NO: 7647978 - DNA, 22 bp, Homo sapiens
actgaaatatttagaagtgaag

SEQ ID NO: 7647979 - DNA, 22 bp, Homo sapiens
actgaaatatttagaagtgaag

SEQ ID NO: 7647980 - DNA, 22 bp, Homo sapiens
actgaaatatttagaagtgaag

SEQ ID NO: 7647981 - DNA, 22 bp, Homo sapiens
actgaaatatttagaagtgaag

SEQ ID NO: 7647982 - DNA, 22 bp, Homo sapiens
actgaaatatttagaagtgaag

SEQ ID NO: 7647983 - DNA, 22 bp, Homo sapiens
actgaaatgaaatctatcatct

SEQ ID NO: 7647984 - DNA, 22 bp, Homo sapiens
actgaaatgaaatctatcatct

SEQ ID NO: 7647985 - DNA, 22 bp, Homo sapiens
actgaaatggggacagtcctta

SEQ ID NO: 7647986 - DNA, 22 bp, Homo sapiens
actgaacagcctgaggagtcac

SEQ ID NO: 7647987 - DNA, 22 bp, Homo sapiens
actgaacagcctgaggagtcac

SEQ ID NO: 7647988 - DNA, 22 bp, Homo sapiens
actgaacagaccattttgtcct

SEQ ID NO: 7647989 - DNA, 22 bp, Homo sapiens
actgaacacttttgaaagatta

SEQ ID NO: 7647990 - DNA, 22 bp, Homo sapiens
actgaacaccatttataacatt

SEQ ID NO: 7647991 - DNA, 22 bp, Homo sapiens
actgaacaccatttataacatt

SEQ ID NO: 7647992 - DNA, 22 bp, Homo sapiens
actgaacaccatttataacatt

SEQ ID NO: 7647993 - DNA, 22 bp, Homo sapiens
actgaacacttttgaaagatta

SEQ ID NO: 7647994 - DNA, 22 bp, Homo sapiens
actgaacacttttgaaagatta

SEQ ID NO: 7647995 - DNA, 22 bp, Homo sapiens
actgaacaccatttataacatt

SEQ ID NO: 7647996 - DNA, 22 bp, Homo sapiens
actgaacaccatttataacatt

SEQ ID NO: 7647997 - DNA, 22 bp, Homo sapiens
actgaaatggggacagtcctta

SEQ ID NO: 7647998 - DNA, 22 bp, Homo sapiens
actgaacacacctgcagcacgt

SEQ ID NO: 7647999 - DNA, 22 bp, Homo sapiens
actgaaatggggacagtcctta

SEQ ID NO: 7648000 - DNA, 22 bp, Homo sapiens
actgaaatttatattttgggca

SEQ ID NO: 7648001 - DNA, 22 bp, Homo sapiens
actgaaatttatattttgggca

SEQ ID NO: 7648002 - DNA, 17 bp, Homo sapiens
agtctgggacctgcgtg

SEQ ID NO: 7648003 - DNA, 17 bp, Homo sapiens
agtctgggacctgcgtg

SEQ ID NO: 7648004 - DNA, 17 bp, Homo sapiens
agtctgggacctgcgtg

SEQ ID NO: 7648005 - DNA, 22 bp, Homo sapiens
agtctgggaactgggaacgttt

SEQ ID NO: 7648006 - DNA, 22 bp, Homo sapiens
agtctgggaactgggaacgttt

SEQ ID NO: 7648007 - DNA, 22 bp, Homo sapiens
agtctggctttttgatgagctt

SEQ ID NO: 7648008 - DNA, 20 bp, Homo sapiens
agtctggcacctattcctgt

SEQ ID NO: 7648009 - DNA, 20 bp, Homo sapiens
agtctggcatgatgcaggca

SEQ ID NO: 7648010 - DNA, 22 bp, Homo sapiens
agtctgggagggatgccagtgt

SEQ ID NO: 7648011 - DNA, 22 bp, Homo sapiens
agtctgggagggatgccagtgt

SEQ ID NO: 7648012 - DNA, 22 bp, Homo sapiens
agtctgggaggcttataaacag

SEQ ID NO: 7648013 - DNA, 22 bp, Homo sapiens
agtctgggaggcttataaacag

SEQ ID NO: 7648014 - DNA, 22 bp, Homo sapiens
agtctgggagaaggtgagatta

SEQ ID NO: 7648015 - DNA, 22 bp, Homo sapiens
agtctgggagaaggtgagatta

SEQ ID NO: 7648016 - DNA, 17 bp, Homo sapiens
agtctgggacctgcgtg

SEQ ID NO: 7648017 - DNA, 22 bp, Homo sapiens
agtctgggagaaggtgagatta

SEQ ID NO: 7648018 - DNA, 22 bp, Homo sapiens
agtctcttggcattctgaaaca

SEQ ID NO: 7648019 - DNA, 22 bp, Homo sapiens
agtctggatttagaggtgggcc

SEQ ID NO: 7648020 - DNA, 22 bp, Homo sapiens
agtctcttggcattctgaaaca

SEQ ID NO: 7648021 - DNA, 22 bp, Homo sapiens
agtctcttggcattctgaaaca

SEQ ID NO: 7648022 - DNA, 22 bp, Homo sapiens
agtctcttgctagaatcagcca

SEQ ID NO: 7648023 - DNA, 22 bp, Homo sapiens
agtctcttgcacattgtattaa

SEQ ID NO: 7648024 - DNA, 22 bp, Homo sapiens
agtctcttgcacattgtattaa

SEQ ID NO: 7648025 - DNA, 22 bp, Homo sapiens
agtctcttcgagccgcagggct

SEQ ID NO: 7648026 - DNA, 22 bp, Homo sapiens
agtctcttccttcaaggctggt

SEQ ID NO: 7648027 - DNA, 22 bp, Homo sapiens
agtctcttaattttttctaagt

SEQ ID NO: 7648028 - DNA, 22 bp, Homo sapiens
agtctcttacccaagcagaatg

SEQ ID NO: 7648029 - DNA, 22 bp, Homo sapiens
agtctcttacccaagcagaatg

SEQ ID NO: 7648030 - DNA, 22 bp, Homo sapiens
agtctcttagatgtggacctgc

SEQ ID NO: 7648031 - DNA, 22 bp, Homo sapiens
agtctcttcctcatgcatatgt

SEQ ID NO: 7648032 - DNA, 22 bp, Homo sapiens
agtctcttattccctattgctg

SEQ ID NO: 7648033 - DNA, 22 bp, Homo sapiens
agtctcttcctcatgcatatgt

SEQ ID NO: 7648034 - DNA, 22 bp, Homo sapiens
agtctcttcctcatgcatatgt

SEQ ID NO: 7648035 - DNA, 22 bp, Homo sapiens
agtctcttcctcatgcatatgt

SEQ ID NO: 7648036 - DNA, 22 bp, Homo sapiens
agtctgggctgtctgcaggagt

SEQ ID NO: 7648037 - DNA, 22 bp, Homo sapiens
agtctgggctgtctgcaggagt

SEQ ID NO: 7648038 - DNA, 22 bp, Homo sapiens
agtctgggctgtctgcaggagt

SEQ ID NO: 7648039 - DNA, 22 bp, Homo sapiens
agtctgggctgtctgcaggagt

SEQ ID NO: 7648040 - DNA, 22 bp, Homo sapiens
agtctgggcatttaggatgttg

SEQ ID NO: 7648041 - DNA, 22 bp, Homo sapiens
agtctgggcatttaggatgttg

SEQ ID NO: 7648042 - DNA, 22 bp, Homo sapiens
agtctgggcatttaggatgttg

SEQ ID NO: 7648043 - DNA, 22 bp, Homo sapiens
agtctgggagggatgccagtgt

SEQ ID NO: 7648044 - DNA, 22 bp, Homo sapiens
agtctgggagggatgccagtgt

SEQ ID NO: 7648045 - DNA, 22 bp, Homo sapiens
agtctgggcatttaggatgttg

SEQ ID NO: 7648046 - DNA, 22 bp, Homo sapiens
agtctgggcatttaggatgttg

SEQ ID NO: 7648047 - DNA, 22 bp, Homo sapiens
agtctgggcatttaggatgttg

SEQ ID NO: 7648048 - DNA, 21 bp, Homo sapiens
agtctggggaagggatcccag

SEQ ID NO: 7648049 - DNA, 21 bp, Homo sapiens
agtctggggaagggatcccag

SEQ ID NO: 7648050 - DNA, 22 bp, Homo sapiens
agtctggggtctggtagaacga

SEQ ID NO: 7648051 - DNA, 22 bp, Homo sapiens
agtctggggtctggtagaacga

SEQ ID NO: 7648052 - DNA, 21 bp, Homo sapiens
agtctggggaagggatcccag

SEQ ID NO: 7648053 - DNA, 22 bp, Homo sapiens
agtctgggctgtctgcaggagt

SEQ ID NO: 7648054 - DNA, 22 bp, Homo sapiens
agtctgggctgtctgcaggagt

SEQ ID NO: 7648055 - DNA, 22 bp, Homo sapiens
agtctgggctgtctgcaggagt

SEQ ID NO: 7648056 - DNA, 22 bp, Homo sapiens
agtctgggctgtctgcaggagt

SEQ ID NO: 7648057 - DNA, 22 bp, Homo sapiens
actcttcatgctatgctcaact

SEQ ID NO: 7648058 - DNA, 22 bp, Homo sapiens
actcttcatacagtcatctaat

SEQ ID NO: 7648059 - DNA, 22 bp, Homo sapiens
agtctggtgtatgaaagtgaat

SEQ ID NO: 7648060 - DNA, 22 bp, Homo sapiens
agtctggtgttctcacactagt

SEQ ID NO: 7648061 - DNA, 22 bp, Homo sapiens
agtctggtagaggaagaggcct

SEQ ID NO: 7648062 - DNA, 22 bp, Homo sapiens
agtctggtattggtctttaatc

SEQ ID NO: 7648063 - DNA, 22 bp, Homo sapiens
agtctggtattggtctttaatc

SEQ ID NO: 7648064 - DNA, 22 bp, Homo sapiens
agtctggtcatctgattctttt

SEQ ID NO: 7648065 - DNA, 22 bp, Homo sapiens
agtctggtctgttcatgggtca

SEQ ID NO: 7648066 - DNA, 22 bp, Homo sapiens
agtctggtgagaacataaatag

SEQ ID NO: 7648067 - DNA, 22 bp, Homo sapiens
agtctggtgctcgctctgcttc

SEQ ID NO: 7648068 - DNA, 19 bp, Homo sapiens
agtctggtggcgtgcatgt

SEQ ID NO: 7648069 - DNA, 22 bp, Homo sapiens
agtctggtggtattttgtagtg

SEQ ID NO: 7648070 - DNA, 22 bp, Homo sapiens
agtctgggtgtgaatgaacttg

SEQ ID NO: 7648071 - DNA, 22 bp, Homo sapiens
agtctggtaaactgaaaaatat

SEQ ID NO: 7648072 - DNA, 22 bp, Homo sapiens
agtctggtaatgtagctcaacc

SEQ ID NO: 7648073 - DNA, 22 bp, Homo sapiens
agtctgggtgtgaatgaacttg

SEQ ID NO: 7648074 - DNA, 22 bp, Homo sapiens
agtctgggtgtgaatgaacttg

SEQ ID NO: 7648075 - DNA, 22 bp, Homo sapiens
agtctgggtggctgagctacag

SEQ ID NO: 7648076 - DNA, 22 bp, Homo sapiens
agtctgggtggctgagctacag

SEQ ID NO: 7648077 - DNA, 22 bp, Homo sapiens
agtctggggtctggtagaacga

SEQ ID NO: 7648078 - DNA, 22 bp, Homo sapiens
agtctgggtggctgagctacag

SEQ ID NO: 7648079 - DNA, 22 bp, Homo sapiens
agtctgggtggctgagctacag

SEQ ID NO: 7648080 - DNA, 22 bp, Homo sapiens
actgctttaaaaaagcaagctt

SEQ ID NO: 7648081 - DNA, 22 bp, Homo sapiens
actgctttaaaaaagcaagctt

SEQ ID NO: 7648082 - DNA, 23 bp, Homo sapiens
agtggctgagagtgtttcatatg

SEQ ID NO: 7648083 - DNA, 20 bp, Homo sapiens
actgcttctttctctgacct

SEQ ID NO: 7648084 - DNA, 20 bp, Homo sapiens
actgcttctttctctgacct

SEQ ID NO: 7648085 - DNA, 22 bp, Homo sapiens
actgcttagtattattaatgtc

SEQ ID NO: 7648086 - DNA, 22 bp, Homo sapiens
actgcttcactgcgtcttatct

SEQ ID NO: 7648087 - DNA, 22 bp, Homo sapiens
actgcttacttctagaactctt

SEQ ID NO: 7648088 - DNA, 22 bp, Homo sapiens
actgcttacttctagaactctt

SEQ ID NO: 7648089 - DNA, 22 bp, Homo sapiens
actgcttagtattattaatgtc

SEQ ID NO: 7648090 - DNA, 22 bp, Homo sapiens
actgcttcctgagaaatcaaca

SEQ ID NO: 7648091 - DNA, 22 bp, Homo sapiens
actgcttctccaatgaattaga

SEQ ID NO: 7648092 - DNA, 22 bp, Homo sapiens
actgcttacttctagaactctt

SEQ ID NO: 7648093 - DNA, 22 bp, Homo sapiens
actgctgtgttcggctccccgt

SEQ ID NO: 7648094 - DNA, 22 bp, Homo sapiens
actgctgtgatctgatgtaatt

SEQ ID NO: 7648095 - DNA, 22 bp, Homo sapiens
actgcttacaaaaggaaagaat

SEQ ID NO: 7648096 - DNA, 22 bp, Homo sapiens
agtggctgagtgactgtgactc

SEQ ID NO: 7648097 - DNA, 22 bp, Homo sapiens
agtggctgagtgactgtgactc

SEQ ID NO: 7648098 - DNA, 20 bp, Homo sapiens
agtggctgatggaaagaagc

SEQ ID NO: 7648099 - DNA, 22 bp, Homo sapiens
agtggctgagtgactgtgactc

SEQ ID NO: 7648100 - DNA, 22 bp, Homo sapiens
agtggctgagtgactgtgactc

SEQ ID NO: 7648101 - DNA, 23 bp, Homo sapiens
agtggctgagagtgtttcatatg

SEQ ID NO: 7648102 - DNA, 22 bp, Homo sapiens
actgctttagacctagagctct

SEQ ID NO: 7648103 - DNA, 22 bp, Homo sapiens
actgctttagacctagagctct

SEQ ID NO: 7648104 - DNA, 22 bp, Homo sapiens
agtggctgatgtaggcagtggg

SEQ ID NO: 7648105 - DNA, 22 bp, Homo sapiens
agtggctgatgtaggcagtggg

SEQ ID NO: 7648106 - DNA, 22 bp, Homo sapiens
agtggctgatgtaggcagtggg

SEQ ID NO: 7648107 - DNA, 22 bp, Homo sapiens
agtggctgatgtaggcagtggg

SEQ ID NO: 7648108 - DNA, 22 bp, Homo sapiens
agtggctgatgtaggcagtggg

SEQ ID NO: 7648109 - DNA, 22 bp, Homo sapiens
agtggctgatgtaggcagtggg

SEQ ID NO: 7648110 - DNA, 22 bp, Homo sapiens
actgctcaaggatctggtaggg

SEQ ID NO: 7648111 - DNA, 22 bp, Homo sapiens
actgctcaaggatctggtaggg

SEQ ID NO: 7648112 - DNA, 22 bp, Homo sapiens
actgctccaccctggggcccag

SEQ ID NO: 7648113 - DNA, 22 bp, Homo sapiens
actgctccaccctggggcccag

SEQ ID NO: 7648114 - DNA, 22 bp, Homo sapiens
actgctctctgcaagtagatgg

SEQ ID NO: 7648115 - DNA, 22 bp, Homo sapiens
actgctctctttgcaggggcta

SEQ ID NO: 7648116 - DNA, 22 bp, Homo sapiens
actgctgagcacacaagagtgt

SEQ ID NO: 7648117 - DNA, 22 bp, Homo sapiens
actgctgagagcaatcccaaac

SEQ ID NO: 7648118 - DNA, 22 bp, Homo sapiens
actgctgactaaacagctccat

SEQ ID NO: 7648119 - DNA, 22 bp, Homo sapiens
actgctctgttttcatatgttt

SEQ ID NO: 7648120 - DNA, 22 bp, Homo sapiens
actgctgacctcaggtcatcct

SEQ ID NO: 7648121 - DNA, 22 bp, Homo sapiens
actgctggaaacccagaatggt

SEQ ID NO: 7648122 - DNA, 22 bp, Homo sapiens
actgctggaaacccagaatggt

SEQ ID NO: 7648123 - DNA, 20 bp, Homo sapiens
actgctgtagaccatctgca

SEQ ID NO: 7648124 - DNA, 22 bp, Homo sapiens
actgctggcatgcatatacaaa

SEQ ID NO: 7648125 - DNA, 22 bp, Homo sapiens
actgctgtgatctgatgtaatt

SEQ ID NO: 7648126 - DNA, 22 bp, Homo sapiens
actgctgagcacacaagagtgt

SEQ ID NO: 7648127 - DNA, 22 bp, Homo sapiens
actgctgatataagaaaagatt

SEQ ID NO: 7648128 - DNA, 22 bp, Homo sapiens
actgctgatataagaaaagatt

SEQ ID NO: 7648129 - DNA, 22 bp, Homo sapiens
actgctgattatgaaagtgaca

SEQ ID NO: 7648130 - DNA, 22 bp, Homo sapiens
actgctgattattgaagtagag

SEQ ID NO: 7648131 - DNA, 22 bp, Homo sapiens
actgctgattattgaagtagag

SEQ ID NO: 7648132 - DNA, 22 bp, Homo sapiens
actgctgatttagctttgtggg

SEQ ID NO: 7648133 - DNA, 22 bp, Homo sapiens
actgctgattttaggactgtta

SEQ ID NO: 7648134 - DNA, 22 bp, Homo sapiens
actgctgatttagctttgtggg

SEQ ID NO: 7648135 - DNA, 22 bp, Homo sapiens
actgctgattttaggactgtta

SEQ ID NO: 7648136 - DNA, 22 bp, Homo sapiens
actgctgcaggtccagcccctt

SEQ ID NO: 7648137 - DNA, 22 bp, Homo sapiens
actggcagaactggtgattgtc

SEQ ID NO: 7648138 - DNA, 22 bp, Homo sapiens
actggcagaacgtgatgcgggt

SEQ ID NO: 7648139 - DNA, 20 bp, Homo sapiens
actggcactggtaggtgtgg

SEQ ID NO: 7648140 - DNA, 20 bp, Homo sapiens
actggcactggtaggtgtgg

SEQ ID NO: 7648141 - DNA, 22 bp, Homo sapiens
actggcactatgttggagaaat

SEQ ID NO: 7648142 - DNA, 22 bp, Homo sapiens
actggcactatgttggagaaat

SEQ ID NO: 7648143 - DNA, 22 bp, Homo sapiens
actggcacaagaagagtcgtgg

SEQ ID NO: 7648144 - DNA, 22 bp, Homo sapiens
actggcacaagaagagtcgtgg

SEQ ID NO: 7648145 - DNA, 19 bp, Homo sapiens
actggcacacaggggctgc

SEQ ID NO: 7648146 - DNA, 22 bp, Homo sapiens
actggcaatagcaaatgcttgg

SEQ ID NO: 7648147 - DNA, 22 bp, Homo sapiens
actggcaatagcaaatgcttgg

SEQ ID NO: 7648148 - DNA, 22 bp, Homo sapiens
actggcaaaatagtatattcct

SEQ ID NO: 7648149 - DNA, 22 bp, Homo sapiens
actggcaaaatagtatattcct

SEQ ID NO: 7648150 - DNA, 19 bp, Homo sapiens
actggcaaaaaaggttaat

SEQ ID NO: 7648151 - DNA, 22 bp, Homo sapiens
actggcagagaccctgatggcc

SEQ ID NO: 7648152 - DNA, 22 bp, Homo sapiens
actggcagaattgaatagttgt

SEQ ID NO: 7648153 - DNA, 22 bp, Homo sapiens
actggcagaattgaatagttgt

SEQ ID NO: 7648154 - DNA, 22 bp, Homo sapiens
actggcagagaccctgatggcc

SEQ ID NO: 7648155 - DNA, 22 bp, Homo sapiens
actggcagagaccctgatggcc

SEQ ID NO: 7648156 - DNA, 22 bp, Homo sapiens
actggcagagggaaaaccattc

SEQ ID NO: 7648157 - DNA, 22 bp, Homo sapiens
actggcagaggatagcactaat

SEQ ID NO: 7648158 - DNA, 22 bp, Homo sapiens
actggcagaggatagcactaat

SEQ ID NO: 7648159 - DNA, 22 bp, Homo sapiens
actggcagaggttggacaccat

SEQ ID NO: 7648160 - DNA, 22 bp, Homo sapiens
actggcagaggttggacaccat

SEQ ID NO: 7648161 - DNA, 22 bp, Homo sapiens
actggcagaggttggacaccat

SEQ ID NO: 7648162 - DNA, 22 bp, Homo sapiens
actggcagccacaactggcagg

SEQ ID NO: 7648163 - DNA, 22 bp, Homo sapiens
actggcagccacaactggcagg

SEQ ID NO: 7648164 - DNA, 22 bp, Homo sapiens
actggcagccacaactggcagg

SEQ ID NO: 7648165 - DNA, 22 bp, Homo sapiens
actggcagccacaactggcagg

SEQ ID NO: 7648166 - DNA, 22 bp, Homo sapiens
actggcagccacaactggcagg

SEQ ID NO: 7648167 - DNA, 22 bp, Homo sapiens
actggcagcagcagcccttggg

SEQ ID NO: 7648168 - DNA, 22 bp, Homo sapiens
actggcagcagcagcccttggg

SEQ ID NO: 7648169 - DNA, 22 bp, Homo sapiens
agtggctgctggagtggagatg

SEQ ID NO: 7648170 - DNA, 22 bp, Homo sapiens
agtggctgctggagtggagatg

SEQ ID NO: 7648171 - DNA, 22 bp, Homo sapiens
agtggctgcttctggttgctcc

SEQ ID NO: 7648172 - DNA, 22 bp, Homo sapiens
agtggctgcttctggttgctcc

SEQ ID NO: 7648173 - DNA, 22 bp, Homo sapiens
agtggctgctgactttaataca

SEQ ID NO: 7648174 - DNA, 22 bp, Homo sapiens
agtggctgctgactttaataca

SEQ ID NO: 7648175 - DNA, 22 bp, Homo sapiens
agtggctgctggagtggagatg

SEQ ID NO: 7648176 - DNA, 22 bp, Homo sapiens
agtggctgattacaaactgagt

SEQ ID NO: 7648177 - DNA, 22 bp, Homo sapiens
agtggctgccaagagcaatgct

SEQ ID NO: 7648178 - DNA, 22 bp, Homo sapiens
agtggctgccaagatataattc

SEQ ID NO: 7648179 - DNA, 22 bp, Homo sapiens
agtggctgctatgatcaggaca

SEQ ID NO: 7648180 - DNA, 22 bp, Homo sapiens
agtggctgctatgatcaggaca

SEQ ID NO: 7648181 - DNA, 22 bp, Homo sapiens
agtggctgctatgatcaggaca

SEQ ID NO: 7648182 - DNA, 22 bp, Homo sapiens
actggacagaggaaatatggag

SEQ ID NO: 7648183 - DNA, 22 bp, Homo sapiens
actggacagaggaaatatggag

SEQ ID NO: 7648184 - DNA, 22 bp, Homo sapiens
agtggctgcttctggttgctcc

SEQ ID NO: 7648185 - DNA, 22 bp, Homo sapiens
agtggctggaattgcaggtgcg

SEQ ID NO: 7648186 - DNA, 22 bp, Homo sapiens
actggagttttaaaggaacttg

SEQ ID NO: 7648187 - DNA, 22 bp, Homo sapiens
actggagttttaaaggaacttg

SEQ ID NO: 7648188 - DNA, 22 bp, Homo sapiens
actggagttttaaaggaacttg

SEQ ID NO: 7648189 - DNA, 20 bp, Homo sapiens
actggatctggctggagctg

SEQ ID NO: 7648190 - DNA, 22 bp, Homo sapiens
actggatggtgtcatgagcagc

SEQ ID NO: 7648191 - DNA, 22 bp, Homo sapiens
actggattgggaaagtacttca

SEQ ID NO: 7648192 - DNA, 19 bp, Homo sapiens
actggcaaaaaaggttaat

SEQ ID NO: 7648193 - DNA, 22 bp, Homo sapiens
actgcacacctccagggcacta

SEQ ID NO: 7648194 - DNA, 21 bp, Homo sapiens
actgcacactatgtgaattga

SEQ ID NO: 7648195 - DNA, 22 bp, Homo sapiens
actgcacacttagcatctggga

SEQ ID NO: 7648196 - DNA, 22 bp, Homo sapiens
actgcacacttagcatctggga

SEQ ID NO: 7648197 - DNA, 22 bp, Homo sapiens
actgcacacctccagggcacta

SEQ ID NO: 7648198 - DNA, 22 bp, Homo sapiens
actgcacagaagaaactatcaa

SEQ ID NO: 7648199 - DNA, 22 bp, Homo sapiens
actgcacagaaccttagaatat

SEQ ID NO: 7648200 - DNA, 22 bp, Homo sapiens
actgcacagaagaaactatcaa

SEQ ID NO: 7648201 - DNA, 22 bp, Homo sapiens
actgcacagaagaaactatcaa

SEQ ID NO: 7648202 - DNA, 23 bp, Homo sapiens
actgcctgtgccgatctctctca

SEQ ID NO: 7648203 - DNA, 23 bp, Homo sapiens
actgcctgtgccgatctctctca

SEQ ID NO: 7648204 - DNA, 23 bp, Homo sapiens
actgcctgtgccgatctctctca

SEQ ID NO: 7648205 - DNA, 22 bp, Homo sapiens
actgcctgtgcactggtctttt

SEQ ID NO: 7648206 - DNA, 22 bp, Homo sapiens
actgcctgtgcactggtctttt

SEQ ID NO: 7648207 - DNA, 21 bp, Homo sapiens
actgcctgtctccatagtcta

SEQ ID NO: 7648208 - DNA, 22 bp, Homo sapiens
actgcacagaattatggttggt

SEQ ID NO: 7648209 - DNA, 22 bp, Homo sapiens
actgcacagaattatggttggt

SEQ ID NO: 7648210 - DNA, 22 bp, Homo sapiens
actgcctgtagctcttcatctc

SEQ ID NO: 7648211 - DNA, 22 bp, Homo sapiens
actgcaacctccgcctgccagg

SEQ ID NO: 7648212 - DNA, 22 bp, Homo sapiens
actgcaacctccgcctgccagg

SEQ ID NO: 7648213 - DNA, 22 bp, Homo sapiens
actgcaacctccgcctgccagg

SEQ ID NO: 7648214 - DNA, 22 bp, Homo sapiens
actgcaacctccgcctgccagg

SEQ ID NO: 7648215 - DNA, 22 bp, Homo sapiens
actgcaacctccgcctgccagg

SEQ ID NO: 7648216 - DNA, 22 bp, Homo sapiens
actgcaacctccgcctgccagg

SEQ ID NO: 7648217 - DNA, 22 bp, Homo sapiens
actgcaacctccgcctgccagg

SEQ ID NO: 7648218 - DNA, 22 bp, Homo sapiens
actgcaacctccgcctgccagg

SEQ ID NO: 7648219 - DNA, 22 bp, Homo sapiens
actgcaacctccgcctgccagg

SEQ ID NO: 7648220 - DNA, 22 bp, Homo sapiens
actgcaagaatggtaatatttg

SEQ ID NO: 7648221 - DNA, 22 bp, Homo sapiens
actgcacacatgtttaagtgga

SEQ ID NO: 7648222 - DNA, 22 bp, Homo sapiens
actgcacaaggcctggacacac

SEQ ID NO: 7648223 - DNA, 22 bp, Homo sapiens
actgcaagtcacttggctatgt

SEQ ID NO: 7648224 - DNA, 22 bp, Homo sapiens
actgcaatctggatcctagaag

SEQ ID NO: 7648225 - DNA, 22 bp, Homo sapiens
actgcaattatttgttcaccaa

SEQ ID NO: 7648226 - DNA, 22 bp, Homo sapiens
actgcacaaggcctggacacac

SEQ ID NO: 7648227 - DNA, 22 bp, Homo sapiens
actgcacaaggcctggacacac

SEQ ID NO: 7648228 - DNA, 22 bp, Homo sapiens
actgcaacacctcctgggttca

SEQ ID NO: 7648229 - DNA, 22 bp, Homo sapiens
actgcaacacctcctgggttca

SEQ ID NO: 7648230 - DNA, 22 bp, Homo sapiens
actgcaaagggaagccctttct

SEQ ID NO: 7648231 - DNA, 22 bp, Homo sapiens
actgcaaagggaagccctttct

SEQ ID NO: 7648232 - DNA, 22 bp, Homo sapiens
actgcaaagggaagccctttct

SEQ ID NO: 7648233 - DNA, 22 bp, Homo sapiens
actgcaaagggaagccctttct

SEQ ID NO: 7648234 - DNA, 22 bp, Homo sapiens
actgcaaagggaagccctttct

SEQ ID NO: 7648235 - DNA, 22 bp, Homo sapiens
actgcaaagccagatattatca

SEQ ID NO: 7648236 - DNA, 21 bp, Homo sapiens
actgcaaacagcagagactga

SEQ ID NO: 7648237 - DNA, 22 bp, Homo sapiens
actgatttttcaggagggcctt

SEQ ID NO: 7648238 - DNA, 22 bp, Homo sapiens
actgcaaaaatgggtgcattca

SEQ ID NO: 7648239 - DNA, 22 bp, Homo sapiens
actgatttggttagagggccag

SEQ ID NO: 7648240 - DNA, 22 bp, Homo sapiens
actgcaaaaatgggtgcattca

SEQ ID NO: 7648241 - DNA, 21 bp, Homo sapiens
actgcaaacagcagagactga

SEQ ID NO: 7648242 - DNA, 22 bp, Homo sapiens
actgcaacctccacctcctggg

SEQ ID NO: 7648243 - DNA, 22 bp, Homo sapiens
actgcaacctccacctcctggg

SEQ ID NO: 7648244 - DNA, 22 bp, Homo sapiens
actgcaacctccacctcctggg

SEQ ID NO: 7648245 - DNA, 22 bp, Homo sapiens
actgcaacacctcctgggttca

SEQ ID NO: 7648246 - DNA, 20 bp, Homo sapiens
actgcaaagtactctttcag

SEQ ID NO: 7648247 - DNA, 22 bp, Homo sapiens
actgcaacacctcctgggttca

SEQ ID NO: 7648248 - DNA, 22 bp, Homo sapiens
actgcaacctccacctcctggg

SEQ ID NO: 7648249 - DNA, 22 bp, Homo sapiens
actgcaacctccacctcctggg

SEQ ID NO: 7648250 - DNA, 22 bp, Homo sapiens
actgcaacctccacctcctggg

SEQ ID NO: 7648251 - DNA, 22 bp, Homo sapiens
actgcaacctccacctcctggg

SEQ ID NO: 7648252 - DNA, 22 bp, Homo sapiens
actgcaacctccacctcctggg

SEQ ID NO: 7648253 - DNA, 22 bp, Homo sapiens
actgaatagcccttctgtctcc

SEQ ID NO: 7648254 - DNA, 22 bp, Homo sapiens
actgaatagtgctgcattgtac

SEQ ID NO: 7648255 - DNA, 22 bp, Homo sapiens
actgaatagtgctgcattgtac

SEQ ID NO: 7648256 - DNA, 22 bp, Homo sapiens
actgaatatattccattgcatg

SEQ ID NO: 7648257 - DNA, 22 bp, Homo sapiens
actgaatatattccattgcatg

SEQ ID NO: 7648258 - DNA, 22 bp, Homo sapiens
actgaattacagtctgcatttt

SEQ ID NO: 7648259 - DNA, 22 bp, Homo sapiens
actgaattacagtctgcatttt

SEQ ID NO: 7648260 - DNA, 22 bp, Homo sapiens
actgaattacagtctgcatttt

SEQ ID NO: 7648261 - DNA, 22 bp, Homo sapiens
actgaattacagtctgcatttt

SEQ ID NO: 7648262 - DNA, 22 bp, Homo sapiens
actgaattacagtctgcatttt

SEQ ID NO: 7648263 - DNA, 22 bp, Homo sapiens
actgaattagggaacactgaac

SEQ ID NO: 7648264 - DNA, 22 bp, Homo sapiens
actgaattagggaacactgaac

SEQ ID NO: 7648265 - DNA, 22 bp, Homo sapiens
actgagggtgcacaggcaggca

SEQ ID NO: 7648266 - DNA, 22 bp, Homo sapiens
actgagggtgcacaggcaggca

SEQ ID NO: 7648267 - DNA, 22 bp, Homo sapiens
actgagggtgcacaggcaggca

SEQ ID NO: 7648268 - DNA, 22 bp, Homo sapiens
actgagggtgcacaggcaggca

SEQ ID NO: 7648269 - DNA, 22 bp, Homo sapiens
actgagggttagtggaccgtgt

SEQ ID NO: 7648270 - DNA, 22 bp, Homo sapiens
actgagggtttggaatttcacc

SEQ ID NO: 7648271 - DNA, 22 bp, Homo sapiens
actgaattagggaacactgaac

SEQ ID NO: 7648272 - DNA, 22 bp, Homo sapiens
actgaattagggaacactgaac

SEQ ID NO: 7648273 - DNA, 22 bp, Homo sapiens
actgaattcctctttcttatcc

SEQ ID NO: 7648274 - DNA, 22 bp, Homo sapiens
actgaattcctctttcttatcc

SEQ ID NO: 7648275 - DNA, 22 bp, Homo sapiens
actgaattcctctttcttatcc

SEQ ID NO: 7648276 - DNA, 22 bp, Homo sapiens
actgaatttatgtttaaaaaca

SEQ ID NO: 7648277 - DNA, 22 bp, Homo sapiens
actgaatttatgtttaaaaaca

SEQ ID NO: 7648278 - DNA, 22 bp, Homo sapiens
actgaatttatgtttaaaaaca

SEQ ID NO: 7648279 - DNA, 22 bp, Homo sapiens
actgagggtcaaccatttgctc

SEQ ID NO: 7648280 - DNA, 22 bp, Homo sapiens
actgagggtcaaccatttgctc

SEQ ID NO: 7648281 - DNA, 22 bp, Homo sapiens
actgaaggtctcagcaaggatg

SEQ ID NO: 7648282 - DNA, 22 bp, Homo sapiens
actgaagtagtcattgtcatta

SEQ ID NO: 7648283 - DNA, 22 bp, Homo sapiens
actgaagtagtcattgtcatta

SEQ ID NO: 7648284 - DNA, 22 bp, Homo sapiens
actgaagtagtcattgtcatta

SEQ ID NO: 7648285 - DNA, 22 bp, Homo sapiens
actgaagtccacacatgtagga

SEQ ID NO: 7648286 - DNA, 22 bp, Homo sapiens
actgaagtccacacatgtagga

SEQ ID NO: 7648287 - DNA, 22 bp, Homo sapiens
actgaagtccacacatgtagga

SEQ ID NO: 7648288 - DNA, 22 bp, Homo sapiens
actgaagtctcttttgttctct

SEQ ID NO: 7648289 - DNA, 22 bp, Homo sapiens
actgaagtctcttttgttctct

SEQ ID NO: 7648290 - DNA, 22 bp, Homo sapiens
actgaagtgaaggcaatctttt

SEQ ID NO: 7648291 - DNA, 22 bp, Homo sapiens
actgaagtgtaggtgttttcct

SEQ ID NO: 7648292 - DNA, 19 bp, Homo sapiens
actgaagttacccaaatgg

SEQ ID NO: 7648293 - DNA, 22 bp, Homo sapiens
actgaagtgtaggtgttttcct

SEQ ID NO: 7648294 - DNA, 22 bp, Homo sapiens
actgaatagcccttctgtctcc

SEQ ID NO: 7648295 - DNA, 22 bp, Homo sapiens
actgaatagaaatgctcatagg

SEQ ID NO: 7648296 - DNA, 22 bp, Homo sapiens
actgaatagaaatgctcatagg

SEQ ID NO: 7648297 - DNA, 22 bp, Homo sapiens
actgaatagcccttctgtctcc

SEQ ID NO: 7648298 - DNA, 22 bp, Homo sapiens
actgaatagaaatgctcatagg

SEQ ID NO: 7648299 - DNA, 22 bp, Homo sapiens
actgaataatggtctgtgatct

SEQ ID NO: 7648300 - DNA, 22 bp, Homo sapiens
actgaataaggtgaatgctctg

SEQ ID NO: 7648301 - DNA, 22 bp, Homo sapiens
actgaataatggtctgtgatct

SEQ ID NO: 7648302 - DNA, 22 bp, Homo sapiens
actgaataatggtctgtgatct

SEQ ID NO: 7648303 - DNA, 22 bp, Homo sapiens
actgaagttcatacaacagact

SEQ ID NO: 7648304 - DNA, 22 bp, Homo sapiens
actgaagttcatacaacagact

SEQ ID NO: 7648305 - DNA, 22 bp, Homo sapiens
actgaagttcatacaacagact

SEQ ID NO: 7648306 - DNA, 22 bp, Homo sapiens
actgaataaggtgaatgctctg

SEQ ID NO: 7648307 - DNA, 23 bp, Homo sapiens
actgattaacatgtgtgatattc

SEQ ID NO: 7648308 - DNA, 22 bp, Homo sapiens
actgatgttaaccctctcttct

SEQ ID NO: 7648309 - DNA, 22 bp, Homo sapiens
actgatggcccaccttggtctc

SEQ ID NO: 7648310 - DNA, 22 bp, Homo sapiens
actgatggcccaccttggtctc

SEQ ID NO: 7648311 - DNA, 22 bp, Homo sapiens
actgatggcccaccttggtctc

SEQ ID NO: 7648312 - DNA, 22 bp, Homo sapiens
actgattcaagttatgcatctt

SEQ ID NO: 7648313 - DNA, 22 bp, Homo sapiens
actgattcaagttatgcatctt

SEQ ID NO: 7648314 - DNA, 22 bp, Homo sapiens
actgatttcagggatgagaaga

SEQ ID NO: 7648315 - DNA, 22 bp, Homo sapiens
actgattgcattcatagggttt

SEQ ID NO: 7648316 - DNA, 22 bp, Homo sapiens
actgattgcattcatagggttt

SEQ ID NO: 7648317 - DNA, 22 bp, Homo sapiens
actgatttcagggatgagaaga

SEQ ID NO: 7648318 - DNA, 22 bp, Homo sapiens
actgatttcagggatgagaaga

SEQ ID NO: 7648319 - DNA, 22 bp, Homo sapiens
actgatttcagggatgagaaga

SEQ ID NO: 7648320 - DNA, 22 bp, Homo sapiens
actgatttcagggatgagaaga

SEQ ID NO: 7648321 - DNA, 22 bp, Homo sapiens
actgatgaagagtaccactgtt

SEQ ID NO: 7648322 - DNA, 22 bp, Homo sapiens
actgatgagagttagtgctagt

SEQ ID NO: 7648323 - DNA, 22 bp, Homo sapiens
actgatgaagagtaccactgtt

SEQ ID NO: 7648324 - DNA, 22 bp, Homo sapiens
actgatgaaaggtaagactcca

SEQ ID NO: 7648325 - DNA, 22 bp, Homo sapiens
actgatgaaaactaataaatta

SEQ ID NO: 7648326 - DNA, 22 bp, Homo sapiens
actgatgaaaactaataaatta

SEQ ID NO: 7648327 - DNA, 22 bp, Homo sapiens
actgatgaaaactaataaatta

SEQ ID NO: 7648328 - DNA, 22 bp, Homo sapiens
actgatgagtaggcagacaagg

SEQ ID NO: 7648329 - DNA, 22 bp, Homo sapiens
actgatgagagttagtgctagt

SEQ ID NO: 7648330 - DNA, 22 bp, Homo sapiens
actgatgagtaggcagacaagg

SEQ ID NO: 7648331 - DNA, 22 bp, Homo sapiens
actgatgatctgggagtagagt

SEQ ID NO: 7648332 - DNA, 22 bp, Homo sapiens
actgatggcccaccttggtctc

SEQ ID NO: 7648333 - DNA, 23 bp, Homo sapiens
actgaggtactgaggttgtgaca

SEQ ID NO: 7648334 - DNA, 23 bp, Homo sapiens
actgaggtactgaggttgtgaca

SEQ ID NO: 7648335 - DNA, 22 bp, Homo sapiens
actgatcacatagatatattcc

SEQ ID NO: 7648336 - DNA, 22 bp, Homo sapiens
actgatcacatagatatattcc

SEQ ID NO: 7648337 - DNA, 22 bp, Homo sapiens
actgaggtaattgtgaggatta

SEQ ID NO: 7648338 - DNA, 22 bp, Homo sapiens
actgagggtttttatactcttt

SEQ ID NO: 7648339 - DNA, 22 bp, Homo sapiens
actgagggtttttatactcttt

SEQ ID NO: 7648340 - DNA, 22 bp, Homo sapiens
actgaggtaattgtgaggatta

SEQ ID NO: 7648341 - DNA, 22 bp, Homo sapiens
actgatgaaaactaataaatta

SEQ ID NO: 7648342 - DNA, 22 bp, Homo sapiens
actgatctgcctgtatgtagct

SEQ ID NO: 7648343 - DNA, 22 bp, Homo sapiens
actgatcacatagatatattcc

SEQ ID NO: 7648344 - DNA, 22 bp, Homo sapiens
actgatctgttttcagattctg

SEQ ID NO: 7648345 - DNA, 22 bp, Homo sapiens
aggctagctgattgccttagaa

SEQ ID NO: 7648346 - DNA, 22 bp, Homo sapiens
aggctagctgtttcagggctag

SEQ ID NO: 7648347 - DNA, 22 bp, Homo sapiens
aggctagctgtttcagggctag

SEQ ID NO: 7648348 - DNA, 22 bp, Homo sapiens
aggctagctgattgccttagaa

SEQ ID NO: 7648349 - DNA, 22 bp, Homo sapiens
aggctagctgtttcagggctag

SEQ ID NO: 7648350 - DNA, 22 bp, Homo sapiens
aggcgcctgcgggatccttgcc

SEQ ID NO: 7648351 - DNA, 22 bp, Homo sapiens
aggctagctgattgccttagaa

SEQ ID NO: 7648352 - DNA, 22 bp, Homo sapiens
aggctagcaatgggagatgagt

SEQ ID NO: 7648353 - DNA, 22 bp, Homo sapiens
aggctagctaatgagtactgtg

SEQ ID NO: 7648354 - DNA, 22 bp, Homo sapiens
aggcgcagcacgtgagagttgg

SEQ ID NO: 7648355 - DNA, 22 bp, Homo sapiens
aggcgcagcacgtgagagttgg

SEQ ID NO: 7648356 - DNA, 22 bp, Homo sapiens
aggcgcagggtttggacccagg

SEQ ID NO: 7648357 - DNA, 22 bp, Homo sapiens
aggcgcagggtttggacccagg

SEQ ID NO: 7648358 - DNA, 22 bp, Homo sapiens
aggcgcagggtttggacccagg

SEQ ID NO: 7648359 - DNA, 22 bp, Homo sapiens
aggcgcagggtttggacccagg

SEQ ID NO: 7648360 - DNA, 22 bp, Homo sapiens
aggcgcagggtttggacccagg

SEQ ID NO: 7648361 - DNA, 22 bp, Homo sapiens
aggcgcattgaggccctgttgc

SEQ ID NO: 7648362 - DNA, 22 bp, Homo sapiens
aggcgcctgcgggatccttgcc

SEQ ID NO: 7648363 - DNA, 22 bp, Homo sapiens
aggcgctgagtaggcaaggagg

SEQ ID NO: 7648364 - DNA, 22 bp, Homo sapiens
aggcgctgagtaggcaaggagg

SEQ ID NO: 7648365 - DNA, 22 bp, Homo sapiens
aggcgcagacatacagggtctg

SEQ ID NO: 7648366 - DNA, 22 bp, Homo sapiens
aggcgcagacatacagggtctg

SEQ ID NO: 7648367 - DNA, 22 bp, Homo sapiens
aggcgcagacatacagggtctg

SEQ ID NO: 7648368 - DNA, 22 bp, Homo sapiens
aggcgcagacatacagggtctg

SEQ ID NO: 7648369 - DNA, 22 bp, Homo sapiens
aggcgcagaaggccaggggcct

SEQ ID NO: 7648370 - DNA, 22 bp, Homo sapiens
aggcgcagaaggccaggggcct

SEQ ID NO: 7648371 - DNA, 22 bp, Homo sapiens
aggcgcagaaggccaggggcct

SEQ ID NO: 7648372 - DNA, 22 bp, Homo sapiens
aggcgcagaaggccaggggcct

SEQ ID NO: 7648373 - DNA, 22 bp, Homo sapiens
aggcgcagaaggccaggggcct

SEQ ID NO: 7648374 - DNA, 22 bp, Homo sapiens
aggcgcagaaggccaggggcct

SEQ ID NO: 7648375 - DNA, 16 bp, Homo sapiens
aggcgaaggttcattt

SEQ ID NO: 7648376 - DNA, 23 bp, Homo sapiens
aggcgagctcttctccagcacgt

SEQ ID NO: 7648377 - DNA, 22 bp, Homo sapiens
aggcgaagggaccagacggtag

SEQ ID NO: 7648378 - DNA, 22 bp, Homo sapiens
aggcctttgtacaataatcata

SEQ ID NO: 7648379 - DNA, 22 bp, Homo sapiens
aggcctttgtggagctcatggc

SEQ ID NO: 7648380 - DNA, 22 bp, Homo sapiens
aggcctttgtacaataatcata

SEQ ID NO: 7648381 - DNA, 20 bp, Homo sapiens
aggccttgtttatagtgaga

SEQ ID NO: 7648382 - DNA, 20 bp, Homo sapiens
aggccttgtttatagtgaga

SEQ ID NO: 7648383 - DNA, 20 bp, Homo sapiens
aggccttgtttatagtgaga

SEQ ID NO: 7648384 - DNA, 22 bp, Homo sapiens
aggcctgttggcgtgggctcta

SEQ ID NO: 7648385 - DNA, 22 bp, Homo sapiens
aggcctgttggcgtgggctcta

SEQ ID NO: 7648386 - DNA, 22 bp, Homo sapiens
aggcctgttggcgtgggctcta

SEQ ID NO: 7648387 - DNA, 22 bp, Homo sapiens
aggcctgttccaggcccctttt

SEQ ID NO: 7648388 - DNA, 22 bp, Homo sapiens
aggcctgttccttcctgggcac

SEQ ID NO: 7648389 - DNA, 22 bp, Homo sapiens
aggcctgtcttctttctttcca

SEQ ID NO: 7648390 - DNA, 22 bp, Homo sapiens
aggcctgcctggatcacacaga

SEQ ID NO: 7648391 - DNA, 22 bp, Homo sapiens
aggcctgcctggatcacacaga

SEQ ID NO: 7648392 - DNA, 22 bp, Homo sapiens
aggcctgcctggatcacacaga

SEQ ID NO: 7648393 - DNA, 22 bp, Homo sapiens
aggccttaccatagctgtagca

SEQ ID NO: 7648394 - DNA, 22 bp, Homo sapiens
aggccttaccatagctgtagca

SEQ ID NO: 7648395 - DNA, 22 bp, Homo sapiens
aggcctgtttcttgtccagctc

SEQ ID NO: 7648396 - DNA, 22 bp, Homo sapiens
aggccttaagaacaaaactatt

SEQ ID NO: 7648397 - DNA, 22 bp, Homo sapiens
aggccttaccatagctgtagca

SEQ ID NO: 7648398 - DNA, 22 bp, Homo sapiens
aggccttaccatagctgtagca

SEQ ID NO: 7648399 - DNA, 22 bp, Homo sapiens
aggccttatctccaaatacagt

SEQ ID NO: 7648400 - DNA, 22 bp, Homo sapiens
aggccttcctcggagacaggga

SEQ ID NO: 7648401 - DNA, 22 bp, Homo sapiens
aggccttcctcggagacaggga

SEQ ID NO: 7648402 - DNA, 22 bp, Homo sapiens
aggccttcctcggagacaggga

SEQ ID NO: 7648403 - DNA, 22 bp, Homo sapiens
aggccttgccaatgagagaact

SEQ ID NO: 7648404 - DNA, 22 bp, Homo sapiens
aggccttgatttaaattttgat

SEQ ID NO: 7648405 - DNA, 22 bp, Homo sapiens
aggccttgaaccttgctgggtg

SEQ ID NO: 7648406 - DNA, 22 bp, Homo sapiens
aggccttgatttaaattttgat

SEQ ID NO: 7648407 - DNA, 22 bp, Homo sapiens
aggccttgccaatgagagaact

SEQ ID NO: 7648408 - DNA, 22 bp, Homo sapiens
aggccttgccaatgagagaact

SEQ ID NO: 7648409 - DNA, 22 bp, Homo sapiens
aggccttgccaatgagagaact

SEQ ID NO: 7648410 - DNA, 22 bp, Homo sapiens
aggccttggaagccagggagcc

SEQ ID NO: 7648411 - DNA, 22 bp, Homo sapiens
aggccttgccaatgagagaact

SEQ ID NO: 7648412 - DNA, 22 bp, Homo sapiens
aggccttgggagcagtgtttgt

SEQ ID NO: 7648413 - DNA, 22 bp, Homo sapiens
aggccttggcatgctgccctgc

SEQ ID NO: 7648414 - DNA, 22 bp, Homo sapiens
aggccttggcagaggccaggct

SEQ ID NO: 7648415 - DNA, 22 bp, Homo sapiens
aggccttggcatgctgccctgc

SEQ ID NO: 7648416 - DNA, 22 bp, Homo sapiens
aggccttggaagccagggagcc

SEQ ID NO: 7648417 - DNA, 22 bp, Homo sapiens
aggccttggcagaggccaggct

SEQ ID NO: 7648418 - DNA, 22 bp, Homo sapiens
aggccttgtgagaagcagagaa

SEQ ID NO: 7648419 - DNA, 22 bp, Homo sapiens
aggccttgtattaatttgtttt

SEQ ID NO: 7648420 - DNA, 22 bp, Homo sapiens
aggccttgtattaatttgtttt

SEQ ID NO: 7648421 - DNA, 18 bp, Homo sapiens
aggccttgggtagcctga

SEQ ID NO: 7648422 - DNA, 22 bp, Homo sapiens
aggccttgtaatggaggggaaa

SEQ ID NO: 7648423 - DNA, 22 bp, Homo sapiens
acattgtgaagataccactgca

SEQ ID NO: 7648424 - DNA, 22 bp, Homo sapiens
aggctatttccactcttctcat

SEQ ID NO: 7648425 - DNA, 22 bp, Homo sapiens
aggctatgtggaataatttgct

SEQ ID NO: 7648426 - DNA, 22 bp, Homo sapiens
aggctatttccactcttctcat

SEQ ID NO: 7648427 - DNA, 22 bp, Homo sapiens
aggctatgacagactcagcctg

SEQ ID NO: 7648428 - DNA, 22 bp, Homo sapiens
aggctatggtggggccagtggc

SEQ ID NO: 7648429 - DNA, 22 bp, Homo sapiens
aggctatttccactcttctcat

SEQ ID NO: 7648430 - DNA, 22 bp, Homo sapiens
aggctaggggcagtgccagcat

SEQ ID NO: 7648431 - DNA, 22 bp, Homo sapiens
aggctaggggcagtgccagcat

SEQ ID NO: 7648432 - DNA, 22 bp, Homo sapiens
aggctaggggcagtgccagcat

SEQ ID NO: 7648433 - DNA, 22 bp, Homo sapiens
aggctagggtaacagatgtggc

SEQ ID NO: 7648434 - DNA, 22 bp, Homo sapiens
aggctagggtaacagatgtggc

SEQ ID NO: 7648435 - DNA, 22 bp, Homo sapiens
aggctagggtaacagatgtggc

SEQ ID NO: 7648436 - DNA, 22 bp, Homo sapiens
aggctagggtaacagatgtggc

SEQ ID NO: 7648437 - DNA, 22 bp, Homo sapiens
aggctagtagctgaatgaactt

SEQ ID NO: 7648438 - DNA, 22 bp, Homo sapiens
aggctagtatcatctacttttg

SEQ ID NO: 7648439 - DNA, 22 bp, Homo sapiens
aggctagttagtatttacaaaa

SEQ ID NO: 7648440 - DNA, 22 bp, Homo sapiens
aggctagttcctgtgcatccag

SEQ ID NO: 7648441 - DNA, 23 bp, Homo sapiens
aggctagtttgtgactttctttg

SEQ ID NO: 7648442 - DNA, 23 bp, Homo sapiens
aggctagtttgtgactttctttg

SEQ ID NO: 7648443 - DNA, 22 bp, Homo sapiens
aggctaggctgatgcctcttcc

SEQ ID NO: 7648444 - DNA, 22 bp, Homo sapiens
aggctaggctgatgcctcttcc

SEQ ID NO: 7648445 - DNA, 22 bp, Homo sapiens
aggctaggcatgtgctaccaca

SEQ ID NO: 7648446 - DNA, 22 bp, Homo sapiens
aggctaggaacagcccggccct

SEQ ID NO: 7648447 - DNA, 22 bp, Homo sapiens
aggctaggcatgtgctaccaca

SEQ ID NO: 7648448 - DNA, 22 bp, Homo sapiens
aggctaggaatcaagcctttct

SEQ ID NO: 7648449 - DNA, 22 bp, Homo sapiens
aggctagctttggctcagtaaa

SEQ ID NO: 7648450 - DNA, 22 bp, Homo sapiens
aggctagctttggctcagtaaa

SEQ ID NO: 7648451 - DNA, 22 bp, Homo sapiens
aggctaggggaacactagaatc

SEQ ID NO: 7648452 - DNA, 22 bp, Homo sapiens
aggctaggggaacactagaatc

SEQ ID NO: 7648453 - DNA, 22 bp, Homo sapiens
aggctagggccatggctggtga

SEQ ID NO: 7648454 - DNA, 22 bp, Homo sapiens
aggctagggccatggctggtga

SEQ ID NO: 7648455 - DNA, 22 bp, Homo sapiens
aggctaggctgatgcctcttcc

SEQ ID NO: 7648456 - DNA, 22 bp, Homo sapiens
aggctagggccatggctggtga

SEQ ID NO: 7648457 - DNA, 22 bp, Homo sapiens
aggctagggccatggctggtga

SEQ ID NO: 7648458 - DNA, 22 bp, Homo sapiens
acatttaaccctcaggtttctg

SEQ ID NO: 7648459 - DNA, 22 bp, Homo sapiens
acatttaaccctcaggtttctg

SEQ ID NO: 7648460 - DNA, 22 bp, Homo sapiens
acatttaaccctcaggtttctg

SEQ ID NO: 7648461 - DNA, 22 bp, Homo sapiens
acatttaaccctcaggtttctg

SEQ ID NO: 7648462 - DNA, 22 bp, Homo sapiens
acatttaagttaaaacctcagt

SEQ ID NO: 7648463 - DNA, 22 bp, Homo sapiens
acatttaacctttgaggaactg

SEQ ID NO: 7648464 - DNA, 22 bp, Homo sapiens
acatttaacctttgaggaactg

SEQ ID NO: 7648465 - DNA, 22 bp, Homo sapiens
acatttaacctttgaggaactg

SEQ ID NO: 7648466 - DNA, 22 bp, Homo sapiens
acatttaacctttgaggaactg

SEQ ID NO: 7648467 - DNA, 22 bp, Homo sapiens
acatttaacctttgaggaactg

SEQ ID NO: 7648468 - DNA, 22 bp, Homo sapiens
acatttaagttaaaacctcagt

SEQ ID NO: 7648469 - DNA, 22 bp, Homo sapiens
acatttaagttaaaacctcagt

SEQ ID NO: 7648470 - DNA, 22 bp, Homo sapiens
acatttaagttaaaacctcagt

SEQ ID NO: 7648471 - DNA, 22 bp, Homo sapiens
acatttaagttaaaacctcagt

SEQ ID NO: 7648472 - DNA, 22 bp, Homo sapiens
acatttaatgatcctactgtga

SEQ ID NO: 7648473 - DNA, 22 bp, Homo sapiens
acatttaatgatcctactgtga

SEQ ID NO: 7648474 - DNA, 22 bp, Homo sapiens
acatttaatgatcctactgtga

SEQ ID NO: 7648475 - DNA, 22 bp, Homo sapiens
acatttaatgatcctactgtga

SEQ ID NO: 7648476 - DNA, 22 bp, Homo sapiens
acatttaagttaaaacctcagt

SEQ ID NO: 7648477 - DNA, 22 bp, Homo sapiens
acatttaagttaaaacctcagt

SEQ ID NO: 7648478 - DNA, 22 bp, Homo sapiens
acatttaaccaaactgtttaat

SEQ ID NO: 7648479 - DNA, 22 bp, Homo sapiens
acatttaaccctcaggtttctg

SEQ ID NO: 7648480 - DNA, 22 bp, Homo sapiens
acatttaaccctcaggtttctg

SEQ ID NO: 7648481 - DNA, 22 bp, Homo sapiens
acatttaaccaaactgtttaat

SEQ ID NO: 7648482 - DNA, 22 bp, Homo sapiens
acatttaaccaaactgtttaat

SEQ ID NO: 7648483 - DNA, 22 bp, Homo sapiens
acatttaaccaaactgtttaat

SEQ ID NO: 7648484 - DNA, 22 bp, Homo sapiens
acatttaaccaaactgtttaat

SEQ ID NO: 7648485 - DNA, 22 bp, Homo sapiens
acattgtgacagttttggagaa

SEQ ID NO: 7648486 - DNA, 19 bp, Homo sapiens
acatttaaattcagatctc

SEQ ID NO: 7648487 - DNA, 22 bp, Homo sapiens
acatttaaccaaactgtttaat

SEQ ID NO: 7648488 - DNA, 22 bp, Homo sapiens
acatttaaccaaactgtttaat

SEQ ID NO: 7648489 - DNA, 19 bp, Homo sapiens
acatttaaattcagatctc

SEQ ID NO: 7648490 - DNA, 19 bp, Homo sapiens
acatttaaattcagatctc

SEQ ID NO: 7648491 - DNA, 22 bp, Homo sapiens
acattgtgcctgtgatattaca

SEQ ID NO: 7648492 - DNA, 22 bp, Homo sapiens
acattgtgcctgtgatattaca

SEQ ID NO: 7648493 - DNA, 22 bp, Homo sapiens
acattgtgatccgactgattaa

SEQ ID NO: 7648494 - DNA, 21 bp, Homo sapiens
acattgtgacatgcagggtgc

SEQ ID NO: 7648495 - DNA, 22 bp, Homo sapiens
acattgtgacagttttggagaa

SEQ ID NO: 7648496 - DNA, 22 bp, Homo sapiens
acattgtgatccgactgattaa

SEQ ID NO: 7648497 - DNA, 22 bp, Homo sapiens
aggctgaggatccctgtgttct

SEQ ID NO: 7648498 - DNA, 22 bp, Homo sapiens
aggctgaggatccctgtgttct

SEQ ID NO: 7648499 - DNA, 22 bp, Homo sapiens
aggctgaggatccctgtgttct

SEQ ID NO: 7648500 - DNA, 22 bp, Homo sapiens
aggctgaggatccctgtgttct

SEQ ID NO: 7648501 - DNA, 22 bp, Homo sapiens
aggctgaggctggcagctccag

SEQ ID NO: 7648502 - DNA, 22 bp, Homo sapiens
acatttcactgttcacagcagg

SEQ ID NO: 7648503 - DNA, 23 bp, Homo sapiens
acatttcaatactgagggtctga

SEQ ID NO: 7648504 - DNA, 22 bp, Homo sapiens
acatttcactgttcacagcagg

SEQ ID NO: 7648505 - DNA, 22 bp, Homo sapiens
aggctgaggatccctgtgttct

SEQ ID NO: 7648506 - DNA, 22 bp, Homo sapiens
aggctgaggctggcagctccag

SEQ ID NO: 7648507 - DNA, 22 bp, Homo sapiens
aggctgaggctggcagctccag

SEQ ID NO: 7648508 - DNA, 22 bp, Homo sapiens
aggctgaggctggcagctccag

SEQ ID NO: 7648509 - DNA, 22 bp, Homo sapiens
aggctgaggctggcagctccag

SEQ ID NO: 7648510 - DNA, 22 bp, Homo sapiens
aggctgaggctggcagctccag

SEQ ID NO: 7648511 - DNA, 22 bp, Homo sapiens
aggctgaggctggcagctccag

SEQ ID NO: 7648512 - DNA, 22 bp, Homo sapiens
aggctgaggctggcagctccag

SEQ ID NO: 7648513 - DNA, 22 bp, Homo sapiens
aggctgaggctggcagctccag

SEQ ID NO: 7648514 - DNA, 22 bp, Homo sapiens
aggctgaggctttccttggaga

SEQ ID NO: 7648515 - DNA, 22 bp, Homo sapiens
aggctgaggctttccttggaga

SEQ ID NO: 7648516 - DNA, 22 bp, Homo sapiens
aggctgagggctcctgagggca

SEQ ID NO: 7648517 - DNA, 22 bp, Homo sapiens
aggctgagggctcctgagggca

SEQ ID NO: 7648518 - DNA, 22 bp, Homo sapiens
aggctgaggctttccttggaga

SEQ ID NO: 7648519 - DNA, 22 bp, Homo sapiens
aggctgaggctttccttggaga

SEQ ID NO: 7648520 - DNA, 22 bp, Homo sapiens
aggctgaggctttccttggaga

SEQ ID NO: 7648521 - DNA, 22 bp, Homo sapiens
aggctgaggctttccttggaga

SEQ ID NO: 7648522 - DNA, 22 bp, Homo sapiens
aggctgagggctcctgagggca

SEQ ID NO: 7648523 - DNA, 22 bp, Homo sapiens
aggctgagggctcctgagggca

SEQ ID NO: 7648524 - DNA, 22 bp, Homo sapiens
aggctgagggctcctgagggca

SEQ ID NO: 7648525 - DNA, 22 bp, Homo sapiens
aggctgagggctcctgagggca

SEQ ID NO: 7648526 - DNA, 22 bp, Homo sapiens
aggctgagggctcctgagggca

SEQ ID NO: 7648527 - DNA, 22 bp, Homo sapiens
aggctgagggctcctgagggca

SEQ ID NO: 7648528 - DNA, 22 bp, Homo sapiens
aggctgagggctcctgagggca

SEQ ID NO: 7648529 - DNA, 22 bp, Homo sapiens
aggctgatgctggctgaggctg

SEQ ID NO: 7648530 - DNA, 22 bp, Homo sapiens
aggctgattgaagtttttgtgg

SEQ ID NO: 7648531 - DNA, 22 bp, Homo sapiens
aggctgcaaagtgcttgggtgc

SEQ ID NO: 7648532 - DNA, 22 bp, Homo sapiens
aggctgcaaagtgcttgggtgc

SEQ ID NO: 7648533 - DNA, 18 bp, Homo sapiens
aggctgcactgtcttaaa

SEQ ID NO: 7648534 - DNA, 18 bp, Homo sapiens
aggctgcactgtcttaaa

SEQ ID NO: 7648535 - DNA, 19 bp, Homo sapiens
aggctgcaaggtggtgggc

SEQ ID NO: 7648536 - DNA, 22 bp, Homo sapiens
aggctgagtttctcattctcgc

SEQ ID NO: 7648537 - DNA, 22 bp, Homo sapiens
aggctgagtttctcattctcgc

SEQ ID NO: 7648538 - DNA, 22 bp, Homo sapiens
aggctgatgctggctgaggctg

SEQ ID NO: 7648539 - DNA, 22 bp, Homo sapiens
aggctgatgctggctgaggctg

SEQ ID NO: 7648540 - DNA, 22 bp, Homo sapiens
aggctgatgctggctgaggctg

SEQ ID NO: 7648541 - DNA, 22 bp, Homo sapiens
aggctgagtttctcattctcgc

SEQ ID NO: 7648542 - DNA, 22 bp, Homo sapiens
aggctgagtttctcattctcgc

SEQ ID NO: 7648543 - DNA, 22 bp, Homo sapiens
aggctgagtttctcattctcgc

SEQ ID NO: 7648544 - DNA, 22 bp, Homo sapiens
aggctgagggctcctgagggca

SEQ ID NO: 7648545 - DNA, 22 bp, Homo sapiens
aggctgagggctcctgagggca

SEQ ID NO: 7648546 - DNA, 22 bp, Homo sapiens
aggctgagggctcctgagggca

SEQ ID NO: 7648547 - DNA, 22 bp, Homo sapiens
aggctgagggctcctgagggca

SEQ ID NO: 7648548 - DNA, 22 bp, Homo sapiens
aggctgagggctcctgagggca

SEQ ID NO: 7648549 - DNA, 22 bp, Homo sapiens
aggctgagtgctcccctagatg

SEQ ID NO: 7648550 - DNA, 22 bp, Homo sapiens
aggctgaggggcgagggaccct

SEQ ID NO: 7648551 - DNA, 22 bp, Homo sapiens
aggctgagtgctcccctagatg

SEQ ID NO: 7648552 - DNA, 20 bp, Homo sapiens
aggctgagttctatgcactt

SEQ ID NO: 7648553 - DNA, 20 bp, Homo sapiens
aggctgagttctatgcactt

SEQ ID NO: 7648554 - DNA, 22 bp, Homo sapiens
aggctgagtttctcattctcgc

SEQ ID NO: 7648555 - DNA, 20 bp, Homo sapiens
aggctgagttctatgcactt

SEQ ID NO: 7648556 - DNA, 22 bp, Homo sapiens
aggctgagtgctcccctagatg

SEQ ID NO: 7648557 - DNA, 20 bp, Homo sapiens
aggctgagttctatgcactt

SEQ ID NO: 7648558 - DNA, 20 bp, Homo sapiens
aggctgagttctatgcactt

SEQ ID NO: 7648559 - DNA, 20 bp, Homo sapiens
aggctgagttctatgcactt

SEQ ID NO: 7648560 - DNA, 22 bp, Homo sapiens
acatttaatgatcctactgtga

SEQ ID NO: 7648561 - DNA, 22 bp, Homo sapiens
acatttaatgatcctactgtga

SEQ ID NO: 7648562 - DNA, 22 bp, Homo sapiens
acatttacagtgctagacaatc

SEQ ID NO: 7648563 - DNA, 22 bp, Homo sapiens
acatttacagtgctagacaatc

SEQ ID NO: 7648564 - DNA, 22 bp, Homo sapiens
acatttacagtgctagacaatc

SEQ ID NO: 7648565 - DNA, 22 bp, Homo sapiens
acatttacagtgctagacaatc

SEQ ID NO: 7648566 - DNA, 22 bp, Homo sapiens
acatttacagtgctagacaatc

SEQ ID NO: 7648567 - DNA, 22 bp, Homo sapiens
acatttaccctggaacattgga

SEQ ID NO: 7648568 - DNA, 22 bp, Homo sapiens
acatttaccctggaacattgga

SEQ ID NO: 7648569 - DNA, 22 bp, Homo sapiens
acatttacattttctctggcct

SEQ ID NO: 7648570 - DNA, 22 bp, Homo sapiens
acatttacattttctctggcct

SEQ ID NO: 7648571 - DNA, 22 bp, Homo sapiens
acatttacagtgctagacaatc

SEQ ID NO: 7648572 - DNA, 22 bp, Homo sapiens
acatttaccctggaacattgga

SEQ ID NO: 7648573 - DNA, 22 bp, Homo sapiens
acatttacctagttaagtcaat

SEQ ID NO: 7648574 - DNA, 22 bp, Homo sapiens
acatttacctagttaagtcaat

SEQ ID NO: 7648575 - DNA, 22 bp, Homo sapiens
acatttacctagttaagtcaat

SEQ ID NO: 7648576 - DNA, 22 bp, Homo sapiens
acatttacctagttaagtcaat

SEQ ID NO: 7648577 - DNA, 22 bp, Homo sapiens
acatttacctagttaagtcaat

SEQ ID NO: 7648578 - DNA, 22 bp, Homo sapiens
acatttacttatcaaaagtcag

SEQ ID NO: 7648579 - DNA, 22 bp, Homo sapiens
acatttacttatcaaaagtcag

SEQ ID NO: 7648580 - DNA, 22 bp, Homo sapiens
acatttacttatcaaaagtcag

SEQ ID NO: 7648581 - DNA, 18 bp, Homo sapiens
acatttaggagagtcaat

SEQ ID NO: 7648582 - DNA, 22 bp, Homo sapiens
acatttaggatgttttgagaga

SEQ ID NO: 7648583 - DNA, 22 bp, Homo sapiens
acatttaggatgttttgagaga

SEQ ID NO: 7648584 - DNA, 18 bp, Homo sapiens
acatttaggagagtcaat

SEQ ID NO: 7648585 - DNA, 22 bp, Homo sapiens
acatttaggatgttttgagaga

SEQ ID NO: 7648586 - DNA, 22 bp, Homo sapiens
acatttatataactcactagga

SEQ ID NO: 7648587 - DNA, 22 bp, Homo sapiens
acatttatataactcactagga

SEQ ID NO: 7648588 - DNA, 22 bp, Homo sapiens
acatttatataactcactagga

SEQ ID NO: 7648589 - DNA, 22 bp, Homo sapiens
acatttatataactcactagga

SEQ ID NO: 7648590 - DNA, 22 bp, Homo sapiens
acatttaggatgttttgagaga

SEQ ID NO: 7648591 - DNA, 19 bp, Homo sapiens
acatttagaatgtacttgc

SEQ ID NO: 7648592 - DNA, 22 bp, Homo sapiens
acatttacttatcaaaagtcag

SEQ ID NO: 7648593 - DNA, 19 bp, Homo sapiens
acatttagaatgtacttgc

SEQ ID NO: 7648594 - DNA, 22 bp, Homo sapiens
acatttagagttctttactcca

SEQ ID NO: 7648595 - DNA, 22 bp, Homo sapiens
acatttagatggtgttatagta

SEQ ID NO: 7648596 - DNA, 18 bp, Homo sapiens
acatttaggagagtcaat

SEQ ID NO: 7648597 - DNA, 18 bp, Homo sapiens
acatttaggagagtcaat

SEQ ID NO: 7648598 - DNA, 22 bp, Homo sapiens
acatttagctgtacaatctatg

SEQ ID NO: 7648599 - DNA, 22 bp, Homo sapiens
acatttatataactcactagga

SEQ ID NO: 7648600 - DNA, 22 bp, Homo sapiens
acatttatataactcactagga

SEQ ID NO: 7648601 - DNA, 22 bp, Homo sapiens
acatttatataactcactagga

SEQ ID NO: 7648602 - DNA, 22 bp, Homo sapiens
acatttatatttagtggggaat

SEQ ID NO: 7648603 - DNA, 22 bp, Homo sapiens
acatttattactcaggttgttg

SEQ ID NO: 7648604 - DNA, 22 bp, Homo sapiens
acatttattactcaggttgttg

SEQ ID NO: 7648605 - DNA, 22 bp, Homo sapiens
acatttattactcaggttgttg

SEQ ID NO: 7648606 - DNA, 22 bp, Homo sapiens
acatttattactcaggttgttg

SEQ ID NO: 7648607 - DNA, 22 bp, Homo sapiens
acatttcactgttcacagcagg

SEQ ID NO: 7648608 - DNA, 23 bp, Homo sapiens
acatttcaatactgagggtctga

SEQ ID NO: 7648609 - DNA, 23 bp, Homo sapiens
acatttcaatactgagggtctga

SEQ ID NO: 7648610 - DNA, 22 bp, Homo sapiens
acatttattttggcacggcaca

SEQ ID NO: 7648611 - DNA, 22 bp, Homo sapiens
acatttattttggcacggcaca

SEQ ID NO: 7648612 - DNA, 22 bp, Homo sapiens
acatttattttggcacggcaca

SEQ ID NO: 7648613 - DNA, 22 bp, Homo sapiens
acatttattttggcacggcaca

SEQ ID NO: 7648614 - DNA, 22 bp, Homo sapiens
acatttattactcaggttgttg

SEQ ID NO: 7648615 - DNA, 22 bp, Homo sapiens
acatttattactcaggttgttg

SEQ ID NO: 7648616 - DNA, 22 bp, Homo sapiens
acatttattttcagctgggaaa

SEQ ID NO: 7648617 - DNA, 22 bp, Homo sapiens
acatttattttcagctgggaaa

SEQ ID NO: 7648618 - DNA, 22 bp, Homo sapiens
acatgagaggctgtggagtaca

SEQ ID NO: 7648619 - DNA, 22 bp, Homo sapiens
acatgagactgggtttgtaggg

SEQ ID NO: 7648620 - DNA, 22 bp, Homo sapiens
acatgagaggctgtggagtaca

SEQ ID NO: 7648621 - DNA, 22 bp, Homo sapiens
acatgagaggctgtggagtaca

SEQ ID NO: 7648622 - DNA, 16 bp, Homo sapiens
acatgagataatgcta

SEQ ID NO: 7648623 - DNA, 22 bp, Homo sapiens
acatgagattagctcacccact

SEQ ID NO: 7648624 - DNA, 22 bp, Homo sapiens
acatgagattagctcacccact

SEQ ID NO: 7648625 - DNA, 22 bp, Homo sapiens
acatgagattagctcacccact

SEQ ID NO: 7648626 - DNA, 22 bp, Homo sapiens
acatgaggtaagggatgttaag

SEQ ID NO: 7648627 - DNA, 22 bp, Homo sapiens
acatgaggtaagggatgttaag

SEQ ID NO: 7648628 - DNA, 22 bp, Homo sapiens
acatgaggaaacaagggtatat

SEQ ID NO: 7648629 - DNA, 22 bp, Homo sapiens
acatgagatggtggggatccct

SEQ ID NO: 7648630 - DNA, 22 bp, Homo sapiens
acatgagatttgggtggtgata

SEQ ID NO: 7648631 - DNA, 22 bp, Homo sapiens
acatgaggaactcaggagtcac

SEQ ID NO: 7648632 - DNA, 22 bp, Homo sapiens
acatgaggaactcaggagtcac

SEQ ID NO: 7648633 - DNA, 23 bp, Homo sapiens
acatgatacacaattagcaaacc

SEQ ID NO: 7648634 - DNA, 22 bp, Homo sapiens
acatgatatatgggaaatgctt

SEQ ID NO: 7648635 - DNA, 22 bp, Homo sapiens
acatgatatatgggaaatgctt

SEQ ID NO: 7648636 - DNA, 23 bp, Homo sapiens
acatgatacacaattagcaaacc

SEQ ID NO: 7648637 - DNA, 23 bp, Homo sapiens
acatgatacacaattagcaaacc

SEQ ID NO: 7648638 - DNA, 22 bp, Homo sapiens
acatgatattaatgtcttattt

SEQ ID NO: 7648639 - DNA, 22 bp, Homo sapiens
acatgatatatgggaaatgctt

SEQ ID NO: 7648640 - DNA, 22 bp, Homo sapiens
acatgatcttatgtagaagatc

SEQ ID NO: 7648641 - DNA, 22 bp, Homo sapiens
acatgattaaaagattttaaag

SEQ ID NO: 7648642 - DNA, 22 bp, Homo sapiens
acatgattaaaagattttaaag

SEQ ID NO: 7648643 - DNA, 22 bp, Homo sapiens
acatgattaaaagattttaaag

SEQ ID NO: 7648644 - DNA, 22 bp, Homo sapiens
acatgattcttgataggcattg

SEQ ID NO: 7648645 - DNA, 22 bp, Homo sapiens
acatgatttgcatgatttgtaa

SEQ ID NO: 7648646 - DNA, 22 bp, Homo sapiens
acatgatttcagggaattctca

SEQ ID NO: 7648647 - DNA, 22 bp, Homo sapiens
acatgatttcagggaattctca

SEQ ID NO: 7648648 - DNA, 22 bp, Homo sapiens
acatgattcttgataggcattg

SEQ ID NO: 7648649 - DNA, 22 bp, Homo sapiens
acatgattggactccttcccct

SEQ ID NO: 7648650 - DNA, 22 bp, Homo sapiens
acatgatttcagggaattctca

SEQ ID NO: 7648651 - DNA, 22 bp, Homo sapiens
acatgatttcagggaattctca

SEQ ID NO: 7648652 - DNA, 22 bp, Homo sapiens
acatgcaaagccacaggacccg

SEQ ID NO: 7648653 - DNA, 22 bp, Homo sapiens
acatgcaaatgtgcatgcatgt

SEQ ID NO: 7648654 - DNA, 22 bp, Homo sapiens
acatgcaaatgtgcatgcatgt

SEQ ID NO: 7648655 - DNA, 22 bp, Homo sapiens
acatgcaaagggatgcaattat

SEQ ID NO: 7648656 - DNA, 22 bp, Homo sapiens
acatgcaacaaagtacctgcaa

SEQ ID NO: 7648657 - DNA, 22 bp, Homo sapiens
acatgcaactaaagggtgccac

SEQ ID NO: 7648658 - DNA, 22 bp, Homo sapiens
acatgcaaatgtgcatgcatgt

SEQ ID NO: 7648659 - DNA, 22 bp, Homo sapiens
acatgcaaatgtgcatgcatgt

SEQ ID NO: 7648660 - DNA, 22 bp, Homo sapiens
acatgcaaaaatatatttatga

SEQ ID NO: 7648661 - DNA, 22 bp, Homo sapiens
acatgcaaaaatatatttatga

SEQ ID NO: 7648662 - DNA, 23 bp, Homo sapiens
acatgcaaaaatcacagtctcct

SEQ ID NO: 7648663 - DNA, 23 bp, Homo sapiens
acatgcaaaaatcacagtctcct

SEQ ID NO: 7648664 - DNA, 23 bp, Homo sapiens
acatgcaaaaatcacagtctcct

SEQ ID NO: 7648665 - DNA, 22 bp, Homo sapiens
acatgatttttaaagagataat

SEQ ID NO: 7648666 - DNA, 22 bp, Homo sapiens
acatgattttagtatcataata

SEQ ID NO: 7648667 - DNA, 22 bp, Homo sapiens
acatgatttgcatgatttgtaa

SEQ ID NO: 7648668 - DNA, 22 bp, Homo sapiens
acatgcaagcagccgtgcagat

SEQ ID NO: 7648669 - DNA, 22 bp, Homo sapiens
acatgcaagcccctgaacacat

SEQ ID NO: 7648670 - DNA, 22 bp, Homo sapiens
acatgcaagcccctgaacacat

SEQ ID NO: 7648671 - DNA, 22 bp, Homo sapiens
acatgcaagcccctgaacacat

SEQ ID NO: 7648672 - DNA, 19 bp, Homo sapiens
acatgcaaggcacctgcag

SEQ ID NO: 7648673 - DNA, 19 bp, Homo sapiens
acatgcaaggcacctgcag

SEQ ID NO: 7648674 - DNA, 19 bp, Homo sapiens
acatgcaaggcacctgcag

SEQ ID NO: 7648675 - DNA, 22 bp, Homo sapiens
acatgcaatattgagactttct

SEQ ID NO: 7648676 - DNA, 22 bp, Homo sapiens
acatgcacacctatatacatgt

SEQ ID NO: 7648677 - DNA, 22 bp, Homo sapiens
acatgcacacctatatacatgt

SEQ ID NO: 7648678 - DNA, 19 bp, Homo sapiens
acatgcaaggcacctgcag

SEQ ID NO: 7648679 - DNA, 19 bp, Homo sapiens
acatgcaaggcacctgcag

SEQ ID NO: 7648680 - DNA, 22 bp, Homo sapiens
acatgcaatattgagactttct

SEQ ID NO: 7648681 - DNA, 22 bp, Homo sapiens
acatgcacccagttacactctc

SEQ ID NO: 7648682 - DNA, 22 bp, Homo sapiens
acatgcacccagttacactctc

SEQ ID NO: 7648683 - DNA, 22 bp, Homo sapiens
acatgcacagcaagggtgagag

SEQ ID NO: 7648684 - DNA, 22 bp, Homo sapiens
acatgcacagcaagggtgagag

SEQ ID NO: 7648685 - DNA, 22 bp, Homo sapiens
acatgcacagcaagggtgagag

SEQ ID NO: 7648686 - DNA, 22 bp, Homo sapiens
acatgcacccagggcattgctt

SEQ ID NO: 7648687 - DNA, 22 bp, Homo sapiens
acatgcacccagggcattgctt

SEQ ID NO: 7648688 - DNA, 22 bp, Homo sapiens
acatgcacacgattcagtctgg

SEQ ID NO: 7648689 - DNA, 22 bp, Homo sapiens
acatgcacacgattcagtctgg

SEQ ID NO: 7648690 - DNA, 22 bp, Homo sapiens
acatgcacacgattcagtctgg

SEQ ID NO: 7648691 - DNA, 22 bp, Homo sapiens
acatgcacacgattcagtctgg

SEQ ID NO: 7648692 - DNA, 22 bp, Homo sapiens
acatgcacacgattcagtctgg

SEQ ID NO: 7648693 - DNA, 22 bp, Homo sapiens
aggcaggggagctggaagggta

SEQ ID NO: 7648694 - DNA, 22 bp, Homo sapiens
aggcaggggagctggaagggta

SEQ ID NO: 7648695 - DNA, 22 bp, Homo sapiens
acatgaaatgcagcctgtaacc

SEQ ID NO: 7648696 - DNA, 22 bp, Homo sapiens
acatgaaagttattctgagttg

SEQ ID NO: 7648697 - DNA, 22 bp, Homo sapiens
aggcaggggagctggaagggta

SEQ ID NO: 7648698 - DNA, 22 bp, Homo sapiens
acatgagagaaaagtattctga

SEQ ID NO: 7648699 - DNA, 22 bp, Homo sapiens
acatgagacaattgttgatgtt

SEQ ID NO: 7648700 - DNA, 22 bp, Homo sapiens
aggcagggctgggattagactc

SEQ ID NO: 7648701 - DNA, 22 bp, Homo sapiens
aggcaggggagctggaagggta

SEQ ID NO: 7648702 - DNA, 22 bp, Homo sapiens
aggcaggggagctggaagggta

SEQ ID NO: 7648703 - DNA, 22 bp, Homo sapiens
aggcaggggagctggaagggta

SEQ ID NO: 7648704 - DNA, 22 bp, Homo sapiens
aggcaggggagctggaagggta

SEQ ID NO: 7648705 - DNA, 22 bp, Homo sapiens
aggcaggggagctggaagggta

SEQ ID NO: 7648706 - DNA, 22 bp, Homo sapiens
aggcagggctcatttcttaggc

SEQ ID NO: 7648707 - DNA, 22 bp, Homo sapiens
aggcagggctgggattagactc

SEQ ID NO: 7648708 - DNA, 22 bp, Homo sapiens
aggcagggctcatttcttaggc

SEQ ID NO: 7648709 - DNA, 22 bp, Homo sapiens
aggcagggctgggattagactc

SEQ ID NO: 7648710 - DNA, 22 bp, Homo sapiens
aggcagggctgggattagactc

SEQ ID NO: 7648711 - DNA, 22 bp, Homo sapiens
aggcagggctgggattagactc

SEQ ID NO: 7648712 - DNA, 22 bp, Homo sapiens
aggcagggctgggattagactc

SEQ ID NO: 7648713 - DNA, 22 bp, Homo sapiens
aggcagggctgggattagactc

SEQ ID NO: 7648714 - DNA, 17 bp, Homo sapiens
aggcaggcagagcggga

SEQ ID NO: 7648715 - DNA, 17 bp, Homo sapiens
aggcaggcagagcggga

SEQ ID NO: 7648716 - DNA, 17 bp, Homo sapiens
aggcaggcagagcggga

SEQ ID NO: 7648717 - DNA, 17 bp, Homo sapiens
aggcaggcagagcggga

SEQ ID NO: 7648718 - DNA, 17 bp, Homo sapiens
aggcaggcagagcggga

SEQ ID NO: 7648719 - DNA, 17 bp, Homo sapiens
aggcaggcagagcggga

SEQ ID NO: 7648720 - DNA, 17 bp, Homo sapiens
aggcaggcagagcggga

SEQ ID NO: 7648721 - DNA, 17 bp, Homo sapiens
aggcaggcagagcggga

SEQ ID NO: 7648722 - DNA, 22 bp, Homo sapiens
aggcaggcagggctcactgtct

SEQ ID NO: 7648723 - DNA, 22 bp, Homo sapiens
aggcaggcagctgtcaccactc

SEQ ID NO: 7648724 - DNA, 22 bp, Homo sapiens
aggcaggcagggctcactgtct

SEQ ID NO: 7648725 - DNA, 22 bp, Homo sapiens
aggcaggcagggctcactgtct

SEQ ID NO: 7648726 - DNA, 22 bp, Homo sapiens
aggcaggcagctgtcaccactc

SEQ ID NO: 7648727 - DNA, 22 bp, Homo sapiens
aggcaggcagctgtcaccactc

SEQ ID NO: 7648728 - DNA, 17 bp, Homo sapiens
aggcaggcagagcggga

SEQ ID NO: 7648729 - DNA, 22 bp, Homo sapiens
aggcaggcagctgtcaccactc

SEQ ID NO: 7648730 - DNA, 22 bp, Homo sapiens
aggcaggcagctgtcaccactc

SEQ ID NO: 7648731 - DNA, 22 bp, Homo sapiens
aggcaggcagctgtcaccactc

SEQ ID NO: 7648732 - DNA, 22 bp, Homo sapiens
aggcaggctggtctgaagagtg

SEQ ID NO: 7648733 - DNA, 22 bp, Homo sapiens
aggcagggaccagttgttttct

SEQ ID NO: 7648734 - DNA, 22 bp, Homo sapiens
aggcaggctggtctgaagagtg

SEQ ID NO: 7648735 - DNA, 23 bp, Homo sapiens
aggcaggcagttcagctgttgtt

SEQ ID NO: 7648736 - DNA, 23 bp, Homo sapiens
aggcaggcagttcagctgttgtt

SEQ ID NO: 7648737 - DNA, 23 bp, Homo sapiens
aggcaggcagttcagctgttgtt

SEQ ID NO: 7648738 - DNA, 23 bp, Homo sapiens
aggcaggcagttcagctgttgtt

SEQ ID NO: 7648739 - DNA, 22 bp, Homo sapiens
aggcaggctggtctgaagagtg

SEQ ID NO: 7648740 - DNA, 22 bp, Homo sapiens
aggcagggaccagttgttttct

SEQ ID NO: 7648741 - DNA, 22 bp, Homo sapiens
aggcagggctcatttcttaggc

SEQ ID NO: 7648742 - DNA, 22 bp, Homo sapiens
aggcagggctcatttcttaggc

SEQ ID NO: 7648743 - DNA, 22 bp, Homo sapiens
aggcagggctcatttcttaggc

SEQ ID NO: 7648744 - DNA, 22 bp, Homo sapiens
aggcagggctcatttcttaggc

SEQ ID NO: 7648745 - DNA, 22 bp, Homo sapiens
aggcagggaccagttgttttct

SEQ ID NO: 7648746 - DNA, 22 bp, Homo sapiens
aggcagggaccagttgttttct

SEQ ID NO: 7648747 - DNA, 20 bp, Homo sapiens
acatggaaggtcaaactatc

SEQ ID NO: 7648748 - DNA, 20 bp, Homo sapiens
acatggaaggtcaaactatc

SEQ ID NO: 7648749 - DNA, 22 bp, Homo sapiens
acatggaagcaaagttctattt

SEQ ID NO: 7648750 - DNA, 20 bp, Homo sapiens
acatggaaggtcaaactatc

SEQ ID NO: 7648751 - DNA, 22 bp, Homo sapiens
acatggaatgtgtactaagtta

SEQ ID NO: 7648752 - DNA, 22 bp, Homo sapiens
acatggaagcaaagttctattt

SEQ ID NO: 7648753 - DNA, 22 bp, Homo sapiens
acatggaagcaaagttctattt

SEQ ID NO: 7648754 - DNA, 22 bp, Homo sapiens
acatggaagataaaaatactca

SEQ ID NO: 7648755 - DNA, 22 bp, Homo sapiens
acatggaagataaaaatactca

SEQ ID NO: 7648756 - DNA, 22 bp, Homo sapiens
acatggaagataaaaatactca

SEQ ID NO: 7648757 - DNA, 22 bp, Homo sapiens
acatggaagataaaaatactca

SEQ ID NO: 7648758 - DNA, 21 bp, Homo sapiens
acatggaagagaaattaacca

SEQ ID NO: 7648759 - DNA, 22 bp, Homo sapiens
acatggaaagtactccacaatt

SEQ ID NO: 7648760 - DNA, 22 bp, Homo sapiens
acatggaaagtactccacaatt

SEQ ID NO: 7648761 - DNA, 22 bp, Homo sapiens
aggccctgttgtagcattttgg

SEQ ID NO: 7648762 - DNA, 22 bp, Homo sapiens
aggccctgttgtagcattttgg

SEQ ID NO: 7648763 - DNA, 22 bp, Homo sapiens
aggccctgttatgagccactgt

SEQ ID NO: 7648764 - DNA, 22 bp, Homo sapiens
aggccctgttatgagccactgt

SEQ ID NO: 7648765 - DNA, 22 bp, Homo sapiens
aggcccttcttggtggctcagg

SEQ ID NO: 7648766 - DNA, 22 bp, Homo sapiens
aggcccttggactcatgctcga

SEQ ID NO: 7648767 - DNA, 22 bp, Homo sapiens
aggccctgttgtagcattttgg

SEQ ID NO: 7648768 - DNA, 22 bp, Homo sapiens
aggcccttcttggtggctcagg

SEQ ID NO: 7648769 - DNA, 22 bp, Homo sapiens
aggcccttcttggtggctcagg

SEQ ID NO: 7648770 - DNA, 22 bp, Homo sapiens
aggcccttaggacccctgcgtg

SEQ ID NO: 7648771 - DNA, 22 bp, Homo sapiens
acatggaaaactaactgctttt

SEQ ID NO: 7648772 - DNA, 22 bp, Homo sapiens
acatggaaaactaactgctttt

SEQ ID NO: 7648773 - DNA, 22 bp, Homo sapiens
aggccgaagtggatgggcatct

SEQ ID NO: 7648774 - DNA, 22 bp, Homo sapiens
aggcccttggactcatgctcga

SEQ ID NO: 7648775 - DNA, 22 bp, Homo sapiens
aggcccttggactcatgctcga

SEQ ID NO: 7648776 - DNA, 22 bp, Homo sapiens
aggcccttggagtagaggctga

SEQ ID NO: 7648777 - DNA, 22 bp, Homo sapiens
acatggagctcaaacatgagtg

SEQ ID NO: 7648778 - DNA, 21 bp, Homo sapiens
acatggactgtgaatggggac

SEQ ID NO: 7648779 - DNA, 22 bp, Homo sapiens
acatggagaccagatggaagta

SEQ ID NO: 7648780 - DNA, 22 bp, Homo sapiens
acatggagaccagatggaagta

SEQ ID NO: 7648781 - DNA, 22 bp, Homo sapiens
acatggagaccagatggaagta

SEQ ID NO: 7648782 - DNA, 21 bp, Homo sapiens
acatggactgtgaatggggac

SEQ ID NO: 7648783 - DNA, 21 bp, Homo sapiens
acatggactgtgaatggggac

SEQ ID NO: 7648784 - DNA, 22 bp, Homo sapiens
acatggaatgtgtactaagtta

SEQ ID NO: 7648785 - DNA, 22 bp, Homo sapiens
acatggaatgtgtactaagtta

SEQ ID NO: 7648786 - DNA, 22 bp, Homo sapiens
acatggcaaaagggactttaca

SEQ ID NO: 7648787 - DNA, 22 bp, Homo sapiens
acatggcacccagatctcaaaa

SEQ ID NO: 7648788 - DNA, 22 bp, Homo sapiens
acatggcaaaagggactttaca

SEQ ID NO: 7648789 - DNA, 22 bp, Homo sapiens
acatggcaaaaccccgtttcta

SEQ ID NO: 7648790 - DNA, 22 bp, Homo sapiens
acatggattgttttaaaagatg

SEQ ID NO: 7648791 - DNA, 22 bp, Homo sapiens
acatggattgttttaaaagatg

SEQ ID NO: 7648792 - DNA, 22 bp, Homo sapiens
acatggatgaattgtctagtgg

SEQ ID NO: 7648793 - DNA, 22 bp, Homo sapiens
acatggagactctaccagaaaa

SEQ ID NO: 7648794 - DNA, 22 bp, Homo sapiens
acatggcattcactcccacagg

SEQ ID NO: 7648795 - DNA, 20 bp, Homo sapiens
acatggcattcccacgtggt

SEQ ID NO: 7648796 - DNA, 19 bp, Homo sapiens
acatggcatcccaggaggt

SEQ ID NO: 7648797 - DNA, 19 bp, Homo sapiens
acatggcatcccaggaggt

SEQ ID NO: 7648798 - DNA, 22 bp, Homo sapiens
aggcctgcctggagcctggctg

SEQ ID NO: 7648799 - DNA, 20 bp, Homo sapiens
acatggcattcccacgtggt

SEQ ID NO: 7648800 - DNA, 22 bp, Homo sapiens
aggcctgcctggagcctggctg

SEQ ID NO: 7648801 - DNA, 22 bp, Homo sapiens
aggcctgcctggagcctggctg

SEQ ID NO: 7648802 - DNA, 20 bp, Homo sapiens
acatggcattcccacgtggt

SEQ ID NO: 7648803 - DNA, 22 bp, Homo sapiens
aggcctgcctggagcctggctg

SEQ ID NO: 7648804 - DNA, 22 bp, Homo sapiens
aggcctgcctggatcacacaga

SEQ ID NO: 7648805 - DNA, 22 bp, Homo sapiens
aggcctgcctggatcacacaga

SEQ ID NO: 7648806 - DNA, 22 bp, Homo sapiens
acatggcacccagatctcaaaa

SEQ ID NO: 7648807 - DNA, 22 bp, Homo sapiens
acatggcagctgatgattggaa

SEQ ID NO: 7648808 - DNA, 22 bp, Homo sapiens
acatggcaggaatcatgtgttt

SEQ ID NO: 7648809 - DNA, 19 bp, Homo sapiens
acatggcatcccaggaggt

SEQ ID NO: 7648810 - DNA, 17 bp, Homo sapiens
acatggcagttcacgct

SEQ ID NO: 7648811 - DNA, 17 bp, Homo sapiens
acatggcagttcacgct

SEQ ID NO: 7648812 - DNA, 22 bp, Homo sapiens
acatggcaggaatcatgtgttt

SEQ ID NO: 7648813 - DNA, 22 bp, Homo sapiens
acatgcaggaaaatgcacagat

SEQ ID NO: 7648814 - DNA, 22 bp, Homo sapiens
acatgcaggaaaatgcacagat

SEQ ID NO: 7648815 - DNA, 22 bp, Homo sapiens
acatgcagggctttttgcctct

SEQ ID NO: 7648816 - DNA, 22 bp, Homo sapiens
acatgcagggctttttgcctct

SEQ ID NO: 7648817 - DNA, 22 bp, Homo sapiens
acatgcaggtgatctggtcaat

SEQ ID NO: 7648818 - DNA, 22 bp, Homo sapiens
acatgcaggaaaatgcacagat

SEQ ID NO: 7648819 - DNA, 22 bp, Homo sapiens
acatgcaggtgatctggtcaat

SEQ ID NO: 7648820 - DNA, 22 bp, Homo sapiens
acatgcagtgagtagttctcca

SEQ ID NO: 7648821 - DNA, 22 bp, Homo sapiens
acatgcagtgagtagttctcca

SEQ ID NO: 7648822 - DNA, 20 bp, Homo sapiens
acatgcagtggtcatttcag

SEQ ID NO: 7648823 - DNA, 22 bp, Homo sapiens
acatgcagtgaggatcttagaa

SEQ ID NO: 7648824 - DNA, 22 bp, Homo sapiens
acatgcaggtgatctggtcaat

SEQ ID NO: 7648825 - DNA, 22 bp, Homo sapiens
acatgcagtgaggatcttagaa

SEQ ID NO: 7648826 - DNA, 20 bp, Homo sapiens
aggccctgccagggacggag

SEQ ID NO: 7648827 - DNA, 22 bp, Homo sapiens
acatgcataaactacttcttat

SEQ ID NO: 7648828 - DNA, 20 bp, Homo sapiens
aggccctgccagggacggag

SEQ ID NO: 7648829 - DNA, 20 bp, Homo sapiens
aggccctgccagggacggag

SEQ ID NO: 7648830 - DNA, 20 bp, Homo sapiens
acatgcagtggtcatttcag

SEQ ID NO: 7648831 - DNA, 20 bp, Homo sapiens
acatgcagtggtcatttcag

SEQ ID NO: 7648832 - DNA, 22 bp, Homo sapiens
acatgcataaactacttcttat

SEQ ID NO: 7648833 - DNA, 22 bp, Homo sapiens
acatgcagagggagggccaggc

SEQ ID NO: 7648834 - DNA, 22 bp, Homo sapiens
acatgcagagggagggccaggc

SEQ ID NO: 7648835 - DNA, 22 bp, Homo sapiens
acatgcaggaaaatgcacagat

SEQ ID NO: 7648836 - DNA, 22 bp, Homo sapiens
acatgcagagggagggccaggc

SEQ ID NO: 7648837 - DNA, 22 bp, Homo sapiens
acatgcaggaaaatgcacagat

SEQ ID NO: 7648838 - DNA, 22 bp, Homo sapiens
acatgcaggaaaatgcacagat

SEQ ID NO: 7648839 - DNA, 22 bp, Homo sapiens
acatgcagaattcttagagagc

SEQ ID NO: 7648840 - DNA, 22 bp, Homo sapiens
acatgcagacgggatcctggca

SEQ ID NO: 7648841 - DNA, 22 bp, Homo sapiens
acatgcagacgggatcctggca

SEQ ID NO: 7648842 - DNA, 22 bp, Homo sapiens
acatgcagacgggatcctggca

SEQ ID NO: 7648843 - DNA, 22 bp, Homo sapiens
acatgcagaattcttagagagc

SEQ ID NO: 7648844 - DNA, 22 bp, Homo sapiens
acatgcagaattcttagagagc

SEQ ID NO: 7648845 - DNA, 22 bp, Homo sapiens
acatgcagaattcttagagagc

SEQ ID NO: 7648846 - DNA, 22 bp, Homo sapiens
acatgcactctcactgtgctct

SEQ ID NO: 7648847 - DNA, 22 bp, Homo sapiens
acatgcactctcactgtgctct

SEQ ID NO: 7648848 - DNA, 22 bp, Homo sapiens
acatgcactgctcagggttccg

SEQ ID NO: 7648849 - DNA, 22 bp, Homo sapiens
acatgcactggttgaggggttt

SEQ ID NO: 7648850 - DNA, 22 bp, Homo sapiens
acatgcactggttgaggggttt

SEQ ID NO: 7648851 - DNA, 22 bp, Homo sapiens
acatgcacggcaccatcttctg

SEQ ID NO: 7648852 - DNA, 22 bp, Homo sapiens
acatgcacggcaccatcttctg

SEQ ID NO: 7648853 - DNA, 20 bp, Homo sapiens
acatgcacgtgtgtatatat

SEQ ID NO: 7648854 - DNA, 20 bp, Homo sapiens
acatgcacgtgtgtatatat

SEQ ID NO: 7648855 - DNA, 20 bp, Homo sapiens
aggccctgtgcatcttgttt

SEQ ID NO: 7648856 - DNA, 20 bp, Homo sapiens
aggccctgtgcatcttgttt

SEQ ID NO: 7648857 - DNA, 20 bp, Homo sapiens
aggccctgtgcatcttgttt

SEQ ID NO: 7648858 - DNA, 22 bp, Homo sapiens
aggccctgttatgagccactgt

SEQ ID NO: 7648859 - DNA, 22 bp, Homo sapiens
aggccctgttatgagccactgt

SEQ ID NO: 7648860 - DNA, 22 bp, Homo sapiens
aggccctgttatgagccactgt

SEQ ID NO: 7648861 - DNA, 20 bp, Homo sapiens
aggccctgtgcatcttgttt

SEQ ID NO: 7648862 - DNA, 22 bp, Homo sapiens
aggccctgttatgagccactgt

SEQ ID NO: 7648863 - DNA, 22 bp, Homo sapiens
aggccctgttatgagccactgt

SEQ ID NO: 7648864 - DNA, 22 bp, Homo sapiens
aggccctgttatgagccactgt

SEQ ID NO: 7648865 - DNA, 22 bp, Homo sapiens
aggccctgtccatggtgctgaa

SEQ ID NO: 7648866 - DNA, 22 bp, Homo sapiens
aggccctgtccatggtgctgaa

SEQ ID NO: 7648867 - DNA, 22 bp, Homo sapiens
aggccctgtccatggtgctgaa

SEQ ID NO: 7648868 - DNA, 22 bp, Homo sapiens
aggccctgtccatggtgctgaa

SEQ ID NO: 7648869 - DNA, 22 bp, Homo sapiens
aggccctgtccatggtgctgaa

SEQ ID NO: 7648870 - DNA, 22 bp, Homo sapiens
aggccctgtccatggtgctgaa

SEQ ID NO: 7648871 - DNA, 22 bp, Homo sapiens
aggccctgtccatggtgctgaa

SEQ ID NO: 7648872 - DNA, 22 bp, Homo sapiens
aggccctgtccatggtgctgaa

SEQ ID NO: 7648873 - DNA, 22 bp, Homo sapiens
aggccctgtccatggtgctgaa

SEQ ID NO: 7648874 - DNA, 22 bp, Homo sapiens
aggccctgcccagagctcctcg

SEQ ID NO: 7648875 - DNA, 22 bp, Homo sapiens
aggccctgcccagagctcctcg

SEQ ID NO: 7648876 - DNA, 22 bp, Homo sapiens
aggccctgcccagagctcctcg

SEQ ID NO: 7648877 - DNA, 22 bp, Homo sapiens
aggccctggtcaggtctggctg

SEQ ID NO: 7648878 - DNA, 22 bp, Homo sapiens
aggccctggtcaggtctggctg

SEQ ID NO: 7648879 - DNA, 22 bp, Homo sapiens
aggccctggtcaggtctggctg

SEQ ID NO: 7648880 - DNA, 22 bp, Homo sapiens
aggccctgtaaggtgtggagat

SEQ ID NO: 7648881 - DNA, 22 bp, Homo sapiens
aggccctggtcaggtctggctg

SEQ ID NO: 7648882 - DNA, 22 bp, Homo sapiens
aggccctgcccagagctcctcg

SEQ ID NO: 7648883 - DNA, 22 bp, Homo sapiens
aggccctgtaaggtgtggagat

SEQ ID NO: 7648884 - DNA, 22 bp, Homo sapiens
aggccctgtaaggtgtggagat

SEQ ID NO: 7648885 - DNA, 22 bp, Homo sapiens
aggccctgtaaggtgtggagat

SEQ ID NO: 7648886 - DNA, 22 bp, Homo sapiens
aggccctgtaaggtgtggagat

SEQ ID NO: 7648887 - DNA, 22 bp, Homo sapiens
aggccctgtaaggtgtggagat

SEQ ID NO: 7648888 - DNA, 22 bp, Homo sapiens
aggccctgtaaggtgtggagat

SEQ ID NO: 7648889 - DNA, 22 bp, Homo sapiens
aggccctgtaaggtgtggagat

SEQ ID NO: 7648890 - DNA, 22 bp, Homo sapiens
aggccctgtaaggtgtggagat

SEQ ID NO: 7648891 - DNA, 22 bp, Homo sapiens
agggagctattgtgttactttg

SEQ ID NO: 7648892 - DNA, 22 bp, Homo sapiens
agggagctatttcagggttatt

SEQ ID NO: 7648893 - DNA, 22 bp, Homo sapiens
agggagctatttcagggttatt

SEQ ID NO: 7648894 - DNA, 22 bp, Homo sapiens
agggagctaggatcctgaaggt

SEQ ID NO: 7648895 - DNA, 22 bp, Homo sapiens
agggagctaggatcctgaaggt

SEQ ID NO: 7648896 - DNA, 22 bp, Homo sapiens
agggagccttcctggctgtggt

SEQ ID NO: 7648897 - DNA, 22 bp, Homo sapiens
agggagctaggatcctgaaggt

SEQ ID NO: 7648898 - DNA, 22 bp, Homo sapiens
agggagccttcctggctgtggt

SEQ ID NO: 7648899 - DNA, 22 bp, Homo sapiens
agggagccttcctggctgtggt

SEQ ID NO: 7648900 - DNA, 22 bp, Homo sapiens
agggagccttcctggctgtggt

SEQ ID NO: 7648901 - DNA, 19 bp, Homo sapiens
accaggcctcagaggccct

SEQ ID NO: 7648902 - DNA, 23 bp, Homo sapiens
agggagctaaaaggctggagcag

SEQ ID NO: 7648903 - DNA, 22 bp, Homo sapiens
agggagccttcctggctgtggt

SEQ ID NO: 7648904 - DNA, 22 bp, Homo sapiens
agggagccttcctggctgtggt

SEQ ID NO: 7648905 - DNA, 23 bp, Homo sapiens
agggagctaaaaggctggagcag

SEQ ID NO: 7648906 - DNA, 23 bp, Homo sapiens
agggagctaaaaggctggagcag

SEQ ID NO: 7648907 - DNA, 20 bp, Homo sapiens
accaggcccggtgtctcctc

SEQ ID NO: 7648908 - DNA, 20 bp, Homo sapiens
accaggcccggtgtctcctc

SEQ ID NO: 7648909 - DNA, 22 bp, Homo sapiens
accaggccctccagctgcgtgg

SEQ ID NO: 7648910 - DNA, 22 bp, Homo sapiens
accaggccctccagctgcgtgg

SEQ ID NO: 7648911 - DNA, 22 bp, Homo sapiens
accaggcctagcaagtacatta

SEQ ID NO: 7648912 - DNA, 22 bp, Homo sapiens
accaggccctccagctgcgtgg

SEQ ID NO: 7648913 - DNA, 19 bp, Homo sapiens
accaggcctcagaggccct

SEQ ID NO: 7648914 - DNA, 19 bp, Homo sapiens
accaggcctcagaggccct

SEQ ID NO: 7648915 - DNA, 19 bp, Homo sapiens
accaggcctcagaggccct

SEQ ID NO: 7648916 - DNA, 19 bp, Homo sapiens
accaggcctcagaggccct

SEQ ID NO: 7648917 - DNA, 19 bp, Homo sapiens
accaggcctcagaggccct

SEQ ID NO: 7648918 - DNA, 22 bp, Homo sapiens
accaggcctagcaagtacatta

SEQ ID NO: 7648919 - DNA, 22 bp, Homo sapiens
accaggcctagcaagtacatta

SEQ ID NO: 7648920 - DNA, 22 bp, Homo sapiens
accaggcctagcaagtacatta

SEQ ID NO: 7648921 - DNA, 22 bp, Homo sapiens
accaggcctagcaagtacatta

SEQ ID NO: 7648922 - DNA, 22 bp, Homo sapiens
accaggcctagcaagtacatta

SEQ ID NO: 7648923 - DNA, 22 bp, Homo sapiens
accaggcctagcaagtacatta

SEQ ID NO: 7648924 - DNA, 22 bp, Homo sapiens
accaggcctagcaagtacatta

SEQ ID NO: 7648925 - DNA, 22 bp, Homo sapiens
accaggcccaccgcatgctcct

SEQ ID NO: 7648926 - DNA, 22 bp, Homo sapiens
accaggagttttgaccaggggc

SEQ ID NO: 7648927 - DNA, 22 bp, Homo sapiens
accaggagttttgaccaggggc

SEQ ID NO: 7648928 - DNA, 23 bp, Homo sapiens
accaggagttgtctcaggaaaca

SEQ ID NO: 7648929 - DNA, 23 bp, Homo sapiens
accaggagttgtctcaggaaaca

SEQ ID NO: 7648930 - DNA, 22 bp, Homo sapiens
accaggcccaccgcatgctcct

SEQ ID NO: 7648931 - DNA, 22 bp, Homo sapiens
accaggagttttgaccaggggc

SEQ ID NO: 7648932 - DNA, 22 bp, Homo sapiens
accaggagttttgaccaggggc

SEQ ID NO: 7648933 - DNA, 22 bp, Homo sapiens
accaggagttgggggtgggacc

SEQ ID NO: 7648934 - DNA, 22 bp, Homo sapiens
agggacagtatccatctcacag

SEQ ID NO: 7648935 - DNA, 22 bp, Homo sapiens
agggacagtatccatctcacag

SEQ ID NO: 7648936 - DNA, 22 bp, Homo sapiens
agggacagtatccatctcacag

SEQ ID NO: 7648937 - DNA, 22 bp, Homo sapiens
accaggagttgggggtgggacc

SEQ ID NO: 7648938 - DNA, 22 bp, Homo sapiens
agggacagtatccatctcacag

SEQ ID NO: 7648939 - DNA, 22 bp, Homo sapiens
agggacagtatccatctcacag

SEQ ID NO: 7648940 - DNA, 22 bp, Homo sapiens
agggacagtatccatctcacag

SEQ ID NO: 7648941 - DNA, 22 bp, Homo sapiens
agggacagtatccatctcacag

SEQ ID NO: 7648942 - DNA, 22 bp, Homo sapiens
agggacagtatccatctcacag

SEQ ID NO: 7648943 - DNA, 22 bp, Homo sapiens
agggacagtatccatctcacag

SEQ ID NO: 7648944 - DNA, 22 bp, Homo sapiens
agggacagtatccatctcacag

SEQ ID NO: 7648945 - DNA, 22 bp, Homo sapiens
agggacagtatccatctcacag

SEQ ID NO: 7648946 - DNA, 22 bp, Homo sapiens
accaggcccgctgctatggtgg

SEQ ID NO: 7648947 - DNA, 22 bp, Homo sapiens
accaggcccgctgctatggtgg

SEQ ID NO: 7648948 - DNA, 22 bp, Homo sapiens
accaggcccgctgctatggtgg

SEQ ID NO: 7648949 - DNA, 20 bp, Homo sapiens
accaggcccggtgtctcctc

SEQ ID NO: 7648950 - DNA, 20 bp, Homo sapiens
accaggccccgggccctgca

SEQ ID NO: 7648951 - DNA, 20 bp, Homo sapiens
accaggccccgggccctgca

SEQ ID NO: 7648952 - DNA, 22 bp, Homo sapiens
accaggcccatgtggattacta

SEQ ID NO: 7648953 - DNA, 22 bp, Homo sapiens
accaggcccatgtggattacta

SEQ ID NO: 7648954 - DNA, 22 bp, Homo sapiens
accaggcccatgtggattacta

SEQ ID NO: 7648955 - DNA, 20 bp, Homo sapiens
accaggccccgggccctgca

SEQ ID NO: 7648956 - DNA, 20 bp, Homo sapiens
accaggccccgggccctgca

SEQ ID NO: 7648957 - DNA, 20 bp, Homo sapiens
accaggccccgggccctgca

SEQ ID NO: 7648958 - DNA, 20 bp, Homo sapiens
accaggccccgggccctgca

SEQ ID NO: 7648959 - DNA, 17 bp, Homo sapiens
agggacagcagtttagg

SEQ ID NO: 7648960 - DNA, 17 bp, Homo sapiens
agggacagcagtttagg

SEQ ID NO: 7648961 - DNA, 17 bp, Homo sapiens
agggacagcagtttagg

SEQ ID NO: 7648962 - DNA, 17 bp, Homo sapiens
agggacagcagtttagg

SEQ ID NO: 7648963 - DNA, 17 bp, Homo sapiens
agggacagcagtttagg

SEQ ID NO: 7648964 - DNA, 17 bp, Homo sapiens
agggacagcagtttagg

SEQ ID NO: 7648965 - DNA, 17 bp, Homo sapiens
agggacagcagtttagg

SEQ ID NO: 7648966 - DNA, 17 bp, Homo sapiens
agggacagcagtttagg

SEQ ID NO: 7648967 - DNA, 17 bp, Homo sapiens
agggacagcagtttagg

SEQ ID NO: 7648968 - DNA, 22 bp, Homo sapiens
agggacagatgaatgactgagt

SEQ ID NO: 7648969 - DNA, 22 bp, Homo sapiens
agggacagatgaatgactgagt

SEQ ID NO: 7648970 - DNA, 22 bp, Homo sapiens
agggacagatgaatgactgagt

SEQ ID NO: 7648971 - DNA, 22 bp, Homo sapiens
agggacagatgaatgactgagt

SEQ ID NO: 7648972 - DNA, 22 bp, Homo sapiens
agggacagatgaatgactgagt

SEQ ID NO: 7648973 - DNA, 22 bp, Homo sapiens
agggacagatgaatgactgagt

SEQ ID NO: 7648974 - DNA, 22 bp, Homo sapiens
agggacagatgaatgactgagt

SEQ ID NO: 7648975 - DNA, 22 bp, Homo sapiens
agggacagatgaatgactgagt

SEQ ID NO: 7648976 - DNA, 22 bp, Homo sapiens
agggacagatgaatgactgagt

SEQ ID NO: 7648977 - DNA, 22 bp, Homo sapiens
agggacacttgctttcaggccc

SEQ ID NO: 7648978 - DNA, 22 bp, Homo sapiens
agggacactgatgagaaattct

SEQ ID NO: 7648979 - DNA, 22 bp, Homo sapiens
agggacacttgctttcaggccc

SEQ ID NO: 7648980 - DNA, 22 bp, Homo sapiens
agggacagatgaatgactgagt

SEQ ID NO: 7648981 - DNA, 22 bp, Homo sapiens
agggacagatgaatgactgagt

SEQ ID NO: 7648982 - DNA, 22 bp, Homo sapiens
agggacagatgaatgactgagt

SEQ ID NO: 7648983 - DNA, 22 bp, Homo sapiens
agggacagatgaatgactgagt

SEQ ID NO: 7648984 - DNA, 21 bp, Homo sapiens
agggacacacaggatggggct

SEQ ID NO: 7648985 - DNA, 20 bp, Homo sapiens
agggacacaatatttctgtg

SEQ ID NO: 7648986 - DNA, 21 bp, Homo sapiens
agggacacacaggatggggct

SEQ ID NO: 7648987 - DNA, 21 bp, Homo sapiens
agggacacacaggatggggct

SEQ ID NO: 7648988 - DNA, 22 bp, Homo sapiens
agggacacactccagtgttatt

SEQ ID NO: 7648989 - DNA, 22 bp, Homo sapiens
agggacacatgtgattatttat

SEQ ID NO: 7648990 - DNA, 22 bp, Homo sapiens
agggacacactccagtgttatt

SEQ ID NO: 7648991 - DNA, 22 bp, Homo sapiens
agggacacactccagtgttatt

SEQ ID NO: 7648992 - DNA, 22 bp, Homo sapiens
agggacacatgtgattatttat

SEQ ID NO: 7648993 - DNA, 22 bp, Homo sapiens
agggacacgaggtcctgctggg

SEQ ID NO: 7648994 - DNA, 22 bp, Homo sapiens
agggacactgatgagaaattct

SEQ ID NO: 7648995 - DNA, 22 bp, Homo sapiens
agggacacgaggtcctgctggg

SEQ ID NO: 7648996 - DNA, 22 bp, Homo sapiens
agggacacgaggtcctgctggg

SEQ ID NO: 7648997 - DNA, 22 bp, Homo sapiens
agggaatgtgaaaacacctctc

SEQ ID NO: 7648998 - DNA, 22 bp, Homo sapiens
agggaatgtagcaagatgccaa

SEQ ID NO: 7648999 - DNA, 22 bp, Homo sapiens
agggaatgtgaaaacacctctc

SEQ ID NO: 7649000 - DNA, 22 bp, Homo sapiens
agggaattcactggaacgccct

SEQ ID NO: 7649001 - DNA, 22 bp, Homo sapiens
agggaattcactggaacgccct

SEQ ID NO: 7649002 - DNA, 22 bp, Homo sapiens
agggaattcactggaacgccct

SEQ ID NO: 7649003 - DNA, 20 bp, Homo sapiens
agggacacaatatttctgtg

SEQ ID NO: 7649004 - DNA, 21 bp, Homo sapiens
agggacaaaacacaatgccac

SEQ ID NO: 7649005 - DNA, 22 bp, Homo sapiens
agggaagaggaccagagtctct

SEQ ID NO: 7649006 - DNA, 22 bp, Homo sapiens
agggaagaggaccagagtctct

SEQ ID NO: 7649007 - DNA, 22 bp, Homo sapiens
agggaagaggaccagagtctct

SEQ ID NO: 7649008 - DNA, 22 bp, Homo sapiens
agggaagaggcaaggtttatgg

SEQ ID NO: 7649009 - DNA, 22 bp, Homo sapiens
agggaagaggcaaggtttatgg

SEQ ID NO: 7649010 - DNA, 22 bp, Homo sapiens
agggaagaggcaaggtttatgg

SEQ ID NO: 7649011 - DNA, 22 bp, Homo sapiens
agggaagaggcaaggtttatgg

SEQ ID NO: 7649012 - DNA, 22 bp, Homo sapiens
agggaagaggaccagagtctct

SEQ ID NO: 7649013 - DNA, 22 bp, Homo sapiens
agggaagcaggaatagctctga

SEQ ID NO: 7649014 - DNA, 22 bp, Homo sapiens
agggaagcaggaatagctctga

SEQ ID NO: 7649015 - DNA, 22 bp, Homo sapiens
agggaagcaggaatagctctga

SEQ ID NO: 7649016 - DNA, 22 bp, Homo sapiens
agggaagcaggaatagctctga

SEQ ID NO: 7649017 - DNA, 22 bp, Homo sapiens
agggaagcagcagccgcctgtc

SEQ ID NO: 7649018 - DNA, 22 bp, Homo sapiens
agggaagcagcagccgcctgtc

SEQ ID NO: 7649019 - DNA, 22 bp, Homo sapiens
agggaagcaggaatagctctga

SEQ ID NO: 7649020 - DNA, 22 bp, Homo sapiens
agggaagcaggaatagctctga

SEQ ID NO: 7649021 - DNA, 22 bp, Homo sapiens
agggaagcaatgattattattc

SEQ ID NO: 7649022 - DNA, 22 bp, Homo sapiens
agggaagaggcaaggtttatgg

SEQ ID NO: 7649023 - DNA, 22 bp, Homo sapiens
agggaagatgtctcatcttagg

SEQ ID NO: 7649024 - DNA, 22 bp, Homo sapiens
agggaagatgtctcatcttagg

SEQ ID NO: 7649025 - DNA, 22 bp, Homo sapiens
agggaagcaatattagatatca

SEQ ID NO: 7649026 - DNA, 22 bp, Homo sapiens
agggaagccccgaggaggcacc

SEQ ID NO: 7649027 - DNA, 22 bp, Homo sapiens
agggaagccccgaggaggcacc

SEQ ID NO: 7649028 - DNA, 22 bp, Homo sapiens
agggaagccccgaggaggcacc

SEQ ID NO: 7649029 - DNA, 22 bp, Homo sapiens
agggaagccccgaggaggcacc

SEQ ID NO: 7649030 - DNA, 22 bp, Homo sapiens
agggaagccctggctgagaccc

SEQ ID NO: 7649031 - DNA, 22 bp, Homo sapiens
agggaagccctggctgagaccc

SEQ ID NO: 7649032 - DNA, 22 bp, Homo sapiens
agggaagccctggctgagaccc

SEQ ID NO: 7649033 - DNA, 22 bp, Homo sapiens
agggaagccaagccttagagaa

SEQ ID NO: 7649034 - DNA, 22 bp, Homo sapiens
agggaagccccgaggaggcacc

SEQ ID NO: 7649035 - DNA, 22 bp, Homo sapiens
agggaagccaagccttagagaa

SEQ ID NO: 7649036 - DNA, 22 bp, Homo sapiens
agggaagctgctgggtccacct

SEQ ID NO: 7649037 - DNA, 22 bp, Homo sapiens
agggaagctgctgggtccacct

SEQ ID NO: 7649038 - DNA, 22 bp, Homo sapiens
agggaagccctggctgagaccc

SEQ ID NO: 7649039 - DNA, 22 bp, Homo sapiens
agggaagctgctgggtccacct

SEQ ID NO: 7649040 - DNA, 22 bp, Homo sapiens
agggaagctgctgggtccacct

SEQ ID NO: 7649041 - DNA, 22 bp, Homo sapiens
agggaagctgctgggtccacct

SEQ ID NO: 7649042 - DNA, 22 bp, Homo sapiens
agggaatgtagcaagatgccaa

SEQ ID NO: 7649043 - DNA, 22 bp, Homo sapiens
agggaagcttgttactgagaag

SEQ ID NO: 7649044 - DNA, 22 bp, Homo sapiens
agggaagcttgttactgagaag

SEQ ID NO: 7649045 - DNA, 22 bp, Homo sapiens
agggaagcttgttactgagaag

SEQ ID NO: 7649046 - DNA, 22 bp, Homo sapiens
agggaagcttgttactgagaag

SEQ ID NO: 7649047 - DNA, 22 bp, Homo sapiens
agggaatgtagcaagatgccaa

SEQ ID NO: 7649048 - DNA, 22 bp, Homo sapiens
aggctttatttgatctatatgc

SEQ ID NO: 7649049 - DNA, 22 bp, Homo sapiens
aggctttcctgtcactcatgct

SEQ ID NO: 7649050 - DNA, 22 bp, Homo sapiens
aggctttatttgatctatatgc

SEQ ID NO: 7649051 - DNA, 22 bp, Homo sapiens
aggctttatttgatctatatgc

SEQ ID NO: 7649052 - DNA, 23 bp, Homo sapiens
aggctttatggtagaaagtttgc

SEQ ID NO: 7649053 - DNA, 23 bp, Homo sapiens
aggctttatggtagaaagtttgc

SEQ ID NO: 7649054 - DNA, 23 bp, Homo sapiens
aggctttatggtagaaagtttgc

SEQ ID NO: 7649055 - DNA, 22 bp, Homo sapiens
agggaagaatcactgggatgtt

SEQ ID NO: 7649056 - DNA, 22 bp, Homo sapiens
agggaagaatcactgggatgtt

SEQ ID NO: 7649057 - DNA, 22 bp, Homo sapiens
agggaagaatcactgggatgtt

SEQ ID NO: 7649058 - DNA, 22 bp, Homo sapiens
agggaagaatcactgggatgtt

SEQ ID NO: 7649059 - DNA, 22 bp, Homo sapiens
agggaagaatcactgggatgtt

SEQ ID NO: 7649060 - DNA, 22 bp, Homo sapiens
agggaagaatcactgggatgtt

SEQ ID NO: 7649061 - DNA, 22 bp, Homo sapiens
aggctttactggatttttcgct

SEQ ID NO: 7649062 - DNA, 22 bp, Homo sapiens
aggctttactggatttttcgct

SEQ ID NO: 7649063 - DNA, 22 bp, Homo sapiens
aggctttactgcctcaggactc

SEQ ID NO: 7649064 - DNA, 22 bp, Homo sapiens
aggctggcatacatttgttctt

SEQ ID NO: 7649065 - DNA, 22 bp, Homo sapiens
aggctggcagccacctcagcag

SEQ ID NO: 7649066 - DNA, 22 bp, Homo sapiens
aggctggcagccacctcagcag

SEQ ID NO: 7649067 - DNA, 22 bp, Homo sapiens
aggctggcagccacctcagcag

SEQ ID NO: 7649068 - DNA, 22 bp, Homo sapiens
aggctggcagccacctcagcag

SEQ ID NO: 7649069 - DNA, 22 bp, Homo sapiens
agggaagagcttgcaagaaacc

SEQ ID NO: 7649070 - DNA, 22 bp, Homo sapiens
agggaagagcttgcaagaaacc

SEQ ID NO: 7649071 - DNA, 22 bp, Homo sapiens
agggaagagcttgcaagaaacc

SEQ ID NO: 7649072 - DNA, 22 bp, Homo sapiens
agggaagagcttgcaagaaacc

SEQ ID NO: 7649073 - DNA, 22 bp, Homo sapiens
agggaagaatcactgggatgtt

SEQ ID NO: 7649074 - DNA, 22 bp, Homo sapiens
agggaagagcttgcaagaaacc

SEQ ID NO: 7649075 - DNA, 22 bp, Homo sapiens
agggaagagcttgcaagaaacc

SEQ ID NO: 7649076 - DNA, 22 bp, Homo sapiens
agggaagagcttgcaagaaacc

SEQ ID NO: 7649077 - DNA, 22 bp, Homo sapiens
agggaagagcttgcaagaaacc

SEQ ID NO: 7649078 - DNA, 22 bp, Homo sapiens
agggaagaatcactgggatgtt

SEQ ID NO: 7649079 - DNA, 22 bp, Homo sapiens
agggaagaatcactgggatgtt

SEQ ID NO: 7649080 - DNA, 22 bp, Homo sapiens
agggaagagcttgcaagaaacc

SEQ ID NO: 7649081 - DNA, 22 bp, Homo sapiens
agggaagagcttgcaagaaacc

SEQ ID NO: 7649082 - DNA, 22 bp, Homo sapiens
agggaagaggaccagagtctct

SEQ ID NO: 7649083 - DNA, 22 bp, Homo sapiens
agggaagaggaccagagtctct

SEQ ID NO: 7649084 - DNA, 22 bp, Homo sapiens
agggaagaggaccagagtctct

SEQ ID NO: 7649085 - DNA, 22 bp, Homo sapiens
agggaagagcttgcaagaaacc

SEQ ID NO: 7649086 - DNA, 22 bp, Homo sapiens
agggaagaggaccagagtctct

SEQ ID NO: 7649087 - DNA, 22 bp, Homo sapiens
agggaagaggaccagagtctct

SEQ ID NO: 7649088 - DNA, 22 bp, Homo sapiens
agggaagaggaccagagtctct

SEQ ID NO: 7649089 - DNA, 22 bp, Homo sapiens
agggaagaggaccagagtctct

SEQ ID NO: 7649090 - DNA, 22 bp, Homo sapiens
agggaagaggaccagagtctct

SEQ ID NO: 7649091 - DNA, 22 bp, Homo sapiens
aggctggcaaggcagatgtgtg

SEQ ID NO: 7649092 - DNA, 22 bp, Homo sapiens
aggctggcaaggcagatgtgtg

SEQ ID NO: 7649093 - DNA, 22 bp, Homo sapiens
aggctggcaaggcagatgtgtg

SEQ ID NO: 7649094 - DNA, 22 bp, Homo sapiens
aggctggcaaggcagatgtgtg

SEQ ID NO: 7649095 - DNA, 22 bp, Homo sapiens
aggctggatttatggggacttc

SEQ ID NO: 7649096 - DNA, 22 bp, Homo sapiens
aggctggcagccacctcagcag

SEQ ID NO: 7649097 - DNA, 22 bp, Homo sapiens
aggctggcagccacctcagcag

SEQ ID NO: 7649098 - DNA, 22 bp, Homo sapiens
aggctggcagccacctcagcag

SEQ ID NO: 7649099 - DNA, 20 bp, Homo sapiens
aggctggcactcctggccag

SEQ ID NO: 7649100 - DNA, 20 bp, Homo sapiens
aggctggcactcctggccag

SEQ ID NO: 7649101 - DNA, 20 bp, Homo sapiens
aggctggcactcctggccag

SEQ ID NO: 7649102 - DNA, 20 bp, Homo sapiens
aggctggcactcctggccag

SEQ ID NO: 7649103 - DNA, 20 bp, Homo sapiens
aggctggcactcctggccag

SEQ ID NO: 7649104 - DNA, 20 bp, Homo sapiens
aggctggcactcctggccag

SEQ ID NO: 7649105 - DNA, 20 bp, Homo sapiens
aggctggcactcctggccag

SEQ ID NO: 7649106 - DNA, 20 bp, Homo sapiens
aggctggcactcctggccag

SEQ ID NO: 7649107 - DNA, 22 bp, Homo sapiens
aggctggagtgtgcagtggcgc

SEQ ID NO: 7649108 - DNA, 22 bp, Homo sapiens
aggctggagtgtgcagtggcgc

SEQ ID NO: 7649109 - DNA, 22 bp, Homo sapiens
aggctggagtgtgcagtggcgc

SEQ ID NO: 7649110 - DNA, 22 bp, Homo sapiens
aggctggagtgtgcagtggcgc

SEQ ID NO: 7649111 - DNA, 22 bp, Homo sapiens
aggctggagtgtgcagtggcgc

SEQ ID NO: 7649112 - DNA, 22 bp, Homo sapiens
aggctggagtgtgcagtggcgc

SEQ ID NO: 7649113 - DNA, 22 bp, Homo sapiens
aggctggagtgtgcagtggcgc

SEQ ID NO: 7649114 - DNA, 22 bp, Homo sapiens
aggctggagtgtgcagtggcgc

SEQ ID NO: 7649115 - DNA, 22 bp, Homo sapiens
aggctggagtgtgcagtggcgc

SEQ ID NO: 7649116 - DNA, 22 bp, Homo sapiens
aggctggagtgtgcagtggcgc

SEQ ID NO: 7649117 - DNA, 22 bp, Homo sapiens
aggctggatctctgttgccttc

SEQ ID NO: 7649118 - DNA, 19 bp, Homo sapiens
aggctggatgcccatctta

SEQ ID NO: 7649119 - DNA, 19 bp, Homo sapiens
aggctggatgcccatctta

SEQ ID NO: 7649120 - DNA, 19 bp, Homo sapiens
aggctggatgcccatctta

SEQ ID NO: 7649121 - DNA, 22 bp, Homo sapiens
aggctggatctctgttgccttc

SEQ ID NO: 7649122 - DNA, 22 bp, Homo sapiens
aggctggatttatggggacttc

SEQ ID NO: 7649123 - DNA, 22 bp, Homo sapiens
aggctggatttatggggacttc

SEQ ID NO: 7649124 - DNA, 22 bp, Homo sapiens
aggctggatttatggggacttc

SEQ ID NO: 7649125 - DNA, 22 bp, Homo sapiens
aggctggatttatggggacttc

SEQ ID NO: 7649126 - DNA, 19 bp, Homo sapiens
aggctggatgcccatctta

SEQ ID NO: 7649127 - DNA, 22 bp, Homo sapiens
aggctggatgtgcctcaccgag

SEQ ID NO: 7649128 - DNA, 22 bp, Homo sapiens
aggctggatgtgcctcaccgag

SEQ ID NO: 7649129 - DNA, 21 bp, Homo sapiens
accaaaacctatactttctgt

SEQ ID NO: 7649130 - DNA, 21 bp, Homo sapiens
accaaaacctatactttctgt

SEQ ID NO: 7649131 - DNA, 21 bp, Homo sapiens
accaaaacctatactttctgt

SEQ ID NO: 7649132 - DNA, 22 bp, Homo sapiens
accaaaacctgctactaaagga

SEQ ID NO: 7649133 - DNA, 22 bp, Homo sapiens
accaaaacctgctactaaagga

SEQ ID NO: 7649134 - DNA, 22 bp, Homo sapiens
accaaaacctgctactaaagga

SEQ ID NO: 7649135 - DNA, 22 bp, Homo sapiens
accaaaacctgctactaaagga

SEQ ID NO: 7649136 - DNA, 21 bp, Homo sapiens
accaaaacctatactttctgt

SEQ ID NO: 7649137 - DNA, 19 bp, Homo sapiens
accaaacagtggacggagc

SEQ ID NO: 7649138 - DNA, 19 bp, Homo sapiens
accaaacagtggacggagc

SEQ ID NO: 7649139 - DNA, 22 bp, Homo sapiens
accaaacaaaattgtgcactgt

SEQ ID NO: 7649140 - DNA, 22 bp, Homo sapiens
accaaacaaaattgtgcactgt

SEQ ID NO: 7649141 - DNA, 22 bp, Homo sapiens
accaaagcgagtgatatgtcat

SEQ ID NO: 7649142 - DNA, 22 bp, Homo sapiens
aggctggagtgtgcagtggcgc

SEQ ID NO: 7649143 - DNA, 22 bp, Homo sapiens
accaaaaagatatgttgaagcc

SEQ ID NO: 7649144 - DNA, 22 bp, Homo sapiens
accaaaaattgtggggctgaat

SEQ ID NO: 7649145 - DNA, 22 bp, Homo sapiens
accaaaaagatatgttgaagcc

SEQ ID NO: 7649146 - DNA, 22 bp, Homo sapiens
accaaaaattgtggggctgaat

SEQ ID NO: 7649147 - DNA, 22 bp, Homo sapiens
accaaaaattgtggggctgaat

SEQ ID NO: 7649148 - DNA, 22 bp, Homo sapiens
accaaaaagatatgttgaagcc

SEQ ID NO: 7649149 - DNA, 22 bp, Homo sapiens
accaaaaattgtggggctgaat

SEQ ID NO: 7649150 - DNA, 22 bp, Homo sapiens
accaaaaattgtggggctgaat

SEQ ID NO: 7649151 - DNA, 22 bp, Homo sapiens
accaaaaagatatgttgaagcc

SEQ ID NO: 7649152 - DNA, 22 bp, Homo sapiens
accaaaaagatatgttgaagcc

SEQ ID NO: 7649153 - DNA, 22 bp, Homo sapiens
acattttttagagtcccacatt

SEQ ID NO: 7649154 - DNA, 22 bp, Homo sapiens
acatttttgggttgatgtctga

SEQ ID NO: 7649155 - DNA, 22 bp, Homo sapiens
acatttttgggttgatgtctga

SEQ ID NO: 7649156 - DNA, 22 bp, Homo sapiens
acatttttgggttgatgtctga

SEQ ID NO: 7649157 - DNA, 22 bp, Homo sapiens
acatttttgggttgatgtctga

SEQ ID NO: 7649158 - DNA, 22 bp, Homo sapiens
acatttttgggttgatgtctga

SEQ ID NO: 7649159 - DNA, 22 bp, Homo sapiens
acatttttgggttgatgtctga

SEQ ID NO: 7649160 - DNA, 22 bp, Homo sapiens
acatttttgggttgatgtctga

SEQ ID NO: 7649161 - DNA, 22 bp, Homo sapiens
acatttttgggttgatgtctga

SEQ ID NO: 7649162 - DNA, 22 bp, Homo sapiens
acattttttagagtcccacatt

SEQ ID NO: 7649163 - DNA, 22 bp, Homo sapiens
acattttttagagtcccacatt

SEQ ID NO: 7649164 - DNA, 22 bp, Homo sapiens
acattttttagagtcccacatt

SEQ ID NO: 7649165 - DNA, 22 bp, Homo sapiens
acattttttagagtcccacatt

SEQ ID NO: 7649166 - DNA, 22 bp, Homo sapiens
acattttttagagtcccacatt

SEQ ID NO: 7649167 - DNA, 22 bp, Homo sapiens
acatttgtcttctttcagatta

SEQ ID NO: 7649168 - DNA, 22 bp, Homo sapiens
acatttgtcttctttcagatta

SEQ ID NO: 7649169 - DNA, 22 bp, Homo sapiens
acatttgtcttctttcagatta

SEQ ID NO: 7649170 - DNA, 22 bp, Homo sapiens
acatttgtcttctttcagatta

SEQ ID NO: 7649171 - DNA, 22 bp, Homo sapiens
acatttgtcttctttcagatta

SEQ ID NO: 7649172 - DNA, 22 bp, Homo sapiens
acatttgtcttctttcagatta

SEQ ID NO: 7649173 - DNA, 22 bp, Homo sapiens
aggctgcagaacagtcaggtgc

SEQ ID NO: 7649174 - DNA, 22 bp, Homo sapiens
aggctgcagaacagtcaggtgc

SEQ ID NO: 7649175 - DNA, 22 bp, Homo sapiens
aggctgcagaacagtcaggtgc

SEQ ID NO: 7649176 - DNA, 22 bp, Homo sapiens
acatttttactgggcatctgca

SEQ ID NO: 7649177 - DNA, 22 bp, Homo sapiens
acatttttactgggcatctgca

SEQ ID NO: 7649178 - DNA, 22 bp, Homo sapiens
acatttttactgggcatctgca

SEQ ID NO: 7649179 - DNA, 22 bp, Homo sapiens
acatttttactgggcatctgca

SEQ ID NO: 7649180 - DNA, 22 bp, Homo sapiens
acatttttatcctgagtgccag

SEQ ID NO: 7649181 - DNA, 22 bp, Homo sapiens
acatttttatcctgagtgccag

SEQ ID NO: 7649182 - DNA, 22 bp, Homo sapiens
acatttttatcctgagtgccag

SEQ ID NO: 7649183 - DNA, 22 bp, Homo sapiens
acatttttatcctgagtgccag

SEQ ID NO: 7649184 - DNA, 22 bp, Homo sapiens
acatttttactgggcatctgca

SEQ ID NO: 7649185 - DNA, 22 bp, Homo sapiens
acatttttactgggcatctgca

SEQ ID NO: 7649186 - DNA, 22 bp, Homo sapiens
acatttttcacatttgtagggt

SEQ ID NO: 7649187 - DNA, 22 bp, Homo sapiens
acatttttcacatttgtagggt

SEQ ID NO: 7649188 - DNA, 22 bp, Homo sapiens
acatttttcacatttgtagggt

SEQ ID NO: 7649189 - DNA, 22 bp, Homo sapiens
acatttttcacatttgtagggt

SEQ ID NO: 7649190 - DNA, 22 bp, Homo sapiens
acatttttctaggaggcaaggt

SEQ ID NO: 7649191 - DNA, 22 bp, Homo sapiens
acatttttctaggaggcaaggt

SEQ ID NO: 7649192 - DNA, 22 bp, Homo sapiens
acatttttctaggaggcaaggt

SEQ ID NO: 7649193 - DNA, 22 bp, Homo sapiens
acatttttctaggaggcaaggt

SEQ ID NO: 7649194 - DNA, 22 bp, Homo sapiens
acatttttctaggaggcaaggt

SEQ ID NO: 7649195 - DNA, 22 bp, Homo sapiens
acatttttctaggaggcaaggt

SEQ ID NO: 7649196 - DNA, 22 bp, Homo sapiens
acatttttattcatcaaagcag

SEQ ID NO: 7649197 - DNA, 22 bp, Homo sapiens
acatttttattcatcaaagcag

SEQ ID NO: 7649198 - DNA, 22 bp, Homo sapiens
acatttttattcatcaaagcag

SEQ ID NO: 7649199 - DNA, 22 bp, Homo sapiens
acatttttattcatcaaagcag

SEQ ID NO: 7649200 - DNA, 22 bp, Homo sapiens
acatttttcacatttgtagggt

SEQ ID NO: 7649201 - DNA, 22 bp, Homo sapiens
acatttttcacatttgtagggt

SEQ ID NO: 7649202 - DNA, 22 bp, Homo sapiens
acatttttattcatcaaagcag

SEQ ID NO: 7649203 - DNA, 22 bp, Homo sapiens
acatttttattcatcaaagcag

SEQ ID NO: 7649204 - DNA, 22 bp, Homo sapiens
acatttttattcatcaaagcag

SEQ ID NO: 7649205 - DNA, 22 bp, Homo sapiens
acatttttatcctgagtgccag

SEQ ID NO: 7649206 - DNA, 22 bp, Homo sapiens
acatttttattcatcaaagcag

SEQ ID NO: 7649207 - DNA, 22 bp, Homo sapiens
acatttttattcatcaaagcag

SEQ ID NO: 7649208 - DNA, 22 bp, Homo sapiens
acatttttattcatcaaagcag

SEQ ID NO: 7649209 - DNA, 22 bp, Homo sapiens
acatttttattcatcaaagcag

SEQ ID NO: 7649210 - DNA, 22 bp, Homo sapiens
acatttttattcatcaaagcag

SEQ ID NO: 7649211 - DNA, 22 bp, Homo sapiens
acatttttattcatcaaagcag

SEQ ID NO: 7649212 - DNA, 22 bp, Homo sapiens
agggagctcagttggaagcggt

SEQ ID NO: 7649213 - DNA, 22 bp, Homo sapiens
agggagctcgatgcctgagtgt

SEQ ID NO: 7649214 - DNA, 22 bp, Homo sapiens
agggagctcgatgcctgagtgt

SEQ ID NO: 7649215 - DNA, 22 bp, Homo sapiens
agggagctcgatgcctgagtgt

SEQ ID NO: 7649216 - DNA, 22 bp, Homo sapiens
agggagctcgatgcctgagtgt

SEQ ID NO: 7649217 - DNA, 22 bp, Homo sapiens
agggagctctaagtagagggac

SEQ ID NO: 7649218 - DNA, 22 bp, Homo sapiens
agggagctctaagtagagggac

SEQ ID NO: 7649219 - DNA, 22 bp, Homo sapiens
agggagctctaagtagagggac

SEQ ID NO: 7649220 - DNA, 22 bp, Homo sapiens
agggagctctaagtagagggac

SEQ ID NO: 7649221 - DNA, 22 bp, Homo sapiens
agggagctcgatgcctgagtgt

SEQ ID NO: 7649222 - DNA, 22 bp, Homo sapiens
agggagctcacagtccagtaga

SEQ ID NO: 7649223 - DNA, 22 bp, Homo sapiens
agggagctcacagtccagtaga

SEQ ID NO: 7649224 - DNA, 22 bp, Homo sapiens
agggagctctttggtcttgccg

SEQ ID NO: 7649225 - DNA, 22 bp, Homo sapiens
agggagctctttggtcttgccg

SEQ ID NO: 7649226 - DNA, 22 bp, Homo sapiens
agggagctctttggtcttgccg

SEQ ID NO: 7649227 - DNA, 22 bp, Homo sapiens
agggagctctgggggcacacgg

SEQ ID NO: 7649228 - DNA, 22 bp, Homo sapiens
agggagctctgggggcacacgg

SEQ ID NO: 7649229 - DNA, 22 bp, Homo sapiens
agggagctctgggggcacacgg

SEQ ID NO: 7649230 - DNA, 22 bp, Homo sapiens
agggagctctgggggcacacgg

SEQ ID NO: 7649231 - DNA, 22 bp, Homo sapiens
accatgttggccaagctggtct

SEQ ID NO: 7649232 - DNA, 22 bp, Homo sapiens
accatcagtactggatgctgac

SEQ ID NO: 7649233 - DNA, 22 bp, Homo sapiens
accatcaagaccttatctagtt

SEQ ID NO: 7649234 - DNA, 22 bp, Homo sapiens
accatattagaaagcacagctc

SEQ ID NO: 7649235 - DNA, 22 bp, Homo sapiens
accattctggtccatactgttc

SEQ ID NO: 7649236 - DNA, 22 bp, Homo sapiens
accattctgtctctttacaaat

SEQ ID NO: 7649237 - DNA, 22 bp, Homo sapiens
accattctgagatgctgctggt

SEQ ID NO: 7649238 - DNA, 21 bp, Homo sapiens
accattctgcacatgctgtca

SEQ ID NO: 7649239 - DNA, 21 bp, Homo sapiens
accattctgcacatgctgtca

SEQ ID NO: 7649240 - DNA, 21 bp, Homo sapiens
accattctgcacatgctgtca

SEQ ID NO: 7649241 - DNA, 20 bp, Homo sapiens
accattaatgtaagctttgt

SEQ ID NO: 7649242 - DNA, 22 bp, Homo sapiens
accattacatgatccttaccca

SEQ ID NO: 7649243 - DNA, 22 bp, Homo sapiens
accattaacatgattttgggga

SEQ ID NO: 7649244 - DNA, 22 bp, Homo sapiens
accattaagaatctggtttcct

SEQ ID NO: 7649245 - DNA, 22 bp, Homo sapiens
accattaagaatctggtttcct

SEQ ID NO: 7649246 - DNA, 22 bp, Homo sapiens
accattaatctcacaaggataa

SEQ ID NO: 7649247 - DNA, 20 bp, Homo sapiens
accattaatgtaagctttgt

SEQ ID NO: 7649248 - DNA, 22 bp, Homo sapiens
accatgtttagtgcagtgttca

SEQ ID NO: 7649249 - DNA, 22 bp, Homo sapiens
accatgtttagtgcagtgttca

SEQ ID NO: 7649250 - DNA, 23 bp, Homo sapiens
accatgtttgaaaaggagtaaat

SEQ ID NO: 7649251 - DNA, 22 bp, Homo sapiens
accattaaagagatcctgggga

SEQ ID NO: 7649252 - DNA, 21 bp, Homo sapiens
accattaacacccaggtttct

SEQ ID NO: 7649253 - DNA, 21 bp, Homo sapiens
accattaacacccaggtttct

SEQ ID NO: 7649254 - DNA, 22 bp, Homo sapiens
accattaacatgattttgggga

SEQ ID NO: 7649255 - DNA, 22 bp, Homo sapiens
accatgttggccaagctggtct

SEQ ID NO: 7649256 - DNA, 22 bp, Homo sapiens
accatgttggccaagctggtct

SEQ ID NO: 7649257 - DNA, 17 bp, Homo sapiens
accattctttttactgc

SEQ ID NO: 7649258 - DNA, 22 bp, Homo sapiens
accattctttacatcagcacag

SEQ ID NO: 7649259 - DNA, 22 bp, Homo sapiens
accattctttacacttatttct

SEQ ID NO: 7649260 - DNA, 22 bp, Homo sapiens
accattgccccctagtgtctgt

SEQ ID NO: 7649261 - DNA, 22 bp, Homo sapiens
accattgccccctagtgtctgt

SEQ ID NO: 7649262 - DNA, 22 bp, Homo sapiens
accattgccccctagtgtctgt

SEQ ID NO: 7649263 - DNA, 22 bp, Homo sapiens
accattgccccctagtgtctgt

SEQ ID NO: 7649264 - DNA, 22 bp, Homo sapiens
accatttaaggaaaatgtatca

SEQ ID NO: 7649265 - DNA, 22 bp, Homo sapiens
accatttaaggaaaatgtatca

SEQ ID NO: 7649266 - DNA, 22 bp, Homo sapiens
accatttaaggaaaatgtatca

SEQ ID NO: 7649267 - DNA, 22 bp, Homo sapiens
accattgccccctagtgtctgt

SEQ ID NO: 7649268 - DNA, 22 bp, Homo sapiens
accattgccccctagtgtctgt

SEQ ID NO: 7649269 - DNA, 22 bp, Homo sapiens
accattgccccctagtgtctgt

SEQ ID NO: 7649270 - DNA, 22 bp, Homo sapiens
accatttaaaattgatgccttc

SEQ ID NO: 7649271 - DNA, 22 bp, Homo sapiens
accatttaaaattgatgccttc

SEQ ID NO: 7649272 - DNA, 22 bp, Homo sapiens
accatttaaggaaaatgtatca

SEQ ID NO: 7649273 - DNA, 22 bp, Homo sapiens
accatttaaggaaaatgtatca

SEQ ID NO: 7649274 - DNA, 22 bp, Homo sapiens
acccacacctccgtatatcact

SEQ ID NO: 7649275 - DNA, 22 bp, Homo sapiens
acccacacctccgtatatcact

SEQ ID NO: 7649276 - DNA, 22 bp, Homo sapiens
acccacacctccgtatatcact

SEQ ID NO: 7649277 - DNA, 22 bp, Homo sapiens
acccacacatctctaattcagt

SEQ ID NO: 7649278 - DNA, 22 bp, Homo sapiens
acccaaaagtcactcaggagca

SEQ ID NO: 7649279 - DNA, 22 bp, Homo sapiens
acccaagacacgtgtcctcagc

SEQ ID NO: 7649280 - DNA, 22 bp, Homo sapiens
acccaagttttccatgcctgtt

SEQ ID NO: 7649281 - DNA, 22 bp, Homo sapiens
accattttgggtattttcagag

SEQ ID NO: 7649282 - DNA, 22 bp, Homo sapiens
accattttgggtattttcagag

SEQ ID NO: 7649283 - DNA, 22 bp, Homo sapiens
accattttgggtattttcagag

SEQ ID NO: 7649284 - DNA, 22 bp, Homo sapiens
acccaaagcaatattcatcagt

SEQ ID NO: 7649285 - DNA, 22 bp, Homo sapiens
acccaaagcaatattcatcagt

SEQ ID NO: 7649286 - DNA, 22 bp, Homo sapiens
accatttgaaggaatcattgac

SEQ ID NO: 7649287 - DNA, 22 bp, Homo sapiens
accatttagtaagtatacctgg

SEQ ID NO: 7649288 - DNA, 22 bp, Homo sapiens
accatttaataagtatttccat

SEQ ID NO: 7649289 - DNA, 22 bp, Homo sapiens
accatttactcccattggaagt

SEQ ID NO: 7649290 - DNA, 22 bp, Homo sapiens
accatttactcccattggaagt

SEQ ID NO: 7649291 - DNA, 22 bp, Homo sapiens
accatttaataagtatttccat

SEQ ID NO: 7649292 - DNA, 22 bp, Homo sapiens
agggcagcttccatagtctggc

SEQ ID NO: 7649293 - DNA, 22 bp, Homo sapiens
acccacagaacctgtgacaaca

SEQ ID NO: 7649294 - DNA, 22 bp, Homo sapiens
agggcagcttccatagtctggc

SEQ ID NO: 7649295 - DNA, 22 bp, Homo sapiens
acccacagaacctgtgacaaca

SEQ ID NO: 7649296 - DNA, 22 bp, Homo sapiens
acccacagaacctgtgacaaca

SEQ ID NO: 7649297 - DNA, 22 bp, Homo sapiens
acccacagaacctgtgacaaca

SEQ ID NO: 7649298 - DNA, 20 bp, Homo sapiens
agggcagcttgaggagccgg

SEQ ID NO: 7649299 - DNA, 20 bp, Homo sapiens
agggcagcttgaggagccgg

SEQ ID NO: 7649300 - DNA, 20 bp, Homo sapiens
agggcagcttgaggagccgg

SEQ ID NO: 7649301 - DNA, 20 bp, Homo sapiens
agggcagcttgaggagccgg

SEQ ID NO: 7649302 - DNA, 20 bp, Homo sapiens
agggcagcttgaggagccgg

SEQ ID NO: 7649303 - DNA, 20 bp, Homo sapiens
agggcagcttgaggagccgg

SEQ ID NO: 7649304 - DNA, 22 bp, Homo sapiens
agggcagcttccatagtctggc

SEQ ID NO: 7649305 - DNA, 22 bp, Homo sapiens
agggcagcttccatagtctggc

SEQ ID NO: 7649306 - DNA, 20 bp, Homo sapiens
agggcagcttgaggagccgg

SEQ ID NO: 7649307 - DNA, 20 bp, Homo sapiens
agggcagcttgaggagccgg

SEQ ID NO: 7649308 - DNA, 20 bp, Homo sapiens
agggcagcttgaggagccgg

SEQ ID NO: 7649309 - DNA, 20 bp, Homo sapiens
agggcagcttgaggagccgg

SEQ ID NO: 7649310 - DNA, 20 bp, Homo sapiens
agggcagcttgaggagccgg

SEQ ID NO: 7649311 - DNA, 20 bp, Homo sapiens
agggcagcttgaggagccgg

SEQ ID NO: 7649312 - DNA, 20 bp, Homo sapiens
agggcagcttgaggagccgg

SEQ ID NO: 7649313 - DNA, 20 bp, Homo sapiens
agggcagcttgaggagccgg

SEQ ID NO: 7649314 - DNA, 20 bp, Homo sapiens
agggcagcttgaggagccgg

SEQ ID NO: 7649315 - DNA, 22 bp, Homo sapiens
agggcatctagttccctctctt

SEQ ID NO: 7649316 - DNA, 22 bp, Homo sapiens
agggcagttcagccacaggctc

SEQ ID NO: 7649317 - DNA, 22 bp, Homo sapiens
agggcagttcagccacaggctc

SEQ ID NO: 7649318 - DNA, 22 bp, Homo sapiens
agggcagttcagccacaggctc

SEQ ID NO: 7649319 - DNA, 22 bp, Homo sapiens
agggcagttcagccacaggctc

SEQ ID NO: 7649320 - DNA, 22 bp, Homo sapiens
agggcagtgtggtgggactgac

SEQ ID NO: 7649321 - DNA, 22 bp, Homo sapiens
agggcagtgggaaagcctgctc

SEQ ID NO: 7649322 - DNA, 22 bp, Homo sapiens
agggcagtgggaaagcctgctc

SEQ ID NO: 7649323 - DNA, 22 bp, Homo sapiens
agggcagtgggaaagcctgctc

SEQ ID NO: 7649324 - DNA, 22 bp, Homo sapiens
agggcagttcaacttcatagtg

SEQ ID NO: 7649325 - DNA, 22 bp, Homo sapiens
agggcagttcaacttcatagtg

SEQ ID NO: 7649326 - DNA, 23 bp, Homo sapiens
agggcatgaagcagaggacgtgg

SEQ ID NO: 7649327 - DNA, 22 bp, Homo sapiens
agggcatgaaatgggcagaagc

SEQ ID NO: 7649328 - DNA, 22 bp, Homo sapiens
agggcatgaaatgggcagaagc

SEQ ID NO: 7649329 - DNA, 22 bp, Homo sapiens
agggcatgaaatgggcagaagc

SEQ ID NO: 7649330 - DNA, 22 bp, Homo sapiens
agggcatgaaatgggcagaagc

SEQ ID NO: 7649331 - DNA, 22 bp, Homo sapiens
agggcatctagttccctctctt

SEQ ID NO: 7649332 - DNA, 22 bp, Homo sapiens
agggcatctctaacagtctcct

SEQ ID NO: 7649333 - DNA, 22 bp, Homo sapiens
agggcatgaagcagtggacagc

SEQ ID NO: 7649334 - DNA, 22 bp, Homo sapiens
agggcatgaagcagtggacagc

SEQ ID NO: 7649335 - DNA, 22 bp, Homo sapiens
agggcatgaagcagtggacagc

SEQ ID NO: 7649336 - DNA, 22 bp, Homo sapiens
agggcatgaagcagtggacagc

SEQ ID NO: 7649337 - DNA, 22 bp, Homo sapiens
agggcatgaagcagtggacagc

SEQ ID NO: 7649338 - DNA, 22 bp, Homo sapiens
agggcatgaagcagtggacagc

SEQ ID NO: 7649339 - DNA, 23 bp, Homo sapiens
agggcatgaagcagaggacgtgg

SEQ ID NO: 7649340 - DNA, 23 bp, Homo sapiens
agggcatgaagcagaggacgtgg

SEQ ID NO: 7649341 - DNA, 23 bp, Homo sapiens
agggcatgaagcagaggacgtgg

SEQ ID NO: 7649342 - DNA, 22 bp, Homo sapiens
acccaggagcaggctgggcagt

SEQ ID NO: 7649343 - DNA, 22 bp, Homo sapiens
acccaggagcaggctgggcagt

SEQ ID NO: 7649344 - DNA, 22 bp, Homo sapiens
acccaggagcaggctgggcagt

SEQ ID NO: 7649345 - DNA, 22 bp, Homo sapiens
acccaggcctgagagacaggag

SEQ ID NO: 7649346 - DNA, 22 bp, Homo sapiens
acccaggcctgagagacaggag

SEQ ID NO: 7649347 - DNA, 22 bp, Homo sapiens
acccaggcctgagagacaggag

SEQ ID NO: 7649348 - DNA, 22 bp, Homo sapiens
acccaggagcaggctgggcagt

SEQ ID NO: 7649349 - DNA, 22 bp, Homo sapiens
acccaggagcaggctgggcagt

SEQ ID NO: 7649350 - DNA, 22 bp, Homo sapiens
acccggcggagcctgcagtgag

SEQ ID NO: 7649351 - DNA, 22 bp, Homo sapiens
acccgggaggcaggagtcatag

SEQ ID NO: 7649352 - DNA, 22 bp, Homo sapiens
acccgggaggcaggagtcatag

SEQ ID NO: 7649353 - DNA, 22 bp, Homo sapiens
acccggcggagcctgcagtgag

SEQ ID NO: 7649354 - DNA, 22 bp, Homo sapiens
acccgggaggcaggagtcatag

SEQ ID NO: 7649355 - DNA, 22 bp, Homo sapiens
acccgggaggcaggagtcatag

SEQ ID NO: 7649356 - DNA, 22 bp, Homo sapiens
acccggagtcggaggttgcagt

SEQ ID NO: 7649357 - DNA, 22 bp, Homo sapiens
acccggagtcggaggttgcagt

SEQ ID NO: 7649358 - DNA, 22 bp, Homo sapiens
acccgccgcacgtccaggctga

SEQ ID NO: 7649359 - DNA, 22 bp, Homo sapiens
acccgcttccggagctgcagtg

SEQ ID NO: 7649360 - DNA, 22 bp, Homo sapiens
acccggagtcggaggttgcagt

SEQ ID NO: 7649361 - DNA, 22 bp, Homo sapiens
acccggagtcggaggttgcagt

SEQ ID NO: 7649362 - DNA, 22 bp, Homo sapiens
acccggagtcggaggttgcagt

SEQ ID NO: 7649363 - DNA, 22 bp, Homo sapiens
acccgggaggcaggagtcatag

SEQ ID NO: 7649364 - DNA, 22 bp, Homo sapiens
acccgggaggcaggagtcatag

SEQ ID NO: 7649365 - DNA, 22 bp, Homo sapiens
acccgtggttttatactacttc

SEQ ID NO: 7649366 - DNA, 22 bp, Homo sapiens
acccgggaggcaggagtcatag

SEQ ID NO: 7649367 - DNA, 22 bp, Homo sapiens
accctactaaatgtggtatgtc

SEQ ID NO: 7649368 - DNA, 22 bp, Homo sapiens
accctaatcccttaaacctgtg

SEQ ID NO: 7649369 - DNA, 22 bp, Homo sapiens
accctagacattgaactagggt

SEQ ID NO: 7649370 - DNA, 22 bp, Homo sapiens
accctaataatcacagactagt

SEQ ID NO: 7649371 - DNA, 22 bp, Homo sapiens
accctaataatcacagactagt

SEQ ID NO: 7649372 - DNA, 22 bp, Homo sapiens
accctaataatcacagactagt

SEQ ID NO: 7649373 - DNA, 22 bp, Homo sapiens
accctaataatcacagactagt

SEQ ID NO: 7649374 - DNA, 22 bp, Homo sapiens
accctcagacagctgtggccag

SEQ ID NO: 7649375 - DNA, 22 bp, Homo sapiens
accctcagacatattccatcat

SEQ ID NO: 7649376 - DNA, 22 bp, Homo sapiens
accctcagacagctgtggccag

SEQ ID NO: 7649377 - DNA, 17 bp, Homo sapiens
accctcaatctcctgca

SEQ ID NO: 7649378 - DNA, 17 bp, Homo sapiens
accctcaatctcctgca

SEQ ID NO: 7649379 - DNA, 16 bp, Homo sapiens
accctcagaaactgct

SEQ ID NO: 7649380 - DNA, 19 bp, Homo sapiens
accctaggaggtctggtga

SEQ ID NO: 7649381 - DNA, 19 bp, Homo sapiens
accctaggaggtctggtga

SEQ ID NO: 7649382 - DNA, 22 bp, Homo sapiens
accctcaacaaattcactctat

SEQ ID NO: 7649383 - DNA, 22 bp, Homo sapiens
accctcaacaaattcactctat

SEQ ID NO: 7649384 - DNA, 22 bp, Homo sapiens
accctcaacaaattcactctat

SEQ ID NO: 7649385 - DNA, 22 bp, Homo sapiens
accctcaacaaattcactctat

SEQ ID NO: 7649386 - DNA, 22 bp, Homo sapiens
accctcaacaaattcactctat

SEQ ID NO: 7649387 - DNA, 22 bp, Homo sapiens
accctcaacaaattcactctat

SEQ ID NO: 7649388 - DNA, 22 bp, Homo sapiens
accctcaacaaattcactctat

SEQ ID NO: 7649389 - DNA, 22 bp, Homo sapiens
accctcaacaaattcactctat

SEQ ID NO: 7649390 - DNA, 22 bp, Homo sapiens
accccaggaagtggaggtcatg

SEQ ID NO: 7649391 - DNA, 22 bp, Homo sapiens
accccaggaagtggaggtcatg

SEQ ID NO: 7649392 - DNA, 22 bp, Homo sapiens
accccaggaagtggaggtcatg

SEQ ID NO: 7649393 - DNA, 22 bp, Homo sapiens
accccaggaagtggaggtcatg

SEQ ID NO: 7649394 - DNA, 22 bp, Homo sapiens
accccaggaagtggaggtcatg

SEQ ID NO: 7649395 - DNA, 22 bp, Homo sapiens
accccttttatagaagaacaga

SEQ ID NO: 7649396 - DNA, 22 bp, Homo sapiens
acccgatgttggtgctctagta

SEQ ID NO: 7649397 - DNA, 22 bp, Homo sapiens
acccgatgttggtgctctagta

SEQ ID NO: 7649398 - DNA, 22 bp, Homo sapiens
agggcctggttctgtgtaggga

SEQ ID NO: 7649399 - DNA, 22 bp, Homo sapiens
agggcctggttctgtgtaggga

SEQ ID NO: 7649400 - DNA, 22 bp, Homo sapiens
agggcctggttctgtgtaggga

SEQ ID NO: 7649401 - DNA, 22 bp, Homo sapiens
agggcctggttctgtgtaggga

SEQ ID NO: 7649402 - DNA, 22 bp, Homo sapiens
accccagctctgagccacacca

SEQ ID NO: 7649403 - DNA, 22 bp, Homo sapiens
accccagctctgagccacacca

SEQ ID NO: 7649404 - DNA, 22 bp, Homo sapiens
agggcctggttctgtgtaggga

SEQ ID NO: 7649405 - DNA, 22 bp, Homo sapiens
agggcctggtgacctgggtcct

SEQ ID NO: 7649406 - DNA, 22 bp, Homo sapiens
agggcctggtgacctgggtcct

SEQ ID NO: 7649407 - DNA, 22 bp, Homo sapiens
agggcctggtgacctgggtcct

SEQ ID NO: 7649408 - DNA, 22 bp, Homo sapiens
agggcctggtgacctgggtcct

SEQ ID NO: 7649409 - DNA, 22 bp, Homo sapiens
agggcctggtgacctgggtcct

SEQ ID NO: 7649410 - DNA, 22 bp, Homo sapiens
agggcctggtgacctgggtcct

SEQ ID NO: 7649411 - DNA, 22 bp, Homo sapiens
agggcctggtgacctgggtcct

SEQ ID NO: 7649412 - DNA, 22 bp, Homo sapiens
agggcctggtgacctgggtcct

SEQ ID NO: 7649413 - DNA, 22 bp, Homo sapiens
agggcctggggtagcttactgc

SEQ ID NO: 7649414 - DNA, 22 bp, Homo sapiens
agggcctggggtagcttactgc

SEQ ID NO: 7649415 - DNA, 22 bp, Homo sapiens
agggcctgggtctgtactcctc

SEQ ID NO: 7649416 - DNA, 22 bp, Homo sapiens
agggcctggtgacctgggtcct

SEQ ID NO: 7649417 - DNA, 22 bp, Homo sapiens
agggcctgggtctgtactcctc

SEQ ID NO: 7649418 - DNA, 22 bp, Homo sapiens
agggcctgggtctgtactcctc

SEQ ID NO: 7649419 - DNA, 22 bp, Homo sapiens
agggcctgggtctgtactcctc

SEQ ID NO: 7649420 - DNA, 22 bp, Homo sapiens
agggcctgggccagcacccttt

SEQ ID NO: 7649421 - DNA, 22 bp, Homo sapiens
agggcctgggccagcacccttt

SEQ ID NO: 7649422 - DNA, 22 bp, Homo sapiens
agggcctgggccagcacccttt

SEQ ID NO: 7649423 - DNA, 22 bp, Homo sapiens
agggcctgggccagcacccttt

SEQ ID NO: 7649424 - DNA, 22 bp, Homo sapiens
agggcctgggccagcacccttt

SEQ ID NO: 7649425 - DNA, 22 bp, Homo sapiens
agggcctgggccagcacccttt

SEQ ID NO: 7649426 - DNA, 22 bp, Homo sapiens
agggcctgggccagcacccttt

SEQ ID NO: 7649427 - DNA, 22 bp, Homo sapiens
agggcctggggtagcttactgc

SEQ ID NO: 7649428 - DNA, 22 bp, Homo sapiens
agggcctgggccagcacccttt

SEQ ID NO: 7649429 - DNA, 22 bp, Homo sapiens
agggcctgggccagcacccttt

SEQ ID NO: 7649430 - DNA, 22 bp, Homo sapiens
agggcctgggatgtcctcctag

SEQ ID NO: 7649431 - DNA, 22 bp, Homo sapiens
agggcctgggaagaggaaccct

SEQ ID NO: 7649432 - DNA, 22 bp, Homo sapiens
agggcctgggatgtcctcctag

SEQ ID NO: 7649433 - DNA, 22 bp, Homo sapiens
agggcctgggatgtcctcctag

SEQ ID NO: 7649434 - DNA, 22 bp, Homo sapiens
agggcctgggatgtcctcctag

SEQ ID NO: 7649435 - DNA, 22 bp, Homo sapiens
agggcctgggatgtcctcctag

SEQ ID NO: 7649436 - DNA, 22 bp, Homo sapiens
agggcctgggccagcacccttt

SEQ ID NO: 7649437 - DNA, 22 bp, Homo sapiens
acccaggctggagtgcagtagc

SEQ ID NO: 7649438 - DNA, 22 bp, Homo sapiens
acccaggctggagtgcagtagc

SEQ ID NO: 7649439 - DNA, 22 bp, Homo sapiens
acccaggctgcttctcagtggc

SEQ ID NO: 7649440 - DNA, 22 bp, Homo sapiens
acccaggctgcttctcagtggc

SEQ ID NO: 7649441 - DNA, 22 bp, Homo sapiens
acccaggctgcttctcagtggc

SEQ ID NO: 7649442 - DNA, 22 bp, Homo sapiens
acccaggctggagtgcagtgac

SEQ ID NO: 7649443 - DNA, 22 bp, Homo sapiens
acccaggctggagtgcagtgac

SEQ ID NO: 7649444 - DNA, 22 bp, Homo sapiens
acccaggctggagtgcagtagc

SEQ ID NO: 7649445 - DNA, 22 bp, Homo sapiens
agggcctgggaagaggaaccct

SEQ ID NO: 7649446 - DNA, 22 bp, Homo sapiens
acccaggctggagtgcagtgac

SEQ ID NO: 7649447 - DNA, 22 bp, Homo sapiens
agggcctgggaagaggaaccct

SEQ ID NO: 7649448 - DNA, 22 bp, Homo sapiens
acccaggctagggtgcagtggc

SEQ ID NO: 7649449 - DNA, 22 bp, Homo sapiens
acccaggctagggtgcagtggc

SEQ ID NO: 7649450 - DNA, 22 bp, Homo sapiens
acccaggctagagtgcagtggt

SEQ ID NO: 7649451 - DNA, 22 bp, Homo sapiens
acccaggctagggtgcagtggc

SEQ ID NO: 7649452 - DNA, 22 bp, Homo sapiens
acccaggctagggtgcagtggc

SEQ ID NO: 7649453 - DNA, 22 bp, Homo sapiens
acccaggctagggtgcagtggc

SEQ ID NO: 7649454 - DNA, 18 bp, Homo sapiens
acccaggctcatggtcct

SEQ ID NO: 7649455 - DNA, 22 bp, Homo sapiens
acccaggctagggtgcagtggc

SEQ ID NO: 7649456 - DNA, 18 bp, Homo sapiens
acccaggctcatggtcct

SEQ ID NO: 7649457 - DNA, 18 bp, Homo sapiens
acccaggctcatggtcct

SEQ ID NO: 7649458 - DNA, 18 bp, Homo sapiens
acccaggctcatggtcct

SEQ ID NO: 7649459 - DNA, 18 bp, Homo sapiens
acccaggctcatggtcct

SEQ ID NO: 7649460 - DNA, 17 bp, Homo sapiens
acccaggctctatcttg

SEQ ID NO: 7649461 - DNA, 18 bp, Homo sapiens
acccaggctcatggtcct

SEQ ID NO: 7649462 - DNA, 22 bp, Homo sapiens
acccaggctagagtgcagtggt

SEQ ID NO: 7649463 - DNA, 22 bp, Homo sapiens
acccaggctagagtgcagtggt

SEQ ID NO: 7649464 - DNA, 22 bp, Homo sapiens
acccaggctagagtgcagtggt

SEQ ID NO: 7649465 - DNA, 22 bp, Homo sapiens
acccaggctagagtgcagtggt

SEQ ID NO: 7649466 - DNA, 22 bp, Homo sapiens
acccaggctagagtgcagtggt

SEQ ID NO: 7649467 - DNA, 22 bp, Homo sapiens
acccaggcgggagtgcagtgtc

SEQ ID NO: 7649468 - DNA, 22 bp, Homo sapiens
acccaggcgggagtgcagtgtc

SEQ ID NO: 7649469 - DNA, 22 bp, Homo sapiens
acccaggctagaagtgaattat

SEQ ID NO: 7649470 - DNA, 22 bp, Homo sapiens
acccaggctagaagtgaattat

SEQ ID NO: 7649471 - DNA, 22 bp, Homo sapiens
acccaggcgggagtgcagtgtc

SEQ ID NO: 7649472 - DNA, 22 bp, Homo sapiens
acccaggcgggagtgcagtgtc

SEQ ID NO: 7649473 - DNA, 22 bp, Homo sapiens
acccaggcgggagtgcagtgtc

SEQ ID NO: 7649474 - DNA, 22 bp, Homo sapiens
acccaggcgggagtgcagtgtc

SEQ ID NO: 7649475 - DNA, 22 bp, Homo sapiens
acccaggcctgagagacaggag

SEQ ID NO: 7649476 - DNA, 22 bp, Homo sapiens
acagctcttcttcaagcctggc

SEQ ID NO: 7649477 - DNA, 22 bp, Homo sapiens
acagctcttaggcagaaccaac

SEQ ID NO: 7649478 - DNA, 22 bp, Homo sapiens
acagctcttaggcagaaccaac

SEQ ID NO: 7649479 - DNA, 22 bp, Homo sapiens
acagctctgtgtattgtcatct

SEQ ID NO: 7649480 - DNA, 22 bp, Homo sapiens
acagctctgtgtattgtcatct

SEQ ID NO: 7649481 - DNA, 22 bp, Homo sapiens
acagctctggtcctttagagag

SEQ ID NO: 7649482 - DNA, 22 bp, Homo sapiens
acagctctgttgccagatctgc

SEQ ID NO: 7649483 - DNA, 22 bp, Homo sapiens
acagctctgttgccagatctgc

SEQ ID NO: 7649484 - DNA, 22 bp, Homo sapiens
acagctgattggatcaaggaca

SEQ ID NO: 7649485 - DNA, 22 bp, Homo sapiens
acagctgattggatcaaggaca

SEQ ID NO: 7649486 - DNA, 22 bp, Homo sapiens
acagctgaacaagatagtgtca

SEQ ID NO: 7649487 - DNA, 22 bp, Homo sapiens
acagctgaaaccagggatctgg

SEQ ID NO: 7649488 - DNA, 22 bp, Homo sapiens
acagctcttcttcaagcctggc

SEQ ID NO: 7649489 - DNA, 22 bp, Homo sapiens
acagctctgcattttgggttaa

SEQ ID NO: 7649490 - DNA, 22 bp, Homo sapiens
acagctctgcatggcagttatt

SEQ ID NO: 7649491 - DNA, 22 bp, Homo sapiens
acagctctgggtgcaggaggtg

SEQ ID NO: 7649492 - DNA, 22 bp, Homo sapiens
acagctctgcattttgggttaa

SEQ ID NO: 7649493 - DNA, 22 bp, Homo sapiens
acagctctccctcagagaaatg

SEQ ID NO: 7649494 - DNA, 22 bp, Homo sapiens
acagctctgagatattactatt

SEQ ID NO: 7649495 - DNA, 22 bp, Homo sapiens
acagctcctactgaagccatgt

SEQ ID NO: 7649496 - DNA, 22 bp, Homo sapiens
acagctcctggggctttaatgg

SEQ ID NO: 7649497 - DNA, 22 bp, Homo sapiens
acagctctccctcagagaaatg

SEQ ID NO: 7649498 - DNA, 22 bp, Homo sapiens
acagctcctactgaagccatgt

SEQ ID NO: 7649499 - DNA, 22 bp, Homo sapiens
acagctcctaacaaaggctctc

SEQ ID NO: 7649500 - DNA, 22 bp, Homo sapiens
acagctcctaacaaaggctctc

SEQ ID NO: 7649501 - DNA, 22 bp, Homo sapiens
acagctaatccccctagattct

SEQ ID NO: 7649502 - DNA, 22 bp, Homo sapiens
acagctaatccccctagattct

SEQ ID NO: 7649503 - DNA, 22 bp, Homo sapiens
acagctacatcaaactcagaag

SEQ ID NO: 7649504 - DNA, 22 bp, Homo sapiens
acagctacatcaaactcagaag

SEQ ID NO: 7649505 - DNA, 21 bp, Homo sapiens
acagctaagcaacaactactg

SEQ ID NO: 7649506 - DNA, 22 bp, Homo sapiens
acagctaagctcccacaacctg

SEQ ID NO: 7649507 - DNA, 22 bp, Homo sapiens
acagctaagggcacaggtcacc

SEQ ID NO: 7649508 - DNA, 22 bp, Homo sapiens
acagctacatcaaactcagaag

SEQ ID NO: 7649509 - DNA, 22 bp, Homo sapiens
acagctacatcaaactcagaag

SEQ ID NO: 7649510 - DNA, 22 bp, Homo sapiens
acagctacatcaaactcagaag

SEQ ID NO: 7649511 - DNA, 22 bp, Homo sapiens
acagctactctgcagataaatc

SEQ ID NO: 7649512 - DNA, 22 bp, Homo sapiens
acagctacatggaatttcattt

SEQ ID NO: 7649513 - DNA, 22 bp, Homo sapiens
acagctactctgcagataaatc

SEQ ID NO: 7649514 - DNA, 22 bp, Homo sapiens
acagccttgtagcatcttagcc

SEQ ID NO: 7649515 - DNA, 22 bp, Homo sapiens
acagcgggaatgtggtaggtgg

SEQ ID NO: 7649516 - DNA, 22 bp, Homo sapiens
acagcctttaaccatttcttcc

SEQ ID NO: 7649517 - DNA, 22 bp, Homo sapiens
acagcctttaaccatttcttcc

SEQ ID NO: 7649518 - DNA, 22 bp, Homo sapiens
acagctaacttaaactaaccta

SEQ ID NO: 7649519 - DNA, 22 bp, Homo sapiens
acagctaacttaaactaaccta

SEQ ID NO: 7649520 - DNA, 22 bp, Homo sapiens
acagcgggaatgtggtaggtgg

SEQ ID NO: 7649521 - DNA, 22 bp, Homo sapiens
acagcgccgattctccggggct

SEQ ID NO: 7649522 - DNA, 22 bp, Homo sapiens
acagctatagacgatgtataga

SEQ ID NO: 7649523 - DNA, 22 bp, Homo sapiens
acagctatagacgatgtataga

SEQ ID NO: 7649524 - DNA, 22 bp, Homo sapiens
acagctatctgactttgactca

SEQ ID NO: 7649525 - DNA, 22 bp, Homo sapiens
acagctcactcacagggctagt

SEQ ID NO: 7649526 - DNA, 22 bp, Homo sapiens
acagctatgacagatggataat

SEQ ID NO: 7649527 - DNA, 22 bp, Homo sapiens
acagctatctgactttgactca

SEQ ID NO: 7649528 - DNA, 22 bp, Homo sapiens
acagctactctgcagataaatc

SEQ ID NO: 7649529 - DNA, 22 bp, Homo sapiens
acagctactctgcagataaatc

SEQ ID NO: 7649530 - DNA, 22 bp, Homo sapiens
acagctaggaaatggaagaact

SEQ ID NO: 7649531 - DNA, 22 bp, Homo sapiens
acagctaggtcttcagcacttt

SEQ ID NO: 7649532 - DNA, 22 bp, Homo sapiens
acagctatagacgatgtataga

SEQ ID NO: 7649533 - DNA, 22 bp, Homo sapiens
acagctatagacgatgtataga

SEQ ID NO: 7649534 - DNA, 22 bp, Homo sapiens
acagctcagacatcactgctct

SEQ ID NO: 7649535 - DNA, 22 bp, Homo sapiens
acagctcagacatcactgctct

SEQ ID NO: 7649536 - DNA, 22 bp, Homo sapiens
acagctcactcacagggctagt

SEQ ID NO: 7649537 - DNA, 22 bp, Homo sapiens
acagctatgacagatggataat

SEQ ID NO: 7649538 - DNA, 22 bp, Homo sapiens
acagctcactcacagggctagt

SEQ ID NO: 7649539 - DNA, 22 bp, Homo sapiens
acagctcatttgtaaaacggag

SEQ ID NO: 7649540 - DNA, 22 bp, Homo sapiens
acagctcatttgtaaaacggag

SEQ ID NO: 7649541 - DNA, 22 bp, Homo sapiens
acagctcagacatcactgctct

SEQ ID NO: 7649542 - DNA, 22 bp, Homo sapiens
acagctcagacatcactgctct

SEQ ID NO: 7649543 - DNA, 22 bp, Homo sapiens
acagctcagacatcactgctct

SEQ ID NO: 7649544 - DNA, 22 bp, Homo sapiens
acagctgcaaattgttagagga

SEQ ID NO: 7649545 - DNA, 22 bp, Homo sapiens
acagctgcacactgaacttggt

SEQ ID NO: 7649546 - DNA, 22 bp, Homo sapiens
acagctgcacactgaacttggt

SEQ ID NO: 7649547 - DNA, 22 bp, Homo sapiens
acagctgcaaattgttagagga

SEQ ID NO: 7649548 - DNA, 22 bp, Homo sapiens
acagctgcacactgaacttggt

SEQ ID NO: 7649549 - DNA, 22 bp, Homo sapiens
acagctgcacactgaacttggt

SEQ ID NO: 7649550 - DNA, 22 bp, Homo sapiens
acagctgcacactgaacttggt

SEQ ID NO: 7649551 - DNA, 23 bp, Homo sapiens
acagctgcacctggccgcctggc

SEQ ID NO: 7649552 - DNA, 22 bp, Homo sapiens
acagctgcattcttaacaggaa

SEQ ID NO: 7649553 - DNA, 22 bp, Homo sapiens
acagctgcattcttaacaggaa

SEQ ID NO: 7649554 - DNA, 22 bp, Homo sapiens
acagctgcatgatggtccagat

SEQ ID NO: 7649555 - DNA, 22 bp, Homo sapiens
acagctgcattcttaacaggaa

SEQ ID NO: 7649556 - DNA, 22 bp, Homo sapiens
acagctgcatgatggtccagat

SEQ ID NO: 7649557 - DNA, 22 bp, Homo sapiens
acagctgcacttgaagcaggtt

SEQ ID NO: 7649558 - DNA, 22 bp, Homo sapiens
acagctgcatgatggtccagat

SEQ ID NO: 7649559 - DNA, 23 bp, Homo sapiens
acagctgcacctggccgcctggc

SEQ ID NO: 7649560 - DNA, 23 bp, Homo sapiens
acagctgcacctggccgcctggc

SEQ ID NO: 7649561 - DNA, 23 bp, Homo sapiens
acagctgcacctggccgcctggc

SEQ ID NO: 7649562 - DNA, 23 bp, Homo sapiens
agctgggcaaggatccgggctcc

SEQ ID NO: 7649563 - DNA, 23 bp, Homo sapiens
agctgggcaaggatccgggctcc

SEQ ID NO: 7649564 - DNA, 23 bp, Homo sapiens
agctgggcaaggatccgggctcc

SEQ ID NO: 7649565 - DNA, 23 bp, Homo sapiens
agctgggcaaggatccgggctcc

SEQ ID NO: 7649566 - DNA, 22 bp, Homo sapiens
acagctgccaagacagagcagg

SEQ ID NO: 7649567 - DNA, 22 bp, Homo sapiens
acagctgccaagacagagcagg

SEQ ID NO: 7649568 - DNA, 22 bp, Homo sapiens
acagctgccaagacagagcagg

SEQ ID NO: 7649569 - DNA, 20 bp, Homo sapiens
agctgggcaattatgactat

SEQ ID NO: 7649570 - DNA, 20 bp, Homo sapiens
agctgggcaattatgactat

SEQ ID NO: 7649571 - DNA, 20 bp, Homo sapiens
agctgggcaattatgactat

SEQ ID NO: 7649572 - DNA, 20 bp, Homo sapiens
agctgggcaattatgactat

SEQ ID NO: 7649573 - DNA, 20 bp, Homo sapiens
agctgggcaattatgactat

SEQ ID NO: 7649574 - DNA, 20 bp, Homo sapiens
agctgggcaattatgactat

SEQ ID NO: 7649575 - DNA, 22 bp, Homo sapiens
agctgggcaccccgctgcgtct

SEQ ID NO: 7649576 - DNA, 19 bp, Homo sapiens
agctggggcggtgtgtgtt

SEQ ID NO: 7649577 - DNA, 19 bp, Homo sapiens
agctggggcggtgtgtgtt

SEQ ID NO: 7649578 - DNA, 22 bp, Homo sapiens
agctggggctgcagagaacagg

SEQ ID NO: 7649579 - DNA, 22 bp, Homo sapiens
agctggggctgcagagaacagg

SEQ ID NO: 7649580 - DNA, 22 bp, Homo sapiens
agctggggctgcagagaacagg

SEQ ID NO: 7649581 - DNA, 22 bp, Homo sapiens
agctggggctgcagagaacagg

SEQ ID NO: 7649582 - DNA, 22 bp, Homo sapiens
agctggggctgcagagaacagg

SEQ ID NO: 7649583 - DNA, 22 bp, Homo sapiens
agctgggtacacgttgtcacaa

SEQ ID NO: 7649584 - DNA, 22 bp, Homo sapiens
agctgggtacagcctgtgccta

SEQ ID NO: 7649585 - DNA, 22 bp, Homo sapiens
agctgggtacagcctgtgccta

SEQ ID NO: 7649586 - DNA, 22 bp, Homo sapiens
agctgggtacagcctgtgccta

SEQ ID NO: 7649587 - DNA, 22 bp, Homo sapiens
agctgggtacacgttgtcacaa

SEQ ID NO: 7649588 - DNA, 22 bp, Homo sapiens
agctgggtacacgttgtcacaa

SEQ ID NO: 7649589 - DNA, 22 bp, Homo sapiens
agctgggtccctctgctgatgg

SEQ ID NO: 7649590 - DNA, 22 bp, Homo sapiens
agctgggtcaataggaaatgta

SEQ ID NO: 7649591 - DNA, 22 bp, Homo sapiens
agctgggtactgatgtcttcag

SEQ ID NO: 7649592 - DNA, 22 bp, Homo sapiens
agctgggtcaataggaaatgta

SEQ ID NO: 7649593 - DNA, 22 bp, Homo sapiens
agctgggtactgatgtcttcag

SEQ ID NO: 7649594 - DNA, 22 bp, Homo sapiens
agctgggtactgatgtcttcag

SEQ ID NO: 7649595 - DNA, 22 bp, Homo sapiens
agctgggggttggataagggta

SEQ ID NO: 7649596 - DNA, 22 bp, Homo sapiens
agctgggggttggataagggta

SEQ ID NO: 7649597 - DNA, 22 bp, Homo sapiens
agctgggggttggataagggta

SEQ ID NO: 7649598 - DNA, 22 bp, Homo sapiens
agctggggttgcacacattttg

SEQ ID NO: 7649599 - DNA, 22 bp, Homo sapiens
agctggggttgcacacattttg

SEQ ID NO: 7649600 - DNA, 22 bp, Homo sapiens
agctggggttgcacacattttg

SEQ ID NO: 7649601 - DNA, 22 bp, Homo sapiens
agctggggttgcacacattttg

SEQ ID NO: 7649602 - DNA, 22 bp, Homo sapiens
agctggggctgtggttgtgatt

SEQ ID NO: 7649603 - DNA, 22 bp, Homo sapiens
agctggggctgtggttgtgatt

SEQ ID NO: 7649604 - DNA, 22 bp, Homo sapiens
agctggggctgcagagaacagg

SEQ ID NO: 7649605 - DNA, 22 bp, Homo sapiens
agctggggctgcagagaacagg

SEQ ID NO: 7649606 - DNA, 22 bp, Homo sapiens
agctggggctgtggttgtgatt

SEQ ID NO: 7649607 - DNA, 22 bp, Homo sapiens
agctggggctgtggttgtgatt

SEQ ID NO: 7649608 - DNA, 22 bp, Homo sapiens
agctggggctgtggttgtgatt

SEQ ID NO: 7649609 - DNA, 22 bp, Homo sapiens
agctggggctgtggttgtgatt

SEQ ID NO: 7649610 - DNA, 22 bp, Homo sapiens
agctgggggtagtgagaaataa

SEQ ID NO: 7649611 - DNA, 22 bp, Homo sapiens
agctgggggtagtgagaaataa

SEQ ID NO: 7649612 - DNA, 22 bp, Homo sapiens
agctgggggtagtgagaaataa

SEQ ID NO: 7649613 - DNA, 22 bp, Homo sapiens
agctgggggttggataagggta

SEQ ID NO: 7649614 - DNA, 22 bp, Homo sapiens
agctgggggttggataagggta

SEQ ID NO: 7649615 - DNA, 22 bp, Homo sapiens
agctgcccaatcctgcagggcg

SEQ ID NO: 7649616 - DNA, 22 bp, Homo sapiens
agctgcccaatcctgcagggcg

SEQ ID NO: 7649617 - DNA, 22 bp, Homo sapiens
agctgcccaatcctgcagggcg

SEQ ID NO: 7649618 - DNA, 22 bp, Homo sapiens
agctgcccaatcctgcagggcg

SEQ ID NO: 7649619 - DNA, 22 bp, Homo sapiens
agctgcccaatcctgcagggcg

SEQ ID NO: 7649620 - DNA, 22 bp, Homo sapiens
agctgcccaaggtcacagagct

SEQ ID NO: 7649621 - DNA, 22 bp, Homo sapiens
agctgcccaaggtcacagagct

SEQ ID NO: 7649622 - DNA, 22 bp, Homo sapiens
agctgccatctgaagaactgca

SEQ ID NO: 7649623 - DNA, 22 bp, Homo sapiens
agctgccatggcctgaatttac

SEQ ID NO: 7649624 - DNA, 22 bp, Homo sapiens
agctgccatctgaagaactgca

SEQ ID NO: 7649625 - DNA, 22 bp, Homo sapiens
agctgcccagataggaggaggc

SEQ ID NO: 7649626 - DNA, 22 bp, Homo sapiens
agctgcccagataggaggaggc

SEQ ID NO: 7649627 - DNA, 22 bp, Homo sapiens
agctgcccagctaggaagaagg

SEQ ID NO: 7649628 - DNA, 22 bp, Homo sapiens
agctgcccaggttcattgggcc

SEQ ID NO: 7649629 - DNA, 22 bp, Homo sapiens
agctgcccagctaggaagaagg

SEQ ID NO: 7649630 - DNA, 22 bp, Homo sapiens
agctgcccaatcctgcagggcg

SEQ ID NO: 7649631 - DNA, 22 bp, Homo sapiens
agctgcccagataggaggaggc

SEQ ID NO: 7649632 - DNA, 21 bp, Homo sapiens
agctgcccagagtagggaagg

SEQ ID NO: 7649633 - DNA, 21 bp, Homo sapiens
agctgcccagagtagggaagg

SEQ ID NO: 7649634 - DNA, 22 bp, Homo sapiens
agctgccagggactgggcatgg

SEQ ID NO: 7649635 - DNA, 17 bp, Homo sapiens
agctgccagggagtgtg

SEQ ID NO: 7649636 - DNA, 17 bp, Homo sapiens
agctgccagggagtgtg

SEQ ID NO: 7649637 - DNA, 17 bp, Homo sapiens
agctgccagggagtgtg

SEQ ID NO: 7649638 - DNA, 22 bp, Homo sapiens
agctgccaggcccctgagaacc

SEQ ID NO: 7649639 - DNA, 22 bp, Homo sapiens
agctgccaggcccctgagaacc

SEQ ID NO: 7649640 - DNA, 22 bp, Homo sapiens
agctgccaggcccctgagaacc

SEQ ID NO: 7649641 - DNA, 17 bp, Homo sapiens
agctgccagggagtgtg

SEQ ID NO: 7649642 - DNA, 22 bp, Homo sapiens
agctgccatcagcctttggatg

SEQ ID NO: 7649643 - DNA, 22 bp, Homo sapiens
agctgccatcagcctttggatg

SEQ ID NO: 7649644 - DNA, 22 bp, Homo sapiens
agctgccatccgaggtgtcaga

SEQ ID NO: 7649645 - DNA, 22 bp, Homo sapiens
agctgccatccgaggtgtcaga

SEQ ID NO: 7649646 - DNA, 22 bp, Homo sapiens
agctgccatctgaagaactgca

SEQ ID NO: 7649647 - DNA, 22 bp, Homo sapiens
agctgccatctgaagaactgca

SEQ ID NO: 7649648 - DNA, 22 bp, Homo sapiens
agctgccatccgaggtgtcaga

SEQ ID NO: 7649649 - DNA, 22 bp, Homo sapiens
agctgccatccgaggtgtcaga

SEQ ID NO: 7649650 - DNA, 22 bp, Homo sapiens
agctgccatcctgttcagcacc

SEQ ID NO: 7649651 - DNA, 22 bp, Homo sapiens
acagcagacattgggtgattga

SEQ ID NO: 7649652 - DNA, 22 bp, Homo sapiens
acagcagacagtcggcttcctg

SEQ ID NO: 7649653 - DNA, 22 bp, Homo sapiens
acagcagacagtcggcttcctg

SEQ ID NO: 7649654 - DNA, 22 bp, Homo sapiens
acagcagacagtcggcttcctg

SEQ ID NO: 7649655 - DNA, 21 bp, Homo sapiens
acagcagacaggcttaggacc

SEQ ID NO: 7649656 - DNA, 21 bp, Homo sapiens
acagcagacaggcttaggacc

SEQ ID NO: 7649657 - DNA, 22 bp, Homo sapiens
acagcagacagtcggcttcctg

SEQ ID NO: 7649658 - DNA, 22 bp, Homo sapiens
agctgccagcatcccggaaggg

SEQ ID NO: 7649659 - DNA, 22 bp, Homo sapiens
agctgccagcatcccggaaggg

SEQ ID NO: 7649660 - DNA, 22 bp, Homo sapiens
agctgccagcatcccggaaggg

SEQ ID NO: 7649661 - DNA, 22 bp, Homo sapiens
agctgcaggcccatgctcagtc

SEQ ID NO: 7649662 - DNA, 22 bp, Homo sapiens
agctgcaggcccatgctcagtc

SEQ ID NO: 7649663 - DNA, 22 bp, Homo sapiens
agctgcaggcccatgctcagtc

SEQ ID NO: 7649664 - DNA, 22 bp, Homo sapiens
acagcagacacaggcacgctgt

SEQ ID NO: 7649665 - DNA, 22 bp, Homo sapiens
acagcagacacaggcacgctgt

SEQ ID NO: 7649666 - DNA, 22 bp, Homo sapiens
acagcacttgggttttcctgtt

SEQ ID NO: 7649667 - DNA, 22 bp, Homo sapiens
acagcactttacttctcagtga

SEQ ID NO: 7649668 - DNA, 22 bp, Homo sapiens
acagcactttacttctcagtga

SEQ ID NO: 7649669 - DNA, 22 bp, Homo sapiens
acagcactttacttctcagtga

SEQ ID NO: 7649670 - DNA, 22 bp, Homo sapiens
acagcactttacttctcagtga

SEQ ID NO: 7649671 - DNA, 22 bp, Homo sapiens
acagcagaataatgagtaatag

SEQ ID NO: 7649672 - DNA, 23 bp, Homo sapiens
acagcacccatgtcatctggctc

SEQ ID NO: 7649673 - DNA, 22 bp, Homo sapiens
acagcacaggagttgaatgggc

SEQ ID NO: 7649674 - DNA, 23 bp, Homo sapiens
acagcacccatgtcatctggctc

SEQ ID NO: 7649675 - DNA, 22 bp, Homo sapiens
acagcacaggagttgaatgggc

SEQ ID NO: 7649676 - DNA, 22 bp, Homo sapiens
acagcacaggagttgaatgggc

SEQ ID NO: 7649677 - DNA, 22 bp, Homo sapiens
acagcacaggagttgaatgggc

SEQ ID NO: 7649678 - DNA, 22 bp, Homo sapiens
acagcacttattcagcacagtg

SEQ ID NO: 7649679 - DNA, 22 bp, Homo sapiens
acagcacttattcagcacagtg

SEQ ID NO: 7649680 - DNA, 22 bp, Homo sapiens
acagcactggtcccgcaagcct

SEQ ID NO: 7649681 - DNA, 22 bp, Homo sapiens
acagcactggtcccgcaagcct

SEQ ID NO: 7649682 - DNA, 22 bp, Homo sapiens
agctgccttaaattactttgtg

SEQ ID NO: 7649683 - DNA, 22 bp, Homo sapiens
agctgccttaaattactttgtg

SEQ ID NO: 7649684 - DNA, 22 bp, Homo sapiens
agctgcctgtgtagaaccatct

SEQ ID NO: 7649685 - DNA, 22 bp, Homo sapiens
agctgccttatggagtatgaaa

SEQ ID NO: 7649686 - DNA, 22 bp, Homo sapiens
agctgccttatggagtatgaaa

SEQ ID NO: 7649687 - DNA, 20 bp, Homo sapiens
agctgccttcattttctaga

SEQ ID NO: 7649688 - DNA, 20 bp, Homo sapiens
agctgccttcattttctaga

SEQ ID NO: 7649689 - DNA, 20 bp, Homo sapiens
agctgccttcattttctaga

SEQ ID NO: 7649690 - DNA, 22 bp, Homo sapiens
agctgcctgtcctaggccatca

SEQ ID NO: 7649691 - DNA, 19 bp, Homo sapiens
agctgcctgtgcgcgcccg

SEQ ID NO: 7649692 - DNA, 22 bp, Homo sapiens
agctgcctgtcctaggccatca

SEQ ID NO: 7649693 - DNA, 22 bp, Homo sapiens
agctgcctgtgctgggagccca

SEQ ID NO: 7649694 - DNA, 22 bp, Homo sapiens
agctgcctgtgtagaaccatct

SEQ ID NO: 7649695 - DNA, 19 bp, Homo sapiens
agctgcctgtgcgcgcccg

SEQ ID NO: 7649696 - DNA, 22 bp, Homo sapiens
agctgcctgtgctgggagccca

SEQ ID NO: 7649697 - DNA, 22 bp, Homo sapiens
agctgcccaggttcattgggcc

SEQ ID NO: 7649698 - DNA, 22 bp, Homo sapiens
agctgcccaggttcattgggcc

SEQ ID NO: 7649699 - DNA, 22 bp, Homo sapiens
agctgcccaggttcattgggcc

SEQ ID NO: 7649700 - DNA, 22 bp, Homo sapiens
agctgcccaggttcattgggcc

SEQ ID NO: 7649701 - DNA, 22 bp, Homo sapiens
agctgcccaggttcattgggcc

SEQ ID NO: 7649702 - DNA, 22 bp, Homo sapiens
agctgccccatgagaggcaggt

SEQ ID NO: 7649703 - DNA, 22 bp, Homo sapiens
agctgccccatgagaggcaggt

SEQ ID NO: 7649704 - DNA, 22 bp, Homo sapiens
agctgcccccagggctgtgctt

SEQ ID NO: 7649705 - DNA, 22 bp, Homo sapiens
agctgcccccagggctgtgctt

SEQ ID NO: 7649706 - DNA, 22 bp, Homo sapiens
agctgcccccagggctgtgctt

SEQ ID NO: 7649707 - DNA, 22 bp, Homo sapiens
agctgccccatgagaggcaggt

SEQ ID NO: 7649708 - DNA, 22 bp, Homo sapiens
agctgccccatgagaggcaggt

SEQ ID NO: 7649709 - DNA, 22 bp, Homo sapiens
agctgccccatgagaggcaggt

SEQ ID NO: 7649710 - DNA, 22 bp, Homo sapiens
agctgccccatgagaggcaggt

SEQ ID NO: 7649711 - DNA, 22 bp, Homo sapiens
agctgcctgtaaaatgtgtgat

SEQ ID NO: 7649712 - DNA, 22 bp, Homo sapiens
agctgcctgtaaaatgtgtgat

SEQ ID NO: 7649713 - DNA, 22 bp, Homo sapiens
agctgcctgtcctaggccatca

SEQ ID NO: 7649714 - DNA, 22 bp, Homo sapiens
agctgcctgtcctaggccatca

SEQ ID NO: 7649715 - DNA, 22 bp, Homo sapiens
agctgcctgtcctaggccatca

SEQ ID NO: 7649716 - DNA, 15 bp, Homo sapiens
agctgcctgggtgct

SEQ ID NO: 7649717 - DNA, 22 bp, Homo sapiens
agctgcctgggcttgtacacct

SEQ ID NO: 7649718 - DNA, 22 bp, Homo sapiens
agctgcccccagggctgtgctt

SEQ ID NO: 7649719 - DNA, 22 bp, Homo sapiens
agctgcctgggcttgtacacct

SEQ ID NO: 7649720 - DNA, 22 bp, Homo sapiens
agctgcctttgcatcactttaa

SEQ ID NO: 7649721 - DNA, 21 bp, Homo sapiens
agctgcctttagagagaacca

SEQ ID NO: 7649722 - DNA, 22 bp, Homo sapiens
agctgcctttgcatcactttaa

SEQ ID NO: 7649723 - DNA, 22 bp, Homo sapiens
agctgccttttgagaaagctca

SEQ ID NO: 7649724 - DNA, 22 bp, Homo sapiens
agctgccttttgagaaagctca

SEQ ID NO: 7649725 - DNA, 22 bp, Homo sapiens
agctgccttttgagaaagctca

SEQ ID NO: 7649726 - DNA, 22 bp, Homo sapiens
agctgctatctccagatgtttg

SEQ ID NO: 7649727 - DNA, 22 bp, Homo sapiens
agctgctagttcctgttctcac

SEQ ID NO: 7649728 - DNA, 22 bp, Homo sapiens
agctgctagttcctgttctcac

SEQ ID NO: 7649729 - DNA, 22 bp, Homo sapiens
agctgctatgacaacaccagcc

SEQ ID NO: 7649730 - DNA, 17 bp, Homo sapiens
agctgccttgcttgagc

SEQ ID NO: 7649731 - DNA, 21 bp, Homo sapiens
agctgcctttagagagaacca

SEQ ID NO: 7649732 - DNA, 17 bp, Homo sapiens
agctgccttgcttgagc

SEQ ID NO: 7649733 - DNA, 17 bp, Homo sapiens
agctgccttgcttgagc

SEQ ID NO: 7649734 - DNA, 22 bp, Homo sapiens
agctgccttccctctcattagg

SEQ ID NO: 7649735 - DNA, 20 bp, Homo sapiens
agctgccttcattttctaga

SEQ ID NO: 7649736 - DNA, 22 bp, Homo sapiens
agctgccttccctctcattagg

SEQ ID NO: 7649737 - DNA, 17 bp, Homo sapiens
agctgccttgcttgagc

SEQ ID NO: 7649738 - DNA, 17 bp, Homo sapiens
agctgccttgcttgagc

SEQ ID NO: 7649739 - DNA, 22 bp, Homo sapiens
agctgccttccctctcattagg

SEQ ID NO: 7649740 - DNA, 21 bp, Homo sapiens
acagccttgtgatggagacag

SEQ ID NO: 7649741 - DNA, 21 bp, Homo sapiens
acagccttgtgatggagacag

SEQ ID NO: 7649742 - DNA, 22 bp, Homo sapiens
acagccttgggttctctggggg

SEQ ID NO: 7649743 - DNA, 22 bp, Homo sapiens
acagccttgggttctctggggg

SEQ ID NO: 7649744 - DNA, 22 bp, Homo sapiens
acagccttgggttctctggggg

SEQ ID NO: 7649745 - DNA, 22 bp, Homo sapiens
acagccttgcttatttgtctct

SEQ ID NO: 7649746 - DNA, 22 bp, Homo sapiens
acagccttgggttctctggggg

SEQ ID NO: 7649747 - DNA, 16 bp, Homo sapiens
acagccttcttctttg

SEQ ID NO: 7649748 - DNA, 23 bp, Homo sapiens
acagccttctggggcttctgggc

SEQ ID NO: 7649749 - DNA, 22 bp, Homo sapiens
acagccttgatattaattgtct

SEQ ID NO: 7649750 - DNA, 22 bp, Homo sapiens
acagccttctgtgtgtgtacaa

SEQ ID NO: 7649751 - DNA, 22 bp, Homo sapiens
acagccttgagctcaaaaggaa

SEQ ID NO: 7649752 - DNA, 23 bp, Homo sapiens
acagccttctggggcttctgggc

SEQ ID NO: 7649753 - DNA, 22 bp, Homo sapiens
agctgctatgtaggaataagat

SEQ ID NO: 7649754 - DNA, 22 bp, Homo sapiens
agctgctatctccagatgtttg

SEQ ID NO: 7649755 - DNA, 22 bp, Homo sapiens
agctgctcacagggattcatgc

SEQ ID NO: 7649756 - DNA, 22 bp, Homo sapiens
agctgctcagatcccggggaag

SEQ ID NO: 7649757 - DNA, 22 bp, Homo sapiens
acagcctgctgcctgcttcttg

SEQ ID NO: 7649758 - DNA, 22 bp, Homo sapiens
acagcctgctgcctgcttcttg

SEQ ID NO: 7649759 - DNA, 22 bp, Homo sapiens
acagcctgctgcctgcttcttg

SEQ ID NO: 7649760 - DNA, 22 bp, Homo sapiens
acagcctgctgcctgcttcttg

SEQ ID NO: 7649761 - DNA, 22 bp, Homo sapiens
aggaatgacatagaaaggggag

SEQ ID NO: 7649762 - DNA, 22 bp, Homo sapiens
aggaagggctgtttctccaaga

SEQ ID NO: 7649763 - DNA, 22 bp, Homo sapiens
aggaagggctgtttctccaaga

SEQ ID NO: 7649764 - DNA, 22 bp, Homo sapiens
aggaagggctgtttctccaaga

SEQ ID NO: 7649765 - DNA, 22 bp, Homo sapiens
aggaagggctgtttctccaaga

SEQ ID NO: 7649766 - DNA, 22 bp, Homo sapiens
aggaagggctgtttctccaaga

SEQ ID NO: 7649767 - DNA, 22 bp, Homo sapiens
aggaagggctgtttctccaaga

SEQ ID NO: 7649768 - DNA, 22 bp, Homo sapiens
aggaagggctgtttctccaaga

SEQ ID NO: 7649769 - DNA, 22 bp, Homo sapiens
aggaagggctgtttctccaaga

SEQ ID NO: 7649770 - DNA, 22 bp, Homo sapiens
aggaagggctgtttctccaaga

SEQ ID NO: 7649771 - DNA, 22 bp, Homo sapiens
acaggctgttggggtccagggt

SEQ ID NO: 7649772 - DNA, 22 bp, Homo sapiens
aggaatgatagtaaaagagaat

SEQ ID NO: 7649773 - DNA, 22 bp, Homo sapiens
aggaatgatagtaaaagagaat

SEQ ID NO: 7649774 - DNA, 22 bp, Homo sapiens
aggaatgatagtaaaagagaat

SEQ ID NO: 7649775 - DNA, 22 bp, Homo sapiens
aggaatgatagtaaaagagaat

SEQ ID NO: 7649776 - DNA, 22 bp, Homo sapiens
aggaatgatagtaaaagagaat

SEQ ID NO: 7649777 - DNA, 22 bp, Homo sapiens
aggaatgattcaagacttggct

SEQ ID NO: 7649778 - DNA, 22 bp, Homo sapiens
aggaatgacttgtagctctgag

SEQ ID NO: 7649779 - DNA, 22 bp, Homo sapiens
aggaatgacttgtagctctgag

SEQ ID NO: 7649780 - DNA, 22 bp, Homo sapiens
aggaatgacttgtagctctgag

SEQ ID NO: 7649781 - DNA, 22 bp, Homo sapiens
aggaatgacttgtagctctgag

SEQ ID NO: 7649782 - DNA, 22 bp, Homo sapiens
aggaatgacttgtagctctgag

SEQ ID NO: 7649783 - DNA, 22 bp, Homo sapiens
aggaatgacttgtagctctgag

SEQ ID NO: 7649784 - DNA, 22 bp, Homo sapiens
acaggctggtttgtaaaagatg

SEQ ID NO: 7649785 - DNA, 22 bp, Homo sapiens
acaggctggtggtcctggccat

SEQ ID NO: 7649786 - DNA, 22 bp, Homo sapiens
acaggctggtttgtaaaagatg

SEQ ID NO: 7649787 - DNA, 22 bp, Homo sapiens
acaggctggtttgtaaaagatg

SEQ ID NO: 7649788 - DNA, 22 bp, Homo sapiens
acaggctgtacttctaatcatc

SEQ ID NO: 7649789 - DNA, 22 bp, Homo sapiens
acaggctgtacttctaatcatc

SEQ ID NO: 7649790 - DNA, 22 bp, Homo sapiens
acaggctgtacttctaatcatc

SEQ ID NO: 7649791 - DNA, 18 bp, Homo sapiens
acaggctgtgggaatggt

SEQ ID NO: 7649792 - DNA, 18 bp, Homo sapiens
acaggctgtgggaatggt

SEQ ID NO: 7649793 - DNA, 18 bp, Homo sapiens
acaggctgtgggaatggt

SEQ ID NO: 7649794 - DNA, 18 bp, Homo sapiens
acaggctgtgggaatggt

SEQ ID NO: 7649795 - DNA, 18 bp, Homo sapiens
acaggctgtgggaatggt

SEQ ID NO: 7649796 - DNA, 18 bp, Homo sapiens
acaggctgtgggaatggt

SEQ ID NO: 7649797 - DNA, 18 bp, Homo sapiens
acaggctgtgggaatggt

SEQ ID NO: 7649798 - DNA, 22 bp, Homo sapiens
acaggctgttggggtccagggt

SEQ ID NO: 7649799 - DNA, 22 bp, Homo sapiens
aggaatggtgctcagcagaaat

SEQ ID NO: 7649800 - DNA, 22 bp, Homo sapiens
aggaatggttatggggatagta

SEQ ID NO: 7649801 - DNA, 22 bp, Homo sapiens
aggaatggttatggggatagta

SEQ ID NO: 7649802 - DNA, 22 bp, Homo sapiens
aggaatggttatggggatagta

SEQ ID NO: 7649803 - DNA, 22 bp, Homo sapiens
aggaatggtgctcagcagaaat

SEQ ID NO: 7649804 - DNA, 23 bp, Homo sapiens
aggaatggctagaagtgtgaccc

SEQ ID NO: 7649805 - DNA, 23 bp, Homo sapiens
aggaatggctagaagtgtgaccc

SEQ ID NO: 7649806 - DNA, 19 bp, Homo sapiens
aggaatggaattaattctg

SEQ ID NO: 7649807 - DNA, 19 bp, Homo sapiens
aggaatggaattaattctg

SEQ ID NO: 7649808 - DNA, 19 bp, Homo sapiens
aggaatggaattaattctg

SEQ ID NO: 7649809 - DNA, 19 bp, Homo sapiens
aggaatggaattaattctg

SEQ ID NO: 7649810 - DNA, 19 bp, Homo sapiens
aggaatggaattaattctg

SEQ ID NO: 7649811 - DNA, 21 bp, Homo sapiens
aggaatgctgaggctcacttt

SEQ ID NO: 7649812 - DNA, 19 bp, Homo sapiens
aggaatggaattaattctg

SEQ ID NO: 7649813 - DNA, 19 bp, Homo sapiens
aggaatggaattaattctg

SEQ ID NO: 7649814 - DNA, 19 bp, Homo sapiens
aggaatggaattaattctg

SEQ ID NO: 7649815 - DNA, 19 bp, Homo sapiens
aggaatggaattaattctg

SEQ ID NO: 7649816 - DNA, 19 bp, Homo sapiens
aggaatggaattaattctg

SEQ ID NO: 7649817 - DNA, 22 bp, Homo sapiens
aggaatggttatggggatagta

SEQ ID NO: 7649818 - DNA, 22 bp, Homo sapiens
aggaatggttatggggatagta

SEQ ID NO: 7649819 - DNA, 22 bp, Homo sapiens
aggaatggttatggggatagta

SEQ ID NO: 7649820 - DNA, 22 bp, Homo sapiens
aggaatgtaaatctagatttta

SEQ ID NO: 7649821 - DNA, 22 bp, Homo sapiens
aggaatgtaacaggagtaaaaa

SEQ ID NO: 7649822 - DNA, 22 bp, Homo sapiens
aggaatgtaatagtgtggctca

SEQ ID NO: 7649823 - DNA, 22 bp, Homo sapiens
aggaatgtaatagtgtggctca

SEQ ID NO: 7649824 - DNA, 22 bp, Homo sapiens
aggaatgtaatagtgtggctca

SEQ ID NO: 7649825 - DNA, 22 bp, Homo sapiens
aggaatgtattattccttctgg

SEQ ID NO: 7649826 - DNA, 22 bp, Homo sapiens
aggaatgtagtttgagtagaaa

SEQ ID NO: 7649827 - DNA, 22 bp, Homo sapiens
aggaatgtagtttgagtagaaa

SEQ ID NO: 7649828 - DNA, 22 bp, Homo sapiens
aggaatgtattattccttctgg

SEQ ID NO: 7649829 - DNA, 22 bp, Homo sapiens
aggaatgtattgacctgttgca

SEQ ID NO: 7649830 - DNA, 22 bp, Homo sapiens
aggaatgtattgacctgttgca

SEQ ID NO: 7649831 - DNA, 22 bp, Homo sapiens
aggaatgtcaagtagatgtgcg

SEQ ID NO: 7649832 - DNA, 22 bp, Homo sapiens
aggaatgtcatagaataatcat

SEQ ID NO: 7649833 - DNA, 22 bp, Homo sapiens
aggaatgtcatagaataatcat

SEQ ID NO: 7649834 - DNA, 22 bp, Homo sapiens
agctttatgggagcttagataa

SEQ ID NO: 7649835 - DNA, 22 bp, Homo sapiens
agctttatgggagcttagataa

SEQ ID NO: 7649836 - DNA, 22 bp, Homo sapiens
agctttatgggagcttagataa

SEQ ID NO: 7649837 - DNA, 22 bp, Homo sapiens
agctttatgggagcttagataa

SEQ ID NO: 7649838 - DNA, 22 bp, Homo sapiens
acaggctgcccgctccccacct

SEQ ID NO: 7649839 - DNA, 22 bp, Homo sapiens
acaggctgcccgctccccacct

SEQ ID NO: 7649840 - DNA, 22 bp, Homo sapiens
acaggctgcccgctccccacct

SEQ ID NO: 7649841 - DNA, 22 bp, Homo sapiens
acaggctgccacttgcatccaa

SEQ ID NO: 7649842 - DNA, 22 bp, Homo sapiens
acaggctctggggcaggatggc

SEQ ID NO: 7649843 - DNA, 22 bp, Homo sapiens
acaggctgccacttgcatccaa

SEQ ID NO: 7649844 - DNA, 22 bp, Homo sapiens
acaggctctggggcaggatggc

SEQ ID NO: 7649845 - DNA, 22 bp, Homo sapiens
acaggctctggggcaggatggc

SEQ ID NO: 7649846 - DNA, 22 bp, Homo sapiens
acaggctctggggcaggatggc

SEQ ID NO: 7649847 - DNA, 22 bp, Homo sapiens
acaggctctggggcaggatggc

SEQ ID NO: 7649848 - DNA, 22 bp, Homo sapiens
acaggctgctgagccatttgct

SEQ ID NO: 7649849 - DNA, 22 bp, Homo sapiens
acaggctgcctaccaagtatca

SEQ ID NO: 7649850 - DNA, 22 bp, Homo sapiens
acaggctgctgagccatttgct

SEQ ID NO: 7649851 - DNA, 22 bp, Homo sapiens
acaggctgcctaccaagtatca

SEQ ID NO: 7649852 - DNA, 22 bp, Homo sapiens
acaggctgcctaccaagtatca

SEQ ID NO: 7649853 - DNA, 22 bp, Homo sapiens
acaggctgctgagccatttgct

SEQ ID NO: 7649854 - DNA, 22 bp, Homo sapiens
acaggctgctgagccatttgct

SEQ ID NO: 7649855 - DNA, 22 bp, Homo sapiens
acaggctgctgagccatttgct

SEQ ID NO: 7649856 - DNA, 22 bp, Homo sapiens
acaggctgcctaccaagtatca

SEQ ID NO: 7649857 - DNA, 22 bp, Homo sapiens
acaggctgcctaccaagtatca

SEQ ID NO: 7649858 - DNA, 22 bp, Homo sapiens
acaggctgcctaccaagtatca

SEQ ID NO: 7649859 - DNA, 22 bp, Homo sapiens
acaggctgcccgctccccacct

SEQ ID NO: 7649860 - DNA, 22 bp, Homo sapiens
acaggctgcccgctccccacct

SEQ ID NO: 7649861 - DNA, 22 bp, Homo sapiens
acaggctgcccgctccccacct

SEQ ID NO: 7649862 - DNA, 22 bp, Homo sapiens
acaggctggaggaggaccaaga

SEQ ID NO: 7649863 - DNA, 22 bp, Homo sapiens
acaggctggaggaggaccaaga

SEQ ID NO: 7649864 - DNA, 22 bp, Homo sapiens
acaggctgctgggctccgtgct

SEQ ID NO: 7649865 - DNA, 22 bp, Homo sapiens
acaggctgctgggctccgtgct

SEQ ID NO: 7649866 - DNA, 22 bp, Homo sapiens
acaggctggaggaggaccaaga

SEQ ID NO: 7649867 - DNA, 22 bp, Homo sapiens
acaggctggaggaggaccaaga

SEQ ID NO: 7649868 - DNA, 22 bp, Homo sapiens
acaggctgggcgcttcctgcgg

SEQ ID NO: 7649869 - DNA, 22 bp, Homo sapiens
acaggctggaggaggaccaaga

SEQ ID NO: 7649870 - DNA, 22 bp, Homo sapiens
acaggctgctgggctccgtgct

SEQ ID NO: 7649871 - DNA, 22 bp, Homo sapiens
acaggctgctgggctccgtgct

SEQ ID NO: 7649872 - DNA, 22 bp, Homo sapiens
acaggctgctgggctccgtgct

SEQ ID NO: 7649873 - DNA, 22 bp, Homo sapiens
acaggctgctgggctccgtgct

SEQ ID NO: 7649874 - DNA, 22 bp, Homo sapiens
acaggctgctgggctccgtgct

SEQ ID NO: 7649875 - DNA, 22 bp, Homo sapiens
acaggctgctgggctccgtgct

SEQ ID NO: 7649876 - DNA, 22 bp, Homo sapiens
acaggctgctgggctccgtgct

SEQ ID NO: 7649877 - DNA, 22 bp, Homo sapiens
acaggctgggcgcttcctgcgg

SEQ ID NO: 7649878 - DNA, 22 bp, Homo sapiens
acaggctgggcgcttcctgcgg

SEQ ID NO: 7649879 - DNA, 22 bp, Homo sapiens
acaggctgggcgcttcctgcgg

SEQ ID NO: 7649880 - DNA, 22 bp, Homo sapiens
acaggctgggcgcttcctgcgg

SEQ ID NO: 7649881 - DNA, 22 bp, Homo sapiens
acaggctgggcgcttcctgcgg

SEQ ID NO: 7649882 - DNA, 22 bp, Homo sapiens
acaggctgggcgcttcctgcgg

SEQ ID NO: 7649883 - DNA, 22 bp, Homo sapiens
acaggctgggcgcttcctgcgg

SEQ ID NO: 7649884 - DNA, 22 bp, Homo sapiens
acaggctggaggaggaccaaga

SEQ ID NO: 7649885 - DNA, 22 bp, Homo sapiens
acaggctggtggtcctggccat

SEQ ID NO: 7649886 - DNA, 22 bp, Homo sapiens
acaggctggtggtcctggccat

SEQ ID NO: 7649887 - DNA, 22 bp, Homo sapiens
acaggctggtggtcctggccat

SEQ ID NO: 7649888 - DNA, 22 bp, Homo sapiens
acaggctggtggtcctggccat

SEQ ID NO: 7649889 - DNA, 22 bp, Homo sapiens
acaggctggtggtcctggccat

SEQ ID NO: 7649890 - DNA, 22 bp, Homo sapiens
acaggctggtggtcctggccat

SEQ ID NO: 7649891 - DNA, 22 bp, Homo sapiens
acaggctggtggtcctggccat

SEQ ID NO: 7649892 - DNA, 22 bp, Homo sapiens
agctttatatttaatgaattct

SEQ ID NO: 7649893 - DNA, 22 bp, Homo sapiens
acaggcctggtgctgctgacag

SEQ ID NO: 7649894 - DNA, 22 bp, Homo sapiens
acaggcctgggttcaaatttgg

SEQ ID NO: 7649895 - DNA, 22 bp, Homo sapiens
acaggcctgggttcaaatttgg

SEQ ID NO: 7649896 - DNA, 22 bp, Homo sapiens
acaggcctgggttcaaatttgg

SEQ ID NO: 7649897 - DNA, 22 bp, Homo sapiens
acaggcctggggtacaagttct

SEQ ID NO: 7649898 - DNA, 22 bp, Homo sapiens
acaggcctggggtacaagttct

SEQ ID NO: 7649899 - DNA, 22 bp, Homo sapiens
acaggcctggaaaggaaggagt

SEQ ID NO: 7649900 - DNA, 22 bp, Homo sapiens
acaggcctggaaaggaaggagt

SEQ ID NO: 7649901 - DNA, 22 bp, Homo sapiens
acaggcctggaaaggaaggagt

SEQ ID NO: 7649902 - DNA, 22 bp, Homo sapiens
acaggcctggaaaggaaggagt

SEQ ID NO: 7649903 - DNA, 22 bp, Homo sapiens
agctttatcagaggagtctcta

SEQ ID NO: 7649904 - DNA, 22 bp, Homo sapiens
agctttatcacaatattggcta

SEQ ID NO: 7649905 - DNA, 22 bp, Homo sapiens
agctttatcacaatattggcta

SEQ ID NO: 7649906 - DNA, 22 bp, Homo sapiens
agctttatgcttcctacaagct

SEQ ID NO: 7649907 - DNA, 22 bp, Homo sapiens
agctttatgcttcctacaagct

SEQ ID NO: 7649908 - DNA, 22 bp, Homo sapiens
agctttatgcttcctacaagct

SEQ ID NO: 7649909 - DNA, 22 bp, Homo sapiens
agctttatgcttcctacaagct

SEQ ID NO: 7649910 - DNA, 22 bp, Homo sapiens
agctttatgaggagaccttagt

SEQ ID NO: 7649911 - DNA, 22 bp, Homo sapiens
agctttatgcttcctacaagct

SEQ ID NO: 7649912 - DNA, 22 bp, Homo sapiens
agctttatgaggagaccttagt

SEQ ID NO: 7649913 - DNA, 22 bp, Homo sapiens
agctttatcttcacctgggaat

SEQ ID NO: 7649914 - DNA, 22 bp, Homo sapiens
agctttatcttcacctgggaat

SEQ ID NO: 7649915 - DNA, 22 bp, Homo sapiens
agctttatcagaggagtctcta

SEQ ID NO: 7649916 - DNA, 22 bp, Homo sapiens
agctttatcccttgcccatcga

SEQ ID NO: 7649917 - DNA, 22 bp, Homo sapiens
acaggcctacgaagtcaggtgc

SEQ ID NO: 7649918 - DNA, 22 bp, Homo sapiens
acaggcccagctcttcaccaga

SEQ ID NO: 7649919 - DNA, 22 bp, Homo sapiens
acaggcctacgaagtcaggtgc

SEQ ID NO: 7649920 - DNA, 22 bp, Homo sapiens
acaggcctacgaagtcaggtgc

SEQ ID NO: 7649921 - DNA, 22 bp, Homo sapiens
acaggcctagctaatgctttcc

SEQ ID NO: 7649922 - DNA, 22 bp, Homo sapiens
acaggcctagctaatgctttcc

SEQ ID NO: 7649923 - DNA, 22 bp, Homo sapiens
acaggcctagctaatgctttcc

SEQ ID NO: 7649924 - DNA, 22 bp, Homo sapiens
acaggcctcaaatagggtgcct

SEQ ID NO: 7649925 - DNA, 22 bp, Homo sapiens
acaggcctatgttccattgcag

SEQ ID NO: 7649926 - DNA, 22 bp, Homo sapiens
acaggcctatgttccattgcag

SEQ ID NO: 7649927 - DNA, 22 bp, Homo sapiens
acaggcctagggtcaatttcct

SEQ ID NO: 7649928 - DNA, 22 bp, Homo sapiens
acaggcctagggtcaatttcct

SEQ ID NO: 7649929 - DNA, 22 bp, Homo sapiens
acaggcctcaagacacccaggt

SEQ ID NO: 7649930 - DNA, 22 bp, Homo sapiens
acaggcctcaaatagggtgcct

SEQ ID NO: 7649931 - DNA, 22 bp, Homo sapiens
acaggcctcaagacacccaggt

SEQ ID NO: 7649932 - DNA, 22 bp, Homo sapiens
acaggcctcaagacacccaggt

SEQ ID NO: 7649933 - DNA, 22 bp, Homo sapiens
acaggcctcaaatagggtgcct

SEQ ID NO: 7649934 - DNA, 22 bp, Homo sapiens
acaggcctcaaatagggtgcct

SEQ ID NO: 7649935 - DNA, 22 bp, Homo sapiens
acaggcctcaaatagggtgcct

SEQ ID NO: 7649936 - DNA, 22 bp, Homo sapiens
acaggcctcaaatagggtgcct

SEQ ID NO: 7649937 - DNA, 18 bp, Homo sapiens
acaggcctcagtcctgca

SEQ ID NO: 7649938 - DNA, 18 bp, Homo sapiens
acaggcctcagtcctgca

SEQ ID NO: 7649939 - DNA, 22 bp, Homo sapiens
acaggcctcaagacacccaggt

SEQ ID NO: 7649940 - DNA, 22 bp, Homo sapiens
acaggcctgacacacagagggc

SEQ ID NO: 7649941 - DNA, 22 bp, Homo sapiens
acaggcctcccatccggagccc

SEQ ID NO: 7649942 - DNA, 22 bp, Homo sapiens
acaggcctgacacacagagggc

SEQ ID NO: 7649943 - DNA, 22 bp, Homo sapiens
acaggcctgacacacagagggc

SEQ ID NO: 7649944 - DNA, 22 bp, Homo sapiens
acaggcctcccatccggagccc

SEQ ID NO: 7649945 - DNA, 18 bp, Homo sapiens
acaggcctcagtcctgca

SEQ ID NO: 7649946 - DNA, 18 bp, Homo sapiens
acaggcctcagtcctgca

SEQ ID NO: 7649947 - DNA, 22 bp, Homo sapiens
acaggcctgacacacagagggc

SEQ ID NO: 7649948 - DNA, 22 bp, Homo sapiens
acaggcctcccatccggagccc

SEQ ID NO: 7649949 - DNA, 22 bp, Homo sapiens
acaggcctcccatccggagccc

SEQ ID NO: 7649950 - DNA, 22 bp, Homo sapiens
acaggcctcccatccggagccc

SEQ ID NO: 7649951 - DNA, 22 bp, Homo sapiens
acaggcctggaaaggaaggagt

SEQ ID NO: 7649952 - DNA, 22 bp, Homo sapiens
acaggcctgatgccttggctgg

SEQ ID NO: 7649953 - DNA, 17 bp, Homo sapiens
acaggcctgcttgcact

SEQ ID NO: 7649954 - DNA, 17 bp, Homo sapiens
acaggcctgcttgcact

SEQ ID NO: 7649955 - DNA, 17 bp, Homo sapiens
acaggcctgcttgcact

SEQ ID NO: 7649956 - DNA, 17 bp, Homo sapiens
acaggcctgcttgcact

SEQ ID NO: 7649957 - DNA, 22 bp, Homo sapiens
acaggcctgatgttatcctatt

SEQ ID NO: 7649958 - DNA, 22 bp, Homo sapiens
acaggcctgagattttgcattt

SEQ ID NO: 7649959 - DNA, 22 bp, Homo sapiens
acaggcctgagattttgcattt

SEQ ID NO: 7649960 - DNA, 22 bp, Homo sapiens
acaggcctgagattttgcattt

SEQ ID NO: 7649961 - DNA, 22 bp, Homo sapiens
acaggcctgagattttgcattt

SEQ ID NO: 7649962 - DNA, 22 bp, Homo sapiens
acaggcctgatgccttggctgg

SEQ ID NO: 7649963 - DNA, 22 bp, Homo sapiens
acaggccagcctggggtaaggt

SEQ ID NO: 7649964 - DNA, 22 bp, Homo sapiens
acaggccataaaggcaggccct

SEQ ID NO: 7649965 - DNA, 22 bp, Homo sapiens
acaggccataaaggcaggccct

SEQ ID NO: 7649966 - DNA, 22 bp, Homo sapiens
acaggccataaaggcaggccct

SEQ ID NO: 7649967 - DNA, 22 bp, Homo sapiens
acaggccataaaggcaggccct

SEQ ID NO: 7649968 - DNA, 22 bp, Homo sapiens
acaggcccagctcttcaccaga

SEQ ID NO: 7649969 - DNA, 22 bp, Homo sapiens
acaggcctacgaagtcaggtgc

SEQ ID NO: 7649970 - DNA, 22 bp, Homo sapiens
acaggcccagctcttcaccaga

SEQ ID NO: 7649971 - DNA, 22 bp, Homo sapiens
acaggccataaaggcaggccct

SEQ ID NO: 7649972 - DNA, 22 bp, Homo sapiens
acaggccataaaggcaggccct

SEQ ID NO: 7649973 - DNA, 22 bp, Homo sapiens
acaggccataaaggcaggccct

SEQ ID NO: 7649974 - DNA, 22 bp, Homo sapiens
acaggcaggtaatttacatatt

SEQ ID NO: 7649975 - DNA, 22 bp, Homo sapiens
acaggcaggtaatttacatatt

SEQ ID NO: 7649976 - DNA, 22 bp, Homo sapiens
acaggcaggtaatttacatatt

SEQ ID NO: 7649977 - DNA, 22 bp, Homo sapiens
acaggcaggtaatttacatatt

SEQ ID NO: 7649978 - DNA, 22 bp, Homo sapiens
acaggcaggtaatttacatatt

SEQ ID NO: 7649979 - DNA, 23 bp, Homo sapiens
acagcttcctggcatggagaacc

SEQ ID NO: 7649980 - DNA, 23 bp, Homo sapiens
acagcttcctactttgctgctgc

SEQ ID NO: 7649981 - DNA, 23 bp, Homo sapiens
acagcttcctactttgctgctgc

SEQ ID NO: 7649982 - DNA, 23 bp, Homo sapiens
acagcttcctactttgctgctgc

SEQ ID NO: 7649983 - DNA, 22 bp, Homo sapiens
acagcttcgaggatctcatccc

SEQ ID NO: 7649984 - DNA, 22 bp, Homo sapiens
acagcttcgaggatctcatccc

SEQ ID NO: 7649985 - DNA, 22 bp, Homo sapiens
acagcttcgaggatctcatccc

SEQ ID NO: 7649986 - DNA, 23 bp, Homo sapiens
acagctgttgaaatttcagtggg

SEQ ID NO: 7649987 - DNA, 22 bp, Homo sapiens
acagcttagccagtcaagctct

SEQ ID NO: 7649988 - DNA, 22 bp, Homo sapiens
acagcttccagtattcttgaaa

SEQ ID NO: 7649989 - DNA, 22 bp, Homo sapiens
acagcttccagtattcttgaaa

SEQ ID NO: 7649990 - DNA, 22 bp, Homo sapiens
acagcttccagtattcttgaaa

SEQ ID NO: 7649991 - DNA, 22 bp, Homo sapiens
acagcttcacccattatccctg

SEQ ID NO: 7649992 - DNA, 22 bp, Homo sapiens
acagcttcacccattatccctg

SEQ ID NO: 7649993 - DNA, 22 bp, Homo sapiens
acagctgtgttttataatcagc

SEQ ID NO: 7649994 - DNA, 22 bp, Homo sapiens
acagctgtgttttataatcagc

SEQ ID NO: 7649995 - DNA, 22 bp, Homo sapiens
acagctgtggggactcttgccc

SEQ ID NO: 7649996 - DNA, 22 bp, Homo sapiens
acagctgtggtctccttagtgt

SEQ ID NO: 7649997 - DNA, 22 bp, Homo sapiens
acagctgtgttttataatcagc

SEQ ID NO: 7649998 - DNA, 22 bp, Homo sapiens
acagctgtgttttataatcagc

SEQ ID NO: 7649999 - DNA, 22 bp, Homo sapiens
acagctgtggggactcttgccc

SEQ ID NO: 7650000 - DNA, 22 bp, Homo sapiens
acagctgtggtctccttagtgt

SEQ ID NO: 7650001 - DNA, 22 bp, Homo sapiens
acagctgtggggactcttgccc

SEQ ID NO: 7650002 - DNA, 22 bp, Homo sapiens
acagctgtgggctctgcatata

SEQ ID NO: 7650003 - DNA, 22 bp, Homo sapiens
agctgggtcttgggccaggaga

SEQ ID NO: 7650004 - DNA, 22 bp, Homo sapiens
agctgggtccctctgctgatgg

SEQ ID NO: 7650005 - DNA, 22 bp, Homo sapiens
agctgggtcttgggccaggaga

SEQ ID NO: 7650006 - DNA, 22 bp, Homo sapiens
agctgggtcttgggccaggaga

SEQ ID NO: 7650007 - DNA, 22 bp, Homo sapiens
agctgggtccctctgctgatgg

SEQ ID NO: 7650008 - DNA, 22 bp, Homo sapiens
agctgggtcaataggaaatgta

SEQ ID NO: 7650009 - DNA, 22 bp, Homo sapiens
agctgggtccctctgctgatgg

SEQ ID NO: 7650010 - DNA, 22 bp, Homo sapiens
agctgggtgaaggcagatggct

SEQ ID NO: 7650011 - DNA, 22 bp, Homo sapiens
agctgggtcttgggccaggaga

SEQ ID NO: 7650012 - DNA, 22 bp, Homo sapiens
agctgggtgaaggcagatggct

SEQ ID NO: 7650013 - DNA, 22 bp, Homo sapiens
agctgggtcttgggccaggaga

SEQ ID NO: 7650014 - DNA, 22 bp, Homo sapiens
agctgggtgaaggcagatggct

SEQ ID NO: 7650015 - DNA, 22 bp, Homo sapiens
agctgggtgaaggcagatggct

SEQ ID NO: 7650016 - DNA, 22 bp, Homo sapiens
agctgggtgaaggcagatggct

SEQ ID NO: 7650017 - DNA, 21 bp, Homo sapiens
acagctgtcttagcttgggct

SEQ ID NO: 7650018 - DNA, 21 bp, Homo sapiens
acagctgtcttagcttgggct

SEQ ID NO: 7650019 - DNA, 22 bp, Homo sapiens
acagctgtgaaaatccacagga

SEQ ID NO: 7650020 - DNA, 22 bp, Homo sapiens
acagctgtgaaaatccacagga

SEQ ID NO: 7650021 - DNA, 22 bp, Homo sapiens
acagctgtattcaagttgcaag

SEQ ID NO: 7650022 - DNA, 22 bp, Homo sapiens
agctgggtgaaggcagatggct

SEQ ID NO: 7650023 - DNA, 22 bp, Homo sapiens
acagctgtgaagcaagcactct

SEQ ID NO: 7650024 - DNA, 22 bp, Homo sapiens
acagctgtgaagcaagcactct

SEQ ID NO: 7650025 - DNA, 22 bp, Homo sapiens
acagctgtgaagcaagcactct

SEQ ID NO: 7650026 - DNA, 22 bp, Homo sapiens
acagctgtgacttagagaagtt

SEQ ID NO: 7650027 - DNA, 22 bp, Homo sapiens
acagctgtgacttagagaagtt

SEQ ID NO: 7650028 - DNA, 22 bp, Homo sapiens
acagctgtgaagcaagcactct

SEQ ID NO: 7650029 - DNA, 22 bp, Homo sapiens
acagctgtgacttagagaagtt

SEQ ID NO: 7650030 - DNA, 22 bp, Homo sapiens
acagctgtgacttagagaagtt

SEQ ID NO: 7650031 - DNA, 22 bp, Homo sapiens
acagctgtgagggtcacttgta

SEQ ID NO: 7650032 - DNA, 22 bp, Homo sapiens
acagctgtgagggtcacttgta

SEQ ID NO: 7650033 - DNA, 22 bp, Homo sapiens
acagctgtgggctctgcatata

SEQ ID NO: 7650034 - DNA, 22 bp, Homo sapiens
acagctgtgggctctgcatata

SEQ ID NO: 7650035 - DNA, 22 bp, Homo sapiens
acagctgtgggctctgcatata

SEQ ID NO: 7650036 - DNA, 22 bp, Homo sapiens
acagctgtgggctctgcatata

SEQ ID NO: 7650037 - DNA, 22 bp, Homo sapiens
acagctgtggccacttgcatcc

SEQ ID NO: 7650038 - DNA, 22 bp, Homo sapiens
acagctgtgatttctatcatga

SEQ ID NO: 7650039 - DNA, 22 bp, Homo sapiens
acagctgtgatttctatcatga

SEQ ID NO: 7650040 - DNA, 22 bp, Homo sapiens
acagctgtggccacttgcatcc

SEQ ID NO: 7650041 - DNA, 22 bp, Homo sapiens
acagctgtgagggtcacttgta

SEQ ID NO: 7650042 - DNA, 21 bp, Homo sapiens
aggcagcatctgatttatatg

SEQ ID NO: 7650043 - DNA, 21 bp, Homo sapiens
aggcagcatctgatttatatg

SEQ ID NO: 7650044 - DNA, 22 bp, Homo sapiens
aggcagcatgctctgcttctac

SEQ ID NO: 7650045 - DNA, 22 bp, Homo sapiens
aggcagcatccagaggagaatg

SEQ ID NO: 7650046 - DNA, 22 bp, Homo sapiens
aggcagcatccagaggagaatg

SEQ ID NO: 7650047 - DNA, 22 bp, Homo sapiens
aggcagcatccagaggagaatg

SEQ ID NO: 7650048 - DNA, 22 bp, Homo sapiens
aggcagcatccagaggagaatg

SEQ ID NO: 7650049 - DNA, 22 bp, Homo sapiens
aggcagcatccagaggagaatg

SEQ ID NO: 7650050 - DNA, 22 bp, Homo sapiens
aggcagcatgctctgcttctac

SEQ ID NO: 7650051 - DNA, 22 bp, Homo sapiens
aggcagcatgctctgcttctac

SEQ ID NO: 7650052 - DNA, 22 bp, Homo sapiens
aggcagcatgggcccagagtcc

SEQ ID NO: 7650053 - DNA, 22 bp, Homo sapiens
aggcagcatgggcccagagtcc

SEQ ID NO: 7650054 - DNA, 22 bp, Homo sapiens
aggcagcatgctctgcttctac

SEQ ID NO: 7650055 - DNA, 21 bp, Homo sapiens
aggcagcatctgatttatatg

SEQ ID NO: 7650056 - DNA, 22 bp, Homo sapiens
aggcagcatgctctgcttctac

SEQ ID NO: 7650057 - DNA, 22 bp, Homo sapiens
aggcagcatgctctgcttctac

SEQ ID NO: 7650058 - DNA, 22 bp, Homo sapiens
aggcagcatgctctgcttctac

SEQ ID NO: 7650059 - DNA, 22 bp, Homo sapiens
aggcagcatccagaggagaatg

SEQ ID NO: 7650060 - DNA, 22 bp, Homo sapiens
aggcagcatccagaggagaatg

SEQ ID NO: 7650061 - DNA, 22 bp, Homo sapiens
aggcagcatccagaggagaatg

SEQ ID NO: 7650062 - DNA, 22 bp, Homo sapiens
aggcagcatccagaggagaatg

SEQ ID NO: 7650063 - DNA, 22 bp, Homo sapiens
aggcagcatccagaggagaatg

SEQ ID NO: 7650064 - DNA, 22 bp, Homo sapiens
aggcagcagtgataagatagga

SEQ ID NO: 7650065 - DNA, 22 bp, Homo sapiens
aggcagcagtgataagatagga

SEQ ID NO: 7650066 - DNA, 22 bp, Homo sapiens
aggcagcagtgataagatagga

SEQ ID NO: 7650067 - DNA, 22 bp, Homo sapiens
aggcagcagtgataagatagga

SEQ ID NO: 7650068 - DNA, 19 bp, Homo sapiens
aggcagcacccagtccttg

SEQ ID NO: 7650069 - DNA, 19 bp, Homo sapiens
aggcagcacccagtccttg

SEQ ID NO: 7650070 - DNA, 22 bp, Homo sapiens
aggcagcagtgataagatagga

SEQ ID NO: 7650071 - DNA, 22 bp, Homo sapiens
aggcagcagtgataagatagga

SEQ ID NO: 7650072 - DNA, 19 bp, Homo sapiens
aggcagcacccagtccttg

SEQ ID NO: 7650073 - DNA, 22 bp, Homo sapiens
aggcagcaattgaaatcattgt

SEQ ID NO: 7650074 - DNA, 22 bp, Homo sapiens
aggcagcaattgaaatcattgt

SEQ ID NO: 7650075 - DNA, 22 bp, Homo sapiens
aggcagcaatgaatgaaatgga

SEQ ID NO: 7650076 - DNA, 22 bp, Homo sapiens
aggcagcaatgaatgaaatgga

SEQ ID NO: 7650077 - DNA, 22 bp, Homo sapiens
aggcagcaattgaaatcattgt

SEQ ID NO: 7650078 - DNA, 22 bp, Homo sapiens
aggcagcaattgaaatcattgt

SEQ ID NO: 7650079 - DNA, 22 bp, Homo sapiens
acagtttggttgctacagtaaa

SEQ ID NO: 7650080 - DNA, 17 bp, Homo sapiens
acagtttgtcattctaa

SEQ ID NO: 7650081 - DNA, 22 bp, Homo sapiens
acagtttggttgctacagtaaa

SEQ ID NO: 7650082 - DNA, 22 bp, Homo sapiens
acagtttggttgctacagtaaa

SEQ ID NO: 7650083 - DNA, 22 bp, Homo sapiens
acagtttggttgctacagtaaa

SEQ ID NO: 7650084 - DNA, 22 bp, Homo sapiens
acagtttggcgtgattgatagt

SEQ ID NO: 7650085 - DNA, 19 bp, Homo sapiens
acagtttgggaaatgagca

SEQ ID NO: 7650086 - DNA, 22 bp, Homo sapiens
acagtttgccctgacattctcc

SEQ ID NO: 7650087 - DNA, 22 bp, Homo sapiens
aggcagcattcaggggtgatga

SEQ ID NO: 7650088 - DNA, 22 bp, Homo sapiens
aggcagcattcaggggtgatga

SEQ ID NO: 7650089 - DNA, 22 bp, Homo sapiens
acagtttgccctgacattctcc

SEQ ID NO: 7650090 - DNA, 22 bp, Homo sapiens
acagtttggcagtttcttacta

SEQ ID NO: 7650091 - DNA, 22 bp, Homo sapiens
acagtttggcaaatgtcccaca

SEQ ID NO: 7650092 - DNA, 22 bp, Homo sapiens
aggcagcatgggccccagctcc

SEQ ID NO: 7650093 - DNA, 22 bp, Homo sapiens
aggcagcatgggccccagctcc

SEQ ID NO: 7650094 - DNA, 22 bp, Homo sapiens
aggcagcatgggccccagctcc

SEQ ID NO: 7650095 - DNA, 22 bp, Homo sapiens
aggcagcatgggccccagctcc

SEQ ID NO: 7650096 - DNA, 22 bp, Homo sapiens
aggcagcatgggcccagagtcc

SEQ ID NO: 7650097 - DNA, 22 bp, Homo sapiens
aggcagcatgggcccagagtcc

SEQ ID NO: 7650098 - DNA, 22 bp, Homo sapiens
aggcagcatgggcccagagtcc

SEQ ID NO: 7650099 - DNA, 22 bp, Homo sapiens
aggcagcatgggcccagagtcc

SEQ ID NO: 7650100 - DNA, 22 bp, Homo sapiens
aggcagcatgggcccagagtcc

SEQ ID NO: 7650101 - DNA, 22 bp, Homo sapiens
aggcagcatgggccccagctcc

SEQ ID NO: 7650102 - DNA, 22 bp, Homo sapiens
aggcagcatgggccccagctcc

SEQ ID NO: 7650103 - DNA, 22 bp, Homo sapiens
aggcagcatgggccccagctcc

SEQ ID NO: 7650104 - DNA, 16 bp, Homo sapiens
aggcagcatgttagtg

SEQ ID NO: 7650105 - DNA, 22 bp, Homo sapiens
aggcagcatgggccccagctcc

SEQ ID NO: 7650106 - DNA, 22 bp, Homo sapiens
aggcagcattcaggggtgatga

SEQ ID NO: 7650107 - DNA, 22 bp, Homo sapiens
aggcagcattcaggggtgatga

SEQ ID NO: 7650108 - DNA, 22 bp, Homo sapiens
aggcagcattcaggggtgatga

SEQ ID NO: 7650109 - DNA, 22 bp, Homo sapiens
aggcagcattcaggggtgatga

SEQ ID NO: 7650110 - DNA, 22 bp, Homo sapiens
aggcaggattgctgacaacaat

SEQ ID NO: 7650111 - DNA, 22 bp, Homo sapiens
aggcaggattgctgacaacaat

SEQ ID NO: 7650112 - DNA, 22 bp, Homo sapiens
aggcaggcaaccacctgggaag

SEQ ID NO: 7650113 - DNA, 22 bp, Homo sapiens
aggcaggcaaccacctgggaag

SEQ ID NO: 7650114 - DNA, 22 bp, Homo sapiens
aggcaggcaaccacctgggaag

SEQ ID NO: 7650115 - DNA, 22 bp, Homo sapiens
aggcaggcaaccacctgggaag

SEQ ID NO: 7650116 - DNA, 22 bp, Homo sapiens
aggcaggcaaccacctgggaag

SEQ ID NO: 7650117 - DNA, 22 bp, Homo sapiens
aggcaggcaaccacctgggaag

SEQ ID NO: 7650118 - DNA, 22 bp, Homo sapiens
aggcaggcaaccacctgggaag

SEQ ID NO: 7650119 - DNA, 22 bp, Homo sapiens
aggcaggcaaccacctgggaag

SEQ ID NO: 7650120 - DNA, 22 bp, Homo sapiens
aggcaggcaaccacctgggaag

SEQ ID NO: 7650121 - DNA, 22 bp, Homo sapiens
aggcaggcaaccacctgggaag

SEQ ID NO: 7650122 - DNA, 22 bp, Homo sapiens
aggcaggattgctgacaacaat

SEQ ID NO: 7650123 - DNA, 22 bp, Homo sapiens
aggcaggattgctgacaacaat

SEQ ID NO: 7650124 - DNA, 22 bp, Homo sapiens
aggcaggattgctgacaacaat

SEQ ID NO: 7650125 - DNA, 22 bp, Homo sapiens
aggcaggattgctgacaacaat

SEQ ID NO: 7650126 - DNA, 22 bp, Homo sapiens
aggcaggattgctgacaacaat

SEQ ID NO: 7650127 - DNA, 22 bp, Homo sapiens
aggcaggattgctgacaacaat

SEQ ID NO: 7650128 - DNA, 22 bp, Homo sapiens
aggcaggattgctgacaacaat

SEQ ID NO: 7650129 - DNA, 22 bp, Homo sapiens
aggcaggattgctgacaacaat

SEQ ID NO: 7650130 - DNA, 22 bp, Homo sapiens
aggcaggattgctgacaacaat

SEQ ID NO: 7650131 - DNA, 22 bp, Homo sapiens
aggcaggattgctgacaacaat

SEQ ID NO: 7650132 - DNA, 22 bp, Homo sapiens
aggcaggattgctgacaacaat

SEQ ID NO: 7650133 - DNA, 21 bp, Homo sapiens
aggcaggattcaaacacagag

SEQ ID NO: 7650134 - DNA, 22 bp, Homo sapiens
aggcaggcactccggaagtgtc

SEQ ID NO: 7650135 - DNA, 22 bp, Homo sapiens
aggcaggcacacttcctccagg

SEQ ID NO: 7650136 - DNA, 22 bp, Homo sapiens
aggcaggcactccggaagtgtc

SEQ ID NO: 7650137 - DNA, 22 bp, Homo sapiens
aggcaggcactccggaagtgtc

SEQ ID NO: 7650138 - DNA, 22 bp, Homo sapiens
aggcaggcactccggaagtgtc

SEQ ID NO: 7650139 - DNA, 22 bp, Homo sapiens
aggcaggcactccggaagtgtc

SEQ ID NO: 7650140 - DNA, 22 bp, Homo sapiens
aggcaggcacacttcctccagg

SEQ ID NO: 7650141 - DNA, 22 bp, Homo sapiens
aggcaggcacacttcctccagg

SEQ ID NO: 7650142 - DNA, 22 bp, Homo sapiens
aggcaggcacacttcctccagg

SEQ ID NO: 7650143 - DNA, 22 bp, Homo sapiens
aggcaggcacacttcctccagg

SEQ ID NO: 7650144 - DNA, 22 bp, Homo sapiens
aggcaggcaaccacctgggaag

SEQ ID NO: 7650145 - DNA, 22 bp, Homo sapiens
aggcaggcaaccacctgggaag

SEQ ID NO: 7650146 - DNA, 22 bp, Homo sapiens
aggcaggcaaccacctgggaag

SEQ ID NO: 7650147 - DNA, 22 bp, Homo sapiens
aggcaggcaagttcatatgagg

SEQ ID NO: 7650148 - DNA, 22 bp, Homo sapiens
aggcaggcaagttcatatgagg

SEQ ID NO: 7650149 - DNA, 22 bp, Homo sapiens
aggcaggcaagttcatatgagg

SEQ ID NO: 7650150 - DNA, 22 bp, Homo sapiens
aggcaggcaagttcatatgagg

SEQ ID NO: 7650151 - DNA, 22 bp, Homo sapiens
aggcaggcaagttcatatgagg

SEQ ID NO: 7650152 - DNA, 22 bp, Homo sapiens
aggcagctggaggcagagacta

SEQ ID NO: 7650153 - DNA, 22 bp, Homo sapiens
aggcagctggaggcagagacta

SEQ ID NO: 7650154 - DNA, 22 bp, Homo sapiens
aggcagctggaggcagagacta

SEQ ID NO: 7650155 - DNA, 22 bp, Homo sapiens
aggcagctggaggcagagacta

SEQ ID NO: 7650156 - DNA, 22 bp, Homo sapiens
aggcagctggaggcagagacta

SEQ ID NO: 7650157 - DNA, 22 bp, Homo sapiens
aggcagctggcaaattctagag

SEQ ID NO: 7650158 - DNA, 22 bp, Homo sapiens
aggcagctggcaaattctagag

SEQ ID NO: 7650159 - DNA, 22 bp, Homo sapiens
aggcagctggcaaattctagag

SEQ ID NO: 7650160 - DNA, 21 bp, Homo sapiens
aggcaggattcaaacacagag

SEQ ID NO: 7650161 - DNA, 22 bp, Homo sapiens
aggcagctggcaaattctagag

SEQ ID NO: 7650162 - DNA, 22 bp, Homo sapiens
acataaagtactgagagactct

SEQ ID NO: 7650163 - DNA, 22 bp, Homo sapiens
acataaatagattattgggagg

SEQ ID NO: 7650164 - DNA, 22 bp, Homo sapiens
acataaatagattattgggagg

SEQ ID NO: 7650165 - DNA, 22 bp, Homo sapiens
acataaatagattattgggagg

SEQ ID NO: 7650166 - DNA, 22 bp, Homo sapiens
acataaatagattattgggagg

SEQ ID NO: 7650167 - DNA, 22 bp, Homo sapiens
acataaatagattattgggagg

SEQ ID NO: 7650168 - DNA, 22 bp, Homo sapiens
acataaatagattattgggagg

SEQ ID NO: 7650169 - DNA, 22 bp, Homo sapiens
acataaatagattattgggagg

SEQ ID NO: 7650170 - DNA, 22 bp, Homo sapiens
acataaagtactgagagactct

SEQ ID NO: 7650171 - DNA, 22 bp, Homo sapiens
acataaaggtgactaacatctt

SEQ ID NO: 7650172 - DNA, 22 bp, Homo sapiens
acataaaggtgactaacatctt

SEQ ID NO: 7650173 - DNA, 22 bp, Homo sapiens
acataaaggtgactaacatctt

SEQ ID NO: 7650174 - DNA, 22 bp, Homo sapiens
acataaaggtgactaacatctt

SEQ ID NO: 7650175 - DNA, 22 bp, Homo sapiens
acagttttttcaacattggaat

SEQ ID NO: 7650176 - DNA, 22 bp, Homo sapiens
acagttttttcaacattggaat

SEQ ID NO: 7650177 - DNA, 22 bp, Homo sapiens
acagttttttcaacattggaat

SEQ ID NO: 7650178 - DNA, 22 bp, Homo sapiens
acagttttttcaacattggaat

SEQ ID NO: 7650179 - DNA, 21 bp, Homo sapiens
acagttttaaggagcacatgg

SEQ ID NO: 7650180 - DNA, 23 bp, Homo sapiens
acataaacagaaggtgtgcttcc

SEQ ID NO: 7650181 - DNA, 23 bp, Homo sapiens
acataaacagaaggtgtgcttcc

SEQ ID NO: 7650182 - DNA, 21 bp, Homo sapiens
acagttttaaggagcacatgg

SEQ ID NO: 7650183 - DNA, 21 bp, Homo sapiens
acagttttaaggagcacatgg

SEQ ID NO: 7650184 - DNA, 21 bp, Homo sapiens
acagttttaaggagcacatgg

SEQ ID NO: 7650185 - DNA, 22 bp, Homo sapiens
acagtttgtgttggccatgggc

SEQ ID NO: 7650186 - DNA, 22 bp, Homo sapiens
acagtttgttccttttcattgc

SEQ ID NO: 7650187 - DNA, 22 bp, Homo sapiens
acagttaagcagtatgatcaca

SEQ ID NO: 7650188 - DNA, 22 bp, Homo sapiens
acagttaagcagtatgatcaca

SEQ ID NO: 7650189 - DNA, 22 bp, Homo sapiens
acagttaaggaaatggaggttc

SEQ ID NO: 7650190 - DNA, 22 bp, Homo sapiens
acagttaataagtagtaagtca

SEQ ID NO: 7650191 - DNA, 22 bp, Homo sapiens
acagttaataagtagtaagtca

SEQ ID NO: 7650192 - DNA, 22 bp, Homo sapiens
acagttaataagtagtaagtca

SEQ ID NO: 7650193 - DNA, 22 bp, Homo sapiens
acagttaatatgtgacagaact

SEQ ID NO: 7650194 - DNA, 22 bp, Homo sapiens
acagttaatatgtgacagaact

SEQ ID NO: 7650195 - DNA, 22 bp, Homo sapiens
acagttaatatgtgacagaact

SEQ ID NO: 7650196 - DNA, 22 bp, Homo sapiens
acagttaatatgtgacagaact

SEQ ID NO: 7650197 - DNA, 22 bp, Homo sapiens
acagttaatcaaatggcatatg

SEQ ID NO: 7650198 - DNA, 22 bp, Homo sapiens
acagttaatcaaatggcatatg

SEQ ID NO: 7650199 - DNA, 22 bp, Homo sapiens
acagttaatcaaatggcatatg

SEQ ID NO: 7650200 - DNA, 22 bp, Homo sapiens
acagttaatcaaatggcatatg

SEQ ID NO: 7650201 - DNA, 22 bp, Homo sapiens
acagttaattaacattaagggg

SEQ ID NO: 7650202 - DNA, 22 bp, Homo sapiens
acagttaattaacattaagggg

SEQ ID NO: 7650203 - DNA, 22 bp, Homo sapiens
acagttaattaacattaagggg

SEQ ID NO: 7650204 - DNA, 22 bp, Homo sapiens
acagttaattaacattaagggg

SEQ ID NO: 7650205 - DNA, 22 bp, Homo sapiens
acagttaatcctaaaggcggta

SEQ ID NO: 7650206 - DNA, 22 bp, Homo sapiens
acagttaattaacattaagggg

SEQ ID NO: 7650207 - DNA, 22 bp, Homo sapiens
acagttaattgttgttgggtgt

SEQ ID NO: 7650208 - DNA, 22 bp, Homo sapiens
acagttaattgttgttgggtgt

SEQ ID NO: 7650209 - DNA, 22 bp, Homo sapiens
acagttacatcacttactgaca

SEQ ID NO: 7650210 - DNA, 22 bp, Homo sapiens
acagttacattccagcaacatc

SEQ ID NO: 7650211 - DNA, 22 bp, Homo sapiens
acagttacattccagcaacatc

SEQ ID NO: 7650212 - DNA, 22 bp, Homo sapiens
acagttacattaaacaaaagga

SEQ ID NO: 7650213 - DNA, 22 bp, Homo sapiens
acagttagggactataatcatt

SEQ ID NO: 7650214 - DNA, 22 bp, Homo sapiens
acagttaggtcctaaaattctg

SEQ ID NO: 7650215 - DNA, 22 bp, Homo sapiens
acagttaggtcctaaaattctg

SEQ ID NO: 7650216 - DNA, 22 bp, Homo sapiens
acagttaggcttatgtctgtag

SEQ ID NO: 7650217 - DNA, 22 bp, Homo sapiens
acagttaccacttagcagttac

SEQ ID NO: 7650218 - DNA, 22 bp, Homo sapiens
acagttacattccagcaacatc

SEQ ID NO: 7650219 - DNA, 22 bp, Homo sapiens
acagttactcatagaagcactt

SEQ ID NO: 7650220 - DNA, 22 bp, Homo sapiens
acagttactcatagaagcactt

SEQ ID NO: 7650221 - DNA, 22 bp, Homo sapiens
acagttcaagtcttagacaaca

SEQ ID NO: 7650222 - DNA, 22 bp, Homo sapiens
acagttcaagtcttagacaaca

SEQ ID NO: 7650223 - DNA, 22 bp, Homo sapiens
acagttcaagacatcagtatga

SEQ ID NO: 7650224 - DNA, 22 bp, Homo sapiens
acagttcaagtcttagacaaca

SEQ ID NO: 7650225 - DNA, 22 bp, Homo sapiens
acagttcaagtcttagacaaca

SEQ ID NO: 7650226 - DNA, 22 bp, Homo sapiens
acagttcaagtcttagacaaca

SEQ ID NO: 7650227 - DNA, 22 bp, Homo sapiens
acagttcaagtcttagacaaca

SEQ ID NO: 7650228 - DNA, 22 bp, Homo sapiens
acagttcactttttatatcaaa

SEQ ID NO: 7650229 - DNA, 22 bp, Homo sapiens
acagttcactttttatatcaaa

SEQ ID NO: 7650230 - DNA, 22 bp, Homo sapiens
acagttcagacaagtgttccat

SEQ ID NO: 7650231 - DNA, 22 bp, Homo sapiens
acagttcagacaagtgttccat

SEQ ID NO: 7650232 - DNA, 22 bp, Homo sapiens
acagttcactttttatatcaaa

SEQ ID NO: 7650233 - DNA, 22 bp, Homo sapiens
acagttcactttttatatcaaa

SEQ ID NO: 7650234 - DNA, 22 bp, Homo sapiens
acagttcaagcaagtttctgtt

SEQ ID NO: 7650235 - DNA, 22 bp, Homo sapiens
acagttcaagacatcagtatga

SEQ ID NO: 7650236 - DNA, 22 bp, Homo sapiens
acagttcaagacatcagtatga

SEQ ID NO: 7650237 - DNA, 22 bp, Homo sapiens
acagttcaagacatcagtatga

SEQ ID NO: 7650238 - DNA, 22 bp, Homo sapiens
acagttatttactgcataaact

SEQ ID NO: 7650239 - DNA, 22 bp, Homo sapiens
acagttatttactgcataaact

SEQ ID NO: 7650240 - DNA, 22 bp, Homo sapiens
acagttattttcccagcattta

SEQ ID NO: 7650241 - DNA, 22 bp, Homo sapiens
acagttattttcccagcattta

SEQ ID NO: 7650242 - DNA, 22 bp, Homo sapiens
acagttattttcccagcattta

SEQ ID NO: 7650243 - DNA, 23 bp, Homo sapiens
acagttatagctgtgaataacat

SEQ ID NO: 7650244 - DNA, 23 bp, Homo sapiens
acagttatagctgtgaataacat

SEQ ID NO: 7650245 - DNA, 22 bp, Homo sapiens
acagttatctttgaaatagaga

SEQ ID NO: 7650246 - DNA, 22 bp, Homo sapiens
acagttatatacatgtagctgt

SEQ ID NO: 7650247 - DNA, 23 bp, Homo sapiens
acagttatagctgtgaataacat

SEQ ID NO: 7650248 - DNA, 23 bp, Homo sapiens
acagttatagctgtgaataacat

SEQ ID NO: 7650249 - DNA, 23 bp, Homo sapiens
acagttatagctgtgaataacat

SEQ ID NO: 7650250 - DNA, 22 bp, Homo sapiens
acagttagtgagatgtctgttt

SEQ ID NO: 7650251 - DNA, 23 bp, Homo sapiens
acagttatagctgtgaataacat

SEQ ID NO: 7650252 - DNA, 23 bp, Homo sapiens
acagttatagctgtgaataacat

SEQ ID NO: 7650253 - DNA, 23 bp, Homo sapiens
acagttatagctgtgaataacat

SEQ ID NO: 7650254 - DNA, 23 bp, Homo sapiens
acagttatagctgtgaataacat

SEQ ID NO: 7650255 - DNA, 22 bp, Homo sapiens
acagttatctttgaaatagaga

SEQ ID NO: 7650256 - DNA, 22 bp, Homo sapiens
acagttatctttgaaatagaga

SEQ ID NO: 7650257 - DNA, 22 bp, Homo sapiens
acagttatctttgaaatagaga

SEQ ID NO: 7650258 - DNA, 22 bp, Homo sapiens
acagttatctttgaaatagaga

SEQ ID NO: 7650259 - DNA, 22 bp, Homo sapiens
acagttattctttatgcaacca

SEQ ID NO: 7650260 - DNA, 22 bp, Homo sapiens
acagttatctttgaaatagaga

SEQ ID NO: 7650261 - DNA, 22 bp, Homo sapiens
acagttatttactgcataaact

SEQ ID NO: 7650262 - DNA, 22 bp, Homo sapiens
acagttatttactgcataaact

SEQ ID NO: 7650263 - DNA, 22 bp, Homo sapiens
acagttattctttatgcaacca

SEQ ID NO: 7650264 - DNA, 22 bp, Homo sapiens
acagttattctttatgcaacca

SEQ ID NO: 7650265 - DNA, 22 bp, Homo sapiens
acagttattctttatgcaacca

SEQ ID NO: 7650266 - DNA, 22 bp, Homo sapiens
acagtgatgggggtgcaggaag

SEQ ID NO: 7650267 - DNA, 22 bp, Homo sapiens
acagtgatgccgggcgagaatg

SEQ ID NO: 7650268 - DNA, 22 bp, Homo sapiens
acagtgatgggggtgcaggaag

SEQ ID NO: 7650269 - DNA, 22 bp, Homo sapiens
acagtgatgagggaattttgtg

SEQ ID NO: 7650270 - DNA, 22 bp, Homo sapiens
acagtgatgagggaattttgtg

SEQ ID NO: 7650271 - DNA, 22 bp, Homo sapiens
acagtgatgagggaattttgtg

SEQ ID NO: 7650272 - DNA, 22 bp, Homo sapiens
acagtgataaaatttcacatgt

SEQ ID NO: 7650273 - DNA, 22 bp, Homo sapiens
acagtgataaaatttcacatgt

SEQ ID NO: 7650274 - DNA, 22 bp, Homo sapiens
acagtgataaaatttcacatgt

SEQ ID NO: 7650275 - DNA, 22 bp, Homo sapiens
acagtgataaaatttcacatgt

SEQ ID NO: 7650276 - DNA, 22 bp, Homo sapiens
acagtgataaaatttcacatgt

SEQ ID NO: 7650277 - DNA, 22 bp, Homo sapiens
acagtgataaaatttcacatgt

SEQ ID NO: 7650278 - DNA, 22 bp, Homo sapiens
acagtgataaaatttcacatgt

SEQ ID NO: 7650279 - DNA, 22 bp, Homo sapiens
acagtgaggacagggactgtgt

SEQ ID NO: 7650280 - DNA, 22 bp, Homo sapiens
acagtgatatttttactcaaat

SEQ ID NO: 7650281 - DNA, 22 bp, Homo sapiens
acagtgatatttttactcaaat

SEQ ID NO: 7650282 - DNA, 22 bp, Homo sapiens
acagtgataaaatttcacatgt

SEQ ID NO: 7650283 - DNA, 22 bp, Homo sapiens
acagtgatatttttactcaaat

SEQ ID NO: 7650284 - DNA, 22 bp, Homo sapiens
acagtgatcagttactgtctgt

SEQ ID NO: 7650285 - DNA, 22 bp, Homo sapiens
acagtgatcagttactgtctgt

SEQ ID NO: 7650286 - DNA, 22 bp, Homo sapiens
acagtgatcttttagttggaac

SEQ ID NO: 7650287 - DNA, 22 bp, Homo sapiens
acagtgatcttttagttggaac

SEQ ID NO: 7650288 - DNA, 22 bp, Homo sapiens
acagtgcaaaccctcgggaaag

SEQ ID NO: 7650289 - DNA, 22 bp, Homo sapiens
acagtgcaaaccctcgggaaag

SEQ ID NO: 7650290 - DNA, 22 bp, Homo sapiens
acagtgattttaggatagatgg

SEQ ID NO: 7650291 - DNA, 22 bp, Homo sapiens
acagtgattttttcgagcagaa

SEQ ID NO: 7650292 - DNA, 22 bp, Homo sapiens
acagtgattttaggatagatgg

SEQ ID NO: 7650293 - DNA, 18 bp, Homo sapiens
acagtgattgttctatgc

SEQ ID NO: 7650294 - DNA, 22 bp, Homo sapiens
acagtgatttcatccttctggg

SEQ ID NO: 7650295 - DNA, 22 bp, Homo sapiens
acagtgatttctgcaagggctc

SEQ ID NO: 7650296 - DNA, 18 bp, Homo sapiens
acagtgattgttctatgc

SEQ ID NO: 7650297 - DNA, 18 bp, Homo sapiens
acagtgattgttctatgc

SEQ ID NO: 7650298 - DNA, 22 bp, Homo sapiens
acagtgattggggtatctgcag

SEQ ID NO: 7650299 - DNA, 22 bp, Homo sapiens
acagtgattggggtatctgcag

SEQ ID NO: 7650300 - DNA, 22 bp, Homo sapiens
acagtgattggtttgggggtga

SEQ ID NO: 7650301 - DNA, 22 bp, Homo sapiens
acagtgattggcactgattcag

SEQ ID NO: 7650302 - DNA, 22 bp, Homo sapiens
acagtgattctgcaaaccatat

SEQ ID NO: 7650303 - DNA, 22 bp, Homo sapiens
acagtgattggcactgattcag

SEQ ID NO: 7650304 - DNA, 22 bp, Homo sapiens
acagtgattctgcaaaccatat

SEQ ID NO: 7650305 - DNA, 22 bp, Homo sapiens
acagtgattctgcaaaccatat

SEQ ID NO: 7650306 - DNA, 22 bp, Homo sapiens
acagtgattctgcaaaccatat

SEQ ID NO: 7650307 - DNA, 22 bp, Homo sapiens
acagttaaatatttctactggg

SEQ ID NO: 7650308 - DNA, 22 bp, Homo sapiens
acagttaactggagagcgagtt

SEQ ID NO: 7650309 - DNA, 22 bp, Homo sapiens
acagttaagcagtatgatcaca

SEQ ID NO: 7650310 - DNA, 22 bp, Homo sapiens
acagttaagcagtatgatcaca

SEQ ID NO: 7650311 - DNA, 22 bp, Homo sapiens
acagttaaatatttctactggg

SEQ ID NO: 7650312 - DNA, 20 bp, Homo sapiens
acagtgtttttgagtagagc

SEQ ID NO: 7650313 - DNA, 22 bp, Homo sapiens
acagtgttttagaaaagcttga

SEQ ID NO: 7650314 - DNA, 22 bp, Homo sapiens
acagtgttttatgagaattgtt

SEQ ID NO: 7650315 - DNA, 22 bp, Homo sapiens
acagtgttttatgagaattgtt

SEQ ID NO: 7650316 - DNA, 22 bp, Homo sapiens
acagtgttttcttaaggagaaa

SEQ ID NO: 7650317 - DNA, 22 bp, Homo sapiens
acagtgttttgtctggcagggc

SEQ ID NO: 7650318 - DNA, 22 bp, Homo sapiens
acagtgcacatcctgagtgatt

SEQ ID NO: 7650319 - DNA, 22 bp, Homo sapiens
acagtgcacatcctgagtgatt

SEQ ID NO: 7650320 - DNA, 22 bp, Homo sapiens
acagtgcacatcctgagtgatt

SEQ ID NO: 7650321 - DNA, 22 bp, Homo sapiens
acagtgcacatcctgagtgatt

SEQ ID NO: 7650322 - DNA, 22 bp, Homo sapiens
acagtgttctgctttttaatcc

SEQ ID NO: 7650323 - DNA, 22 bp, Homo sapiens
acagtgttctgctttttaatcc

SEQ ID NO: 7650324 - DNA, 22 bp, Homo sapiens
acagtgttctgctttttaatcc

SEQ ID NO: 7650325 - DNA, 22 bp, Homo sapiens
acagtgttttagaaaagcttga

SEQ ID NO: 7650326 - DNA, 22 bp, Homo sapiens
acagtgttttagaaaagcttga

SEQ ID NO: 7650327 - DNA, 22 bp, Homo sapiens
acagtgcaaataggactgtctt

SEQ ID NO: 7650328 - DNA, 22 bp, Homo sapiens
acagtgcaaataggactgtctt

SEQ ID NO: 7650329 - DNA, 22 bp, Homo sapiens
acagtgcaaacttttgtctcct

SEQ ID NO: 7650330 - DNA, 22 bp, Homo sapiens
acagtgcacatcctgagtgatt

SEQ ID NO: 7650331 - DNA, 22 bp, Homo sapiens
acagtgcaaataggactgtctt

SEQ ID NO: 7650332 - DNA, 22 bp, Homo sapiens
acagtgcaaataggactgtctt

SEQ ID NO: 7650333 - DNA, 22 bp, Homo sapiens
aggagtctgttgaaatgtctat

SEQ ID NO: 7650334 - DNA, 22 bp, Homo sapiens
aggagtctgttgaaatgtctat

SEQ ID NO: 7650335 - DNA, 22 bp, Homo sapiens
aggagtgagtgtcctcagcaga

SEQ ID NO: 7650336 - DNA, 22 bp, Homo sapiens
aggagtctgttgaaatgtctat

SEQ ID NO: 7650337 - DNA, 22 bp, Homo sapiens
aggagtgagctttggggtcaga

SEQ ID NO: 7650338 - DNA, 22 bp, Homo sapiens
aggagtgagctttggggtcaga

SEQ ID NO: 7650339 - DNA, 22 bp, Homo sapiens
aggagtgagctttggggtcaga

SEQ ID NO: 7650340 - DNA, 22 bp, Homo sapiens
aggagtctgaactggtcccctg

SEQ ID NO: 7650341 - DNA, 17 bp, Homo sapiens
aggagtctcagatgagc

SEQ ID NO: 7650342 - DNA, 20 bp, Homo sapiens
aggagtccctgtgctctctc

SEQ ID NO: 7650343 - DNA, 22 bp, Homo sapiens
aggagtcctcatgtctgtgcga

SEQ ID NO: 7650344 - DNA, 20 bp, Homo sapiens
aggagtccctgtgctctctc

SEQ ID NO: 7650345 - DNA, 22 bp, Homo sapiens
aggagtccatgagcagctagag

SEQ ID NO: 7650346 - DNA, 20 bp, Homo sapiens
aggagtccctgtgctctctc

SEQ ID NO: 7650347 - DNA, 22 bp, Homo sapiens
aggagtccacccaggaatttaa

SEQ ID NO: 7650348 - DNA, 22 bp, Homo sapiens
aggagtccatgagcagctagag

SEQ ID NO: 7650349 - DNA, 22 bp, Homo sapiens
aggagtgctgcaagttgacaga

SEQ ID NO: 7650350 - DNA, 22 bp, Homo sapiens
aggagtggaattactgggttct

SEQ ID NO: 7650351 - DNA, 22 bp, Homo sapiens
aggagtggaattactgggttct

SEQ ID NO: 7650352 - DNA, 22 bp, Homo sapiens
aggagtgctgcaagttgacaga

SEQ ID NO: 7650353 - DNA, 22 bp, Homo sapiens
acagtgaggacagggactgtgt

SEQ ID NO: 7650354 - DNA, 22 bp, Homo sapiens
acagtgaggacagggactgtgt

SEQ ID NO: 7650355 - DNA, 22 bp, Homo sapiens
aggagtggaattactgggttct

SEQ ID NO: 7650356 - DNA, 22 bp, Homo sapiens
aggagtggaattactgggttct

SEQ ID NO: 7650357 - DNA, 22 bp, Homo sapiens
acagtgaggacagggactgtgt

SEQ ID NO: 7650358 - DNA, 22 bp, Homo sapiens
aggagtgcaaatagtccagaga

SEQ ID NO: 7650359 - DNA, 22 bp, Homo sapiens
aggagtgcaaatagtccagaga

SEQ ID NO: 7650360 - DNA, 22 bp, Homo sapiens
aggagtgccttttcatgagtgt

SEQ ID NO: 7650361 - DNA, 22 bp, Homo sapiens
aggagtgctgcaagttgacaga

SEQ ID NO: 7650362 - DNA, 22 bp, Homo sapiens
aggagtgagtgtcctcagcaga

SEQ ID NO: 7650363 - DNA, 22 bp, Homo sapiens
aggagtgagtgtcctcagcaga

SEQ ID NO: 7650364 - DNA, 22 bp, Homo sapiens
aggagtgagctttggggtcaga

SEQ ID NO: 7650365 - DNA, 22 bp, Homo sapiens
aggagtgagtgtcctcagcaga

SEQ ID NO: 7650366 - DNA, 22 bp, Homo sapiens
aggagtgagtgtcctcagcaga

SEQ ID NO: 7650367 - DNA, 22 bp, Homo sapiens
aggagtgcaaatagtccagaga

SEQ ID NO: 7650368 - DNA, 22 bp, Homo sapiens
aggagtgcaaatagtccagaga

SEQ ID NO: 7650369 - DNA, 22 bp, Homo sapiens
aggagtgcaaatagtccagaga

SEQ ID NO: 7650370 - DNA, 19 bp, Homo sapiens
aggagtcaggaacttcctt

SEQ ID NO: 7650371 - DNA, 22 bp, Homo sapiens
aggagtcagattgtttgaatgt

SEQ ID NO: 7650372 - DNA, 22 bp, Homo sapiens
aggagtcagatatgggaaagtt

SEQ ID NO: 7650373 - DNA, 22 bp, Homo sapiens
aggagtcaggaccaaatggaaa

SEQ ID NO: 7650374 - DNA, 22 bp, Homo sapiens
aggagtcaggaccaaatggaaa

SEQ ID NO: 7650375 - DNA, 22 bp, Homo sapiens
aggagggtgatccgggctggtc

SEQ ID NO: 7650376 - DNA, 22 bp, Homo sapiens
aggagggtgatccgggctggtc

SEQ ID NO: 7650377 - DNA, 22 bp, Homo sapiens
aggagggtggcctcatgtgagt

SEQ ID NO: 7650378 - DNA, 22 bp, Homo sapiens
aggagggtggcctcatgtgagt

SEQ ID NO: 7650379 - DNA, 22 bp, Homo sapiens
aggagtcactcagggcttcatc

SEQ ID NO: 7650380 - DNA, 22 bp, Homo sapiens
aggagtcactcagggcttcatc

SEQ ID NO: 7650381 - DNA, 22 bp, Homo sapiens
aggagtcagatatgggaaagtt

SEQ ID NO: 7650382 - DNA, 22 bp, Homo sapiens
acagtacaagcatgatacataa

SEQ ID NO: 7650383 - DNA, 22 bp, Homo sapiens
acagtacaagcatgatacataa

SEQ ID NO: 7650384 - DNA, 22 bp, Homo sapiens
acagtacaagcatgatacataa

SEQ ID NO: 7650385 - DNA, 22 bp, Homo sapiens
acagtacaagcatgatacataa

SEQ ID NO: 7650386 - DNA, 22 bp, Homo sapiens
acagtacaagcatgatacataa

SEQ ID NO: 7650387 - DNA, 22 bp, Homo sapiens
aggagggtgatccgggctggtc

SEQ ID NO: 7650388 - DNA, 22 bp, Homo sapiens
aggagggtgatccgggctggtc

SEQ ID NO: 7650389 - DNA, 22 bp, Homo sapiens
aggagggtgatccgggctggtc

SEQ ID NO: 7650390 - DNA, 22 bp, Homo sapiens
aggagggtgatccgggctggtc

SEQ ID NO: 7650391 - DNA, 22 bp, Homo sapiens
aggagggtgatccgggctggtc

SEQ ID NO: 7650392 - DNA, 22 bp, Homo sapiens
aggagggtcatgttgaagtgta

SEQ ID NO: 7650393 - DNA, 22 bp, Homo sapiens
aggagggtcatgttgaagtgta

SEQ ID NO: 7650394 - DNA, 22 bp, Homo sapiens
acagtacaccactgtgtacagt

SEQ ID NO: 7650395 - DNA, 22 bp, Homo sapiens
acagtacaccactgtgtacagt

SEQ ID NO: 7650396 - DNA, 22 bp, Homo sapiens
acagtacaagcaatgcattttt

SEQ ID NO: 7650397 - DNA, 22 bp, Homo sapiens
acagtacaagcaatgcattttt

SEQ ID NO: 7650398 - DNA, 22 bp, Homo sapiens
acagtacaagcatgatacataa

SEQ ID NO: 7650399 - DNA, 22 bp, Homo sapiens
acagtacaagcaatgcattttt

SEQ ID NO: 7650400 - DNA, 22 bp, Homo sapiens
acagtacaagcaatgcattttt

SEQ ID NO: 7650401 - DNA, 22 bp, Homo sapiens
acagtacaagcaatgcattttt

SEQ ID NO: 7650402 - DNA, 22 bp, Homo sapiens
acagtacaagcaatgcattttt

SEQ ID NO: 7650403 - DNA, 22 bp, Homo sapiens
acagtacaaaacccaccagagg

SEQ ID NO: 7650404 - DNA, 22 bp, Homo sapiens
acagtaattgtgtacgaggaca

SEQ ID NO: 7650405 - DNA, 22 bp, Homo sapiens
acagtaatttattgaacacctt

SEQ ID NO: 7650406 - DNA, 22 bp, Homo sapiens
acagtaatttattgaacacctt

SEQ ID NO: 7650407 - DNA, 22 bp, Homo sapiens
acagtacaaaacccaccagagg

SEQ ID NO: 7650408 - DNA, 22 bp, Homo sapiens
acagtacaaaacccaccagagg

SEQ ID NO: 7650409 - DNA, 22 bp, Homo sapiens
acagtaacagtctatttctcag

SEQ ID NO: 7650410 - DNA, 22 bp, Homo sapiens
acagtaacagtctatttctcag

SEQ ID NO: 7650411 - DNA, 21 bp, Homo sapiens
acagtaaattccctgcaaaga

SEQ ID NO: 7650412 - DNA, 22 bp, Homo sapiens
acagtaacacctactctgtccc

SEQ ID NO: 7650413 - DNA, 21 bp, Homo sapiens
acagtaaattccctgcaaaga

SEQ ID NO: 7650414 - DNA, 21 bp, Homo sapiens
acagtaaattccctgcaaaga

SEQ ID NO: 7650415 - DNA, 22 bp, Homo sapiens
acagtaacaaatggcctgagga

SEQ ID NO: 7650416 - DNA, 21 bp, Homo sapiens
acagtaaattccctgcaaaga

SEQ ID NO: 7650417 - DNA, 21 bp, Homo sapiens
acagtaaattccctgcaaaga

SEQ ID NO: 7650418 - DNA, 21 bp, Homo sapiens
acagtaaattccctgcaaaga

SEQ ID NO: 7650419 - DNA, 22 bp, Homo sapiens
acagtaataagtgttggtgagg

SEQ ID NO: 7650420 - DNA, 22 bp, Homo sapiens
acagtaataagtgttggtgagg

SEQ ID NO: 7650421 - DNA, 22 bp, Homo sapiens
acagtaataagtgttggtgagg

SEQ ID NO: 7650422 - DNA, 22 bp, Homo sapiens
acagtaagggtaaataagaaca

SEQ ID NO: 7650423 - DNA, 21 bp, Homo sapiens
acagtaagacagggcatttgc

SEQ ID NO: 7650424 - DNA, 21 bp, Homo sapiens
acagtaagacagggcatttgc

SEQ ID NO: 7650425 - DNA, 22 bp, Homo sapiens
acagtaagcggggttggagggc

SEQ ID NO: 7650426 - DNA, 22 bp, Homo sapiens
acagtaagcggggttggagggc

SEQ ID NO: 7650427 - DNA, 17 bp, Homo sapiens
acagtaactatgttatg

SEQ ID NO: 7650428 - DNA, 22 bp, Homo sapiens
acagtaacctctcctctgaagg

SEQ ID NO: 7650429 - DNA, 17 bp, Homo sapiens
acagtaactatgttatg

SEQ ID NO: 7650430 - DNA, 17 bp, Homo sapiens
acagtaactatgttatg

SEQ ID NO: 7650431 - DNA, 22 bp, Homo sapiens
acagtaactcttttaccctcct

SEQ ID NO: 7650432 - DNA, 22 bp, Homo sapiens
acagtaattaaacattctgatt

SEQ ID NO: 7650433 - DNA, 22 bp, Homo sapiens
acagtaattaaacattctgatt

SEQ ID NO: 7650434 - DNA, 22 bp, Homo sapiens
acagtaattaaaatggatctgc

SEQ ID NO: 7650435 - DNA, 22 bp, Homo sapiens
acagtaattaaaatggatctgc

SEQ ID NO: 7650436 - DNA, 22 bp, Homo sapiens
acagtaattaaaatggatctgc

SEQ ID NO: 7650437 - DNA, 22 bp, Homo sapiens
acagtaatgcatacaagttagt

SEQ ID NO: 7650438 - DNA, 22 bp, Homo sapiens
acagtaatgcatacaagttagt

SEQ ID NO: 7650439 - DNA, 22 bp, Homo sapiens
acagtaatgcatacaagttagt

SEQ ID NO: 7650440 - DNA, 22 bp, Homo sapiens
acagtaatgcatacaagttagt

SEQ ID NO: 7650441 - DNA, 22 bp, Homo sapiens
acagtaattaaggtctgaaacg

SEQ ID NO: 7650442 - DNA, 22 bp, Homo sapiens
acagtaattaaggtctgaaacg

SEQ ID NO: 7650443 - DNA, 22 bp, Homo sapiens
acagtaattaaacattctgatt

SEQ ID NO: 7650444 - DNA, 22 bp, Homo sapiens
acagtaattaaacattctgatt

SEQ ID NO: 7650445 - DNA, 22 bp, Homo sapiens
acagtaattaaggtctgaaacg

SEQ ID NO: 7650446 - DNA, 22 bp, Homo sapiens
acagtaattgtgaacttaacgt

SEQ ID NO: 7650447 - DNA, 22 bp, Homo sapiens
acagtaattgtgaacttaacgt

SEQ ID NO: 7650448 - DNA, 22 bp, Homo sapiens
acagtaattaaggtctgaaacg

SEQ ID NO: 7650449 - DNA, 22 bp, Homo sapiens
acagtaattgtgaacttaacgt

SEQ ID NO: 7650450 - DNA, 22 bp, Homo sapiens
acagtaatgataaccagcattt

SEQ ID NO: 7650451 - DNA, 22 bp, Homo sapiens
acagtaatctgggaacttgtta

SEQ ID NO: 7650452 - DNA, 22 bp, Homo sapiens
acagtaatctgggaacttgtta

SEQ ID NO: 7650453 - DNA, 22 bp, Homo sapiens
acagtaataagtgttggtgagg

SEQ ID NO: 7650454 - DNA, 22 bp, Homo sapiens
acagtaatgataaccagcattt

SEQ ID NO: 7650455 - DNA, 22 bp, Homo sapiens
acagtaatgattctgagtctct

SEQ ID NO: 7650456 - DNA, 22 bp, Homo sapiens
acagtaatgattctgagtctct

SEQ ID NO: 7650457 - DNA, 22 bp, Homo sapiens
acagtaatgattctgagtctct

SEQ ID NO: 7650458 - DNA, 22 bp, Homo sapiens
acagtaatctgggaacttgtta

SEQ ID NO: 7650459 - DNA, 22 bp, Homo sapiens
acagtaatattgatgctcgtca

SEQ ID NO: 7650460 - DNA, 22 bp, Homo sapiens
acagtaatcatatgattttctc

SEQ ID NO: 7650461 - DNA, 22 bp, Homo sapiens
acagtaatcatatgattttctc

SEQ ID NO: 7650462 - DNA, 22 bp, Homo sapiens
acagtaataagtgttggtgagg

SEQ ID NO: 7650463 - DNA, 22 bp, Homo sapiens
acagtaatattgatgctcgtca

SEQ ID NO: 7650464 - DNA, 22 bp, Homo sapiens
acagtaatattgatgctcgtca

SEQ ID NO: 7650465 - DNA, 22 bp, Homo sapiens
aggaggaaagaaggcccccagc

SEQ ID NO: 7650466 - DNA, 22 bp, Homo sapiens
aggaggaaagaaggcccccagc

SEQ ID NO: 7650467 - DNA, 22 bp, Homo sapiens
aggaggaaagaaggcccccagc

SEQ ID NO: 7650468 - DNA, 22 bp, Homo sapiens
aggaggaaagaaggcccccagc

SEQ ID NO: 7650469 - DNA, 21 bp, Homo sapiens
aggaggaacccgtggctgggc

SEQ ID NO: 7650470 - DNA, 22 bp, Homo sapiens
aggaggaaagaaggcccccagc

SEQ ID NO: 7650471 - DNA, 22 bp, Homo sapiens
aggaggaaagaaggcccccagc

SEQ ID NO: 7650472 - DNA, 23 bp, Homo sapiens
aggaggaaaagttatctgctgag

SEQ ID NO: 7650473 - DNA, 23 bp, Homo sapiens
aggaggaaaagttatctgctgag

SEQ ID NO: 7650474 - DNA, 23 bp, Homo sapiens
aggaggaaaagttatctgctgag

SEQ ID NO: 7650475 - DNA, 23 bp, Homo sapiens
aggaggaaaagttatctgctgag

SEQ ID NO: 7650476 - DNA, 23 bp, Homo sapiens
aggaggaaaagttatctgctgag

SEQ ID NO: 7650477 - DNA, 23 bp, Homo sapiens
aggaggaaaagttatctgctgag

SEQ ID NO: 7650478 - DNA, 23 bp, Homo sapiens
aggaggaaaagttatctgctgag

SEQ ID NO: 7650479 - DNA, 22 bp, Homo sapiens
aggaggaaaaaggccacagcaa

SEQ ID NO: 7650480 - DNA, 22 bp, Homo sapiens
aggaggaaaaaggccacagcaa

SEQ ID NO: 7650481 - DNA, 22 bp, Homo sapiens
aggaggaaaaaggccacagcaa

SEQ ID NO: 7650482 - DNA, 22 bp, Homo sapiens
aggaggaaaaaggccacagcaa

SEQ ID NO: 7650483 - DNA, 22 bp, Homo sapiens
aggaggaaaaaggccacagcaa

SEQ ID NO: 7650484 - DNA, 22 bp, Homo sapiens
aggaggaaaaaggccacagcaa

SEQ ID NO: 7650485 - DNA, 22 bp, Homo sapiens
aggaggaaaaaggccacagcaa

SEQ ID NO: 7650486 - DNA, 22 bp, Homo sapiens
aggaggaaaaaggccacagcaa

SEQ ID NO: 7650487 - DNA, 22 bp, Homo sapiens
aggaggaaaaaggccacagcaa

SEQ ID NO: 7650488 - DNA, 20 bp, Homo sapiens
aggaggaaaaaatgacgagc

SEQ ID NO: 7650489 - DNA, 20 bp, Homo sapiens
aggaggaaaaaatgacgagc

SEQ ID NO: 7650490 - DNA, 22 bp, Homo sapiens
aggaggaactcagaaagaaggt

SEQ ID NO: 7650491 - DNA, 20 bp, Homo sapiens
aggaggaagaaagcacactg

SEQ ID NO: 7650492 - DNA, 20 bp, Homo sapiens
aggaggaagaaagcacactg

SEQ ID NO: 7650493 - DNA, 20 bp, Homo sapiens
aggaggaagaaagcacactg

SEQ ID NO: 7650494 - DNA, 22 bp, Homo sapiens
aggaggaactcagaaagaaggt

SEQ ID NO: 7650495 - DNA, 22 bp, Homo sapiens
aggaggaactcagaaagaaggt

SEQ ID NO: 7650496 - DNA, 22 bp, Homo sapiens
acagtaaatcaacagaatatct

SEQ ID NO: 7650497 - DNA, 21 bp, Homo sapiens
acagtaaattccctgcaaaga

SEQ ID NO: 7650498 - DNA, 20 bp, Homo sapiens
aggaggaagaaagcacactg

SEQ ID NO: 7650499 - DNA, 20 bp, Homo sapiens
aggaggaagaaagcacactg

SEQ ID NO: 7650500 - DNA, 20 bp, Homo sapiens
aggaggaagaaagcacactg

SEQ ID NO: 7650501 - DNA, 20 bp, Homo sapiens
aggaggaagaaagcacactg

SEQ ID NO: 7650502 - DNA, 22 bp, Homo sapiens
aggaggaactcagaaagaaggt

SEQ ID NO: 7650503 - DNA, 22 bp, Homo sapiens
aggaggaactcagaaagaaggt

SEQ ID NO: 7650504 - DNA, 22 bp, Homo sapiens
aggaggaactcagaaagaaggt

SEQ ID NO: 7650505 - DNA, 22 bp, Homo sapiens
aggaggaactcagaaagaaggt

SEQ ID NO: 7650506 - DNA, 22 bp, Homo sapiens
aggaggaactcagaaagaaggt

SEQ ID NO: 7650507 - DNA, 22 bp, Homo sapiens
aggaggaactcagaaagaaggt

SEQ ID NO: 7650508 - DNA, 22 bp, Homo sapiens
aggaggaactcagaaagaaggt

SEQ ID NO: 7650509 - DNA, 22 bp, Homo sapiens
aggaggaactcagaaagaaggt

SEQ ID NO: 7650510 - DNA, 21 bp, Homo sapiens
aggaggaacccgtggctgggc

SEQ ID NO: 7650511 - DNA, 21 bp, Homo sapiens
aggaggaacccgtggctgggc

SEQ ID NO: 7650512 - DNA, 21 bp, Homo sapiens
aggaggaacccgtggctgggc

SEQ ID NO: 7650513 - DNA, 21 bp, Homo sapiens
aggaggaacccgtggctgggc

SEQ ID NO: 7650514 - DNA, 21 bp, Homo sapiens
aggagctgtgtgcttcctttc

SEQ ID NO: 7650515 - DNA, 22 bp, Homo sapiens
aggagctggccactaggatgca

SEQ ID NO: 7650516 - DNA, 21 bp, Homo sapiens
aggagctgtgttagctggtcg

SEQ ID NO: 7650517 - DNA, 21 bp, Homo sapiens
aggagctgtgttagctggtcg

SEQ ID NO: 7650518 - DNA, 22 bp, Homo sapiens
aggagctggagtccaggcaagt

SEQ ID NO: 7650519 - DNA, 22 bp, Homo sapiens
aggagctggagtccaggcaagt

SEQ ID NO: 7650520 - DNA, 22 bp, Homo sapiens
aggagctggagtccaggcaagt

SEQ ID NO: 7650521 - DNA, 22 bp, Homo sapiens
aggagctggagtccaggcaagt

SEQ ID NO: 7650522 - DNA, 22 bp, Homo sapiens
aggagctggagtccaggcaagt

SEQ ID NO: 7650523 - DNA, 22 bp, Homo sapiens
aggagctggagtccaggcaagt

SEQ ID NO: 7650524 - DNA, 22 bp, Homo sapiens
acaggtggtctttgctcctttt

SEQ ID NO: 7650525 - DNA, 22 bp, Homo sapiens
acaggtgtaaaacccaggatgg

SEQ ID NO: 7650526 - DNA, 22 bp, Homo sapiens
acaggtgtaaaacccaggatgg

SEQ ID NO: 7650527 - DNA, 22 bp, Homo sapiens
acaggtggtctttgctcctttt

SEQ ID NO: 7650528 - DNA, 22 bp, Homo sapiens
acaggtggtctttgctcctttt

SEQ ID NO: 7650529 - DNA, 22 bp, Homo sapiens
acaggtggtctttgctcctttt

SEQ ID NO: 7650530 - DNA, 22 bp, Homo sapiens
acaggtggtctttgctcctttt

SEQ ID NO: 7650531 - DNA, 22 bp, Homo sapiens
acaggtggtctttgctcctttt

SEQ ID NO: 7650532 - DNA, 22 bp, Homo sapiens
aggagctgttttgttcagcaaa

SEQ ID NO: 7650533 - DNA, 21 bp, Homo sapiens
aggagctgtgttagctggtcg

SEQ ID NO: 7650534 - DNA, 22 bp, Homo sapiens
aggagctgttttgttcagcaaa

SEQ ID NO: 7650535 - DNA, 22 bp, Homo sapiens
aggagctgttttgttcagcaaa

SEQ ID NO: 7650536 - DNA, 20 bp, Homo sapiens
aggagcttaggaggttattg

SEQ ID NO: 7650537 - DNA, 22 bp, Homo sapiens
aggagcttcagagagaacctgg

SEQ ID NO: 7650538 - DNA, 22 bp, Homo sapiens
aggagctgttttgttcagcaaa

SEQ ID NO: 7650539 - DNA, 22 bp, Homo sapiens
aggagcttcagagagaacctgg

SEQ ID NO: 7650540 - DNA, 20 bp, Homo sapiens
aggaggaaaaaatgacgagc

SEQ ID NO: 7650541 - DNA, 20 bp, Homo sapiens
aggaggaaaaaatgacgagc

SEQ ID NO: 7650542 - DNA, 20 bp, Homo sapiens
aggaggaaaaaatgacgagc

SEQ ID NO: 7650543 - DNA, 20 bp, Homo sapiens
aggaggaaaaaatgacgagc

SEQ ID NO: 7650544 - DNA, 20 bp, Homo sapiens
aggaggaaaaaatgacgagc

SEQ ID NO: 7650545 - DNA, 20 bp, Homo sapiens
aggaggaaaaaatgacgagc

SEQ ID NO: 7650546 - DNA, 21 bp, Homo sapiens
aggagctgtgttagctggtcg

SEQ ID NO: 7650547 - DNA, 21 bp, Homo sapiens
aggagctgtgttagctggtcg

SEQ ID NO: 7650548 - DNA, 21 bp, Homo sapiens
aggagctgtgttagctggtcg

SEQ ID NO: 7650549 - DNA, 21 bp, Homo sapiens
aggagctgtgttagctggtcg

SEQ ID NO: 7650550 - DNA, 21 bp, Homo sapiens
aggagctgtgttagctggtcg

SEQ ID NO: 7650551 - DNA, 22 bp, Homo sapiens
acaggtggtagagtggaaagag

SEQ ID NO: 7650552 - DNA, 22 bp, Homo sapiens
acaggtggtagagtggaaagag

SEQ ID NO: 7650553 - DNA, 22 bp, Homo sapiens
acaggtggtaaaatggactgtc

SEQ ID NO: 7650554 - DNA, 22 bp, Homo sapiens
acaggtggtaaaatggactgtc

SEQ ID NO: 7650555 - DNA, 22 bp, Homo sapiens
acaggtggtaaaatggactgtc

SEQ ID NO: 7650556 - DNA, 22 bp, Homo sapiens
acaggtggtaaaatggactgtc

SEQ ID NO: 7650557 - DNA, 22 bp, Homo sapiens
acaggtggggaggctgaggttc

SEQ ID NO: 7650558 - DNA, 22 bp, Homo sapiens
acaggtggggaggctgaggttc

SEQ ID NO: 7650559 - DNA, 22 bp, Homo sapiens
acaggtggggcacttggagcct

SEQ ID NO: 7650560 - DNA, 22 bp, Homo sapiens
acaggtggggcacttggagcct

SEQ ID NO: 7650561 - DNA, 22 bp, Homo sapiens
acaggtgggcttaagagtcggc

SEQ ID NO: 7650562 - DNA, 22 bp, Homo sapiens
acaggtggcttattggctgatt

SEQ ID NO: 7650563 - DNA, 22 bp, Homo sapiens
acaggtgggcttaagagtcggc

SEQ ID NO: 7650564 - DNA, 22 bp, Homo sapiens
acaggtgggcttaagagtcggc

SEQ ID NO: 7650565 - DNA, 22 bp, Homo sapiens
acaggtggccccgagggagtgg

SEQ ID NO: 7650566 - DNA, 22 bp, Homo sapiens
acaggtggccccgagggagtgg

SEQ ID NO: 7650567 - DNA, 22 bp, Homo sapiens
acaggtggcataggcagtttga

SEQ ID NO: 7650568 - DNA, 22 bp, Homo sapiens
acaggtggccccgagggagtgg

SEQ ID NO: 7650569 - DNA, 22 bp, Homo sapiens
acaggtggccccgagggagtgg

SEQ ID NO: 7650570 - DNA, 22 bp, Homo sapiens
acaggtggcttattggctgatt

SEQ ID NO: 7650571 - DNA, 22 bp, Homo sapiens
acaggtggcttattggctgatt

SEQ ID NO: 7650572 - DNA, 22 bp, Homo sapiens
acaggtggcttattggctgatt

SEQ ID NO: 7650573 - DNA, 22 bp, Homo sapiens
acaggtggcttattggctgatt

SEQ ID NO: 7650574 - DNA, 22 bp, Homo sapiens
acaggtggcttattggctgatt

SEQ ID NO: 7650575 - DNA, 22 bp, Homo sapiens
acaggtggcttattggctgatt

SEQ ID NO: 7650576 - DNA, 22 bp, Homo sapiens
acaggtggcttattggctgatt

SEQ ID NO: 7650577 - DNA, 22 bp, Homo sapiens
acaggtggcttattggctgatt

SEQ ID NO: 7650578 - DNA, 22 bp, Homo sapiens
acaggtgggcttaagagtcggc

SEQ ID NO: 7650579 - DNA, 22 bp, Homo sapiens
acaggtggcttattggctgatt

SEQ ID NO: 7650580 - DNA, 18 bp, Homo sapiens
acagggagggcgctgggg

SEQ ID NO: 7650581 - DNA, 18 bp, Homo sapiens
acagggagggcgctgggg

SEQ ID NO: 7650582 - DNA, 18 bp, Homo sapiens
acagggagggcgctgggg

SEQ ID NO: 7650583 - DNA, 18 bp, Homo sapiens
acagggagggcgctgggg

SEQ ID NO: 7650584 - DNA, 18 bp, Homo sapiens
acagggagggcgctgggg

SEQ ID NO: 7650585 - DNA, 18 bp, Homo sapiens
acagggagggcgctgggg

SEQ ID NO: 7650586 - DNA, 18 bp, Homo sapiens
acagggagggcgctgggg

SEQ ID NO: 7650587 - DNA, 18 bp, Homo sapiens
acagggagggcgctgggg

SEQ ID NO: 7650588 - DNA, 18 bp, Homo sapiens
acagggagggcgctgggg

SEQ ID NO: 7650589 - DNA, 18 bp, Homo sapiens
acagggagggcgctgggg

SEQ ID NO: 7650590 - DNA, 18 bp, Homo sapiens
acagggagggcgctgggg

SEQ ID NO: 7650591 - DNA, 22 bp, Homo sapiens
acagggagtgcaattcatattg

SEQ ID NO: 7650592 - DNA, 22 bp, Homo sapiens
acagggagtgcaattcatattg

SEQ ID NO: 7650593 - DNA, 22 bp, Homo sapiens
acagggagtgcaattcatattg

SEQ ID NO: 7650594 - DNA, 22 bp, Homo sapiens
acagggagtctgaggggatagt

SEQ ID NO: 7650595 - DNA, 22 bp, Homo sapiens
acagggagtctgaggggatagt

SEQ ID NO: 7650596 - DNA, 22 bp, Homo sapiens
acagggagtctgaggggatagt

SEQ ID NO: 7650597 - DNA, 22 bp, Homo sapiens
acagggagtctgaggggatagt

SEQ ID NO: 7650598 - DNA, 22 bp, Homo sapiens
acagggagtctgaggggatagt

SEQ ID NO: 7650599 - DNA, 22 bp, Homo sapiens
acagggagtctgaggggatagt

SEQ ID NO: 7650600 - DNA, 22 bp, Homo sapiens
acagggagtctgaggggatagt

SEQ ID NO: 7650601 - DNA, 22 bp, Homo sapiens
acagggagtctgaggggatagt

SEQ ID NO: 7650602 - DNA, 22 bp, Homo sapiens
acagggagtctgaggggatagt

SEQ ID NO: 7650603 - DNA, 22 bp, Homo sapiens
acagggagtctgaggggatagt

SEQ ID NO: 7650604 - DNA, 22 bp, Homo sapiens
acagggcaacctctgggagact

SEQ ID NO: 7650605 - DNA, 22 bp, Homo sapiens
acagggcaacctctgggagact

SEQ ID NO: 7650606 - DNA, 22 bp, Homo sapiens
acagggcaacctctgggagact

SEQ ID NO: 7650607 - DNA, 22 bp, Homo sapiens
acagggcaacctctgggagact

SEQ ID NO: 7650608 - DNA, 22 bp, Homo sapiens
acagggcaacctctgggagact

SEQ ID NO: 7650609 - DNA, 22 bp, Homo sapiens
acagggcaacctctgggagact

SEQ ID NO: 7650610 - DNA, 22 bp, Homo sapiens
acagggcaacctctgggagact

SEQ ID NO: 7650611 - DNA, 22 bp, Homo sapiens
acagggcaacctctgggagact

SEQ ID NO: 7650612 - DNA, 22 bp, Homo sapiens
acagggcaacctctgggagact

SEQ ID NO: 7650613 - DNA, 22 bp, Homo sapiens
acagggcaacctctgggagact

SEQ ID NO: 7650614 - DNA, 22 bp, Homo sapiens
acagggcaacctctgggagact

SEQ ID NO: 7650615 - DNA, 22 bp, Homo sapiens
acagggattatgactgacagcc

SEQ ID NO: 7650616 - DNA, 18 bp, Homo sapiens
acagggagggcgctgggg

SEQ ID NO: 7650617 - DNA, 18 bp, Homo sapiens
acagggatggggtaagtg

SEQ ID NO: 7650618 - DNA, 18 bp, Homo sapiens
acagggatggggtaagtg

SEQ ID NO: 7650619 - DNA, 18 bp, Homo sapiens
acagggatggggtaagtg

SEQ ID NO: 7650620 - DNA, 22 bp, Homo sapiens
acaggtggaaacatggtgttgg

SEQ ID NO: 7650621 - DNA, 22 bp, Homo sapiens
acaggtgcatgctaccatgtct

SEQ ID NO: 7650622 - DNA, 22 bp, Homo sapiens
acagggttgtggccttaaaggc

SEQ ID NO: 7650623 - DNA, 22 bp, Homo sapiens
acagggttgtggccttaaaggc

SEQ ID NO: 7650624 - DNA, 22 bp, Homo sapiens
acagggttgtggccttaaaggc

SEQ ID NO: 7650625 - DNA, 22 bp, Homo sapiens
acaggtggacacagcagcagtc

SEQ ID NO: 7650626 - DNA, 22 bp, Homo sapiens
acaggtggacacagcagcagtc

SEQ ID NO: 7650627 - DNA, 22 bp, Homo sapiens
acaggtggacacagcagcagtc

SEQ ID NO: 7650628 - DNA, 22 bp, Homo sapiens
acagggttgaagagcataaagt

SEQ ID NO: 7650629 - DNA, 22 bp, Homo sapiens
acagggttgaagagcataaagt

SEQ ID NO: 7650630 - DNA, 22 bp, Homo sapiens
acagggttgaagagcataaagt

SEQ ID NO: 7650631 - DNA, 22 bp, Homo sapiens
acagggttgccaaatactaatt

SEQ ID NO: 7650632 - DNA, 22 bp, Homo sapiens
acagggttgccaaatactaatt

SEQ ID NO: 7650633 - DNA, 22 bp, Homo sapiens
acagggcacctgaggtaggaag

SEQ ID NO: 7650634 - DNA, 22 bp, Homo sapiens
acagggcacctgaggtaggaag

SEQ ID NO: 7650635 - DNA, 22 bp, Homo sapiens
acagggcacctgaggtaggaag

SEQ ID NO: 7650636 - DNA, 22 bp, Homo sapiens
acagggcacctgaggtaggaag

SEQ ID NO: 7650637 - DNA, 22 bp, Homo sapiens
acagggcacctgaggtaggaag

SEQ ID NO: 7650638 - DNA, 22 bp, Homo sapiens
acagggcacctgaggtaggaag

SEQ ID NO: 7650639 - DNA, 22 bp, Homo sapiens
acagggtggggatggtgagctt

SEQ ID NO: 7650640 - DNA, 22 bp, Homo sapiens
acaggtggaggctttaggaggt

SEQ ID NO: 7650641 - DNA, 22 bp, Homo sapiens
acaggtggacacagcagcagtc

SEQ ID NO: 7650642 - DNA, 22 bp, Homo sapiens
acaggtggacacagcagcagtc

SEQ ID NO: 7650643 - DNA, 22 bp, Homo sapiens
acaggtggagtggttagcaggc

SEQ ID NO: 7650644 - DNA, 22 bp, Homo sapiens
acaggtggcactgctgttactc

SEQ ID NO: 7650645 - DNA, 22 bp, Homo sapiens
acaggtggcactgctgttactc

SEQ ID NO: 7650646 - DNA, 22 bp, Homo sapiens
acaggtggcagaagcatttact

SEQ ID NO: 7650647 - DNA, 22 bp, Homo sapiens
acaggtggcataggcagtttga

SEQ ID NO: 7650648 - DNA, 19 bp, Homo sapiens
acagatggaggaatctggg

SEQ ID NO: 7650649 - DNA, 22 bp, Homo sapiens
acagatggagctactaggtaaa

SEQ ID NO: 7650650 - DNA, 22 bp, Homo sapiens
acagatggaggttattatgaac

SEQ ID NO: 7650651 - DNA, 22 bp, Homo sapiens
acagatggaggttattatgaac

SEQ ID NO: 7650652 - DNA, 22 bp, Homo sapiens
acagatggaggttattatgaac

SEQ ID NO: 7650653 - DNA, 22 bp, Homo sapiens
acagatggagctactaggtaaa

SEQ ID NO: 7650654 - DNA, 22 bp, Homo sapiens
acagatggagctactaggtaaa

SEQ ID NO: 7650655 - DNA, 22 bp, Homo sapiens
acagatggagctactaggtaaa

SEQ ID NO: 7650656 - DNA, 22 bp, Homo sapiens
acagatggccatattactatat

SEQ ID NO: 7650657 - DNA, 21 bp, Homo sapiens
acagatgggatgagcacactg

SEQ ID NO: 7650658 - DNA, 21 bp, Homo sapiens
acagatgggatgagcacactg

SEQ ID NO: 7650659 - DNA, 22 bp, Homo sapiens
acagatggccatattactatat

SEQ ID NO: 7650660 - DNA, 20 bp, Homo sapiens
acagatggcagttattacat

SEQ ID NO: 7650661 - DNA, 22 bp, Homo sapiens
acagatggcactttttaggact

SEQ ID NO: 7650662 - DNA, 22 bp, Homo sapiens
acagatggcacctttttgctgt

SEQ ID NO: 7650663 - DNA, 22 bp, Homo sapiens
acagatggggcacaaagccaca

SEQ ID NO: 7650664 - DNA, 21 bp, Homo sapiens
acagatgggatgagcacactg

SEQ ID NO: 7650665 - DNA, 22 bp, Homo sapiens
acagatggggcacaaagccaca

SEQ ID NO: 7650666 - DNA, 22 bp, Homo sapiens
acagatggtagcattatgttgg

SEQ ID NO: 7650667 - DNA, 22 bp, Homo sapiens
acagatggtgagccgctgatgt

SEQ ID NO: 7650668 - DNA, 22 bp, Homo sapiens
acagatggtagcattatgttgg

SEQ ID NO: 7650669 - DNA, 22 bp, Homo sapiens
acagatgtaatctattcacatt

SEQ ID NO: 7650670 - DNA, 22 bp, Homo sapiens
acagatggttattgtcatttct

SEQ ID NO: 7650671 - DNA, 22 bp, Homo sapiens
acagatgtaatctattcacatt

SEQ ID NO: 7650672 - DNA, 22 bp, Homo sapiens
acagatgttacagtatgatctc

SEQ ID NO: 7650673 - DNA, 22 bp, Homo sapiens
acagatgtggagtttgcatgat

SEQ ID NO: 7650674 - DNA, 22 bp, Homo sapiens
acagatgtggagtttgcatgat

SEQ ID NO: 7650675 - DNA, 22 bp, Homo sapiens
acagatgttagcaatgatgatg

SEQ ID NO: 7650676 - DNA, 22 bp, Homo sapiens
acagatgttacagtatgatctc

SEQ ID NO: 7650677 - DNA, 22 bp, Homo sapiens
acagatgttagcaatgatgatg

SEQ ID NO: 7650678 - DNA, 22 bp, Homo sapiens
acagatgttacagtatgatctc

SEQ ID NO: 7650679 - DNA, 22 bp, Homo sapiens
acagatgttgcttgtcattctc

SEQ ID NO: 7650680 - DNA, 21 bp, Homo sapiens
acagattagcacaatgcaggc

SEQ ID NO: 7650681 - DNA, 21 bp, Homo sapiens
acagattagcacaatgcaggc

SEQ ID NO: 7650682 - DNA, 21 bp, Homo sapiens
acagattagcacaatgcaggc

SEQ ID NO: 7650683 - DNA, 22 bp, Homo sapiens
acagatgtaccttagtgatggg

SEQ ID NO: 7650684 - DNA, 22 bp, Homo sapiens
acagatgtaccttagtgatggg

SEQ ID NO: 7650685 - DNA, 22 bp, Homo sapiens
acagatgtaccttagtgatggg

SEQ ID NO: 7650686 - DNA, 22 bp, Homo sapiens
acagatgtacactcatatataa

SEQ ID NO: 7650687 - DNA, 22 bp, Homo sapiens
acagatgtacactcatatataa

SEQ ID NO: 7650688 - DNA, 22 bp, Homo sapiens
acagatgtacactcatatataa

SEQ ID NO: 7650689 - DNA, 21 bp, Homo sapiens
acagatgtgatatgcagtctt

SEQ ID NO: 7650690 - DNA, 22 bp, Homo sapiens
acagatgtggagtttgcatgat

SEQ ID NO: 7650691 - DNA, 22 bp, Homo sapiens
acagatgtaccttagtgatggg

SEQ ID NO: 7650692 - DNA, 22 bp, Homo sapiens
acagattcactgcactggccat

SEQ ID NO: 7650693 - DNA, 22 bp, Homo sapiens
acagattcactgcactggccat

SEQ ID NO: 7650694 - DNA, 22 bp, Homo sapiens
acagattcactgcactggccat

SEQ ID NO: 7650695 - DNA, 22 bp, Homo sapiens
acagattcactgcactggccat

SEQ ID NO: 7650696 - DNA, 22 bp, Homo sapiens
acagattcactgcactggccat

SEQ ID NO: 7650697 - DNA, 22 bp, Homo sapiens
acagattcactgcactggccat

SEQ ID NO: 7650698 - DNA, 22 bp, Homo sapiens
acagattcactgcactggccat

SEQ ID NO: 7650699 - DNA, 22 bp, Homo sapiens
acagattcactgcactggccat

SEQ ID NO: 7650700 - DNA, 22 bp, Homo sapiens
acagattatggatatatgtgga

SEQ ID NO: 7650701 - DNA, 22 bp, Homo sapiens
acagattatggatatatgtgga

SEQ ID NO: 7650702 - DNA, 22 bp, Homo sapiens
acagattatggatatatgtgga

SEQ ID NO: 7650703 - DNA, 22 bp, Homo sapiens
acagattagctggggccattga

SEQ ID NO: 7650704 - DNA, 21 bp, Homo sapiens
acagattagcacaatgcaggc

SEQ ID NO: 7650705 - DNA, 22 bp, Homo sapiens
agctcccagagtcctctgccca

SEQ ID NO: 7650706 - DNA, 22 bp, Homo sapiens
agctcccagagctcgagagtaa

SEQ ID NO: 7650707 - DNA, 22 bp, Homo sapiens
agctcccagagctcgagagtaa

SEQ ID NO: 7650708 - DNA, 22 bp, Homo sapiens
agctcccagagctcgagagtaa

SEQ ID NO: 7650709 - DNA, 19 bp, Homo sapiens
agctcctgattgtgcctcg

SEQ ID NO: 7650710 - DNA, 19 bp, Homo sapiens
agctcctgattgtgcctcg

SEQ ID NO: 7650711 - DNA, 22 bp, Homo sapiens
acagcaatgagtaactccttgg

SEQ ID NO: 7650712 - DNA, 22 bp, Homo sapiens
acagcaattgtatgcatagcat

SEQ ID NO: 7650713 - DNA, 22 bp, Homo sapiens
acagcaattttgtgcacaagtg

SEQ ID NO: 7650714 - DNA, 22 bp, Homo sapiens
acagcaattttgtgcacaagtg

SEQ ID NO: 7650715 - DNA, 22 bp, Homo sapiens
acagcaattgtatgcatagcat

SEQ ID NO: 7650716 - DNA, 22 bp, Homo sapiens
acagcaattttgtgcacaagtg

SEQ ID NO: 7650717 - DNA, 22 bp, Homo sapiens
agctcctgctctttgtccctaa

SEQ ID NO: 7650718 - DNA, 22 bp, Homo sapiens
agctcctgcttgacagaagagg

SEQ ID NO: 7650719 - DNA, 22 bp, Homo sapiens
agctcctgcttgacagaagagg

SEQ ID NO: 7650720 - DNA, 22 bp, Homo sapiens
agctcctgcttgacagaagagg

SEQ ID NO: 7650721 - DNA, 22 bp, Homo sapiens
agctcctgcttgacagaagagg

SEQ ID NO: 7650722 - DNA, 22 bp, Homo sapiens
agctcctgcttgacagaagagg

SEQ ID NO: 7650723 - DNA, 22 bp, Homo sapiens
agctcctgctctttgtccctaa

SEQ ID NO: 7650724 - DNA, 22 bp, Homo sapiens
agctcctgctctttgtccctaa

SEQ ID NO: 7650725 - DNA, 22 bp, Homo sapiens
agctcctgctctttgtccctaa

SEQ ID NO: 7650726 - DNA, 22 bp, Homo sapiens
agctcctgctctttgtccctaa

SEQ ID NO: 7650727 - DNA, 22 bp, Homo sapiens
agctcctgcgcacggtgcacac

SEQ ID NO: 7650728 - DNA, 22 bp, Homo sapiens
agctcctgcgcacggtgcacac

SEQ ID NO: 7650729 - DNA, 22 bp, Homo sapiens
agctcctgcgcacggtgcacac

SEQ ID NO: 7650730 - DNA, 22 bp, Homo sapiens
agctcctgctctttgtccctaa

SEQ ID NO: 7650731 - DNA, 22 bp, Homo sapiens
agctcctgctctttgtccctaa

SEQ ID NO: 7650732 - DNA, 22 bp, Homo sapiens
agctcctgctctttgtccctaa

SEQ ID NO: 7650733 - DNA, 22 bp, Homo sapiens
acagcacagagtggtatggctg

SEQ ID NO: 7650734 - DNA, 22 bp, Homo sapiens
acagcacagagtggtatggctg

SEQ ID NO: 7650735 - DNA, 22 bp, Homo sapiens
acagcacagagtggtatggctg

SEQ ID NO: 7650736 - DNA, 19 bp, Homo sapiens
acagcacagaaatatttca

SEQ ID NO: 7650737 - DNA, 22 bp, Homo sapiens
acagcacagagtggtatggctg

SEQ ID NO: 7650738 - DNA, 22 bp, Homo sapiens
acagcacagagtggtatggctg

SEQ ID NO: 7650739 - DNA, 19 bp, Homo sapiens
acagcacagaaatatttca

SEQ ID NO: 7650740 - DNA, 19 bp, Homo sapiens
acagcacagaaatatttca

SEQ ID NO: 7650741 - DNA, 22 bp, Homo sapiens
acagcacaatctgagtcccaga

SEQ ID NO: 7650742 - DNA, 22 bp, Homo sapiens
acagcacaatctgagtcccaga

SEQ ID NO: 7650743 - DNA, 22 bp, Homo sapiens
acagcacaatctgagtcccaga

SEQ ID NO: 7650744 - DNA, 22 bp, Homo sapiens
acagcacaatctgagtcccaga

SEQ ID NO: 7650745 - DNA, 22 bp, Homo sapiens
acagcacaatctgagtcccaga

SEQ ID NO: 7650746 - DNA, 22 bp, Homo sapiens
acagcacaatctgagtcccaga

SEQ ID NO: 7650747 - DNA, 22 bp, Homo sapiens
acagcacaatctgagtcccaga

SEQ ID NO: 7650748 - DNA, 22 bp, Homo sapiens
acagcacaatctgagtcccaga

SEQ ID NO: 7650749 - DNA, 22 bp, Homo sapiens
acagcacaatctgagtcccaga

SEQ ID NO: 7650750 - DNA, 22 bp, Homo sapiens
agctcctgcccaggaaggctct

SEQ ID NO: 7650751 - DNA, 22 bp, Homo sapiens
agctcctgccaacactgatggg

SEQ ID NO: 7650752 - DNA, 22 bp, Homo sapiens
agctcctgccaacactgatggg

SEQ ID NO: 7650753 - DNA, 17 bp, Homo sapiens
agctcctgcccatggct

SEQ ID NO: 7650754 - DNA, 17 bp, Homo sapiens
agctcctgcccatggct

SEQ ID NO: 7650755 - DNA, 22 bp, Homo sapiens
agctcctgcccaggaaggctct

SEQ ID NO: 7650756 - DNA, 22 bp, Homo sapiens
agctcctgcccaggaaggctct

SEQ ID NO: 7650757 - DNA, 22 bp, Homo sapiens
agctcctgcccaggaaggctct

SEQ ID NO: 7650758 - DNA, 22 bp, Homo sapiens
agctcctgcgcacggtgcacac

SEQ ID NO: 7650759 - DNA, 22 bp, Homo sapiens
agctcctgcgcacggtgcacac

SEQ ID NO: 7650760 - DNA, 22 bp, Homo sapiens
agctcctgcgcacggtgcacac

SEQ ID NO: 7650761 - DNA, 22 bp, Homo sapiens
agctcctgcgcacggtgcacac

SEQ ID NO: 7650762 - DNA, 22 bp, Homo sapiens
agctcctgcgcacggtgcacac

SEQ ID NO: 7650763 - DNA, 22 bp, Homo sapiens
agctcctgcgcacggtgcacac

SEQ ID NO: 7650764 - DNA, 22 bp, Homo sapiens
agctcctgcgcacggtgcacac

SEQ ID NO: 7650765 - DNA, 17 bp, Homo sapiens
agctcctgcccatggct

SEQ ID NO: 7650766 - DNA, 17 bp, Homo sapiens
agctcctgcccatggct

SEQ ID NO: 7650767 - DNA, 17 bp, Homo sapiens
agctcctgcccatggct

SEQ ID NO: 7650768 - DNA, 17 bp, Homo sapiens
agctcctgcccatggct

SEQ ID NO: 7650769 - DNA, 22 bp, Homo sapiens
agctcctgcagactcctgctca

SEQ ID NO: 7650770 - DNA, 22 bp, Homo sapiens
agctcctgccaacactgatggg

SEQ ID NO: 7650771 - DNA, 22 bp, Homo sapiens
agctcctgccaacactgatggg

SEQ ID NO: 7650772 - DNA, 22 bp, Homo sapiens
agctcctgccaacactgatggg

SEQ ID NO: 7650773 - DNA, 22 bp, Homo sapiens
agctcctgcagactcctgctca

SEQ ID NO: 7650774 - DNA, 22 bp, Homo sapiens
agctcctgcagactcctgctca

SEQ ID NO: 7650775 - DNA, 22 bp, Homo sapiens
agctcctgcagactcctgctca

SEQ ID NO: 7650776 - DNA, 22 bp, Homo sapiens
agctcctgcagactcctgctca

SEQ ID NO: 7650777 - DNA, 22 bp, Homo sapiens
agctcctgcagactcctgctca

SEQ ID NO: 7650778 - DNA, 22 bp, Homo sapiens
agctcctgcagactcctgctca

SEQ ID NO: 7650779 - DNA, 22 bp, Homo sapiens
agctcctgcaccaggggcccct

SEQ ID NO: 7650780 - DNA, 22 bp, Homo sapiens
agctcctgcaccaggggcccct

SEQ ID NO: 7650781 - DNA, 19 bp, Homo sapiens
agctcctgattgtgcctcg

SEQ ID NO: 7650782 - DNA, 22 bp, Homo sapiens
agctcctgcaccaggggcccct

SEQ ID NO: 7650783 - DNA, 22 bp, Homo sapiens
agctcccagagtcctctgccca

SEQ ID NO: 7650784 - DNA, 19 bp, Homo sapiens
agctcctgattgtgcctcg

SEQ ID NO: 7650785 - DNA, 19 bp, Homo sapiens
agctcctgattgtgcctcg

SEQ ID NO: 7650786 - DNA, 22 bp, Homo sapiens
agctcctgcacccagccttgag

SEQ ID NO: 7650787 - DNA, 22 bp, Homo sapiens
agctcctgcacccagccttgag

SEQ ID NO: 7650788 - DNA, 22 bp, Homo sapiens
agctcctgcaccaggggcccct

SEQ ID NO: 7650789 - DNA, 22 bp, Homo sapiens
agctcctgcaccaggggcccct

SEQ ID NO: 7650790 - DNA, 22 bp, Homo sapiens
agctcctgcacccagccttgag

SEQ ID NO: 7650791 - DNA, 22 bp, Homo sapiens
agctcctgcaccaggggcccct

SEQ ID NO: 7650792 - DNA, 22 bp, Homo sapiens
agctcctgcacccagccttgag

SEQ ID NO: 7650793 - DNA, 22 bp, Homo sapiens
agctcctgcacccagccttgag

SEQ ID NO: 7650794 - DNA, 22 bp, Homo sapiens
acagagctgggatctgaaccca

SEQ ID NO: 7650795 - DNA, 22 bp, Homo sapiens
acagagctgggatctgaaccca

SEQ ID NO: 7650796 - DNA, 19 bp, Homo sapiens
acagagctctctgcttctg

SEQ ID NO: 7650797 - DNA, 19 bp, Homo sapiens
acagagctctctgcttctg

SEQ ID NO: 7650798 - DNA, 22 bp, Homo sapiens
acagagctgggtgccccctgga

SEQ ID NO: 7650799 - DNA, 22 bp, Homo sapiens
acagagctgggatctgaaccca

SEQ ID NO: 7650800 - DNA, 22 bp, Homo sapiens
acagagctgggatctgaaccca

SEQ ID NO: 7650801 - DNA, 20 bp, Homo sapiens
acagatatttgattttcagt

SEQ ID NO: 7650802 - DNA, 20 bp, Homo sapiens
acagatgaggatgcggaggc

SEQ ID NO: 7650803 - DNA, 22 bp, Homo sapiens
acagatatttggggaaagacgt

SEQ ID NO: 7650804 - DNA, 22 bp, Homo sapiens
acagagctgtacatgtgccatg

SEQ ID NO: 7650805 - DNA, 20 bp, Homo sapiens
acagatatttgattttcagt

SEQ ID NO: 7650806 - DNA, 21 bp, Homo sapiens
acagatatttcattgaacatt

SEQ ID NO: 7650807 - DNA, 22 bp, Homo sapiens
acagagctgtacatgtgccatg

SEQ ID NO: 7650808 - DNA, 22 bp, Homo sapiens
acagagctaaatttcaatccca

SEQ ID NO: 7650809 - DNA, 22 bp, Homo sapiens
acagagctaatgttgcataggc

SEQ ID NO: 7650810 - DNA, 22 bp, Homo sapiens
acagagctaatgttgcataggc

SEQ ID NO: 7650811 - DNA, 22 bp, Homo sapiens
acagagctaatgttgcataggc

SEQ ID NO: 7650812 - DNA, 22 bp, Homo sapiens
acagagctaatgttgcataggc

SEQ ID NO: 7650813 - DNA, 22 bp, Homo sapiens
acagagctaatgttgcataggc

SEQ ID NO: 7650814 - DNA, 22 bp, Homo sapiens
acagagctaatgttgcataggc

SEQ ID NO: 7650815 - DNA, 19 bp, Homo sapiens
acagagctctctgcttctg

SEQ ID NO: 7650816 - DNA, 22 bp, Homo sapiens
acagagctaatgttgcataggc

SEQ ID NO: 7650817 - DNA, 17 bp, Homo sapiens
acagagctacatattct

SEQ ID NO: 7650818 - DNA, 17 bp, Homo sapiens
acagagctacatattct

SEQ ID NO: 7650819 - DNA, 22 bp, Homo sapiens
acagagctcccagccatctcct

SEQ ID NO: 7650820 - DNA, 22 bp, Homo sapiens
acagagctcccagccatctcct

SEQ ID NO: 7650821 - DNA, 17 bp, Homo sapiens
acagagctacatattct

SEQ ID NO: 7650822 - DNA, 22 bp, Homo sapiens
acagatgagttagaataggcag

SEQ ID NO: 7650823 - DNA, 22 bp, Homo sapiens
acagatgagttagaataggcag

SEQ ID NO: 7650824 - DNA, 22 bp, Homo sapiens
acagatgatgtgcacagataga

SEQ ID NO: 7650825 - DNA, 22 bp, Homo sapiens
acagatgatgtgcacagataga

SEQ ID NO: 7650826 - DNA, 22 bp, Homo sapiens
acagatgagttagaataggcag

SEQ ID NO: 7650827 - DNA, 22 bp, Homo sapiens
acagatgagttaaagcagagtg

SEQ ID NO: 7650828 - DNA, 22 bp, Homo sapiens
acagatgagttaaagcagagtg

SEQ ID NO: 7650829 - DNA, 22 bp, Homo sapiens
acagatgaggctggcgagggca

SEQ ID NO: 7650830 - DNA, 22 bp, Homo sapiens
acagatgaggctggcgagggca

SEQ ID NO: 7650831 - DNA, 22 bp, Homo sapiens
acagatgaggctggcgagggca

SEQ ID NO: 7650832 - DNA, 22 bp, Homo sapiens
acagatgaggcccatcagtctg

SEQ ID NO: 7650833 - DNA, 22 bp, Homo sapiens
acagatgaggcccatcagtctg

SEQ ID NO: 7650834 - DNA, 22 bp, Homo sapiens
acagatgaggctggcgagggca

SEQ ID NO: 7650835 - DNA, 22 bp, Homo sapiens
acagatgagttaaagcagagtg

SEQ ID NO: 7650836 - DNA, 22 bp, Homo sapiens
acagatgaggtgtttggagagc

SEQ ID NO: 7650837 - DNA, 22 bp, Homo sapiens
acagatgcaaggaaatgattgc

SEQ ID NO: 7650838 - DNA, 22 bp, Homo sapiens
acagatgatttttatgaaaaca

SEQ ID NO: 7650839 - DNA, 22 bp, Homo sapiens
acagatgatgtgcacagataga

SEQ ID NO: 7650840 - DNA, 22 bp, Homo sapiens
acagatgatgtgcacagataga

SEQ ID NO: 7650841 - DNA, 22 bp, Homo sapiens
acagatgatgtgcacagataga

SEQ ID NO: 7650842 - DNA, 22 bp, Homo sapiens
acagatgatttttatgaaaaca

SEQ ID NO: 7650843 - DNA, 22 bp, Homo sapiens
acagatgatttttatgaaaaca

SEQ ID NO: 7650844 - DNA, 22 bp, Homo sapiens
acagatgatgtgcacagataga

SEQ ID NO: 7650845 - DNA, 22 bp, Homo sapiens
acagatgatttttatgaaaaca

SEQ ID NO: 7650846 - DNA, 22 bp, Homo sapiens
acagatgatttttatgaaaaca

SEQ ID NO: 7650847 - DNA, 22 bp, Homo sapiens
agcctctgatggctcccaagga

SEQ ID NO: 7650848 - DNA, 22 bp, Homo sapiens
agcctctgatggctcccaagga

SEQ ID NO: 7650849 - DNA, 22 bp, Homo sapiens
agcctctgatgatcacaggggg

SEQ ID NO: 7650850 - DNA, 22 bp, Homo sapiens
agcctctgatgatcacaggggg

SEQ ID NO: 7650851 - DNA, 22 bp, Homo sapiens
agcctctgatgatcacaggggg

SEQ ID NO: 7650852 - DNA, 22 bp, Homo sapiens
agcctctgatgatcacaggggg

SEQ ID NO: 7650853 - DNA, 22 bp, Homo sapiens
agcctctgatgatcacaggggg

SEQ ID NO: 7650854 - DNA, 22 bp, Homo sapiens
agcctctgactgtcagcaaggt

SEQ ID NO: 7650855 - DNA, 22 bp, Homo sapiens
agcctctctttattcccagcta

SEQ ID NO: 7650856 - DNA, 22 bp, Homo sapiens
agcctctctttattcccagcta

SEQ ID NO: 7650857 - DNA, 22 bp, Homo sapiens
agcctctctttctggtggctaa

SEQ ID NO: 7650858 - DNA, 22 bp, Homo sapiens
agcctctctttattcccagcta

SEQ ID NO: 7650859 - DNA, 22 bp, Homo sapiens
agcctctgactgtcagcaaggt

SEQ ID NO: 7650860 - DNA, 22 bp, Homo sapiens
agcctctctttctggtggctaa

SEQ ID NO: 7650861 - DNA, 22 bp, Homo sapiens
agcctctgactgtcagcaaggt

SEQ ID NO: 7650862 - DNA, 22 bp, Homo sapiens
agcctctgactgtcagcaaggt

SEQ ID NO: 7650863 - DNA, 21 bp, Homo sapiens
acagagccgggcacaaagctg

SEQ ID NO: 7650864 - DNA, 22 bp, Homo sapiens
acagagcctccaggagtgctgg

SEQ ID NO: 7650865 - DNA, 22 bp, Homo sapiens
acagagccactttggtgcctac

SEQ ID NO: 7650866 - DNA, 22 bp, Homo sapiens
acagagcccttccttgcaccat

SEQ ID NO: 7650867 - DNA, 22 bp, Homo sapiens
agcctctgatggctcccaagga

SEQ ID NO: 7650868 - DNA, 22 bp, Homo sapiens
agcctctgatggctcccaagga

SEQ ID NO: 7650869 - DNA, 22 bp, Homo sapiens
agcctctgatggctcccaagga

SEQ ID NO: 7650870 - DNA, 22 bp, Homo sapiens
acagagcatttgggacagagag

SEQ ID NO: 7650871 - DNA, 22 bp, Homo sapiens
acagagccaaaaggacatagta

SEQ ID NO: 7650872 - DNA, 22 bp, Homo sapiens
acagagccaaaaggacatagta

SEQ ID NO: 7650873 - DNA, 22 bp, Homo sapiens
acagagccactttggtgcctac

SEQ ID NO: 7650874 - DNA, 22 bp, Homo sapiens
agccctgtttatgccacatcat

SEQ ID NO: 7650875 - DNA, 22 bp, Homo sapiens
agccctgtttatgccacatcat

SEQ ID NO: 7650876 - DNA, 20 bp, Homo sapiens
agccctgtttcctggagaga

SEQ ID NO: 7650877 - DNA, 22 bp, Homo sapiens
agccctgtttatgccacatcat

SEQ ID NO: 7650878 - DNA, 22 bp, Homo sapiens
agccctgtttatgccacatcat

SEQ ID NO: 7650879 - DNA, 22 bp, Homo sapiens
agccctgttctgttttagtagc

SEQ ID NO: 7650880 - DNA, 22 bp, Homo sapiens
acagagagctgtgattgagtta

SEQ ID NO: 7650881 - DNA, 22 bp, Homo sapiens
agccctgttgtctgatgatggg

SEQ ID NO: 7650882 - DNA, 22 bp, Homo sapiens
agccctgttgtctgatgatggg

SEQ ID NO: 7650883 - DNA, 20 bp, Homo sapiens
agccctgtttcctggagaga

SEQ ID NO: 7650884 - DNA, 20 bp, Homo sapiens
agccctgtttcctggagaga

SEQ ID NO: 7650885 - DNA, 22 bp, Homo sapiens
agcctcctgtagccctcaccca

SEQ ID NO: 7650886 - DNA, 22 bp, Homo sapiens
agcctcctgtagccctcaccca

SEQ ID NO: 7650887 - DNA, 22 bp, Homo sapiens
agcctcctgtagccctcaccca

SEQ ID NO: 7650888 - DNA, 22 bp, Homo sapiens
agcctcctgtagccctcaccca

SEQ ID NO: 7650889 - DNA, 22 bp, Homo sapiens
agcctctcactgtcaccctccc

SEQ ID NO: 7650890 - DNA, 22 bp, Homo sapiens
agcctctcaaagaaaccctgta

SEQ ID NO: 7650891 - DNA, 22 bp, Homo sapiens
agcctctcactgtcaccctccc

SEQ ID NO: 7650892 - DNA, 22 bp, Homo sapiens
agcctctcactgtcaccctccc

SEQ ID NO: 7650893 - DNA, 22 bp, Homo sapiens
agcctctctgttagtcactggg

SEQ ID NO: 7650894 - DNA, 22 bp, Homo sapiens
agcctctctgatgtgacagcta

SEQ ID NO: 7650895 - DNA, 22 bp, Homo sapiens
agcctctctccagcttggcaga

SEQ ID NO: 7650896 - DNA, 22 bp, Homo sapiens
agcctctctccagcttggcaga

SEQ ID NO: 7650897 - DNA, 22 bp, Homo sapiens
agcctctctgttagtcactggg

SEQ ID NO: 7650898 - DNA, 22 bp, Homo sapiens
agcctctcttatcccttcaaag

SEQ ID NO: 7650899 - DNA, 22 bp, Homo sapiens
agcctctcttatcccttcaaag

SEQ ID NO: 7650900 - DNA, 22 bp, Homo sapiens
agcctctcagagtgctgggatt

SEQ ID NO: 7650901 - DNA, 22 bp, Homo sapiens
agcctctcatgttctcccccag

SEQ ID NO: 7650902 - DNA, 22 bp, Homo sapiens
agcctctcagagtgctgggatt

SEQ ID NO: 7650903 - DNA, 22 bp, Homo sapiens
agcctctcatgttctcccccag

SEQ ID NO: 7650904 - DNA, 22 bp, Homo sapiens
agcctctccagagcctggcaga

SEQ ID NO: 7650905 - DNA, 22 bp, Homo sapiens
agcctctccagagcctggcaga

SEQ ID NO: 7650906 - DNA, 22 bp, Homo sapiens
agcctctccagagcctggcaga

SEQ ID NO: 7650907 - DNA, 22 bp, Homo sapiens
agcctctctccagcttggcaga

SEQ ID NO: 7650908 - DNA, 22 bp, Homo sapiens
acagagaaagttcctctcaggc

SEQ ID NO: 7650909 - DNA, 22 bp, Homo sapiens
acagagaaagtgggctgaagat

SEQ ID NO: 7650910 - DNA, 22 bp, Homo sapiens
acagagaaagttcctctcaggc

SEQ ID NO: 7650911 - DNA, 22 bp, Homo sapiens
acagagaaagtgggctgaagat

SEQ ID NO: 7650912 - DNA, 22 bp, Homo sapiens
acagagaaagtgggctgaagat

SEQ ID NO: 7650913 - DNA, 22 bp, Homo sapiens
acagagaaagttcctctcaggc

SEQ ID NO: 7650914 - DNA, 22 bp, Homo sapiens
acagagaaagttcctctcaggc

SEQ ID NO: 7650915 - DNA, 22 bp, Homo sapiens
acagagaaagttcctctcaggc

SEQ ID NO: 7650916 - DNA, 22 bp, Homo sapiens
acagagaaagttcctctcaggc

SEQ ID NO: 7650917 - DNA, 23 bp, Homo sapiens
acagagacaatggtttcatcttg

SEQ ID NO: 7650918 - DNA, 22 bp, Homo sapiens
acagagacacggaagctaaaga

SEQ ID NO: 7650919 - DNA, 22 bp, Homo sapiens
acagagacacggaagctaaaga

SEQ ID NO: 7650920 - DNA, 22 bp, Homo sapiens
acagagacacggaagctaaaga

SEQ ID NO: 7650921 - DNA, 23 bp, Homo sapiens
acagagacaatggtttcatcttg

SEQ ID NO: 7650922 - DNA, 23 bp, Homo sapiens
acagagacaatggtttcatcttg

SEQ ID NO: 7650923 - DNA, 23 bp, Homo sapiens
acagagacaatggtttcatcttg

SEQ ID NO: 7650924 - DNA, 23 bp, Homo sapiens
acagagacaatggtttcatcttg

SEQ ID NO: 7650925 - DNA, 22 bp, Homo sapiens
acagagacaaatgttagtagtt

SEQ ID NO: 7650926 - DNA, 22 bp, Homo sapiens
acagagacaaatgttagtagtt

SEQ ID NO: 7650927 - DNA, 22 bp, Homo sapiens
acagagacaaatgttagtagtt

SEQ ID NO: 7650928 - DNA, 22 bp, Homo sapiens
acagagacaaatgttagtagtt

SEQ ID NO: 7650929 - DNA, 22 bp, Homo sapiens
acagagacaatatttgtaaagt

SEQ ID NO: 7650930 - DNA, 22 bp, Homo sapiens
acagagaaagttcctctcaggc

SEQ ID NO: 7650931 - DNA, 22 bp, Homo sapiens
acagagacaatatttgtaaagt

SEQ ID NO: 7650932 - DNA, 23 bp, Homo sapiens
acagagacaatggtttcatcttg

SEQ ID NO: 7650933 - DNA, 23 bp, Homo sapiens
acagagacaatggtttcatcttg

SEQ ID NO: 7650934 - DNA, 22 bp, Homo sapiens
acagagactaagcttttcatca

SEQ ID NO: 7650935 - DNA, 22 bp, Homo sapiens
acagagacctggccttgctttg

SEQ ID NO: 7650936 - DNA, 22 bp, Homo sapiens
acagagactaagcttttcatca

SEQ ID NO: 7650937 - DNA, 22 bp, Homo sapiens
acagagactaagcttttcatca

SEQ ID NO: 7650938 - DNA, 22 bp, Homo sapiens
acagagactaagcttttcatca

SEQ ID NO: 7650939 - DNA, 22 bp, Homo sapiens
acagagactaagcttttcatca

SEQ ID NO: 7650940 - DNA, 22 bp, Homo sapiens
acagagactaagcttttcatca

SEQ ID NO: 7650941 - DNA, 22 bp, Homo sapiens
acagagactcatgaaagatgac

SEQ ID NO: 7650942 - DNA, 22 bp, Homo sapiens
acagagactcatgaaagatgac

SEQ ID NO: 7650943 - DNA, 22 bp, Homo sapiens
acagagacctggccttgctttg

SEQ ID NO: 7650944 - DNA, 22 bp, Homo sapiens
acagagacctggccttgctttg

SEQ ID NO: 7650945 - DNA, 22 bp, Homo sapiens
acagagaccagttacagcgtcc

SEQ ID NO: 7650946 - DNA, 22 bp, Homo sapiens
acagagaccagttacagcgtcc

SEQ ID NO: 7650947 - DNA, 22 bp, Homo sapiens
acagagaccagttacagcgtcc

SEQ ID NO: 7650948 - DNA, 22 bp, Homo sapiens
acagagaccagttacagcgtcc

SEQ ID NO: 7650949 - DNA, 22 bp, Homo sapiens
acagagaccagcatcttctgcc

SEQ ID NO: 7650950 - DNA, 22 bp, Homo sapiens
acagagaccagcatcttctgcc

SEQ ID NO: 7650951 - DNA, 22 bp, Homo sapiens
acagagaccagcatcttctgcc

SEQ ID NO: 7650952 - DNA, 22 bp, Homo sapiens
acagagaccagcatcttctgcc

SEQ ID NO: 7650953 - DNA, 22 bp, Homo sapiens
acagagacaggcagacagtctt

SEQ ID NO: 7650954 - DNA, 22 bp, Homo sapiens
acagagacaggcagacagtctt

SEQ ID NO: 7650955 - DNA, 22 bp, Homo sapiens
acagagagctgtgattgagtta

SEQ ID NO: 7650956 - DNA, 22 bp, Homo sapiens
acagagagaggcccgaggctgc

SEQ ID NO: 7650957 - DNA, 22 bp, Homo sapiens
acagagagctgtgattgagtta

SEQ ID NO: 7650958 - DNA, 22 bp, Homo sapiens
acagagagctgtgattgagtta

SEQ ID NO: 7650959 - DNA, 22 bp, Homo sapiens
acagagagaattgggtttacag

SEQ ID NO: 7650960 - DNA, 22 bp, Homo sapiens
acagagagaggcccgaggctgc

SEQ ID NO: 7650961 - DNA, 22 bp, Homo sapiens
acagagagaggcccgaggctgc

SEQ ID NO: 7650962 - DNA, 22 bp, Homo sapiens
acagagagaggcccgaggctgc

SEQ ID NO: 7650963 - DNA, 22 bp, Homo sapiens
acagagagaggcccgaggctgc

SEQ ID NO: 7650964 - DNA, 22 bp, Homo sapiens
acagagagaggcccgaggctgc

SEQ ID NO: 7650965 - DNA, 22 bp, Homo sapiens
acagagagaaacaatcagcagc

SEQ ID NO: 7650966 - DNA, 22 bp, Homo sapiens
acagagagaaacaatcagcagc

SEQ ID NO: 7650967 - DNA, 22 bp, Homo sapiens
acagagagaattgggtttacag

SEQ ID NO: 7650968 - DNA, 22 bp, Homo sapiens
acagagagaattgggtttacag

SEQ ID NO: 7650969 - DNA, 22 bp, Homo sapiens
acagagagaattgggtttacag

SEQ ID NO: 7650970 - DNA, 22 bp, Homo sapiens
acagagagaaacaatcagcagc

SEQ ID NO: 7650971 - DNA, 22 bp, Homo sapiens
acagagagaaacaatcagcagc

SEQ ID NO: 7650972 - DNA, 22 bp, Homo sapiens
acagagagaaacaatcagcagc

SEQ ID NO: 7650973 - DNA, 22 bp, Homo sapiens
acagagacttggagcaggctga

SEQ ID NO: 7650974 - DNA, 22 bp, Homo sapiens
acagagactgggagcaagaggc

SEQ ID NO: 7650975 - DNA, 22 bp, Homo sapiens
acagagactgggagcaagaggc

SEQ ID NO: 7650976 - DNA, 22 bp, Homo sapiens
acagagactgggagcaagaggc

SEQ ID NO: 7650977 - DNA, 22 bp, Homo sapiens
acagagactgggagcaagaggc

SEQ ID NO: 7650978 - DNA, 22 bp, Homo sapiens
acagagactgggagcaagaggc

SEQ ID NO: 7650979 - DNA, 23 bp, Homo sapiens
acagagactgccaagatattctc

SEQ ID NO: 7650980 - DNA, 23 bp, Homo sapiens
acagagactgccaagatattctc

SEQ ID NO: 7650981 - DNA, 23 bp, Homo sapiens
acagagactgccaagatattctc

SEQ ID NO: 7650982 - DNA, 20 bp, Homo sapiens
acagagactgagacacttgc

SEQ ID NO: 7650983 - DNA, 20 bp, Homo sapiens
acagagactgagacacttgc

SEQ ID NO: 7650984 - DNA, 20 bp, Homo sapiens
acagagactgagacacttgc

SEQ ID NO: 7650985 - DNA, 22 bp, Homo sapiens
acagagacttggagcaggctga

SEQ ID NO: 7650986 - DNA, 22 bp, Homo sapiens
acagagacttggagcaggctga

SEQ ID NO: 7650987 - DNA, 22 bp, Homo sapiens
acagagacttggagcaggctga

SEQ ID NO: 7650988 - DNA, 22 bp, Homo sapiens
acagagactgggatgcctgcct

SEQ ID NO: 7650989 - DNA, 22 bp, Homo sapiens
acagagactgggatgcctgcct

SEQ ID NO: 7650990 - DNA, 22 bp, Homo sapiens
acagagactgggagcaagaggc

SEQ ID NO: 7650991 - DNA, 22 bp, Homo sapiens
acagagactgggagcaagaggc

SEQ ID NO: 7650992 - DNA, 22 bp, Homo sapiens
acagagactgggagcaagaggc

SEQ ID NO: 7650993 - DNA, 21 bp, Homo sapiens
acagagaaagagcagcctcct

SEQ ID NO: 7650994 - DNA, 21 bp, Homo sapiens
acagagaaagagcagcctcct

SEQ ID NO: 7650995 - DNA, 21 bp, Homo sapiens
acagagaaagagcagcctcct

SEQ ID NO: 7650996 - DNA, 21 bp, Homo sapiens
acagagaaagagcagcctcct

SEQ ID NO: 7650997 - DNA, 22 bp, Homo sapiens
acagagaaagtgggctgaagat

SEQ ID NO: 7650998 - DNA, 22 bp, Homo sapiens
acagagaaagtgggctgaagat

SEQ ID NO: 7650999 - DNA, 22 bp, Homo sapiens
acagagaaagtgggctgaagat

SEQ ID NO: 7651000 - DNA, 22 bp, Homo sapiens
acagagaaagtgggctgaagat

SEQ ID NO: 7651001 - DNA, 21 bp, Homo sapiens
acagagaaagagcagcctcct

SEQ ID NO: 7651002 - DNA, 22 bp, Homo sapiens
acagagaaagtgggctgaagat

SEQ ID NO: 7651003 - DNA, 22 bp, Homo sapiens
acagagaaagtgggctgaagat

SEQ ID NO: 7651004 - DNA, 22 bp, Homo sapiens
acagagaaagtgggctgaagat

SEQ ID NO: 7651005 - DNA, 22 bp, Homo sapiens
acagagaaactaaggagtttgg

SEQ ID NO: 7651006 - DNA, 22 bp, Homo sapiens
acagagaaactaaggagtttgg

SEQ ID NO: 7651007 - DNA, 21 bp, Homo sapiens
acagagaaagagcagcctcct

SEQ ID NO: 7651008 - DNA, 21 bp, Homo sapiens
acagagaaagagcagcctcct

SEQ ID NO: 7651009 - DNA, 22 bp, Homo sapiens
acagactgtttggttcatgtct

SEQ ID NO: 7651010 - DNA, 22 bp, Homo sapiens
acagacttgttccctagtgagt

SEQ ID NO: 7651011 - DNA, 22 bp, Homo sapiens
acagacttgttccctagtgagt

SEQ ID NO: 7651012 - DNA, 22 bp, Homo sapiens
acagactgtttggttcatgtct

SEQ ID NO: 7651013 - DNA, 22 bp, Homo sapiens
acagactgtgagtctcattttc

SEQ ID NO: 7651014 - DNA, 22 bp, Homo sapiens
acagactgttggcctactgagc

SEQ ID NO: 7651015 - DNA, 22 bp, Homo sapiens
acagactgttggcctactgagc

SEQ ID NO: 7651016 - DNA, 22 bp, Homo sapiens
acagactgtgagtatgcatagt

SEQ ID NO: 7651017 - DNA, 22 bp, Homo sapiens
acagactgtgagtctcattttc

SEQ ID NO: 7651018 - DNA, 22 bp, Homo sapiens
acagactgtttggttcatgtct

SEQ ID NO: 7651019 - DNA, 22 bp, Homo sapiens
acagactgtttggttcatgtct

SEQ ID NO: 7651020 - DNA, 23 bp, Homo sapiens
acagacattccataatgtacacc

SEQ ID NO: 7651021 - DNA, 23 bp, Homo sapiens
acagacattccataatgtacacc

SEQ ID NO: 7651022 - DNA, 23 bp, Homo sapiens
acagacattccataatgtacacc

SEQ ID NO: 7651023 - DNA, 23 bp, Homo sapiens
acagacattccataatgtacacc

SEQ ID NO: 7651024 - DNA, 22 bp, Homo sapiens
acagacattcatatcctcggta

SEQ ID NO: 7651025 - DNA, 21 bp, Homo sapiens
agccagggtggacactgtatg

SEQ ID NO: 7651026 - DNA, 21 bp, Homo sapiens
agccagggtggacactgtatg

SEQ ID NO: 7651027 - DNA, 22 bp, Homo sapiens
acagacattcagctaagtctat

SEQ ID NO: 7651028 - DNA, 22 bp, Homo sapiens
acagacattcagctaagtctat

SEQ ID NO: 7651029 - DNA, 22 bp, Homo sapiens
acagacattcagctaagtctat

SEQ ID NO: 7651030 - DNA, 22 bp, Homo sapiens
acagactgtcatgacactatat

SEQ ID NO: 7651031 - DNA, 22 bp, Homo sapiens
acagactgtcccaccacatgga

SEQ ID NO: 7651032 - DNA, 22 bp, Homo sapiens
acagactgtcccaccacatgga

SEQ ID NO: 7651033 - DNA, 22 bp, Homo sapiens
acagactgtcccaccacatgga

SEQ ID NO: 7651034 - DNA, 22 bp, Homo sapiens
acagactgtgagtatgcatagt

SEQ ID NO: 7651035 - DNA, 22 bp, Homo sapiens
acagactgtgagtatgcatagt

SEQ ID NO: 7651036 - DNA, 22 bp, Homo sapiens
acagactgtgagtatgcatagt

SEQ ID NO: 7651037 - DNA, 22 bp, Homo sapiens
acagactgtgagtatgcatagt

SEQ ID NO: 7651038 - DNA, 22 bp, Homo sapiens
acagactgtgagtatgcatagt

SEQ ID NO: 7651039 - DNA, 19 bp, Homo sapiens
agccagggtgagaaggagc

SEQ ID NO: 7651040 - DNA, 22 bp, Homo sapiens
agccagggtgagagggctttgt

SEQ ID NO: 7651041 - DNA, 19 bp, Homo sapiens
agccagggtgagaaggagc

SEQ ID NO: 7651042 - DNA, 19 bp, Homo sapiens
agccagggtgagaaggagc

SEQ ID NO: 7651043 - DNA, 19 bp, Homo sapiens
agccagggtgagaaggagc

SEQ ID NO: 7651044 - DNA, 19 bp, Homo sapiens
agccagggtgagaaggagc

SEQ ID NO: 7651045 - DNA, 19 bp, Homo sapiens
agccagggtgagaaggagc

SEQ ID NO: 7651046 - DNA, 19 bp, Homo sapiens
agccagggtgagaaggagc

SEQ ID NO: 7651047 - DNA, 19 bp, Homo sapiens
agccagggtgagaaggagc

SEQ ID NO: 7651048 - DNA, 19 bp, Homo sapiens
agccagggtgagaaggagc

SEQ ID NO: 7651049 - DNA, 22 bp, Homo sapiens
agccagggtctctcgctctgtt

SEQ ID NO: 7651050 - DNA, 22 bp, Homo sapiens
agccagggtctctcgctctgtt

SEQ ID NO: 7651051 - DNA, 22 bp, Homo sapiens
agccagggtctctcgctctgtt

SEQ ID NO: 7651052 - DNA, 22 bp, Homo sapiens
agccagggtaaggtacttagta

SEQ ID NO: 7651053 - DNA, 22 bp, Homo sapiens
agccagggtaaggtacttagta

SEQ ID NO: 7651054 - DNA, 22 bp, Homo sapiens
agccagggggacgctttctggc

SEQ ID NO: 7651055 - DNA, 22 bp, Homo sapiens
agccagggggacgctttctggc

SEQ ID NO: 7651056 - DNA, 19 bp, Homo sapiens
agccagggtccagacatgt

SEQ ID NO: 7651057 - DNA, 19 bp, Homo sapiens
agccagggtccagacatgt

SEQ ID NO: 7651058 - DNA, 22 bp, Homo sapiens
agccagggggacgctttctggc

SEQ ID NO: 7651059 - DNA, 22 bp, Homo sapiens
agccagggtaaggtacttagta

SEQ ID NO: 7651060 - DNA, 22 bp, Homo sapiens
agccagggtctctcgctctgtt

SEQ ID NO: 7651061 - DNA, 22 bp, Homo sapiens
agccagggtctctcgctctgtt

SEQ ID NO: 7651062 - DNA, 22 bp, Homo sapiens
agccagggtctctcgctctgtt

SEQ ID NO: 7651063 - DNA, 22 bp, Homo sapiens
agccagggtctctcgctctgtt

SEQ ID NO: 7651064 - DNA, 19 bp, Homo sapiens
agccagggtccagacatgt

SEQ ID NO: 7651065 - DNA, 19 bp, Homo sapiens
agccagggtccagacatgt

SEQ ID NO: 7651066 - DNA, 19 bp, Homo sapiens
agccagggtccagacatgt

SEQ ID NO: 7651067 - DNA, 19 bp, Homo sapiens
agccagggtccagacatgt

SEQ ID NO: 7651068 - DNA, 19 bp, Homo sapiens
agccagggtccagacatgt

SEQ ID NO: 7651069 - DNA, 19 bp, Homo sapiens
agccagggtccagacatgt

SEQ ID NO: 7651070 - DNA, 22 bp, Homo sapiens
acagacagaggctccatgagga

SEQ ID NO: 7651071 - DNA, 22 bp, Homo sapiens
acagacagaggctccatgagga

SEQ ID NO: 7651072 - DNA, 22 bp, Homo sapiens
acagacagacagattgcatatg

SEQ ID NO: 7651073 - DNA, 22 bp, Homo sapiens
acagacagacagattgcatatg

SEQ ID NO: 7651074 - DNA, 22 bp, Homo sapiens
acagacagacagattgcatatg

SEQ ID NO: 7651075 - DNA, 22 bp, Homo sapiens
acagacagacagagaactattc

SEQ ID NO: 7651076 - DNA, 22 bp, Homo sapiens
acagacagacagagaactattc

SEQ ID NO: 7651077 - DNA, 22 bp, Homo sapiens
acagacagacagattgcatatg

SEQ ID NO: 7651078 - DNA, 22 bp, Homo sapiens
acagacagacagattgcatatg

SEQ ID NO: 7651079 - DNA, 18 bp, Homo sapiens
acagacacttagtatgag

SEQ ID NO: 7651080 - DNA, 22 bp, Homo sapiens
acagacagacagagaactattc

SEQ ID NO: 7651081 - DNA, 22 bp, Homo sapiens
acagacagacagagaactattc

SEQ ID NO: 7651082 - DNA, 22 bp, Homo sapiens
acagacactgcactcccacctt

SEQ ID NO: 7651083 - DNA, 22 bp, Homo sapiens
acagacactgcactcccacctt

SEQ ID NO: 7651084 - DNA, 22 bp, Homo sapiens
acagacacaggcgtggagtcgc

SEQ ID NO: 7651085 - DNA, 22 bp, Homo sapiens
acagacactgcactcccacctt

SEQ ID NO: 7651086 - DNA, 18 bp, Homo sapiens
acagacacttagtatgag

SEQ ID NO: 7651087 - DNA, 18 bp, Homo sapiens
acagacacttagtatgag

SEQ ID NO: 7651088 - DNA, 22 bp, Homo sapiens
acagacagaggctccatgagga

SEQ ID NO: 7651089 - DNA, 22 bp, Homo sapiens
acagacagaggctccatgagga

SEQ ID NO: 7651090 - DNA, 22 bp, Homo sapiens
acagacagattttgtctgatgt

SEQ ID NO: 7651091 - DNA, 22 bp, Homo sapiens
acagacagattttgtctgatgt

SEQ ID NO: 7651092 - DNA, 22 bp, Homo sapiens
acagacagattttgtctgatgt

SEQ ID NO: 7651093 - DNA, 22 bp, Homo sapiens
agccagggggacgctttctggc

SEQ ID NO: 7651094 - DNA, 22 bp, Homo sapiens
agccaggggattcatcagggac

SEQ ID NO: 7651095 - DNA, 22 bp, Homo sapiens
acagacagggcacctgcctcct

SEQ ID NO: 7651096 - DNA, 22 bp, Homo sapiens
acagacagggcacctgcctcct

SEQ ID NO: 7651097 - DNA, 22 bp, Homo sapiens
agccaggggattcatcagggac

SEQ ID NO: 7651098 - DNA, 22 bp, Homo sapiens
agccaggggattcatcagggac

SEQ ID NO: 7651099 - DNA, 22 bp, Homo sapiens
agccaggggattcatcagggac

SEQ ID NO: 7651100 - DNA, 22 bp, Homo sapiens
acagaaagataggcacaaggtc

SEQ ID NO: 7651101 - DNA, 22 bp, Homo sapiens
acagaaagataggcacaaggtc

SEQ ID NO: 7651102 - DNA, 22 bp, Homo sapiens
acagaaagataggcacaaggtc

SEQ ID NO: 7651103 - DNA, 22 bp, Homo sapiens
acagaaagataggcacaaggtc

SEQ ID NO: 7651104 - DNA, 22 bp, Homo sapiens
acagaaagataggcacaaggtc

SEQ ID NO: 7651105 - DNA, 22 bp, Homo sapiens
acagaaagataggcacaaggtc

SEQ ID NO: 7651106 - DNA, 22 bp, Homo sapiens
acagaattaatgaaaattacaa

SEQ ID NO: 7651107 - DNA, 22 bp, Homo sapiens
acagaattaatgaaaattacaa

SEQ ID NO: 7651108 - DNA, 22 bp, Homo sapiens
acagaattaatgaaaattacaa

SEQ ID NO: 7651109 - DNA, 22 bp, Homo sapiens
acagaattaatgaaaattacaa

SEQ ID NO: 7651110 - DNA, 22 bp, Homo sapiens
acagaattaatgaaaattacaa

SEQ ID NO: 7651111 - DNA, 22 bp, Homo sapiens
acagaattaatgaaaattacaa

SEQ ID NO: 7651112 - DNA, 22 bp, Homo sapiens
acagaattaatgaaaattacaa

SEQ ID NO: 7651113 - DNA, 20 bp, Homo sapiens
acagaaagagagaatgtcag

SEQ ID NO: 7651114 - DNA, 20 bp, Homo sapiens
acagaaagagagaatgtcag

SEQ ID NO: 7651115 - DNA, 20 bp, Homo sapiens
acagaaagagagaatgtcag

SEQ ID NO: 7651116 - DNA, 20 bp, Homo sapiens
acagaaagagagaatgtcag

SEQ ID NO: 7651117 - DNA, 20 bp, Homo sapiens
acagaaagagagaatgtcag

SEQ ID NO: 7651118 - DNA, 20 bp, Homo sapiens
acagaaagagagaatgtcag

SEQ ID NO: 7651119 - DNA, 22 bp, Homo sapiens
acagaaagaccttgtaacactt

SEQ ID NO: 7651120 - DNA, 22 bp, Homo sapiens
acagaaagaccttgtaacactt

SEQ ID NO: 7651121 - DNA, 22 bp, Homo sapiens
acagaaagaccttgtaacactt

SEQ ID NO: 7651122 - DNA, 22 bp, Homo sapiens
acagacaagtagttcagacaag

SEQ ID NO: 7651123 - DNA, 22 bp, Homo sapiens
acagaattaggagatcctcttg

SEQ ID NO: 7651124 - DNA, 22 bp, Homo sapiens
acagacaagtagttcagacaag

SEQ ID NO: 7651125 - DNA, 22 bp, Homo sapiens
acagacaagtagttcagacaag

SEQ ID NO: 7651126 - DNA, 22 bp, Homo sapiens
acagacaagtagttcagacaag

SEQ ID NO: 7651127 - DNA, 22 bp, Homo sapiens
acagacaagtagttcagacaag

SEQ ID NO: 7651128 - DNA, 22 bp, Homo sapiens
acagacaagtagttcagacaag

SEQ ID NO: 7651129 - DNA, 22 bp, Homo sapiens
acagacaagtagttcagacaag

SEQ ID NO: 7651130 - DNA, 22 bp, Homo sapiens
acagacaagtagttcagacaag

SEQ ID NO: 7651131 - DNA, 22 bp, Homo sapiens
acagacacaggcctgggctcct

SEQ ID NO: 7651132 - DNA, 22 bp, Homo sapiens
acagacacaggcctgggctcct

SEQ ID NO: 7651133 - DNA, 22 bp, Homo sapiens
acagacacaggcctgggctcct

SEQ ID NO: 7651134 - DNA, 22 bp, Homo sapiens
acagacacaggcctgggctcct

SEQ ID NO: 7651135 - DNA, 22 bp, Homo sapiens
acagacacaggcgtggagtcgc

SEQ ID NO: 7651136 - DNA, 22 bp, Homo sapiens
acagacacaggcctgggctcct

SEQ ID NO: 7651137 - DNA, 22 bp, Homo sapiens
acagacacaggcctgggctcct

SEQ ID NO: 7651138 - DNA, 22 bp, Homo sapiens
acagacacaggcgtggagtcgc

SEQ ID NO: 7651139 - DNA, 22 bp, Homo sapiens
acagacacaggcgtggagtcgc

SEQ ID NO: 7651140 - DNA, 22 bp, Homo sapiens
acagacacaggcgtggagtcgc

SEQ ID NO: 7651141 - DNA, 22 bp, Homo sapiens
acagacacaggcgtggagtcgc

SEQ ID NO: 7651142 - DNA, 22 bp, Homo sapiens
acagacacaggcgtggagtcgc

SEQ ID NO: 7651143 - DNA, 22 bp, Homo sapiens
acagacacaggcgtggagtcgc

SEQ ID NO: 7651144 - DNA, 22 bp, Homo sapiens
acagaaaatgccagaagggtgg

SEQ ID NO: 7651145 - DNA, 22 bp, Homo sapiens
acagaaaatgccagaagggtgg

SEQ ID NO: 7651146 - DNA, 22 bp, Homo sapiens
acagaaaatgccagaagggtgg

SEQ ID NO: 7651147 - DNA, 22 bp, Homo sapiens
acagaaaatgccagaagggtgg

SEQ ID NO: 7651148 - DNA, 22 bp, Homo sapiens
acagaaaatgccagaagggtgg

SEQ ID NO: 7651149 - DNA, 22 bp, Homo sapiens
acagaaaatgccagaagggtgg

SEQ ID NO: 7651150 - DNA, 22 bp, Homo sapiens
acagaaaagtttacttttgctc

SEQ ID NO: 7651151 - DNA, 22 bp, Homo sapiens
acagaaaatgccagaagggtgg

SEQ ID NO: 7651152 - DNA, 22 bp, Homo sapiens
acagaaaatgccagaagggtgg

SEQ ID NO: 7651153 - DNA, 22 bp, Homo sapiens
acagaaacccagaaaacctctc

SEQ ID NO: 7651154 - DNA, 22 bp, Homo sapiens
acagaaaatgccagaagggtgg

SEQ ID NO: 7651155 - DNA, 22 bp, Homo sapiens
acagaaacccagaaaacctctc

SEQ ID NO: 7651156 - DNA, 22 bp, Homo sapiens
acagaaaatgccagaagggtgg

SEQ ID NO: 7651157 - DNA, 22 bp, Homo sapiens
acagaaaatgccagaagggtgg

SEQ ID NO: 7651158 - DNA, 22 bp, Homo sapiens
acagaaagaaggtgtatttgag

SEQ ID NO: 7651159 - DNA, 22 bp, Homo sapiens
acagaaagaaggtgtatttgag

SEQ ID NO: 7651160 - DNA, 22 bp, Homo sapiens
acagaaagaaggtgtatttgag

SEQ ID NO: 7651161 - DNA, 22 bp, Homo sapiens
acagaaagaccttgtaacactt

SEQ ID NO: 7651162 - DNA, 22 bp, Homo sapiens
acagaaagaccttgtaacactt

SEQ ID NO: 7651163 - DNA, 22 bp, Homo sapiens
acagaaacccagaaaacctctc

SEQ ID NO: 7651164 - DNA, 22 bp, Homo sapiens
acagaaacccagaaaacctctc

SEQ ID NO: 7651165 - DNA, 22 bp, Homo sapiens
acagaaagaaggtgtatttgag

SEQ ID NO: 7651166 - DNA, 22 bp, Homo sapiens
acagaaagaaggtgtatttgag

SEQ ID NO: 7651167 - DNA, 22 bp, Homo sapiens
acagaaaagtttacttttgctc

SEQ ID NO: 7651168 - DNA, 22 bp, Homo sapiens
acagaaaagtttacttttgctc

SEQ ID NO: 7651169 - DNA, 22 bp, Homo sapiens
acagaaaagtttacttttgctc

SEQ ID NO: 7651170 - DNA, 22 bp, Homo sapiens
acagaaaagtttacttttgctc

SEQ ID NO: 7651171 - DNA, 22 bp, Homo sapiens
acagaaaagtttacttttgctc

SEQ ID NO: 7651172 - DNA, 22 bp, Homo sapiens
acagaaaaatgagggagctgga

SEQ ID NO: 7651173 - DNA, 22 bp, Homo sapiens
acagaaaaatgagggagctgga

SEQ ID NO: 7651174 - DNA, 22 bp, Homo sapiens
acagaaaaatgagggagctgga

SEQ ID NO: 7651175 - DNA, 22 bp, Homo sapiens
acagaaaagtttacttttgctc

SEQ ID NO: 7651176 - DNA, 22 bp, Homo sapiens
acagaaaagtttacttttgctc

SEQ ID NO: 7651177 - DNA, 22 bp, Homo sapiens
acagaaaaatgagggagctgga

SEQ ID NO: 7651178 - DNA, 22 bp, Homo sapiens
acagaaaaatgagggagctgga

SEQ ID NO: 7651179 - DNA, 22 bp, Homo sapiens
acagaaaaatgagggagctgga

SEQ ID NO: 7651180 - DNA, 22 bp, Homo sapiens
acagaaaaatgagggagctgga

SEQ ID NO: 7651181 - DNA, 22 bp, Homo sapiens
acagaaaaatgagggagctgga

SEQ ID NO: 7651182 - DNA, 22 bp, Homo sapiens
acagaaaaatgagggagctgga

SEQ ID NO: 7651183 - DNA, 22 bp, Homo sapiens
acacttttgtttgaagtctcca

SEQ ID NO: 7651184 - DNA, 22 bp, Homo sapiens
acacttttgtttgaagtctcca

SEQ ID NO: 7651185 - DNA, 22 bp, Homo sapiens
acacttttgtgtatatccagtt

SEQ ID NO: 7651186 - DNA, 22 bp, Homo sapiens
acacttttgtgtatatccagtt

SEQ ID NO: 7651187 - DNA, 22 bp, Homo sapiens
acacttttgtgtatatccagtt

SEQ ID NO: 7651188 - DNA, 22 bp, Homo sapiens
acacttttgtttgaagtctcca

SEQ ID NO: 7651189 - DNA, 22 bp, Homo sapiens
acacttttgtttgaagtctcca

SEQ ID NO: 7651190 - DNA, 22 bp, Homo sapiens
acacttttgtttgaagtctcca

SEQ ID NO: 7651191 - DNA, 22 bp, Homo sapiens
acactttatcaatattcaaaaa

SEQ ID NO: 7651192 - DNA, 22 bp, Homo sapiens
acactttatcaatattcaaaaa

SEQ ID NO: 7651193 - DNA, 22 bp, Homo sapiens
acactttatcaatattcaaaaa

SEQ ID NO: 7651194 - DNA, 22 bp, Homo sapiens
acactttatcaatattcaaaaa

SEQ ID NO: 7651195 - DNA, 22 bp, Homo sapiens
acactttatcaatattcaaaaa

SEQ ID NO: 7651196 - DNA, 22 bp, Homo sapiens
acactttatcaatattcaaaaa

SEQ ID NO: 7651197 - DNA, 22 bp, Homo sapiens
acactttatctcatctcagaca

SEQ ID NO: 7651198 - DNA, 22 bp, Homo sapiens
acactttatcaatattcaaaaa

SEQ ID NO: 7651199 - DNA, 22 bp, Homo sapiens
acactttatctcatctcagaca

SEQ ID NO: 7651200 - DNA, 22 bp, Homo sapiens
acactttatcaatattcaaaaa

SEQ ID NO: 7651201 - DNA, 22 bp, Homo sapiens
acactttatgtctagatctggg

SEQ ID NO: 7651202 - DNA, 22 bp, Homo sapiens
acactttatctcatctcagaca

SEQ ID NO: 7651203 - DNA, 22 bp, Homo sapiens
acactttatctcatctcagaca

SEQ ID NO: 7651204 - DNA, 22 bp, Homo sapiens
acactttatctcatctcagaca

SEQ ID NO: 7651205 - DNA, 22 bp, Homo sapiens
acactttatgtctagatctggg

SEQ ID NO: 7651206 - DNA, 22 bp, Homo sapiens
acactttatgtctagatctggg

SEQ ID NO: 7651207 - DNA, 23 bp, Homo sapiens
acactttcaaatatgcacagagc

SEQ ID NO: 7651208 - DNA, 22 bp, Homo sapiens
acactttctggagctgcacata

SEQ ID NO: 7651209 - DNA, 22 bp, Homo sapiens
acactttgctacatttcatatt

SEQ ID NO: 7651210 - DNA, 22 bp, Homo sapiens
acactttgatagataatgcagg

SEQ ID NO: 7651211 - DNA, 22 bp, Homo sapiens
acactttctggagctgcacata

SEQ ID NO: 7651212 - DNA, 22 bp, Homo sapiens
acactttgttgtggcatatacg

SEQ ID NO: 7651213 - DNA, 22 bp, Homo sapiens
acactttgggctggataattat

SEQ ID NO: 7651214 - DNA, 22 bp, Homo sapiens
acactttgttgtggcatatacg

SEQ ID NO: 7651215 - DNA, 22 bp, Homo sapiens
acacttttaagactttaatgaa

SEQ ID NO: 7651216 - DNA, 22 bp, Homo sapiens
acacttttaagactttaatgaa

SEQ ID NO: 7651217 - DNA, 22 bp, Homo sapiens
acacttttaagactttaatgaa

SEQ ID NO: 7651218 - DNA, 22 bp, Homo sapiens
acacttttatctctggaggctt

SEQ ID NO: 7651219 - DNA, 22 bp, Homo sapiens
acacttttatctctggaggctt

SEQ ID NO: 7651220 - DNA, 22 bp, Homo sapiens
acacttttagctatgagttaat

SEQ ID NO: 7651221 - DNA, 22 bp, Homo sapiens
acacttttagctatgagttaat

SEQ ID NO: 7651222 - DNA, 22 bp, Homo sapiens
acacttttagctatgagttaat

SEQ ID NO: 7651223 - DNA, 22 bp, Homo sapiens
acacagaggaaagtgtgaaggg

SEQ ID NO: 7651224 - DNA, 22 bp, Homo sapiens
acacagaggaaagtgtgaaggg

SEQ ID NO: 7651225 - DNA, 22 bp, Homo sapiens
acacagaggaaagtgtgaaggg

SEQ ID NO: 7651226 - DNA, 22 bp, Homo sapiens
acacagaggaaagtgtgaaggg

SEQ ID NO: 7651227 - DNA, 22 bp, Homo sapiens
acacagaggaaagtgtgaaggg

SEQ ID NO: 7651228 - DNA, 22 bp, Homo sapiens
acacagagcttctcaactggga

SEQ ID NO: 7651229 - DNA, 22 bp, Homo sapiens
acacagaagatctcttaatgct

SEQ ID NO: 7651230 - DNA, 22 bp, Homo sapiens
acacagaagatctcttaatgct

SEQ ID NO: 7651231 - DNA, 22 bp, Homo sapiens
agcagcaaaagagaatagtttg

SEQ ID NO: 7651232 - DNA, 22 bp, Homo sapiens
acacagagcttctcaactggga

SEQ ID NO: 7651233 - DNA, 22 bp, Homo sapiens
acacagagcttctcaactggga

SEQ ID NO: 7651234 - DNA, 21 bp, Homo sapiens
acacagaggcatcatcacttt

SEQ ID NO: 7651235 - DNA, 21 bp, Homo sapiens
acacagaggcatcatcacttt

SEQ ID NO: 7651236 - DNA, 22 bp, Homo sapiens
acacagaggcatgacagtggct

SEQ ID NO: 7651237 - DNA, 22 bp, Homo sapiens
acacagaggcatgacagtggct

SEQ ID NO: 7651238 - DNA, 22 bp, Homo sapiens
acacagaggcatgacagtggct

SEQ ID NO: 7651239 - DNA, 22 bp, Homo sapiens
acacagaggcatgacagtggct

SEQ ID NO: 7651240 - DNA, 22 bp, Homo sapiens
acacagaggcatgacagtggct

SEQ ID NO: 7651241 - DNA, 22 bp, Homo sapiens
acacagaggtggccactctttt

SEQ ID NO: 7651242 - DNA, 22 bp, Homo sapiens
acacagagggcagaagatacat

SEQ ID NO: 7651243 - DNA, 22 bp, Homo sapiens
acacagaggtggccactctttt

SEQ ID NO: 7651244 - DNA, 22 bp, Homo sapiens
acacagaggtggccactctttt

SEQ ID NO: 7651245 - DNA, 22 bp, Homo sapiens
acacagagtatcttttgcctag

SEQ ID NO: 7651246 - DNA, 22 bp, Homo sapiens
acacagagtatcttttgcctag

SEQ ID NO: 7651247 - DNA, 22 bp, Homo sapiens
acacagagtatcttttgcctag

SEQ ID NO: 7651248 - DNA, 22 bp, Homo sapiens
acacagagtatcttttgcctag

SEQ ID NO: 7651249 - DNA, 22 bp, Homo sapiens
acacagaggtggccactctttt

SEQ ID NO: 7651250 - DNA, 22 bp, Homo sapiens
acacagaggcatgacagtggct

SEQ ID NO: 7651251 - DNA, 22 bp, Homo sapiens
acacagaggcatgacagtggct

SEQ ID NO: 7651252 - DNA, 22 bp, Homo sapiens
acacagaggcatgacagtggct

SEQ ID NO: 7651253 - DNA, 22 bp, Homo sapiens
acacagaggcatgacagtggct

SEQ ID NO: 7651254 - DNA, 22 bp, Homo sapiens
acacagagggcagaagatacat

SEQ ID NO: 7651255 - DNA, 22 bp, Homo sapiens
acacagagggcagaagatacat

SEQ ID NO: 7651256 - DNA, 22 bp, Homo sapiens
acacagaggctccagagataga

SEQ ID NO: 7651257 - DNA, 22 bp, Homo sapiens
acacagaggctccagagataga

SEQ ID NO: 7651258 - DNA, 22 bp, Homo sapiens
acacagaggctccagagataga

SEQ ID NO: 7651259 - DNA, 22 bp, Homo sapiens
acacagaggctccagagataga

SEQ ID NO: 7651260 - DNA, 20 bp, Homo sapiens
acacagagtgagtctgcttg

SEQ ID NO: 7651261 - DNA, 22 bp, Homo sapiens
acacagagtccttactgaggta

SEQ ID NO: 7651262 - DNA, 20 bp, Homo sapiens
acacagagtgagtctgcttg

SEQ ID NO: 7651263 - DNA, 20 bp, Homo sapiens
acacagagtgagtctgcttg

SEQ ID NO: 7651264 - DNA, 22 bp, Homo sapiens
acacagagtccttactgaggta

SEQ ID NO: 7651265 - DNA, 22 bp, Homo sapiens
acacagagtccttactgaggta

SEQ ID NO: 7651266 - DNA, 22 bp, Homo sapiens
acacagagtccttactgaggta

SEQ ID NO: 7651267 - DNA, 22 bp, Homo sapiens
acacagagtccttactgaggta

SEQ ID NO: 7651268 - DNA, 22 bp, Homo sapiens
acacagagtccttactgaggta

SEQ ID NO: 7651269 - DNA, 22 bp, Homo sapiens
acacagagtccttactgaggta

SEQ ID NO: 7651270 - DNA, 22 bp, Homo sapiens
acacagagtccttactgaggta

SEQ ID NO: 7651271 - DNA, 22 bp, Homo sapiens
acacagagtccttactgaggta

SEQ ID NO: 7651272 - DNA, 22 bp, Homo sapiens
acacagagtatttagaaggggt

SEQ ID NO: 7651273 - DNA, 22 bp, Homo sapiens
acacagagtatttagaaggggt

SEQ ID NO: 7651274 - DNA, 22 bp, Homo sapiens
acacagagtatttagaaggggt

SEQ ID NO: 7651275 - DNA, 22 bp, Homo sapiens
acacagagtatttagaaggggt

SEQ ID NO: 7651276 - DNA, 22 bp, Homo sapiens
acacagagttattatgtgaact

SEQ ID NO: 7651277 - DNA, 22 bp, Homo sapiens
acacagagttattatgtgaact

SEQ ID NO: 7651278 - DNA, 22 bp, Homo sapiens
acacagagttattatgtgaact

SEQ ID NO: 7651279 - DNA, 22 bp, Homo sapiens
acacagagttattatgtgaact

SEQ ID NO: 7651280 - DNA, 22 bp, Homo sapiens
acacagagttattatgtgaact

SEQ ID NO: 7651281 - DNA, 22 bp, Homo sapiens
acacagagttattatgtgaact

SEQ ID NO: 7651282 - DNA, 22 bp, Homo sapiens
acacagagttattatgtgaact

SEQ ID NO: 7651283 - DNA, 22 bp, Homo sapiens
acacagagtggtttgtagaata

SEQ ID NO: 7651284 - DNA, 22 bp, Homo sapiens
acacagagtggtttgtagaata

SEQ ID NO: 7651285 - DNA, 22 bp, Homo sapiens
acacagagtttgacacatggga

SEQ ID NO: 7651286 - DNA, 22 bp, Homo sapiens
acacagagtttgacacatggga

SEQ ID NO: 7651287 - DNA, 22 bp, Homo sapiens
acacagagtttgacacatggga

SEQ ID NO: 7651288 - DNA, 22 bp, Homo sapiens
acacagagtttgacacatggga

SEQ ID NO: 7651289 - DNA, 22 bp, Homo sapiens
acacagagtttgacacatggga

SEQ ID NO: 7651290 - DNA, 22 bp, Homo sapiens
acacagagtttgacacatggga

SEQ ID NO: 7651291 - DNA, 22 bp, Homo sapiens
agcagctggtaggagtggccac

SEQ ID NO: 7651292 - DNA, 22 bp, Homo sapiens
agcagctggtaggagtggccac

SEQ ID NO: 7651293 - DNA, 22 bp, Homo sapiens
agcagctggtaggagtggccac

SEQ ID NO: 7651294 - DNA, 22 bp, Homo sapiens
agcagctggtaggagtggccac

SEQ ID NO: 7651295 - DNA, 22 bp, Homo sapiens
agcagctggtaggagtggccac

SEQ ID NO: 7651296 - DNA, 22 bp, Homo sapiens
agcagctggtaggagtggccac

SEQ ID NO: 7651297 - DNA, 22 bp, Homo sapiens
agcagctggtgagcaagctcag

SEQ ID NO: 7651298 - DNA, 22 bp, Homo sapiens
agcagctggtgagcaagctcag

SEQ ID NO: 7651299 - DNA, 22 bp, Homo sapiens
agcagctggtaggagtggccac

SEQ ID NO: 7651300 - DNA, 22 bp, Homo sapiens
agcagctggtgcaactctaaga

SEQ ID NO: 7651301 - DNA, 22 bp, Homo sapiens
agcagctggtgcaactctaaga

SEQ ID NO: 7651302 - DNA, 22 bp, Homo sapiens
agcagctggtgcaactctaaga

SEQ ID NO: 7651303 - DNA, 22 bp, Homo sapiens
agcagctggtgcaactctaaga

SEQ ID NO: 7651304 - DNA, 22 bp, Homo sapiens
agcagctggtgagcaagctcag

SEQ ID NO: 7651305 - DNA, 22 bp, Homo sapiens
agcagctggtgagcaagctcag

SEQ ID NO: 7651306 - DNA, 17 bp, Homo sapiens
agcagctgggttgatct

SEQ ID NO: 7651307 - DNA, 17 bp, Homo sapiens
agcagctgggttgatct

SEQ ID NO: 7651308 - DNA, 17 bp, Homo sapiens
agcagctgggttgatct

SEQ ID NO: 7651309 - DNA, 17 bp, Homo sapiens
agcagctgggttgatct

SEQ ID NO: 7651310 - DNA, 22 bp, Homo sapiens
agcagctggtaggagtggccac

SEQ ID NO: 7651311 - DNA, 22 bp, Homo sapiens
agcagctggtaggagtggccac

SEQ ID NO: 7651312 - DNA, 17 bp, Homo sapiens
agcagctgggttgatct

SEQ ID NO: 7651313 - DNA, 22 bp, Homo sapiens
agcagctgggtccggcggagca

SEQ ID NO: 7651314 - DNA, 17 bp, Homo sapiens
agcagctgggttgatct

SEQ ID NO: 7651315 - DNA, 22 bp, Homo sapiens
agcagctgggtccggcggagca

SEQ ID NO: 7651316 - DNA, 22 bp, Homo sapiens
agcagctgggtccggcggagca

SEQ ID NO: 7651317 - DNA, 23 bp, Homo sapiens
agcagctggggtgctcttttgtc

SEQ ID NO: 7651318 - DNA, 22 bp, Homo sapiens
agcagctggggcctgtgacgat

SEQ ID NO: 7651319 - DNA, 23 bp, Homo sapiens
agcagctggggtgctcttttgtc

SEQ ID NO: 7651320 - DNA, 22 bp, Homo sapiens
agcagctggggcctgtgacgat

SEQ ID NO: 7651321 - DNA, 22 bp, Homo sapiens
agcagctggggcctgtgacgat

SEQ ID NO: 7651322 - DNA, 22 bp, Homo sapiens
agcagctggggcctgtgacgat

SEQ ID NO: 7651323 - DNA, 22 bp, Homo sapiens
agcagctgggtccggcggagca

SEQ ID NO: 7651324 - DNA, 22 bp, Homo sapiens
agcagctgggtccggcggagca

SEQ ID NO: 7651325 - DNA, 22 bp, Homo sapiens
agcagctgggtccggcggagca

SEQ ID NO: 7651326 - DNA, 22 bp, Homo sapiens
agcagctgggtccggcggagca

SEQ ID NO: 7651327 - DNA, 22 bp, Homo sapiens
agcagctgggtccggcggagca

SEQ ID NO: 7651328 - DNA, 22 bp, Homo sapiens
agcagctgggtccggcggagca

SEQ ID NO: 7651329 - DNA, 23 bp, Homo sapiens
agcagctggggtgctcttttgtc

SEQ ID NO: 7651330 - DNA, 22 bp, Homo sapiens
agcagctgagccccagctgtga

SEQ ID NO: 7651331 - DNA, 22 bp, Homo sapiens
agcagctgagccccagctgtga

SEQ ID NO: 7651332 - DNA, 22 bp, Homo sapiens
acacagatgctatttagtctct

SEQ ID NO: 7651333 - DNA, 22 bp, Homo sapiens
acacagatgctatttagtctct

SEQ ID NO: 7651334 - DNA, 22 bp, Homo sapiens
acacagatgctatttagtctct

SEQ ID NO: 7651335 - DNA, 22 bp, Homo sapiens
acacagatgggtagaaaacaga

SEQ ID NO: 7651336 - DNA, 22 bp, Homo sapiens
agcagctgagccccagctgtga

SEQ ID NO: 7651337 - DNA, 22 bp, Homo sapiens
agcagctgagccccagctgtga

SEQ ID NO: 7651338 - DNA, 22 bp, Homo sapiens
agcagctgggctcagagctggg

SEQ ID NO: 7651339 - DNA, 22 bp, Homo sapiens
agcagctgggctcagagctggg

SEQ ID NO: 7651340 - DNA, 22 bp, Homo sapiens
agcagctgggctcagagctggg

SEQ ID NO: 7651341 - DNA, 22 bp, Homo sapiens
agcagctggggcctgtgacgat

SEQ ID NO: 7651342 - DNA, 22 bp, Homo sapiens
agcagctgggctcagagctggg

SEQ ID NO: 7651343 - DNA, 22 bp, Homo sapiens
agcagctggggcctgtgacgat

SEQ ID NO: 7651344 - DNA, 22 bp, Homo sapiens
agcagctggggcctgtgacgat

SEQ ID NO: 7651345 - DNA, 22 bp, Homo sapiens
agcagctggggcctgtgacgat

SEQ ID NO: 7651346 - DNA, 22 bp, Homo sapiens
agcagctggggcctgtgacgat

SEQ ID NO: 7651347 - DNA, 22 bp, Homo sapiens
acacagatgcattacacatcta

SEQ ID NO: 7651348 - DNA, 22 bp, Homo sapiens
acacagatgcattacacatcta

SEQ ID NO: 7651349 - DNA, 22 bp, Homo sapiens
acacagatgcattacacatcta

SEQ ID NO: 7651350 - DNA, 22 bp, Homo sapiens
acacagatgcattacacatcta

SEQ ID NO: 7651351 - DNA, 22 bp, Homo sapiens
acacagatgcattacacatcta

SEQ ID NO: 7651352 - DNA, 22 bp, Homo sapiens
acacagatattttgaatacata

SEQ ID NO: 7651353 - DNA, 22 bp, Homo sapiens
acacagatgatgttccaggaac

SEQ ID NO: 7651354 - DNA, 22 bp, Homo sapiens
acacagatgatgttccaggaac

SEQ ID NO: 7651355 - DNA, 22 bp, Homo sapiens
acacagatgcaacctgaccgag

SEQ ID NO: 7651356 - DNA, 22 bp, Homo sapiens
acacagatattttgaatacata

SEQ ID NO: 7651357 - DNA, 22 bp, Homo sapiens
acacagatattttgaatacata

SEQ ID NO: 7651358 - DNA, 22 bp, Homo sapiens
acacagatattttgaatacata

SEQ ID NO: 7651359 - DNA, 22 bp, Homo sapiens
acacagatattttgaatacata

SEQ ID NO: 7651360 - DNA, 22 bp, Homo sapiens
acacagatattgtacttgatcc

SEQ ID NO: 7651361 - DNA, 22 bp, Homo sapiens
acacagatattgtacttgatcc

SEQ ID NO: 7651362 - DNA, 22 bp, Homo sapiens
acacagatattgtacttgatcc

SEQ ID NO: 7651363 - DNA, 22 bp, Homo sapiens
acacagatattgtacttgatcc

SEQ ID NO: 7651364 - DNA, 22 bp, Homo sapiens
acacagataatgctcatatagg

SEQ ID NO: 7651365 - DNA, 22 bp, Homo sapiens
acacagataatgctcatatagg

SEQ ID NO: 7651366 - DNA, 22 bp, Homo sapiens
acacagataatgctcatatagg

SEQ ID NO: 7651367 - DNA, 22 bp, Homo sapiens
agcagagcagatagtattatct

SEQ ID NO: 7651368 - DNA, 22 bp, Homo sapiens
agcagagcagaatgtgaaggtg

SEQ ID NO: 7651369 - DNA, 19 bp, Homo sapiens
agcagagcaaagtggctga

SEQ ID NO: 7651370 - DNA, 19 bp, Homo sapiens
agcagagcaaagtggctga

SEQ ID NO: 7651371 - DNA, 19 bp, Homo sapiens
agcagagcaaagtggctga

SEQ ID NO: 7651372 - DNA, 19 bp, Homo sapiens
agcagagcaaagtggctga

SEQ ID NO: 7651373 - DNA, 19 bp, Homo sapiens
agcagagcaaagtggctga

SEQ ID NO: 7651374 - DNA, 18 bp, Homo sapiens
agcagagagtgaatggga

SEQ ID NO: 7651375 - DNA, 18 bp, Homo sapiens
agcagagagtgaatggga

SEQ ID NO: 7651376 - DNA, 19 bp, Homo sapiens
agcagagcaaagtggctga

SEQ ID NO: 7651377 - DNA, 18 bp, Homo sapiens
agcagagagtgaatggga

SEQ ID NO: 7651378 - DNA, 22 bp, Homo sapiens
agcagagaggaggtggccctgt

SEQ ID NO: 7651379 - DNA, 22 bp, Homo sapiens
agcagagaggaggtggccctgt

SEQ ID NO: 7651380 - DNA, 18 bp, Homo sapiens
agcagagagtgaatggga

SEQ ID NO: 7651381 - DNA, 18 bp, Homo sapiens
agcagagagtgaatggga

SEQ ID NO: 7651382 - DNA, 18 bp, Homo sapiens
agcagagagtgaatggga

SEQ ID NO: 7651383 - DNA, 18 bp, Homo sapiens
agcagagagtgaatggga

SEQ ID NO: 7651384 - DNA, 18 bp, Homo sapiens
agcagagagtgaatggga

SEQ ID NO: 7651385 - DNA, 22 bp, Homo sapiens
agcagagcatggtgggaagggc

SEQ ID NO: 7651386 - DNA, 22 bp, Homo sapiens
agcagagcatgctaagtgactc

SEQ ID NO: 7651387 - DNA, 22 bp, Homo sapiens
agcagagcatgctaagtgactc

SEQ ID NO: 7651388 - DNA, 19 bp, Homo sapiens
agcagagcagggccgtggg

SEQ ID NO: 7651389 - DNA, 22 bp, Homo sapiens
agcagagcatgctaagtgactc

SEQ ID NO: 7651390 - DNA, 22 bp, Homo sapiens
agcagagccagaattggaccag

SEQ ID NO: 7651391 - DNA, 22 bp, Homo sapiens
agcagagccagaattggaccag

SEQ ID NO: 7651392 - DNA, 22 bp, Homo sapiens
agcagagccagaattggaccag

SEQ ID NO: 7651393 - DNA, 21 bp, Homo sapiens
agcagagccaccattacctgc

SEQ ID NO: 7651394 - DNA, 22 bp, Homo sapiens
agcagagcatggtgggaagggc

SEQ ID NO: 7651395 - DNA, 22 bp, Homo sapiens
agcagagcatggtgggaagggc

SEQ ID NO: 7651396 - DNA, 22 bp, Homo sapiens
agcagagcatggtgggaagggc

SEQ ID NO: 7651397 - DNA, 22 bp, Homo sapiens
agcagaactgatgagacttgag

SEQ ID NO: 7651398 - DNA, 22 bp, Homo sapiens
agcagaacctgcagacctgtct

SEQ ID NO: 7651399 - DNA, 22 bp, Homo sapiens
acaatgctgttgagacattctt

SEQ ID NO: 7651400 - DNA, 22 bp, Homo sapiens
acaatgctgcagggaaattagg

SEQ ID NO: 7651401 - DNA, 22 bp, Homo sapiens
agcagaacctgcagacctgtct

SEQ ID NO: 7651402 - DNA, 22 bp, Homo sapiens
agcagaactgatgagacttgag

SEQ ID NO: 7651403 - DNA, 22 bp, Homo sapiens
agcagaagaaagccacatgact

SEQ ID NO: 7651404 - DNA, 22 bp, Homo sapiens
agcagaagaaagccacatgact

SEQ ID NO: 7651405 - DNA, 22 bp, Homo sapiens
agcagaagaaagccacatgact

SEQ ID NO: 7651406 - DNA, 22 bp, Homo sapiens
agcagaagaaagccacatgact

SEQ ID NO: 7651407 - DNA, 22 bp, Homo sapiens
agcagagaggaggtggccctgt

SEQ ID NO: 7651408 - DNA, 22 bp, Homo sapiens
agcagagaggaggtggccctgt

SEQ ID NO: 7651409 - DNA, 21 bp, Homo sapiens
acaatgcatggaactcatggc

SEQ ID NO: 7651410 - DNA, 21 bp, Homo sapiens
acaatgcatggaactcatggc

SEQ ID NO: 7651411 - DNA, 21 bp, Homo sapiens
acaatgcatggaactcatggc

SEQ ID NO: 7651412 - DNA, 22 bp, Homo sapiens
acaatgctgcagggaaattagg

SEQ ID NO: 7651413 - DNA, 22 bp, Homo sapiens
acaatgctgcagggaaattagg

SEQ ID NO: 7651414 - DNA, 22 bp, Homo sapiens
acaatgctgcagggaaattagg

SEQ ID NO: 7651415 - DNA, 22 bp, Homo sapiens
acaatgctccctgtagtcagga

SEQ ID NO: 7651416 - DNA, 22 bp, Homo sapiens
acaatgctccctgtagtcagga

SEQ ID NO: 7651417 - DNA, 22 bp, Homo sapiens
acaatgctcatatttatgccaa

SEQ ID NO: 7651418 - DNA, 22 bp, Homo sapiens
acaatgctcatatttatgccaa

SEQ ID NO: 7651419 - DNA, 22 bp, Homo sapiens
acaatgcaccagcatcttcacc

SEQ ID NO: 7651420 - DNA, 22 bp, Homo sapiens
acaatgcaccagcatcttcacc

SEQ ID NO: 7651421 - DNA, 22 bp, Homo sapiens
acaatgcaccagcatcttcacc

SEQ ID NO: 7651422 - DNA, 22 bp, Homo sapiens
acaatgcacctattttaaaact

SEQ ID NO: 7651423 - DNA, 22 bp, Homo sapiens
acaatgcacctattttaaaact

SEQ ID NO: 7651424 - DNA, 22 bp, Homo sapiens
acaatgcaccagcatcttcacc

SEQ ID NO: 7651425 - DNA, 22 bp, Homo sapiens
acaatgcaccagcatcttcacc

SEQ ID NO: 7651426 - DNA, 22 bp, Homo sapiens
acaatgcacctattttaaaact

SEQ ID NO: 7651427 - DNA, 22 bp, Homo sapiens
acaatgcacctattttaaaact

SEQ ID NO: 7651428 - DNA, 17 bp, Homo sapiens
acaatgcagtctctagt

SEQ ID NO: 7651429 - DNA, 22 bp, Homo sapiens
acaatgcatacctagcagctca

SEQ ID NO: 7651430 - DNA, 22 bp, Homo sapiens
acaatgcacctattttaaaact

SEQ ID NO: 7651431 - DNA, 22 bp, Homo sapiens
acaatgcacctattttaaaact

SEQ ID NO: 7651432 - DNA, 23 bp, Homo sapiens
acaatgcactttaaatggttccc

SEQ ID NO: 7651433 - DNA, 23 bp, Homo sapiens
acaatgcactttaaatggttccc

SEQ ID NO: 7651434 - DNA, 22 bp, Homo sapiens
agcagagcccttccatggcctt

SEQ ID NO: 7651435 - DNA, 22 bp, Homo sapiens
agcagagcccttccatggcctt

SEQ ID NO: 7651436 - DNA, 22 bp, Homo sapiens
agcagagcctgggctaggggtg

SEQ ID NO: 7651437 - DNA, 22 bp, Homo sapiens
agcagagcctgggctaggggtg

SEQ ID NO: 7651438 - DNA, 22 bp, Homo sapiens
agcagagcccttccatggcctt

SEQ ID NO: 7651439 - DNA, 22 bp, Homo sapiens
agcagagcccttccatggcctt

SEQ ID NO: 7651440 - DNA, 22 bp, Homo sapiens
agcagagcccttccatggcctt

SEQ ID NO: 7651441 - DNA, 18 bp, Homo sapiens
agcagagcccatgcattc

SEQ ID NO: 7651442 - DNA, 18 bp, Homo sapiens
agcagagcccatgcattc

SEQ ID NO: 7651443 - DNA, 18 bp, Homo sapiens
agcagagcccatgcattc

SEQ ID NO: 7651444 - DNA, 22 bp, Homo sapiens
agcagagccaggtctctctgta

SEQ ID NO: 7651445 - DNA, 19 bp, Homo sapiens
agcagagccctgaagatcc

SEQ ID NO: 7651446 - DNA, 18 bp, Homo sapiens
agcagagcccatgcattc

SEQ ID NO: 7651447 - DNA, 20 bp, Homo sapiens
agcagatagcgggagagttt

SEQ ID NO: 7651448 - DNA, 20 bp, Homo sapiens
agcagatagcgggagagttt

SEQ ID NO: 7651449 - DNA, 22 bp, Homo sapiens
agcagatagtagaacatgtata

SEQ ID NO: 7651450 - DNA, 22 bp, Homo sapiens
agcagataggacatttcattct

SEQ ID NO: 7651451 - DNA, 22 bp, Homo sapiens
agcagagtgtgaaggcagggct

SEQ ID NO: 7651452 - DNA, 22 bp, Homo sapiens
agcagagcctgggctaggggtg

SEQ ID NO: 7651453 - DNA, 22 bp, Homo sapiens
agcagagcctgggctaggggtg

SEQ ID NO: 7651454 - DNA, 22 bp, Homo sapiens
agcagagtttctcaacatcagc

SEQ ID NO: 7651455 - DNA, 22 bp, Homo sapiens
agcagagtttctcaacatcagc

SEQ ID NO: 7651456 - DNA, 22 bp, Homo sapiens
agcagagtgtgaaggcagggct

SEQ ID NO: 7651457 - DNA, 22 bp, Homo sapiens
agcagagtgtgaaggcagggct

SEQ ID NO: 7651458 - DNA, 22 bp, Homo sapiens
agcagatgaatcccagataaag

SEQ ID NO: 7651459 - DNA, 22 bp, Homo sapiens
agcagatgagcctcatgactgg

SEQ ID NO: 7651460 - DNA, 22 bp, Homo sapiens
agcagatgaatcccagataaag

SEQ ID NO: 7651461 - DNA, 22 bp, Homo sapiens
agcagatgagcctcatgactgg

SEQ ID NO: 7651462 - DNA, 22 bp, Homo sapiens
agcagatgagcctcatgactgg

SEQ ID NO: 7651463 - DNA, 22 bp, Homo sapiens
agcagatatttgttgagcactt

SEQ ID NO: 7651464 - DNA, 22 bp, Homo sapiens
agcagatatgatacttaattta

SEQ ID NO: 7651465 - DNA, 22 bp, Homo sapiens
agcagatgaatcccagataaag

SEQ ID NO: 7651466 - DNA, 22 bp, Homo sapiens
agcagatgaatcccagataaag

SEQ ID NO: 7651467 - DNA, 22 bp, Homo sapiens
agcagatgcattatgattgaaa

SEQ ID NO: 7651468 - DNA, 22 bp, Homo sapiens
agcagatgcaaacttaccttga

SEQ ID NO: 7651469 - DNA, 22 bp, Homo sapiens
agcagatgcattatgattgaaa

SEQ ID NO: 7651470 - DNA, 22 bp, Homo sapiens
agcagatgagcctcatgactgg

SEQ ID NO: 7651471 - DNA, 22 bp, Homo sapiens
agcagatgcaaacttaccttga

SEQ ID NO: 7651472 - DNA, 22 bp, Homo sapiens
agcagatgagcctcatgactgg

SEQ ID NO: 7651473 - DNA, 22 bp, Homo sapiens
agcagatggagaatggagtcag

SEQ ID NO: 7651474 - DNA, 22 bp, Homo sapiens
agcagatgggagatggagctgc

SEQ ID NO: 7651475 - DNA, 22 bp, Homo sapiens
agcagatgcgtctgagtgggag

SEQ ID NO: 7651476 - DNA, 22 bp, Homo sapiens
agcagatgtgtctctgcactgt

SEQ ID NO: 7651477 - DNA, 22 bp, Homo sapiens
agcagatgttccctggtccctt

SEQ ID NO: 7651478 - DNA, 22 bp, Homo sapiens
agcagatgtgtctctgcactgt

SEQ ID NO: 7651479 - DNA, 22 bp, Homo sapiens
agcagatgttccctggtccctt

SEQ ID NO: 7651480 - DNA, 22 bp, Homo sapiens
agcagatgtttcagagcaggct

SEQ ID NO: 7651481 - DNA, 22 bp, Homo sapiens
agcagatgtttcagagcaggct

SEQ ID NO: 7651482 - DNA, 22 bp, Homo sapiens
agcagatgttccctggtccctt

SEQ ID NO: 7651483 - DNA, 22 bp, Homo sapiens
agcagatgtgtctctgcactgt

SEQ ID NO: 7651484 - DNA, 22 bp, Homo sapiens
agcagatgtgtctctgcactgt

SEQ ID NO: 7651485 - DNA, 22 bp, Homo sapiens
agcagatgtgtctctgcactgt

SEQ ID NO: 7651486 - DNA, 22 bp, Homo sapiens
agcagatggtgtcatgggatgg

SEQ ID NO: 7651487 - DNA, 22 bp, Homo sapiens
agcagcaaagaataggccctct

SEQ ID NO: 7651488 - DNA, 22 bp, Homo sapiens
agcagcaaagccaggggatggg

SEQ ID NO: 7651489 - DNA, 22 bp, Homo sapiens
agcagcaaagccaggggatggg

SEQ ID NO: 7651490 - DNA, 22 bp, Homo sapiens
agcagcaaagaataggccctct

SEQ ID NO: 7651491 - DNA, 22 bp, Homo sapiens
agcagcaaagaataggccctct

SEQ ID NO: 7651492 - DNA, 22 bp, Homo sapiens
agcagcaaagaataggccctct

SEQ ID NO: 7651493 - DNA, 22 bp, Homo sapiens
acacagaagatctcttaatgct

SEQ ID NO: 7651494 - DNA, 22 bp, Homo sapiens
acacagaagatctcttaatgct

SEQ ID NO: 7651495 - DNA, 22 bp, Homo sapiens
acacagaagatctcttaatgct

SEQ ID NO: 7651496 - DNA, 22 bp, Homo sapiens
acacagaagatctcttaatgct

SEQ ID NO: 7651497 - DNA, 22 bp, Homo sapiens
acacagaagatctcttaatgct

SEQ ID NO: 7651498 - DNA, 22 bp, Homo sapiens
acacagaagatctcttaatgct

SEQ ID NO: 7651499 - DNA, 22 bp, Homo sapiens
acacagaagatctcttaatgct

SEQ ID NO: 7651500 - DNA, 22 bp, Homo sapiens
agcagatgtttcagagcaggct

SEQ ID NO: 7651501 - DNA, 22 bp, Homo sapiens
agcagattggttaagcacatta

SEQ ID NO: 7651502 - DNA, 23 bp, Homo sapiens
agcagcaaaaatttatctttctg

SEQ ID NO: 7651503 - DNA, 22 bp, Homo sapiens
agcagatgtttcagagcaggct

SEQ ID NO: 7651504 - DNA, 22 bp, Homo sapiens
agcagcaaaagagaatagtttg

SEQ ID NO: 7651505 - DNA, 22 bp, Homo sapiens
agcagcaaaagagaatagtttg

SEQ ID NO: 7651506 - DNA, 22 bp, Homo sapiens
agcagcaaaagagaatagtttg

SEQ ID NO: 7651507 - DNA, 22 bp, Homo sapiens
agcagcaaaagagaatagtttg

SEQ ID NO: 7651508 - DNA, 23 bp, Homo sapiens
agcagcaaaaatttatctttctg

SEQ ID NO: 7651509 - DNA, 22 bp, Homo sapiens
acacattataggcaatcaaaag

SEQ ID NO: 7651510 - DNA, 22 bp, Homo sapiens
acacattataggcaatcaaaag

SEQ ID NO: 7651511 - DNA, 22 bp, Homo sapiens
acacattataggcaatcaaaag

SEQ ID NO: 7651512 - DNA, 22 bp, Homo sapiens
acacattatagagagtataata

SEQ ID NO: 7651513 - DNA, 22 bp, Homo sapiens
acacattataggcaatcaaaag

SEQ ID NO: 7651514 - DNA, 22 bp, Homo sapiens
acacattataggcaatcaaaag

SEQ ID NO: 7651515 - DNA, 22 bp, Homo sapiens
acacattaggcagtgcttaaat

SEQ ID NO: 7651516 - DNA, 22 bp, Homo sapiens
acacattaggcagtgcttaaat

SEQ ID NO: 7651517 - DNA, 22 bp, Homo sapiens
acacattagtgctctgtctcat

SEQ ID NO: 7651518 - DNA, 22 bp, Homo sapiens
acacattaggcagtgcttaaat

SEQ ID NO: 7651519 - DNA, 22 bp, Homo sapiens
acacattaggcagtgcttaaat

SEQ ID NO: 7651520 - DNA, 22 bp, Homo sapiens
acacattagtgctctgtctcat

SEQ ID NO: 7651521 - DNA, 22 bp, Homo sapiens
acacattatagagagtataata

SEQ ID NO: 7651522 - DNA, 22 bp, Homo sapiens
acacattatagagagtataata

SEQ ID NO: 7651523 - DNA, 22 bp, Homo sapiens
acacattatagagagtataata

SEQ ID NO: 7651524 - DNA, 22 bp, Homo sapiens
acacattatagagagtataata

SEQ ID NO: 7651525 - DNA, 22 bp, Homo sapiens
acacccaggctggcgtgcagtg

SEQ ID NO: 7651526 - DNA, 22 bp, Homo sapiens
acacccaggctggcgtgcagtg

SEQ ID NO: 7651527 - DNA, 22 bp, Homo sapiens
acacccaggctggcgtgcagtg

SEQ ID NO: 7651528 - DNA, 22 bp, Homo sapiens
acacccaggctggcgtgcagtg

SEQ ID NO: 7651529 - DNA, 22 bp, Homo sapiens
acactagctaaatgctgattaa

SEQ ID NO: 7651530 - DNA, 22 bp, Homo sapiens
acacccaggaataaggactggg

SEQ ID NO: 7651531 - DNA, 22 bp, Homo sapiens
acacccaggaataaggactggg

SEQ ID NO: 7651532 - DNA, 22 bp, Homo sapiens
acacccaggaataaggactggg

SEQ ID NO: 7651533 - DNA, 22 bp, Homo sapiens
acactagtagaatagtgtttgc

SEQ ID NO: 7651534 - DNA, 22 bp, Homo sapiens
acactagtagaatagtgtttgc

SEQ ID NO: 7651535 - DNA, 22 bp, Homo sapiens
acacccaggctggcgtgcagtg

SEQ ID NO: 7651536 - DNA, 22 bp, Homo sapiens
acactagctattaacttcacat

SEQ ID NO: 7651537 - DNA, 22 bp, Homo sapiens
acactagtagaatagtgtttgc

SEQ ID NO: 7651538 - DNA, 22 bp, Homo sapiens
acactagtatttctataagtga

SEQ ID NO: 7651539 - DNA, 22 bp, Homo sapiens
acactagtatttctataagtga

SEQ ID NO: 7651540 - DNA, 22 bp, Homo sapiens
acactataagacagatacagca

SEQ ID NO: 7651541 - DNA, 22 bp, Homo sapiens
acactagtggaaattgatttgt

SEQ ID NO: 7651542 - DNA, 22 bp, Homo sapiens
acactagtctcttcttgacttg

SEQ ID NO: 7651543 - DNA, 22 bp, Homo sapiens
acactctgtgaggcatgtaatg

SEQ ID NO: 7651544 - DNA, 22 bp, Homo sapiens
acactctgtgaggcatgtaatg

SEQ ID NO: 7651545 - DNA, 22 bp, Homo sapiens
acactctgtgaggcatgtaatg

SEQ ID NO: 7651546 - DNA, 22 bp, Homo sapiens
acactctgtaatgtcacactcc

SEQ ID NO: 7651547 - DNA, 22 bp, Homo sapiens
acactctgctctgagcttcagg

SEQ ID NO: 7651548 - DNA, 22 bp, Homo sapiens
acactctgtaatgtcacactcc

SEQ ID NO: 7651549 - DNA, 22 bp, Homo sapiens
acactctgtaatgtcacactcc

SEQ ID NO: 7651550 - DNA, 22 bp, Homo sapiens
acactctagagggaagcgcttt

SEQ ID NO: 7651551 - DNA, 22 bp, Homo sapiens
acactccagggagggagggaat

SEQ ID NO: 7651552 - DNA, 22 bp, Homo sapiens
acactctacagagcaatctacc

SEQ ID NO: 7651553 - DNA, 22 bp, Homo sapiens
acactcaccctcccactgcctg

SEQ ID NO: 7651554 - DNA, 22 bp, Homo sapiens
acactcaaagcagggagtgttc

SEQ ID NO: 7651555 - DNA, 22 bp, Homo sapiens
acactatttaaatctaacctgt

SEQ ID NO: 7651556 - DNA, 22 bp, Homo sapiens
acactagtggaaattgatttgt

SEQ ID NO: 7651557 - DNA, 22 bp, Homo sapiens
acactatacttccattgctggt

SEQ ID NO: 7651558 - DNA, 22 bp, Homo sapiens
acactatacttccattgctggt

SEQ ID NO: 7651559 - DNA, 22 bp, Homo sapiens
acactataagacagatacagca

SEQ ID NO: 7651560 - DNA, 22 bp, Homo sapiens
acactcaccctcccactgcctg

SEQ ID NO: 7651561 - DNA, 22 bp, Homo sapiens
acactcagtaaacgacaatggg

SEQ ID NO: 7651562 - DNA, 22 bp, Homo sapiens
acactcagtaaacgacaatggg

SEQ ID NO: 7651563 - DNA, 22 bp, Homo sapiens
acactccagggagggagggaat

SEQ ID NO: 7651564 - DNA, 22 bp, Homo sapiens
acactgaatatacaatgaatat

SEQ ID NO: 7651565 - DNA, 22 bp, Homo sapiens
acactgaatcagaaattgttgg

SEQ ID NO: 7651566 - DNA, 22 bp, Homo sapiens
acactgaatatacaatgaatat

SEQ ID NO: 7651567 - DNA, 22 bp, Homo sapiens
acactgaatatacaatgaatat

SEQ ID NO: 7651568 - DNA, 22 bp, Homo sapiens
acactgaatatacaatgaatat

SEQ ID NO: 7651569 - DNA, 22 bp, Homo sapiens
acactgaagagcactttcaaag

SEQ ID NO: 7651570 - DNA, 22 bp, Homo sapiens
acactgaagagcactttcaaag

SEQ ID NO: 7651571 - DNA, 22 bp, Homo sapiens
acactgaagagcactttcaaag

SEQ ID NO: 7651572 - DNA, 22 bp, Homo sapiens
acactgaaggctacaaggttga

SEQ ID NO: 7651573 - DNA, 22 bp, Homo sapiens
acactgaaagaagccagcttgt

SEQ ID NO: 7651574 - DNA, 23 bp, Homo sapiens
acactcttcccagaaggttctga

SEQ ID NO: 7651575 - DNA, 22 bp, Homo sapiens
acactcttctcacagtcagttt

SEQ ID NO: 7651576 - DNA, 22 bp, Homo sapiens
acactgactgggacagaagacc

SEQ ID NO: 7651577 - DNA, 22 bp, Homo sapiens
acactgacgcttgacagtcacc

SEQ ID NO: 7651578 - DNA, 22 bp, Homo sapiens
acactgacgcttgacagtcacc

SEQ ID NO: 7651579 - DNA, 22 bp, Homo sapiens
acactgactgggacagaagacc

SEQ ID NO: 7651580 - DNA, 22 bp, Homo sapiens
acactgactgggacagaagacc

SEQ ID NO: 7651581 - DNA, 22 bp, Homo sapiens
acactgagcttccaagatgggg

SEQ ID NO: 7651582 - DNA, 22 bp, Homo sapiens
acactgagcatctctagaggca

SEQ ID NO: 7651583 - DNA, 22 bp, Homo sapiens
acactgagattttcctgacacc

SEQ ID NO: 7651584 - DNA, 22 bp, Homo sapiens
acactgagaggtgacagcgtgc

SEQ ID NO: 7651585 - DNA, 22 bp, Homo sapiens
acactgagattttcctgacacc

SEQ ID NO: 7651586 - DNA, 22 bp, Homo sapiens
acactgaatgctgtttagaaat

SEQ ID NO: 7651587 - DNA, 22 bp, Homo sapiens
acactgaatgctgtttagaaat

SEQ ID NO: 7651588 - DNA, 22 bp, Homo sapiens
acactgaatgtttaagaacttg

SEQ ID NO: 7651589 - DNA, 19 bp, Homo sapiens
acactgaatgtagaattgg

SEQ ID NO: 7651590 - DNA, 22 bp, Homo sapiens
acactgaatgtttaagaacttg

SEQ ID NO: 7651591 - DNA, 22 bp, Homo sapiens
acactgaatgtttaagaacttg

SEQ ID NO: 7651592 - DNA, 22 bp, Homo sapiens
acactgaatgtttaagaacttg

SEQ ID NO: 7651593 - DNA, 22 bp, Homo sapiens
acactgaatgtttaagaacttg

SEQ ID NO: 7651594 - DNA, 17 bp, Homo sapiens
acactgacatgccacac

SEQ ID NO: 7651595 - DNA, 22 bp, Homo sapiens
acacttcagcagtatgcttggg

SEQ ID NO: 7651596 - DNA, 22 bp, Homo sapiens
acactttacagaatgttttgat

SEQ ID NO: 7651597 - DNA, 22 bp, Homo sapiens
acacttcagcagtatgcttggg

SEQ ID NO: 7651598 - DNA, 22 bp, Homo sapiens
acacttcagctccacaaacatt

SEQ ID NO: 7651599 - DNA, 22 bp, Homo sapiens
acactttacagcttcctttgca

SEQ ID NO: 7651600 - DNA, 22 bp, Homo sapiens
acactttacagcttcctttgca

SEQ ID NO: 7651601 - DNA, 22 bp, Homo sapiens
acactttacagcttcctttgca

SEQ ID NO: 7651602 - DNA, 22 bp, Homo sapiens
acactttactcttacaccattg

SEQ ID NO: 7651603 - DNA, 22 bp, Homo sapiens
acactttactcttacaccattg

SEQ ID NO: 7651604 - DNA, 22 bp, Homo sapiens
acactttagaaaaaagaatggt

SEQ ID NO: 7651605 - DNA, 22 bp, Homo sapiens
acactttagaaaaaagaatggt

SEQ ID NO: 7651606 - DNA, 22 bp, Homo sapiens
acactttagtatgaagaggtag

SEQ ID NO: 7651607 - DNA, 22 bp, Homo sapiens
acactttagtatgaagaggtag

SEQ ID NO: 7651608 - DNA, 22 bp, Homo sapiens
acactttagatattcccttctg

SEQ ID NO: 7651609 - DNA, 22 bp, Homo sapiens
acactttactcttacaccattg

SEQ ID NO: 7651610 - DNA, 22 bp, Homo sapiens
acactttagaaaaaagaatggt

SEQ ID NO: 7651611 - DNA, 22 bp, Homo sapiens
acactttagaaaaaagaatggt

SEQ ID NO: 7651612 - DNA, 22 bp, Homo sapiens
acacttcacccctgctcccagt

SEQ ID NO: 7651613 - DNA, 22 bp, Homo sapiens
acacttcacccctgctcccagt

SEQ ID NO: 7651614 - DNA, 22 bp, Homo sapiens
acacttcacccctgctcccagt

SEQ ID NO: 7651615 - DNA, 22 bp, Homo sapiens
acacttcacccctgctcccagt

SEQ ID NO: 7651616 - DNA, 22 bp, Homo sapiens
acactgcagatgaaagcataag

SEQ ID NO: 7651617 - DNA, 22 bp, Homo sapiens
acactgattgtagtctgtggtg

SEQ ID NO: 7651618 - DNA, 22 bp, Homo sapiens
acactgatgttggccctggtca

SEQ ID NO: 7651619 - DNA, 19 bp, Homo sapiens
acactgatcagatcagcag

SEQ ID NO: 7651620 - DNA, 22 bp, Homo sapiens
acactgagttttaccaggcaca

SEQ ID NO: 7651621 - DNA, 19 bp, Homo sapiens
acactgatcagatcagcag

SEQ ID NO: 7651622 - DNA, 19 bp, Homo sapiens
acactgatcagatcagcag

SEQ ID NO: 7651623 - DNA, 22 bp, Homo sapiens
acactgagtattgagtagggta

SEQ ID NO: 7651624 - DNA, 22 bp, Homo sapiens
acactgagtattgagtagggta

SEQ ID NO: 7651625 - DNA, 22 bp, Homo sapiens
acactgagtattgagtagggta

SEQ ID NO: 7651626 - DNA, 22 bp, Homo sapiens
acactgagttttaccaggcaca

SEQ ID NO: 7651627 - DNA, 22 bp, Homo sapiens
acacatgtgattctaagacagc

SEQ ID NO: 7651628 - DNA, 22 bp, Homo sapiens
acacatgtgattctaagacagc

SEQ ID NO: 7651629 - DNA, 22 bp, Homo sapiens
acacatgtgattctaagacagc

SEQ ID NO: 7651630 - DNA, 22 bp, Homo sapiens
acacatgtgattctaagacagc

SEQ ID NO: 7651631 - DNA, 20 bp, Homo sapiens
acacatgtgcgtgttcagta

SEQ ID NO: 7651632 - DNA, 22 bp, Homo sapiens
acacatgtgattctaagacagc

SEQ ID NO: 7651633 - DNA, 22 bp, Homo sapiens
acacatgtatgttttgtatttg

SEQ ID NO: 7651634 - DNA, 22 bp, Homo sapiens
acacatgtatgttttgtatttg

SEQ ID NO: 7651635 - DNA, 22 bp, Homo sapiens
acacatgtatgttttgtatttg

SEQ ID NO: 7651636 - DNA, 22 bp, Homo sapiens
acacatgtatgttttgtatttg

SEQ ID NO: 7651637 - DNA, 20 bp, Homo sapiens
acacatgtcaagctaaaggc

SEQ ID NO: 7651638 - DNA, 20 bp, Homo sapiens
acacatgtcaagctaaaggc

SEQ ID NO: 7651639 - DNA, 22 bp, Homo sapiens
acacatgtgattctaagacagc

SEQ ID NO: 7651640 - DNA, 20 bp, Homo sapiens
acacatgtcaagctaaaggc

SEQ ID NO: 7651641 - DNA, 22 bp, Homo sapiens
acacatgtatggcacttacatt

SEQ ID NO: 7651642 - DNA, 22 bp, Homo sapiens
acacatgtatgttttgtatttg

SEQ ID NO: 7651643 - DNA, 22 bp, Homo sapiens
acacatgtatggcacttacatt

SEQ ID NO: 7651644 - DNA, 22 bp, Homo sapiens
acacatgtatatgcttgtgtgt

SEQ ID NO: 7651645 - DNA, 22 bp, Homo sapiens
acacatgtatatgcttgtgtgt

SEQ ID NO: 7651646 - DNA, 22 bp, Homo sapiens
acacatgtatatgcttgtgtgt

SEQ ID NO: 7651647 - DNA, 22 bp, Homo sapiens
acacatgtatatgcttgtgtgt

SEQ ID NO: 7651648 - DNA, 22 bp, Homo sapiens
acacatgtacagattagtattt

SEQ ID NO: 7651649 - DNA, 22 bp, Homo sapiens
acacatgtatatgcttgtgtgt

SEQ ID NO: 7651650 - DNA, 22 bp, Homo sapiens
acacatgtacagattagtattt

SEQ ID NO: 7651651 - DNA, 22 bp, Homo sapiens
acacatgtacagattagtattt

SEQ ID NO: 7651652 - DNA, 19 bp, Homo sapiens
acacatgtaacagtttttc

SEQ ID NO: 7651653 - DNA, 19 bp, Homo sapiens
acacatgtaacagtttttc

SEQ ID NO: 7651654 - DNA, 19 bp, Homo sapiens
acacatgtaacagtttttc

SEQ ID NO: 7651655 - DNA, 19 bp, Homo sapiens
acacatgtaacagtttttc

SEQ ID NO: 7651656 - DNA, 22 bp, Homo sapiens
acacatgttcaagaatgttcag

SEQ ID NO: 7651657 - DNA, 19 bp, Homo sapiens
acacatgtgtgttatgtgc

SEQ ID NO: 7651658 - DNA, 19 bp, Homo sapiens
acacatgtgtgttatgtgc

SEQ ID NO: 7651659 - DNA, 22 bp, Homo sapiens
acacatgttcaagaatgttcag

SEQ ID NO: 7651660 - DNA, 22 bp, Homo sapiens
acacatgtttacagtcttcagt

SEQ ID NO: 7651661 - DNA, 22 bp, Homo sapiens
acacatgtttacagtcttcagt

SEQ ID NO: 7651662 - DNA, 22 bp, Homo sapiens
acacatgtttacagtcttcagt

SEQ ID NO: 7651663 - DNA, 22 bp, Homo sapiens
acacatgtttacagtcttcagt

SEQ ID NO: 7651664 - DNA, 22 bp, Homo sapiens
acacatgtgtctgcatgcagtg

SEQ ID NO: 7651665 - DNA, 20 bp, Homo sapiens
acacatgtgcgtgttcagta

SEQ ID NO: 7651666 - DNA, 20 bp, Homo sapiens
acacatgtgcgtgttcagta

SEQ ID NO: 7651667 - DNA, 20 bp, Homo sapiens
acacatgtgcgtgttcagta

SEQ ID NO: 7651668 - DNA, 20 bp, Homo sapiens
acacatgtgcgtgttcagta

SEQ ID NO: 7651669 - DNA, 19 bp, Homo sapiens
acacatgtgtgttatgtgc

SEQ ID NO: 7651670 - DNA, 22 bp, Homo sapiens
acacatgtgtctgcatgcagtg

SEQ ID NO: 7651671 - DNA, 22 bp, Homo sapiens
acacatgtgtctgcatgcagtg

SEQ ID NO: 7651672 - DNA, 22 bp, Homo sapiens
acacattaacctttgaaattct

SEQ ID NO: 7651673 - DNA, 22 bp, Homo sapiens
acacattaacctttgaaattct

SEQ ID NO: 7651674 - DNA, 22 bp, Homo sapiens
acacattaacctttgaaattct

SEQ ID NO: 7651675 - DNA, 22 bp, Homo sapiens
acacattaacctttgaaattct

SEQ ID NO: 7651676 - DNA, 22 bp, Homo sapiens
acacattaaaacgtctacaatg

SEQ ID NO: 7651677 - DNA, 22 bp, Homo sapiens
acacattaaaacgtctacaatg

SEQ ID NO: 7651678 - DNA, 22 bp, Homo sapiens
acacattaaaacgtctacaatg

SEQ ID NO: 7651679 - DNA, 22 bp, Homo sapiens
acacattaaaacgtctacaatg

SEQ ID NO: 7651680 - DNA, 22 bp, Homo sapiens
acacattaaaacgtctacaatg

SEQ ID NO: 7651681 - DNA, 22 bp, Homo sapiens
acacattaaaacgtctacaatg

SEQ ID NO: 7651682 - DNA, 22 bp, Homo sapiens
acacattaaaacgtctacaatg

SEQ ID NO: 7651683 - DNA, 22 bp, Homo sapiens
acacatgtttgtgtagtcagtt

SEQ ID NO: 7651684 - DNA, 22 bp, Homo sapiens
acacatgtttccaaaagcaccc

SEQ ID NO: 7651685 - DNA, 22 bp, Homo sapiens
acacatgtttccaaaagcaccc

SEQ ID NO: 7651686 - DNA, 22 bp, Homo sapiens
acacatgtttgtgtagtcagtt

SEQ ID NO: 7651687 - DNA, 22 bp, Homo sapiens
acacatgtttgtgtagtcagtt

SEQ ID NO: 7651688 - DNA, 23 bp, Homo sapiens
acacatgtttatgcttgggggca

SEQ ID NO: 7651689 - DNA, 22 bp, Homo sapiens
acacatgtttccaaaagcaccc

SEQ ID NO: 7651690 - DNA, 22 bp, Homo sapiens
acacatgtttccaaaagcaccc

SEQ ID NO: 7651691 - DNA, 22 bp, Homo sapiens
agcagctggttcccgagggcgt

SEQ ID NO: 7651692 - DNA, 22 bp, Homo sapiens
agcagctggttcccgagggcgt

SEQ ID NO: 7651693 - DNA, 22 bp, Homo sapiens
agcagctgtactttcatctgtt

SEQ ID NO: 7651694 - DNA, 22 bp, Homo sapiens
agcagctgtactttcatctgtt

SEQ ID NO: 7651695 - DNA, 22 bp, Homo sapiens
agcagctgtactttcatctgtt

SEQ ID NO: 7651696 - DNA, 22 bp, Homo sapiens
agcagctggttcccgagggcgt

SEQ ID NO: 7651697 - DNA, 22 bp, Homo sapiens
agcagctggttcccgagggcgt

SEQ ID NO: 7651698 - DNA, 22 bp, Homo sapiens
agcagctggttcccgagggcgt

SEQ ID NO: 7651699 - DNA, 22 bp, Homo sapiens
agcagctggttcccgagggcgt

SEQ ID NO: 7651700 - DNA, 22 bp, Homo sapiens
agcagctggttcccgagggcgt

SEQ ID NO: 7651701 - DNA, 22 bp, Homo sapiens
agcagctggtgcaactctaaga

SEQ ID NO: 7651702 - DNA, 22 bp, Homo sapiens
agcagctggtgcaactctaaga

SEQ ID NO: 7651703 - DNA, 18 bp, Homo sapiens
acacaggctgacagcacc

SEQ ID NO: 7651704 - DNA, 18 bp, Homo sapiens
acacaggctgacagcacc

SEQ ID NO: 7651705 - DNA, 18 bp, Homo sapiens
acacaggctgacagcacc

SEQ ID NO: 7651706 - DNA, 22 bp, Homo sapiens
acacaggcatagccatacatgt

SEQ ID NO: 7651707 - DNA, 22 bp, Homo sapiens
acacaggcatagccatacatgt

SEQ ID NO: 7651708 - DNA, 22 bp, Homo sapiens
agcagctgtactttcatctgtt

SEQ ID NO: 7651709 - DNA, 18 bp, Homo sapiens
acacaggctgacagcacc

SEQ ID NO: 7651710 - DNA, 18 bp, Homo sapiens
acacaggctgacagcacc

SEQ ID NO: 7651711 - DNA, 18 bp, Homo sapiens
acacaggctgacagcacc

SEQ ID NO: 7651712 - DNA, 18 bp, Homo sapiens
acacaggctgacagcacc

SEQ ID NO: 7651713 - DNA, 18 bp, Homo sapiens
acacaggctgacagcacc

SEQ ID NO: 7651714 - DNA, 17 bp, Homo sapiens
acacagggagagggagc

SEQ ID NO: 7651715 - DNA, 17 bp, Homo sapiens
acacagggagagggagc

SEQ ID NO: 7651716 - DNA, 17 bp, Homo sapiens
acacagggagagggagc

SEQ ID NO: 7651717 - DNA, 17 bp, Homo sapiens
acacagggagagggagc

SEQ ID NO: 7651718 - DNA, 17 bp, Homo sapiens
acacagggagagggagc

SEQ ID NO: 7651719 - DNA, 17 bp, Homo sapiens
acacagggagagggagc

SEQ ID NO: 7651720 - DNA, 17 bp, Homo sapiens
acacagggagagggagc

SEQ ID NO: 7651721 - DNA, 17 bp, Homo sapiens
acacagggagagggagc

SEQ ID NO: 7651722 - DNA, 17 bp, Homo sapiens
acacagggagagggagc

SEQ ID NO: 7651723 - DNA, 22 bp, Homo sapiens
acacagggatatttcaggtggt

SEQ ID NO: 7651724 - DNA, 22 bp, Homo sapiens
acacagggatatttcaggtggt

SEQ ID NO: 7651725 - DNA, 22 bp, Homo sapiens
acacagggatatttcaggtggt

SEQ ID NO: 7651726 - DNA, 22 bp, Homo sapiens
acacagggatatttcaggtggt

SEQ ID NO: 7651727 - DNA, 22 bp, Homo sapiens
acacagggatatttcaggtggt

SEQ ID NO: 7651728 - DNA, 22 bp, Homo sapiens
acacagggaggaggtgctgtgc

SEQ ID NO: 7651729 - DNA, 22 bp, Homo sapiens
acacagggaggaggtgctgtgc

SEQ ID NO: 7651730 - DNA, 22 bp, Homo sapiens
acacagggaggaggtgctgtgc

SEQ ID NO: 7651731 - DNA, 22 bp, Homo sapiens
acacagggaggaggtgctgtgc

SEQ ID NO: 7651732 - DNA, 22 bp, Homo sapiens
acacagggaggaggtgctgtgc

SEQ ID NO: 7651733 - DNA, 19 bp, Homo sapiens
acacatgtaacagtttttc

SEQ ID NO: 7651734 - DNA, 22 bp, Homo sapiens
acacatgtaaaacacttagcaa

SEQ ID NO: 7651735 - DNA, 22 bp, Homo sapiens
acacatgtaaaacacttagcaa

SEQ ID NO: 7651736 - DNA, 22 bp, Homo sapiens
acacatggtggctggactatag

SEQ ID NO: 7651737 - DNA, 22 bp, Homo sapiens
acacatggtggctggactatag

SEQ ID NO: 7651738 - DNA, 22 bp, Homo sapiens
acacatcttagactgaaatatg

SEQ ID NO: 7651739 - DNA, 22 bp, Homo sapiens
acacatgctgataagaatataa

SEQ ID NO: 7651740 - DNA, 22 bp, Homo sapiens
acacatggattgcttagctgga

SEQ ID NO: 7651741 - DNA, 22 bp, Homo sapiens
acacatgggtggggagctaagt

SEQ ID NO: 7651742 - DNA, 22 bp, Homo sapiens
acacatgggtggggagctaagt

SEQ ID NO: 7651743 - DNA, 22 bp, Homo sapiens
acacatgggtggggagctaagt

SEQ ID NO: 7651744 - DNA, 22 bp, Homo sapiens
acacatgggtggggagctaagt

SEQ ID NO: 7651745 - DNA, 22 bp, Homo sapiens
acacatgggtggggagctaagt

SEQ ID NO: 7651746 - DNA, 22 bp, Homo sapiens
acacatggtctacttcttctca

SEQ ID NO: 7651747 - DNA, 22 bp, Homo sapiens
acacatcttagactgaaatatg

SEQ ID NO: 7651748 - DNA, 22 bp, Homo sapiens
acacatcttagactgaaatatg

SEQ ID NO: 7651749 - DNA, 22 bp, Homo sapiens
acacagggcggaaagcatgaga

SEQ ID NO: 7651750 - DNA, 22 bp, Homo sapiens
acacagggcggaaagcatgaga

SEQ ID NO: 7651751 - DNA, 22 bp, Homo sapiens
acacagggcggaaagcatgaga

SEQ ID NO: 7651752 - DNA, 22 bp, Homo sapiens
acacagggcggaaagcatgaga

SEQ ID NO: 7651753 - DNA, 22 bp, Homo sapiens
acacatctccagccagcaggag

SEQ ID NO: 7651754 - DNA, 22 bp, Homo sapiens
acacagggcagagagctggctc

SEQ ID NO: 7651755 - DNA, 22 bp, Homo sapiens
acacagggcagagagctggctc

SEQ ID NO: 7651756 - DNA, 22 bp, Homo sapiens
acacagggcggaaagcatgaga

SEQ ID NO: 7651757 - DNA, 22 bp, Homo sapiens
acacagggcggaaagcatgaga

SEQ ID NO: 7651758 - DNA, 22 bp, Homo sapiens
acacagggcagagagctggctc

SEQ ID NO: 7651759 - DNA, 22 bp, Homo sapiens
acacagggcagagagctggctc

SEQ ID NO: 7651760 - DNA, 22 bp, Homo sapiens
acacagggcagagagctggctc

SEQ ID NO: 7651761 - DNA, 22 bp, Homo sapiens
acacagggcagagagctggctc

SEQ ID NO: 7651762 - DNA, 22 bp, Homo sapiens
acacagggcaatgctttgacct

SEQ ID NO: 7651763 - DNA, 22 bp, Homo sapiens
acacagggcaatgctttgacct

SEQ ID NO: 7651764 - DNA, 19 bp, Homo sapiens
acacagggatcagagggtt

SEQ ID NO: 7651765 - DNA, 19 bp, Homo sapiens
acacagggatcagagggtt

SEQ ID NO: 7651766 - DNA, 19 bp, Homo sapiens
acacagggatcagagggtt

SEQ ID NO: 7651767 - DNA, 19 bp, Homo sapiens
acacagggatcagagggtt

SEQ ID NO: 7651768 - DNA, 19 bp, Homo sapiens
acacagggatcagagggtt

SEQ ID NO: 7651769 - DNA, 19 bp, Homo sapiens
acacagggatcagagggtt

SEQ ID NO: 7651770 - DNA, 19 bp, Homo sapiens
acacagggatcagagggtt

SEQ ID NO: 7651771 - DNA, 22 bp, Homo sapiens
agagacaggatatctgctcatg

SEQ ID NO: 7651772 - DNA, 22 bp, Homo sapiens
agagacaggatatctgctcatg

SEQ ID NO: 7651773 - DNA, 22 bp, Homo sapiens
agagacaggatatctgctcatg

SEQ ID NO: 7651774 - DNA, 22 bp, Homo sapiens
agagacaggatatctgctcatg

SEQ ID NO: 7651775 - DNA, 22 bp, Homo sapiens
agagacaggatatctgctcatg

SEQ ID NO: 7651776 - DNA, 22 bp, Homo sapiens
agagacaggatatctgctcatg

SEQ ID NO: 7651777 - DNA, 22 bp, Homo sapiens
agagacaggatatctgctcatg

SEQ ID NO: 7651778 - DNA, 22 bp, Homo sapiens
agagacaggatatctgctcatg

SEQ ID NO: 7651779 - DNA, 22 bp, Homo sapiens
agagacagggttttgccatgtt

SEQ ID NO: 7651780 - DNA, 22 bp, Homo sapiens
agagacagggttttgccatgtt

SEQ ID NO: 7651781 - DNA, 22 bp, Homo sapiens
agagacagggttttgccatgtt

SEQ ID NO: 7651782 - DNA, 22 bp, Homo sapiens
agagacagggttttgccatgtt

SEQ ID NO: 7651783 - DNA, 22 bp, Homo sapiens
agagacagggttttgccatgtt

SEQ ID NO: 7651784 - DNA, 22 bp, Homo sapiens
agagacagggttttgccatgtt

SEQ ID NO: 7651785 - DNA, 22 bp, Homo sapiens
agagacagggttttgccatgtt

SEQ ID NO: 7651786 - DNA, 22 bp, Homo sapiens
agagcaggtggcaactctggga

SEQ ID NO: 7651787 - DNA, 22 bp, Homo sapiens
agagcaggtggcaactctggga

SEQ ID NO: 7651788 - DNA, 22 bp, Homo sapiens
agagcaggtggcaactctggga

SEQ ID NO: 7651789 - DNA, 22 bp, Homo sapiens
agagacagggttttgccatgtt

SEQ ID NO: 7651790 - DNA, 22 bp, Homo sapiens
agagacagggttttgccatgtt

SEQ ID NO: 7651791 - DNA, 22 bp, Homo sapiens
agagcaggtggcaactctggga

SEQ ID NO: 7651792 - DNA, 22 bp, Homo sapiens
agagcaggtggcaactctggga

SEQ ID NO: 7651793 - DNA, 22 bp, Homo sapiens
agagcaggtggcaactctggga

SEQ ID NO: 7651794 - DNA, 22 bp, Homo sapiens
agagcagtcaggaacatgctta

SEQ ID NO: 7651795 - DNA, 22 bp, Homo sapiens
agagcagtcaggaacatgctta

SEQ ID NO: 7651796 - DNA, 22 bp, Homo sapiens
agagcagtcaggctaggacact

SEQ ID NO: 7651797 - DNA, 22 bp, Homo sapiens
agagccaggcggctgggcacct

SEQ ID NO: 7651798 - DNA, 22 bp, Homo sapiens
agagccaggcggctgggcacct

SEQ ID NO: 7651799 - DNA, 22 bp, Homo sapiens
agagccaggcggctgggcacct

SEQ ID NO: 7651800 - DNA, 22 bp, Homo sapiens
agagccaggcggctgggcacct

SEQ ID NO: 7651801 - DNA, 22 bp, Homo sapiens
agagccaggcggctgggcacct

SEQ ID NO: 7651802 - DNA, 22 bp, Homo sapiens
agagccaggctcccatggggca

SEQ ID NO: 7651803 - DNA, 22 bp, Homo sapiens
agagccaggctcccatggggca

SEQ ID NO: 7651804 - DNA, 22 bp, Homo sapiens
agagccaggctcccatggggca

SEQ ID NO: 7651805 - DNA, 22 bp, Homo sapiens
agagccaggcggctgggcacct

SEQ ID NO: 7651806 - DNA, 22 bp, Homo sapiens
agagccaggcggctgggcacct

SEQ ID NO: 7651807 - DNA, 22 bp, Homo sapiens
agagccaggcggctgggcacct

SEQ ID NO: 7651808 - DNA, 22 bp, Homo sapiens
agagccaggctcccatggggca

SEQ ID NO: 7651809 - DNA, 22 bp, Homo sapiens
agagccaggctcccatggggca

SEQ ID NO: 7651810 - DNA, 22 bp, Homo sapiens
agagccaggctcccatggggca

SEQ ID NO: 7651811 - DNA, 22 bp, Homo sapiens
agagccaggctcccatggggca

SEQ ID NO: 7651812 - DNA, 22 bp, Homo sapiens
agagccaggctcccatggggca

SEQ ID NO: 7651813 - DNA, 22 bp, Homo sapiens
agagccaggctcccatggggca

SEQ ID NO: 7651814 - DNA, 22 bp, Homo sapiens
agagccaggctcccatggggca

SEQ ID NO: 7651815 - DNA, 22 bp, Homo sapiens
agagccaggctctacctgggtt

SEQ ID NO: 7651816 - DNA, 22 bp, Homo sapiens
agagccaggctcccatggggca

SEQ ID NO: 7651817 - DNA, 22 bp, Homo sapiens
agagccaggctctacctgggtt

SEQ ID NO: 7651818 - DNA, 22 bp, Homo sapiens
agagccaggctctacctgggtt

SEQ ID NO: 7651819 - DNA, 22 bp, Homo sapiens
agagccaggctctacctgggtt

SEQ ID NO: 7651820 - DNA, 22 bp, Homo sapiens
agagccaggtgctgctgtttga

SEQ ID NO: 7651821 - DNA, 22 bp, Homo sapiens
agagccaggtgctgctgtttga

SEQ ID NO: 7651822 - DNA, 22 bp, Homo sapiens
agagccaggctctacctgggtt

SEQ ID NO: 7651823 - DNA, 22 bp, Homo sapiens
agagccaggctctacctgggtt

SEQ ID NO: 7651824 - DNA, 22 bp, Homo sapiens
agagccaggtgctgctgtttga

SEQ ID NO: 7651825 - DNA, 22 bp, Homo sapiens
agagccaggtgctgctgtttga

SEQ ID NO: 7651826 - DNA, 22 bp, Homo sapiens
agagccagttacaactgtggag

SEQ ID NO: 7651827 - DNA, 22 bp, Homo sapiens
agagccagttacaactgtggag

SEQ ID NO: 7651828 - DNA, 22 bp, Homo sapiens
agagccagttacaactgtggag

SEQ ID NO: 7651829 - DNA, 22 bp, Homo sapiens
agagccagttacaactgtggag

SEQ ID NO: 7651830 - DNA, 22 bp, Homo sapiens
agagccagttacaactgtggag

SEQ ID NO: 7651831 - DNA, 22 bp, Homo sapiens
agagccagttacaactgtggag

SEQ ID NO: 7651832 - DNA, 22 bp, Homo sapiens
agagccagttacaactgtggag

SEQ ID NO: 7651833 - DNA, 22 bp, Homo sapiens
agagccagttacaactgtggag

SEQ ID NO: 7651834 - DNA, 22 bp, Homo sapiens
agagccagttaagcacttacag

SEQ ID NO: 7651835 - DNA, 22 bp, Homo sapiens
agagccaggtgtagtctcggag

SEQ ID NO: 7651836 - DNA, 22 bp, Homo sapiens
agagccaggtgtagtctcggag

SEQ ID NO: 7651837 - DNA, 22 bp, Homo sapiens
agagccaggtgctgctgtttga

SEQ ID NO: 7651838 - DNA, 22 bp, Homo sapiens
agagccaggtgtagtctcggag

SEQ ID NO: 7651839 - DNA, 22 bp, Homo sapiens
agagccaggtgtagtctcggag

SEQ ID NO: 7651840 - DNA, 22 bp, Homo sapiens
agagccaggtgtagtctcggag

SEQ ID NO: 7651841 - DNA, 22 bp, Homo sapiens
agagccaggtgtagtctcggag

SEQ ID NO: 7651842 - DNA, 22 bp, Homo sapiens
agagccagttacaactgtggag

SEQ ID NO: 7651843 - DNA, 22 bp, Homo sapiens
agagccagttacaactgtggag

SEQ ID NO: 7651844 - DNA, 22 bp, Homo sapiens
agagccagttacaactgtggag

SEQ ID NO: 7651845 - DNA, 22 bp, Homo sapiens
agagccagttacaactgtggag

SEQ ID NO: 7651846 - DNA, 22 bp, Homo sapiens
agagccagttgttaagcactta

SEQ ID NO: 7651847 - DNA, 22 bp, Homo sapiens
agagccagttgttaagcactta

SEQ ID NO: 7651848 - DNA, 22 bp, Homo sapiens
agagccagttgttaagcactta

SEQ ID NO: 7651849 - DNA, 22 bp, Homo sapiens
agagcctgcatctagcctcaga

SEQ ID NO: 7651850 - DNA, 22 bp, Homo sapiens
agagcctgcatctagcctcaga

SEQ ID NO: 7651851 - DNA, 22 bp, Homo sapiens
agagcctgcatctagcctcaga

SEQ ID NO: 7651852 - DNA, 22 bp, Homo sapiens
agagcctgcatctagcctcaga

SEQ ID NO: 7651853 - DNA, 22 bp, Homo sapiens
agagcctgcatcaggcttgggg

SEQ ID NO: 7651854 - DNA, 22 bp, Homo sapiens
agagccagttgttaagcactta

SEQ ID NO: 7651855 - DNA, 22 bp, Homo sapiens
agagcctgcatcaggcttgggg

SEQ ID NO: 7651856 - DNA, 22 bp, Homo sapiens
agagcctgcatcaggcttgggg

SEQ ID NO: 7651857 - DNA, 22 bp, Homo sapiens
agagcctggacctgagctacaa

SEQ ID NO: 7651858 - DNA, 22 bp, Homo sapiens
agagcctggacctgagctacaa

SEQ ID NO: 7651859 - DNA, 22 bp, Homo sapiens
agagcctggacctgagctacaa

SEQ ID NO: 7651860 - DNA, 22 bp, Homo sapiens
agagcctggacctgggctctga

SEQ ID NO: 7651861 - DNA, 22 bp, Homo sapiens
agagcctggacctgggctctga

SEQ ID NO: 7651862 - DNA, 20 bp, Homo sapiens
agagcctggaaaaagacatc

SEQ ID NO: 7651863 - DNA, 20 bp, Homo sapiens
agagcctggaaaaagacatc

SEQ ID NO: 7651864 - DNA, 22 bp, Homo sapiens
agagcctgctacctcattccag

SEQ ID NO: 7651865 - DNA, 22 bp, Homo sapiens
agagcctgctacctcattccag

SEQ ID NO: 7651866 - DNA, 22 bp, Homo sapiens
agagcctgctgtgtaagtcaca

SEQ ID NO: 7651867 - DNA, 22 bp, Homo sapiens
agagcctggaggttctgctgaa

SEQ ID NO: 7651868 - DNA, 22 bp, Homo sapiens
agagcctggaggttctgctgaa

SEQ ID NO: 7651869 - DNA, 22 bp, Homo sapiens
agagcctggaggttctgctgaa

SEQ ID NO: 7651870 - DNA, 22 bp, Homo sapiens
agagcctggacttttctgagcc

SEQ ID NO: 7651871 - DNA, 22 bp, Homo sapiens
agagcctggacctgggctctga

SEQ ID NO: 7651872 - DNA, 22 bp, Homo sapiens
agagcctggacttttctgagcc

SEQ ID NO: 7651873 - DNA, 22 bp, Homo sapiens
agagcctggaggttctgctgaa

SEQ ID NO: 7651874 - DNA, 22 bp, Homo sapiens
agagcctggaggttctgctgaa

SEQ ID NO: 7651875 - DNA, 22 bp, Homo sapiens
agagcctggcaaaaggtcctgc

SEQ ID NO: 7651876 - DNA, 22 bp, Homo sapiens
agagcctggcaaaaggtcctgc

SEQ ID NO: 7651877 - DNA, 22 bp, Homo sapiens
aattccaggcagaaatgtgagt

SEQ ID NO: 7651878 - DNA, 22 bp, Homo sapiens
aattccaggcagaaatgtgagt

SEQ ID NO: 7651879 - DNA, 22 bp, Homo sapiens
aattccagggggtaccattcat

SEQ ID NO: 7651880 - DNA, 22 bp, Homo sapiens
aattccagggggtaccattcat

SEQ ID NO: 7651881 - DNA, 22 bp, Homo sapiens
aattccagggtacctctgattt

SEQ ID NO: 7651882 - DNA, 22 bp, Homo sapiens
aattctgatgaataaatcatcc

SEQ ID NO: 7651883 - DNA, 22 bp, Homo sapiens
aattctgatgaataaatcatcc

SEQ ID NO: 7651884 - DNA, 22 bp, Homo sapiens
aattctgatgaataaatcatcc

SEQ ID NO: 7651885 - DNA, 22 bp, Homo sapiens
aattctgatgaataaatcatcc

SEQ ID NO: 7651886 - DNA, 22 bp, Homo sapiens
aattctgatgaataaatcatcc

SEQ ID NO: 7651887 - DNA, 22 bp, Homo sapiens
aattctgatgagtcagagaaag

SEQ ID NO: 7651888 - DNA, 22 bp, Homo sapiens
aattctgatgatactgcattgt

SEQ ID NO: 7651889 - DNA, 22 bp, Homo sapiens
aattctgatgatactgcattgt

SEQ ID NO: 7651890 - DNA, 22 bp, Homo sapiens
aattctgattagatgcctttgt

SEQ ID NO: 7651891 - DNA, 22 bp, Homo sapiens
aattctgcttcatcagctcttt

SEQ ID NO: 7651892 - DNA, 22 bp, Homo sapiens
aattctgatccagaacctgtca

SEQ ID NO: 7651893 - DNA, 22 bp, Homo sapiens
aattctgaggagggaagaggaa

SEQ ID NO: 7651894 - DNA, 22 bp, Homo sapiens
aattccagtaggcaccactcat

SEQ ID NO: 7651895 - DNA, 22 bp, Homo sapiens
aattccagtctctgctctattt

SEQ ID NO: 7651896 - DNA, 22 bp, Homo sapiens
aattccagggttagctcatttg

SEQ ID NO: 7651897 - DNA, 22 bp, Homo sapiens
aattccagtaggcaccactcat

SEQ ID NO: 7651898 - DNA, 22 bp, Homo sapiens
aattccatccatttgtttcaac

SEQ ID NO: 7651899 - DNA, 22 bp, Homo sapiens
aattaaaagataacccatgagt

SEQ ID NO: 7651900 - DNA, 22 bp, Homo sapiens
aattaaaagataacccatgagt

SEQ ID NO: 7651901 - DNA, 22 bp, Homo sapiens
aattaaaagataacccatgagt

SEQ ID NO: 7651902 - DNA, 22 bp, Homo sapiens
aattaaaagataacccatgagt

SEQ ID NO: 7651903 - DNA, 22 bp, Homo sapiens
aattaaaagataacccatgagt

SEQ ID NO: 7651904 - DNA, 22 bp, Homo sapiens
aattaaaagataacccatgagt

SEQ ID NO: 7651905 - DNA, 22 bp, Homo sapiens
aattaaaagataacccatgagt

SEQ ID NO: 7651906 - DNA, 22 bp, Homo sapiens
aattaaaagataacccatgagt

SEQ ID NO: 7651907 - DNA, 22 bp, Homo sapiens
aattaaaagataacccatgagt

SEQ ID NO: 7651908 - DNA, 22 bp, Homo sapiens
aattaaaaaaggagagcttgct

SEQ ID NO: 7651909 - DNA, 22 bp, Homo sapiens
aattaaaaaaggagagcttgct

SEQ ID NO: 7651910 - DNA, 22 bp, Homo sapiens
aattaaaaaaggagagcttgct

SEQ ID NO: 7651911 - DNA, 22 bp, Homo sapiens
aattaaaaaaggagagcttgct

SEQ ID NO: 7651912 - DNA, 22 bp, Homo sapiens
aattaaaagataacccatgagt

SEQ ID NO: 7651913 - DNA, 22 bp, Homo sapiens
aattaaaagataacccatgagt

SEQ ID NO: 7651914 - DNA, 22 bp, Homo sapiens
aattaaaagataacccatgagt

SEQ ID NO: 7651915 - DNA, 22 bp, Homo sapiens
aattaaaagataacccatgagt

SEQ ID NO: 7651916 - DNA, 22 bp, Homo sapiens
aattaaaaaaggagagcttgct

SEQ ID NO: 7651917 - DNA, 22 bp, Homo sapiens
aattaaattggtttagagagga

SEQ ID NO: 7651918 - DNA, 22 bp, Homo sapiens
aattaaattggtttagagagga

SEQ ID NO: 7651919 - DNA, 22 bp, Homo sapiens
aattaaattggtttagagagga

SEQ ID NO: 7651920 - DNA, 22 bp, Homo sapiens
aattaaatgacaggggaagatg

SEQ ID NO: 7651921 - DNA, 23 bp, Homo sapiens
aattaaattgctagatccagggc

SEQ ID NO: 7651922 - DNA, 23 bp, Homo sapiens
aattaaattgctagatccagggc

SEQ ID NO: 7651923 - DNA, 22 bp, Homo sapiens
agagacaggagttctgtttcca

SEQ ID NO: 7651924 - DNA, 22 bp, Homo sapiens
agagacaggagttctgtttcca

SEQ ID NO: 7651925 - DNA, 22 bp, Homo sapiens
agagacaggaatggcattaaga

SEQ ID NO: 7651926 - DNA, 22 bp, Homo sapiens
agagacaggaatggcattaaga

SEQ ID NO: 7651927 - DNA, 22 bp, Homo sapiens
agagacaggagttctgtttcca

SEQ ID NO: 7651928 - DNA, 22 bp, Homo sapiens
agagacaggagttctgtttcca

SEQ ID NO: 7651929 - DNA, 22 bp, Homo sapiens
agagacaggatatctgctcatg

SEQ ID NO: 7651930 - DNA, 22 bp, Homo sapiens
agagacaggatatctgctcatg

SEQ ID NO: 7651931 - DNA, 22 bp, Homo sapiens
agagacaggagttctgtttcca

SEQ ID NO: 7651932 - DNA, 22 bp, Homo sapiens
agagacaggagttctgtttcca

SEQ ID NO: 7651933 - DNA, 22 bp, Homo sapiens
agagacaggaatggcattaaga

SEQ ID NO: 7651934 - DNA, 22 bp, Homo sapiens
agagacaggaatggcattaaga

SEQ ID NO: 7651935 - DNA, 22 bp, Homo sapiens
agagacaggaatggcattaaga

SEQ ID NO: 7651936 - DNA, 18 bp, Homo sapiens
agagacagcagcaaaaga

SEQ ID NO: 7651937 - DNA, 22 bp, Homo sapiens
agagacaggaatggcattaaga

SEQ ID NO: 7651938 - DNA, 22 bp, Homo sapiens
agagacaggaatggcattaaga

SEQ ID NO: 7651939 - DNA, 22 bp, Homo sapiens
agagacaggaatggcattaaga

SEQ ID NO: 7651940 - DNA, 18 bp, Homo sapiens
agagacagcagcaaaaga

SEQ ID NO: 7651941 - DNA, 18 bp, Homo sapiens
agagacagcagcaaaaga

SEQ ID NO: 7651942 - DNA, 18 bp, Homo sapiens
agagacagcagcaaaaga

SEQ ID NO: 7651943 - DNA, 18 bp, Homo sapiens
agagacagcagcaaaaga

SEQ ID NO: 7651944 - DNA, 22 bp, Homo sapiens
agagacagatctgagggacctc

SEQ ID NO: 7651945 - DNA, 22 bp, Homo sapiens
agagacagaggcaatatagctt

SEQ ID NO: 7651946 - DNA, 22 bp, Homo sapiens
aattaacaaatgtagctgtgat

SEQ ID NO: 7651947 - DNA, 22 bp, Homo sapiens
aattaacagagggcttattact

SEQ ID NO: 7651948 - DNA, 22 bp, Homo sapiens
aattaacagagggcttattact

SEQ ID NO: 7651949 - DNA, 22 bp, Homo sapiens
aattaacaaatgtagctgtgat

SEQ ID NO: 7651950 - DNA, 22 bp, Homo sapiens
agagacagatctgagggacctc

SEQ ID NO: 7651951 - DNA, 22 bp, Homo sapiens
agagacagatctgagggacctc

SEQ ID NO: 7651952 - DNA, 18 bp, Homo sapiens
agagacagcagcaaaaga

SEQ ID NO: 7651953 - DNA, 18 bp, Homo sapiens
agagacagcagcaaaaga

SEQ ID NO: 7651954 - DNA, 18 bp, Homo sapiens
agagacagcagcaaaaga

SEQ ID NO: 7651955 - DNA, 18 bp, Homo sapiens
agagacagcagcaaaaga

SEQ ID NO: 7651956 - DNA, 18 bp, Homo sapiens
agagacagcagcaaaaga

SEQ ID NO: 7651957 - DNA, 22 bp, Homo sapiens
agagacagatctgagggacctc

SEQ ID NO: 7651958 - DNA, 22 bp, Homo sapiens
agagacagatctgagggacctc

SEQ ID NO: 7651959 - DNA, 22 bp, Homo sapiens
aatgtttggctagatagatgga

SEQ ID NO: 7651960 - DNA, 22 bp, Homo sapiens
agaccgagaagttctccaggcc

SEQ ID NO: 7651961 - DNA, 22 bp, Homo sapiens
agacctcaataccaggcaccac

SEQ ID NO: 7651962 - DNA, 22 bp, Homo sapiens
aatgtttggctagatagatgga

SEQ ID NO: 7651963 - DNA, 22 bp, Homo sapiens
aatgtttgtgcataaatatgtt

SEQ ID NO: 7651964 - DNA, 22 bp, Homo sapiens
aatgttttaaaagagattgaga

SEQ ID NO: 7651965 - DNA, 22 bp, Homo sapiens
aatgttttaaaagagattgaga

SEQ ID NO: 7651966 - DNA, 22 bp, Homo sapiens
aattaaaaaaggagagcttgct

SEQ ID NO: 7651967 - DNA, 22 bp, Homo sapiens
aattaaaaaaggagagcttgct

SEQ ID NO: 7651968 - DNA, 22 bp, Homo sapiens
aattaaaaaaggagagcttgct

SEQ ID NO: 7651969 - DNA, 22 bp, Homo sapiens
aattaaaaaaggagagcttgct

SEQ ID NO: 7651970 - DNA, 22 bp, Homo sapiens
aattaaaaaaggagagcttgct

SEQ ID NO: 7651971 - DNA, 22 bp, Homo sapiens
aattaaaaaaggagagcttgct

SEQ ID NO: 7651972 - DNA, 22 bp, Homo sapiens
aattaaaaaaggagagcttgct

SEQ ID NO: 7651973 - DNA, 22 bp, Homo sapiens
aatgttttaaaagagattgaga

SEQ ID NO: 7651974 - DNA, 22 bp, Homo sapiens
aatgttttaaaagagattgaga

SEQ ID NO: 7651975 - DNA, 22 bp, Homo sapiens
aattaaaaaaggagagcttgct

SEQ ID NO: 7651976 - DNA, 22 bp, Homo sapiens
aattaaaaaaggagagcttgct

SEQ ID NO: 7651977 - DNA, 20 bp, Homo sapiens
agaccctgtgtcctgtggcc

SEQ ID NO: 7651978 - DNA, 20 bp, Homo sapiens
agaccctgtgtcctgtggcc

SEQ ID NO: 7651979 - DNA, 22 bp, Homo sapiens
agaccctgttagttccagtctt

SEQ ID NO: 7651980 - DNA, 22 bp, Homo sapiens
agaccctggtaaacactccagg

SEQ ID NO: 7651981 - DNA, 22 bp, Homo sapiens
agaccctggtaaacactccagg

SEQ ID NO: 7651982 - DNA, 22 bp, Homo sapiens
agaccctggtaaacactccagg

SEQ ID NO: 7651983 - DNA, 22 bp, Homo sapiens
agaccctgtatgtgtttagttt

SEQ ID NO: 7651984 - DNA, 22 bp, Homo sapiens
agacctaaagtacccagcatat

SEQ ID NO: 7651985 - DNA, 22 bp, Homo sapiens
agaccctttgggtctgtgcagg

SEQ ID NO: 7651986 - DNA, 22 bp, Homo sapiens
agacccttgtaatgactgtgag

SEQ ID NO: 7651987 - DNA, 22 bp, Homo sapiens
agacccttcagacggctagagc

SEQ ID NO: 7651988 - DNA, 20 bp, Homo sapiens
agaccctgtgtcctgtggcc

SEQ ID NO: 7651989 - DNA, 22 bp, Homo sapiens
agaccctgttagttccagtctt

SEQ ID NO: 7651990 - DNA, 22 bp, Homo sapiens
agacccttgcagtctggttgtc

SEQ ID NO: 7651991 - DNA, 22 bp, Homo sapiens
aatgtggttaacccatttaaga

SEQ ID NO: 7651992 - DNA, 22 bp, Homo sapiens
aatgtggttaacccatttaaga

SEQ ID NO: 7651993 - DNA, 22 bp, Homo sapiens
aatgtgtaaatgaggagtcttg

SEQ ID NO: 7651994 - DNA, 22 bp, Homo sapiens
aatgtggccacttttttctggg

SEQ ID NO: 7651995 - DNA, 22 bp, Homo sapiens
aatgtggggaagccatggctga

SEQ ID NO: 7651996 - DNA, 22 bp, Homo sapiens
aatgtggggaagccatggctga

SEQ ID NO: 7651997 - DNA, 22 bp, Homo sapiens
aatgtggggaagccatggctga

SEQ ID NO: 7651998 - DNA, 22 bp, Homo sapiens
aatgtggtctctcttagtagaa

SEQ ID NO: 7651999 - DNA, 22 bp, Homo sapiens
aatgtggttaaaatttggttgt

SEQ ID NO: 7652000 - DNA, 22 bp, Homo sapiens
agaccccctttaatggaagtgc

SEQ ID NO: 7652001 - DNA, 22 bp, Homo sapiens
aatgtgtacatgacagatagaa

SEQ ID NO: 7652002 - DNA, 18 bp, Homo sapiens
agaccctctaagggcagt

SEQ ID NO: 7652003 - DNA, 18 bp, Homo sapiens
agaccctctaagggcagt

SEQ ID NO: 7652004 - DNA, 22 bp, Homo sapiens
agaccctctccatgcccactgc

SEQ ID NO: 7652005 - DNA, 22 bp, Homo sapiens
agaccctctcctcatggacatg

SEQ ID NO: 7652006 - DNA, 22 bp, Homo sapiens
agaccctggagaatgaaagtgc

SEQ ID NO: 7652007 - DNA, 22 bp, Homo sapiens
agaccctgcattttccagggtt

SEQ ID NO: 7652008 - DNA, 22 bp, Homo sapiens
agaccctggggaaagtcacttc

SEQ ID NO: 7652009 - DNA, 22 bp, Homo sapiens
agaccctgcattttccagggtt

SEQ ID NO: 7652010 - DNA, 22 bp, Homo sapiens
agaccctgcacctctcgtgggc

SEQ ID NO: 7652011 - DNA, 22 bp, Homo sapiens
agaccctggggaaagtcacttc

SEQ ID NO: 7652012 - DNA, 22 bp, Homo sapiens
agaccctggggaaagtcacttc

SEQ ID NO: 7652013 - DNA, 22 bp, Homo sapiens
agaccctggtaaacactccagg

SEQ ID NO: 7652014 - DNA, 22 bp, Homo sapiens
agaccctggggaaagtcacttc

SEQ ID NO: 7652015 - DNA, 22 bp, Homo sapiens
agaccctggtaaacactccagg

SEQ ID NO: 7652016 - DNA, 22 bp, Homo sapiens
agaccctggtaaacactccagg

SEQ ID NO: 7652017 - DNA, 22 bp, Homo sapiens
agaccctggggaaagtcacttc

SEQ ID NO: 7652018 - DNA, 22 bp, Homo sapiens
agaccctgcattttccagggtt

SEQ ID NO: 7652019 - DNA, 22 bp, Homo sapiens
agaccctgcattttccagggtt

SEQ ID NO: 7652020 - DNA, 22 bp, Homo sapiens
agaccctgcattttccagggtt

SEQ ID NO: 7652021 - DNA, 22 bp, Homo sapiens
agaccctgcattttccagggtt

SEQ ID NO: 7652022 - DNA, 21 bp, Homo sapiens
agaccctgcatatgttcagta

SEQ ID NO: 7652023 - DNA, 21 bp, Homo sapiens
agaccctgcatatgttcagta

SEQ ID NO: 7652024 - DNA, 21 bp, Homo sapiens
agaccctgcatatgttcagta

SEQ ID NO: 7652025 - DNA, 22 bp, Homo sapiens
agaccctgcacctctcgtgggc

SEQ ID NO: 7652026 - DNA, 22 bp, Homo sapiens
aatggcagaggcaaagatggta

SEQ ID NO: 7652027 - DNA, 22 bp, Homo sapiens
aatggcagagactgttgaaata

SEQ ID NO: 7652028 - DNA, 22 bp, Homo sapiens
aatggcagagactgttgaaata

SEQ ID NO: 7652029 - DNA, 22 bp, Homo sapiens
aatggcagaggcaaagatggta

SEQ ID NO: 7652030 - DNA, 22 bp, Homo sapiens
aatggcagaggcaaagatggta

SEQ ID NO: 7652031 - DNA, 22 bp, Homo sapiens
aatggcagaatgggccagaagc

SEQ ID NO: 7652032 - DNA, 22 bp, Homo sapiens
aatggcagagactgttgaaata

SEQ ID NO: 7652033 - DNA, 22 bp, Homo sapiens
aatggcagaatgggccagaagc

SEQ ID NO: 7652034 - DNA, 22 bp, Homo sapiens
aatggcactttataaatgttaa

SEQ ID NO: 7652035 - DNA, 22 bp, Homo sapiens
aatggcactttataaatgttaa

SEQ ID NO: 7652036 - DNA, 22 bp, Homo sapiens
aatggcagaatgggccagaagc

SEQ ID NO: 7652037 - DNA, 22 bp, Homo sapiens
aatggcagaatgggccagaagc

SEQ ID NO: 7652038 - DNA, 19 bp, Homo sapiens
aatggcagatgccatatct

SEQ ID NO: 7652039 - DNA, 19 bp, Homo sapiens
aatggcagatgccatatct

SEQ ID NO: 7652040 - DNA, 22 bp, Homo sapiens
aatggcagaggcaaagatggta

SEQ ID NO: 7652041 - DNA, 22 bp, Homo sapiens
aatggcagaggcaaagatggta

SEQ ID NO: 7652042 - DNA, 22 bp, Homo sapiens
aatggcagaggcaaagatggta

SEQ ID NO: 7652043 - DNA, 22 bp, Homo sapiens
aatggcagtagttgcatgagag

SEQ ID NO: 7652044 - DNA, 22 bp, Homo sapiens
aatggcatgggaaatgcagtgg

SEQ ID NO: 7652045 - DNA, 22 bp, Homo sapiens
aatggcagtagttgcatgagag

SEQ ID NO: 7652046 - DNA, 22 bp, Homo sapiens
aatggcagtagttgcatgagag

SEQ ID NO: 7652047 - DNA, 22 bp, Homo sapiens
aatggcagtagttgcatgagag

SEQ ID NO: 7652048 - DNA, 22 bp, Homo sapiens
aatggcagtagttgcatgagag

SEQ ID NO: 7652049 - DNA, 22 bp, Homo sapiens
aatgggaagtcactactgttac

SEQ ID NO: 7652050 - DNA, 22 bp, Homo sapiens
aatgggagagaacacaaagtcc

SEQ ID NO: 7652051 - DNA, 22 bp, Homo sapiens
aatgggagagaacacaaagtcc

SEQ ID NO: 7652052 - DNA, 22 bp, Homo sapiens
aatgggaagtcactactgttac

SEQ ID NO: 7652053 - DNA, 22 bp, Homo sapiens
aatgggaggattttctctcttg

SEQ ID NO: 7652054 - DNA, 22 bp, Homo sapiens
aatgggaagtcactactgttac

SEQ ID NO: 7652055 - DNA, 22 bp, Homo sapiens
aatgggcacacttagagagtaa

SEQ ID NO: 7652056 - DNA, 22 bp, Homo sapiens
aatgggcacacttagagagtaa

SEQ ID NO: 7652057 - DNA, 22 bp, Homo sapiens
aatgggataattgttcatggga

SEQ ID NO: 7652058 - DNA, 22 bp, Homo sapiens
aatgggattaagaaagatcttg

SEQ ID NO: 7652059 - DNA, 22 bp, Homo sapiens
aatgggagtggcttggaaatca

SEQ ID NO: 7652060 - DNA, 22 bp, Homo sapiens
aatgggagtggcttggaaatca

SEQ ID NO: 7652061 - DNA, 22 bp, Homo sapiens
aatgggataatagaagtagaat

SEQ ID NO: 7652062 - DNA, 22 bp, Homo sapiens
aatgggaggattttctctcttg

SEQ ID NO: 7652063 - DNA, 22 bp, Homo sapiens
aatgggaggtagtatgggaggt

SEQ ID NO: 7652064 - DNA, 22 bp, Homo sapiens
aatgggaggtagtatgggaggt

SEQ ID NO: 7652065 - DNA, 22 bp, Homo sapiens
aatggcaattcagtgaaattat

SEQ ID NO: 7652066 - DNA, 22 bp, Homo sapiens
aatggcaccttcaagaagaaaa

SEQ ID NO: 7652067 - DNA, 22 bp, Homo sapiens
aatggcactttataaatgttaa

SEQ ID NO: 7652068 - DNA, 22 bp, Homo sapiens
aatggcactttataaatgttaa

SEQ ID NO: 7652069 - DNA, 22 bp, Homo sapiens
aatggcactttataaatgttaa

SEQ ID NO: 7652070 - DNA, 22 bp, Homo sapiens
aatggaggtgtctggcctggta

SEQ ID NO: 7652071 - DNA, 22 bp, Homo sapiens
aatggaggtgtctggcctggta

SEQ ID NO: 7652072 - DNA, 22 bp, Homo sapiens
aatggcaaaaggataacaagga

SEQ ID NO: 7652073 - DNA, 22 bp, Homo sapiens
aatggcaagctgaactcagaag

SEQ ID NO: 7652074 - DNA, 22 bp, Homo sapiens
aatggcaaagtgttttcatacc

SEQ ID NO: 7652075 - DNA, 22 bp, Homo sapiens
aatggcaaagtgttttcatacc

SEQ ID NO: 7652076 - DNA, 22 bp, Homo sapiens
aatggcaacatggtatagtgag

SEQ ID NO: 7652077 - DNA, 22 bp, Homo sapiens
agacaattgttctaagtaaaaa

SEQ ID NO: 7652078 - DNA, 22 bp, Homo sapiens
agacaattgttctaagtaaaaa

SEQ ID NO: 7652079 - DNA, 22 bp, Homo sapiens
agacaattaaaaaattatgctt

SEQ ID NO: 7652080 - DNA, 22 bp, Homo sapiens
agacaattaaaaaattatgctt

SEQ ID NO: 7652081 - DNA, 22 bp, Homo sapiens
agacaattaaaaaattatgctt

SEQ ID NO: 7652082 - DNA, 22 bp, Homo sapiens
agacaattaaaaaattatgctt

SEQ ID NO: 7652083 - DNA, 22 bp, Homo sapiens
agacaatgtttggtctacactt

SEQ ID NO: 7652084 - DNA, 22 bp, Homo sapiens
aatggagaggctgtgagtgaga

SEQ ID NO: 7652085 - DNA, 22 bp, Homo sapiens
aatggagacttcaaaatggatt

SEQ ID NO: 7652086 - DNA, 22 bp, Homo sapiens
aatggagaggctgtgagtgaga

SEQ ID NO: 7652087 - DNA, 22 bp, Homo sapiens
agacaatttcaaagtaatatta

SEQ ID NO: 7652088 - DNA, 22 bp, Homo sapiens
agacaatttcaaagtaatatta

SEQ ID NO: 7652089 - DNA, 22 bp, Homo sapiens
agacaatgtcaaggtgatcatc

SEQ ID NO: 7652090 - DNA, 22 bp, Homo sapiens
agacaatgtttggtctacactt

SEQ ID NO: 7652091 - DNA, 22 bp, Homo sapiens
agacaatgtttggtctacactt

SEQ ID NO: 7652092 - DNA, 22 bp, Homo sapiens
agacaatgtcaaggtgatcatc

SEQ ID NO: 7652093 - DNA, 22 bp, Homo sapiens
agacaatgtttggtctacactt

SEQ ID NO: 7652094 - DNA, 22 bp, Homo sapiens
agacaatggctaagtaacctgt

SEQ ID NO: 7652095 - DNA, 19 bp, Homo sapiens
agacaatggggttggcagt

SEQ ID NO: 7652096 - DNA, 22 bp, Homo sapiens
agacaatgtcaaggtgatcatc

SEQ ID NO: 7652097 - DNA, 22 bp, Homo sapiens
agacaatggctaagtaacctgt

SEQ ID NO: 7652098 - DNA, 22 bp, Homo sapiens
agacaatgtcaaggtgatcatc

SEQ ID NO: 7652099 - DNA, 22 bp, Homo sapiens
agacaatggagagcagagtact

SEQ ID NO: 7652100 - DNA, 22 bp, Homo sapiens
agacaatggagggaaatacttc

SEQ ID NO: 7652101 - DNA, 22 bp, Homo sapiens
agacaatggagggaaatacttc

SEQ ID NO: 7652102 - DNA, 22 bp, Homo sapiens
agacaatggagggaaatacttc

SEQ ID NO: 7652103 - DNA, 22 bp, Homo sapiens
agacaatggctaagtaacctgt

SEQ ID NO: 7652104 - DNA, 22 bp, Homo sapiens
agacaatggctaagtaacctgt

SEQ ID NO: 7652105 - DNA, 22 bp, Homo sapiens
agacaatggagggaaatacttc

SEQ ID NO: 7652106 - DNA, 22 bp, Homo sapiens
agacaatggagagcagagtact

SEQ ID NO: 7652107 - DNA, 22 bp, Homo sapiens
agacaatggagagcagagtact

SEQ ID NO: 7652108 - DNA, 22 bp, Homo sapiens
agacaatggagagcagagtact

SEQ ID NO: 7652109 - DNA, 21 bp, Homo sapiens
agacaatgctgtaaaattcag

SEQ ID NO: 7652110 - DNA, 21 bp, Homo sapiens
agacaatgctgtaaaattcag

SEQ ID NO: 7652111 - DNA, 21 bp, Homo sapiens
agacaatgctgtaaaattcag

SEQ ID NO: 7652112 - DNA, 22 bp, Homo sapiens
agacaatggagagcagagtact

SEQ ID NO: 7652113 - DNA, 22 bp, Homo sapiens
agacaatggaccaagcaccttc

SEQ ID NO: 7652114 - DNA, 20 bp, Homo sapiens
agacaatgagtgacagagtt

SEQ ID NO: 7652115 - DNA, 20 bp, Homo sapiens
agacaatgagtgacagagtt

SEQ ID NO: 7652116 - DNA, 22 bp, Homo sapiens
agacaatgcaagcagggagtgg

SEQ ID NO: 7652117 - DNA, 20 bp, Homo sapiens
agacaatgagtgacagagtt

SEQ ID NO: 7652118 - DNA, 22 bp, Homo sapiens
agacaatgaatagatttgagaa

SEQ ID NO: 7652119 - DNA, 22 bp, Homo sapiens
agacaatgaatagatttgagaa

SEQ ID NO: 7652120 - DNA, 20 bp, Homo sapiens
agacaatgagtgacagagtt

SEQ ID NO: 7652121 - DNA, 22 bp, Homo sapiens
agacaatatgtatattaagaat

SEQ ID NO: 7652122 - DNA, 22 bp, Homo sapiens
agacaatatgtatattaagaat

SEQ ID NO: 7652123 - DNA, 22 bp, Homo sapiens
agacaatatttcttgcctggtt

SEQ ID NO: 7652124 - DNA, 22 bp, Homo sapiens
agacaatatgtatattaagaat

SEQ ID NO: 7652125 - DNA, 22 bp, Homo sapiens
agacaaaccttgttttatgatg

SEQ ID NO: 7652126 - DNA, 22 bp, Homo sapiens
agacaatatgtatattaagaat

SEQ ID NO: 7652127 - DNA, 22 bp, Homo sapiens
agacaatatgtatattaagaat

SEQ ID NO: 7652128 - DNA, 22 bp, Homo sapiens
agaagcagcaagcccttcaaag

SEQ ID NO: 7652129 - DNA, 23 bp, Homo sapiens
agaagcagcttctggagtatcgg

SEQ ID NO: 7652130 - DNA, 23 bp, Homo sapiens
agaagcagcttctggagtatcgg

SEQ ID NO: 7652131 - DNA, 23 bp, Homo sapiens
agaagcagcttctggagtatcgg

SEQ ID NO: 7652132 - DNA, 23 bp, Homo sapiens
agaagcagcttctggagtatcgg

SEQ ID NO: 7652133 - DNA, 23 bp, Homo sapiens
agaagcagcttctggagtatcgg

SEQ ID NO: 7652134 - DNA, 23 bp, Homo sapiens
agaagcagcttctggagtatcgg

SEQ ID NO: 7652135 - DNA, 20 bp, Homo sapiens
agacaaaatgacttcatgca

SEQ ID NO: 7652136 - DNA, 20 bp, Homo sapiens
agacaaaatgacttcatgca

SEQ ID NO: 7652137 - DNA, 22 bp, Homo sapiens
agaagcagctttcaaggtgatt

SEQ ID NO: 7652138 - DNA, 23 bp, Homo sapiens
agaagcagcttctggagtatcgg

SEQ ID NO: 7652139 - DNA, 22 bp, Homo sapiens
agacaaacccagtggctgtttt

SEQ ID NO: 7652140 - DNA, 20 bp, Homo sapiens
agacaaaatgacttcatgca

SEQ ID NO: 7652141 - DNA, 20 bp, Homo sapiens
agacaaaatgacttcatgca

SEQ ID NO: 7652142 - DNA, 20 bp, Homo sapiens
agacaaaatgacttcatgca

SEQ ID NO: 7652143 - DNA, 22 bp, Homo sapiens
agaagcagaaggaagcagggcc

SEQ ID NO: 7652144 - DNA, 22 bp, Homo sapiens
agaagcagaaggaagcagggcc

SEQ ID NO: 7652145 - DNA, 22 bp, Homo sapiens
agaagcagactctgaggcaagg

SEQ ID NO: 7652146 - DNA, 22 bp, Homo sapiens
agaagcagactctgaggcaagg

SEQ ID NO: 7652147 - DNA, 22 bp, Homo sapiens
agaagcagactctgaggcaagg

SEQ ID NO: 7652148 - DNA, 22 bp, Homo sapiens
agaagcagactctgaggcaagg

SEQ ID NO: 7652149 - DNA, 22 bp, Homo sapiens
agaagcagcaagcccttcaaag

SEQ ID NO: 7652150 - DNA, 22 bp, Homo sapiens
agaagcagactctgaggcaagg

SEQ ID NO: 7652151 - DNA, 22 bp, Homo sapiens
agaagcagactctgaggcaagg

SEQ ID NO: 7652152 - DNA, 22 bp, Homo sapiens
agaagcagactctgaggcaagg

SEQ ID NO: 7652153 - DNA, 22 bp, Homo sapiens
agaagcagactctgaggcaagg

SEQ ID NO: 7652154 - DNA, 22 bp, Homo sapiens
agaagcagactctgaggcaagg

SEQ ID NO: 7652155 - DNA, 22 bp, Homo sapiens
aatgtcttccctggcaggccaa

SEQ ID NO: 7652156 - DNA, 22 bp, Homo sapiens
aatgtcttcagttctgtattgt

SEQ ID NO: 7652157 - DNA, 22 bp, Homo sapiens
aatgtgaactttgtcatgtaac

SEQ ID NO: 7652158 - DNA, 22 bp, Homo sapiens
aatgtgaactttgtcatgtaac

SEQ ID NO: 7652159 - DNA, 18 bp, Homo sapiens
aatgtgaatatttacttc

SEQ ID NO: 7652160 - DNA, 22 bp, Homo sapiens
aatgtcttcagttctgtattgt

SEQ ID NO: 7652161 - DNA, 22 bp, Homo sapiens
aatgtcttctcttgttgaattt

SEQ ID NO: 7652162 - DNA, 22 bp, Homo sapiens
aatgtgactgaatatttactct

SEQ ID NO: 7652163 - DNA, 22 bp, Homo sapiens
aatgtgactggagtctcttggc

SEQ ID NO: 7652164 - DNA, 22 bp, Homo sapiens
aatgtgactggagtctcttggc

SEQ ID NO: 7652165 - DNA, 18 bp, Homo sapiens
aatgtgaatatttacttc

SEQ ID NO: 7652166 - DNA, 18 bp, Homo sapiens
aatgtgaatatttacttc

SEQ ID NO: 7652167 - DNA, 18 bp, Homo sapiens
aatgtgaatatttacttc

SEQ ID NO: 7652168 - DNA, 18 bp, Homo sapiens
aatgtgaatatttacttc

SEQ ID NO: 7652169 - DNA, 22 bp, Homo sapiens
aatgtaaaatatcttgtacttg

SEQ ID NO: 7652170 - DNA, 22 bp, Homo sapiens
aatgtaaaatatcttgtacttg

SEQ ID NO: 7652171 - DNA, 22 bp, Homo sapiens
aatgtcttcagtgtatacatgg

SEQ ID NO: 7652172 - DNA, 22 bp, Homo sapiens
aatgtaaaatatcttgtacttg

SEQ ID NO: 7652173 - DNA, 22 bp, Homo sapiens
aatgtaaaatatcttgtacttg

SEQ ID NO: 7652174 - DNA, 22 bp, Homo sapiens
aatggtttttgcatattcaggt

SEQ ID NO: 7652175 - DNA, 22 bp, Homo sapiens
aatgtaaaatatcttgtacttg

SEQ ID NO: 7652176 - DNA, 22 bp, Homo sapiens
aatgtaaaatatcttgtacttg

SEQ ID NO: 7652177 - DNA, 22 bp, Homo sapiens
aatgtaaaatatcttgtacttg

SEQ ID NO: 7652178 - DNA, 22 bp, Homo sapiens
aatggttttgtctcatcaatgt

SEQ ID NO: 7652179 - DNA, 22 bp, Homo sapiens
aatggtttttagtgagatcgat

SEQ ID NO: 7652180 - DNA, 22 bp, Homo sapiens
aatggtttttagtgagatcgat

SEQ ID NO: 7652181 - DNA, 22 bp, Homo sapiens
aatggtttttgcatattcaggt

SEQ ID NO: 7652182 - DNA, 22 bp, Homo sapiens
aatggttttgctttagtattct

SEQ ID NO: 7652183 - DNA, 22 bp, Homo sapiens
aatggttttgctttagtattct

SEQ ID NO: 7652184 - DNA, 22 bp, Homo sapiens
aatggttttgtctcatcaatgt

SEQ ID NO: 7652185 - DNA, 22 bp, Homo sapiens
aatggttttgtctcatcaatgt

SEQ ID NO: 7652186 - DNA, 17 bp, Homo sapiens
aatgtggaagtacatgc

SEQ ID NO: 7652187 - DNA, 17 bp, Homo sapiens
aatgtggaagtacatgc

SEQ ID NO: 7652188 - DNA, 22 bp, Homo sapiens
aatgtggatccttacagatacc

SEQ ID NO: 7652189 - DNA, 22 bp, Homo sapiens
aatgtggattcacaagtgctca

SEQ ID NO: 7652190 - DNA, 22 bp, Homo sapiens
aatgtggcattgtcattattgg

SEQ ID NO: 7652191 - DNA, 22 bp, Homo sapiens
aatgtggccacttttttctggg

SEQ ID NO: 7652192 - DNA, 22 bp, Homo sapiens
aatgtggatgatactagtactt

SEQ ID NO: 7652193 - DNA, 22 bp, Homo sapiens
aatgtggatgatactagtactt

SEQ ID NO: 7652194 - DNA, 22 bp, Homo sapiens
aatgtggattcacaagtgctca

SEQ ID NO: 7652195 - DNA, 22 bp, Homo sapiens
aatgtgctttgttcagccattt

SEQ ID NO: 7652196 - DNA, 22 bp, Homo sapiens
aatgtgctgtcaacatttcgaa

SEQ ID NO: 7652197 - DNA, 22 bp, Homo sapiens
aatgtgcttctggctgtggtca

SEQ ID NO: 7652198 - DNA, 22 bp, Homo sapiens
aatgtgctggtaactgctttgc

SEQ ID NO: 7652199 - DNA, 23 bp, Homo sapiens
aatgtgctgtattcatttctgga

SEQ ID NO: 7652200 - DNA, 23 bp, Homo sapiens
aatgtgctgtattcatttctgga

SEQ ID NO: 7652201 - DNA, 23 bp, Homo sapiens
aatgtgctgtattcatttctgga

SEQ ID NO: 7652202 - DNA, 22 bp, Homo sapiens
aatgtgcagatgaataaacaaa

SEQ ID NO: 7652203 - DNA, 22 bp, Homo sapiens
aatgtgcagatgaataaacaaa

SEQ ID NO: 7652204 - DNA, 22 bp, Homo sapiens
aatgtgcagatgaataaacaaa

SEQ ID NO: 7652205 - DNA, 22 bp, Homo sapiens
aatgtgcaggctcaaaccttgt

SEQ ID NO: 7652206 - DNA, 22 bp, Homo sapiens
aatgtgattttcccagtagaat

SEQ ID NO: 7652207 - DNA, 22 bp, Homo sapiens
aatgtgatctgtcatgatggca

SEQ ID NO: 7652208 - DNA, 22 bp, Homo sapiens
aatgtgattagcctctactgga

SEQ ID NO: 7652209 - DNA, 22 bp, Homo sapiens
aatgtgaggccttggtagttat

SEQ ID NO: 7652210 - DNA, 22 bp, Homo sapiens
aatgtgaggccttggtagttat

SEQ ID NO: 7652211 - DNA, 22 bp, Homo sapiens
aatgtgagccaatgcccgtggg

SEQ ID NO: 7652212 - DNA, 22 bp, Homo sapiens
aatgtgagccaatgcccgtggg

SEQ ID NO: 7652213 - DNA, 22 bp, Homo sapiens
aatgtgactgtatttgaaaaga

SEQ ID NO: 7652214 - DNA, 22 bp, Homo sapiens
aatgtgagccaatgcccgtggg

SEQ ID NO: 7652215 - DNA, 22 bp, Homo sapiens
aatgtgaggccttggtagttat

SEQ ID NO: 7652216 - DNA, 22 bp, Homo sapiens
aatgtgaggccttggtagttat

SEQ ID NO: 7652217 - DNA, 22 bp, Homo sapiens
aatgtgagccaatgcccgtggg

SEQ ID NO: 7652218 - DNA, 22 bp, Homo sapiens
aatgtgagccaatgcccgtggg

SEQ ID NO: 7652219 - DNA, 22 bp, Homo sapiens
aatggtttgtacctgtccttgg

SEQ ID NO: 7652220 - DNA, 22 bp, Homo sapiens
aatggtttgtacctgtccttgg

SEQ ID NO: 7652221 - DNA, 22 bp, Homo sapiens
aatggtttggactattcaatag

SEQ ID NO: 7652222 - DNA, 22 bp, Homo sapiens
aatggtttggactattcaatag

SEQ ID NO: 7652223 - DNA, 22 bp, Homo sapiens
aatggtttgtacctgtccttgg

SEQ ID NO: 7652224 - DNA, 22 bp, Homo sapiens
aatggttttgcaggtttgtgga

SEQ ID NO: 7652225 - DNA, 22 bp, Homo sapiens
aatggttttgcaggtttgtgga

SEQ ID NO: 7652226 - DNA, 22 bp, Homo sapiens
aatggttttctagaacatgaaa

SEQ ID NO: 7652227 - DNA, 22 bp, Homo sapiens
aatggttttctagaacatgaaa

SEQ ID NO: 7652228 - DNA, 22 bp, Homo sapiens
aatggttttctagaacatgaaa

SEQ ID NO: 7652229 - DNA, 22 bp, Homo sapiens
aatggtttgatggacaaaatga

SEQ ID NO: 7652230 - DNA, 19 bp, Homo sapiens
aatggtttgatgaagtata

SEQ ID NO: 7652231 - DNA, 22 bp, Homo sapiens
aatggtttgatggacaaaatga

SEQ ID NO: 7652232 - DNA, 22 bp, Homo sapiens
aatggtttggactattcaatag

SEQ ID NO: 7652233 - DNA, 22 bp, Homo sapiens
aatggtttggactattcaatag

SEQ ID NO: 7652234 - DNA, 22 bp, Homo sapiens
aatggtttggactattcaatag

SEQ ID NO: 7652235 - DNA, 19 bp, Homo sapiens
aatggtttgatgaagtata

SEQ ID NO: 7652236 - DNA, 22 bp, Homo sapiens
aatggtttctgaagttaggcag

SEQ ID NO: 7652237 - DNA, 19 bp, Homo sapiens
aatggtttgatgaagtata

SEQ ID NO: 7652238 - DNA, 22 bp, Homo sapiens
aatggtttgatggacaaaatga

SEQ ID NO: 7652239 - DNA, 22 bp, Homo sapiens
aatggtttaacatatgcttgag

SEQ ID NO: 7652240 - DNA, 22 bp, Homo sapiens
aatggtttaacatatgcttgag

SEQ ID NO: 7652241 - DNA, 22 bp, Homo sapiens
aatggtttagttaagactgagt

SEQ ID NO: 7652242 - DNA, 22 bp, Homo sapiens
aatggttacagaaatgaaagta

SEQ ID NO: 7652243 - DNA, 22 bp, Homo sapiens
aatggtttaacatatgcttgag

SEQ ID NO: 7652244 - DNA, 23 bp, Homo sapiens
aatggtcttcctccacccctctg

SEQ ID NO: 7652245 - DNA, 23 bp, Homo sapiens
aatggtcttcctccacccctctg

SEQ ID NO: 7652246 - DNA, 23 bp, Homo sapiens
aatggtcttcctccacccctctg

SEQ ID NO: 7652247 - DNA, 22 bp, Homo sapiens
aatggttaatatttgtaatatg

SEQ ID NO: 7652248 - DNA, 22 bp, Homo sapiens
aatggtggatgtctgttctgac

SEQ ID NO: 7652249 - DNA, 22 bp, Homo sapiens
aatggtgaggctcctaaatttt

SEQ ID NO: 7652250 - DNA, 22 bp, Homo sapiens
aatggtttatggggaccgcaaa

SEQ ID NO: 7652251 - DNA, 22 bp, Homo sapiens
aatggttacagaaatgaaagta

SEQ ID NO: 7652252 - DNA, 22 bp, Homo sapiens
aatggtttagttaagactgagt

SEQ ID NO: 7652253 - DNA, 22 bp, Homo sapiens
aatggtttcaaacacactaagt

SEQ ID NO: 7652254 - DNA, 22 bp, Homo sapiens
aatggtttctgaagttaggcag

SEQ ID NO: 7652255 - DNA, 22 bp, Homo sapiens
aatggtttcaaacacactaagt

SEQ ID NO: 7652256 - DNA, 22 bp, Homo sapiens
aatggtttcaaacacactaagt

SEQ ID NO: 7652257 - DNA, 22 bp, Homo sapiens
aatggtaatttgcagaaagtcc

SEQ ID NO: 7652258 - DNA, 22 bp, Homo sapiens
aatggtaatttgcagaaagtcc

SEQ ID NO: 7652259 - DNA, 22 bp, Homo sapiens
aatggtacagtgtacagaactg

SEQ ID NO: 7652260 - DNA, 22 bp, Homo sapiens
aatggtaccctggtgacttaga

SEQ ID NO: 7652261 - DNA, 22 bp, Homo sapiens
aatggtaccctggtgacttaga

SEQ ID NO: 7652262 - DNA, 19 bp, Homo sapiens
aatggtaattagagaaatg

SEQ ID NO: 7652263 - DNA, 19 bp, Homo sapiens
aatggtaattagagaaatg

SEQ ID NO: 7652264 - DNA, 22 bp, Homo sapiens
aatggtcagggcttttgtaggt

SEQ ID NO: 7652265 - DNA, 22 bp, Homo sapiens
aatggtcagggcttttgtaggt

SEQ ID NO: 7652266 - DNA, 22 bp, Homo sapiens
aatggtcaaaaagatacgtaaa

SEQ ID NO: 7652267 - DNA, 22 bp, Homo sapiens
aatggtatttgtcaagcatagt

SEQ ID NO: 7652268 - DNA, 22 bp, Homo sapiens
aatggtatcacctcacagaatt

SEQ ID NO: 7652269 - DNA, 22 bp, Homo sapiens
aatggtatcacctcacagaatt

SEQ ID NO: 7652270 - DNA, 22 bp, Homo sapiens
aatggtatcacctcacagaatt

SEQ ID NO: 7652271 - DNA, 22 bp, Homo sapiens
aatggtaatattggcacagaaa

SEQ ID NO: 7652272 - DNA, 22 bp, Homo sapiens
aatggtaatggagagaactact

SEQ ID NO: 7652273 - DNA, 22 bp, Homo sapiens
aatggtaatggagagaactact

SEQ ID NO: 7652274 - DNA, 22 bp, Homo sapiens
aatggtaatatttcatagttgt

SEQ ID NO: 7652275 - DNA, 22 bp, Homo sapiens
aatggtaatatttcatagttgt

SEQ ID NO: 7652276 - DNA, 22 bp, Homo sapiens
aatggtaatggagagaactact

SEQ ID NO: 7652277 - DNA, 22 bp, Homo sapiens
aatggtaatggagagaactact

SEQ ID NO: 7652278 - DNA, 22 bp, Homo sapiens
aatgggctttggccagtaggag

SEQ ID NO: 7652279 - DNA, 22 bp, Homo sapiens
aatgggtagttttggaatatga

SEQ ID NO: 7652280 - DNA, 23 bp, Homo sapiens
aatgggtgcaactatccatgaca

SEQ ID NO: 7652281 - DNA, 23 bp, Homo sapiens
aatgggtgcaactatccatgaca

SEQ ID NO: 7652282 - DNA, 20 bp, Homo sapiens
aatgggctttgatgagtgtg

SEQ ID NO: 7652283 - DNA, 20 bp, Homo sapiens
aatgggctttgatgagtgtg

SEQ ID NO: 7652284 - DNA, 22 bp, Homo sapiens
aatgggctttcttggacaggag

SEQ ID NO: 7652285 - DNA, 22 bp, Homo sapiens
aatgggctttcttggacaggag

SEQ ID NO: 7652286 - DNA, 22 bp, Homo sapiens
aatgggcatttggggttgagaa

SEQ ID NO: 7652287 - DNA, 22 bp, Homo sapiens
aatgggcatttgtttgtggtac

SEQ ID NO: 7652288 - DNA, 22 bp, Homo sapiens
aatgggttgctttccacagcct

SEQ ID NO: 7652289 - DNA, 23 bp, Homo sapiens
aatgggtgcaactatccatgaca

SEQ ID NO: 7652290 - DNA, 22 bp, Homo sapiens
aatgggtttctgtcccagctct

SEQ ID NO: 7652291 - DNA, 22 bp, Homo sapiens
aatgggtttctgtcccagctct

SEQ ID NO: 7652292 - DNA, 22 bp, Homo sapiens
aatgggttgctttccacagcct

SEQ ID NO: 7652293 - DNA, 22 bp, Homo sapiens
aatgggttgtagggaaagtcaa

SEQ ID NO: 7652294 - DNA, 23 bp, Homo sapiens
aatgggtgcaactatccatgaca

SEQ ID NO: 7652295 - DNA, 23 bp, Homo sapiens
aatgggtgcaactatccatgaca

SEQ ID NO: 7652296 - DNA, 23 bp, Homo sapiens
aatgggtgcaactatccatgaca

SEQ ID NO: 7652297 - DNA, 22 bp, Homo sapiens
aattgcatgttaatgactaagt

SEQ ID NO: 7652298 - DNA, 22 bp, Homo sapiens
aattgctaaagattatgttttc

SEQ ID NO: 7652299 - DNA, 19 bp, Homo sapiens
aattgcctgtctctgccag

SEQ ID NO: 7652300 - DNA, 22 bp, Homo sapiens
aattgcccatatttgagaatga

SEQ ID NO: 7652301 - DNA, 22 bp, Homo sapiens
aattgcccgcacattgagaggt

SEQ ID NO: 7652302 - DNA, 22 bp, Homo sapiens
aattgcataaaattcaactctg

SEQ ID NO: 7652303 - DNA, 22 bp, Homo sapiens
aattgcactttagcaatggtga

SEQ ID NO: 7652304 - DNA, 22 bp, Homo sapiens
aattgcatatatatgaggccat

SEQ ID NO: 7652305 - DNA, 22 bp, Homo sapiens
aattgatgggcactgaaatatt

SEQ ID NO: 7652306 - DNA, 22 bp, Homo sapiens
aattgatgtaaggaagacttag

SEQ ID NO: 7652307 - DNA, 22 bp, Homo sapiens
aattgatggacagagatgaaga

SEQ ID NO: 7652308 - DNA, 22 bp, Homo sapiens
aattgatggacagagatgaaga

SEQ ID NO: 7652309 - DNA, 22 bp, Homo sapiens
aattgcaacaggtagacttttc

SEQ ID NO: 7652310 - DNA, 22 bp, Homo sapiens
aattgatgtctaccacatgcct

SEQ ID NO: 7652311 - DNA, 22 bp, Homo sapiens
aattgatgatacccacacttat

SEQ ID NO: 7652312 - DNA, 22 bp, Homo sapiens
aattgatggacagagatgaaga

SEQ ID NO: 7652313 - DNA, 22 bp, Homo sapiens
aattgacagaaagtttacgagg

SEQ ID NO: 7652314 - DNA, 22 bp, Homo sapiens
aattgacagaaagtttacgagg

SEQ ID NO: 7652315 - DNA, 22 bp, Homo sapiens
aattgacagaaagtttacgagg

SEQ ID NO: 7652316 - DNA, 22 bp, Homo sapiens
aattgacagaaagtttacgagg

SEQ ID NO: 7652317 - DNA, 22 bp, Homo sapiens
aattgagatgacagaggaatag

SEQ ID NO: 7652318 - DNA, 22 bp, Homo sapiens
aattgaaaatattgtagaccat

SEQ ID NO: 7652319 - DNA, 22 bp, Homo sapiens
aattcttgttgttagtatattt

SEQ ID NO: 7652320 - DNA, 22 bp, Homo sapiens
aattgaaaatattgtagaccat

SEQ ID NO: 7652321 - DNA, 22 bp, Homo sapiens
aattgaaaatattgtagaccat

SEQ ID NO: 7652322 - DNA, 22 bp, Homo sapiens
aattgaaaatattgtagaccat

SEQ ID NO: 7652323 - DNA, 22 bp, Homo sapiens
aattgaaagaagtgggattgcc

SEQ ID NO: 7652324 - DNA, 22 bp, Homo sapiens
aattcttgttgttagtatattt

SEQ ID NO: 7652325 - DNA, 22 bp, Homo sapiens
aattcttgttgttagtatattt

SEQ ID NO: 7652326 - DNA, 22 bp, Homo sapiens
aattcttggaaacattactgga

SEQ ID NO: 7652327 - DNA, 22 bp, Homo sapiens
aattcttcagtttctgggactc

SEQ ID NO: 7652328 - DNA, 22 bp, Homo sapiens
aattgacaaatcatacttgtat

SEQ ID NO: 7652329 - DNA, 22 bp, Homo sapiens
aattgacaaatcatacttgtat

SEQ ID NO: 7652330 - DNA, 22 bp, Homo sapiens
aattgacaaatcatacttgtat

SEQ ID NO: 7652331 - DNA, 22 bp, Homo sapiens
aattgacaaatcatacttgtat

SEQ ID NO: 7652332 - DNA, 22 bp, Homo sapiens
aattgacaaatcatacttgtat

SEQ ID NO: 7652333 - DNA, 22 bp, Homo sapiens
aattgacaaatcatacttgtat

SEQ ID NO: 7652334 - DNA, 21 bp, Homo sapiens
aattgaagatgtggagccatt

SEQ ID NO: 7652335 - DNA, 22 bp, Homo sapiens
aattgaacaagtaatagaagag

SEQ ID NO: 7652336 - DNA, 22 bp, Homo sapiens
aattgaaattctttgtggtcca

SEQ ID NO: 7652337 - DNA, 22 bp, Homo sapiens
aattgaaattctttgtggtcca

SEQ ID NO: 7652338 - DNA, 22 bp, Homo sapiens
aattctgtaactttactgaatt

SEQ ID NO: 7652339 - DNA, 22 bp, Homo sapiens
aattctgtaactttactgaatt

SEQ ID NO: 7652340 - DNA, 22 bp, Homo sapiens
aattctgtaaagcttgtcatgc

SEQ ID NO: 7652341 - DNA, 22 bp, Homo sapiens
aattctgtaaagcttgtcatgc

SEQ ID NO: 7652342 - DNA, 22 bp, Homo sapiens
aattctgtaaagcttgtcatgc

SEQ ID NO: 7652343 - DNA, 20 bp, Homo sapiens
aattctgtcttttctgctgc

SEQ ID NO: 7652344 - DNA, 22 bp, Homo sapiens
aattctgtgcaggcagagctat

SEQ ID NO: 7652345 - DNA, 20 bp, Homo sapiens
aattctgtcttttctgctgc

SEQ ID NO: 7652346 - DNA, 22 bp, Homo sapiens
aattctgttactaatgtgatgt

SEQ ID NO: 7652347 - DNA, 22 bp, Homo sapiens
aattctgtgcaggcagagctat

SEQ ID NO: 7652348 - DNA, 19 bp, Homo sapiens
aattctgtttcagcagatc

SEQ ID NO: 7652349 - DNA, 19 bp, Homo sapiens
aattctgtttcagcagatc

SEQ ID NO: 7652350 - DNA, 19 bp, Homo sapiens
aattctgtttcagcagatc

SEQ ID NO: 7652351 - DNA, 22 bp, Homo sapiens
aattcttaatcccataaagtga

SEQ ID NO: 7652352 - DNA, 22 bp, Homo sapiens
aattcttaatcccataaagtga

SEQ ID NO: 7652353 - DNA, 22 bp, Homo sapiens
aattcttaatcccataaagtga

SEQ ID NO: 7652354 - DNA, 22 bp, Homo sapiens
aattcttaatcccataaagtga

SEQ ID NO: 7652355 - DNA, 22 bp, Homo sapiens
aattcttaatcccataaagtga

SEQ ID NO: 7652356 - DNA, 22 bp, Homo sapiens
aattcttcaagtgctttggaga

SEQ ID NO: 7652357 - DNA, 22 bp, Homo sapiens
aattcttaatcccataaagtga

SEQ ID NO: 7652358 - DNA, 22 bp, Homo sapiens
aattcttcaagtgctttggaga

SEQ ID NO: 7652359 - DNA, 22 bp, Homo sapiens
aattcttcaagtgctttggaga

SEQ ID NO: 7652360 - DNA, 22 bp, Homo sapiens
agaggctctttgagctgggaga

SEQ ID NO: 7652361 - DNA, 22 bp, Homo sapiens
agaggctcttgcccttcccaca

SEQ ID NO: 7652362 - DNA, 22 bp, Homo sapiens
agaggctctggtgcagcatgca

SEQ ID NO: 7652363 - DNA, 22 bp, Homo sapiens
agaggctctggtgcagcatgca

SEQ ID NO: 7652364 - DNA, 22 bp, Homo sapiens
agaggctctggtgcagcatgca

SEQ ID NO: 7652365 - DNA, 22 bp, Homo sapiens
agaggctctggtgcagcatgca

SEQ ID NO: 7652366 - DNA, 22 bp, Homo sapiens
agaggctctggtgcagcatgca

SEQ ID NO: 7652367 - DNA, 22 bp, Homo sapiens
agaggctctgccgcctcaggta

SEQ ID NO: 7652368 - DNA, 18 bp, Homo sapiens
agaggctcgatactagaa

SEQ ID NO: 7652369 - DNA, 22 bp, Homo sapiens
agaggctctaatcccctccaca

SEQ ID NO: 7652370 - DNA, 22 bp, Homo sapiens
agaggctctggtgcagcatgca

SEQ ID NO: 7652371 - DNA, 22 bp, Homo sapiens
agaggctctgccgcctcaggta

SEQ ID NO: 7652372 - DNA, 22 bp, Homo sapiens
agaggctctgccgcctcaggta

SEQ ID NO: 7652373 - DNA, 22 bp, Homo sapiens
agaggctctaataccagcatgg

SEQ ID NO: 7652374 - DNA, 22 bp, Homo sapiens
agaggctctaatcccctccaca

SEQ ID NO: 7652375 - DNA, 22 bp, Homo sapiens
agaggctgaatgatgtcatcat

SEQ ID NO: 7652376 - DNA, 22 bp, Homo sapiens
agaggctgaatgatgtcatcat

SEQ ID NO: 7652377 - DNA, 22 bp, Homo sapiens
agaggctgaatgatgtcatcat

SEQ ID NO: 7652378 - DNA, 22 bp, Homo sapiens
agaggctgaatgatgtcatcat

SEQ ID NO: 7652379 - DNA, 22 bp, Homo sapiens
agaggctgaatgatgtcatcat

SEQ ID NO: 7652380 - DNA, 22 bp, Homo sapiens
agaggctcttgcccttcccaca

SEQ ID NO: 7652381 - DNA, 22 bp, Homo sapiens
agaggctctttgagctgggaga

SEQ ID NO: 7652382 - DNA, 22 bp, Homo sapiens
agaggctctttgagctgggaga

SEQ ID NO: 7652383 - DNA, 22 bp, Homo sapiens
agaggctctttgagctgggaga

SEQ ID NO: 7652384 - DNA, 22 bp, Homo sapiens
agaggctcttgcccttcccaca

SEQ ID NO: 7652385 - DNA, 22 bp, Homo sapiens
agaggctctttgagctgggaga

SEQ ID NO: 7652386 - DNA, 22 bp, Homo sapiens
agaggctgagaaaccctcttct

SEQ ID NO: 7652387 - DNA, 22 bp, Homo sapiens
agaggctgagaaaccctcttct

SEQ ID NO: 7652388 - DNA, 22 bp, Homo sapiens
agaggctgagaaaccctcttct

SEQ ID NO: 7652389 - DNA, 22 bp, Homo sapiens
agaggctgagaaaccctcttct

SEQ ID NO: 7652390 - DNA, 22 bp, Homo sapiens
agaggctgaatgatgtcatcat

SEQ ID NO: 7652391 - DNA, 22 bp, Homo sapiens
agaggccctctctctcctgatg

SEQ ID NO: 7652392 - DNA, 22 bp, Homo sapiens
agaggctctaaggttggatcaa

SEQ ID NO: 7652393 - DNA, 18 bp, Homo sapiens
agaggctcgatactagaa

SEQ ID NO: 7652394 - DNA, 22 bp, Homo sapiens
aattgcttgtcttcttccctac

SEQ ID NO: 7652395 - DNA, 22 bp, Homo sapiens
aattgcttgtttctttaactga

SEQ ID NO: 7652396 - DNA, 22 bp, Homo sapiens
aattgcttagttgcaactatgc

SEQ ID NO: 7652397 - DNA, 22 bp, Homo sapiens
aattgcttagagaatccaggta

SEQ ID NO: 7652398 - DNA, 22 bp, Homo sapiens
aattgcttatcttgttgaatag

SEQ ID NO: 7652399 - DNA, 22 bp, Homo sapiens
aattgctagtttgtagcatttg

SEQ ID NO: 7652400 - DNA, 22 bp, Homo sapiens
aattgctagactatactgtaat

SEQ ID NO: 7652401 - DNA, 22 bp, Homo sapiens
aattgcttcattaacatttagg

SEQ ID NO: 7652402 - DNA, 22 bp, Homo sapiens
aattgcttcattaacatttagg

SEQ ID NO: 7652403 - DNA, 22 bp, Homo sapiens
aattgcttatgccaggtgagag

SEQ ID NO: 7652404 - DNA, 22 bp, Homo sapiens
aattgcttcattaacatttagg

SEQ ID NO: 7652405 - DNA, 22 bp, Homo sapiens
aattgcttgatgactagtaatt

SEQ ID NO: 7652406 - DNA, 22 bp, Homo sapiens
aattgcttgatgactagtaatt

SEQ ID NO: 7652407 - DNA, 22 bp, Homo sapiens
aattgcttgatgactagtaatt

SEQ ID NO: 7652408 - DNA, 22 bp, Homo sapiens
aattgcttgatgactagtaatt

SEQ ID NO: 7652409 - DNA, 22 bp, Homo sapiens
acaaagtaagggctaatgagca

SEQ ID NO: 7652410 - DNA, 22 bp, Homo sapiens
acaaaggttgggtcaattgtcc

SEQ ID NO: 7652411 - DNA, 22 bp, Homo sapiens
acaaagtaagggctaatgagca

SEQ ID NO: 7652412 - DNA, 22 bp, Homo sapiens
acaaagtaagggctaatgagca

SEQ ID NO: 7652413 - DNA, 22 bp, Homo sapiens
acaaaggttgggtcaattgtcc

SEQ ID NO: 7652414 - DNA, 22 bp, Homo sapiens
acaaagtaagggctaatgagca

SEQ ID NO: 7652415 - DNA, 22 bp, Homo sapiens
acaaaggtgcgtcccttcagct

SEQ ID NO: 7652416 - DNA, 22 bp, Homo sapiens
acaaaggtgcgtcccttcagct

SEQ ID NO: 7652417 - DNA, 22 bp, Homo sapiens
acaaaggtgagcagaagacaca

SEQ ID NO: 7652418 - DNA, 22 bp, Homo sapiens
acaaaggtgagcagaagacaca

SEQ ID NO: 7652419 - DNA, 22 bp, Homo sapiens
acaaagggggactgcagagggt

SEQ ID NO: 7652420 - DNA, 22 bp, Homo sapiens
acaaagggggactgcagagggt

SEQ ID NO: 7652421 - DNA, 22 bp, Homo sapiens
acaaagggggactgcagagggt

SEQ ID NO: 7652422 - DNA, 22 bp, Homo sapiens
acaaagggggactgcagagggt

SEQ ID NO: 7652423 - DNA, 18 bp, Homo sapiens
acaaaggtctgcaagacc

SEQ ID NO: 7652424 - DNA, 18 bp, Homo sapiens
acaaaggtctgcaagacc

SEQ ID NO: 7652425 - DNA, 22 bp, Homo sapiens
acaaaggcatagtgaatgtttt

SEQ ID NO: 7652426 - DNA, 22 bp, Homo sapiens
agagggggaaaatagaggtgtt

SEQ ID NO: 7652427 - DNA, 20 bp, Homo sapiens
acaaagtattgaggacaagt

SEQ ID NO: 7652428 - DNA, 22 bp, Homo sapiens
acaaagtagtcaaagtagatga

SEQ ID NO: 7652429 - DNA, 22 bp, Homo sapiens
acaaagtagtcaaagtagatga

SEQ ID NO: 7652430 - DNA, 22 bp, Homo sapiens
acaaagtagtcaaagtagatga

SEQ ID NO: 7652431 - DNA, 22 bp, Homo sapiens
acaaagtagtcaaagtagatga

SEQ ID NO: 7652432 - DNA, 22 bp, Homo sapiens
acaaagtaggtcatcaaagctc

SEQ ID NO: 7652433 - DNA, 22 bp, Homo sapiens
acaaagtaggtcatcaaagctc

SEQ ID NO: 7652434 - DNA, 22 bp, Homo sapiens
acaaagtagtcaaagtagatga

SEQ ID NO: 7652435 - DNA, 22 bp, Homo sapiens
acaaagtaggtcatcaaagctc

SEQ ID NO: 7652436 - DNA, 23 bp, Homo sapiens
acaaagtaattcctgcttccaaa

SEQ ID NO: 7652437 - DNA, 22 bp, Homo sapiens
acaaagtaagggctaatgagca

SEQ ID NO: 7652438 - DNA, 23 bp, Homo sapiens
acaaagtaattcctgcttccaaa

SEQ ID NO: 7652439 - DNA, 22 bp, Homo sapiens
acaaagtaggaagattagctga

SEQ ID NO: 7652440 - DNA, 22 bp, Homo sapiens
acaaagtaggaagattagctga

SEQ ID NO: 7652441 - DNA, 22 bp, Homo sapiens
acaaagtaggcagtgggctgga

SEQ ID NO: 7652442 - DNA, 22 bp, Homo sapiens
agagggggcagcggaccagtga

SEQ ID NO: 7652443 - DNA, 22 bp, Homo sapiens
agagggggcagcggaccagtga

SEQ ID NO: 7652444 - DNA, 22 bp, Homo sapiens
agagggggcagcggaccagtga

SEQ ID NO: 7652445 - DNA, 22 bp, Homo sapiens
agagggggcagcggaccagtga

SEQ ID NO: 7652446 - DNA, 22 bp, Homo sapiens
agagggggcagcggaccagtga

SEQ ID NO: 7652447 - DNA, 22 bp, Homo sapiens
agagggggaaaatagaggtgtt

SEQ ID NO: 7652448 - DNA, 22 bp, Homo sapiens
agagggggcagcggaccagtga

SEQ ID NO: 7652449 - DNA, 22 bp, Homo sapiens
agagggggaaaatagaggtgtt

SEQ ID NO: 7652450 - DNA, 22 bp, Homo sapiens
agagggggaaaatagaggtgtt

SEQ ID NO: 7652451 - DNA, 22 bp, Homo sapiens
agagggggaaaatagaggtgtt

SEQ ID NO: 7652452 - DNA, 22 bp, Homo sapiens
agagggggaaaatagaggtgtt

SEQ ID NO: 7652453 - DNA, 22 bp, Homo sapiens
agagggggaaaatagaggtgtt

SEQ ID NO: 7652454 - DNA, 22 bp, Homo sapiens
agagggggaaaatagaggtgtt

SEQ ID NO: 7652455 - DNA, 22 bp, Homo sapiens
agagggggaaaatagaggtgtt

SEQ ID NO: 7652456 - DNA, 22 bp, Homo sapiens
agagggggaaaatagaggtgtt

SEQ ID NO: 7652457 - DNA, 22 bp, Homo sapiens
agagggggtgtcagcactgcag

SEQ ID NO: 7652458 - DNA, 22 bp, Homo sapiens
agagggggtgtcagcactgcag

SEQ ID NO: 7652459 - DNA, 22 bp, Homo sapiens
agagggggtgtcagcactgcag

SEQ ID NO: 7652460 - DNA, 22 bp, Homo sapiens
agagggggtgtcagcactgcag

SEQ ID NO: 7652461 - DNA, 22 bp, Homo sapiens
agagggggtgtcagcactgcag

SEQ ID NO: 7652462 - DNA, 22 bp, Homo sapiens
agagggggtgtcagcactgcag

SEQ ID NO: 7652463 - DNA, 22 bp, Homo sapiens
agagggggtgtcagcactgcag

SEQ ID NO: 7652464 - DNA, 22 bp, Homo sapiens
agagggggtgtcagcactgcag

SEQ ID NO: 7652465 - DNA, 22 bp, Homo sapiens
agagggggtgtcagcactgcag

SEQ ID NO: 7652466 - DNA, 22 bp, Homo sapiens
agagggggtgtcagcactgcag

SEQ ID NO: 7652467 - DNA, 22 bp, Homo sapiens
agaggggtgggcacagcgccca

SEQ ID NO: 7652468 - DNA, 22 bp, Homo sapiens
agaggggtgggcacagcgccca

SEQ ID NO: 7652469 - DNA, 22 bp, Homo sapiens
agagggggtgttccagaagcat

SEQ ID NO: 7652470 - DNA, 22 bp, Homo sapiens
agaggggtgggcacagcgccca

SEQ ID NO: 7652471 - DNA, 22 bp, Homo sapiens
agagggggtgttccagaagcat

SEQ ID NO: 7652472 - DNA, 22 bp, Homo sapiens
agagggggtgttccagaagcat

SEQ ID NO: 7652473 - DNA, 22 bp, Homo sapiens
agagggggtgttccagaagcat

SEQ ID NO: 7652474 - DNA, 22 bp, Homo sapiens
agagggggtgttccagaagcat

SEQ ID NO: 7652475 - DNA, 22 bp, Homo sapiens
agagggggtgttccagaagcat

SEQ ID NO: 7652476 - DNA, 22 bp, Homo sapiens
agagggggtgttccagaagcat

SEQ ID NO: 7652477 - DNA, 22 bp, Homo sapiens
acaaagaaggaattggtcttta

SEQ ID NO: 7652478 - DNA, 19 bp, Homo sapiens
acaaagctgtgagcagctt

SEQ ID NO: 7652479 - DNA, 22 bp, Homo sapiens
agaggcttgacaatatgattgg

SEQ ID NO: 7652480 - DNA, 22 bp, Homo sapiens
agaggcttgacaatatgattgg

SEQ ID NO: 7652481 - DNA, 22 bp, Homo sapiens
acaaagaaggaattggtcttta

SEQ ID NO: 7652482 - DNA, 22 bp, Homo sapiens
acaaagaaggaattggtcttta

SEQ ID NO: 7652483 - DNA, 22 bp, Homo sapiens
agaggcttggaggtgcaaggtt

SEQ ID NO: 7652484 - DNA, 22 bp, Homo sapiens
acaaagaaggaattggtcttta

SEQ ID NO: 7652485 - DNA, 20 bp, Homo sapiens
agaggcttccttgggaggag

SEQ ID NO: 7652486 - DNA, 20 bp, Homo sapiens
agaggcttccttgggaggag

SEQ ID NO: 7652487 - DNA, 22 bp, Homo sapiens
agaggcttcctgccacctgaga

SEQ ID NO: 7652488 - DNA, 23 bp, Homo sapiens
agaggcttatgtttatttcttcc

SEQ ID NO: 7652489 - DNA, 23 bp, Homo sapiens
agaggcttatgtttatttcttcc

SEQ ID NO: 7652490 - DNA, 22 bp, Homo sapiens
agaggcttcctgccacctgaga

SEQ ID NO: 7652491 - DNA, 20 bp, Homo sapiens
agaggcttccttgggaggag

SEQ ID NO: 7652492 - DNA, 22 bp, Homo sapiens
agaggcttctcggatggggcag

SEQ ID NO: 7652493 - DNA, 22 bp, Homo sapiens
agaggcttctttctgatttgcg

SEQ ID NO: 7652494 - DNA, 22 bp, Homo sapiens
agaggcttctttctgatttgcg

SEQ ID NO: 7652495 - DNA, 18 bp, Homo sapiens
acaaaggatcatgaggga

SEQ ID NO: 7652496 - DNA, 18 bp, Homo sapiens
acaaaggatcatgaggga

SEQ ID NO: 7652497 - DNA, 18 bp, Homo sapiens
acaaaggatcatgaggga

SEQ ID NO: 7652498 - DNA, 22 bp, Homo sapiens
acaaaggactgaaactggctgt

SEQ ID NO: 7652499 - DNA, 22 bp, Homo sapiens
acaaaggcagagaattcaacat

SEQ ID NO: 7652500 - DNA, 21 bp, Homo sapiens
acaaaggaagtctcttttaag

SEQ ID NO: 7652501 - DNA, 22 bp, Homo sapiens
acaaagcttagacctaagagat

SEQ ID NO: 7652502 - DNA, 22 bp, Homo sapiens
acaaagcttagacctaagagat

SEQ ID NO: 7652503 - DNA, 22 bp, Homo sapiens
acaaagcttagacctaagagat

SEQ ID NO: 7652504 - DNA, 19 bp, Homo sapiens
acaaagctgtgagcagctt

SEQ ID NO: 7652505 - DNA, 22 bp, Homo sapiens
acaaagcttagacctaagagat

SEQ ID NO: 7652506 - DNA, 19 bp, Homo sapiens
acaaagctgtgagcagctt

SEQ ID NO: 7652507 - DNA, 22 bp, Homo sapiens
acaaagcttagacctaagagat

SEQ ID NO: 7652508 - DNA, 19 bp, Homo sapiens
acaaagctgtgagcagctt

SEQ ID NO: 7652509 - DNA, 19 bp, Homo sapiens
acaaagctgtgagcagctt

SEQ ID NO: 7652510 - DNA, 22 bp, Homo sapiens
acaaagacgggataaggtttgg

SEQ ID NO: 7652511 - DNA, 22 bp, Homo sapiens
acaaagacgggataaggtttgg

SEQ ID NO: 7652512 - DNA, 22 bp, Homo sapiens
agaggctgagaaaccctcttct

SEQ ID NO: 7652513 - DNA, 22 bp, Homo sapiens
agaggctgatggagtagtgtct

SEQ ID NO: 7652514 - DNA, 22 bp, Homo sapiens
agaggctgatggagtagtgtct

SEQ ID NO: 7652515 - DNA, 22 bp, Homo sapiens
agaggctgatggagtagtgtct

SEQ ID NO: 7652516 - DNA, 22 bp, Homo sapiens
agaggctgatggagtagtgtct

SEQ ID NO: 7652517 - DNA, 22 bp, Homo sapiens
agaggctgtgcagagggagtgc

SEQ ID NO: 7652518 - DNA, 22 bp, Homo sapiens
agaggctgatggagtagtgtct

SEQ ID NO: 7652519 - DNA, 22 bp, Homo sapiens
agaggctgtgcagagggagtgc

SEQ ID NO: 7652520 - DNA, 22 bp, Homo sapiens
agaggctgtgcccaccaggcaa

SEQ ID NO: 7652521 - DNA, 22 bp, Homo sapiens
agaggctgtgcccaccaggcaa

SEQ ID NO: 7652522 - DNA, 22 bp, Homo sapiens
agaggctgtgcccaccaggcaa

SEQ ID NO: 7652523 - DNA, 22 bp, Homo sapiens
agaggctgtgcccaccaggcaa

SEQ ID NO: 7652524 - DNA, 22 bp, Homo sapiens
agaggctgtgcccaccaggcaa

SEQ ID NO: 7652525 - DNA, 22 bp, Homo sapiens
agaggctgtgcccaccaggcaa

SEQ ID NO: 7652526 - DNA, 22 bp, Homo sapiens
agaggctgtgcccaccaggcaa

SEQ ID NO: 7652527 - DNA, 22 bp, Homo sapiens
agaggctgtgcccaccaggcaa

SEQ ID NO: 7652528 - DNA, 22 bp, Homo sapiens
agaggctgtgcccaccaggcaa

SEQ ID NO: 7652529 - DNA, 22 bp, Homo sapiens
agaggctgttacactcccagat

SEQ ID NO: 7652530 - DNA, 22 bp, Homo sapiens
agaggctgttacactcccagat

SEQ ID NO: 7652531 - DNA, 22 bp, Homo sapiens
agaggctgttacactcccagat

SEQ ID NO: 7652532 - DNA, 22 bp, Homo sapiens
agaggctgttacactcccagat

SEQ ID NO: 7652533 - DNA, 22 bp, Homo sapiens
agaggctgttacactcccagat

SEQ ID NO: 7652534 - DNA, 22 bp, Homo sapiens
agaggctgttacactcccagat

SEQ ID NO: 7652535 - DNA, 22 bp, Homo sapiens
agaggctgtgcccaccaggcaa

SEQ ID NO: 7652536 - DNA, 22 bp, Homo sapiens
agaggctgtgcccaccaggcaa

SEQ ID NO: 7652537 - DNA, 22 bp, Homo sapiens
agaggctgtgcccaccaggcaa

SEQ ID NO: 7652538 - DNA, 22 bp, Homo sapiens
agaggctgttacactcccagat

SEQ ID NO: 7652539 - DNA, 22 bp, Homo sapiens
agaggctgttacactcccagat

SEQ ID NO: 7652540 - DNA, 22 bp, Homo sapiens
agaggcttacaaagattgatga

SEQ ID NO: 7652541 - DNA, 22 bp, Homo sapiens
agaggcttacaaagattgatga

SEQ ID NO: 7652542 - DNA, 18 bp, Homo sapiens
agaggcttaatgaatggc

SEQ ID NO: 7652543 - DNA, 18 bp, Homo sapiens
agaggcttaatgaatggc

SEQ ID NO: 7652544 - DNA, 22 bp, Homo sapiens
agaggctgttacactcccagat

SEQ ID NO: 7652545 - DNA, 22 bp, Homo sapiens
agaggctgttacactcccagat

SEQ ID NO: 7652546 - DNA, 22 bp, Homo sapiens
agaggctgttacactcccagat

SEQ ID NO: 7652547 - DNA, 22 bp, Homo sapiens
acaagagattatctacagatga

SEQ ID NO: 7652548 - DNA, 22 bp, Homo sapiens
acaagagattatctacagatga

SEQ ID NO: 7652549 - DNA, 22 bp, Homo sapiens
acaagagattatctacagatga

SEQ ID NO: 7652550 - DNA, 22 bp, Homo sapiens
acaagagattatctacagatga

SEQ ID NO: 7652551 - DNA, 22 bp, Homo sapiens
acaagagattatctacagatga

SEQ ID NO: 7652552 - DNA, 22 bp, Homo sapiens
acaagagattatctacagatga

SEQ ID NO: 7652553 - DNA, 22 bp, Homo sapiens
acaagagattatctacagatga

SEQ ID NO: 7652554 - DNA, 22 bp, Homo sapiens
acaagagcattgcaggtgtgtt

SEQ ID NO: 7652555 - DNA, 22 bp, Homo sapiens
acaagagattatctacagatga

SEQ ID NO: 7652556 - DNA, 22 bp, Homo sapiens
acaagactgtgctctaagagtg

SEQ ID NO: 7652557 - DNA, 22 bp, Homo sapiens
acaagactgtgctctaagagtg

SEQ ID NO: 7652558 - DNA, 22 bp, Homo sapiens
acaagaattatttctagttaac

SEQ ID NO: 7652559 - DNA, 22 bp, Homo sapiens
acaagagagacactaggaatgt

SEQ ID NO: 7652560 - DNA, 22 bp, Homo sapiens
acaagagagacactaggaatgt

SEQ ID NO: 7652561 - DNA, 22 bp, Homo sapiens
acaagagacaagaggttcttct

SEQ ID NO: 7652562 - DNA, 22 bp, Homo sapiens
acaagagtagacagccttcttt

SEQ ID NO: 7652563 - DNA, 22 bp, Homo sapiens
acaagagtaatttcaacagagt

SEQ ID NO: 7652564 - DNA, 22 bp, Homo sapiens
acaagagtctgcatttctaaca

SEQ ID NO: 7652565 - DNA, 22 bp, Homo sapiens
acaagagtatctttgactttag

SEQ ID NO: 7652566 - DNA, 22 bp, Homo sapiens
acaagagtatctttgactttag

SEQ ID NO: 7652567 - DNA, 22 bp, Homo sapiens
acaagagccctttcagattgac

SEQ ID NO: 7652568 - DNA, 22 bp, Homo sapiens
acaagagccctttcagattgac

SEQ ID NO: 7652569 - DNA, 20 bp, Homo sapiens
acaagagctcagattcagag

SEQ ID NO: 7652570 - DNA, 22 bp, Homo sapiens
acaagagcttatttccctgttt

SEQ ID NO: 7652571 - DNA, 22 bp, Homo sapiens
acaagagcttatttccctgttt

SEQ ID NO: 7652572 - DNA, 22 bp, Homo sapiens
acaagatactcagctacaagac

SEQ ID NO: 7652573 - DNA, 22 bp, Homo sapiens
acaagatactcagctacaagac

SEQ ID NO: 7652574 - DNA, 22 bp, Homo sapiens
acaagataaggtgtcagtgtgt

SEQ ID NO: 7652575 - DNA, 22 bp, Homo sapiens
acaagatactcagctacaagac

SEQ ID NO: 7652576 - DNA, 22 bp, Homo sapiens
acaagatactcagctacaagac

SEQ ID NO: 7652577 - DNA, 22 bp, Homo sapiens
acaagatactcagctacaagac

SEQ ID NO: 7652578 - DNA, 22 bp, Homo sapiens
acaagatactcagctacaagac

SEQ ID NO: 7652579 - DNA, 22 bp, Homo sapiens
acaagatactcagctacaagac

SEQ ID NO: 7652580 - DNA, 22 bp, Homo sapiens
acaagatagcttagaagattca

SEQ ID NO: 7652581 - DNA, 22 bp, Homo sapiens
acaagatagcttagaagattca

SEQ ID NO: 7652582 - DNA, 22 bp, Homo sapiens
acaagatagcttagaagattca

SEQ ID NO: 7652583 - DNA, 22 bp, Homo sapiens
acaagatagcttagaagattca

SEQ ID NO: 7652584 - DNA, 22 bp, Homo sapiens
agataatggagggatttgcatt

SEQ ID NO: 7652585 - DNA, 22 bp, Homo sapiens
agataatgaatttattgaatgt

SEQ ID NO: 7652586 - DNA, 22 bp, Homo sapiens
agataatggagggatttgcatt

SEQ ID NO: 7652587 - DNA, 22 bp, Homo sapiens
acaacatttccatttccttggt

SEQ ID NO: 7652588 - DNA, 22 bp, Homo sapiens
agataatctctaggcttcatgt

SEQ ID NO: 7652589 - DNA, 22 bp, Homo sapiens
agataatgaatttattgaatgt

SEQ ID NO: 7652590 - DNA, 22 bp, Homo sapiens
agataatgaatgccatgacatt

SEQ ID NO: 7652591 - DNA, 22 bp, Homo sapiens
agataataagtctggtaataat

SEQ ID NO: 7652592 - DNA, 22 bp, Homo sapiens
acaagaatgtagattagttaag

SEQ ID NO: 7652593 - DNA, 22 bp, Homo sapiens
acaagaattatttctagttaac

SEQ ID NO: 7652594 - DNA, 22 bp, Homo sapiens
acaactagcaggtattaatttt

SEQ ID NO: 7652595 - DNA, 22 bp, Homo sapiens
acaactagcaggtattaatttt

SEQ ID NO: 7652596 - DNA, 23 bp, Homo sapiens
acaaccagcactggagggcacca

SEQ ID NO: 7652597 - DNA, 22 bp, Homo sapiens
acaaccatgtcagttcaaacca

SEQ ID NO: 7652598 - DNA, 22 bp, Homo sapiens
acaaccttctggagatatctgt

SEQ ID NO: 7652599 - DNA, 22 bp, Homo sapiens
agataataaatgttttaggttt

SEQ ID NO: 7652600 - DNA, 22 bp, Homo sapiens
agataataaatgttttaggttt

SEQ ID NO: 7652601 - DNA, 22 bp, Homo sapiens
agataataaatgttttaggttt

SEQ ID NO: 7652602 - DNA, 22 bp, Homo sapiens
agataataagtctggtaataat

SEQ ID NO: 7652603 - DNA, 22 bp, Homo sapiens
agataataagtctggtaataat

SEQ ID NO: 7652604 - DNA, 22 bp, Homo sapiens
agataagtactgttattattgc

SEQ ID NO: 7652605 - DNA, 22 bp, Homo sapiens
agataagctgtttttcaagaat

SEQ ID NO: 7652606 - DNA, 22 bp, Homo sapiens
agataactggtttacattattg

SEQ ID NO: 7652607 - DNA, 22 bp, Homo sapiens
agataagatagtccagcacaat

SEQ ID NO: 7652608 - DNA, 22 bp, Homo sapiens
agataactggtttacattattg

SEQ ID NO: 7652609 - DNA, 22 bp, Homo sapiens
agataactggtttacattattg

SEQ ID NO: 7652610 - DNA, 22 bp, Homo sapiens
agataagagcctgtgtttggaa

SEQ ID NO: 7652611 - DNA, 22 bp, Homo sapiens
agataacttttgggtattcatg

SEQ ID NO: 7652612 - DNA, 22 bp, Homo sapiens
acaacacagcaaaaccccatct

SEQ ID NO: 7652613 - DNA, 22 bp, Homo sapiens
acaacaatctaccctagcttct

SEQ ID NO: 7652614 - DNA, 22 bp, Homo sapiens
acaacaatctaccctagcttct

SEQ ID NO: 7652615 - DNA, 22 bp, Homo sapiens
acaacaatctaccctagcttct

SEQ ID NO: 7652616 - DNA, 22 bp, Homo sapiens
acaacaatctaccctagcttct

SEQ ID NO: 7652617 - DNA, 22 bp, Homo sapiens
acaacaatctaccctagcttct

SEQ ID NO: 7652618 - DNA, 22 bp, Homo sapiens
acaacacagctttcctcaagtt

SEQ ID NO: 7652619 - DNA, 22 bp, Homo sapiens
acaacacagctttcctcaagtt

SEQ ID NO: 7652620 - DNA, 22 bp, Homo sapiens
acaacacagctttcctcaagtt

SEQ ID NO: 7652621 - DNA, 22 bp, Homo sapiens
acaacacagcaaaaccccatct

SEQ ID NO: 7652622 - DNA, 22 bp, Homo sapiens
acaacacagcaaaaccccatct

SEQ ID NO: 7652623 - DNA, 22 bp, Homo sapiens
acaacaaagacacttgaaatga

SEQ ID NO: 7652624 - DNA, 22 bp, Homo sapiens
acaacaatctaccctagcttct

SEQ ID NO: 7652625 - DNA, 22 bp, Homo sapiens
acaacaaggcttttcattcata

SEQ ID NO: 7652626 - DNA, 22 bp, Homo sapiens
acaacaaagacacttgaaatga

SEQ ID NO: 7652627 - DNA, 22 bp, Homo sapiens
acaacaaagacacttgaaatga

SEQ ID NO: 7652628 - DNA, 22 bp, Homo sapiens
acaacaaagacacttgaaatga

SEQ ID NO: 7652629 - DNA, 22 bp, Homo sapiens
acaaattgccccattttgaact

SEQ ID NO: 7652630 - DNA, 22 bp, Homo sapiens
acaaattgccccattttgaact

SEQ ID NO: 7652631 - DNA, 19 bp, Homo sapiens
acaaattggcaaaatgcaa

SEQ ID NO: 7652632 - DNA, 19 bp, Homo sapiens
acaaattggcaaaatgcaa

SEQ ID NO: 7652633 - DNA, 22 bp, Homo sapiens
agaggggtggtgctctcctgga

SEQ ID NO: 7652634 - DNA, 22 bp, Homo sapiens
agaggggttaagtgctagtccg

SEQ ID NO: 7652635 - DNA, 22 bp, Homo sapiens
agaggggttaagtgctagtccg

SEQ ID NO: 7652636 - DNA, 22 bp, Homo sapiens
agaggggttaagtgctagtccg

SEQ ID NO: 7652637 - DNA, 22 bp, Homo sapiens
acaaattgccccattttgaact

SEQ ID NO: 7652638 - DNA, 22 bp, Homo sapiens
acaacaaagacacttgaaatga

SEQ ID NO: 7652639 - DNA, 22 bp, Homo sapiens
acaacaaagacacttgaaatga

SEQ ID NO: 7652640 - DNA, 22 bp, Homo sapiens
acaacaaagacacttgaaatga

SEQ ID NO: 7652641 - DNA, 22 bp, Homo sapiens
acaacaaagacacttgaaatga

SEQ ID NO: 7652642 - DNA, 22 bp, Homo sapiens
acaacaaagacacttgaaatga

SEQ ID NO: 7652643 - DNA, 22 bp, Homo sapiens
acaacaaagacacttgaaatga

SEQ ID NO: 7652644 - DNA, 20 bp, Homo sapiens
acaacaaacttgcttaagga

SEQ ID NO: 7652645 - DNA, 20 bp, Homo sapiens
acaacaaacttgcttaagga

SEQ ID NO: 7652646 - DNA, 20 bp, Homo sapiens
acaacaaacttgcttaagga

SEQ ID NO: 7652647 - DNA, 20 bp, Homo sapiens
acaacaaacttgcttaagga

SEQ ID NO: 7652648 - DNA, 20 bp, Homo sapiens
acaacaaacttgcttaagga

SEQ ID NO: 7652649 - DNA, 20 bp, Homo sapiens
acaaattggcagaatgacaa

SEQ ID NO: 7652650 - DNA, 22 bp, Homo sapiens
acaacagagctggactgagagg

SEQ ID NO: 7652651 - DNA, 22 bp, Homo sapiens
acaacagagctggactgagagg

SEQ ID NO: 7652652 - DNA, 22 bp, Homo sapiens
acaacagagctggactgagagg

SEQ ID NO: 7652653 - DNA, 17 bp, Homo sapiens
acaacagaaatgtattc

SEQ ID NO: 7652654 - DNA, 22 bp, Homo sapiens
acaacacatgtgtatatgtgtg

SEQ ID NO: 7652655 - DNA, 22 bp, Homo sapiens
acaacacatgtgtatatgtgtg

SEQ ID NO: 7652656 - DNA, 17 bp, Homo sapiens
acaacagaaatgtattc

SEQ ID NO: 7652657 - DNA, 17 bp, Homo sapiens
acaacagaaatgtattc

SEQ ID NO: 7652658 - DNA, 17 bp, Homo sapiens
acaacagaaatgtattc

SEQ ID NO: 7652659 - DNA, 22 bp, Homo sapiens
acaacacatgtgtatatgtgtg

SEQ ID NO: 7652660 - DNA, 22 bp, Homo sapiens
acaacacatgtgtatatgtgtg

SEQ ID NO: 7652661 - DNA, 22 bp, Homo sapiens
acaacacatgtgtatatgtgtg

SEQ ID NO: 7652662 - DNA, 22 bp, Homo sapiens
acaacacatgtgtatatgtgtg

SEQ ID NO: 7652663 - DNA, 22 bp, Homo sapiens
acaacacagctttcctcaagtt

SEQ ID NO: 7652664 - DNA, 22 bp, Homo sapiens
acaacacagctttcctcaagtt

SEQ ID NO: 7652665 - DNA, 22 bp, Homo sapiens
acaacacatgtgtatatgtgtg

SEQ ID NO: 7652666 - DNA, 22 bp, Homo sapiens
acaacacatgtgtatatgtgtg

SEQ ID NO: 7652667 - DNA, 22 bp, Homo sapiens
acaacacatgtgtatatgtgtg

SEQ ID NO: 7652668 - DNA, 22 bp, Homo sapiens
agataaattcctaagatttcag

SEQ ID NO: 7652669 - DNA, 22 bp, Homo sapiens
agataacatgttgcagattctg

SEQ ID NO: 7652670 - DNA, 22 bp, Homo sapiens
acaacagagctggactgagagg

SEQ ID NO: 7652671 - DNA, 22 bp, Homo sapiens
agataaattcctaagatttcag

SEQ ID NO: 7652672 - DNA, 22 bp, Homo sapiens
acaacagagctggactgagagg

SEQ ID NO: 7652673 - DNA, 22 bp, Homo sapiens
acaacagagctggactgagagg

SEQ ID NO: 7652674 - DNA, 22 bp, Homo sapiens
acaacagagctggactgagagg

SEQ ID NO: 7652675 - DNA, 22 bp, Homo sapiens
acaacagagctggactgagagg

SEQ ID NO: 7652676 - DNA, 22 bp, Homo sapiens
acaacagagctggactgagagg

SEQ ID NO: 7652677 - DNA, 22 bp, Homo sapiens
agataactaaagaaagggatta

SEQ ID NO: 7652678 - DNA, 22 bp, Homo sapiens
agataactcattttgtatatcc

SEQ ID NO: 7652679 - DNA, 22 bp, Homo sapiens
agataactcattttgtatatcc

SEQ ID NO: 7652680 - DNA, 22 bp, Homo sapiens
agataactcattttgtatatcc

SEQ ID NO: 7652681 - DNA, 22 bp, Homo sapiens
agataactcattttgtatatcc

SEQ ID NO: 7652682 - DNA, 22 bp, Homo sapiens
agataactggtttacattattg

SEQ ID NO: 7652683 - DNA, 22 bp, Homo sapiens
agataacatttattgaatgtaa

SEQ ID NO: 7652684 - DNA, 22 bp, Homo sapiens
agataacatttattgaatgtaa

SEQ ID NO: 7652685 - DNA, 22 bp, Homo sapiens
agataacatttattgaatgtaa

SEQ ID NO: 7652686 - DNA, 22 bp, Homo sapiens
agataacatttattgaatgtaa

SEQ ID NO: 7652687 - DNA, 22 bp, Homo sapiens
agataacatttattgaatgtaa

SEQ ID NO: 7652688 - DNA, 22 bp, Homo sapiens
acaatgagtttgatgtagtttg

SEQ ID NO: 7652689 - DNA, 22 bp, Homo sapiens
acaatgaatttaataccttatt

SEQ ID NO: 7652690 - DNA, 22 bp, Homo sapiens
acaatgaccaaaatgtttccag

SEQ ID NO: 7652691 - DNA, 22 bp, Homo sapiens
acaatgatgcagatgagtaaga

SEQ ID NO: 7652692 - DNA, 22 bp, Homo sapiens
acaatgatgcagatgagtaaga

SEQ ID NO: 7652693 - DNA, 22 bp, Homo sapiens
acaatgatgcagatgagtaaga

SEQ ID NO: 7652694 - DNA, 19 bp, Homo sapiens
acaatgaatgtgttctctt

SEQ ID NO: 7652695 - DNA, 19 bp, Homo sapiens
acaatgaatgtgttctctt

SEQ ID NO: 7652696 - DNA, 22 bp, Homo sapiens
acaatgaatttaataccttatt

SEQ ID NO: 7652697 - DNA, 22 bp, Homo sapiens
acaatgaatttaataccttatt

SEQ ID NO: 7652698 - DNA, 22 bp, Homo sapiens
acaatgcaataggagctagaaa

SEQ ID NO: 7652699 - DNA, 22 bp, Homo sapiens
acaatgcaataggagctagaaa

SEQ ID NO: 7652700 - DNA, 22 bp, Homo sapiens
acaatgcaattgtaaggtgtgt

SEQ ID NO: 7652701 - DNA, 22 bp, Homo sapiens
acaatgcaattgtaaggtgtgt

SEQ ID NO: 7652702 - DNA, 22 bp, Homo sapiens
acaatgattttttagagtagtt

SEQ ID NO: 7652703 - DNA, 22 bp, Homo sapiens
acaatgattttttagagtagtt

SEQ ID NO: 7652704 - DNA, 22 bp, Homo sapiens
acaatgattttttagagtagtt

SEQ ID NO: 7652705 - DNA, 22 bp, Homo sapiens
acaatgattttttagagtagtt

SEQ ID NO: 7652706 - DNA, 22 bp, Homo sapiens
acaatgattttttagagtagtt

SEQ ID NO: 7652707 - DNA, 22 bp, Homo sapiens
acaatgattttttagagtagtt

SEQ ID NO: 7652708 - DNA, 22 bp, Homo sapiens
acaatgaatatcatgaagtact

SEQ ID NO: 7652709 - DNA, 22 bp, Homo sapiens
acaatgaatatcatgaagtact

SEQ ID NO: 7652710 - DNA, 22 bp, Homo sapiens
acaatgaatatcatgaagtact

SEQ ID NO: 7652711 - DNA, 22 bp, Homo sapiens
acaatgaagggagacacttgct

SEQ ID NO: 7652712 - DNA, 22 bp, Homo sapiens
acaatgaatactaagcaccagg

SEQ ID NO: 7652713 - DNA, 22 bp, Homo sapiens
acaatgaatactaagcaccagg

SEQ ID NO: 7652714 - DNA, 22 bp, Homo sapiens
acaatgaatatcatgaagtact

SEQ ID NO: 7652715 - DNA, 19 bp, Homo sapiens
acaatgaatgtgttctctt

SEQ ID NO: 7652716 - DNA, 19 bp, Homo sapiens
acaatgaatgtgttctctt

SEQ ID NO: 7652717 - DNA, 22 bp, Homo sapiens
acaatgaagggagacacttgct

SEQ ID NO: 7652718 - DNA, 22 bp, Homo sapiens
acaatgaagggagacacttgct

SEQ ID NO: 7652719 - DNA, 22 bp, Homo sapiens
acaatgaagataatgttgcagt

SEQ ID NO: 7652720 - DNA, 22 bp, Homo sapiens
acaatgaagataatgttgcagt

SEQ ID NO: 7652721 - DNA, 22 bp, Homo sapiens
acaatgaagataatgttgcagt

SEQ ID NO: 7652722 - DNA, 22 bp, Homo sapiens
acaatgaagataatgttgcagt

SEQ ID NO: 7652723 - DNA, 22 bp, Homo sapiens
acaatgaaccaaatttaccaat

SEQ ID NO: 7652724 - DNA, 22 bp, Homo sapiens
acaatgaacgctttttaactgt

SEQ ID NO: 7652725 - DNA, 22 bp, Homo sapiens
acaatgaacgctttttaactgt

SEQ ID NO: 7652726 - DNA, 22 bp, Homo sapiens
acaatgaacgctttttaactgt

SEQ ID NO: 7652727 - DNA, 22 bp, Homo sapiens
acaatgaaccaaatttaccaat

SEQ ID NO: 7652728 - DNA, 22 bp, Homo sapiens
acaatgaacgctttttaactgt

SEQ ID NO: 7652729 - DNA, 22 bp, Homo sapiens
acaatgaacgctttttaactgt

SEQ ID NO: 7652730 - DNA, 22 bp, Homo sapiens
acaatgaacgctttttaactgt

SEQ ID NO: 7652731 - DNA, 22 bp, Homo sapiens
acaatgaacacacaaggaattc

SEQ ID NO: 7652732 - DNA, 22 bp, Homo sapiens
acaatgaacacacaaggaattc

SEQ ID NO: 7652733 - DNA, 22 bp, Homo sapiens
acaatgaaccaaatttaccaat

SEQ ID NO: 7652734 - DNA, 22 bp, Homo sapiens
acaatgaaccaaatttaccaat

SEQ ID NO: 7652735 - DNA, 22 bp, Homo sapiens
acaatgaacacacaaggaattc

SEQ ID NO: 7652736 - DNA, 22 bp, Homo sapiens
acaatgaaaggtattctgaact

SEQ ID NO: 7652737 - DNA, 22 bp, Homo sapiens
acaatgaacacacaaggaattc

SEQ ID NO: 7652738 - DNA, 22 bp, Homo sapiens
acaatgaacacacaaggaattc

SEQ ID NO: 7652739 - DNA, 22 bp, Homo sapiens
acaatgaaaggtattctgaact

SEQ ID NO: 7652740 - DNA, 22 bp, Homo sapiens
acaatgaaaaaatttactgtgg

SEQ ID NO: 7652741 - DNA, 22 bp, Homo sapiens
acaatcttattagtagtataga

SEQ ID NO: 7652742 - DNA, 22 bp, Homo sapiens
acaatcttattagtagtataga

SEQ ID NO: 7652743 - DNA, 22 bp, Homo sapiens
acaatgaaaaaatttactgtgg

SEQ ID NO: 7652744 - DNA, 22 bp, Homo sapiens
acaatgaaaaaatttactgtgg

SEQ ID NO: 7652745 - DNA, 22 bp, Homo sapiens
acaatgaaagcaagaagacggc

SEQ ID NO: 7652746 - DNA, 22 bp, Homo sapiens
acaatgaaagcaagaagacggc

SEQ ID NO: 7652747 - DNA, 22 bp, Homo sapiens
acaatgaaaaaatttactgtgg

SEQ ID NO: 7652748 - DNA, 22 bp, Homo sapiens
acaatcttattagtagtataga

SEQ ID NO: 7652749 - DNA, 22 bp, Homo sapiens
acaatcttattagtagtataga

SEQ ID NO: 7652750 - DNA, 22 bp, Homo sapiens
acaatctggaaaagttaactat

SEQ ID NO: 7652751 - DNA, 22 bp, Homo sapiens
acaatcattggcttcattacaa

SEQ ID NO: 7652752 - DNA, 22 bp, Homo sapiens
acaatcattggcttcattacaa

SEQ ID NO: 7652753 - DNA, 22 bp, Homo sapiens
acaatcattggcttcattacaa

SEQ ID NO: 7652754 - DNA, 22 bp, Homo sapiens
acaatcagcactgagtttatct

SEQ ID NO: 7652755 - DNA, 22 bp, Homo sapiens
acaatcagcactgagtttatct

SEQ ID NO: 7652756 - DNA, 22 bp, Homo sapiens
acaatcagcactgagtttatct

SEQ ID NO: 7652757 - DNA, 22 bp, Homo sapiens
acaagcatgtggtaaaaagacc

SEQ ID NO: 7652758 - DNA, 22 bp, Homo sapiens
acaagcatgggctttgacatca

SEQ ID NO: 7652759 - DNA, 22 bp, Homo sapiens
acaagcatgggctttgacatca

SEQ ID NO: 7652760 - DNA, 22 bp, Homo sapiens
acaagcatcaggttcagcaata

SEQ ID NO: 7652761 - DNA, 22 bp, Homo sapiens
acaagcatcaggttcagcaata

SEQ ID NO: 7652762 - DNA, 22 bp, Homo sapiens
acaagcagtaaaggccacagtc

SEQ ID NO: 7652763 - DNA, 22 bp, Homo sapiens
acaagcagtaaaggccacagtc

SEQ ID NO: 7652764 - DNA, 22 bp, Homo sapiens
acaagcagtaaaggccacagtc

SEQ ID NO: 7652765 - DNA, 22 bp, Homo sapiens
acaagcagtaaaggccacagtc

SEQ ID NO: 7652766 - DNA, 17 bp, Homo sapiens
acaagcagtggccatgg

SEQ ID NO: 7652767 - DNA, 17 bp, Homo sapiens
acaagcagtggccatgg

SEQ ID NO: 7652768 - DNA, 22 bp, Homo sapiens
acaagcataagtgagatgaata

SEQ ID NO: 7652769 - DNA, 17 bp, Homo sapiens
acaagcagtggccatgg

SEQ ID NO: 7652770 - DNA, 22 bp, Homo sapiens
acaagcataagtgagatgaata

SEQ ID NO: 7652771 - DNA, 22 bp, Homo sapiens
acaagcataagtgagatgaata

SEQ ID NO: 7652772 - DNA, 22 bp, Homo sapiens
acaagctcagatccctgtctct

SEQ ID NO: 7652773 - DNA, 22 bp, Homo sapiens
acaagctccttattcagctggg

SEQ ID NO: 7652774 - DNA, 22 bp, Homo sapiens
acaagctgtggtgggacaagag

SEQ ID NO: 7652775 - DNA, 22 bp, Homo sapiens
acaagcttattaagttatctgt

SEQ ID NO: 7652776 - DNA, 22 bp, Homo sapiens
acaagcttattaagttatctgt

SEQ ID NO: 7652777 - DNA, 22 bp, Homo sapiens
acaagcctaacataacataagt

SEQ ID NO: 7652778 - DNA, 22 bp, Homo sapiens
acaagcgggccacagtgctggt

SEQ ID NO: 7652779 - DNA, 22 bp, Homo sapiens
acaagcgggccacagtgctggt

SEQ ID NO: 7652780 - DNA, 22 bp, Homo sapiens
acaagcgggccacagtgctggt

SEQ ID NO: 7652781 - DNA, 22 bp, Homo sapiens
acaagcgggccacagtgctggt

SEQ ID NO: 7652782 - DNA, 22 bp, Homo sapiens
acaatagacaaagtgaatggct

SEQ ID NO: 7652783 - DNA, 21 bp, Homo sapiens
acaatagaatagagtgtggtg

SEQ ID NO: 7652784 - DNA, 21 bp, Homo sapiens
acaatagaatagagtgtggtg

SEQ ID NO: 7652785 - DNA, 22 bp, Homo sapiens
acaagcttccaggtgatgctga

SEQ ID NO: 7652786 - DNA, 22 bp, Homo sapiens
acaatagaaggaaactgacata

SEQ ID NO: 7652787 - DNA, 22 bp, Homo sapiens
acaatagacaaagtgaatggct

SEQ ID NO: 7652788 - DNA, 22 bp, Homo sapiens
acaatagacaaagtgaatggct

SEQ ID NO: 7652789 - DNA, 22 bp, Homo sapiens
acaatcacacatgcaattatac

SEQ ID NO: 7652790 - DNA, 22 bp, Homo sapiens
acaatcacacatgcaattatac

SEQ ID NO: 7652791 - DNA, 22 bp, Homo sapiens
acaagatagcttagaagattca

SEQ ID NO: 7652792 - DNA, 23 bp, Homo sapiens
acaagatagggataaaaagataa

SEQ ID NO: 7652793 - DNA, 23 bp, Homo sapiens
acaagatagggataaaaagataa

SEQ ID NO: 7652794 - DNA, 23 bp, Homo sapiens
acaagatagggataaaaagataa

SEQ ID NO: 7652795 - DNA, 23 bp, Homo sapiens
acaagatagggataaaaagataa

SEQ ID NO: 7652796 - DNA, 23 bp, Homo sapiens
acaagatagggataaaaagataa

SEQ ID NO: 7652797 - DNA, 23 bp, Homo sapiens
acaagatagggataaaaagataa

SEQ ID NO: 7652798 - DNA, 23 bp, Homo sapiens
acaagatagggataaaaagataa

SEQ ID NO: 7652799 - DNA, 22 bp, Homo sapiens
acaagataggttgagtctagcc

SEQ ID NO: 7652800 - DNA, 22 bp, Homo sapiens
acaagataggttgagtctagcc

SEQ ID NO: 7652801 - DNA, 22 bp, Homo sapiens
acaagattcaatgaattgattg

SEQ ID NO: 7652802 - DNA, 22 bp, Homo sapiens
acaagattcaatgaattgattg

SEQ ID NO: 7652803 - DNA, 22 bp, Homo sapiens
acaagatgtgtttatacaagct

SEQ ID NO: 7652804 - DNA, 22 bp, Homo sapiens
acaagatgtgtttatacaagct

SEQ ID NO: 7652805 - DNA, 22 bp, Homo sapiens
acaagatgtgtttatacaagct

SEQ ID NO: 7652806 - DNA, 22 bp, Homo sapiens
acaagatggaatattgagaaaa

SEQ ID NO: 7652807 - DNA, 22 bp, Homo sapiens
acaagatggaatattgagaaaa

SEQ ID NO: 7652808 - DNA, 22 bp, Homo sapiens
acaagataggttgagtctagcc

SEQ ID NO: 7652809 - DNA, 22 bp, Homo sapiens
acaagataggttgagtctagcc

SEQ ID NO: 7652810 - DNA, 22 bp, Homo sapiens
acaagataggttgagtctagcc

SEQ ID NO: 7652811 - DNA, 22 bp, Homo sapiens
acaagatttaatgcaacccaag

SEQ ID NO: 7652812 - DNA, 22 bp, Homo sapiens
acaagatttagcttaaagggct

SEQ ID NO: 7652813 - DNA, 22 bp, Homo sapiens
acaagatttaatgcaacccaag

SEQ ID NO: 7652814 - DNA, 22 bp, Homo sapiens
acaagatttggctgaaactcca

SEQ ID NO: 7652815 - DNA, 22 bp, Homo sapiens
acaagatttggctgaaactcca

SEQ ID NO: 7652816 - DNA, 22 bp, Homo sapiens
acaagatttggctgaaactcca

SEQ ID NO: 7652817 - DNA, 22 bp, Homo sapiens
acaagatttggctgaaactcca

SEQ ID NO: 7652818 - DNA, 22 bp, Homo sapiens
acaagattttatgactcttttt

SEQ ID NO: 7652819 - DNA, 22 bp, Homo sapiens
acaagattttatgactcttttt

SEQ ID NO: 7652820 - DNA, 22 bp, Homo sapiens
acaagattttatgactcttttt

SEQ ID NO: 7652821 - DNA, 22 bp, Homo sapiens
acaagcacttcactgtcctctg

SEQ ID NO: 7652822 - DNA, 22 bp, Homo sapiens
acaagcagaaggtggggtctta

SEQ ID NO: 7652823 - DNA, 22 bp, Homo sapiens
acaagattttatgactcttttt

SEQ ID NO: 7652824 - DNA, 22 bp, Homo sapiens
acaagcacttcactgtcctctg

SEQ ID NO: 7652825 - DNA, 23 bp, Homo sapiens
acaagcagcccagtgctctgcct

SEQ ID NO: 7652826 - DNA, 23 bp, Homo sapiens
acaagcagcccagtgctctgcct

SEQ ID NO: 7652827 - DNA, 22 bp, Homo sapiens
acaagcagagattaaatgtttt

SEQ ID NO: 7652828 - DNA, 22 bp, Homo sapiens
agaaatctttgaagtgtaatgt

SEQ ID NO: 7652829 - DNA, 22 bp, Homo sapiens
agaaatagcagagtcaggcggg

SEQ ID NO: 7652830 - DNA, 22 bp, Homo sapiens
agaaatagaggaaaggtttgac

SEQ ID NO: 7652831 - DNA, 22 bp, Homo sapiens
agaaatagaggaaaggtttgac

SEQ ID NO: 7652832 - DNA, 22 bp, Homo sapiens
agaaatactttgtaaatctcac

SEQ ID NO: 7652833 - DNA, 22 bp, Homo sapiens
agaaatactttgtaaatctcac

SEQ ID NO: 7652834 - DNA, 22 bp, Homo sapiens
agaaatagaggaaaggtttgac

SEQ ID NO: 7652835 - DNA, 22 bp, Homo sapiens
agaaatgaaaccaaagcctaga

SEQ ID NO: 7652836 - DNA, 22 bp, Homo sapiens
agaaatgaaaccaaagcctaga

SEQ ID NO: 7652837 - DNA, 22 bp, Homo sapiens
agaaatgaaaccaaagcctaga

SEQ ID NO: 7652838 - DNA, 22 bp, Homo sapiens
agaaatgaaaccaaagcctaga

SEQ ID NO: 7652839 - DNA, 22 bp, Homo sapiens
agaaatgaaaccaaagcctaga

SEQ ID NO: 7652840 - DNA, 22 bp, Homo sapiens
agaaatgaagcaggagttatta

SEQ ID NO: 7652841 - DNA, 22 bp, Homo sapiens
agaaatgaagagagtcaaggtt

SEQ ID NO: 7652842 - DNA, 22 bp, Homo sapiens
agaaatgaagagagtcaaggtt

SEQ ID NO: 7652843 - DNA, 22 bp, Homo sapiens
agaaatgaagagagtcaaggtt

SEQ ID NO: 7652844 - DNA, 22 bp, Homo sapiens
agaaatgaagagagtcaaggtt

SEQ ID NO: 7652845 - DNA, 22 bp, Homo sapiens
agaaatgaaaccaaagcctaga

SEQ ID NO: 7652846 - DNA, 22 bp, Homo sapiens
agaaatgaaaccaaagcctaga

SEQ ID NO: 7652847 - DNA, 22 bp, Homo sapiens
agaaatgaaaccaaagcctaga

SEQ ID NO: 7652848 - DNA, 22 bp, Homo sapiens
agaaatgaaaccaaagcctaga

SEQ ID NO: 7652849 - DNA, 22 bp, Homo sapiens
agaaatgaagcaggagttatta

SEQ ID NO: 7652850 - DNA, 22 bp, Homo sapiens
agaaatgaagcaggagttatta

SEQ ID NO: 7652851 - DNA, 22 bp, Homo sapiens
agaaatgaagcaggagttatta

SEQ ID NO: 7652852 - DNA, 22 bp, Homo sapiens
agaaatgaagcaggagttatta

SEQ ID NO: 7652853 - DNA, 22 bp, Homo sapiens
agaaatgaatatgtagtggtta

SEQ ID NO: 7652854 - DNA, 22 bp, Homo sapiens
agaaatgaatatgtagtggtta

SEQ ID NO: 7652855 - DNA, 22 bp, Homo sapiens
agaaatgaatatgtagtggtta

SEQ ID NO: 7652856 - DNA, 22 bp, Homo sapiens
agaaatgacaagactgatcagg

SEQ ID NO: 7652857 - DNA, 22 bp, Homo sapiens
agaaatgacaagactgatcagg

SEQ ID NO: 7652858 - DNA, 22 bp, Homo sapiens
agaaatgacaagactgatcagg

SEQ ID NO: 7652859 - DNA, 22 bp, Homo sapiens
agaaatgacaagactgatcagg

SEQ ID NO: 7652860 - DNA, 22 bp, Homo sapiens
agaaatgacaagactgatcagg

SEQ ID NO: 7652861 - DNA, 22 bp, Homo sapiens
agaaatgacaagactgatcagg

SEQ ID NO: 7652862 - DNA, 22 bp, Homo sapiens
aatcataattcaaataagctta

SEQ ID NO: 7652863 - DNA, 22 bp, Homo sapiens
aatcataattcaaataagctta

SEQ ID NO: 7652864 - DNA, 22 bp, Homo sapiens
aatcataattcaaataagctta

SEQ ID NO: 7652865 - DNA, 22 bp, Homo sapiens
aatcagtttcttggcaagttta

SEQ ID NO: 7652866 - DNA, 22 bp, Homo sapiens
aatcagttgttcactctgaaaa

SEQ ID NO: 7652867 - DNA, 22 bp, Homo sapiens
aatcagttctacatcttatcca

SEQ ID NO: 7652868 - DNA, 22 bp, Homo sapiens
aatcagttagaaggaagagaat

SEQ ID NO: 7652869 - DNA, 22 bp, Homo sapiens
aatcagttagaaggaagagaat

SEQ ID NO: 7652870 - DNA, 22 bp, Homo sapiens
aatcagttctacatcttatcca

SEQ ID NO: 7652871 - DNA, 22 bp, Homo sapiens
aatcagttgtccaaagttcaca

SEQ ID NO: 7652872 - DNA, 22 bp, Homo sapiens
aatcagttgtccaaagttcaca

SEQ ID NO: 7652873 - DNA, 22 bp, Homo sapiens
aatcagttgtccaaagttcaca

SEQ ID NO: 7652874 - DNA, 22 bp, Homo sapiens
aatcataattcaaataagctta

SEQ ID NO: 7652875 - DNA, 22 bp, Homo sapiens
aatcataattcaaataagctta

SEQ ID NO: 7652876 - DNA, 22 bp, Homo sapiens
aatcataattcaaataagctta

SEQ ID NO: 7652877 - DNA, 22 bp, Homo sapiens
aatcataattcaaataagctta

SEQ ID NO: 7652878 - DNA, 22 bp, Homo sapiens
agaaatactttgtaaatctcac

SEQ ID NO: 7652879 - DNA, 22 bp, Homo sapiens
agaaatactttgtaaatctcac

SEQ ID NO: 7652880 - DNA, 22 bp, Homo sapiens
agaaatactttgtaaatctcac

SEQ ID NO: 7652881 - DNA, 21 bp, Homo sapiens
aatcagtgttctcaggggcaa

SEQ ID NO: 7652882 - DNA, 22 bp, Homo sapiens
aatcagtgtgtaaagtggctgc

SEQ ID NO: 7652883 - DNA, 22 bp, Homo sapiens
aatcagtgtggtgacttgtctg

SEQ ID NO: 7652884 - DNA, 23 bp, Homo sapiens
aatcagtgcagttttatgccaag

SEQ ID NO: 7652885 - DNA, 22 bp, Homo sapiens
aatcagtggttcccagcccagg

SEQ ID NO: 7652886 - DNA, 22 bp, Homo sapiens
aatcaggaggaagccttgggca

SEQ ID NO: 7652887 - DNA, 22 bp, Homo sapiens
aatcaggcacagcgactgcagc

SEQ ID NO: 7652888 - DNA, 22 bp, Homo sapiens
aatcaggccaagtgaagtggga

SEQ ID NO: 7652889 - DNA, 19 bp, Homo sapiens
aatcaggctgaagtgtgtt

SEQ ID NO: 7652890 - DNA, 22 bp, Homo sapiens
aatcagtattggtatagaatga

SEQ ID NO: 7652891 - DNA, 22 bp, Homo sapiens
aatcagtattggtatagaatga

SEQ ID NO: 7652892 - DNA, 22 bp, Homo sapiens
aatcagaacttctcagggtggg

SEQ ID NO: 7652893 - DNA, 22 bp, Homo sapiens
aatcagaacttctcagggtggg

SEQ ID NO: 7652894 - DNA, 22 bp, Homo sapiens
aatcagaaattctacatcacaa

SEQ ID NO: 7652895 - DNA, 22 bp, Homo sapiens
aatcagaaccttgggtcataac

SEQ ID NO: 7652896 - DNA, 22 bp, Homo sapiens
aatcagaaattgagggtctggt

SEQ ID NO: 7652897 - DNA, 22 bp, Homo sapiens
aatcagaatcagttgacacagc

SEQ ID NO: 7652898 - DNA, 22 bp, Homo sapiens
aatcagaatcagttgacacagc

SEQ ID NO: 7652899 - DNA, 22 bp, Homo sapiens
aatcagaatcagttgacacagc

SEQ ID NO: 7652900 - DNA, 22 bp, Homo sapiens
aatcagaatttattgaatcttt

SEQ ID NO: 7652901 - DNA, 22 bp, Homo sapiens
aatcagaatttattgaatcttt

SEQ ID NO: 7652902 - DNA, 22 bp, Homo sapiens
aatcagaatcagttgacacagc

SEQ ID NO: 7652903 - DNA, 22 bp, Homo sapiens
aatcagaatttattgaatcttt

SEQ ID NO: 7652904 - DNA, 22 bp, Homo sapiens
aatcagaatttattgaatcttt

SEQ ID NO: 7652905 - DNA, 22 bp, Homo sapiens
aatcagaatttattgaatcttt

SEQ ID NO: 7652906 - DNA, 22 bp, Homo sapiens
aatcagaatttattgaatcttt

SEQ ID NO: 7652907 - DNA, 22 bp, Homo sapiens
aatcagatgaatcaatatatcc

SEQ ID NO: 7652908 - DNA, 22 bp, Homo sapiens
aatcagcaaaggtcagctctaa

SEQ ID NO: 7652909 - DNA, 17 bp, Homo sapiens
aatcagatttctgagga

SEQ ID NO: 7652910 - DNA, 17 bp, Homo sapiens
aatcagatttctgagga

SEQ ID NO: 7652911 - DNA, 22 bp, Homo sapiens
aatcagatgaatcaatatatcc

SEQ ID NO: 7652912 - DNA, 22 bp, Homo sapiens
aatcagatgaatcaatatatcc

SEQ ID NO: 7652913 - DNA, 22 bp, Homo sapiens
aatcagagccctctgagcttca

SEQ ID NO: 7652914 - DNA, 22 bp, Homo sapiens
aatcagagccctctgagcttca

SEQ ID NO: 7652915 - DNA, 22 bp, Homo sapiens
aatcagactattaaagtctctt

SEQ ID NO: 7652916 - DNA, 22 bp, Homo sapiens
aatcagacagttctggattcaa

SEQ ID NO: 7652917 - DNA, 22 bp, Homo sapiens
aatcagaatttattgaatcttt

SEQ ID NO: 7652918 - DNA, 22 bp, Homo sapiens
aatcaggatgactgtcatttca

SEQ ID NO: 7652919 - DNA, 22 bp, Homo sapiens
aatcaggatgactgtcatttca

SEQ ID NO: 7652920 - DNA, 22 bp, Homo sapiens
aatcaggatgactgtcatttca

SEQ ID NO: 7652921 - DNA, 22 bp, Homo sapiens
aatcaggatgactgtcatttca

SEQ ID NO: 7652922 - DNA, 22 bp, Homo sapiens
aatcaggatatgaacccaggta

SEQ ID NO: 7652923 - DNA, 22 bp, Homo sapiens
aatcaggatatgaacccaggta

SEQ ID NO: 7652924 - DNA, 22 bp, Homo sapiens
aatcaggatatgaacccaggta

SEQ ID NO: 7652925 - DNA, 22 bp, Homo sapiens
aatcaggatagaacctcacgtg

SEQ ID NO: 7652926 - DNA, 22 bp, Homo sapiens
aatcaggatagaacctcacgtg

SEQ ID NO: 7652927 - DNA, 22 bp, Homo sapiens
aatcaggatagaacctcacgtg

SEQ ID NO: 7652928 - DNA, 22 bp, Homo sapiens
aatcaggaggaagccttgggca

SEQ ID NO: 7652929 - DNA, 22 bp, Homo sapiens
aatcaggaggaagccttgggca

SEQ ID NO: 7652930 - DNA, 22 bp, Homo sapiens
aatcaggaggaagccttgggca

SEQ ID NO: 7652931 - DNA, 22 bp, Homo sapiens
aatcaggagctgaggtttagcc

SEQ ID NO: 7652932 - DNA, 22 bp, Homo sapiens
aatcaggagctgaggtttagcc

SEQ ID NO: 7652933 - DNA, 22 bp, Homo sapiens
aatcaggagctgaggtttagcc

SEQ ID NO: 7652934 - DNA, 22 bp, Homo sapiens
aatcaggaggataagggggtcc

SEQ ID NO: 7652935 - DNA, 22 bp, Homo sapiens
aatcaggaggataagggggtcc

SEQ ID NO: 7652936 - DNA, 22 bp, Homo sapiens
aatcaggaggataagggggtcc

SEQ ID NO: 7652937 - DNA, 22 bp, Homo sapiens
aatcaggagtgtgcactttgat

SEQ ID NO: 7652938 - DNA, 22 bp, Homo sapiens
aatcaggagtgtgcactttgat

SEQ ID NO: 7652939 - DNA, 22 bp, Homo sapiens
aatcaggagtgtgcactttgat

SEQ ID NO: 7652940 - DNA, 22 bp, Homo sapiens
aatcaggagtgtgcactttgat

SEQ ID NO: 7652941 - DNA, 21 bp, Homo sapiens
aatcaggaagtgtgtgtcctg

SEQ ID NO: 7652942 - DNA, 21 bp, Homo sapiens
aatcaggaagtgtgtgtcctg

SEQ ID NO: 7652943 - DNA, 21 bp, Homo sapiens
aatcaggaagtgtgtgtcctg

SEQ ID NO: 7652944 - DNA, 22 bp, Homo sapiens
aatcaggacccactctacagtt

SEQ ID NO: 7652945 - DNA, 22 bp, Homo sapiens
aatcaggacccactctacagtt

SEQ ID NO: 7652946 - DNA, 22 bp, Homo sapiens
aatcaggacccactctacagtt

SEQ ID NO: 7652947 - DNA, 22 bp, Homo sapiens
aatcaggacccactctacagtt

SEQ ID NO: 7652948 - DNA, 22 bp, Homo sapiens
aatcaggacccactctacagtt

SEQ ID NO: 7652949 - DNA, 22 bp, Homo sapiens
aatcaggactgtgccaaaccta

SEQ ID NO: 7652950 - DNA, 22 bp, Homo sapiens
aatcaggactgtgccaaaccta

SEQ ID NO: 7652951 - DNA, 22 bp, Homo sapiens
aatcaggactgtgccaaaccta

SEQ ID NO: 7652952 - DNA, 22 bp, Homo sapiens
aatcaggacccactctacagtt

SEQ ID NO: 7652953 - DNA, 22 bp, Homo sapiens
aatcaggagagctgcgaacgtt

SEQ ID NO: 7652954 - DNA, 22 bp, Homo sapiens
aatcaggagagctgcgaacgtt

SEQ ID NO: 7652955 - DNA, 22 bp, Homo sapiens
aatcaggagagctgcgaacgtt

SEQ ID NO: 7652956 - DNA, 19 bp, Homo sapiens
aatcaggagcctaattagg

SEQ ID NO: 7652957 - DNA, 19 bp, Homo sapiens
aatcaggagcctaattagg

SEQ ID NO: 7652958 - DNA, 19 bp, Homo sapiens
aatcaggagcctaattagg

SEQ ID NO: 7652959 - DNA, 19 bp, Homo sapiens
aatcaggagcctaattagg

SEQ ID NO: 7652960 - DNA, 22 bp, Homo sapiens
aatcaggagctagggggcaatg

SEQ ID NO: 7652961 - DNA, 22 bp, Homo sapiens
aatcaggagctagggggcaatg

SEQ ID NO: 7652962 - DNA, 22 bp, Homo sapiens
aatcaggagctagggggcaatg

SEQ ID NO: 7652963 - DNA, 22 bp, Homo sapiens
aatcaggaaactatcaacacat

SEQ ID NO: 7652964 - DNA, 22 bp, Homo sapiens
aatcaggaaactatcaacacat

SEQ ID NO: 7652965 - DNA, 22 bp, Homo sapiens
aatcaggaaactatcaacacat

SEQ ID NO: 7652966 - DNA, 22 bp, Homo sapiens
aatcaggaaactatcaacacat

SEQ ID NO: 7652967 - DNA, 22 bp, Homo sapiens
aatcagctttgaaagagggtct

SEQ ID NO: 7652968 - DNA, 22 bp, Homo sapiens
aatcagctttgaaagagggtct

SEQ ID NO: 7652969 - DNA, 22 bp, Homo sapiens
aatcaggaactcaagtgcattg

SEQ ID NO: 7652970 - DNA, 22 bp, Homo sapiens
aatcaggaactcaagtgcattg

SEQ ID NO: 7652971 - DNA, 22 bp, Homo sapiens
aatcaggaactcaagtgcattg

SEQ ID NO: 7652972 - DNA, 22 bp, Homo sapiens
aatcaggaaactatcaacacat

SEQ ID NO: 7652973 - DNA, 22 bp, Homo sapiens
aatcagcctgagcacaaggcca

SEQ ID NO: 7652974 - DNA, 23 bp, Homo sapiens
aatcagcatgctctgtggctggc

SEQ ID NO: 7652975 - DNA, 22 bp, Homo sapiens
aatcagcagttggaattagata

SEQ ID NO: 7652976 - DNA, 23 bp, Homo sapiens
aatcagcatgctctgtggctggc

SEQ ID NO: 7652977 - DNA, 23 bp, Homo sapiens
aatcagcatgctctgtggctggc

SEQ ID NO: 7652978 - DNA, 22 bp, Homo sapiens
aatcagcaggcttctaaatttt

SEQ ID NO: 7652979 - DNA, 22 bp, Homo sapiens
aatcagcaggcttctaaatttt

SEQ ID NO: 7652980 - DNA, 22 bp, Homo sapiens
aatcagcaggcttctaaatttt

SEQ ID NO: 7652981 - DNA, 22 bp, Homo sapiens
aatcagcagttggaattagata

SEQ ID NO: 7652982 - DNA, 22 bp, Homo sapiens
aatcagcagttggaattagata

SEQ ID NO: 7652983 - DNA, 22 bp, Homo sapiens
aatcagcaaatgcttactcagg

SEQ ID NO: 7652984 - DNA, 22 bp, Homo sapiens
aatcagcaaatgcttactcagg

SEQ ID NO: 7652985 - DNA, 22 bp, Homo sapiens
aatcagcaaatgcttactcagg

SEQ ID NO: 7652986 - DNA, 22 bp, Homo sapiens
aatcagcagaagagaggtctta

SEQ ID NO: 7652987 - DNA, 22 bp, Homo sapiens
aatcagcagaagagaggtctta

SEQ ID NO: 7652988 - DNA, 22 bp, Homo sapiens
aatcagcaaatgcttactcagg

SEQ ID NO: 7652989 - DNA, 22 bp, Homo sapiens
agaaatgacacacatgagacat

SEQ ID NO: 7652990 - DNA, 22 bp, Homo sapiens
agaaatgacacacatgagacat

SEQ ID NO: 7652991 - DNA, 22 bp, Homo sapiens
agaaatgacacacatgagacat

SEQ ID NO: 7652992 - DNA, 22 bp, Homo sapiens
agaaatgacacacatgagacat

SEQ ID NO: 7652993 - DNA, 22 bp, Homo sapiens
agaaatgacacacatgagacat

SEQ ID NO: 7652994 - DNA, 22 bp, Homo sapiens
agaaatgacacacatgagacat

SEQ ID NO: 7652995 - DNA, 22 bp, Homo sapiens
agaaatgacacacatgagacat

SEQ ID NO: 7652996 - DNA, 22 bp, Homo sapiens
agaaattatgcagtagttttat

SEQ ID NO: 7652997 - DNA, 22 bp, Homo sapiens
agaaattatgcagtagttttat

SEQ ID NO: 7652998 - DNA, 22 bp, Homo sapiens
agaaattatgcagtagttttat

SEQ ID NO: 7652999 - DNA, 22 bp, Homo sapiens
agaaattattagtgaatagtct

SEQ ID NO: 7653000 - DNA, 22 bp, Homo sapiens
agaaattattagtgaatagtct

SEQ ID NO: 7653001 - DNA, 22 bp, Homo sapiens
agaaattattagtgaatagtct

SEQ ID NO: 7653002 - DNA, 22 bp, Homo sapiens
agaaattattagtgaatagtct

SEQ ID NO: 7653003 - DNA, 22 bp, Homo sapiens
agaaattattagtgaatagtct

SEQ ID NO: 7653004 - DNA, 22 bp, Homo sapiens
agaaattattagtgaatagtct

SEQ ID NO: 7653005 - DNA, 22 bp, Homo sapiens
agaaattattagtgaatagtct

SEQ ID NO: 7653006 - DNA, 22 bp, Homo sapiens
agaaattattagtgaatagtct

SEQ ID NO: 7653007 - DNA, 22 bp, Homo sapiens
agaaattattagtgaatagtct

SEQ ID NO: 7653008 - DNA, 22 bp, Homo sapiens
agaaattattagtgaatagtct

SEQ ID NO: 7653009 - DNA, 22 bp, Homo sapiens
agaaattctaagcatcaatagc

SEQ ID NO: 7653010 - DNA, 22 bp, Homo sapiens
agaaattctaagcatcaatagc

SEQ ID NO: 7653011 - DNA, 22 bp, Homo sapiens
agaaattctaagcatcaatagc

SEQ ID NO: 7653012 - DNA, 22 bp, Homo sapiens
agaaattcctaaggtacacaag

SEQ ID NO: 7653013 - DNA, 22 bp, Homo sapiens
agaaattcctaaggtacacaag

SEQ ID NO: 7653014 - DNA, 22 bp, Homo sapiens
agaaattcaattctaattagct

SEQ ID NO: 7653015 - DNA, 22 bp, Homo sapiens
agaaattcaattctaattagct

SEQ ID NO: 7653016 - DNA, 22 bp, Homo sapiens
agaaattattagtgaatagtct

SEQ ID NO: 7653017 - DNA, 22 bp, Homo sapiens
agaaattcaattctaattagct

SEQ ID NO: 7653018 - DNA, 20 bp, Homo sapiens
agaacaagtactaaaggaga

SEQ ID NO: 7653019 - DNA, 20 bp, Homo sapiens
agaacaagtactaaaggaga

SEQ ID NO: 7653020 - DNA, 20 bp, Homo sapiens
agaacaagtactaaaggaga

SEQ ID NO: 7653021 - DNA, 20 bp, Homo sapiens
agaacaagtactaaaggaga

SEQ ID NO: 7653022 - DNA, 20 bp, Homo sapiens
agaacaagtactaaaggaga

SEQ ID NO: 7653023 - DNA, 20 bp, Homo sapiens
agaacaagtactaaaggaga

SEQ ID NO: 7653024 - DNA, 22 bp, Homo sapiens
agaacaaatcgatggaagcctg

SEQ ID NO: 7653025 - DNA, 22 bp, Homo sapiens
agaacaaggctgtttccaatgc

SEQ ID NO: 7653026 - DNA, 22 bp, Homo sapiens
agaacaaatcgatggaagcctg

SEQ ID NO: 7653027 - DNA, 22 bp, Homo sapiens
agaacaaatcgatggaagcctg

SEQ ID NO: 7653028 - DNA, 22 bp, Homo sapiens
agaacaaaattagaggagtgca

SEQ ID NO: 7653029 - DNA, 22 bp, Homo sapiens
agaacaaaattagaggagtgca

SEQ ID NO: 7653030 - DNA, 22 bp, Homo sapiens
agaaattgccagaatgtcaggc

SEQ ID NO: 7653031 - DNA, 22 bp, Homo sapiens
agaacaaaattagaggagtgca

SEQ ID NO: 7653032 - DNA, 22 bp, Homo sapiens
agaacaaaattagaggagtgca

SEQ ID NO: 7653033 - DNA, 22 bp, Homo sapiens
agaacaaaattagaggagtgca

SEQ ID NO: 7653034 - DNA, 22 bp, Homo sapiens
agaacaaatcgatggaagcctg

SEQ ID NO: 7653035 - DNA, 22 bp, Homo sapiens
agaacaaatcgatggaagcctg

SEQ ID NO: 7653036 - DNA, 22 bp, Homo sapiens
agaacaatgcgtattttactcc

SEQ ID NO: 7653037 - DNA, 22 bp, Homo sapiens
agaacaatgcgtattttactcc

SEQ ID NO: 7653038 - DNA, 22 bp, Homo sapiens
agaacaatgcgtattttactcc

SEQ ID NO: 7653039 - DNA, 22 bp, Homo sapiens
aatgagttctggttcattttat

SEQ ID NO: 7653040 - DNA, 22 bp, Homo sapiens
agaacaattgccccaaagcttg

SEQ ID NO: 7653041 - DNA, 22 bp, Homo sapiens
agaacaattgccccaaagcttg

SEQ ID NO: 7653042 - DNA, 23 bp, Homo sapiens
aatgagttgggcagcatacaggc

SEQ ID NO: 7653043 - DNA, 23 bp, Homo sapiens
aatgagttgggcagcatacaggc

SEQ ID NO: 7653044 - DNA, 23 bp, Homo sapiens
aatgagttgggcagcatacaggc

SEQ ID NO: 7653045 - DNA, 22 bp, Homo sapiens
aatgataagacatgagtagagg

SEQ ID NO: 7653046 - DNA, 22 bp, Homo sapiens
aatgagtttgttctattatttg

SEQ ID NO: 7653047 - DNA, 22 bp, Homo sapiens
aatgatgacaggataaagaaca

SEQ ID NO: 7653048 - DNA, 22 bp, Homo sapiens
aatgatgacaggataaagaaca

SEQ ID NO: 7653049 - DNA, 22 bp, Homo sapiens
aatgatgagttctaatagaccc

SEQ ID NO: 7653050 - DNA, 22 bp, Homo sapiens
aatgatgagaactggagtaatt

SEQ ID NO: 7653051 - DNA, 22 bp, Homo sapiens
agaagcagaaggaagcagggcc

SEQ ID NO: 7653052 - DNA, 22 bp, Homo sapiens
agaagcagaaggaagcagggcc

SEQ ID NO: 7653053 - DNA, 22 bp, Homo sapiens
agaagcagaaggaagcagggcc

SEQ ID NO: 7653054 - DNA, 22 bp, Homo sapiens
agaagcagaaggaagcagggcc

SEQ ID NO: 7653055 - DNA, 22 bp, Homo sapiens
agaagcagaaggaagcagggcc

SEQ ID NO: 7653056 - DNA, 22 bp, Homo sapiens
agaagcagaaggaagcagggcc

SEQ ID NO: 7653057 - DNA, 22 bp, Homo sapiens
agaagcagaaggaagcagggcc

SEQ ID NO: 7653058 - DNA, 22 bp, Homo sapiens
agaagcagaaggaagcagggcc

SEQ ID NO: 7653059 - DNA, 22 bp, Homo sapiens
agaagcagaaggaagcagggcc

SEQ ID NO: 7653060 - DNA, 22 bp, Homo sapiens
agaagcagaaaagggcactttt

SEQ ID NO: 7653061 - DNA, 22 bp, Homo sapiens
agaagcagaaaagggcactttt

SEQ ID NO: 7653062 - DNA, 22 bp, Homo sapiens
agaagcagaaaagggcactttt

SEQ ID NO: 7653063 - DNA, 22 bp, Homo sapiens
agaagcagaaactgggcttgtg

SEQ ID NO: 7653064 - DNA, 22 bp, Homo sapiens
agaagcagaaactgggcttgtg

SEQ ID NO: 7653065 - DNA, 22 bp, Homo sapiens
agaagcagaaaagggcactttt

SEQ ID NO: 7653066 - DNA, 22 bp, Homo sapiens
agaagcagaaactgggcttgtg

SEQ ID NO: 7653067 - DNA, 22 bp, Homo sapiens
agaagcagaaactgggcttgtg

SEQ ID NO: 7653068 - DNA, 22 bp, Homo sapiens
agaagcagaaactgggcttgtg

SEQ ID NO: 7653069 - DNA, 22 bp, Homo sapiens
agaagcagaaggaagcagggcc

SEQ ID NO: 7653070 - DNA, 22 bp, Homo sapiens
agaagcagaaggaagcagggcc

SEQ ID NO: 7653071 - DNA, 22 bp, Homo sapiens
agaagcagaaggaagcagggcc

SEQ ID NO: 7653072 - DNA, 22 bp, Homo sapiens
agaagcagaaggaagcagggcc

SEQ ID NO: 7653073 - DNA, 22 bp, Homo sapiens
aatgcaaacagcccagaatcca

SEQ ID NO: 7653074 - DNA, 22 bp, Homo sapiens
aatgcaaacagcccagaatcca

SEQ ID NO: 7653075 - DNA, 22 bp, Homo sapiens
aatgcaaacagcccagaatcca

SEQ ID NO: 7653076 - DNA, 22 bp, Homo sapiens
aatgcaaacagcccagaatcca

SEQ ID NO: 7653077 - DNA, 22 bp, Homo sapiens
aatgcaaacagcccagaatcca

SEQ ID NO: 7653078 - DNA, 22 bp, Homo sapiens
agaagcagaaaagggcactttt

SEQ ID NO: 7653079 - DNA, 22 bp, Homo sapiens
aatgcaaacagcccagaatcca

SEQ ID NO: 7653080 - DNA, 22 bp, Homo sapiens
aatgcaaacagcccagaatcca

SEQ ID NO: 7653081 - DNA, 22 bp, Homo sapiens
aatgatttggcaaaggaatcca

SEQ ID NO: 7653082 - DNA, 22 bp, Homo sapiens
aatgatttggcaaaggaatcca

SEQ ID NO: 7653083 - DNA, 22 bp, Homo sapiens
aatgatttggcaaaggaatcca

SEQ ID NO: 7653084 - DNA, 22 bp, Homo sapiens
aatgatttcccctacacagaag

SEQ ID NO: 7653085 - DNA, 22 bp, Homo sapiens
aatgatttcccctacacagaag

SEQ ID NO: 7653086 - DNA, 22 bp, Homo sapiens
aatgatttcccctacacagaag

SEQ ID NO: 7653087 - DNA, 22 bp, Homo sapiens
aatgatttcccctacacagaag

SEQ ID NO: 7653088 - DNA, 22 bp, Homo sapiens
aatgatttcccctacacagaag

SEQ ID NO: 7653089 - DNA, 22 bp, Homo sapiens
aatgatttcccctacacagaag

SEQ ID NO: 7653090 - DNA, 22 bp, Homo sapiens
aatgatttcccctacacagaag

SEQ ID NO: 7653091 - DNA, 22 bp, Homo sapiens
aatgatgtattagtacaacaca

SEQ ID NO: 7653092 - DNA, 22 bp, Homo sapiens
aatgatgtattagtacaacaca

SEQ ID NO: 7653093 - DNA, 22 bp, Homo sapiens
aatgatgtatgtgtgcacgcat

SEQ ID NO: 7653094 - DNA, 22 bp, Homo sapiens
aatgatgtattagtacaacaca

SEQ ID NO: 7653095 - DNA, 22 bp, Homo sapiens
aatgatgtattagtacaacaca

SEQ ID NO: 7653096 - DNA, 23 bp, Homo sapiens
aatgatgtcagaagatgaagtct

SEQ ID NO: 7653097 - DNA, 23 bp, Homo sapiens
aatgatgtcagaagatgaagtct

SEQ ID NO: 7653098 - DNA, 22 bp, Homo sapiens
aatgatggtttcatcacttgaa

SEQ ID NO: 7653099 - DNA, 22 bp, Homo sapiens
aatgatggttaaacactggagg

SEQ ID NO: 7653100 - DNA, 22 bp, Homo sapiens
aatgatggtttcatcacttgaa

SEQ ID NO: 7653101 - DNA, 22 bp, Homo sapiens
aatgatggttaaacactggagg

SEQ ID NO: 7653102 - DNA, 22 bp, Homo sapiens
aatgatggttaaacactggagg

SEQ ID NO: 7653103 - DNA, 22 bp, Homo sapiens
aatgatggatttagacaagctg

SEQ ID NO: 7653104 - DNA, 22 bp, Homo sapiens
aatgatgggaaggagaaaagca

SEQ ID NO: 7653105 - DNA, 22 bp, Homo sapiens
aatgatggtattgatgagctaa

SEQ ID NO: 7653106 - DNA, 22 bp, Homo sapiens
aatgatgagttctaatagaccc

SEQ ID NO: 7653107 - DNA, 22 bp, Homo sapiens
aatgatgagttctaatagaccc

SEQ ID NO: 7653108 - DNA, 22 bp, Homo sapiens
aatgatgccctggagttttgca

SEQ ID NO: 7653109 - DNA, 22 bp, Homo sapiens
aatgatgagttctaatagaccc

SEQ ID NO: 7653110 - DNA, 23 bp, Homo sapiens
aatgatttcatgatgatagcagc

SEQ ID NO: 7653111 - DNA, 23 bp, Homo sapiens
aatgatttcatgatgatagcagc

SEQ ID NO: 7653112 - DNA, 23 bp, Homo sapiens
aatgatttcatgatgatagcagc

SEQ ID NO: 7653113 - DNA, 23 bp, Homo sapiens
aatgatttcatgatgatagcagc

SEQ ID NO: 7653114 - DNA, 23 bp, Homo sapiens
aatgatttcatgatgatagcagc

SEQ ID NO: 7653115 - DNA, 22 bp, Homo sapiens
aatgattggcactagatacaca

SEQ ID NO: 7653116 - DNA, 22 bp, Homo sapiens
aatgattgcaaacattgagaac

SEQ ID NO: 7653117 - DNA, 22 bp, Homo sapiens
aatgattgtcattccaaaaagt

SEQ ID NO: 7653118 - DNA, 22 bp, Homo sapiens
aatgattgtcattccaaaaagt

SEQ ID NO: 7653119 - DNA, 22 bp, Homo sapiens
aatgatgtttttaaagaacata

SEQ ID NO: 7653120 - DNA, 22 bp, Homo sapiens
aatgatgtttttaaagaacata

SEQ ID NO: 7653121 - DNA, 22 bp, Homo sapiens
aatgattgaggttatcgcagta

SEQ ID NO: 7653122 - DNA, 22 bp, Homo sapiens
aatgattactgatcgcatagga

SEQ ID NO: 7653123 - DNA, 22 bp, Homo sapiens
aatgattctatttgcagcttgg

SEQ ID NO: 7653124 - DNA, 22 bp, Homo sapiens
aatgattctatttgcagcttgg

SEQ ID NO: 7653125 - DNA, 22 bp, Homo sapiens
aatgatgtttttaaagaacata

SEQ ID NO: 7653126 - DNA, 22 bp, Homo sapiens
aatgatgtttttaaagaacata

SEQ ID NO: 7653127 - DNA, 22 bp, Homo sapiens
aatgatgtcgaaaagtaagctc

SEQ ID NO: 7653128 - DNA, 22 bp, Homo sapiens
actgttcttgtaacacttaaat

SEQ ID NO: 7653129 - DNA, 22 bp, Homo sapiens
actgttcttgtaacacttaaat

SEQ ID NO: 7653130 - DNA, 22 bp, Homo sapiens
actgttgaagtgccagcttgat

SEQ ID NO: 7653131 - DNA, 19 bp, Homo sapiens
actgttctgtatgttgatt

SEQ ID NO: 7653132 - DNA, 22 bp, Homo sapiens
actgttcttcatttagcaaaga

SEQ ID NO: 7653133 - DNA, 22 bp, Homo sapiens
actgttcttcccatttatattg

SEQ ID NO: 7653134 - DNA, 22 bp, Homo sapiens
actgttcttcccatttatattg

SEQ ID NO: 7653135 - DNA, 22 bp, Homo sapiens
actgttcttcatttagcaaaga

SEQ ID NO: 7653136 - DNA, 19 bp, Homo sapiens
actgttctgtatgttgatt

SEQ ID NO: 7653137 - DNA, 22 bp, Homo sapiens
actttaaaactgatcatcagag

SEQ ID NO: 7653138 - DNA, 22 bp, Homo sapiens
actttaaaactgatcatcagag

SEQ ID NO: 7653139 - DNA, 22 bp, Homo sapiens
actttaaaactgatcatcagag

SEQ ID NO: 7653140 - DNA, 22 bp, Homo sapiens
actttaaaactgatcatcagag

SEQ ID NO: 7653141 - DNA, 22 bp, Homo sapiens
actttaaaactgatcatcagag

SEQ ID NO: 7653142 - DNA, 22 bp, Homo sapiens
actttaaaactgatcatcagag

SEQ ID NO: 7653143 - DNA, 22 bp, Homo sapiens
actttaaaactgatcatcagag

SEQ ID NO: 7653144 - DNA, 22 bp, Homo sapiens
actttaaaactgatcatcagag

SEQ ID NO: 7653145 - DNA, 22 bp, Homo sapiens
actgttgaagtgccagcttgat

SEQ ID NO: 7653146 - DNA, 22 bp, Homo sapiens
actgttgaagtgccagcttgat

SEQ ID NO: 7653147 - DNA, 22 bp, Homo sapiens
actttaaaaagagccttctaac

SEQ ID NO: 7653148 - DNA, 22 bp, Homo sapiens
actttaaaaagagccttctaac

SEQ ID NO: 7653149 - DNA, 19 bp, Homo sapiens
actgttctaacttgcagct

SEQ ID NO: 7653150 - DNA, 18 bp, Homo sapiens
actgttccttcagaggac

SEQ ID NO: 7653151 - DNA, 19 bp, Homo sapiens
actgttctaacttgcagct

SEQ ID NO: 7653152 - DNA, 21 bp, Homo sapiens
actgttccttcagacatcctt

SEQ ID NO: 7653153 - DNA, 22 bp, Homo sapiens
actgttcatttgtcctgtatct

SEQ ID NO: 7653154 - DNA, 22 bp, Homo sapiens
actgttcatttgtcctgtatct

SEQ ID NO: 7653155 - DNA, 22 bp, Homo sapiens
actgttcccagattctcacatt

SEQ ID NO: 7653156 - DNA, 18 bp, Homo sapiens
actgttctctcctgccct

SEQ ID NO: 7653157 - DNA, 22 bp, Homo sapiens
actgttctcctttggctatatc

SEQ ID NO: 7653158 - DNA, 22 bp, Homo sapiens
actgttctccagcatggctgta

SEQ ID NO: 7653159 - DNA, 22 bp, Homo sapiens
actgttctgcatgctgtgaggg

SEQ ID NO: 7653160 - DNA, 22 bp, Homo sapiens
actgttctgcatgctgtgaggg

SEQ ID NO: 7653161 - DNA, 22 bp, Homo sapiens
actgttctgcatgtacctgagg

SEQ ID NO: 7653162 - DNA, 22 bp, Homo sapiens
actgttctgcatgctgtgaggg

SEQ ID NO: 7653163 - DNA, 19 bp, Homo sapiens
actgttctgtatgttgatt

SEQ ID NO: 7653164 - DNA, 22 bp, Homo sapiens
actgttctgccaagatcaacgt

SEQ ID NO: 7653165 - DNA, 22 bp, Homo sapiens
actgttctgccaactttggtta

SEQ ID NO: 7653166 - DNA, 22 bp, Homo sapiens
actgttctgccaactttggtta

SEQ ID NO: 7653167 - DNA, 22 bp, Homo sapiens
actgttctgccaagatcaacgt

SEQ ID NO: 7653168 - DNA, 22 bp, Homo sapiens
actgttctgccaagatcaacgt

SEQ ID NO: 7653169 - DNA, 23 bp, Homo sapiens
actttattgaccccaggtcagtt

SEQ ID NO: 7653170 - DNA, 23 bp, Homo sapiens
actttattgaccccaggtcagtt

SEQ ID NO: 7653171 - DNA, 22 bp, Homo sapiens
actttatttcctattgcatcca

SEQ ID NO: 7653172 - DNA, 22 bp, Homo sapiens
actttatttcctattgcatcca

SEQ ID NO: 7653173 - DNA, 22 bp, Homo sapiens
actttatttcctattgcatcca

SEQ ID NO: 7653174 - DNA, 22 bp, Homo sapiens
actttatttcctattgcatcca

SEQ ID NO: 7653175 - DNA, 22 bp, Homo sapiens
actttatttcctattgcatcca

SEQ ID NO: 7653176 - DNA, 22 bp, Homo sapiens
actttatttcctattgcatcca

SEQ ID NO: 7653177 - DNA, 23 bp, Homo sapiens
actttattgaccccaggtcagtt

SEQ ID NO: 7653178 - DNA, 23 bp, Homo sapiens
actttattgaccccaggtcagtt

SEQ ID NO: 7653179 - DNA, 23 bp, Homo sapiens
actttattgaccccaggtcagtt

SEQ ID NO: 7653180 - DNA, 23 bp, Homo sapiens
actttattgaccccaggtcagtt

SEQ ID NO: 7653181 - DNA, 23 bp, Homo sapiens
actttattgaccccaggtcagtt

SEQ ID NO: 7653182 - DNA, 23 bp, Homo sapiens
actttattgaccccaggtcagtt

SEQ ID NO: 7653183 - DNA, 22 bp, Homo sapiens
actttatgtttgatatctatgg

SEQ ID NO: 7653184 - DNA, 23 bp, Homo sapiens
actttattgaccccaggtcagtt

SEQ ID NO: 7653185 - DNA, 23 bp, Homo sapiens
actttattgaccccaggtcagtt

SEQ ID NO: 7653186 - DNA, 23 bp, Homo sapiens
actttattgaccccaggtcagtt

SEQ ID NO: 7653187 - DNA, 23 bp, Homo sapiens
actttattgaccccaggtcagtt

SEQ ID NO: 7653188 - DNA, 22 bp, Homo sapiens
actttatgtttgatatctatgg

SEQ ID NO: 7653189 - DNA, 20 bp, Homo sapiens
actttatgagttcaattttg

SEQ ID NO: 7653190 - DNA, 20 bp, Homo sapiens
actttatgagttcaattttg

SEQ ID NO: 7653191 - DNA, 22 bp, Homo sapiens
actttcttaggctgtataaatg

SEQ ID NO: 7653192 - DNA, 22 bp, Homo sapiens
actttcttaggctgtataaatg

SEQ ID NO: 7653193 - DNA, 22 bp, Homo sapiens
actttcttaggctgtataaatg

SEQ ID NO: 7653194 - DNA, 22 bp, Homo sapiens
actttcttaggctgtataaatg

SEQ ID NO: 7653195 - DNA, 22 bp, Homo sapiens
actttcttaggctgtataaatg

SEQ ID NO: 7653196 - DNA, 22 bp, Homo sapiens
actttcttaggctgtataaatg

SEQ ID NO: 7653197 - DNA, 22 bp, Homo sapiens
actttcttaggctgtataaatg

SEQ ID NO: 7653198 - DNA, 22 bp, Homo sapiens
actttcttaggctgtataaatg

SEQ ID NO: 7653199 - DNA, 22 bp, Homo sapiens
actttatttcctattgcatcca

SEQ ID NO: 7653200 - DNA, 22 bp, Homo sapiens
actttatttcctattgcatcca

SEQ ID NO: 7653201 - DNA, 22 bp, Homo sapiens
actttctgttagatgaatggat

SEQ ID NO: 7653202 - DNA, 22 bp, Homo sapiens
actttctgtggttaccagggag

SEQ ID NO: 7653203 - DNA, 21 bp, Homo sapiens
actttctgtgggttcaagcat

SEQ ID NO: 7653204 - DNA, 21 bp, Homo sapiens
actttctgtgggttcaagcat

SEQ ID NO: 7653205 - DNA, 22 bp, Homo sapiens
actttctgtggttaccagggag

SEQ ID NO: 7653206 - DNA, 22 bp, Homo sapiens
actttcttggtcccatgtttga

SEQ ID NO: 7653207 - DNA, 22 bp, Homo sapiens
actttcttggtcccatgtttga

SEQ ID NO: 7653208 - DNA, 22 bp, Homo sapiens
actttcttggtcccatgtttga

SEQ ID NO: 7653209 - DNA, 22 bp, Homo sapiens
actttcttggtcccatgtttga

SEQ ID NO: 7653210 - DNA, 22 bp, Homo sapiens
actttcttcttatgcattaagg

SEQ ID NO: 7653211 - DNA, 22 bp, Homo sapiens
actttcttcttatgcattaagg

SEQ ID NO: 7653212 - DNA, 22 bp, Homo sapiens
actttcttcttatgcattaagg

SEQ ID NO: 7653213 - DNA, 22 bp, Homo sapiens
actttcttctactacttggaga

SEQ ID NO: 7653214 - DNA, 22 bp, Homo sapiens
actttcttcttatgcattaagg

SEQ ID NO: 7653215 - DNA, 22 bp, Homo sapiens
actttcttcttatgcattaagg

SEQ ID NO: 7653216 - DNA, 22 bp, Homo sapiens
actttcttatccatgatctcac

SEQ ID NO: 7653217 - DNA, 22 bp, Homo sapiens
actttcttatccatgatctcac

SEQ ID NO: 7653218 - DNA, 22 bp, Homo sapiens
actttcttatccatgatctcac

SEQ ID NO: 7653219 - DNA, 22 bp, Homo sapiens
actttcttatccatgatctcac

SEQ ID NO: 7653220 - DNA, 22 bp, Homo sapiens
actttcttatccatgatctcac

SEQ ID NO: 7653221 - DNA, 22 bp, Homo sapiens
actttcttaggctgtataaatg

SEQ ID NO: 7653222 - DNA, 22 bp, Homo sapiens
actttcttctactacttggaga

SEQ ID NO: 7653223 - DNA, 22 bp, Homo sapiens
actttcttctactacttggaga

SEQ ID NO: 7653224 - DNA, 22 bp, Homo sapiens
actttcttatccatgatctcac

SEQ ID NO: 7653225 - DNA, 22 bp, Homo sapiens
actttgaaactaaaattcatta

SEQ ID NO: 7653226 - DNA, 22 bp, Homo sapiens
actttgaaactaaaattcatta

SEQ ID NO: 7653227 - DNA, 22 bp, Homo sapiens
actttgaaactaaaattcatta

SEQ ID NO: 7653228 - DNA, 22 bp, Homo sapiens
actttgaaactaaaattcatta

SEQ ID NO: 7653229 - DNA, 22 bp, Homo sapiens
actttcttggtcccatgtttga

SEQ ID NO: 7653230 - DNA, 22 bp, Homo sapiens
actttgaaaagacagtagctct

SEQ ID NO: 7653231 - DNA, 22 bp, Homo sapiens
actttgaaactaaaattcatta

SEQ ID NO: 7653232 - DNA, 22 bp, Homo sapiens
actttgaaactaaaattcatta

SEQ ID NO: 7653233 - DNA, 22 bp, Homo sapiens
actttgaaatgtgtaagagaga

SEQ ID NO: 7653234 - DNA, 22 bp, Homo sapiens
actttgaaatgtgtaagagaga

SEQ ID NO: 7653235 - DNA, 22 bp, Homo sapiens
actttgaaatgtgtaagagaga

SEQ ID NO: 7653236 - DNA, 22 bp, Homo sapiens
actttgaaactaaaattcatta

SEQ ID NO: 7653237 - DNA, 22 bp, Homo sapiens
aatcacatctcattcaacagcc

SEQ ID NO: 7653238 - DNA, 22 bp, Homo sapiens
aatcacatctcattcaacagcc

SEQ ID NO: 7653239 - DNA, 22 bp, Homo sapiens
actttgaaggggaacattttaa

SEQ ID NO: 7653240 - DNA, 22 bp, Homo sapiens
actttgaaggggaacattttaa

SEQ ID NO: 7653241 - DNA, 22 bp, Homo sapiens
actttgaaatgtgtaagagaga

SEQ ID NO: 7653242 - DNA, 22 bp, Homo sapiens
aatcacatgcagggcctccacc

SEQ ID NO: 7653243 - DNA, 22 bp, Homo sapiens
aatcacatgaaaactgtgtgtt

SEQ ID NO: 7653244 - DNA, 22 bp, Homo sapiens
aatcacatgaaaactgtgtgtt

SEQ ID NO: 7653245 - DNA, 22 bp, Homo sapiens
aatcagaaagaggtcatgttgc

SEQ ID NO: 7653246 - DNA, 22 bp, Homo sapiens
aatcagaaattctacatcacaa

SEQ ID NO: 7653247 - DNA, 19 bp, Homo sapiens
aatcagaaatatcgaggcc

SEQ ID NO: 7653248 - DNA, 20 bp, Homo sapiens
aatcagaaagtgtgagctct

SEQ ID NO: 7653249 - DNA, 20 bp, Homo sapiens
aatcagaaagtgtgagctct

SEQ ID NO: 7653250 - DNA, 22 bp, Homo sapiens
aatcagaaaggctaaggaagca

SEQ ID NO: 7653251 - DNA, 22 bp, Homo sapiens
aatcagaaagatcttgatgaga

SEQ ID NO: 7653252 - DNA, 22 bp, Homo sapiens
aatcagaaagatcttgatgaga

SEQ ID NO: 7653253 - DNA, 22 bp, Homo sapiens
aatcagaaagatcttgatgaga

SEQ ID NO: 7653254 - DNA, 22 bp, Homo sapiens
aatcagaaaggctaaggaagca

SEQ ID NO: 7653255 - DNA, 22 bp, Homo sapiens
aatatactatactactttctgg

SEQ ID NO: 7653256 - DNA, 22 bp, Homo sapiens
aatatactatactactttctgg

SEQ ID NO: 7653257 - DNA, 22 bp, Homo sapiens
aatatagaatcactttccttca

SEQ ID NO: 7653258 - DNA, 22 bp, Homo sapiens
aatatactatactactttctgg

SEQ ID NO: 7653259 - DNA, 22 bp, Homo sapiens
aatatactatactactttctgg

SEQ ID NO: 7653260 - DNA, 22 bp, Homo sapiens
aatatactatactactttctgg

SEQ ID NO: 7653261 - DNA, 22 bp, Homo sapiens
aatatactatactactttctgg

SEQ ID NO: 7653262 - DNA, 22 bp, Homo sapiens
aatatactatactactttctgg

SEQ ID NO: 7653263 - DNA, 22 bp, Homo sapiens
aatatactatactactttctgg

SEQ ID NO: 7653264 - DNA, 22 bp, Homo sapiens
aatatactatactactttctgg

SEQ ID NO: 7653265 - DNA, 22 bp, Homo sapiens
aatatagatttactcaagagaa

SEQ ID NO: 7653266 - DNA, 22 bp, Homo sapiens
aatatagatttactcaagagaa

SEQ ID NO: 7653267 - DNA, 22 bp, Homo sapiens
aatatagcattgtatgactgtg

SEQ ID NO: 7653268 - DNA, 22 bp, Homo sapiens
aatatagcattgtatgactgtg

SEQ ID NO: 7653269 - DNA, 22 bp, Homo sapiens
aatatagatttactcaagagaa

SEQ ID NO: 7653270 - DNA, 22 bp, Homo sapiens
aatatagatttactcaagagaa

SEQ ID NO: 7653271 - DNA, 22 bp, Homo sapiens
aatatagaatcactttccttca

SEQ ID NO: 7653272 - DNA, 22 bp, Homo sapiens
aatatagaatcactttccttca

SEQ ID NO: 7653273 - DNA, 22 bp, Homo sapiens
aatatagaatcactttccttca

SEQ ID NO: 7653274 - DNA, 22 bp, Homo sapiens
actgggcttcacttggcacatc

SEQ ID NO: 7653275 - DNA, 22 bp, Homo sapiens
actgggcttcacttggcacatc

SEQ ID NO: 7653276 - DNA, 22 bp, Homo sapiens
actgggcttcacttggcacatc

SEQ ID NO: 7653277 - DNA, 22 bp, Homo sapiens
aatagtatttatttggaaaaag

SEQ ID NO: 7653278 - DNA, 22 bp, Homo sapiens
aatagtatttatttggaaaaag

SEQ ID NO: 7653279 - DNA, 19 bp, Homo sapiens
actgggcttgtcctcgtgg

SEQ ID NO: 7653280 - DNA, 19 bp, Homo sapiens
actgggcttgtcctcgtgg

SEQ ID NO: 7653281 - DNA, 22 bp, Homo sapiens
aatataattttattcctagagt

SEQ ID NO: 7653282 - DNA, 22 bp, Homo sapiens
aatataattttattcctagagt

SEQ ID NO: 7653283 - DNA, 22 bp, Homo sapiens
aatataattttattcctagagt

SEQ ID NO: 7653284 - DNA, 22 bp, Homo sapiens
aatataattttattcctagagt

SEQ ID NO: 7653285 - DNA, 22 bp, Homo sapiens
aatagtccttagtaagctgtga

SEQ ID NO: 7653286 - DNA, 22 bp, Homo sapiens
aatagtctctcccacaccatcc

SEQ ID NO: 7653287 - DNA, 22 bp, Homo sapiens
aatataattttattcctagagt

SEQ ID NO: 7653288 - DNA, 22 bp, Homo sapiens
aatatagttctagaaatatttt

SEQ ID NO: 7653289 - DNA, 22 bp, Homo sapiens
aatatagttctagaaatatttt

SEQ ID NO: 7653290 - DNA, 22 bp, Homo sapiens
aatatagttctagaaatatttt

SEQ ID NO: 7653291 - DNA, 22 bp, Homo sapiens
aatatagttctagaaatatttt

SEQ ID NO: 7653292 - DNA, 22 bp, Homo sapiens
aatatagttctagaaatatttt

SEQ ID NO: 7653293 - DNA, 22 bp, Homo sapiens
aatatagttctagaaatatttt

SEQ ID NO: 7653294 - DNA, 22 bp, Homo sapiens
aatatagttctagaaatatttt

SEQ ID NO: 7653295 - DNA, 22 bp, Homo sapiens
aatatagtgttagctcatttga

SEQ ID NO: 7653296 - DNA, 22 bp, Homo sapiens
aatatagttctagaaatatttt

SEQ ID NO: 7653297 - DNA, 22 bp, Homo sapiens
aatatagctcactataccatgg

SEQ ID NO: 7653298 - DNA, 22 bp, Homo sapiens
aatatagctcactataccatgg

SEQ ID NO: 7653299 - DNA, 22 bp, Homo sapiens
aatatagctcactataccatgg

SEQ ID NO: 7653300 - DNA, 22 bp, Homo sapiens
aatatagctcactataccatgg

SEQ ID NO: 7653301 - DNA, 22 bp, Homo sapiens
aatatagtgttagctcatttga

SEQ ID NO: 7653302 - DNA, 22 bp, Homo sapiens
aatatagtgttagctcatttga

SEQ ID NO: 7653303 - DNA, 22 bp, Homo sapiens
aatatagtgccaagcctctgat

SEQ ID NO: 7653304 - DNA, 22 bp, Homo sapiens
aatatagtgttagctcatttga

SEQ ID NO: 7653305 - DNA, 22 bp, Homo sapiens
aatatagctcactataccatgg

SEQ ID NO: 7653306 - DNA, 22 bp, Homo sapiens
aatatagttctggtattgttaa

SEQ ID NO: 7653307 - DNA, 22 bp, Homo sapiens
actgttcaagcaaatgacattg

SEQ ID NO: 7653308 - DNA, 20 bp, Homo sapiens
actgttcaagggcctggtgg

SEQ ID NO: 7653309 - DNA, 22 bp, Homo sapiens
actgttcacagattagtcgatg

SEQ ID NO: 7653310 - DNA, 22 bp, Homo sapiens
actgttcacagattagtcgatg

SEQ ID NO: 7653311 - DNA, 22 bp, Homo sapiens
aatatagttctagaaatatttt

SEQ ID NO: 7653312 - DNA, 22 bp, Homo sapiens
aatatagttctggtattgttaa

SEQ ID NO: 7653313 - DNA, 22 bp, Homo sapiens
aatatagttctggtattgttaa

SEQ ID NO: 7653314 - DNA, 22 bp, Homo sapiens
aatatagttctggtattgttaa

SEQ ID NO: 7653315 - DNA, 21 bp, Homo sapiens
actgttcatctgttcagaagc

SEQ ID NO: 7653316 - DNA, 21 bp, Homo sapiens
actgttcatctgttcagaagc

SEQ ID NO: 7653317 - DNA, 21 bp, Homo sapiens
actgttcatctgttcagaagc

SEQ ID NO: 7653318 - DNA, 22 bp, Homo sapiens
actgttcatctcttagaaagta

SEQ ID NO: 7653319 - DNA, 22 bp, Homo sapiens
actgttcatttggatttctctg

SEQ ID NO: 7653320 - DNA, 21 bp, Homo sapiens
actgttcatttgatgaactgg

SEQ ID NO: 7653321 - DNA, 22 bp, Homo sapiens
actgttcatttggatttctctg

SEQ ID NO: 7653322 - DNA, 22 bp, Homo sapiens
actgttcatcctttttgaacaa

SEQ ID NO: 7653323 - DNA, 22 bp, Homo sapiens
actgttcatcctttttgaacaa

SEQ ID NO: 7653324 - DNA, 22 bp, Homo sapiens
actgttcatattcttagaaatt

SEQ ID NO: 7653325 - DNA, 22 bp, Homo sapiens
actgttcatctcttagaaagta

SEQ ID NO: 7653326 - DNA, 22 bp, Homo sapiens
actgttcatctcttagaaagta

SEQ ID NO: 7653327 - DNA, 22 bp, Homo sapiens
actgttcatattcttagaaatt

SEQ ID NO: 7653328 - DNA, 22 bp, Homo sapiens
actgttcatattcttagaaatt

SEQ ID NO: 7653329 - DNA, 22 bp, Homo sapiens
actgttcatattcttagaaatt

SEQ ID NO: 7653330 - DNA, 22 bp, Homo sapiens
actgttcatattcttagaaatt

SEQ ID NO: 7653331 - DNA, 22 bp, Homo sapiens
actgttcacccagcactagcag

SEQ ID NO: 7653332 - DNA, 22 bp, Homo sapiens
aatactgcatacagtttctcat

SEQ ID NO: 7653333 - DNA, 22 bp, Homo sapiens
aatactgcccccactctgccca

SEQ ID NO: 7653334 - DNA, 22 bp, Homo sapiens
aatactgcctgtgaggtaactc

SEQ ID NO: 7653335 - DNA, 22 bp, Homo sapiens
aatactgcctgtgaggtaactc

SEQ ID NO: 7653336 - DNA, 22 bp, Homo sapiens
aatactgcctgtgaggtaactc

SEQ ID NO: 7653337 - DNA, 22 bp, Homo sapiens
actgggctgcctggttcttcta

SEQ ID NO: 7653338 - DNA, 22 bp, Homo sapiens
actgggctgcttgagtgccttc

SEQ ID NO: 7653339 - DNA, 22 bp, Homo sapiens
actgggctgcttgagtgccttc

SEQ ID NO: 7653340 - DNA, 22 bp, Homo sapiens
aatactgcctgtgaggtaactc

SEQ ID NO: 7653341 - DNA, 22 bp, Homo sapiens
aatactgcctgtgaggtaactc

SEQ ID NO: 7653342 - DNA, 22 bp, Homo sapiens
aatactgaattagttgagacaa

SEQ ID NO: 7653343 - DNA, 22 bp, Homo sapiens
aatactgaattagttgagacaa

SEQ ID NO: 7653344 - DNA, 22 bp, Homo sapiens
aatactgaattagttgagacaa

SEQ ID NO: 7653345 - DNA, 22 bp, Homo sapiens
aatactgagatcccacaaagca

SEQ ID NO: 7653346 - DNA, 22 bp, Homo sapiens
aatactgagatcccacaaagca

SEQ ID NO: 7653347 - DNA, 22 bp, Homo sapiens
aatactgaaagtattttcaaat

SEQ ID NO: 7653348 - DNA, 22 bp, Homo sapiens
aatactgaattagttgagacaa

SEQ ID NO: 7653349 - DNA, 22 bp, Homo sapiens
aatactctagggcagtgcttct

SEQ ID NO: 7653350 - DNA, 22 bp, Homo sapiens
aatactgaaagtattttcaaat

SEQ ID NO: 7653351 - DNA, 22 bp, Homo sapiens
aatactgaaagtattttcaaat

SEQ ID NO: 7653352 - DNA, 22 bp, Homo sapiens
aatactatgttgtgacacatga

SEQ ID NO: 7653353 - DNA, 22 bp, Homo sapiens
aatactatgttgtgacacatga

SEQ ID NO: 7653354 - DNA, 22 bp, Homo sapiens
aatactatgttgtgacacatga

SEQ ID NO: 7653355 - DNA, 22 bp, Homo sapiens
aatactatgtagccaaaataat

SEQ ID NO: 7653356 - DNA, 22 bp, Homo sapiens
aatactatgtagccaaaataat

SEQ ID NO: 7653357 - DNA, 22 bp, Homo sapiens
aatactatgtagccaaaataat

SEQ ID NO: 7653358 - DNA, 22 bp, Homo sapiens
aatactatgtagccaaaataat

SEQ ID NO: 7653359 - DNA, 22 bp, Homo sapiens
aatactatgtagccaaaataat

SEQ ID NO: 7653360 - DNA, 22 bp, Homo sapiens
aatactatgtagccaaaataat

SEQ ID NO: 7653361 - DNA, 22 bp, Homo sapiens
aatactatgtagccaaaataat

SEQ ID NO: 7653362 - DNA, 22 bp, Homo sapiens
aatactatgtagccaaaataat

SEQ ID NO: 7653363 - DNA, 22 bp, Homo sapiens
aatactagttaaatgaatgaat

SEQ ID NO: 7653364 - DNA, 22 bp, Homo sapiens
aatactagttattaaagctttt

SEQ ID NO: 7653365 - DNA, 22 bp, Homo sapiens
aatactagttattaaagctttt

SEQ ID NO: 7653366 - DNA, 22 bp, Homo sapiens
aatactatgtagccaaaataat

SEQ ID NO: 7653367 - DNA, 22 bp, Homo sapiens
aatactatgtagccaaaataat

SEQ ID NO: 7653368 - DNA, 22 bp, Homo sapiens
aatactatgtagccaaaataat

SEQ ID NO: 7653369 - DNA, 22 bp, Homo sapiens
aatactagttaaatgaatgaat

SEQ ID NO: 7653370 - DNA, 22 bp, Homo sapiens
aatactagttattaaagctttt

SEQ ID NO: 7653371 - DNA, 20 bp, Homo sapiens
aatactaaacacaaagcagt

SEQ ID NO: 7653372 - DNA, 22 bp, Homo sapiens
aatactagctgcatttaaaggt

SEQ ID NO: 7653373 - DNA, 22 bp, Homo sapiens
aatactagctgcatttaaaggt

SEQ ID NO: 7653374 - DNA, 20 bp, Homo sapiens
aatactaaacacaaagcagt

SEQ ID NO: 7653375 - DNA, 22 bp, Homo sapiens
actgggcttatttcttgtgaac

SEQ ID NO: 7653376 - DNA, 22 bp, Homo sapiens
actgggcttatttcttgtgaac

SEQ ID NO: 7653377 - DNA, 22 bp, Homo sapiens
actgggcttatttcttgtgaac

SEQ ID NO: 7653378 - DNA, 22 bp, Homo sapiens
actgggcttatgctgtggagta

SEQ ID NO: 7653379 - DNA, 22 bp, Homo sapiens
actgggcttatttcttgtgaac

SEQ ID NO: 7653380 - DNA, 22 bp, Homo sapiens
actgggcttcacttggcacatc

SEQ ID NO: 7653381 - DNA, 22 bp, Homo sapiens
actgggcttcacttggcacatc

SEQ ID NO: 7653382 - DNA, 23 bp, Homo sapiens
actgggcttatgaggaggcttgt

SEQ ID NO: 7653383 - DNA, 22 bp, Homo sapiens
actgggctgttttttgagtgga

SEQ ID NO: 7653384 - DNA, 22 bp, Homo sapiens
actgggcttatgctgtggagta

SEQ ID NO: 7653385 - DNA, 22 bp, Homo sapiens
actgggcttatgctgtggagta

SEQ ID NO: 7653386 - DNA, 23 bp, Homo sapiens
actgggcttatgaggaggcttgt

SEQ ID NO: 7653387 - DNA, 22 bp, Homo sapiens
actgggctgtaaagagaggcaa

SEQ ID NO: 7653388 - DNA, 22 bp, Homo sapiens
actgggctgtggacacccagcg

SEQ ID NO: 7653389 - DNA, 22 bp, Homo sapiens
actgggctgtggacacccagcg

SEQ ID NO: 7653390 - DNA, 22 bp, Homo sapiens
actgggctgttccttatttcta

SEQ ID NO: 7653391 - DNA, 22 bp, Homo sapiens
actgggctgtggacacccagcg

SEQ ID NO: 7653392 - DNA, 22 bp, Homo sapiens
actgggctgcttgagtgccttc

SEQ ID NO: 7653393 - DNA, 22 bp, Homo sapiens
actgggctggggctcattctcc

SEQ ID NO: 7653394 - DNA, 22 bp, Homo sapiens
actgggctggggctcattctcc

SEQ ID NO: 7653395 - DNA, 22 bp, Homo sapiens
actgggctggggctcattctcc

SEQ ID NO: 7653396 - DNA, 22 bp, Homo sapiens
actgggctggttagttttacta

SEQ ID NO: 7653397 - DNA, 22 bp, Homo sapiens
actgggctgtaaagagaggcaa

SEQ ID NO: 7653398 - DNA, 22 bp, Homo sapiens
actggctgaaagtaaagaacac

SEQ ID NO: 7653399 - DNA, 22 bp, Homo sapiens
actggctgaaagtaaagaacac

SEQ ID NO: 7653400 - DNA, 22 bp, Homo sapiens
actggctctctacatttgccag

SEQ ID NO: 7653401 - DNA, 22 bp, Homo sapiens
actggctctgtgatctatgatt

SEQ ID NO: 7653402 - DNA, 22 bp, Homo sapiens
actggctctctacatttgccag

SEQ ID NO: 7653403 - DNA, 22 bp, Homo sapiens
actggccttgggtaaagcccct

SEQ ID NO: 7653404 - DNA, 22 bp, Homo sapiens
actggcccttgattgcatcagc

SEQ ID NO: 7653405 - DNA, 22 bp, Homo sapiens
actggcctatcagcatgagtct

SEQ ID NO: 7653406 - DNA, 22 bp, Homo sapiens
actggccttgggtaaagcccct

SEQ ID NO: 7653407 - DNA, 22 bp, Homo sapiens
actggcccttgattgcatcagc

SEQ ID NO: 7653408 - DNA, 22 bp, Homo sapiens
actggcctatcagcatgagtct

SEQ ID NO: 7653409 - DNA, 22 bp, Homo sapiens
actggcctatcagcatgagtct

SEQ ID NO: 7653410 - DNA, 21 bp, Homo sapiens
actggccctgccttacaaata

SEQ ID NO: 7653411 - DNA, 22 bp, Homo sapiens
actggccctggctgctaggctg

SEQ ID NO: 7653412 - DNA, 21 bp, Homo sapiens
actggccctgccttacaaata

SEQ ID NO: 7653413 - DNA, 22 bp, Homo sapiens
actggccctggctgctaggctg

SEQ ID NO: 7653414 - DNA, 22 bp, Homo sapiens
actggccctggctgctaggctg

SEQ ID NO: 7653415 - DNA, 22 bp, Homo sapiens
actggcccttgattgcatcagc

SEQ ID NO: 7653416 - DNA, 22 bp, Homo sapiens
actggcccgggagcagaggcct

SEQ ID NO: 7653417 - DNA, 22 bp, Homo sapiens
actggcccgggagcagaggcct

SEQ ID NO: 7653418 - DNA, 22 bp, Homo sapiens
actggcccgggagcagaggcct

SEQ ID NO: 7653419 - DNA, 22 bp, Homo sapiens
actggcccgggagcagaggcct

SEQ ID NO: 7653420 - DNA, 22 bp, Homo sapiens
actggccatgggatttatattt

SEQ ID NO: 7653421 - DNA, 22 bp, Homo sapiens
actggccatgggatttatattt

SEQ ID NO: 7653422 - DNA, 22 bp, Homo sapiens
actggccatgggatttatattt

SEQ ID NO: 7653423 - DNA, 22 bp, Homo sapiens
actggccatgaacttgggatct

SEQ ID NO: 7653424 - DNA, 22 bp, Homo sapiens
actggccaggcagcagtagctt

SEQ ID NO: 7653425 - DNA, 22 bp, Homo sapiens
actggccaggcagcagtagctt

SEQ ID NO: 7653426 - DNA, 22 bp, Homo sapiens
actggccaggcacagctgtggg

SEQ ID NO: 7653427 - DNA, 22 bp, Homo sapiens
actggccaggcacagctgtggg

SEQ ID NO: 7653428 - DNA, 22 bp, Homo sapiens
actggccaggcacagctgtggg

SEQ ID NO: 7653429 - DNA, 22 bp, Homo sapiens
actggccagaactaagtcacat

SEQ ID NO: 7653430 - DNA, 22 bp, Homo sapiens
actggccagaactaagtcacat

SEQ ID NO: 7653431 - DNA, 22 bp, Homo sapiens
actggccagccaacaacaatag

SEQ ID NO: 7653432 - DNA, 22 bp, Homo sapiens
actggccagccaacaacaatag

SEQ ID NO: 7653433 - DNA, 22 bp, Homo sapiens
actggccaggagctggaaatac

SEQ ID NO: 7653434 - DNA, 22 bp, Homo sapiens
actggccaggagctggaaatac

SEQ ID NO: 7653435 - DNA, 22 bp, Homo sapiens
actggccaggcacagctgtggg

SEQ ID NO: 7653436 - DNA, 22 bp, Homo sapiens
actggccaggcacagctgtggg

SEQ ID NO: 7653437 - DNA, 22 bp, Homo sapiens
actggccaggcagcagtagctt

SEQ ID NO: 7653438 - DNA, 22 bp, Homo sapiens
actggccaggcagcagtagctt

SEQ ID NO: 7653439 - DNA, 22 bp, Homo sapiens
actggccaggcagcagtagctt

SEQ ID NO: 7653440 - DNA, 22 bp, Homo sapiens
actggccaggcagcagtagctt

SEQ ID NO: 7653441 - DNA, 22 bp, Homo sapiens
actggccaggcgaaccacactg

SEQ ID NO: 7653442 - DNA, 22 bp, Homo sapiens
actggccaggttcaaaatacag

SEQ ID NO: 7653443 - DNA, 22 bp, Homo sapiens
actggccaggttcaaaatacag

SEQ ID NO: 7653444 - DNA, 22 bp, Homo sapiens
actggccatgaacttgggatct

SEQ ID NO: 7653445 - DNA, 22 bp, Homo sapiens
actggccaggcgaaccacactg

SEQ ID NO: 7653446 - DNA, 22 bp, Homo sapiens
actggccaggcagcagtagctt

SEQ ID NO: 7653447 - DNA, 22 bp, Homo sapiens
actggccaggcagcagtagctt

SEQ ID NO: 7653448 - DNA, 22 bp, Homo sapiens
actggccaggcgaaccacactg

SEQ ID NO: 7653449 - DNA, 22 bp, Homo sapiens
actggctgaagtttactttttg

SEQ ID NO: 7653450 - DNA, 22 bp, Homo sapiens
actggctgaaagtaaagaacac

SEQ ID NO: 7653451 - DNA, 22 bp, Homo sapiens
actggctgaagtttactttttg

SEQ ID NO: 7653452 - DNA, 22 bp, Homo sapiens
actggctgaagtttactttttg

SEQ ID NO: 7653453 - DNA, 22 bp, Homo sapiens
actggctgaggaagttgccact

SEQ ID NO: 7653454 - DNA, 22 bp, Homo sapiens
actggctgaggaagttgccact

SEQ ID NO: 7653455 - DNA, 22 bp, Homo sapiens
actggctgaggaagttgccact

SEQ ID NO: 7653456 - DNA, 22 bp, Homo sapiens
actggctgagttgcttcagcaa

SEQ ID NO: 7653457 - DNA, 22 bp, Homo sapiens
actggctgaggaagttgccact

SEQ ID NO: 7653458 - DNA, 22 bp, Homo sapiens
actggctgaggaagttgccact

SEQ ID NO: 7653459 - DNA, 22 bp, Homo sapiens
actggctctgcatttttggctc

SEQ ID NO: 7653460 - DNA, 22 bp, Homo sapiens
aatacagaggaaacatttaata

SEQ ID NO: 7653461 - DNA, 22 bp, Homo sapiens
aatacagaggaaacatttaata

SEQ ID NO: 7653462 - DNA, 22 bp, Homo sapiens
actggctgagttgcttcagcaa

SEQ ID NO: 7653463 - DNA, 22 bp, Homo sapiens
aatacagagaatgttatttgga

SEQ ID NO: 7653464 - DNA, 22 bp, Homo sapiens
actggctgagttgcttcagcaa

SEQ ID NO: 7653465 - DNA, 22 bp, Homo sapiens
actggctgagttgcttcagcaa

SEQ ID NO: 7653466 - DNA, 22 bp, Homo sapiens
aatacagaggaaacatttaata

SEQ ID NO: 7653467 - DNA, 22 bp, Homo sapiens
aatacagaggcttccagtaaaa

SEQ ID NO: 7653468 - DNA, 22 bp, Homo sapiens
aatacagaggaaacatttaata

SEQ ID NO: 7653469 - DNA, 22 bp, Homo sapiens
aatacagaggaaacatttaata

SEQ ID NO: 7653470 - DNA, 22 bp, Homo sapiens
aatacagaggaaacatttaata

SEQ ID NO: 7653471 - DNA, 22 bp, Homo sapiens
aatacatgttttctactattct

SEQ ID NO: 7653472 - DNA, 22 bp, Homo sapiens
aatacagaggcttccagtaaaa

SEQ ID NO: 7653473 - DNA, 22 bp, Homo sapiens
aataccacctcattctggaggc

SEQ ID NO: 7653474 - DNA, 22 bp, Homo sapiens
aataccttgctgtagccacgca

SEQ ID NO: 7653475 - DNA, 22 bp, Homo sapiens
aatacctttcctgccattcact

SEQ ID NO: 7653476 - DNA, 22 bp, Homo sapiens
aataccttgctcatagggctga

SEQ ID NO: 7653477 - DNA, 22 bp, Homo sapiens
aatacctttcctgccattcact

SEQ ID NO: 7653478 - DNA, 22 bp, Homo sapiens
aatacgtcccatcatctttttc

SEQ ID NO: 7653479 - DNA, 22 bp, Homo sapiens
aatacgtctgaatgcattctca

SEQ ID NO: 7653480 - DNA, 20 bp, Homo sapiens
aatactaaacacaaagcagt

SEQ ID NO: 7653481 - DNA, 20 bp, Homo sapiens
aatactaaacacaaagcagt

SEQ ID NO: 7653482 - DNA, 20 bp, Homo sapiens
aatactaaacacaaagcagt

SEQ ID NO: 7653483 - DNA, 22 bp, Homo sapiens
aatacgtggttactctatagag

SEQ ID NO: 7653484 - DNA, 22 bp, Homo sapiens
aataccttccaacatcaagaca

SEQ ID NO: 7653485 - DNA, 22 bp, Homo sapiens
aataccttccaacatcaagaca

SEQ ID NO: 7653486 - DNA, 22 bp, Homo sapiens
aataccttccaacatcaagaca

SEQ ID NO: 7653487 - DNA, 22 bp, Homo sapiens
aataccatgataattaattcat

SEQ ID NO: 7653488 - DNA, 22 bp, Homo sapiens
aataccatgataattaattcat

SEQ ID NO: 7653489 - DNA, 22 bp, Homo sapiens
aataccagagacagtgtttacc

SEQ ID NO: 7653490 - DNA, 22 bp, Homo sapiens
aataccatgcagaaataacata

SEQ ID NO: 7653491 - DNA, 22 bp, Homo sapiens
aataccatgcagaaataacata

SEQ ID NO: 7653492 - DNA, 22 bp, Homo sapiens
aataccatgcagaaataacata

SEQ ID NO: 7653493 - DNA, 22 bp, Homo sapiens
aataccatgcagaaataacata

SEQ ID NO: 7653494 - DNA, 22 bp, Homo sapiens
actggacagaggaaatatggag

SEQ ID NO: 7653495 - DNA, 22 bp, Homo sapiens
actggacagaggaaatatggag

SEQ ID NO: 7653496 - DNA, 22 bp, Homo sapiens
actggacagaggaaatatggag

SEQ ID NO: 7653497 - DNA, 23 bp, Homo sapiens
actggacagagtggacgaggctg

SEQ ID NO: 7653498 - DNA, 23 bp, Homo sapiens
actggacagagtggacgaggctg

SEQ ID NO: 7653499 - DNA, 23 bp, Homo sapiens
actggacagagtggacgaggctg

SEQ ID NO: 7653500 - DNA, 22 bp, Homo sapiens
actggactcacgtattcctgag

SEQ ID NO: 7653501 - DNA, 22 bp, Homo sapiens
actggactccccaagggccagg

SEQ ID NO: 7653502 - DNA, 22 bp, Homo sapiens
actggacatttctagaaagcag

SEQ ID NO: 7653503 - DNA, 22 bp, Homo sapiens
actggacaggttcatggtttta

SEQ ID NO: 7653504 - DNA, 22 bp, Homo sapiens
actggactcacgtattcctgag

SEQ ID NO: 7653505 - DNA, 20 bp, Homo sapiens
actggagccatctcagccta

SEQ ID NO: 7653506 - DNA, 20 bp, Homo sapiens
actggagccatctcagccta

SEQ ID NO: 7653507 - DNA, 22 bp, Homo sapiens
actggagcccgtggaggcgcag

SEQ ID NO: 7653508 - DNA, 22 bp, Homo sapiens
actggagcccgtggaggcgcag

SEQ ID NO: 7653509 - DNA, 19 bp, Homo sapiens
actggagcctgatggagga

SEQ ID NO: 7653510 - DNA, 19 bp, Homo sapiens
actggagcctgatggagga

SEQ ID NO: 7653511 - DNA, 22 bp, Homo sapiens
actggactccccaagggccagg

SEQ ID NO: 7653512 - DNA, 22 bp, Homo sapiens
actggactctggaggtttcgta

SEQ ID NO: 7653513 - DNA, 22 bp, Homo sapiens
actggagactgtgtcttttgat

SEQ ID NO: 7653514 - DNA, 18 bp, Homo sapiens
actggagcattagcagct

SEQ ID NO: 7653515 - DNA, 22 bp, Homo sapiens
actgcactccagcctgggtgac

SEQ ID NO: 7653516 - DNA, 22 bp, Homo sapiens
actgcactccagcctgggtgac

SEQ ID NO: 7653517 - DNA, 22 bp, Homo sapiens
actgcactccagcctgggtgac

SEQ ID NO: 7653518 - DNA, 22 bp, Homo sapiens
actgcactccagcctgggtgac

SEQ ID NO: 7653519 - DNA, 22 bp, Homo sapiens
actgcactccagcctgggtgac

SEQ ID NO: 7653520 - DNA, 22 bp, Homo sapiens
actgcactccagcctgggtgac

SEQ ID NO: 7653521 - DNA, 22 bp, Homo sapiens
actgcactccagcctgggtgac

SEQ ID NO: 7653522 - DNA, 22 bp, Homo sapiens
actgcactccagcctgggtgac

SEQ ID NO: 7653523 - DNA, 22 bp, Homo sapiens
actgcgtggggagctgtgacta

SEQ ID NO: 7653524 - DNA, 22 bp, Homo sapiens
actgcgtggggagctgtgacta

SEQ ID NO: 7653525 - DNA, 22 bp, Homo sapiens
actgcgtggggagctgtgacta

SEQ ID NO: 7653526 - DNA, 22 bp, Homo sapiens
actgcgggaacccgcggccggc

SEQ ID NO: 7653527 - DNA, 22 bp, Homo sapiens
actgcgctccagcctgggtgac

SEQ ID NO: 7653528 - DNA, 22 bp, Homo sapiens
actgctagtgagaaaataacca

SEQ ID NO: 7653529 - DNA, 22 bp, Homo sapiens
actgctagtgagaaaataacca

SEQ ID NO: 7653530 - DNA, 22 bp, Homo sapiens
actgctaaatctccatcgatta

SEQ ID NO: 7653531 - DNA, 22 bp, Homo sapiens
actggacagaggaaatatggag

SEQ ID NO: 7653532 - DNA, 22 bp, Homo sapiens
actggagtgagtatcgatgaac

SEQ ID NO: 7653533 - DNA, 22 bp, Homo sapiens
actggagtattgtttaatacca

SEQ ID NO: 7653534 - DNA, 22 bp, Homo sapiens
actggagtagatctgactgagt

SEQ ID NO: 7653535 - DNA, 20 bp, Homo sapiens
actggagtaccctagagaag

SEQ ID NO: 7653536 - DNA, 20 bp, Homo sapiens
actggagtaccctagagaag

SEQ ID NO: 7653537 - DNA, 22 bp, Homo sapiens
actggagtgtttggaggatgca

SEQ ID NO: 7653538 - DNA, 22 bp, Homo sapiens
actggagttattatttgcagct

SEQ ID NO: 7653539 - DNA, 22 bp, Homo sapiens
actggagtgtttggaggatgca

SEQ ID NO: 7653540 - DNA, 20 bp, Homo sapiens
actggagttcatgctaagag

SEQ ID NO: 7653541 - DNA, 22 bp, Homo sapiens
actggccagaactaagtcacat

SEQ ID NO: 7653542 - DNA, 22 bp, Homo sapiens
actggccagaactaagtcacat

SEQ ID NO: 7653543 - DNA, 22 bp, Homo sapiens
actggaggggaaaatggtagta

SEQ ID NO: 7653544 - DNA, 22 bp, Homo sapiens
actggaggcccctcccagtgaa

SEQ ID NO: 7653545 - DNA, 22 bp, Homo sapiens
actggaggggaaaatggtagta

SEQ ID NO: 7653546 - DNA, 22 bp, Homo sapiens
actggaggggaaaatggtagta

SEQ ID NO: 7653547 - DNA, 22 bp, Homo sapiens
actggagtaaaggtcacttgtg

SEQ ID NO: 7653548 - DNA, 22 bp, Homo sapiens
actggagtacagtggcgtgaac

SEQ ID NO: 7653549 - DNA, 22 bp, Homo sapiens
actggagctgagagcatgggta

SEQ ID NO: 7653550 - DNA, 22 bp, Homo sapiens
actggagcttctaaggaggagt

SEQ ID NO: 7653551 - DNA, 19 bp, Homo sapiens
actggagcctgatggagga

SEQ ID NO: 7653552 - DNA, 22 bp, Homo sapiens
actggaggcccctcccagtgaa

SEQ ID NO: 7653553 - DNA, 22 bp, Homo sapiens
actggaggattcctggaaggcg

SEQ ID NO: 7653554 - DNA, 22 bp, Homo sapiens
actggaggattcctggaaggcg

SEQ ID NO: 7653555 - DNA, 22 bp, Homo sapiens
actggagcttctaaggaggagt

SEQ ID NO: 7653556 - DNA, 22 bp, Homo sapiens
actggaggattcctggaaggcg

SEQ ID NO: 7653557 - DNA, 22 bp, Homo sapiens
actggaggattcctggaaggcg

SEQ ID NO: 7653558 - DNA, 22 bp, Homo sapiens
actggaggattcctggaaggcg

SEQ ID NO: 7653559 - DNA, 22 bp, Homo sapiens
actgcactccagcccgagcaac

SEQ ID NO: 7653560 - DNA, 22 bp, Homo sapiens
actgcactccagcccgagcaac

SEQ ID NO: 7653561 - DNA, 22 bp, Homo sapiens
actgcactccaacctgggtgac

SEQ ID NO: 7653562 - DNA, 22 bp, Homo sapiens
actgcactccaacctgggtgac

SEQ ID NO: 7653563 - DNA, 22 bp, Homo sapiens
actgcactccaacctgggtgac

SEQ ID NO: 7653564 - DNA, 22 bp, Homo sapiens
actgcactccaacctgggtgac

SEQ ID NO: 7653565 - DNA, 22 bp, Homo sapiens
actgcactccagcccgagcaac

SEQ ID NO: 7653566 - DNA, 22 bp, Homo sapiens
actgcactccagcctcggggtc

SEQ ID NO: 7653567 - DNA, 22 bp, Homo sapiens
actgcactccagcctcggggtc

SEQ ID NO: 7653568 - DNA, 22 bp, Homo sapiens
actgcactccagcctcggggtc

SEQ ID NO: 7653569 - DNA, 22 bp, Homo sapiens
actgcactccagcctcggggtc

SEQ ID NO: 7653570 - DNA, 22 bp, Homo sapiens
actgcactccaacctgggtgac

SEQ ID NO: 7653571 - DNA, 22 bp, Homo sapiens
actgcactccaacctgggtgac

SEQ ID NO: 7653572 - DNA, 22 bp, Homo sapiens
actgcactccaacctgggtgac

SEQ ID NO: 7653573 - DNA, 22 bp, Homo sapiens
actgcactccaacctgggtgac

SEQ ID NO: 7653574 - DNA, 22 bp, Homo sapiens
actgcactccaacctgggtgac

SEQ ID NO: 7653575 - DNA, 22 bp, Homo sapiens
actgcactccaacctgggtgac

SEQ ID NO: 7653576 - DNA, 22 bp, Homo sapiens
actgcactccagcctgggtaac

SEQ ID NO: 7653577 - DNA, 22 bp, Homo sapiens
actgcactccagcctgggtaac

SEQ ID NO: 7653578 - DNA, 22 bp, Homo sapiens
actgcactccagcctgggtaac

SEQ ID NO: 7653579 - DNA, 22 bp, Homo sapiens
actgcactccagcctgggtgac

SEQ ID NO: 7653580 - DNA, 22 bp, Homo sapiens
actgcactccagcctgggtaac

SEQ ID NO: 7653581 - DNA, 22 bp, Homo sapiens
actgcactccagcctgggtaac

SEQ ID NO: 7653582 - DNA, 22 bp, Homo sapiens
actgcactccagcctgggacac

SEQ ID NO: 7653583 - DNA, 22 bp, Homo sapiens
actgcactccagcctgggcaac

SEQ ID NO: 7653584 - DNA, 22 bp, Homo sapiens
actgcactccagcctgggcaca

SEQ ID NO: 7653585 - DNA, 22 bp, Homo sapiens
actgcactccagcctgggcgac

SEQ ID NO: 7653586 - DNA, 22 bp, Homo sapiens
actgcactccagcctgggtaac

SEQ ID NO: 7653587 - DNA, 22 bp, Homo sapiens
actgcactccagcctgggtaac

SEQ ID NO: 7653588 - DNA, 22 bp, Homo sapiens
actgcactccagcctgggtaac

SEQ ID NO: 7653589 - DNA, 22 bp, Homo sapiens
actgcactccagcctgggcggc

SEQ ID NO: 7653590 - DNA, 22 bp, Homo sapiens
actgcactccagcctgggtaac

SEQ ID NO: 7653591 - DNA, 22 bp, Homo sapiens
actgcactccagcctgggtaac

SEQ ID NO: 7653592 - DNA, 22 bp, Homo sapiens
actgcactccagcctgggtaac

SEQ ID NO: 7653593 - DNA, 22 bp, Homo sapiens
actgagtgtaggactttgagtt

SEQ ID NO: 7653594 - DNA, 22 bp, Homo sapiens
actgagtgggaggtttgtgtga

SEQ ID NO: 7653595 - DNA, 22 bp, Homo sapiens
actgagtgggaggtttgtgtga

SEQ ID NO: 7653596 - DNA, 22 bp, Homo sapiens
actgagtgtccactatgagcca

SEQ ID NO: 7653597 - DNA, 22 bp, Homo sapiens
actgataagttgcttgctctca

SEQ ID NO: 7653598 - DNA, 22 bp, Homo sapiens
actgagttatgggtatgccttg

SEQ ID NO: 7653599 - DNA, 22 bp, Homo sapiens
actgatattaaacacaatttaa

SEQ ID NO: 7653600 - DNA, 22 bp, Homo sapiens
actgatacatctgtggaagtgg

SEQ ID NO: 7653601 - DNA, 22 bp, Homo sapiens
actgagttatgggtatgccttg

SEQ ID NO: 7653602 - DNA, 22 bp, Homo sapiens
actgataagttgcttgctctca

SEQ ID NO: 7653603 - DNA, 22 bp, Homo sapiens
actgatacggttttagagtcca

SEQ ID NO: 7653604 - DNA, 22 bp, Homo sapiens
actgcactccaacctgggtgac

SEQ ID NO: 7653605 - DNA, 22 bp, Homo sapiens
actgcactccaacctgggtgac

SEQ ID NO: 7653606 - DNA, 22 bp, Homo sapiens
actgcactccaacctgggtgac

SEQ ID NO: 7653607 - DNA, 22 bp, Homo sapiens
actgcactccaacctgggtgac

SEQ ID NO: 7653608 - DNA, 22 bp, Homo sapiens
actgatcacagatatgtatatt

SEQ ID NO: 7653609 - DNA, 22 bp, Homo sapiens
actgatattaaacacaatttaa

SEQ ID NO: 7653610 - DNA, 22 bp, Homo sapiens
actgatattaaacacaatttaa

SEQ ID NO: 7653611 - DNA, 22 bp, Homo sapiens
actgatcacagatatgtatatt

SEQ ID NO: 7653612 - DNA, 22 bp, Homo sapiens
actgatcaagggtttaatttta

SEQ ID NO: 7653613 - DNA, 22 bp, Homo sapiens
actgagtggctggggagtggca

SEQ ID NO: 7653614 - DNA, 22 bp, Homo sapiens
actgagtggctggggagtggca

SEQ ID NO: 7653615 - DNA, 22 bp, Homo sapiens
actgaggtttttagtgttaaat

SEQ ID NO: 7653616 - DNA, 22 bp, Homo sapiens
actgagtgggaggtttgtgtga

SEQ ID NO: 7653617 - DNA, 22 bp, Homo sapiens
actgaggtttttagtgttaaat

SEQ ID NO: 7653618 - DNA, 22 bp, Homo sapiens
actgaggtttacttgaaggaga

SEQ ID NO: 7653619 - DNA, 22 bp, Homo sapiens
actgaggtttcattttatcgct

SEQ ID NO: 7653620 - DNA, 22 bp, Homo sapiens
actgaggttgtagtaggaattc

SEQ ID NO: 7653621 - DNA, 22 bp, Homo sapiens
actgaggttgaaatagtgatgt

SEQ ID NO: 7653622 - DNA, 22 bp, Homo sapiens
actgaggttgaaatagtgatgt

SEQ ID NO: 7653623 - DNA, 22 bp, Homo sapiens
actgaggttattgcaataaaat

SEQ ID NO: 7653624 - DNA, 20 bp, Homo sapiens
actgaggttagataacaggt

SEQ ID NO: 7653625 - DNA, 21 bp, Homo sapiens
actgaggttagatgccttgcc

SEQ ID NO: 7653626 - DNA, 22 bp, Homo sapiens
actgagagaacgggctgctccc

SEQ ID NO: 7653627 - DNA, 22 bp, Homo sapiens
actgaggtagggcacacctagg

SEQ ID NO: 7653628 - DNA, 22 bp, Homo sapiens
actgaggtagggcacacctagg

SEQ ID NO: 7653629 - DNA, 22 bp, Homo sapiens
actgaggtcaggggtatgtgat

SEQ ID NO: 7653630 - DNA, 22 bp, Homo sapiens
actgaggtataattgacataac

SEQ ID NO: 7653631 - DNA, 23 bp, Homo sapiens
actgaggtactgaggttgtgaca

SEQ ID NO: 7653632 - DNA, 23 bp, Homo sapiens
actgaggtactgaggttgtgaca

SEQ ID NO: 7653633 - DNA, 22 bp, Homo sapiens
actgagagagctgggtatctcc

SEQ ID NO: 7653634 - DNA, 22 bp, Homo sapiens
actgagagaagggattttaagt

SEQ ID NO: 7653635 - DNA, 22 bp, Homo sapiens
actgaggtctatcatgagccag

SEQ ID NO: 7653636 - DNA, 22 bp, Homo sapiens
actgaggtctatcatgagccag

SEQ ID NO: 7653637 - DNA, 22 bp, Homo sapiens
actgaggtcaggggtatgtgat

SEQ ID NO: 7653638 - DNA, 22 bp, Homo sapiens
actgaggtcatgcatagtttct

SEQ ID NO: 7653639 - DNA, 22 bp, Homo sapiens
actgaggtctcaggtggggaag

SEQ ID NO: 7653640 - DNA, 22 bp, Homo sapiens
actgaggtctcaggtggggaag

SEQ ID NO: 7653641 - DNA, 22 bp, Homo sapiens
actgaggtggggtctgcttgga

SEQ ID NO: 7653642 - DNA, 22 bp, Homo sapiens
actgaggtggggtctgcttgga

SEQ ID NO: 7653643 - DNA, 22 bp, Homo sapiens
actgagagaacgggctgctccc

SEQ ID NO: 7653644 - DNA, 22 bp, Homo sapiens
actgagagaacgggctgctccc

SEQ ID NO: 7653645 - DNA, 22 bp, Homo sapiens
actctggcgggcgggcgagcca

SEQ ID NO: 7653646 - DNA, 22 bp, Homo sapiens
actctggctattcactataata

SEQ ID NO: 7653647 - DNA, 22 bp, Homo sapiens
actctggctgccttgtgagcat

SEQ ID NO: 7653648 - DNA, 22 bp, Homo sapiens
actctggcgggcgggcgagcca

SEQ ID NO: 7653649 - DNA, 22 bp, Homo sapiens
actctggccctcctgctgccag

SEQ ID NO: 7653650 - DNA, 22 bp, Homo sapiens
actctggccatcttggaccttg

SEQ ID NO: 7653651 - DNA, 22 bp, Homo sapiens
actctggccccaggatctgtgt

SEQ ID NO: 7653652 - DNA, 22 bp, Homo sapiens
actctgctggctgcagggcagc

SEQ ID NO: 7653653 - DNA, 22 bp, Homo sapiens
actctgctggctgcagggcagc

SEQ ID NO: 7653654 - DNA, 21 bp, Homo sapiens
actctgctgcgggcttggcct

SEQ ID NO: 7653655 - DNA, 22 bp, Homo sapiens
actctgctgataggtcctcaga

SEQ ID NO: 7653656 - DNA, 22 bp, Homo sapiens
actctgctgataggtcctcaga

SEQ ID NO: 7653657 - DNA, 22 bp, Homo sapiens
actctgctgataggtcctcaga

SEQ ID NO: 7653658 - DNA, 21 bp, Homo sapiens
actctgctgcgggcttggcct

SEQ ID NO: 7653659 - DNA, 21 bp, Homo sapiens
actctgctgcgggcttggcct

SEQ ID NO: 7653660 - DNA, 22 bp, Homo sapiens
actctgcttaattaaaaccagg

SEQ ID NO: 7653661 - DNA, 22 bp, Homo sapiens
actctgcttaattaaaaccagg

SEQ ID NO: 7653662 - DNA, 22 bp, Homo sapiens
actctgctgtttactctctata

SEQ ID NO: 7653663 - DNA, 22 bp, Homo sapiens
actctgctgtttactctctata

SEQ ID NO: 7653664 - DNA, 22 bp, Homo sapiens
actctgctgtctgatggcagga

SEQ ID NO: 7653665 - DNA, 22 bp, Homo sapiens
actctgctgtctgatggcagga

SEQ ID NO: 7653666 - DNA, 22 bp, Homo sapiens
actctgctgtttactctctata

SEQ ID NO: 7653667 - DNA, 22 bp, Homo sapiens
actctgctgtttactctctata

SEQ ID NO: 7653668 - DNA, 22 bp, Homo sapiens
actctgctcttatagtgttata

SEQ ID NO: 7653669 - DNA, 22 bp, Homo sapiens
actctgctcttatagtgttata

SEQ ID NO: 7653670 - DNA, 22 bp, Homo sapiens
actctgctcttatagtgttata

SEQ ID NO: 7653671 - DNA, 17 bp, Homo sapiens
actctgctgaagtagaa

SEQ ID NO: 7653672 - DNA, 17 bp, Homo sapiens
actctgctgaagtagaa

SEQ ID NO: 7653673 - DNA, 22 bp, Homo sapiens
actctgctcttatagtgttata

SEQ ID NO: 7653674 - DNA, 17 bp, Homo sapiens
actctgctgaagtagaa

SEQ ID NO: 7653675 - DNA, 22 bp, Homo sapiens
actctgctctttggacaatgcc

SEQ ID NO: 7653676 - DNA, 22 bp, Homo sapiens
actctgctctttggacaatgcc

SEQ ID NO: 7653677 - DNA, 22 bp, Homo sapiens
actctcccttggagcctcaggc

SEQ ID NO: 7653678 - DNA, 22 bp, Homo sapiens
actctcccttatctaactttac

SEQ ID NO: 7653679 - DNA, 22 bp, Homo sapiens
actctgcttattgctgcaggca

SEQ ID NO: 7653680 - DNA, 22 bp, Homo sapiens
actctgcttattgctgcaggca

SEQ ID NO: 7653681 - DNA, 22 bp, Homo sapiens
actctgcttccacttttgctaa

SEQ ID NO: 7653682 - DNA, 22 bp, Homo sapiens
actctgcttccacttttgctaa

SEQ ID NO: 7653683 - DNA, 22 bp, Homo sapiens
actctgcttattgctgcaggca

SEQ ID NO: 7653684 - DNA, 22 bp, Homo sapiens
actctgcttattgctgcaggca

SEQ ID NO: 7653685 - DNA, 22 bp, Homo sapiens
actctgcttattgctgcaggca

SEQ ID NO: 7653686 - DNA, 22 bp, Homo sapiens
actctgcttgcccaatggaaac

SEQ ID NO: 7653687 - DNA, 22 bp, Homo sapiens
actctgcttgcccaatggaaac

SEQ ID NO: 7653688 - DNA, 22 bp, Homo sapiens
actctgcttgggccatatctgg

SEQ ID NO: 7653689 - DNA, 22 bp, Homo sapiens
actctgcttgggccatatctgg

SEQ ID NO: 7653690 - DNA, 22 bp, Homo sapiens
actctgcttgggccatatctgg

SEQ ID NO: 7653691 - DNA, 22 bp, Homo sapiens
actctgcttgggccatatctgg

SEQ ID NO: 7653692 - DNA, 22 bp, Homo sapiens
actctggagatggatgtcagga

SEQ ID NO: 7653693 - DNA, 22 bp, Homo sapiens
actctggagatggatgtcagga

SEQ ID NO: 7653694 - DNA, 22 bp, Homo sapiens
actctggagatggatgtcagga

SEQ ID NO: 7653695 - DNA, 22 bp, Homo sapiens
actctggcaagcttccacttcc

SEQ ID NO: 7653696 - DNA, 22 bp, Homo sapiens
actctggcactgggtacctcag

SEQ ID NO: 7653697 - DNA, 22 bp, Homo sapiens
actctggcagcagaaccagtgt

SEQ ID NO: 7653698 - DNA, 22 bp, Homo sapiens
actctggccaggtgcggtatgt

SEQ ID NO: 7653699 - DNA, 22 bp, Homo sapiens
acctttatgattcacaatgtat

SEQ ID NO: 7653700 - DNA, 22 bp, Homo sapiens
acctttatggagaacttgggat

SEQ ID NO: 7653701 - DNA, 22 bp, Homo sapiens
acggggctagagaaggtttctt

SEQ ID NO: 7653702 - DNA, 22 bp, Homo sapiens
acggggctagagaaggtttctt

SEQ ID NO: 7653703 - DNA, 22 bp, Homo sapiens
acctttatgtttgattacaatt

SEQ ID NO: 7653704 - DNA, 22 bp, Homo sapiens
acctttatgtttgattacaatt

SEQ ID NO: 7653705 - DNA, 22 bp, Homo sapiens
acctttatgaaacagctgtcgt

SEQ ID NO: 7653706 - DNA, 22 bp, Homo sapiens
acctttatgattcacaatgtat

SEQ ID NO: 7653707 - DNA, 22 bp, Homo sapiens
acctttatgattcacaatgtat

SEQ ID NO: 7653708 - DNA, 22 bp, Homo sapiens
acctttatgattcacaatgtat

SEQ ID NO: 7653709 - DNA, 22 bp, Homo sapiens
acgggtggctgaggaggcctct

SEQ ID NO: 7653710 - DNA, 22 bp, Homo sapiens
acgggtggctgaggaggcctct

SEQ ID NO: 7653711 - DNA, 22 bp, Homo sapiens
acgggtggctgaggaggcctct

SEQ ID NO: 7653712 - DNA, 22 bp, Homo sapiens
acggggctagagaaggtttctt

SEQ ID NO: 7653713 - DNA, 22 bp, Homo sapiens
acggggctagagaaggtttctt

SEQ ID NO: 7653714 - DNA, 22 bp, Homo sapiens
acggggctagagaaggtttctt

SEQ ID NO: 7653715 - DNA, 22 bp, Homo sapiens
acgggtggtaatgagaaaagga

SEQ ID NO: 7653716 - DNA, 22 bp, Homo sapiens
acggtgcagcctgtcccttctc

SEQ ID NO: 7653717 - DNA, 22 bp, Homo sapiens
acggtgcagcctgtcccttctc

SEQ ID NO: 7653718 - DNA, 22 bp, Homo sapiens
acggtgaccaagcatcaccgag

SEQ ID NO: 7653719 - DNA, 22 bp, Homo sapiens
acgggtggctgaggaggcctct

SEQ ID NO: 7653720 - DNA, 22 bp, Homo sapiens
acgggtggtaatgagaaaagga

SEQ ID NO: 7653721 - DNA, 22 bp, Homo sapiens
acggtaacagataccacagact

SEQ ID NO: 7653722 - DNA, 22 bp, Homo sapiens
acgtgcaggatctggttggcga

SEQ ID NO: 7653723 - DNA, 22 bp, Homo sapiens
acgtgcaggatctggttggcga

SEQ ID NO: 7653724 - DNA, 22 bp, Homo sapiens
acgtcatcgttgtcatcgtcat

SEQ ID NO: 7653725 - DNA, 22 bp, Homo sapiens
acgtgcaggatctggttggcga

SEQ ID NO: 7653726 - DNA, 22 bp, Homo sapiens
acgtgcaggatctggttggcga

SEQ ID NO: 7653727 - DNA, 22 bp, Homo sapiens
acgtgcaggatctggttggcga

SEQ ID NO: 7653728 - DNA, 22 bp, Homo sapiens
acgtgaggacaaagggagaagg

SEQ ID NO: 7653729 - DNA, 22 bp, Homo sapiens
acgtcactcttgcctctaagaa

SEQ ID NO: 7653730 - DNA, 22 bp, Homo sapiens
acggtgctgggtattggggttc

SEQ ID NO: 7653731 - DNA, 22 bp, Homo sapiens
acggtgctgggtattggggttc

SEQ ID NO: 7653732 - DNA, 22 bp, Homo sapiens
acgtagaaaccaaatagcatca

SEQ ID NO: 7653733 - DNA, 22 bp, Homo sapiens
acgtaatactattcttagtgat

SEQ ID NO: 7653734 - DNA, 22 bp, Homo sapiens
acgtaatataagaaagtgtggt

SEQ ID NO: 7653735 - DNA, 22 bp, Homo sapiens
acggtgctgggtattggggttc

SEQ ID NO: 7653736 - DNA, 22 bp, Homo sapiens
acggtgctgggtattggggttc

SEQ ID NO: 7653737 - DNA, 22 bp, Homo sapiens
acgtagcactgagagatgcagg

SEQ ID NO: 7653738 - DNA, 22 bp, Homo sapiens
acgtacagaccagaaacaggga

SEQ ID NO: 7653739 - DNA, 22 bp, Homo sapiens
acctaagagatcttctggtcca

SEQ ID NO: 7653740 - DNA, 22 bp, Homo sapiens
acctaagaaatccagagatttc

SEQ ID NO: 7653741 - DNA, 22 bp, Homo sapiens
acctaataaaggtaaattctgt

SEQ ID NO: 7653742 - DNA, 23 bp, Homo sapiens
acctaattgaaaatgatgtcata

SEQ ID NO: 7653743 - DNA, 22 bp, Homo sapiens
acctacatcaagggagtggtag

SEQ ID NO: 7653744 - DNA, 22 bp, Homo sapiens
acctacatagttaagtaacaaa

SEQ ID NO: 7653745 - DNA, 22 bp, Homo sapiens
accgggctaatttttgtatctt

SEQ ID NO: 7653746 - DNA, 22 bp, Homo sapiens
accgggaagtcctgcactgggc

SEQ ID NO: 7653747 - DNA, 22 bp, Homo sapiens
accgggaagtcctgcactgggc

SEQ ID NO: 7653748 - DNA, 22 bp, Homo sapiens
accgggaagtcctgcactgggc

SEQ ID NO: 7653749 - DNA, 23 bp, Homo sapiens
acctaaatagctgtgttgaagta

SEQ ID NO: 7653750 - DNA, 22 bp, Homo sapiens
acctaaatctacctcatgtttt

SEQ ID NO: 7653751 - DNA, 22 bp, Homo sapiens
acctaaatctacctcatgtttt

SEQ ID NO: 7653752 - DNA, 22 bp, Homo sapiens
acctaacttacctaggtccaca

SEQ ID NO: 7653753 - DNA, 22 bp, Homo sapiens
acctaaattctggctgattagg

SEQ ID NO: 7653754 - DNA, 22 bp, Homo sapiens
acctaaattctggctgattagg

SEQ ID NO: 7653755 - DNA, 22 bp, Homo sapiens
acctagaatgaagcaatgctgt

SEQ ID NO: 7653756 - DNA, 22 bp, Homo sapiens
acctagaatgaagcaatgctgt

SEQ ID NO: 7653757 - DNA, 22 bp, Homo sapiens
acctagaatttaaaacattgct

SEQ ID NO: 7653758 - DNA, 22 bp, Homo sapiens
acctagaatttaaaacattgct

SEQ ID NO: 7653759 - DNA, 23 bp, Homo sapiens
acctagaaatacgttttacatgg

SEQ ID NO: 7653760 - DNA, 23 bp, Homo sapiens
acctagaaatacgttttacatgg

SEQ ID NO: 7653761 - DNA, 22 bp, Homo sapiens
acctagaactgcaggctatttt

SEQ ID NO: 7653762 - DNA, 22 bp, Homo sapiens
acctactgctccacagtgacta

SEQ ID NO: 7653763 - DNA, 22 bp, Homo sapiens
acctagaaactgacagaatatt

SEQ ID NO: 7653764 - DNA, 22 bp, Homo sapiens
acctagaaactgacagaatatt

SEQ ID NO: 7653765 - DNA, 22 bp, Homo sapiens
acctacatggctttaagtaagt

SEQ ID NO: 7653766 - DNA, 20 bp, Homo sapiens
acctacatgtatagtgaggg

SEQ ID NO: 7653767 - DNA, 22 bp, Homo sapiens
acctacatgttccacatagttg

SEQ ID NO: 7653768 - DNA, 22 bp, Homo sapiens
aagtctaaacacatatttaaaa

SEQ ID NO: 7653769 - DNA, 22 bp, Homo sapiens
aagtcgtggcaggcttgcacga

SEQ ID NO: 7653770 - DNA, 22 bp, Homo sapiens
aagtcgtggcaggcttgcacga

SEQ ID NO: 7653771 - DNA, 22 bp, Homo sapiens
aagtcctttctcatggaggaat

SEQ ID NO: 7653772 - DNA, 22 bp, Homo sapiens
aagtcctttctcatggaggaat

SEQ ID NO: 7653773 - DNA, 22 bp, Homo sapiens
aagtcctttaatatcacatagt

SEQ ID NO: 7653774 - DNA, 22 bp, Homo sapiens
aagtctcagaaaactagtgtgg

SEQ ID NO: 7653775 - DNA, 22 bp, Homo sapiens
aagtctcagaaaactagtgtgg

SEQ ID NO: 7653776 - DNA, 22 bp, Homo sapiens
aagtctagtatccttcttgact

SEQ ID NO: 7653777 - DNA, 22 bp, Homo sapiens
aagtctcatccgtgtagctcca

SEQ ID NO: 7653778 - DNA, 22 bp, Homo sapiens
aagtctaggacaggaagtctat

SEQ ID NO: 7653779 - DNA, 22 bp, Homo sapiens
aagtctagtatccttcttgact

SEQ ID NO: 7653780 - DNA, 22 bp, Homo sapiens
aagtctaaacacatatttaaaa

SEQ ID NO: 7653781 - DNA, 22 bp, Homo sapiens
aagtctaaacacatatttaaaa

SEQ ID NO: 7653782 - DNA, 22 bp, Homo sapiens
aagtctaacctattccggtgtt

SEQ ID NO: 7653783 - DNA, 22 bp, Homo sapiens
aagtctaagtttgtaacttgga

SEQ ID NO: 7653784 - DNA, 22 bp, Homo sapiens
aagtctaagtttgtaacttgga

SEQ ID NO: 7653785 - DNA, 22 bp, Homo sapiens
acgtggagagaatagggcacca

SEQ ID NO: 7653786 - DNA, 22 bp, Homo sapiens
acgtggagccacagatggagca

SEQ ID NO: 7653787 - DNA, 22 bp, Homo sapiens
acgtggagagaatagggcacca

SEQ ID NO: 7653788 - DNA, 22 bp, Homo sapiens
acgtggagagaatagggcacca

SEQ ID NO: 7653789 - DNA, 22 bp, Homo sapiens
acgtgcgtgtgcgcacacatac

SEQ ID NO: 7653790 - DNA, 18 bp, Homo sapiens
acgtgctgtgccttttgc

SEQ ID NO: 7653791 - DNA, 22 bp, Homo sapiens
acgtggagccacagatggagca

SEQ ID NO: 7653792 - DNA, 20 bp, Homo sapiens
acgtggccaccagtggctta

SEQ ID NO: 7653793 - DNA, 20 bp, Homo sapiens
acgtggccaccagtggctta

SEQ ID NO: 7653794 - DNA, 20 bp, Homo sapiens
acgtggccaccagtggctta

SEQ ID NO: 7653795 - DNA, 20 bp, Homo sapiens
acgtggccaccagtggctta

SEQ ID NO: 7653796 - DNA, 20 bp, Homo sapiens
acgtggccaccagtggctta

SEQ ID NO: 7653797 - DNA, 20 bp, Homo sapiens
acgtggccaccagtggctta

SEQ ID NO: 7653798 - DNA, 20 bp, Homo sapiens
acgtggccaccagtggctta

SEQ ID NO: 7653799 - DNA, 20 bp, Homo sapiens
acgtggccaccagtggctta

SEQ ID NO: 7653800 - DNA, 22 bp, Homo sapiens
actacactccaattttctaggt

SEQ ID NO: 7653801 - DNA, 22 bp, Homo sapiens
actacactgccctggggatcaa

SEQ ID NO: 7653802 - DNA, 22 bp, Homo sapiens
actacacagggatgtgactacc

SEQ ID NO: 7653803 - DNA, 22 bp, Homo sapiens
aagtctctttacctctccaggc

SEQ ID NO: 7653804 - DNA, 22 bp, Homo sapiens
aagtctctttacctctccaggc

SEQ ID NO: 7653805 - DNA, 22 bp, Homo sapiens
aagtctctttacctctccaggc

SEQ ID NO: 7653806 - DNA, 22 bp, Homo sapiens
aagtctctttacctctccaggc

SEQ ID NO: 7653807 - DNA, 22 bp, Homo sapiens
aagtctcttcctctgccaaaga

SEQ ID NO: 7653808 - DNA, 22 bp, Homo sapiens
aagtctcttagtaatatccaac

SEQ ID NO: 7653809 - DNA, 22 bp, Homo sapiens
aagtctctggttgcttgcatgg

SEQ ID NO: 7653810 - DNA, 22 bp, Homo sapiens
aagtctctggttgcttgcatgg

SEQ ID NO: 7653811 - DNA, 22 bp, Homo sapiens
aagtctctggtgatgcaggaaa

SEQ ID NO: 7653812 - DNA, 22 bp, Homo sapiens
aagtctctggtgatgcaggaaa

SEQ ID NO: 7653813 - DNA, 22 bp, Homo sapiens
aagtctctgactcacacaatgt

SEQ ID NO: 7653814 - DNA, 22 bp, Homo sapiens
aagtctctggcaaatgatcttg

SEQ ID NO: 7653815 - DNA, 22 bp, Homo sapiens
aagtctctggcaaatgatcttg

SEQ ID NO: 7653816 - DNA, 22 bp, Homo sapiens
aagtctctcatggctgacagca

SEQ ID NO: 7653817 - DNA, 22 bp, Homo sapiens
aagtctctcatggctgacagca

SEQ ID NO: 7653818 - DNA, 22 bp, Homo sapiens
aagtctctcatggctgacagca

SEQ ID NO: 7653819 - DNA, 22 bp, Homo sapiens
aagtctctcatggctgacagca

SEQ ID NO: 7653820 - DNA, 22 bp, Homo sapiens
aagtctctcacatatctggtcc

SEQ ID NO: 7653821 - DNA, 22 bp, Homo sapiens
aagtctctaagactgtgccatc

SEQ ID NO: 7653822 - DNA, 22 bp, Homo sapiens
actctcccacgttcgactctaa

SEQ ID NO: 7653823 - DNA, 22 bp, Homo sapiens
actctcccacgttcgactctaa

SEQ ID NO: 7653824 - DNA, 22 bp, Homo sapiens
actctcccacgttcgactctaa

SEQ ID NO: 7653825 - DNA, 22 bp, Homo sapiens
actctccctgagagggaggcat

SEQ ID NO: 7653826 - DNA, 22 bp, Homo sapiens
actctcccagctatatgtggtg

SEQ ID NO: 7653827 - DNA, 22 bp, Homo sapiens
actctcccagctatatgtggtg

SEQ ID NO: 7653828 - DNA, 22 bp, Homo sapiens
actctcccagctatatgtggtg

SEQ ID NO: 7653829 - DNA, 22 bp, Homo sapiens
actctccctgctatccacttcc

SEQ ID NO: 7653830 - DNA, 22 bp, Homo sapiens
actctccctgctatccacttcc

SEQ ID NO: 7653831 - DNA, 22 bp, Homo sapiens
actctccctgctatccacttcc

SEQ ID NO: 7653832 - DNA, 22 bp, Homo sapiens
actctccctgagagggaggcat

SEQ ID NO: 7653833 - DNA, 22 bp, Homo sapiens
actctccctgctatccacttcc

SEQ ID NO: 7653834 - DNA, 22 bp, Homo sapiens
actctattgctgcttgatgtga

SEQ ID NO: 7653835 - DNA, 22 bp, Homo sapiens
actctcaaaaagagtagcagtt

SEQ ID NO: 7653836 - DNA, 22 bp, Homo sapiens
actctcaaatattaatctttgg

SEQ ID NO: 7653837 - DNA, 22 bp, Homo sapiens
actctcaatgtggttaatccaa

SEQ ID NO: 7653838 - DNA, 22 bp, Homo sapiens
actctcagagggtggcagcaat

SEQ ID NO: 7653839 - DNA, 22 bp, Homo sapiens
actctcagagggtggcagcaat

SEQ ID NO: 7653840 - DNA, 22 bp, Homo sapiens
actctcactgcttggctcctgc

SEQ ID NO: 7653841 - DNA, 22 bp, Homo sapiens
actctcagggacagggtctggg

SEQ ID NO: 7653842 - DNA, 22 bp, Homo sapiens
actctcagggacagggtctggg

SEQ ID NO: 7653843 - DNA, 22 bp, Homo sapiens
actctcagggctccagggaaag

SEQ ID NO: 7653844 - DNA, 23 bp, Homo sapiens
actctcaggttctttccagcagg

SEQ ID NO: 7653845 - DNA, 23 bp, Homo sapiens
actctcaggttctttccagcagg

SEQ ID NO: 7653846 - DNA, 22 bp, Homo sapiens
actctccagggatttaggatgg

SEQ ID NO: 7653847 - DNA, 23 bp, Homo sapiens
actctcaggttctttccagcagg

SEQ ID NO: 7653848 - DNA, 22 bp, Homo sapiens
actctccacccactcactctgt

SEQ ID NO: 7653849 - DNA, 22 bp, Homo sapiens
actctccacccactcactctgt

SEQ ID NO: 7653850 - DNA, 22 bp, Homo sapiens
actcagagaacattcccagtct

SEQ ID NO: 7653851 - DNA, 22 bp, Homo sapiens
actcagagaaacagcagggtgt

SEQ ID NO: 7653852 - DNA, 22 bp, Homo sapiens
actcagacttgcttcctggtgc

SEQ ID NO: 7653853 - DNA, 22 bp, Homo sapiens
actcagagaaacagcagggtgt

SEQ ID NO: 7653854 - DNA, 22 bp, Homo sapiens
actcagagaaacagcagggtgt

SEQ ID NO: 7653855 - DNA, 22 bp, Homo sapiens
actcagagaaacagcagggtgt

SEQ ID NO: 7653856 - DNA, 22 bp, Homo sapiens
actcagacatgccttttacttc

SEQ ID NO: 7653857 - DNA, 22 bp, Homo sapiens
actcagacagaccaaagttctg

SEQ ID NO: 7653858 - DNA, 22 bp, Homo sapiens
actcagacgaaaacatgaacat

SEQ ID NO: 7653859 - DNA, 22 bp, Homo sapiens
actcagactataagcttatttt

SEQ ID NO: 7653860 - DNA, 22 bp, Homo sapiens
actcagactataagcttatttt

SEQ ID NO: 7653861 - DNA, 22 bp, Homo sapiens
actcagagaatatctagaagga

SEQ ID NO: 7653862 - DNA, 22 bp, Homo sapiens
actcagagaactggattagagg

SEQ ID NO: 7653863 - DNA, 22 bp, Homo sapiens
actcagagaatatctagaagga

SEQ ID NO: 7653864 - DNA, 22 bp, Homo sapiens
actcagagaatatctagaagga

SEQ ID NO: 7653865 - DNA, 22 bp, Homo sapiens
actcagagaatatctagaagga

SEQ ID NO: 7653866 - DNA, 23 bp, Homo sapiens
actcagagaccccgggaagtgac

SEQ ID NO: 7653867 - DNA, 23 bp, Homo sapiens
actcagagaccccgggaagtgac

SEQ ID NO: 7653868 - DNA, 23 bp, Homo sapiens
actcagagaccccgggaagtgac

SEQ ID NO: 7653869 - DNA, 22 bp, Homo sapiens
actctaaattgtgccaatatgc

SEQ ID NO: 7653870 - DNA, 22 bp, Homo sapiens
actctaaattgtgccaatatgc

SEQ ID NO: 7653871 - DNA, 22 bp, Homo sapiens
actccctccaaatctgcacagt

SEQ ID NO: 7653872 - DNA, 22 bp, Homo sapiens
actccctccaaatctgcacagt

SEQ ID NO: 7653873 - DNA, 22 bp, Homo sapiens
actccctccaaatctgcacagt

SEQ ID NO: 7653874 - DNA, 22 bp, Homo sapiens
actccctccaaatctgcacagt

SEQ ID NO: 7653875 - DNA, 23 bp, Homo sapiens
actccccagtctcttcttgccaa

SEQ ID NO: 7653876 - DNA, 22 bp, Homo sapiens
actccctcaagtcactttagtt

SEQ ID NO: 7653877 - DNA, 23 bp, Homo sapiens
actccccagtctcttcttgccaa

SEQ ID NO: 7653878 - DNA, 22 bp, Homo sapiens
actctacagaatgaatacctgt

SEQ ID NO: 7653879 - DNA, 19 bp, Homo sapiens
actctacagtgtgtacaac

SEQ ID NO: 7653880 - DNA, 22 bp, Homo sapiens
actctacagaatgaatacctgt

SEQ ID NO: 7653881 - DNA, 22 bp, Homo sapiens
actctaccatgccactccatag

SEQ ID NO: 7653882 - DNA, 20 bp, Homo sapiens
actctaccagggcagcagca

SEQ ID NO: 7653883 - DNA, 19 bp, Homo sapiens
actctacagtgtgtacaac

SEQ ID NO: 7653884 - DNA, 22 bp, Homo sapiens
actagttttccataatatagga

SEQ ID NO: 7653885 - DNA, 22 bp, Homo sapiens
actagttttccataatatagga

SEQ ID NO: 7653886 - DNA, 22 bp, Homo sapiens
actagttttccataatatagga

SEQ ID NO: 7653887 - DNA, 22 bp, Homo sapiens
actagtttgagtaattgtaatg

SEQ ID NO: 7653888 - DNA, 22 bp, Homo sapiens
actagttttcaggcatgtctgg

SEQ ID NO: 7653889 - DNA, 22 bp, Homo sapiens
actagttttcaggcatgtctgg

SEQ ID NO: 7653890 - DNA, 22 bp, Homo sapiens
actacagaagtcttattagaga

SEQ ID NO: 7653891 - DNA, 22 bp, Homo sapiens
actacagaagtcttattagaga

SEQ ID NO: 7653892 - DNA, 22 bp, Homo sapiens
actagtttgaaaatatctgatt

SEQ ID NO: 7653893 - DNA, 22 bp, Homo sapiens
actagtttgaaaatatctgatt

SEQ ID NO: 7653894 - DNA, 22 bp, Homo sapiens
actagtttgaaaatatctgatt

SEQ ID NO: 7653895 - DNA, 22 bp, Homo sapiens
actataaaaggataaaccagaa

SEQ ID NO: 7653896 - DNA, 22 bp, Homo sapiens
actataaaaggataaaccagaa

SEQ ID NO: 7653897 - DNA, 22 bp, Homo sapiens
actataaaaggataaaccagaa

SEQ ID NO: 7653898 - DNA, 22 bp, Homo sapiens
actagtttttcctctgtcctgt

SEQ ID NO: 7653899 - DNA, 22 bp, Homo sapiens
actataaaaggataaaccagaa

SEQ ID NO: 7653900 - DNA, 22 bp, Homo sapiens
actataaaaggataaaccagaa

SEQ ID NO: 7653901 - DNA, 22 bp, Homo sapiens
actataaaaggataaaccagaa

SEQ ID NO: 7653902 - DNA, 22 bp, Homo sapiens
actataaaaggataaaccagaa

SEQ ID NO: 7653903 - DNA, 22 bp, Homo sapiens
actatacaccaaaatattaagg

SEQ ID NO: 7653904 - DNA, 22 bp, Homo sapiens
actatacagaagaggataggaa

SEQ ID NO: 7653905 - DNA, 22 bp, Homo sapiens
actatacaccaaaatattaagg

SEQ ID NO: 7653906 - DNA, 22 bp, Homo sapiens
actatacaccaaaatattaagg

SEQ ID NO: 7653907 - DNA, 22 bp, Homo sapiens
actatacaccaaaatattaagg

SEQ ID NO: 7653908 - DNA, 22 bp, Homo sapiens
actatacaccaaaatattaagg

SEQ ID NO: 7653909 - DNA, 22 bp, Homo sapiens
actatacaccaaaatattaagg

SEQ ID NO: 7653910 - DNA, 22 bp, Homo sapiens
actatacaccaaaatattaagg

SEQ ID NO: 7653911 - DNA, 22 bp, Homo sapiens
actataacctgttagaatagat

SEQ ID NO: 7653912 - DNA, 22 bp, Homo sapiens
actatacaagattagggatttg

SEQ ID NO: 7653913 - DNA, 22 bp, Homo sapiens
actataacctgttagaatagat

SEQ ID NO: 7653914 - DNA, 22 bp, Homo sapiens
actataacccatggaatataag

SEQ ID NO: 7653915 - DNA, 22 bp, Homo sapiens
actataacccatggaatataag

SEQ ID NO: 7653916 - DNA, 23 bp, Homo sapiens
actataaagttgttctgatttac

SEQ ID NO: 7653917 - DNA, 22 bp, Homo sapiens
actataacccatggaatataag

SEQ ID NO: 7653918 - DNA, 23 bp, Homo sapiens
actataaagttgttctgatttac

SEQ ID NO: 7653919 - DNA, 23 bp, Homo sapiens
actataaagttgttctgatttac

SEQ ID NO: 7653920 - DNA, 23 bp, Homo sapiens
actataaagttgttctgatttac

SEQ ID NO: 7653921 - DNA, 23 bp, Homo sapiens
actataaagttgttctgatttac

SEQ ID NO: 7653922 - DNA, 23 bp, Homo sapiens
actataaagttgttctgatttac

SEQ ID NO: 7653923 - DNA, 22 bp, Homo sapiens
actcactcttaatcagactccc

SEQ ID NO: 7653924 - DNA, 22 bp, Homo sapiens
actcactctttcaattgaaaga

SEQ ID NO: 7653925 - DNA, 22 bp, Homo sapiens
actcactgcactttgaaatgtg

SEQ ID NO: 7653926 - DNA, 22 bp, Homo sapiens
actcactcttaatcagactccc

SEQ ID NO: 7653927 - DNA, 22 bp, Homo sapiens
actcactgcactttgaaatgtg

SEQ ID NO: 7653928 - DNA, 22 bp, Homo sapiens
actcaccacagagcagggaacc

SEQ ID NO: 7653929 - DNA, 22 bp, Homo sapiens
actatacataaaacatttgggt

SEQ ID NO: 7653930 - DNA, 22 bp, Homo sapiens
actatacattgaatgttaaggt

SEQ ID NO: 7653931 - DNA, 22 bp, Homo sapiens
actatacattgaatgttaaggt

SEQ ID NO: 7653932 - DNA, 22 bp, Homo sapiens
actatacattgaatgttaaggt

SEQ ID NO: 7653933 - DNA, 22 bp, Homo sapiens
actatacagtatgtacgtgcac

SEQ ID NO: 7653934 - DNA, 22 bp, Homo sapiens
actatacagtatgtacgtgcac

SEQ ID NO: 7653935 - DNA, 22 bp, Homo sapiens
actatacagtatgtacgtgcac

SEQ ID NO: 7653936 - DNA, 22 bp, Homo sapiens
actatacagtatgtacgtgcac

SEQ ID NO: 7653937 - DNA, 22 bp, Homo sapiens
actatacagtatgtacgtgcac

SEQ ID NO: 7653938 - DNA, 22 bp, Homo sapiens
actatacataaaacatttgggt

SEQ ID NO: 7653939 - DNA, 22 bp, Homo sapiens
actatacattgaatgttaaggt

SEQ ID NO: 7653940 - DNA, 22 bp, Homo sapiens
actatacataaaacatttgggt

SEQ ID NO: 7653941 - DNA, 22 bp, Homo sapiens
actcactgggtcccggaagccc

SEQ ID NO: 7653942 - DNA, 22 bp, Homo sapiens
actcactgggtcccggaagccc

SEQ ID NO: 7653943 - DNA, 22 bp, Homo sapiens
actcagaaccatttactctgag

SEQ ID NO: 7653944 - DNA, 22 bp, Homo sapiens
actcagaaccatttactctgag

SEQ ID NO: 7653945 - DNA, 22 bp, Homo sapiens
actcagaagatataatgactca

SEQ ID NO: 7653946 - DNA, 22 bp, Homo sapiens
actcagaagatataatgactca

SEQ ID NO: 7653947 - DNA, 22 bp, Homo sapiens
actcagaatgactgatgctgtg

SEQ ID NO: 7653948 - DNA, 22 bp, Homo sapiens
actcagaatgactgatgctgtg

SEQ ID NO: 7653949 - DNA, 22 bp, Homo sapiens
actcagaagatgtgggtagata

SEQ ID NO: 7653950 - DNA, 22 bp, Homo sapiens
actcagaagatataatgactca

SEQ ID NO: 7653951 - DNA, 22 bp, Homo sapiens
actcagaagatgtgggtagata

SEQ ID NO: 7653952 - DNA, 22 bp, Homo sapiens
actcagaagatataatgactca

SEQ ID NO: 7653953 - DNA, 22 bp, Homo sapiens
actcagaagatataatgactca

SEQ ID NO: 7653954 - DNA, 22 bp, Homo sapiens
actcagacagaccaaagttctg

SEQ ID NO: 7653955 - DNA, 22 bp, Homo sapiens
actcagaatgtcactgagggac

SEQ ID NO: 7653956 - DNA, 22 bp, Homo sapiens
actcagaatgactgatgctgtg

SEQ ID NO: 7653957 - DNA, 22 bp, Homo sapiens
actcagaatgtcactgagggac

SEQ ID NO: 7653958 - DNA, 22 bp, Homo sapiens
actcagaatgtcactgagggac

SEQ ID NO: 7653959 - DNA, 22 bp, Homo sapiens
actcagaatgactgatgctgtg

SEQ ID NO: 7653960 - DNA, 22 bp, Homo sapiens
aaggaggcactcgctctcaggg

SEQ ID NO: 7653961 - DNA, 22 bp, Homo sapiens
aaggaggcagaactcacatgga

SEQ ID NO: 7653962 - DNA, 22 bp, Homo sapiens
aaggaggcagaactcacatgga

SEQ ID NO: 7653963 - DNA, 22 bp, Homo sapiens
aaggaggcactcgctctcaggg

SEQ ID NO: 7653964 - DNA, 22 bp, Homo sapiens
aaggaggcagaactcacatgga

SEQ ID NO: 7653965 - DNA, 22 bp, Homo sapiens
aaggaggcactcgctctcaggg

SEQ ID NO: 7653966 - DNA, 22 bp, Homo sapiens
acatagaacctggcacatagta

SEQ ID NO: 7653967 - DNA, 22 bp, Homo sapiens
acatagaacctggcacatagta

SEQ ID NO: 7653968 - DNA, 22 bp, Homo sapiens
acatagaacctggcacatagta

SEQ ID NO: 7653969 - DNA, 22 bp, Homo sapiens
acatatgaggtgttattctatg

SEQ ID NO: 7653970 - DNA, 20 bp, Homo sapiens
acatatgaatgatagagcca

SEQ ID NO: 7653971 - DNA, 20 bp, Homo sapiens
acatatgaatgatagagcca

SEQ ID NO: 7653972 - DNA, 22 bp, Homo sapiens
acatatctgttagacacagcag

SEQ ID NO: 7653973 - DNA, 22 bp, Homo sapiens
acatagaacctggcacatagta

SEQ ID NO: 7653974 - DNA, 20 bp, Homo sapiens
acatatgaatgatagagcca

SEQ ID NO: 7653975 - DNA, 22 bp, Homo sapiens
acatatctgttagacacagcag

SEQ ID NO: 7653976 - DNA, 22 bp, Homo sapiens
aaggaggagcggaggcttgttg

SEQ ID NO: 7653977 - DNA, 22 bp, Homo sapiens
aaggaggagcggaggcttgttg

SEQ ID NO: 7653978 - DNA, 22 bp, Homo sapiens
aaggaggagtggggtcctggaa

SEQ ID NO: 7653979 - DNA, 22 bp, Homo sapiens
aaggaggagtggggtcctggaa

SEQ ID NO: 7653980 - DNA, 22 bp, Homo sapiens
aaggaggagtggggtcctggaa

SEQ ID NO: 7653981 - DNA, 22 bp, Homo sapiens
aaggaggagtggggtcctggaa

SEQ ID NO: 7653982 - DNA, 22 bp, Homo sapiens
aaggaggagtggggtcctggaa

SEQ ID NO: 7653983 - DNA, 22 bp, Homo sapiens
aaggaggcaccctgagcctgcc

SEQ ID NO: 7653984 - DNA, 22 bp, Homo sapiens
aaggaggcactcgctctcaggg

SEQ ID NO: 7653985 - DNA, 22 bp, Homo sapiens
aaggaggcaccctgagcctgcc

SEQ ID NO: 7653986 - DNA, 22 bp, Homo sapiens
aaggaggcaccctgagcctgcc

SEQ ID NO: 7653987 - DNA, 22 bp, Homo sapiens
aaggaggcaccctgagcctgcc

SEQ ID NO: 7653988 - DNA, 22 bp, Homo sapiens
aaggaggacacccaggactggg

SEQ ID NO: 7653989 - DNA, 22 bp, Homo sapiens
aaggaggacacccaggactggg

SEQ ID NO: 7653990 - DNA, 22 bp, Homo sapiens
aaggaggacacccaggactggg

SEQ ID NO: 7653991 - DNA, 22 bp, Homo sapiens
aaggaggagattagtgtttagg

SEQ ID NO: 7653992 - DNA, 22 bp, Homo sapiens
aaggaggacacccaggactggg

SEQ ID NO: 7653993 - DNA, 22 bp, Homo sapiens
aaggaggagattagtgtttagg

SEQ ID NO: 7653994 - DNA, 22 bp, Homo sapiens
aaggaggagcggaggcttgttg

SEQ ID NO: 7653995 - DNA, 22 bp, Homo sapiens
aaggaggagcggaggcttgttg

SEQ ID NO: 7653996 - DNA, 22 bp, Homo sapiens
aaggaggaatttcagggtgaat

SEQ ID NO: 7653997 - DNA, 22 bp, Homo sapiens
aaggaggaatttcagggtgaat

SEQ ID NO: 7653998 - DNA, 22 bp, Homo sapiens
aaggaggaatttcagggtgaat

SEQ ID NO: 7653999 - DNA, 22 bp, Homo sapiens
aaggaggaatttcagggtgaat

SEQ ID NO: 7654000 - DNA, 22 bp, Homo sapiens
aaggaggaattctgagttcatg

SEQ ID NO: 7654001 - DNA, 22 bp, Homo sapiens
aaggaggaattctgagttcatg

SEQ ID NO: 7654002 - DNA, 22 bp, Homo sapiens
aaggaggaattctgagttcatg

SEQ ID NO: 7654003 - DNA, 22 bp, Homo sapiens
aaggaggaatttcagggtgaat

SEQ ID NO: 7654004 - DNA, 22 bp, Homo sapiens
aaggaggaatttcagggtgaat

SEQ ID NO: 7654005 - DNA, 22 bp, Homo sapiens
aaggaggacacccaggactggg

SEQ ID NO: 7654006 - DNA, 22 bp, Homo sapiens
aaggaggacacccaggactggg

SEQ ID NO: 7654007 - DNA, 22 bp, Homo sapiens
aaggaggacacccaggactggg

SEQ ID NO: 7654008 - DNA, 22 bp, Homo sapiens
aaggaggacacccaggactggg

SEQ ID NO: 7654009 - DNA, 22 bp, Homo sapiens
aaggaggaatttcagggtgaat

SEQ ID NO: 7654010 - DNA, 22 bp, Homo sapiens
aaggaggaatttcagggtgaat

SEQ ID NO: 7654011 - DNA, 22 bp, Homo sapiens
aaggaggaatgtagccagctcc

SEQ ID NO: 7654012 - DNA, 22 bp, Homo sapiens
aaggaggaataaagaggtggtg

SEQ ID NO: 7654013 - DNA, 22 bp, Homo sapiens
aaggaggaatgtagccagctcc

SEQ ID NO: 7654014 - DNA, 22 bp, Homo sapiens
aaggaggaatgtagccagctcc

SEQ ID NO: 7654015 - DNA, 22 bp, Homo sapiens
acagtgtttggcaatgcatgca

SEQ ID NO: 7654016 - DNA, 22 bp, Homo sapiens
acagtgtttggcaatgcatgca

SEQ ID NO: 7654017 - DNA, 22 bp, Homo sapiens
acagtgtttcacttaaccgttt

SEQ ID NO: 7654018 - DNA, 22 bp, Homo sapiens
acagtgtttggcaatgcatgca

SEQ ID NO: 7654019 - DNA, 22 bp, Homo sapiens
acagtgtttatgtacagattgt

SEQ ID NO: 7654020 - DNA, 22 bp, Homo sapiens
acagtgtttatgtacagattgt

SEQ ID NO: 7654021 - DNA, 22 bp, Homo sapiens
acagtgtttaagagatggcatt

SEQ ID NO: 7654022 - DNA, 22 bp, Homo sapiens
acagtgtttatgtacagattgt

SEQ ID NO: 7654023 - DNA, 22 bp, Homo sapiens
acagtgtttatgtacagattgt

SEQ ID NO: 7654024 - DNA, 22 bp, Homo sapiens
acagtgtttatgtacagattgt

SEQ ID NO: 7654025 - DNA, 22 bp, Homo sapiens
acagtgtttatgtacagattgt

SEQ ID NO: 7654026 - DNA, 22 bp, Homo sapiens
acagtgtttatgtacagattgt

SEQ ID NO: 7654027 - DNA, 22 bp, Homo sapiens
acatatgttgtaaacattccaa

SEQ ID NO: 7654028 - DNA, 22 bp, Homo sapiens
aaggcagagattagcagaatga

SEQ ID NO: 7654029 - DNA, 22 bp, Homo sapiens
aaggcagagattagcagaatga

SEQ ID NO: 7654030 - DNA, 22 bp, Homo sapiens
aaggcagagattagcagaatga

SEQ ID NO: 7654031 - DNA, 22 bp, Homo sapiens
aaggcagaggaaggtctagttt

SEQ ID NO: 7654032 - DNA, 22 bp, Homo sapiens
aaggcagaggaaggtctagttt

SEQ ID NO: 7654033 - DNA, 22 bp, Homo sapiens
aaggcagaggaaggtctagttt

SEQ ID NO: 7654034 - DNA, 22 bp, Homo sapiens
aaggcagaggaaggtctagttt

SEQ ID NO: 7654035 - DNA, 22 bp, Homo sapiens
aaggcagaggaaggtctagttt

SEQ ID NO: 7654036 - DNA, 22 bp, Homo sapiens
aaggcagagattagcagaatga

SEQ ID NO: 7654037 - DNA, 22 bp, Homo sapiens
acatatgtgttgtacatgcatg

SEQ ID NO: 7654038 - DNA, 22 bp, Homo sapiens
acatatgtgttgtacatgcatg

SEQ ID NO: 7654039 - DNA, 22 bp, Homo sapiens
acatatgtgttgtacatgcatg

SEQ ID NO: 7654040 - DNA, 22 bp, Homo sapiens
acatatgtgttgtacatgcatg

SEQ ID NO: 7654041 - DNA, 22 bp, Homo sapiens
aaggcagagattagcagaatga

SEQ ID NO: 7654042 - DNA, 22 bp, Homo sapiens
aaggcagagattagcagaatga

SEQ ID NO: 7654043 - DNA, 22 bp, Homo sapiens
aaggcagagattagcagaatga

SEQ ID NO: 7654044 - DNA, 22 bp, Homo sapiens
acatatgtgttgtacatgcatg

SEQ ID NO: 7654045 - DNA, 22 bp, Homo sapiens
acatatgtgttgtacatgcatg

SEQ ID NO: 7654046 - DNA, 22 bp, Homo sapiens
acatatgttgtaaacattccaa

SEQ ID NO: 7654047 - DNA, 22 bp, Homo sapiens
acatatgttgtaaacattccaa

SEQ ID NO: 7654048 - DNA, 22 bp, Homo sapiens
aaggcagagtctatcttggaag

SEQ ID NO: 7654049 - DNA, 22 bp, Homo sapiens
aaggcagagtctatcttggaag

SEQ ID NO: 7654050 - DNA, 22 bp, Homo sapiens
aaggcagagtctatcttggaag

SEQ ID NO: 7654051 - DNA, 22 bp, Homo sapiens
aaggcagagtctatcttggaag

SEQ ID NO: 7654052 - DNA, 22 bp, Homo sapiens
aaggcagagtctatcttggaag

SEQ ID NO: 7654053 - DNA, 22 bp, Homo sapiens
aaggcagagggctggatcagag

SEQ ID NO: 7654054 - DNA, 22 bp, Homo sapiens
aaggcagagggctggatcagag

SEQ ID NO: 7654055 - DNA, 22 bp, Homo sapiens
aaggcagagggctggatcagag

SEQ ID NO: 7654056 - DNA, 22 bp, Homo sapiens
aaggcagagggctggatcagag

SEQ ID NO: 7654057 - DNA, 22 bp, Homo sapiens
aaggcagagggctggatcagag

SEQ ID NO: 7654058 - DNA, 22 bp, Homo sapiens
aaggcagaggaaggtctagttt

SEQ ID NO: 7654059 - DNA, 22 bp, Homo sapiens
aaggcagagggctggatcagag

SEQ ID NO: 7654060 - DNA, 22 bp, Homo sapiens
aaggcagagggctggatcagag

SEQ ID NO: 7654061 - DNA, 22 bp, Homo sapiens
aaggcagagggctggatcagag

SEQ ID NO: 7654062 - DNA, 22 bp, Homo sapiens
acatatgcgatcataggatgca

SEQ ID NO: 7654063 - DNA, 22 bp, Homo sapiens
acatatgcgatcataggatgca

SEQ ID NO: 7654064 - DNA, 22 bp, Homo sapiens
acatatgctcatctgcattccc

SEQ ID NO: 7654065 - DNA, 22 bp, Homo sapiens
acatatgcgatcataggatgca

SEQ ID NO: 7654066 - DNA, 22 bp, Homo sapiens
acatatgcgatcataggatgca

SEQ ID NO: 7654067 - DNA, 22 bp, Homo sapiens
acatatgtatatgtacacagtc

SEQ ID NO: 7654068 - DNA, 22 bp, Homo sapiens
acatatgctcatctgcattccc

SEQ ID NO: 7654069 - DNA, 22 bp, Homo sapiens
acatatgtatatgtacacagtc

SEQ ID NO: 7654070 - DNA, 22 bp, Homo sapiens
acatatgtatatgtacacagtc

SEQ ID NO: 7654071 - DNA, 22 bp, Homo sapiens
acatatgtatatgtacacagtc

SEQ ID NO: 7654072 - DNA, 22 bp, Homo sapiens
acatatgagtactatacagtgc

SEQ ID NO: 7654073 - DNA, 22 bp, Homo sapiens
acatatgagtactatacagtgc

SEQ ID NO: 7654074 - DNA, 22 bp, Homo sapiens
acatatgagtactatacagtgc

SEQ ID NO: 7654075 - DNA, 22 bp, Homo sapiens
acatatgagtactatacagtgc

SEQ ID NO: 7654076 - DNA, 22 bp, Homo sapiens
acatatgatattgaggatctca

SEQ ID NO: 7654077 - DNA, 22 bp, Homo sapiens
acatatgatattgaggatctca

SEQ ID NO: 7654078 - DNA, 22 bp, Homo sapiens
acatatgcatacccaaagcagt

SEQ ID NO: 7654079 - DNA, 20 bp, Homo sapiens
acatatgtgtgcatatcttt

SEQ ID NO: 7654080 - DNA, 22 bp, Homo sapiens
acatatgtgttgtacatgcatg

SEQ ID NO: 7654081 - DNA, 22 bp, Homo sapiens
acatatgtgttgtacatgcatg

SEQ ID NO: 7654082 - DNA, 19 bp, Homo sapiens
acatatgtggatatacatg

SEQ ID NO: 7654083 - DNA, 19 bp, Homo sapiens
acatatgtggatatacatg

SEQ ID NO: 7654084 - DNA, 22 bp, Homo sapiens
acatatgtctatttcatgtaaa

SEQ ID NO: 7654085 - DNA, 19 bp, Homo sapiens
acatatgtggatatacatg

SEQ ID NO: 7654086 - DNA, 22 bp, Homo sapiens
acatatgtgtctgcacatgccc

SEQ ID NO: 7654087 - DNA, 22 bp, Homo sapiens
acatatgtatatgtacacagtc

SEQ ID NO: 7654088 - DNA, 22 bp, Homo sapiens
acatatgtctatttcatgtaaa

SEQ ID NO: 7654089 - DNA, 22 bp, Homo sapiens
acatatgtgcttatatccatga

SEQ ID NO: 7654090 - DNA, 22 bp, Homo sapiens
acatatgtgcttatatccatga

SEQ ID NO: 7654091 - DNA, 22 bp, Homo sapiens
acatatgtgcttatatccatga

SEQ ID NO: 7654092 - DNA, 19 bp, Homo sapiens
acatatgtggatatacatg

SEQ ID NO: 7654093 - DNA, 19 bp, Homo sapiens
acatatgtggatatacatg

SEQ ID NO: 7654094 - DNA, 19 bp, Homo sapiens
acatatgtggatatacatg

SEQ ID NO: 7654095 - DNA, 19 bp, Homo sapiens
acatatgtggatatacatg

SEQ ID NO: 7654096 - DNA, 19 bp, Homo sapiens
acatatgtggatatacatg

SEQ ID NO: 7654097 - DNA, 22 bp, Homo sapiens
acatatgtgcttatatccatga

SEQ ID NO: 7654098 - DNA, 22 bp, Homo sapiens
acagtcttgagcatcagccaga

SEQ ID NO: 7654099 - DNA, 22 bp, Homo sapiens
acagtcttgagcatcagccaga

SEQ ID NO: 7654100 - DNA, 22 bp, Homo sapiens
acagtcttgagcatcagccaga

SEQ ID NO: 7654101 - DNA, 22 bp, Homo sapiens
acagtcttcatgctagaatggc

SEQ ID NO: 7654102 - DNA, 22 bp, Homo sapiens
acagtcttcatgctagaatggc

SEQ ID NO: 7654103 - DNA, 22 bp, Homo sapiens
acagtcttcatgctagaatggc

SEQ ID NO: 7654104 - DNA, 22 bp, Homo sapiens
acagtcttcccttattccactc

SEQ ID NO: 7654105 - DNA, 22 bp, Homo sapiens
acagtcttgctgtatggtcagg

SEQ ID NO: 7654106 - DNA, 22 bp, Homo sapiens
acagtcttgcacttctatcagc

SEQ ID NO: 7654107 - DNA, 22 bp, Homo sapiens
acagtcttgcacttctatcagc

SEQ ID NO: 7654108 - DNA, 22 bp, Homo sapiens
acagtcttgcacttctatcagc

SEQ ID NO: 7654109 - DNA, 22 bp, Homo sapiens
acagtcttgcacttctatcagc

SEQ ID NO: 7654110 - DNA, 22 bp, Homo sapiens
acagtctttaatttctttgtgg

SEQ ID NO: 7654111 - DNA, 22 bp, Homo sapiens
acagtcttgctgtatggtcagg

SEQ ID NO: 7654112 - DNA, 22 bp, Homo sapiens
acagtcttgctgtatggtcagg

SEQ ID NO: 7654113 - DNA, 22 bp, Homo sapiens
acagtcttgctgtatggtcagg

SEQ ID NO: 7654114 - DNA, 22 bp, Homo sapiens
acagtctttaatttctttgtgg

SEQ ID NO: 7654115 - DNA, 22 bp, Homo sapiens
acagtctttaatttctttgtgg

SEQ ID NO: 7654116 - DNA, 22 bp, Homo sapiens
acagtctttaatttctttgtgg

SEQ ID NO: 7654117 - DNA, 22 bp, Homo sapiens
acagtctttaatttctttgtgg

SEQ ID NO: 7654118 - DNA, 22 bp, Homo sapiens
aaggaggaataaagaggtggtg

SEQ ID NO: 7654119 - DNA, 22 bp, Homo sapiens
acagtctgtcccccaggtgcta

SEQ ID NO: 7654120 - DNA, 22 bp, Homo sapiens
aaggaggaataaagaggtggtg

SEQ ID NO: 7654121 - DNA, 22 bp, Homo sapiens
aaggaggaataaagaggtggtg

SEQ ID NO: 7654122 - DNA, 22 bp, Homo sapiens
aaggaggaataaagaggtggtg

SEQ ID NO: 7654123 - DNA, 22 bp, Homo sapiens
aaggaggaataaagaggtggtg

SEQ ID NO: 7654124 - DNA, 22 bp, Homo sapiens
aaggaggaataaagaggtggtg

SEQ ID NO: 7654125 - DNA, 19 bp, Homo sapiens
acagtcttacaaatgtcca

SEQ ID NO: 7654126 - DNA, 19 bp, Homo sapiens
acagtcttacaaatgtcca

SEQ ID NO: 7654127 - DNA, 19 bp, Homo sapiens
acagtcttacaaatgtcca

SEQ ID NO: 7654128 - DNA, 22 bp, Homo sapiens
acagtcttaatggataggagct

SEQ ID NO: 7654129 - DNA, 19 bp, Homo sapiens
acagtcttacaaatgtcca

SEQ ID NO: 7654130 - DNA, 22 bp, Homo sapiens
aaggaggaataaagaggtggtg

SEQ ID NO: 7654131 - DNA, 22 bp, Homo sapiens
acagtcttaatggataggagct

SEQ ID NO: 7654132 - DNA, 22 bp, Homo sapiens
acagtcttaatggataggagct

SEQ ID NO: 7654133 - DNA, 22 bp, Homo sapiens
acagtcttaatggataggagct

SEQ ID NO: 7654134 - DNA, 22 bp, Homo sapiens
acagtcttatgcatacactatt

SEQ ID NO: 7654135 - DNA, 22 bp, Homo sapiens
acagtcttatgcatacactatt

SEQ ID NO: 7654136 - DNA, 22 bp, Homo sapiens
acagtcttatgcatacactatt

SEQ ID NO: 7654137 - DNA, 22 bp, Homo sapiens
acagtcttatgcatacactatt

SEQ ID NO: 7654138 - DNA, 22 bp, Homo sapiens
acagtcttatgcatacactatt

SEQ ID NO: 7654139 - DNA, 22 bp, Homo sapiens
acagtcttatgcatacactatt

SEQ ID NO: 7654140 - DNA, 22 bp, Homo sapiens
acagtctttcagtaataatact

SEQ ID NO: 7654141 - DNA, 22 bp, Homo sapiens
acagtctttcagtaataatact

SEQ ID NO: 7654142 - DNA, 22 bp, Homo sapiens
acagtctttcagtaataatact

SEQ ID NO: 7654143 - DNA, 22 bp, Homo sapiens
acagtctttcagtaataatact

SEQ ID NO: 7654144 - DNA, 22 bp, Homo sapiens
acagtctttagagtattgtcct

SEQ ID NO: 7654145 - DNA, 22 bp, Homo sapiens
acagtctttctacattctgtgc

SEQ ID NO: 7654146 - DNA, 22 bp, Homo sapiens
acagtctttaatttctttgtgg

SEQ ID NO: 7654147 - DNA, 22 bp, Homo sapiens
acagtctttaatttctttgtgg

SEQ ID NO: 7654148 - DNA, 22 bp, Homo sapiens
acagtctttagagtattgtcct

SEQ ID NO: 7654149 - DNA, 22 bp, Homo sapiens
acagtctttagagtattgtcct

SEQ ID NO: 7654150 - DNA, 22 bp, Homo sapiens
acagtctttagagtattgtcct

SEQ ID NO: 7654151 - DNA, 17 bp, Homo sapiens
acagtgtctatgaaatg

SEQ ID NO: 7654152 - DNA, 17 bp, Homo sapiens
acagtgtctatgaaatg

SEQ ID NO: 7654153 - DNA, 17 bp, Homo sapiens
acagtgtctatgaaatg

SEQ ID NO: 7654154 - DNA, 16 bp, Homo sapiens
acagtgtctcaagcac

SEQ ID NO: 7654155 - DNA, 16 bp, Homo sapiens
acagtgtctcaagcac

SEQ ID NO: 7654156 - DNA, 22 bp, Homo sapiens
acagtgtctcactgctgaaatc

SEQ ID NO: 7654157 - DNA, 22 bp, Homo sapiens
acagtgttcttgatattacagt

SEQ ID NO: 7654158 - DNA, 22 bp, Homo sapiens
acagtgttcttgatattacagt

SEQ ID NO: 7654159 - DNA, 22 bp, Homo sapiens
acagtgttcttgatattacagt

SEQ ID NO: 7654160 - DNA, 22 bp, Homo sapiens
acagtgtctcactgctgaaatc

SEQ ID NO: 7654161 - DNA, 22 bp, Homo sapiens
acagtgtttaaaaatcagatct

SEQ ID NO: 7654162 - DNA, 22 bp, Homo sapiens
acagtgtttaaaaatcagatct

SEQ ID NO: 7654163 - DNA, 22 bp, Homo sapiens
acagtgtttaaaaatcagatct

SEQ ID NO: 7654164 - DNA, 22 bp, Homo sapiens
acagtgtttaaaataatatgct

SEQ ID NO: 7654165 - DNA, 22 bp, Homo sapiens
acagtgttgaggtgcttgtttc

SEQ ID NO: 7654166 - DNA, 22 bp, Homo sapiens
acagtgttgtatttagtttgat

SEQ ID NO: 7654167 - DNA, 22 bp, Homo sapiens
acagtgttgtggctcttaatag

SEQ ID NO: 7654168 - DNA, 22 bp, Homo sapiens
acagtgttgtggctcttaatag

SEQ ID NO: 7654169 - DNA, 22 bp, Homo sapiens
acagtgttgtggctcttaatag

SEQ ID NO: 7654170 - DNA, 22 bp, Homo sapiens
acagtgttgtggctcttaatag

SEQ ID NO: 7654171 - DNA, 22 bp, Homo sapiens
aaggagaatttggcttgtgatg

SEQ ID NO: 7654172 - DNA, 20 bp, Homo sapiens
aaggagaatgacacggctgc

SEQ ID NO: 7654173 - DNA, 22 bp, Homo sapiens
aaggagacatttgcagagcacc

SEQ ID NO: 7654174 - DNA, 22 bp, Homo sapiens
aaggacaggctaacctgacatt

SEQ ID NO: 7654175 - DNA, 20 bp, Homo sapiens
aaggagaatgacacggctgc

SEQ ID NO: 7654176 - DNA, 20 bp, Homo sapiens
aaggagaatgacacggctgc

SEQ ID NO: 7654177 - DNA, 22 bp, Homo sapiens
aaggacaggctaacctgacatt

SEQ ID NO: 7654178 - DNA, 20 bp, Homo sapiens
aaggagaatgacacggctgc

SEQ ID NO: 7654179 - DNA, 20 bp, Homo sapiens
aaggagaatgacacggctgc

SEQ ID NO: 7654180 - DNA, 22 bp, Homo sapiens
aaggagacttggcatcacttaa

SEQ ID NO: 7654181 - DNA, 22 bp, Homo sapiens
aaggagacttggcatcacttaa

SEQ ID NO: 7654182 - DNA, 22 bp, Homo sapiens
aaggagagagctttgctggaac

SEQ ID NO: 7654183 - DNA, 22 bp, Homo sapiens
aaggagagagctttgctggaac

SEQ ID NO: 7654184 - DNA, 22 bp, Homo sapiens
aaggagacttggcatcacttaa

SEQ ID NO: 7654185 - DNA, 22 bp, Homo sapiens
aaggagacatttgcagagcacc

SEQ ID NO: 7654186 - DNA, 22 bp, Homo sapiens
aaggagacatttgcagagcacc

SEQ ID NO: 7654187 - DNA, 22 bp, Homo sapiens
aagctggactctgccatttact

SEQ ID NO: 7654188 - DNA, 22 bp, Homo sapiens
aagctggacattgtagggggga

SEQ ID NO: 7654189 - DNA, 22 bp, Homo sapiens
aagctggacattgtagggggga

SEQ ID NO: 7654190 - DNA, 22 bp, Homo sapiens
aagctggacattgtagggggga

SEQ ID NO: 7654191 - DNA, 22 bp, Homo sapiens
aagctggacactgacccactgt

SEQ ID NO: 7654192 - DNA, 22 bp, Homo sapiens
aagctggacactgacccactgt

SEQ ID NO: 7654193 - DNA, 20 bp, Homo sapiens
aagctggaagaccagcattg

SEQ ID NO: 7654194 - DNA, 22 bp, Homo sapiens
aagctggaacatcttgaggaag

SEQ ID NO: 7654195 - DNA, 22 bp, Homo sapiens
aagctggaacatcttgaggaag

SEQ ID NO: 7654196 - DNA, 22 bp, Homo sapiens
aagctggaacatcttgaggaag

SEQ ID NO: 7654197 - DNA, 20 bp, Homo sapiens
aagctggaagaccagcattg

SEQ ID NO: 7654198 - DNA, 20 bp, Homo sapiens
aagctggaagaccagcattg

SEQ ID NO: 7654199 - DNA, 20 bp, Homo sapiens
aagctggaagaccagcattg

SEQ ID NO: 7654200 - DNA, 22 bp, Homo sapiens
aagctggacactgacccactgt

SEQ ID NO: 7654201 - DNA, 22 bp, Homo sapiens
aagctggacactgacccactgt

SEQ ID NO: 7654202 - DNA, 22 bp, Homo sapiens
aagctggagagttaggtgaata

SEQ ID NO: 7654203 - DNA, 22 bp, Homo sapiens
aagctggagagttaggtgaata

SEQ ID NO: 7654204 - DNA, 22 bp, Homo sapiens
aagctggagagttaggtgaata

SEQ ID NO: 7654205 - DNA, 22 bp, Homo sapiens
aagctggagagttaggtgaata

SEQ ID NO: 7654206 - DNA, 22 bp, Homo sapiens
aaggacaggcacagtggtggag

SEQ ID NO: 7654207 - DNA, 22 bp, Homo sapiens
aaggacaggcacagtggtggag

SEQ ID NO: 7654208 - DNA, 22 bp, Homo sapiens
aaggacaggcacagtggtggag

SEQ ID NO: 7654209 - DNA, 22 bp, Homo sapiens
aaggacaggctaacctgacatt

SEQ ID NO: 7654210 - DNA, 22 bp, Homo sapiens
aaggacaggctaacctgacatt

SEQ ID NO: 7654211 - DNA, 22 bp, Homo sapiens
aaggacaggctaacctgacatt

SEQ ID NO: 7654212 - DNA, 22 bp, Homo sapiens
aaggaggaaaatattgttgctg

SEQ ID NO: 7654213 - DNA, 22 bp, Homo sapiens
aaggaggaaaatattgttgctg

SEQ ID NO: 7654214 - DNA, 22 bp, Homo sapiens
aaggagctttcattacagcctt

SEQ ID NO: 7654215 - DNA, 22 bp, Homo sapiens
aaggagctttcattacagcctt

SEQ ID NO: 7654216 - DNA, 22 bp, Homo sapiens
aaggagcttgttcgccttcctc

SEQ ID NO: 7654217 - DNA, 22 bp, Homo sapiens
aaggagctgggagggacacatg

SEQ ID NO: 7654218 - DNA, 17 bp, Homo sapiens
aaggagctgagagatgg

SEQ ID NO: 7654219 - DNA, 17 bp, Homo sapiens
aaggagctgagagatgg

SEQ ID NO: 7654220 - DNA, 22 bp, Homo sapiens
aaggagctgggagggacacatg

SEQ ID NO: 7654221 - DNA, 22 bp, Homo sapiens
aaggagctgggagggacacatg

SEQ ID NO: 7654222 - DNA, 22 bp, Homo sapiens
aaggagctgggagggacacatg

SEQ ID NO: 7654223 - DNA, 22 bp, Homo sapiens
aaggagctatgcataactgatc

SEQ ID NO: 7654224 - DNA, 22 bp, Homo sapiens
aaggagcgcttagggggcagaa

SEQ ID NO: 7654225 - DNA, 22 bp, Homo sapiens
aaggagctatgcataactgatc

SEQ ID NO: 7654226 - DNA, 22 bp, Homo sapiens
aaggagctcccggcagaccagg

SEQ ID NO: 7654227 - DNA, 22 bp, Homo sapiens
aaggagctcccggcagaccagg

SEQ ID NO: 7654228 - DNA, 22 bp, Homo sapiens
aaggagctcccggcagaccagg

SEQ ID NO: 7654229 - DNA, 22 bp, Homo sapiens
aaggagctcttaaaatcagaga

SEQ ID NO: 7654230 - DNA, 22 bp, Homo sapiens
aaggagctcccggcagaccagg

SEQ ID NO: 7654231 - DNA, 22 bp, Homo sapiens
aaggagctcttaaaatcagaga

SEQ ID NO: 7654232 - DNA, 17 bp, Homo sapiens
aaggagctgagagatgg

SEQ ID NO: 7654233 - DNA, 17 bp, Homo sapiens
aaggagctgagagatgg

SEQ ID NO: 7654234 - DNA, 21 bp, Homo sapiens
aaggagcctaggaggctcagg

SEQ ID NO: 7654235 - DNA, 21 bp, Homo sapiens
aaggagcctaggaggctcagg

SEQ ID NO: 7654236 - DNA, 22 bp, Homo sapiens
aaggagcacacaatctagaacc

SEQ ID NO: 7654237 - DNA, 22 bp, Homo sapiens
aaggagcacacaatctagaacc

SEQ ID NO: 7654238 - DNA, 22 bp, Homo sapiens
aaggagcacacaatctagaacc

SEQ ID NO: 7654239 - DNA, 22 bp, Homo sapiens
aaggagcacacaatctagaacc

SEQ ID NO: 7654240 - DNA, 22 bp, Homo sapiens
aaggagattgttaaagctatat

SEQ ID NO: 7654241 - DNA, 22 bp, Homo sapiens
aaggagattgttaaagctatat

SEQ ID NO: 7654242 - DNA, 22 bp, Homo sapiens
aaggagagtacaggagttggta

SEQ ID NO: 7654243 - DNA, 22 bp, Homo sapiens
aaggagagtacaggagttggta

SEQ ID NO: 7654244 - DNA, 22 bp, Homo sapiens
aaggagagtacaggagttggta

SEQ ID NO: 7654245 - DNA, 22 bp, Homo sapiens
aaggagagtacaggagttggta

SEQ ID NO: 7654246 - DNA, 22 bp, Homo sapiens
aaggagaggttgtccgtgttgt

SEQ ID NO: 7654247 - DNA, 22 bp, Homo sapiens
aaggagagagctttgctggaac

SEQ ID NO: 7654248 - DNA, 22 bp, Homo sapiens
aaggagagagctttgctggaac

SEQ ID NO: 7654249 - DNA, 22 bp, Homo sapiens
aagctagataacttttatattt

SEQ ID NO: 7654250 - DNA, 22 bp, Homo sapiens
aagctagataacttttatattt

SEQ ID NO: 7654251 - DNA, 22 bp, Homo sapiens
aagctagatgacgttatttttt

SEQ ID NO: 7654252 - DNA, 22 bp, Homo sapiens
aagctacattaagcagatttac

SEQ ID NO: 7654253 - DNA, 22 bp, Homo sapiens
aagctacttttatatgcagtag

SEQ ID NO: 7654254 - DNA, 22 bp, Homo sapiens
aagctacttttatatgcagtag

SEQ ID NO: 7654255 - DNA, 22 bp, Homo sapiens
aagctagataacttttatattt

SEQ ID NO: 7654256 - DNA, 21 bp, Homo sapiens
aagctacagaaaataatttga

SEQ ID NO: 7654257 - DNA, 19 bp, Homo sapiens
aagctacagcccaggtctg

SEQ ID NO: 7654258 - DNA, 21 bp, Homo sapiens
aagctacagaaaataatttga

SEQ ID NO: 7654259 - DNA, 21 bp, Homo sapiens
aagctacagaaaataatttga

SEQ ID NO: 7654260 - DNA, 22 bp, Homo sapiens
aagctacattaagcagatttac

SEQ ID NO: 7654261 - DNA, 22 bp, Homo sapiens
aagctacattaagcagatttac

SEQ ID NO: 7654262 - DNA, 22 bp, Homo sapiens
aagctacagtttacccatggtt

SEQ ID NO: 7654263 - DNA, 22 bp, Homo sapiens
aagctacattaagcagatttac

SEQ ID NO: 7654264 - DNA, 22 bp, Homo sapiens
aagctagattggcattcatttc

SEQ ID NO: 7654265 - DNA, 19 bp, Homo sapiens
aagctacagcccaggtctg

SEQ ID NO: 7654266 - DNA, 22 bp, Homo sapiens
aagctagattggcattcatttc

SEQ ID NO: 7654267 - DNA, 20 bp, Homo sapiens
aagctagcaaaagccacaaa

SEQ ID NO: 7654268 - DNA, 20 bp, Homo sapiens
aagctagcaaaagccacaaa

SEQ ID NO: 7654269 - DNA, 22 bp, Homo sapiens
aagctaggcctcagtttcctga

SEQ ID NO: 7654270 - DNA, 22 bp, Homo sapiens
aagctaggcctcagtttcctga

SEQ ID NO: 7654271 - DNA, 22 bp, Homo sapiens
aagctatcagctactatcagct

SEQ ID NO: 7654272 - DNA, 22 bp, Homo sapiens
aagctatagagtgtaagatgat

SEQ ID NO: 7654273 - DNA, 22 bp, Homo sapiens
aagctatagagtgtaagatgat

SEQ ID NO: 7654274 - DNA, 22 bp, Homo sapiens
aagctatacaatgcacaaatga

SEQ ID NO: 7654275 - DNA, 22 bp, Homo sapiens
aagcgccatggttcctgcgcag

SEQ ID NO: 7654276 - DNA, 22 bp, Homo sapiens
aagcgcaggactggctcacggc

SEQ ID NO: 7654277 - DNA, 22 bp, Homo sapiens
aagcgccatggttcctgcgcag

SEQ ID NO: 7654278 - DNA, 22 bp, Homo sapiens
aagcgccatggttcctgcgcag

SEQ ID NO: 7654279 - DNA, 22 bp, Homo sapiens
aagcggagcatttgaacttgaa

SEQ ID NO: 7654280 - DNA, 22 bp, Homo sapiens
aagcgcccatgcctgagagcgt

SEQ ID NO: 7654281 - DNA, 17 bp, Homo sapiens
aagcggagggccgggcc

SEQ ID NO: 7654282 - DNA, 19 bp, Homo sapiens
aagctaagacctgaaggtt

SEQ ID NO: 7654283 - DNA, 22 bp, Homo sapiens
aagcgttggcctcccctgatga

SEQ ID NO: 7654284 - DNA, 23 bp, Homo sapiens
aagcgtcttttcaatgtggctgg

SEQ ID NO: 7654285 - DNA, 22 bp, Homo sapiens
aagcggcatgaggagtaagtag

SEQ ID NO: 7654286 - DNA, 22 bp, Homo sapiens
aagcggagtccggctgggggtg

SEQ ID NO: 7654287 - DNA, 22 bp, Homo sapiens
aagcggagtccggctgggggtg

SEQ ID NO: 7654288 - DNA, 22 bp, Homo sapiens
aagctaagtggaagtcttatca

SEQ ID NO: 7654289 - DNA, 22 bp, Homo sapiens
aagctaagtataggtgaatcct

SEQ ID NO: 7654290 - DNA, 22 bp, Homo sapiens
aagctaagtggaagtcttatca

SEQ ID NO: 7654291 - DNA, 22 bp, Homo sapiens
aagctaagggtgtttaagcagg

SEQ ID NO: 7654292 - DNA, 22 bp, Homo sapiens
aagctaagggtgtttaagcagg

SEQ ID NO: 7654293 - DNA, 22 bp, Homo sapiens
aagctaagattacagatttggg

SEQ ID NO: 7654294 - DNA, 22 bp, Homo sapiens
aagctacaatgtgtttttgaaa

SEQ ID NO: 7654295 - DNA, 22 bp, Homo sapiens
aagctacaatgtgtttttgaaa

SEQ ID NO: 7654296 - DNA, 22 bp, Homo sapiens
aagctacacatctgttgggtat

SEQ ID NO: 7654297 - DNA, 21 bp, Homo sapiens
aagctacagaaaataatttga

SEQ ID NO: 7654298 - DNA, 22 bp, Homo sapiens
aagccctgggatgttcagcagt

SEQ ID NO: 7654299 - DNA, 22 bp, Homo sapiens
aagccctgggatgttcagcagt

SEQ ID NO: 7654300 - DNA, 22 bp, Homo sapiens
aagccctgggatgttcagcagt

SEQ ID NO: 7654301 - DNA, 22 bp, Homo sapiens
aagccaagtgctggccatgggc

SEQ ID NO: 7654302 - DNA, 22 bp, Homo sapiens
aagccaagtgctggccatgggc

SEQ ID NO: 7654303 - DNA, 22 bp, Homo sapiens
aagccaaggttttggtcacagc

SEQ ID NO: 7654304 - DNA, 22 bp, Homo sapiens
aagccaaggagaatggcctcag

SEQ ID NO: 7654305 - DNA, 22 bp, Homo sapiens
aagccaaggcctgtctggggct

SEQ ID NO: 7654306 - DNA, 22 bp, Homo sapiens
aagccaagtgctggccatgggc

SEQ ID NO: 7654307 - DNA, 22 bp, Homo sapiens
aagccaaggttttggtcacagc

SEQ ID NO: 7654308 - DNA, 22 bp, Homo sapiens
aagccaaggttttggtcacagc

SEQ ID NO: 7654309 - DNA, 22 bp, Homo sapiens
aagccaaggttttggtcacagc

SEQ ID NO: 7654310 - DNA, 22 bp, Homo sapiens
aagcatttttgaaatggtagga

SEQ ID NO: 7654311 - DNA, 22 bp, Homo sapiens
aagcatttttgaaatggtagga

SEQ ID NO: 7654312 - DNA, 22 bp, Homo sapiens
aagccaaaggctccagtgacct

SEQ ID NO: 7654313 - DNA, 22 bp, Homo sapiens
aagccaaagtgggcatgcctca

SEQ ID NO: 7654314 - DNA, 22 bp, Homo sapiens
aagccaaaggctccagtgacct

SEQ ID NO: 7654315 - DNA, 22 bp, Homo sapiens
aagccaaaggctccagtgacct

SEQ ID NO: 7654316 - DNA, 22 bp, Homo sapiens
aagccaagagttaactatttgt

SEQ ID NO: 7654317 - DNA, 22 bp, Homo sapiens
aagccaaggagaatggcctcag

SEQ ID NO: 7654318 - DNA, 22 bp, Homo sapiens
aagccaaataatgtaggtacat

SEQ ID NO: 7654319 - DNA, 22 bp, Homo sapiens
aagccaaataatgtaggtacat

SEQ ID NO: 7654320 - DNA, 22 bp, Homo sapiens
aagcgcagacacagagagtgga

SEQ ID NO: 7654321 - DNA, 22 bp, Homo sapiens
aagcgcagacacagagagtgga

SEQ ID NO: 7654322 - DNA, 22 bp, Homo sapiens
aagcgcagacacagagagtgga

SEQ ID NO: 7654323 - DNA, 22 bp, Homo sapiens
aagcgccatggttcctgcgcag

SEQ ID NO: 7654324 - DNA, 22 bp, Homo sapiens
aagcgccatggttcctgcgcag

SEQ ID NO: 7654325 - DNA, 22 bp, Homo sapiens
aagcctttgtttgggaagtttt

SEQ ID NO: 7654326 - DNA, 22 bp, Homo sapiens
aagcgcaatcttttctgtcttt

SEQ ID NO: 7654327 - DNA, 22 bp, Homo sapiens
aagccttttccacctaatagag

SEQ ID NO: 7654328 - DNA, 22 bp, Homo sapiens
aagccttttccacctaatagag

SEQ ID NO: 7654329 - DNA, 22 bp, Homo sapiens
aagccttggcccttcattataa

SEQ ID NO: 7654330 - DNA, 22 bp, Homo sapiens
aagccttggggctcctctgtat

SEQ ID NO: 7654331 - DNA, 22 bp, Homo sapiens
aagccttgcctatttgatgaca

SEQ ID NO: 7654332 - DNA, 22 bp, Homo sapiens
aagccttgcctatttgatgaca

SEQ ID NO: 7654333 - DNA, 22 bp, Homo sapiens
aagccttgattcactctgtgga

SEQ ID NO: 7654334 - DNA, 22 bp, Homo sapiens
aagccttgattcactctgtgga

SEQ ID NO: 7654335 - DNA, 22 bp, Homo sapiens
aagccctggggttgcacaaggc

SEQ ID NO: 7654336 - DNA, 22 bp, Homo sapiens
aagccctggggttgcacaaggc

SEQ ID NO: 7654337 - DNA, 22 bp, Homo sapiens
aagccctgggatgttcagcagt

SEQ ID NO: 7654338 - DNA, 22 bp, Homo sapiens
aagccctggggttgcacaaggc

SEQ ID NO: 7654339 - DNA, 22 bp, Homo sapiens
aagccctggggttgcacaaggc

SEQ ID NO: 7654340 - DNA, 22 bp, Homo sapiens
aagccttccctttttgagctca

SEQ ID NO: 7654341 - DNA, 22 bp, Homo sapiens
aagccttcctgagtgcaaggcc

SEQ ID NO: 7654342 - DNA, 21 bp, Homo sapiens
acagcctgtcatctcatggtc

SEQ ID NO: 7654343 - DNA, 21 bp, Homo sapiens
acagcctgtcatctcatggtc

SEQ ID NO: 7654344 - DNA, 21 bp, Homo sapiens
acagcctgtcatctcatggtc

SEQ ID NO: 7654345 - DNA, 21 bp, Homo sapiens
acagcctgtcatctcatggtc

SEQ ID NO: 7654346 - DNA, 22 bp, Homo sapiens
acagcctgtgtaccagctggga

SEQ ID NO: 7654347 - DNA, 22 bp, Homo sapiens
acagcctgtgtaccagctggga

SEQ ID NO: 7654348 - DNA, 21 bp, Homo sapiens
acagcctgtcatctcatggtc

SEQ ID NO: 7654349 - DNA, 21 bp, Homo sapiens
acagcctgtcatctcatggtc

SEQ ID NO: 7654350 - DNA, 21 bp, Homo sapiens
acagcctgtcatctcatggtc

SEQ ID NO: 7654351 - DNA, 21 bp, Homo sapiens
acagcctgtcatctcatggtc

SEQ ID NO: 7654352 - DNA, 22 bp, Homo sapiens
acagcctggcctgagttaaggc

SEQ ID NO: 7654353 - DNA, 21 bp, Homo sapiens
acagcctgtcatctcatggtc

SEQ ID NO: 7654354 - DNA, 21 bp, Homo sapiens
acagcctgtcatctcatggtc

SEQ ID NO: 7654355 - DNA, 21 bp, Homo sapiens
acagcctgtcatctcatggtc

SEQ ID NO: 7654356 - DNA, 21 bp, Homo sapiens
acagcctgtcatctcatggtc

SEQ ID NO: 7654357 - DNA, 22 bp, Homo sapiens
acagcctggcctgagttaaggc

SEQ ID NO: 7654358 - DNA, 22 bp, Homo sapiens
acagcctggcctgagttaaggc

SEQ ID NO: 7654359 - DNA, 22 bp, Homo sapiens
acagcctggcctgagttaaggc

SEQ ID NO: 7654360 - DNA, 22 bp, Homo sapiens
acagcctggcctgagttaaggc

SEQ ID NO: 7654361 - DNA, 22 bp, Homo sapiens
acagcctggactggctctctgc

SEQ ID NO: 7654362 - DNA, 19 bp, Homo sapiens
acagcctgttggtggggct

SEQ ID NO: 7654363 - DNA, 19 bp, Homo sapiens
acagcctgttggtggggct

SEQ ID NO: 7654364 - DNA, 19 bp, Homo sapiens
acagcctgttggtggggct

SEQ ID NO: 7654365 - DNA, 22 bp, Homo sapiens
acagcctgtgtaccagctggga

SEQ ID NO: 7654366 - DNA, 22 bp, Homo sapiens
acagcctgtgtaccagctggga

SEQ ID NO: 7654367 - DNA, 22 bp, Homo sapiens
acagcctgtgtaccagctggga

SEQ ID NO: 7654368 - DNA, 22 bp, Homo sapiens
acagcctgtgtaccagctggga

SEQ ID NO: 7654369 - DNA, 22 bp, Homo sapiens
acagcctgtgtaccagctggga

SEQ ID NO: 7654370 - DNA, 22 bp, Homo sapiens
acagcctgtgtaccagctggga

SEQ ID NO: 7654371 - DNA, 22 bp, Homo sapiens
acagcctgtttgatctggtgct

SEQ ID NO: 7654372 - DNA, 22 bp, Homo sapiens
acagcctgtttgatctggtgct

SEQ ID NO: 7654373 - DNA, 22 bp, Homo sapiens
acagcctgtttgatctggtgct

SEQ ID NO: 7654374 - DNA, 22 bp, Homo sapiens
acagcctgtttgatctggtgct

SEQ ID NO: 7654375 - DNA, 19 bp, Homo sapiens
acagcctgttggtggggct

SEQ ID NO: 7654376 - DNA, 19 bp, Homo sapiens
acagcctgttggtggggct

SEQ ID NO: 7654377 - DNA, 22 bp, Homo sapiens
acagcctgtttgatctggtgct

SEQ ID NO: 7654378 - DNA, 22 bp, Homo sapiens
acagcctgtttgatctggtgct

SEQ ID NO: 7654379 - DNA, 22 bp, Homo sapiens
acagcctgtttgatctggtgct

SEQ ID NO: 7654380 - DNA, 21 bp, Homo sapiens
acagccttacctggggtgtga

SEQ ID NO: 7654381 - DNA, 22 bp, Homo sapiens
aagcattttgttttaagaatga

SEQ ID NO: 7654382 - DNA, 22 bp, Homo sapiens
aagcattttgccacttgaagtt

SEQ ID NO: 7654383 - DNA, 22 bp, Homo sapiens
aagcattttgccacttgaagtt

SEQ ID NO: 7654384 - DNA, 22 bp, Homo sapiens
aagcattttgttttaagaatga

SEQ ID NO: 7654385 - DNA, 22 bp, Homo sapiens
aagcattttgttttaagaatga

SEQ ID NO: 7654386 - DNA, 22 bp, Homo sapiens
aagcattttgttttaagaatga

SEQ ID NO: 7654387 - DNA, 22 bp, Homo sapiens
aagcattttgttttaagaatga

SEQ ID NO: 7654388 - DNA, 22 bp, Homo sapiens
aagcattttgttttaagaatga

SEQ ID NO: 7654389 - DNA, 22 bp, Homo sapiens
aagcattttgttttaagaatga

SEQ ID NO: 7654390 - DNA, 22 bp, Homo sapiens
aagcatttttcacagcaacagc

SEQ ID NO: 7654391 - DNA, 22 bp, Homo sapiens
aagcatttttcacagcaacagc

SEQ ID NO: 7654392 - DNA, 22 bp, Homo sapiens
aagcatttttcacagcaacagc

SEQ ID NO: 7654393 - DNA, 22 bp, Homo sapiens
aagcatttttcacagcaacagc

SEQ ID NO: 7654394 - DNA, 22 bp, Homo sapiens
aagcatttttcacagcaacagc

SEQ ID NO: 7654395 - DNA, 22 bp, Homo sapiens
aagcatttttcacagcaacagc

SEQ ID NO: 7654396 - DNA, 22 bp, Homo sapiens
aagcattttagataaagcatca

SEQ ID NO: 7654397 - DNA, 22 bp, Homo sapiens
aagcattttagataaagcatca

SEQ ID NO: 7654398 - DNA, 22 bp, Homo sapiens
aagcattttagtaatgaacttg

SEQ ID NO: 7654399 - DNA, 22 bp, Homo sapiens
aagcattttagtaatgaacttg

SEQ ID NO: 7654400 - DNA, 22 bp, Homo sapiens
aagcattttgccacttgaagtt

SEQ ID NO: 7654401 - DNA, 22 bp, Homo sapiens
aagcattttagataaagcatca

SEQ ID NO: 7654402 - DNA, 22 bp, Homo sapiens
aagcattttagataaagcatca

SEQ ID NO: 7654403 - DNA, 22 bp, Homo sapiens
aagcattttagtaatgaacttg

SEQ ID NO: 7654404 - DNA, 22 bp, Homo sapiens
aagcattttagataaagcatca

SEQ ID NO: 7654405 - DNA, 22 bp, Homo sapiens
aagcattttagataaagcatca

SEQ ID NO: 7654406 - DNA, 22 bp, Homo sapiens
aagcatttgtgaaattcagatg

SEQ ID NO: 7654407 - DNA, 22 bp, Homo sapiens
aagcattttagataaagcatca

SEQ ID NO: 7654408 - DNA, 22 bp, Homo sapiens
aagcatttgtgaaattcagatg

SEQ ID NO: 7654409 - DNA, 22 bp, Homo sapiens
aagcattttagataaagcatca

SEQ ID NO: 7654410 - DNA, 22 bp, Homo sapiens
acagccttctcttcactgtgtc

SEQ ID NO: 7654411 - DNA, 22 bp, Homo sapiens
acagccttctctattggcctca

SEQ ID NO: 7654412 - DNA, 22 bp, Homo sapiens
acagccttcgaagtttcttcct

SEQ ID NO: 7654413 - DNA, 22 bp, Homo sapiens
acagccttactatactaaacag

SEQ ID NO: 7654414 - DNA, 22 bp, Homo sapiens
acagccttattctttagtttac

SEQ ID NO: 7654415 - DNA, 22 bp, Homo sapiens
acagccttattctttagtttac

SEQ ID NO: 7654416 - DNA, 22 bp, Homo sapiens
acagccttattgcgagcaaggc

SEQ ID NO: 7654417 - DNA, 22 bp, Homo sapiens
aagctgccctcattcccagtgc

SEQ ID NO: 7654418 - DNA, 22 bp, Homo sapiens
aagctgccctcattcccagtgc

SEQ ID NO: 7654419 - DNA, 18 bp, Homo sapiens
aagctgccctcaggcagg

SEQ ID NO: 7654420 - DNA, 19 bp, Homo sapiens
acagggcagcaataggata

SEQ ID NO: 7654421 - DNA, 22 bp, Homo sapiens
acagggcagcaactttgtgcct

SEQ ID NO: 7654422 - DNA, 19 bp, Homo sapiens
acagggcagcaataggata

SEQ ID NO: 7654423 - DNA, 22 bp, Homo sapiens
aagctgcctagagttgaatgtc

SEQ ID NO: 7654424 - DNA, 22 bp, Homo sapiens
aagctgcctagagttgaatgtc

SEQ ID NO: 7654425 - DNA, 22 bp, Homo sapiens
aagctgccctgtgttagagttc

SEQ ID NO: 7654426 - DNA, 22 bp, Homo sapiens
aagctgccctcattcccagtgc

SEQ ID NO: 7654427 - DNA, 22 bp, Homo sapiens
aagctgcctagagttgaatgtc

SEQ ID NO: 7654428 - DNA, 22 bp, Homo sapiens
aagctgcctgccacgctagata

SEQ ID NO: 7654429 - DNA, 22 bp, Homo sapiens
aagctgcctgggaggaagggct

SEQ ID NO: 7654430 - DNA, 22 bp, Homo sapiens
aagctgcctgccacgctagata

SEQ ID NO: 7654431 - DNA, 22 bp, Homo sapiens
aagctgcctgggaggaagggct

SEQ ID NO: 7654432 - DNA, 22 bp, Homo sapiens
aagctgcctgggaggaagggct

SEQ ID NO: 7654433 - DNA, 22 bp, Homo sapiens
aagctgccttccatgtgaggaa

SEQ ID NO: 7654434 - DNA, 22 bp, Homo sapiens
aagctgccttccatgtgaggaa

SEQ ID NO: 7654435 - DNA, 23 bp, Homo sapiens
aagctgccttcgcagttggtctg

SEQ ID NO: 7654436 - DNA, 22 bp, Homo sapiens
aagctgccttgctgaggagaaa

SEQ ID NO: 7654437 - DNA, 22 bp, Homo sapiens
aagctgccttccatgtgaggaa

SEQ ID NO: 7654438 - DNA, 23 bp, Homo sapiens
aagctgccttcgcagttggtctg

SEQ ID NO: 7654439 - DNA, 22 bp, Homo sapiens
aagctgccttgctgaggagaaa

SEQ ID NO: 7654440 - DNA, 22 bp, Homo sapiens
aagctgctctcacaacactgtt

SEQ ID NO: 7654441 - DNA, 22 bp, Homo sapiens
aagctgctggtgactgggctga

SEQ ID NO: 7654442 - DNA, 22 bp, Homo sapiens
aagctgctggtgactgggctga

SEQ ID NO: 7654443 - DNA, 22 bp, Homo sapiens
aagctgctttgtcaggaatatg

SEQ ID NO: 7654444 - DNA, 22 bp, Homo sapiens
aagctggaacatcttgaggaag

SEQ ID NO: 7654445 - DNA, 22 bp, Homo sapiens
aagctgcttggggctcctgcag

SEQ ID NO: 7654446 - DNA, 22 bp, Homo sapiens
aagctgcttggggctcctgcag

SEQ ID NO: 7654447 - DNA, 22 bp, Homo sapiens
aagctgcttggggctcctgcag

SEQ ID NO: 7654448 - DNA, 22 bp, Homo sapiens
aagctgctttgtcaggaatatg

SEQ ID NO: 7654449 - DNA, 22 bp, Homo sapiens
acagggcagagggcagttggta

SEQ ID NO: 7654450 - DNA, 22 bp, Homo sapiens
acagggcagagggcagttggta

SEQ ID NO: 7654451 - DNA, 22 bp, Homo sapiens
acagggcagagggcagttggta

SEQ ID NO: 7654452 - DNA, 22 bp, Homo sapiens
acagggcagagggcagttggta

SEQ ID NO: 7654453 - DNA, 22 bp, Homo sapiens
acagggcagagtgaaatgctat

SEQ ID NO: 7654454 - DNA, 22 bp, Homo sapiens
acagggcagagtgaaatgctat

SEQ ID NO: 7654455 - DNA, 22 bp, Homo sapiens
acagggcagagggcagttggta

SEQ ID NO: 7654456 - DNA, 19 bp, Homo sapiens
acagggcagcaataggata

SEQ ID NO: 7654457 - DNA, 22 bp, Homo sapiens
acagggcagcaactttgtgcct

SEQ ID NO: 7654458 - DNA, 22 bp, Homo sapiens
acagggcagcaactttgtgcct

SEQ ID NO: 7654459 - DNA, 22 bp, Homo sapiens
acagggcagagtgaaatgctat

SEQ ID NO: 7654460 - DNA, 22 bp, Homo sapiens
acagggcagcaactttgtgcct

SEQ ID NO: 7654461 - DNA, 22 bp, Homo sapiens
acagggcagaaatgttgcatct

SEQ ID NO: 7654462 - DNA, 17 bp, Homo sapiens
acagggcagaaacagct

SEQ ID NO: 7654463 - DNA, 22 bp, Homo sapiens
acagggcagaaatgttgcatct

SEQ ID NO: 7654464 - DNA, 22 bp, Homo sapiens
acagggcagaaatgttgcatct

SEQ ID NO: 7654465 - DNA, 22 bp, Homo sapiens
acagggcagaaatgttgcatct

SEQ ID NO: 7654466 - DNA, 17 bp, Homo sapiens
acagggcagaaacagct

SEQ ID NO: 7654467 - DNA, 22 bp, Homo sapiens
acagggcagagaggcaggcttg

SEQ ID NO: 7654468 - DNA, 22 bp, Homo sapiens
acagggcagagaggcaggcttg

SEQ ID NO: 7654469 - DNA, 22 bp, Homo sapiens
acagggcagagaggcaggcttg

SEQ ID NO: 7654470 - DNA, 22 bp, Homo sapiens
acagggcagagaggcaggcttg

SEQ ID NO: 7654471 - DNA, 22 bp, Homo sapiens
acagggcagagaggcaggcttg

SEQ ID NO: 7654472 - DNA, 22 bp, Homo sapiens
acagggcagagaggcaggcttg

SEQ ID NO: 7654473 - DNA, 22 bp, Homo sapiens
acagggcagagaggcaggcttg

SEQ ID NO: 7654474 - DNA, 22 bp, Homo sapiens
aagctcatgggtgctgtacttt

SEQ ID NO: 7654475 - DNA, 22 bp, Homo sapiens
aagctcattaattagaagctaa

SEQ ID NO: 7654476 - DNA, 22 bp, Homo sapiens
aagctcagtgatgcctccaggg

SEQ ID NO: 7654477 - DNA, 22 bp, Homo sapiens
aagctcagtgatgcctccaggg

SEQ ID NO: 7654478 - DNA, 22 bp, Homo sapiens
aagctcagtgatgcctccaggg

SEQ ID NO: 7654479 - DNA, 22 bp, Homo sapiens
aagctcagtgatgcctccaggg

SEQ ID NO: 7654480 - DNA, 22 bp, Homo sapiens
aagctcagtgatgcctccaggg

SEQ ID NO: 7654481 - DNA, 22 bp, Homo sapiens
aagctcaggctggacctggctt

SEQ ID NO: 7654482 - DNA, 22 bp, Homo sapiens
aagctcaggaaagagtctggtt

SEQ ID NO: 7654483 - DNA, 22 bp, Homo sapiens
aagctcaggctggacctggctt

SEQ ID NO: 7654484 - DNA, 22 bp, Homo sapiens
aagctccccgaaacccacctct

SEQ ID NO: 7654485 - DNA, 22 bp, Homo sapiens
aagctccccgaaacccacctct

SEQ ID NO: 7654486 - DNA, 22 bp, Homo sapiens
aagctctgaggtgagcaatcgg

SEQ ID NO: 7654487 - DNA, 22 bp, Homo sapiens
aagctctgaggtgagcaatcgg

SEQ ID NO: 7654488 - DNA, 22 bp, Homo sapiens
aagctccccgaaacccacctct

SEQ ID NO: 7654489 - DNA, 19 bp, Homo sapiens
aagctccagcagatccttt

SEQ ID NO: 7654490 - DNA, 18 bp, Homo sapiens
aagctcattctcttccta

SEQ ID NO: 7654491 - DNA, 19 bp, Homo sapiens
aagctccagcagatccttt

SEQ ID NO: 7654492 - DNA, 22 bp, Homo sapiens
aagctcaggaaagagtctggtt

SEQ ID NO: 7654493 - DNA, 22 bp, Homo sapiens
aagctcaggaaagagtctggtt

SEQ ID NO: 7654494 - DNA, 22 bp, Homo sapiens
aagctcaggaaagagtctggtt

SEQ ID NO: 7654495 - DNA, 22 bp, Homo sapiens
aagctcagcatgtctcctagaa

SEQ ID NO: 7654496 - DNA, 22 bp, Homo sapiens
aagctcagcatgtctcctagaa

SEQ ID NO: 7654497 - DNA, 22 bp, Homo sapiens
aagctcagcatgtctcctagaa

SEQ ID NO: 7654498 - DNA, 22 bp, Homo sapiens
aagctcagcagccaggccctgt

SEQ ID NO: 7654499 - DNA, 22 bp, Homo sapiens
aagctcagagtctcggagggaa

SEQ ID NO: 7654500 - DNA, 22 bp, Homo sapiens
aagctcagcagccaggccctgt

SEQ ID NO: 7654501 - DNA, 22 bp, Homo sapiens
aagctcagagtctcggagggaa

SEQ ID NO: 7654502 - DNA, 22 bp, Homo sapiens
aagctcagagtagctcagcgtc

SEQ ID NO: 7654503 - DNA, 22 bp, Homo sapiens
aagctcagaggtagataatgtt

SEQ ID NO: 7654504 - DNA, 22 bp, Homo sapiens
aagctcagagtctcggagggaa

SEQ ID NO: 7654505 - DNA, 22 bp, Homo sapiens
aagctcagaggtagataatgtt

SEQ ID NO: 7654506 - DNA, 22 bp, Homo sapiens
aagctattgaatttatagcata

SEQ ID NO: 7654507 - DNA, 22 bp, Homo sapiens
aagctattgaatttatagcata

SEQ ID NO: 7654508 - DNA, 22 bp, Homo sapiens
aagctcagagtagctcagcgtc

SEQ ID NO: 7654509 - DNA, 22 bp, Homo sapiens
aagctcagagtagctcagcgtc

SEQ ID NO: 7654510 - DNA, 22 bp, Homo sapiens
aagctcagagtagctcagcgtc

SEQ ID NO: 7654511 - DNA, 22 bp, Homo sapiens
aagctatgggggagtttcaacc

SEQ ID NO: 7654512 - DNA, 22 bp, Homo sapiens
aagctatgggggagtttcaacc

SEQ ID NO: 7654513 - DNA, 22 bp, Homo sapiens
aagctatgttcctgcactgctc

SEQ ID NO: 7654514 - DNA, 22 bp, Homo sapiens
aagctattgaatttatagcata

SEQ ID NO: 7654515 - DNA, 22 bp, Homo sapiens
aagctattgaatttatagcata

SEQ ID NO: 7654516 - DNA, 22 bp, Homo sapiens
aagctattgaatttatagcata

SEQ ID NO: 7654517 - DNA, 22 bp, Homo sapiens
acagggaaagggacagcagcag

SEQ ID NO: 7654518 - DNA, 22 bp, Homo sapiens
acagggaaagggacagcagcag

SEQ ID NO: 7654519 - DNA, 22 bp, Homo sapiens
acagggaaagggacagcagcag

SEQ ID NO: 7654520 - DNA, 22 bp, Homo sapiens
acagggaaagggacagcagcag

SEQ ID NO: 7654521 - DNA, 22 bp, Homo sapiens
acagggaaagggacagcagcag

SEQ ID NO: 7654522 - DNA, 22 bp, Homo sapiens
acagggaaagggacagcagcag

SEQ ID NO: 7654523 - DNA, 22 bp, Homo sapiens
aagctcttatgatatttattta

SEQ ID NO: 7654524 - DNA, 18 bp, Homo sapiens
aagctcttaaatggttca

SEQ ID NO: 7654525 - DNA, 22 bp, Homo sapiens
aagctcttatgatatttattta

SEQ ID NO: 7654526 - DNA, 23 bp, Homo sapiens
acagggaaaagtcatcagtgtga

SEQ ID NO: 7654527 - DNA, 22 bp, Homo sapiens
aagctctgtctcttgggagtta

SEQ ID NO: 7654528 - DNA, 22 bp, Homo sapiens
acagggaacaggaatatacaaa

SEQ ID NO: 7654529 - DNA, 22 bp, Homo sapiens
acagggaacaggaatatacaaa

SEQ ID NO: 7654530 - DNA, 22 bp, Homo sapiens
aagctctgtagctcatgtgata

SEQ ID NO: 7654531 - DNA, 22 bp, Homo sapiens
acagggaaagggacagcagcag

SEQ ID NO: 7654532 - DNA, 22 bp, Homo sapiens
acagggaacaggaatatacaaa

SEQ ID NO: 7654533 - DNA, 22 bp, Homo sapiens
acagggaacaggaatatacaaa

SEQ ID NO: 7654534 - DNA, 22 bp, Homo sapiens
acagggaacaggaatatacaaa

SEQ ID NO: 7654535 - DNA, 17 bp, Homo sapiens
acagggcagaaacagct

SEQ ID NO: 7654536 - DNA, 17 bp, Homo sapiens
acagggcagaaacagct

SEQ ID NO: 7654537 - DNA, 17 bp, Homo sapiens
acagggcagaaacagct

SEQ ID NO: 7654538 - DNA, 20 bp, Homo sapiens
aagctctgcttcatgtggtc

SEQ ID NO: 7654539 - DNA, 20 bp, Homo sapiens
aagctctgcttcatgtggtc

SEQ ID NO: 7654540 - DNA, 22 bp, Homo sapiens
aagctctgctcatgatgacgtt

SEQ ID NO: 7654541 - DNA, 22 bp, Homo sapiens
aagctctgctcatgatgacgtt

SEQ ID NO: 7654542 - DNA, 22 bp, Homo sapiens
aagctctgctcagcagactagg

SEQ ID NO: 7654543 - DNA, 22 bp, Homo sapiens
aagctctgctcagcagactagg

SEQ ID NO: 7654544 - DNA, 22 bp, Homo sapiens
aagctctgatacttcctacctg

SEQ ID NO: 7654545 - DNA, 22 bp, Homo sapiens
aagctctgatacttcctacctg

SEQ ID NO: 7654546 - DNA, 22 bp, Homo sapiens
aagctctgctcagcagactagg

SEQ ID NO: 7654547 - DNA, 22 bp, Homo sapiens
aagctctgctcagcagactagg

SEQ ID NO: 7654548 - DNA, 22 bp, Homo sapiens
aagctctgtctcttgggagtta

SEQ ID NO: 7654549 - DNA, 22 bp, Homo sapiens
aagctctgtctcttgggagtta

SEQ ID NO: 7654550 - DNA, 22 bp, Homo sapiens
aagctctgtctcttgggagtta

SEQ ID NO: 7654551 - DNA, 22 bp, Homo sapiens
aagctctgtagctcatgtgata

SEQ ID NO: 7654552 - DNA, 22 bp, Homo sapiens
aagctctgtagctcatgtgata

SEQ ID NO: 7654553 - DNA, 22 bp, Homo sapiens
aagctctggttaaaaggcctgg

SEQ ID NO: 7654554 - DNA, 22 bp, Homo sapiens
aagctctggggtacacatctgc

SEQ ID NO: 7654555 - DNA, 18 bp, Homo sapiens
aagctctggctaggaaaa

SEQ ID NO: 7654556 - DNA, 18 bp, Homo sapiens
aagctctggctaggaaaa

SEQ ID NO: 7654557 - DNA, 22 bp, Homo sapiens
aagctctggggtacacatctgc

SEQ ID NO: 7654558 - DNA, 22 bp, Homo sapiens
accaggcccaccgcatgctcct

SEQ ID NO: 7654559 - DNA, 22 bp, Homo sapiens
accaggcccaccgcatgctcct

SEQ ID NO: 7654560 - DNA, 22 bp, Homo sapiens
accaggcccaccgcatgctcct

SEQ ID NO: 7654561 - DNA, 22 bp, Homo sapiens
accaggcccaccgcatgctcct

SEQ ID NO: 7654562 - DNA, 22 bp, Homo sapiens
acattttgagaaatgacaagct

SEQ ID NO: 7654563 - DNA, 22 bp, Homo sapiens
acattttgcccttatttgctga

SEQ ID NO: 7654564 - DNA, 21 bp, Homo sapiens
accaggccaggaggctggcac

SEQ ID NO: 7654565 - DNA, 21 bp, Homo sapiens
accaggccaggaggctggcac

SEQ ID NO: 7654566 - DNA, 21 bp, Homo sapiens
acattttctgttttaggaagt

SEQ ID NO: 7654567 - DNA, 21 bp, Homo sapiens
acattttctgttttaggaagt

SEQ ID NO: 7654568 - DNA, 22 bp, Homo sapiens
acattttgaaagggaaattgtt

SEQ ID NO: 7654569 - DNA, 21 bp, Homo sapiens
acattttctgttttaggaagt

SEQ ID NO: 7654570 - DNA, 22 bp, Homo sapiens
acattttgaaagggaaattgtt

SEQ ID NO: 7654571 - DNA, 22 bp, Homo sapiens
accaggcttgataccaagaaat

SEQ ID NO: 7654572 - DNA, 19 bp, Homo sapiens
accaggcttatggtcagtg

SEQ ID NO: 7654573 - DNA, 22 bp, Homo sapiens
accaggcttgataccaagaaat

SEQ ID NO: 7654574 - DNA, 22 bp, Homo sapiens
accaggcttgataccaagaaat

SEQ ID NO: 7654575 - DNA, 19 bp, Homo sapiens
accaggcttatggtcagtg

SEQ ID NO: 7654576 - DNA, 19 bp, Homo sapiens
accaggcttatggtcagtg

SEQ ID NO: 7654577 - DNA, 19 bp, Homo sapiens
accaggcttatggtcagtg

SEQ ID NO: 7654578 - DNA, 19 bp, Homo sapiens
accaggcttatggtcagtg

SEQ ID NO: 7654579 - DNA, 19 bp, Homo sapiens
accaggcttatggtcagtg

SEQ ID NO: 7654580 - DNA, 19 bp, Homo sapiens
accaggcttatggtcagtg

SEQ ID NO: 7654581 - DNA, 19 bp, Homo sapiens
accaggcttatggtcagtg

SEQ ID NO: 7654582 - DNA, 22 bp, Homo sapiens
accaggctgttgggcccagtgt

SEQ ID NO: 7654583 - DNA, 22 bp, Homo sapiens
accaggctgttgggcccagtgt

SEQ ID NO: 7654584 - DNA, 22 bp, Homo sapiens
accaggcccaccgcatgctcct

SEQ ID NO: 7654585 - DNA, 22 bp, Homo sapiens
accaggcttaatcctttgctat

SEQ ID NO: 7654586 - DNA, 22 bp, Homo sapiens
accaggcttaatcctttgctat

SEQ ID NO: 7654587 - DNA, 22 bp, Homo sapiens
accaggcttaatcctttgctat

SEQ ID NO: 7654588 - DNA, 22 bp, Homo sapiens
acatttgtttctctagagtagg

SEQ ID NO: 7654589 - DNA, 22 bp, Homo sapiens
acattttaatatgcttagtgtg

SEQ ID NO: 7654590 - DNA, 22 bp, Homo sapiens
acattttaatatgcttagtgtg

SEQ ID NO: 7654591 - DNA, 22 bp, Homo sapiens
acatttgtttctctagagtagg

SEQ ID NO: 7654592 - DNA, 22 bp, Homo sapiens
acattttaatatgcttagtgtg

SEQ ID NO: 7654593 - DNA, 22 bp, Homo sapiens
acattttaatatgcttagtgtg

SEQ ID NO: 7654594 - DNA, 22 bp, Homo sapiens
acatttgtttctctagagtagg

SEQ ID NO: 7654595 - DNA, 20 bp, Homo sapiens
acatttgtggatctgagaga

SEQ ID NO: 7654596 - DNA, 22 bp, Homo sapiens
acatttgtgcacatgtgcatgg

SEQ ID NO: 7654597 - DNA, 22 bp, Homo sapiens
acatttgtgcacatgtgcatgg

SEQ ID NO: 7654598 - DNA, 20 bp, Homo sapiens
acatttgtggatctgagaga

SEQ ID NO: 7654599 - DNA, 22 bp, Homo sapiens
acattttacaccaagacttctt

SEQ ID NO: 7654600 - DNA, 22 bp, Homo sapiens
acattttacaccaagacttctt

SEQ ID NO: 7654601 - DNA, 22 bp, Homo sapiens
acattttacaccaagacttctt

SEQ ID NO: 7654602 - DNA, 22 bp, Homo sapiens
acattttaatatgcttagtgtg

SEQ ID NO: 7654603 - DNA, 22 bp, Homo sapiens
acattttaatatgcttagtgtg

SEQ ID NO: 7654604 - DNA, 22 bp, Homo sapiens
acattttacaccaagacttctt

SEQ ID NO: 7654605 - DNA, 22 bp, Homo sapiens
acattttacaccaagacttctt

SEQ ID NO: 7654606 - DNA, 22 bp, Homo sapiens
acattttacaccaagacttctt

SEQ ID NO: 7654607 - DNA, 21 bp, Homo sapiens
acattttctgttttaggaagt

SEQ ID NO: 7654608 - DNA, 22 bp, Homo sapiens
acattttacagttgtctggcta

SEQ ID NO: 7654609 - DNA, 21 bp, Homo sapiens
acattttctgttttaggaagt

SEQ ID NO: 7654610 - DNA, 21 bp, Homo sapiens
acattttctgttttaggaagt

SEQ ID NO: 7654611 - DNA, 21 bp, Homo sapiens
acattttctgttttaggaagt

SEQ ID NO: 7654612 - DNA, 22 bp, Homo sapiens
acattttacagttgtctggcta

SEQ ID NO: 7654613 - DNA, 22 bp, Homo sapiens
acattttacagttgtctggcta

SEQ ID NO: 7654614 - DNA, 22 bp, Homo sapiens
acattttacagttgtctggcta

SEQ ID NO: 7654615 - DNA, 22 bp, Homo sapiens
accagggaccgccacactgcaa

SEQ ID NO: 7654616 - DNA, 22 bp, Homo sapiens
accagggaccgccacactgcaa

SEQ ID NO: 7654617 - DNA, 22 bp, Homo sapiens
accagggaccgccacactgcaa

SEQ ID NO: 7654618 - DNA, 22 bp, Homo sapiens
accagggcaaatgtttgtactc

SEQ ID NO: 7654619 - DNA, 22 bp, Homo sapiens
accagggcaaatgtttgtactc

SEQ ID NO: 7654620 - DNA, 22 bp, Homo sapiens
accagggcacaggagtctgaag

SEQ ID NO: 7654621 - DNA, 22 bp, Homo sapiens
accagggcaaatgtttgtactc

SEQ ID NO: 7654622 - DNA, 21 bp, Homo sapiens
accaggcttgtgggagggagc

SEQ ID NO: 7654623 - DNA, 21 bp, Homo sapiens
accaggcttgtgggagggagc

SEQ ID NO: 7654624 - DNA, 21 bp, Homo sapiens
accaggcttgtgggagggagc

SEQ ID NO: 7654625 - DNA, 21 bp, Homo sapiens
accaggcttgtgggagggagc

SEQ ID NO: 7654626 - DNA, 21 bp, Homo sapiens
accaggcttgtgggagggagc

SEQ ID NO: 7654627 - DNA, 21 bp, Homo sapiens
accaggcttgtgggagggagc

SEQ ID NO: 7654628 - DNA, 22 bp, Homo sapiens
accaggcttgatgatttgctta

SEQ ID NO: 7654629 - DNA, 22 bp, Homo sapiens
accaggcttgatgatttgctta

SEQ ID NO: 7654630 - DNA, 22 bp, Homo sapiens
accaggcttgatgatttgctta

SEQ ID NO: 7654631 - DNA, 22 bp, Homo sapiens
accaggcttgatgatttgctta

SEQ ID NO: 7654632 - DNA, 22 bp, Homo sapiens
aagggctgtaagccaagtaaag

SEQ ID NO: 7654633 - DNA, 22 bp, Homo sapiens
aagggctggtctagaaagggag

SEQ ID NO: 7654634 - DNA, 22 bp, Homo sapiens
aagggctggtctagaaagggag

SEQ ID NO: 7654635 - DNA, 21 bp, Homo sapiens
accaggcttgtgggagggagc

SEQ ID NO: 7654636 - DNA, 22 bp, Homo sapiens
aagggctggtctagaaagggag

SEQ ID NO: 7654637 - DNA, 22 bp, Homo sapiens
aagggctggtctagaaagggag

SEQ ID NO: 7654638 - DNA, 22 bp, Homo sapiens
aagggctgtaagccaagtaaag

SEQ ID NO: 7654639 - DNA, 22 bp, Homo sapiens
aagggctgtaagccaagtaaag

SEQ ID NO: 7654640 - DNA, 22 bp, Homo sapiens
aagggctgtaagccaagtaaag

SEQ ID NO: 7654641 - DNA, 22 bp, Homo sapiens
aagggctgtaagccaagtaaag

SEQ ID NO: 7654642 - DNA, 22 bp, Homo sapiens
aagggctgggtctggttaaccc

SEQ ID NO: 7654643 - DNA, 22 bp, Homo sapiens
aagggctgggtctggttaaccc

SEQ ID NO: 7654644 - DNA, 22 bp, Homo sapiens
aagggctgggtctggttaaccc

SEQ ID NO: 7654645 - DNA, 22 bp, Homo sapiens
accagggcacaggagtctgaag

SEQ ID NO: 7654646 - DNA, 22 bp, Homo sapiens
accagggcacaggagtctgaag

SEQ ID NO: 7654647 - DNA, 22 bp, Homo sapiens
accagggcacaggagtctgaag

SEQ ID NO: 7654648 - DNA, 22 bp, Homo sapiens
aagggctggtctagaaagggag

SEQ ID NO: 7654649 - DNA, 22 bp, Homo sapiens
aagggctggtctagaaagggag

SEQ ID NO: 7654650 - DNA, 22 bp, Homo sapiens
aagggctggtctagaaagggag

SEQ ID NO: 7654651 - DNA, 22 bp, Homo sapiens
aagggctggtctagaaagggag

SEQ ID NO: 7654652 - DNA, 22 bp, Homo sapiens
aagggctgggtctggttaaccc

SEQ ID NO: 7654653 - DNA, 22 bp, Homo sapiens
accagggaccgccacactgcaa

SEQ ID NO: 7654654 - DNA, 22 bp, Homo sapiens
accatgttggccaagctggtct

SEQ ID NO: 7654655 - DNA, 22 bp, Homo sapiens
accatgttggccaagctggtct

SEQ ID NO: 7654656 - DNA, 22 bp, Homo sapiens
acccagagcccttagcacagac

SEQ ID NO: 7654657 - DNA, 22 bp, Homo sapiens
acccagagctgggcttggcaaa

SEQ ID NO: 7654658 - DNA, 19 bp, Homo sapiens
acccagagccctttgcagg

SEQ ID NO: 7654659 - DNA, 19 bp, Homo sapiens
acccagagccctttgcagg

SEQ ID NO: 7654660 - DNA, 22 bp, Homo sapiens
acccagagctgggcttggcaaa

SEQ ID NO: 7654661 - DNA, 22 bp, Homo sapiens
acccagagctgggcttggcaaa

SEQ ID NO: 7654662 - DNA, 22 bp, Homo sapiens
acccagagctgggcttggcaaa

SEQ ID NO: 7654663 - DNA, 22 bp, Homo sapiens
acccagagcccttagcacagac

SEQ ID NO: 7654664 - DNA, 19 bp, Homo sapiens
acccagagccctttgcagg

SEQ ID NO: 7654665 - DNA, 22 bp, Homo sapiens
acccagagcccttagcacagac

SEQ ID NO: 7654666 - DNA, 22 bp, Homo sapiens
aagggcttaggattttgctgtg

SEQ ID NO: 7654667 - DNA, 22 bp, Homo sapiens
aagggcttgatcatgttgaaga

SEQ ID NO: 7654668 - DNA, 22 bp, Homo sapiens
aagggcttttaagatttatcct

SEQ ID NO: 7654669 - DNA, 22 bp, Homo sapiens
aagggcttttaagatttatcct

SEQ ID NO: 7654670 - DNA, 22 bp, Homo sapiens
aaggggaaaaagtgttaggagt

SEQ ID NO: 7654671 - DNA, 22 bp, Homo sapiens
aaggggaaaaagtgttaggagt

SEQ ID NO: 7654672 - DNA, 22 bp, Homo sapiens
aagggcttaggattttgctgtg

SEQ ID NO: 7654673 - DNA, 22 bp, Homo sapiens
aagggcttaagaatcttcaagg

SEQ ID NO: 7654674 - DNA, 22 bp, Homo sapiens
aagggcttacatctgtttctaa

SEQ ID NO: 7654675 - DNA, 22 bp, Homo sapiens
aagggctgttatgtttttatac

SEQ ID NO: 7654676 - DNA, 22 bp, Homo sapiens
aagggctgttatgtttttatac

SEQ ID NO: 7654677 - DNA, 22 bp, Homo sapiens
aagggctgttatgtttttatac

SEQ ID NO: 7654678 - DNA, 22 bp, Homo sapiens
aagggctgtagacaagattgct

SEQ ID NO: 7654679 - DNA, 22 bp, Homo sapiens
aagggctgtagacaagattgct

SEQ ID NO: 7654680 - DNA, 22 bp, Homo sapiens
aagggctgtaagccaagtaaag

SEQ ID NO: 7654681 - DNA, 22 bp, Homo sapiens
aagggctgtaagccaagtaaag

SEQ ID NO: 7654682 - DNA, 22 bp, Homo sapiens
aagggctgtagacaagattgct

SEQ ID NO: 7654683 - DNA, 22 bp, Homo sapiens
aagggctgtagacaagattgct

SEQ ID NO: 7654684 - DNA, 22 bp, Homo sapiens
aagggctgtagtttgttgatca

SEQ ID NO: 7654685 - DNA, 22 bp, Homo sapiens
aagggctgtagtttgttgatca

SEQ ID NO: 7654686 - DNA, 22 bp, Homo sapiens
aagggctgtagtttgttgatca

SEQ ID NO: 7654687 - DNA, 22 bp, Homo sapiens
aagggctgtagtttgttgatca

SEQ ID NO: 7654688 - DNA, 22 bp, Homo sapiens
acccaggagccgtgagaggtta

SEQ ID NO: 7654689 - DNA, 22 bp, Homo sapiens
acccaggagccgtgagaggtta

SEQ ID NO: 7654690 - DNA, 22 bp, Homo sapiens
acccaggagccgtgagaggtta

SEQ ID NO: 7654691 - DNA, 22 bp, Homo sapiens
acccagagtgtctgtctcagtc

SEQ ID NO: 7654692 - DNA, 22 bp, Homo sapiens
acccagagtcatggcacttagc

SEQ ID NO: 7654693 - DNA, 22 bp, Homo sapiens
acccagagtcatggcacttagc

SEQ ID NO: 7654694 - DNA, 22 bp, Homo sapiens
acccagagtgtctgtctcagtc

SEQ ID NO: 7654695 - DNA, 22 bp, Homo sapiens
acccagagtgtctgtctcagtc

SEQ ID NO: 7654696 - DNA, 22 bp, Homo sapiens
acccagagtcatgtttattccc

SEQ ID NO: 7654697 - DNA, 22 bp, Homo sapiens
acccagagtcagacagccatgg

SEQ ID NO: 7654698 - DNA, 22 bp, Homo sapiens
acccagagtcatggcacttagc

SEQ ID NO: 7654699 - DNA, 22 bp, Homo sapiens
acccagagtcagacagccatgg

SEQ ID NO: 7654700 - DNA, 22 bp, Homo sapiens
acccagagtcatggcacttagc

SEQ ID NO: 7654701 - DNA, 22 bp, Homo sapiens
acccagagtcatggcacttagc

SEQ ID NO: 7654702 - DNA, 22 bp, Homo sapiens
acccagagtcagacagccatgg

SEQ ID NO: 7654703 - DNA, 22 bp, Homo sapiens
acccagagtcagacagccatgg

SEQ ID NO: 7654704 - DNA, 22 bp, Homo sapiens
acccagagtcagacagccatgg

SEQ ID NO: 7654705 - DNA, 22 bp, Homo sapiens
acccagagtaacagatggattc

SEQ ID NO: 7654706 - DNA, 22 bp, Homo sapiens
acccagaggcggaggttgcagt

SEQ ID NO: 7654707 - DNA, 22 bp, Homo sapiens
acccagaggtgtctagcaagct

SEQ ID NO: 7654708 - DNA, 22 bp, Homo sapiens
acccagaggtgtctagcaagct

SEQ ID NO: 7654709 - DNA, 22 bp, Homo sapiens
acccagaggcggaggttgcagt

SEQ ID NO: 7654710 - DNA, 22 bp, Homo sapiens
acccagaggtgtctagcaagct

SEQ ID NO: 7654711 - DNA, 22 bp, Homo sapiens
acccagaggtgtctagcaagct

SEQ ID NO: 7654712 - DNA, 22 bp, Homo sapiens
acccagagtaacagatggattc

SEQ ID NO: 7654713 - DNA, 22 bp, Homo sapiens
acccagagtaacagatggattc

SEQ ID NO: 7654714 - DNA, 22 bp, Homo sapiens
acccagaggtgtctagcaagct

SEQ ID NO: 7654715 - DNA, 22 bp, Homo sapiens
acccagaggtgtctagcaagct

SEQ ID NO: 7654716 - DNA, 22 bp, Homo sapiens
acccagagtaacagatggattc

SEQ ID NO: 7654717 - DNA, 22 bp, Homo sapiens
acccagagtaacagatggattc

SEQ ID NO: 7654718 - DNA, 22 bp, Homo sapiens
acccagagtaacagatggattc

SEQ ID NO: 7654719 - DNA, 22 bp, Homo sapiens
acccagaggcggaggttgcagt

SEQ ID NO: 7654720 - DNA, 22 bp, Homo sapiens
acccagaggcggaggttgcagt

SEQ ID NO: 7654721 - DNA, 22 bp, Homo sapiens
acccagaggcggaggttgcagt

SEQ ID NO: 7654722 - DNA, 22 bp, Homo sapiens
acccagagctgggcttggcaaa

SEQ ID NO: 7654723 - DNA, 22 bp, Homo sapiens
acccagagctgggcttggcaaa

SEQ ID NO: 7654724 - DNA, 22 bp, Homo sapiens
acccagagctgggcttggcaaa

SEQ ID NO: 7654725 - DNA, 22 bp, Homo sapiens
acccagagctgggcttggcaaa

SEQ ID NO: 7654726 - DNA, 22 bp, Homo sapiens
acccaggaggtgacacagggct

SEQ ID NO: 7654727 - DNA, 22 bp, Homo sapiens
acccaggaggtgacacagggct

SEQ ID NO: 7654728 - DNA, 22 bp, Homo sapiens
acccaggaggtgacacagggct

SEQ ID NO: 7654729 - DNA, 22 bp, Homo sapiens
acccaggaggtgacacagggct

SEQ ID NO: 7654730 - DNA, 22 bp, Homo sapiens
acccaggaggtggaggctgcag

SEQ ID NO: 7654731 - DNA, 22 bp, Homo sapiens
acccaggaggtggaggctgcag

SEQ ID NO: 7654732 - DNA, 22 bp, Homo sapiens
acccaggaggtggaggctgcag

SEQ ID NO: 7654733 - DNA, 22 bp, Homo sapiens
acccaggaggtggaggctgcag

SEQ ID NO: 7654734 - DNA, 22 bp, Homo sapiens
acccaggatagagtgctgcagt

SEQ ID NO: 7654735 - DNA, 22 bp, Homo sapiens
acccaggatagagtgctgcagt

SEQ ID NO: 7654736 - DNA, 22 bp, Homo sapiens
acccaggataatctgtgtatct

SEQ ID NO: 7654737 - DNA, 22 bp, Homo sapiens
acccaggatagagtgctgcagt

SEQ ID NO: 7654738 - DNA, 22 bp, Homo sapiens
acccaggatagagtgctgcagt

SEQ ID NO: 7654739 - DNA, 22 bp, Homo sapiens
acccaggatagagtgctgcagt

SEQ ID NO: 7654740 - DNA, 22 bp, Homo sapiens
acccaggataatctgtgtatct

SEQ ID NO: 7654741 - DNA, 22 bp, Homo sapiens
acccaggaggtggaggctgcag

SEQ ID NO: 7654742 - DNA, 22 bp, Homo sapiens
acccaggataatctgtgtatct

SEQ ID NO: 7654743 - DNA, 22 bp, Homo sapiens
acccaggataatctgtgtatct

SEQ ID NO: 7654744 - DNA, 22 bp, Homo sapiens
acccaggataatctgtgtatct

SEQ ID NO: 7654745 - DNA, 22 bp, Homo sapiens
acccaggaggcagaggttgcag

SEQ ID NO: 7654746 - DNA, 22 bp, Homo sapiens
acccaggaggcagaggttgcag

SEQ ID NO: 7654747 - DNA, 22 bp, Homo sapiens
acccaggaggcagaggttgcag

SEQ ID NO: 7654748 - DNA, 22 bp, Homo sapiens
acccaggaggcagaggttgcag

SEQ ID NO: 7654749 - DNA, 22 bp, Homo sapiens
acccaggaggcaaggttgcagt

SEQ ID NO: 7654750 - DNA, 22 bp, Homo sapiens
acccaggaggcaaggttgcagt

SEQ ID NO: 7654751 - DNA, 22 bp, Homo sapiens
acccaggaggcaaggttgcagt

SEQ ID NO: 7654752 - DNA, 22 bp, Homo sapiens
acccaggaggcaaggttgcagt

SEQ ID NO: 7654753 - DNA, 22 bp, Homo sapiens
acccaggaggcaaggttgcagt

SEQ ID NO: 7654754 - DNA, 22 bp, Homo sapiens
acccaggaggcaaggttgcagt

SEQ ID NO: 7654755 - DNA, 22 bp, Homo sapiens
acccaggagctctggggtcctc

SEQ ID NO: 7654756 - DNA, 22 bp, Homo sapiens
acccaggagctctggggtcctc

SEQ ID NO: 7654757 - DNA, 22 bp, Homo sapiens
acccaggagctctggggtcctc

SEQ ID NO: 7654758 - DNA, 22 bp, Homo sapiens
acccagagtcatgtttattccc

SEQ ID NO: 7654759 - DNA, 22 bp, Homo sapiens
acccaggagccgtgagaggtta

SEQ ID NO: 7654760 - DNA, 22 bp, Homo sapiens
acccaggagccgtgagaggtta

SEQ ID NO: 7654761 - DNA, 22 bp, Homo sapiens
acccctccattctgaaggctgc

SEQ ID NO: 7654762 - DNA, 22 bp, Homo sapiens
accccttgaaggcagagaagct

SEQ ID NO: 7654763 - DNA, 22 bp, Homo sapiens
accccttctcctggctgttcca

SEQ ID NO: 7654764 - DNA, 22 bp, Homo sapiens
accccttctcctggctgttcca

SEQ ID NO: 7654765 - DNA, 22 bp, Homo sapiens
acccctccattctgaaggctgc

SEQ ID NO: 7654766 - DNA, 22 bp, Homo sapiens
acccctccattctgaaggctgc

SEQ ID NO: 7654767 - DNA, 22 bp, Homo sapiens
accctgagaaagtcacatgcat

SEQ ID NO: 7654768 - DNA, 22 bp, Homo sapiens
accctgagaaagtcacatgcat

SEQ ID NO: 7654769 - DNA, 22 bp, Homo sapiens
accctgaaagcatcctcctgtc

SEQ ID NO: 7654770 - DNA, 22 bp, Homo sapiens
accctgaaagcatcctcctgtc

SEQ ID NO: 7654771 - DNA, 22 bp, Homo sapiens
accctgaagcaggcactcagct

SEQ ID NO: 7654772 - DNA, 22 bp, Homo sapiens
accctgaagcaggcactcagct

SEQ ID NO: 7654773 - DNA, 22 bp, Homo sapiens
acccaggatgataatgttcaca

SEQ ID NO: 7654774 - DNA, 22 bp, Homo sapiens
acccaggatgataatgttcaca

SEQ ID NO: 7654775 - DNA, 22 bp, Homo sapiens
acccaggatgataatgttcaca

SEQ ID NO: 7654776 - DNA, 22 bp, Homo sapiens
acccaggatagagtgctgcagt

SEQ ID NO: 7654777 - DNA, 22 bp, Homo sapiens
acccaggatagagtgctgcagt

SEQ ID NO: 7654778 - DNA, 22 bp, Homo sapiens
acccctcatcagttgcttccta

SEQ ID NO: 7654779 - DNA, 22 bp, Homo sapiens
acccctcagctcttcgtgcccc

SEQ ID NO: 7654780 - DNA, 22 bp, Homo sapiens
acccctcatcagttgcttccta

SEQ ID NO: 7654781 - DNA, 22 bp, Homo sapiens
acccctcagctcttcgtgcccc

SEQ ID NO: 7654782 - DNA, 22 bp, Homo sapiens
acccctcagctcttcgtgcccc

SEQ ID NO: 7654783 - DNA, 22 bp, Homo sapiens
acccaggatgataatgttcaca

SEQ ID NO: 7654784 - DNA, 22 bp, Homo sapiens
accctgagatgccacagcatga

SEQ ID NO: 7654785 - DNA, 22 bp, Homo sapiens
accctgagatgccacagcatga

SEQ ID NO: 7654786 - DNA, 19 bp, Homo sapiens
accctgagaggtggtccgg

SEQ ID NO: 7654787 - DNA, 22 bp, Homo sapiens
accctgagatgccacagcatga

SEQ ID NO: 7654788 - DNA, 19 bp, Homo sapiens
accctgagaggtggtccgg

SEQ ID NO: 7654789 - DNA, 22 bp, Homo sapiens
accctgagaatgagtgtctcct

SEQ ID NO: 7654790 - DNA, 22 bp, Homo sapiens
accctgagaaagtcacatgcat

SEQ ID NO: 7654791 - DNA, 22 bp, Homo sapiens
accctgagaaagtcacatgcat

SEQ ID NO: 7654792 - DNA, 22 bp, Homo sapiens
accctgagaaagtcacatgcat

SEQ ID NO: 7654793 - DNA, 22 bp, Homo sapiens
accctgagaaagtcacatgcat

SEQ ID NO: 7654794 - DNA, 22 bp, Homo sapiens
accctgagaaagtcacatgcat

SEQ ID NO: 7654795 - DNA, 22 bp, Homo sapiens
accctgagccgccaggaaggcc

SEQ ID NO: 7654796 - DNA, 22 bp, Homo sapiens
accctgagccgccaggaaggcc

SEQ ID NO: 7654797 - DNA, 22 bp, Homo sapiens
accctgagatgccacagcatga

SEQ ID NO: 7654798 - DNA, 22 bp, Homo sapiens
accctgagccaaaccagttaga

SEQ ID NO: 7654799 - DNA, 22 bp, Homo sapiens
accctgagggatgagagttgca

SEQ ID NO: 7654800 - DNA, 20 bp, Homo sapiens
accctgaggctccccagcct

SEQ ID NO: 7654801 - DNA, 22 bp, Homo sapiens
accctgagatgccacagcatga

SEQ ID NO: 7654802 - DNA, 20 bp, Homo sapiens
accctgaggctccccagcct

SEQ ID NO: 7654803 - DNA, 22 bp, Homo sapiens
accctgagccgccaggaaggcc

SEQ ID NO: 7654804 - DNA, 22 bp, Homo sapiens
accctgatggccagattgtgga

SEQ ID NO: 7654805 - DNA, 20 bp, Homo sapiens
accctgcatactggaaggct

SEQ ID NO: 7654806 - DNA, 20 bp, Homo sapiens
accctgcatactggaaggct

SEQ ID NO: 7654807 - DNA, 22 bp, Homo sapiens
accctgccaaggatggccccga

SEQ ID NO: 7654808 - DNA, 22 bp, Homo sapiens
accctgagtgcaacggtgagga

SEQ ID NO: 7654809 - DNA, 22 bp, Homo sapiens
accctgagtgcaacggtgagga

SEQ ID NO: 7654810 - DNA, 22 bp, Homo sapiens
accctgagtgcaacggtgagga

SEQ ID NO: 7654811 - DNA, 22 bp, Homo sapiens
accctgatataggtccaagagc

SEQ ID NO: 7654812 - DNA, 22 bp, Homo sapiens
accctgatataggtccaagagc

SEQ ID NO: 7654813 - DNA, 22 bp, Homo sapiens
accctgagtcagacagcctgac

SEQ ID NO: 7654814 - DNA, 22 bp, Homo sapiens
accctgagtcagacagcctgac

SEQ ID NO: 7654815 - DNA, 22 bp, Homo sapiens
accctgagtcactgtctgtctg

SEQ ID NO: 7654816 - DNA, 22 bp, Homo sapiens
accctgagggtgctgggtttct

SEQ ID NO: 7654817 - DNA, 22 bp, Homo sapiens
accctgagggtgctgggtttct

SEQ ID NO: 7654818 - DNA, 22 bp, Homo sapiens
accctgaggggtatagcagaag

SEQ ID NO: 7654819 - DNA, 22 bp, Homo sapiens
accctgaggggtatagcagaag

SEQ ID NO: 7654820 - DNA, 22 bp, Homo sapiens
accctgaggggtatagcagaag

SEQ ID NO: 7654821 - DNA, 22 bp, Homo sapiens
accctgaggggtatagcagaag

SEQ ID NO: 7654822 - DNA, 22 bp, Homo sapiens
accctgaggggtatagcagaag

SEQ ID NO: 7654823 - DNA, 22 bp, Homo sapiens
accgggaagtcctgcactgggc

SEQ ID NO: 7654824 - DNA, 22 bp, Homo sapiens
accgggaagtcctgcactgggc

SEQ ID NO: 7654825 - DNA, 22 bp, Homo sapiens
accgagttagccaggatggtct

SEQ ID NO: 7654826 - DNA, 22 bp, Homo sapiens
accgggaagtcctgcactgggc

SEQ ID NO: 7654827 - DNA, 22 bp, Homo sapiens
accgcagtgacgtgggacttcc

SEQ ID NO: 7654828 - DNA, 22 bp, Homo sapiens
accgagttagccaggatggtct

SEQ ID NO: 7654829 - DNA, 22 bp, Homo sapiens
accgagttagccaggatggtct

SEQ ID NO: 7654830 - DNA, 22 bp, Homo sapiens
accgaatatgtgagtattatgc

SEQ ID NO: 7654831 - DNA, 22 bp, Homo sapiens
accctgcctctgcttcctgtag

SEQ ID NO: 7654832 - DNA, 22 bp, Homo sapiens
acccttttgcctttaattcatg

SEQ ID NO: 7654833 - DNA, 22 bp, Homo sapiens
accctgccgtgggctgcttgtg

SEQ ID NO: 7654834 - DNA, 22 bp, Homo sapiens
accctgcctctgcttcctgtag

SEQ ID NO: 7654835 - DNA, 22 bp, Homo sapiens
accctgcctctgcttcctgtag

SEQ ID NO: 7654836 - DNA, 22 bp, Homo sapiens
accctgccgtgggctgcttgtg

SEQ ID NO: 7654837 - DNA, 22 bp, Homo sapiens
accctgccgtgggctgcttgtg

SEQ ID NO: 7654838 - DNA, 22 bp, Homo sapiens
accctgccgtgggctgcttgtg

SEQ ID NO: 7654839 - DNA, 20 bp, Homo sapiens
accctgccaggcatgtgaat

SEQ ID NO: 7654840 - DNA, 20 bp, Homo sapiens
accctgccaggcatgtgaat

SEQ ID NO: 7654841 - DNA, 22 bp, Homo sapiens
accctgccctctccagctcagg

SEQ ID NO: 7654842 - DNA, 22 bp, Homo sapiens
accctgccctctccagctcagg

SEQ ID NO: 7654843 - DNA, 22 bp, Homo sapiens
accctgccctctccagctcagg

SEQ ID NO: 7654844 - DNA, 22 bp, Homo sapiens
aaggccttgccgaaggatgcca

SEQ ID NO: 7654845 - DNA, 22 bp, Homo sapiens
aaggccttgcctgacagcacca

SEQ ID NO: 7654846 - DNA, 22 bp, Homo sapiens
aaggccttgccgaaggatgcca

SEQ ID NO: 7654847 - DNA, 22 bp, Homo sapiens
aaggccttgcctgacagcacca

SEQ ID NO: 7654848 - DNA, 22 bp, Homo sapiens
aaggccttgcctgacagcacca

SEQ ID NO: 7654849 - DNA, 22 bp, Homo sapiens
aaggccttgcctgacagcacca

SEQ ID NO: 7654850 - DNA, 22 bp, Homo sapiens
aaggccttgcctgacagcacca

SEQ ID NO: 7654851 - DNA, 22 bp, Homo sapiens
aaggccttctcttgtgtctgtg

SEQ ID NO: 7654852 - DNA, 22 bp, Homo sapiens
aaggccttctcttgtgtctgtg

SEQ ID NO: 7654853 - DNA, 22 bp, Homo sapiens
aaggccttgccgaaggatgcca

SEQ ID NO: 7654854 - DNA, 22 bp, Homo sapiens
aaggcctttcttatcagtagat

SEQ ID NO: 7654855 - DNA, 22 bp, Homo sapiens
aaggcctttcttatcagtagat

SEQ ID NO: 7654856 - DNA, 22 bp, Homo sapiens
aaggcctttcctgctttgaatg

SEQ ID NO: 7654857 - DNA, 22 bp, Homo sapiens
aaggcctttctagctttgtgct

SEQ ID NO: 7654858 - DNA, 22 bp, Homo sapiens
aaggcctttctagctttgtgct

SEQ ID NO: 7654859 - DNA, 22 bp, Homo sapiens
aaggccttggttctgagcaata

SEQ ID NO: 7654860 - DNA, 22 bp, Homo sapiens
aaggccttggctctctgtgtgc

SEQ ID NO: 7654861 - DNA, 22 bp, Homo sapiens
aaggcctttaggctttcattgt

SEQ ID NO: 7654862 - DNA, 22 bp, Homo sapiens
aaggcctttaggctttcattgt

SEQ ID NO: 7654863 - DNA, 22 bp, Homo sapiens
aaggcctttcaggattttgctc

SEQ ID NO: 7654864 - DNA, 22 bp, Homo sapiens
aaggcctttcaggattttgctc

SEQ ID NO: 7654865 - DNA, 21 bp, Homo sapiens
aaggcctgcttactgctagtt

SEQ ID NO: 7654866 - DNA, 21 bp, Homo sapiens
aaggcctgcttactgctagtt

SEQ ID NO: 7654867 - DNA, 21 bp, Homo sapiens
aaggcctgcttactgctagtt

SEQ ID NO: 7654868 - DNA, 22 bp, Homo sapiens
aaggcctgctcagctgtctgtg

SEQ ID NO: 7654869 - DNA, 22 bp, Homo sapiens
aaggcctcttctctctggagat

SEQ ID NO: 7654870 - DNA, 22 bp, Homo sapiens
aaggcctgaacatgaggagatg

SEQ ID NO: 7654871 - DNA, 22 bp, Homo sapiens
aaggcctgaacatgaggagatg

SEQ ID NO: 7654872 - DNA, 22 bp, Homo sapiens
aaggcctgaacatgaggagatg

SEQ ID NO: 7654873 - DNA, 22 bp, Homo sapiens
aaggcctgctcagctgtctgtg

SEQ ID NO: 7654874 - DNA, 22 bp, Homo sapiens
aaggcctgaacatgaggagatg

SEQ ID NO: 7654875 - DNA, 22 bp, Homo sapiens
aaggcctgctcagctgtctgtg

SEQ ID NO: 7654876 - DNA, 22 bp, Homo sapiens
aaggccttaaagctctctccag

SEQ ID NO: 7654877 - DNA, 22 bp, Homo sapiens
aaggccttccctttgagccgca

SEQ ID NO: 7654878 - DNA, 22 bp, Homo sapiens
aaggccttctaccaaggctggg

SEQ ID NO: 7654879 - DNA, 22 bp, Homo sapiens
aaggccttctaccaaggctggg

SEQ ID NO: 7654880 - DNA, 22 bp, Homo sapiens
aaggcctggatttaggttgtga

SEQ ID NO: 7654881 - DNA, 22 bp, Homo sapiens
aaggcctgggaggcctctcttc

SEQ ID NO: 7654882 - DNA, 22 bp, Homo sapiens
aaggcctgggagtactgggaca

SEQ ID NO: 7654883 - DNA, 22 bp, Homo sapiens
aaggccaggggctggcgcctcc

SEQ ID NO: 7654884 - DNA, 22 bp, Homo sapiens
aaggccaggggctggcgcctcc

SEQ ID NO: 7654885 - DNA, 22 bp, Homo sapiens
aaggccagggatgccagctcgg

SEQ ID NO: 7654886 - DNA, 22 bp, Homo sapiens
aaggcagataagaattcagcaa

SEQ ID NO: 7654887 - DNA, 22 bp, Homo sapiens
aaggcagataagaattcagcaa

SEQ ID NO: 7654888 - DNA, 22 bp, Homo sapiens
aaggcagataagaattcagcaa

SEQ ID NO: 7654889 - DNA, 22 bp, Homo sapiens
aaggccagggatgccagctcgg

SEQ ID NO: 7654890 - DNA, 22 bp, Homo sapiens
aaggcagataagaattcagcaa

SEQ ID NO: 7654891 - DNA, 22 bp, Homo sapiens
aaggcagataagaattcagcaa

SEQ ID NO: 7654892 - DNA, 20 bp, Homo sapiens
aaggcagagtgggttggagc

SEQ ID NO: 7654893 - DNA, 20 bp, Homo sapiens
aaggcagagtgggttggagc

SEQ ID NO: 7654894 - DNA, 20 bp, Homo sapiens
aaggcagagtgggttggagc

SEQ ID NO: 7654895 - DNA, 20 bp, Homo sapiens
aaggcagagtgggttggagc

SEQ ID NO: 7654896 - DNA, 22 bp, Homo sapiens
aaggcctcttctctctggagat

SEQ ID NO: 7654897 - DNA, 22 bp, Homo sapiens
aaggcctccgccaatggcagag

SEQ ID NO: 7654898 - DNA, 22 bp, Homo sapiens
aaggcctcttctctctggagat

SEQ ID NO: 7654899 - DNA, 22 bp, Homo sapiens
aaggcctcttctctctggagat

SEQ ID NO: 7654900 - DNA, 22 bp, Homo sapiens
aaggcctcttctctctggagat

SEQ ID NO: 7654901 - DNA, 22 bp, Homo sapiens
aaggcctccgccaatggcagag

SEQ ID NO: 7654902 - DNA, 22 bp, Homo sapiens
aaggcctccgccaatggcagag

SEQ ID NO: 7654903 - DNA, 22 bp, Homo sapiens
aaggcctccgccaatggcagag

SEQ ID NO: 7654904 - DNA, 22 bp, Homo sapiens
aaggcctcaggtgaggctgccc

SEQ ID NO: 7654905 - DNA, 22 bp, Homo sapiens
aaggcctcatgtaatcaggccc

SEQ ID NO: 7654906 - DNA, 22 bp, Homo sapiens
aaggcctcatgtaatcaggccc

SEQ ID NO: 7654907 - DNA, 22 bp, Homo sapiens
aaggcctccctctttcatggga

SEQ ID NO: 7654908 - DNA, 22 bp, Homo sapiens
aaggcctccctctttcatggga

SEQ ID NO: 7654909 - DNA, 22 bp, Homo sapiens
aaggcctccctgtgtgcaggtg

SEQ ID NO: 7654910 - DNA, 22 bp, Homo sapiens
aaggcctccctgtgtgcaggtg

SEQ ID NO: 7654911 - DNA, 22 bp, Homo sapiens
aaggcctccctgtgtgcaggtg

SEQ ID NO: 7654912 - DNA, 22 bp, Homo sapiens
aaggcctccctctttcatggga

SEQ ID NO: 7654913 - DNA, 22 bp, Homo sapiens
aaggccctttagcagaggaggg

SEQ ID NO: 7654914 - DNA, 22 bp, Homo sapiens
aaggcccttggaaaatgcagta

SEQ ID NO: 7654915 - DNA, 22 bp, Homo sapiens
aaggcccttggaaaatgcagta

SEQ ID NO: 7654916 - DNA, 22 bp, Homo sapiens
aaggcccttggaaaatgcagta

SEQ ID NO: 7654917 - DNA, 22 bp, Homo sapiens
aaggccaggggctggcgcctcc

SEQ ID NO: 7654918 - DNA, 22 bp, Homo sapiens
aaggccaggggctggcgcctcc

SEQ ID NO: 7654919 - DNA, 22 bp, Homo sapiens
aaggccaggggctggcgcctcc

SEQ ID NO: 7654920 - DNA, 22 bp, Homo sapiens
aaggccaggggctggcgcctcc

SEQ ID NO: 7654921 - DNA, 22 bp, Homo sapiens
aaggcctcaggtgaggctgccc

SEQ ID NO: 7654922 - DNA, 18 bp, Homo sapiens
aaggcctagtccctctct

SEQ ID NO: 7654923 - DNA, 22 bp, Homo sapiens
aaggcctcaggtgaggctgccc

SEQ ID NO: 7654924 - DNA, 22 bp, Homo sapiens
aaggccctttagcagaggaggg

SEQ ID NO: 7654925 - DNA, 22 bp, Homo sapiens
aaggctcagggtttaagtttct

SEQ ID NO: 7654926 - DNA, 22 bp, Homo sapiens
aaggctcaggagtcccttaagc

SEQ ID NO: 7654927 - DNA, 22 bp, Homo sapiens
aaggctcagtaataagttggaa

SEQ ID NO: 7654928 - DNA, 22 bp, Homo sapiens
aaggctcatcagggcatttaga

SEQ ID NO: 7654929 - DNA, 22 bp, Homo sapiens
aaggctcatcagggcatttaga

SEQ ID NO: 7654930 - DNA, 22 bp, Homo sapiens
aaggctccaccctcatggatgc

SEQ ID NO: 7654931 - DNA, 22 bp, Homo sapiens
aaggctccagtgaatgctggca

SEQ ID NO: 7654932 - DNA, 22 bp, Homo sapiens
aaggctcaaagaagctaagtga

SEQ ID NO: 7654933 - DNA, 22 bp, Homo sapiens
aaggctcaaagaagctaagtga

SEQ ID NO: 7654934 - DNA, 22 bp, Homo sapiens
aaggctcaattaactaagaagt

SEQ ID NO: 7654935 - DNA, 22 bp, Homo sapiens
aaggctcaattaactaagaagt

SEQ ID NO: 7654936 - DNA, 22 bp, Homo sapiens
aaggctcactgaaatgtaggca

SEQ ID NO: 7654937 - DNA, 22 bp, Homo sapiens
aaggctcagctactcagcctgc

SEQ ID NO: 7654938 - DNA, 22 bp, Homo sapiens
aaggctcagctactcagcctgc

SEQ ID NO: 7654939 - DNA, 22 bp, Homo sapiens
aaggctcagagcctggagctgc

SEQ ID NO: 7654940 - DNA, 22 bp, Homo sapiens
aaggctcactgaaatgtaggca

SEQ ID NO: 7654941 - DNA, 22 bp, Homo sapiens
aaggctcactgaaatgtaggca

SEQ ID NO: 7654942 - DNA, 22 bp, Homo sapiens
aaggctcactgtagagtaattg

SEQ ID NO: 7654943 - DNA, 22 bp, Homo sapiens
aaggctcagagcctggagctgc

SEQ ID NO: 7654944 - DNA, 22 bp, Homo sapiens
aaggctcagagcctggagctgc

SEQ ID NO: 7654945 - DNA, 22 bp, Homo sapiens
aaggctatattcattattctct

SEQ ID NO: 7654946 - DNA, 22 bp, Homo sapiens
aaggctatatctcaatactatt

SEQ ID NO: 7654947 - DNA, 22 bp, Homo sapiens
aaggctaaattctgtactgcat

SEQ ID NO: 7654948 - DNA, 22 bp, Homo sapiens
aaggctagagaggtattcaagt

SEQ ID NO: 7654949 - DNA, 22 bp, Homo sapiens
aaggctagagaggtattcaagt

SEQ ID NO: 7654950 - DNA, 22 bp, Homo sapiens
aaggctatgatctttttcatga

SEQ ID NO: 7654951 - DNA, 20 bp, Homo sapiens
aaggctatgctgtggtctgc

SEQ ID NO: 7654952 - DNA, 22 bp, Homo sapiens
aaggcctttcttatcagtagat

SEQ ID NO: 7654953 - DNA, 22 bp, Homo sapiens
aaggcctttgccccgatacagg

SEQ ID NO: 7654954 - DNA, 22 bp, Homo sapiens
aaggcctttcctgctttgaatg

SEQ ID NO: 7654955 - DNA, 22 bp, Homo sapiens
aaggcctttgggggcctggtcc

SEQ ID NO: 7654956 - DNA, 22 bp, Homo sapiens
aaggcggggggatcacgaggtc

SEQ ID NO: 7654957 - DNA, 22 bp, Homo sapiens
aaggctaaattctgtactgcat

SEQ ID NO: 7654958 - DNA, 22 bp, Homo sapiens
aaggcggggggatcacgaggtc

SEQ ID NO: 7654959 - DNA, 22 bp, Homo sapiens
aaggccttttcagttcctcctt

SEQ ID NO: 7654960 - DNA, 22 bp, Homo sapiens
aaggcgctgggctaaggcacca

SEQ ID NO: 7654961 - DNA, 22 bp, Homo sapiens
aaggctctgcaaaacctccaag

SEQ ID NO: 7654962 - DNA, 22 bp, Homo sapiens
aaggctctgcaaaacctccaag

SEQ ID NO: 7654963 - DNA, 22 bp, Homo sapiens
aaggctctgcaaaacctccaag

SEQ ID NO: 7654964 - DNA, 22 bp, Homo sapiens
aaggctctgcaaaacctccaag

SEQ ID NO: 7654965 - DNA, 22 bp, Homo sapiens
aaggctctctgatggcagcagt

SEQ ID NO: 7654966 - DNA, 22 bp, Homo sapiens
aaggctctctgatggcagcagt

SEQ ID NO: 7654967 - DNA, 22 bp, Homo sapiens
aaggctctctgatggcagcagt

SEQ ID NO: 7654968 - DNA, 22 bp, Homo sapiens
aaggctctccaaatgatataat

SEQ ID NO: 7654969 - DNA, 22 bp, Homo sapiens
aaggctctccaaatgatataat

SEQ ID NO: 7654970 - DNA, 22 bp, Homo sapiens
aaggctcggcaatgtgcggctc

SEQ ID NO: 7654971 - DNA, 21 bp, Homo sapiens
aaggctcctcctctaggcctc

SEQ ID NO: 7654972 - DNA, 22 bp, Homo sapiens
acattcttgaagtgaagtttat

SEQ ID NO: 7654973 - DNA, 22 bp, Homo sapiens
aaggctctctgatggcagcagt

SEQ ID NO: 7654974 - DNA, 21 bp, Homo sapiens
acattgtgtatgcgagagttt

SEQ ID NO: 7654975 - DNA, 21 bp, Homo sapiens
acattgtgtatgcgagagttt

SEQ ID NO: 7654976 - DNA, 22 bp, Homo sapiens
acattgttagtagaccagtggc

SEQ ID NO: 7654977 - DNA, 23 bp, Homo sapiens
acattgttcaatgaaagttagga

SEQ ID NO: 7654978 - DNA, 22 bp, Homo sapiens
acattcttcttgtgaatttact

SEQ ID NO: 7654979 - DNA, 22 bp, Homo sapiens
acattcttcttgtgaatttact

SEQ ID NO: 7654980 - DNA, 22 bp, Homo sapiens
acattcttccagctggctgttg

SEQ ID NO: 7654981 - DNA, 22 bp, Homo sapiens
acattcttcttgtgaatttact

SEQ ID NO: 7654982 - DNA, 22 bp, Homo sapiens
acattcttccagctggctgttg

SEQ ID NO: 7654983 - DNA, 22 bp, Homo sapiens
aaggctcttgagtggtgatagt

SEQ ID NO: 7654984 - DNA, 22 bp, Homo sapiens
acattcttccagctggctgttg

SEQ ID NO: 7654985 - DNA, 22 bp, Homo sapiens
aaggctctgggtttcataggtg

SEQ ID NO: 7654986 - DNA, 22 bp, Homo sapiens
acatttaaatatgccttatatt

SEQ ID NO: 7654987 - DNA, 19 bp, Homo sapiens
acatttaaattcagatctc

SEQ ID NO: 7654988 - DNA, 19 bp, Homo sapiens
acatttaaattcagatctc

SEQ ID NO: 7654989 - DNA, 19 bp, Homo sapiens
acatttaaattcagatctc

SEQ ID NO: 7654990 - DNA, 19 bp, Homo sapiens
acatttaaattcagatctc

SEQ ID NO: 7654991 - DNA, 22 bp, Homo sapiens
aaggctggacctggatgaatct

SEQ ID NO: 7654992 - DNA, 22 bp, Homo sapiens
aaggctgcttttaacatgcata

SEQ ID NO: 7654993 - DNA, 19 bp, Homo sapiens
acatttaaattcagatctc

SEQ ID NO: 7654994 - DNA, 19 bp, Homo sapiens
acatttaaattcagatctc

SEQ ID NO: 7654995 - DNA, 22 bp, Homo sapiens
aaggctgcttttaacatgcata

SEQ ID NO: 7654996 - DNA, 19 bp, Homo sapiens
aaggctggagaaggcctct

SEQ ID NO: 7654997 - DNA, 19 bp, Homo sapiens
aaggctggagaaggcctct

SEQ ID NO: 7654998 - DNA, 19 bp, Homo sapiens
aaggctggagaaggcctct

SEQ ID NO: 7654999 - DNA, 22 bp, Homo sapiens
aaggctggacctggatgaatct

SEQ ID NO: 7655000 - DNA, 22 bp, Homo sapiens
aaggctggacctggatgaatct

SEQ ID NO: 7655001 - DNA, 22 bp, Homo sapiens
aaggctggacctggatgaatct

SEQ ID NO: 7655002 - DNA, 22 bp, Homo sapiens
aaggctggacctggatgaatct

SEQ ID NO: 7655003 - DNA, 22 bp, Homo sapiens
aaggctggacctggatgaatct

SEQ ID NO: 7655004 - DNA, 22 bp, Homo sapiens
aaggctggacctggatgaatct

SEQ ID NO: 7655005 - DNA, 22 bp, Homo sapiens
aaggctggacctggatgaatct

SEQ ID NO: 7655006 - DNA, 21 bp, Homo sapiens
aaggctggagatgcaggtctg

SEQ ID NO: 7655007 - DNA, 21 bp, Homo sapiens
aaggctggagatgcaggtctg

SEQ ID NO: 7655008 - DNA, 21 bp, Homo sapiens
aaggctggagatgcaggtctg

SEQ ID NO: 7655009 - DNA, 21 bp, Homo sapiens
aaggctggagatgcaggtctg

SEQ ID NO: 7655010 - DNA, 21 bp, Homo sapiens
aaggctggagatgcaggtctg

SEQ ID NO: 7655011 - DNA, 22 bp, Homo sapiens
aaggctggagatggttggaatg

SEQ ID NO: 7655012 - DNA, 22 bp, Homo sapiens
aaggctggagatggttggaatg

SEQ ID NO: 7655013 - DNA, 22 bp, Homo sapiens
aaggctggagatggttggaatg

SEQ ID NO: 7655014 - DNA, 22 bp, Homo sapiens
aaggctggagatggttggaatg

SEQ ID NO: 7655015 - DNA, 19 bp, Homo sapiens
aaggctggagaaggcctct

SEQ ID NO: 7655016 - DNA, 19 bp, Homo sapiens
aaggctggagaaggcctct

SEQ ID NO: 7655017 - DNA, 19 bp, Homo sapiens
aaggctggagaaggcctct

SEQ ID NO: 7655018 - DNA, 21 bp, Homo sapiens
aaggctggagatgcaggtctg

SEQ ID NO: 7655019 - DNA, 21 bp, Homo sapiens
aaggctggagatgcaggtctg

SEQ ID NO: 7655020 - DNA, 21 bp, Homo sapiens
aaggctggagatgcaggtctg

SEQ ID NO: 7655021 - DNA, 22 bp, Homo sapiens
acatttaaatatgccttatatt

SEQ ID NO: 7655022 - DNA, 22 bp, Homo sapiens
acatttaaatatgccttatatt

SEQ ID NO: 7655023 - DNA, 22 bp, Homo sapiens
acatttaaatatgccttatatt

SEQ ID NO: 7655024 - DNA, 22 bp, Homo sapiens
acatttaaatatgccttatatt

SEQ ID NO: 7655025 - DNA, 22 bp, Homo sapiens
acatttaaatacctatgtttct

SEQ ID NO: 7655026 - DNA, 22 bp, Homo sapiens
acatttaaatacctatgtttct

SEQ ID NO: 7655027 - DNA, 22 bp, Homo sapiens
acatttaaatacctatgtttct

SEQ ID NO: 7655028 - DNA, 22 bp, Homo sapiens
acatttaaatacctatgtttct

SEQ ID NO: 7655029 - DNA, 22 bp, Homo sapiens
acatttaaatacctatgtttct

SEQ ID NO: 7655030 - DNA, 22 bp, Homo sapiens
acatttaaatacctatgtttct

SEQ ID NO: 7655031 - DNA, 22 bp, Homo sapiens
acatttaaatacctatgtttct

SEQ ID NO: 7655032 - DNA, 22 bp, Homo sapiens
acattgtttgagaatacagatg

SEQ ID NO: 7655033 - DNA, 22 bp, Homo sapiens
acattgtttgagaatacagatg

SEQ ID NO: 7655034 - DNA, 22 bp, Homo sapiens
acattgtttgagaatacagatg

SEQ ID NO: 7655035 - DNA, 22 bp, Homo sapiens
acattgtttgagaatacagatg

SEQ ID NO: 7655036 - DNA, 22 bp, Homo sapiens
acattgtttgagaatacagatg

SEQ ID NO: 7655037 - DNA, 22 bp, Homo sapiens
acattgtttgagaatacagatg

SEQ ID NO: 7655038 - DNA, 22 bp, Homo sapiens
acattgtttctgaccatgatga

SEQ ID NO: 7655039 - DNA, 22 bp, Homo sapiens
acattgttgtttgcagcacagg

SEQ ID NO: 7655040 - DNA, 22 bp, Homo sapiens
acattgttgtttgcagcacagg

SEQ ID NO: 7655041 - DNA, 22 bp, Homo sapiens
acattgttctacttctagttag

SEQ ID NO: 7655042 - DNA, 22 bp, Homo sapiens
acattgttctacttctagttag

SEQ ID NO: 7655043 - DNA, 22 bp, Homo sapiens
acattgttgagcctcttgttca

SEQ ID NO: 7655044 - DNA, 22 bp, Homo sapiens
acattgttgagcctcttgttca

SEQ ID NO: 7655045 - DNA, 22 bp, Homo sapiens
acattgttgagcctcttgttca

SEQ ID NO: 7655046 - DNA, 22 bp, Homo sapiens
acattgttgtgcaattatagtt

SEQ ID NO: 7655047 - DNA, 22 bp, Homo sapiens
acattgttgtgcaattatagtt

SEQ ID NO: 7655048 - DNA, 22 bp, Homo sapiens
acattgttgcctagccatgagt

SEQ ID NO: 7655049 - DNA, 22 bp, Homo sapiens
acattgttgcctagccatgagt

SEQ ID NO: 7655050 - DNA, 22 bp, Homo sapiens
aaggctgggaaacatgcaggcc

SEQ ID NO: 7655051 - DNA, 22 bp, Homo sapiens
aaggctgggaaacatgcaggcc

SEQ ID NO: 7655052 - DNA, 22 bp, Homo sapiens
acatttcatgttttccagagca

SEQ ID NO: 7655053 - DNA, 22 bp, Homo sapiens
acatttcatgttttccagagca

SEQ ID NO: 7655054 - DNA, 22 bp, Homo sapiens
acatttcatttgcagtatggat

SEQ ID NO: 7655055 - DNA, 22 bp, Homo sapiens
acatttcatttgcagtatggat

SEQ ID NO: 7655056 - DNA, 22 bp, Homo sapiens
aaggctggcaatatatttgtta

SEQ ID NO: 7655057 - DNA, 22 bp, Homo sapiens
aaggctggcaatatatttgtta

SEQ ID NO: 7655058 - DNA, 22 bp, Homo sapiens
aaggctggcaatatatttgtta

SEQ ID NO: 7655059 - DNA, 22 bp, Homo sapiens
aaggctgggaaacatgcaggcc

SEQ ID NO: 7655060 - DNA, 22 bp, Homo sapiens
aaggctgggaaacatgcaggcc

SEQ ID NO: 7655061 - DNA, 22 bp, Homo sapiens
aaggctgggaaacatgcaggcc

SEQ ID NO: 7655062 - DNA, 22 bp, Homo sapiens
aaggctgggaaacatgcaggcc

SEQ ID NO: 7655063 - DNA, 22 bp, Homo sapiens
aaggctgggaaacatgcaggcc

SEQ ID NO: 7655064 - DNA, 22 bp, Homo sapiens
acatttctcttgatgtctctat

SEQ ID NO: 7655065 - DNA, 22 bp, Homo sapiens
acatttcatttgcagtatggat

SEQ ID NO: 7655066 - DNA, 22 bp, Homo sapiens
acatttctcttgatgtctctat

SEQ ID NO: 7655067 - DNA, 22 bp, Homo sapiens
acatttctcttgatgtctctat

SEQ ID NO: 7655068 - DNA, 22 bp, Homo sapiens
acatttctcttgatgtctctat

SEQ ID NO: 7655069 - DNA, 22 bp, Homo sapiens
acatttctcttgatgtctctat

SEQ ID NO: 7655070 - DNA, 22 bp, Homo sapiens
acatttctcttgatgtctctat

SEQ ID NO: 7655071 - DNA, 22 bp, Homo sapiens
acatttctgagcagggagctgt

SEQ ID NO: 7655072 - DNA, 22 bp, Homo sapiens
acatttctgagcagggagctgt

SEQ ID NO: 7655073 - DNA, 22 bp, Homo sapiens
acatttctgcatctcagagcta

SEQ ID NO: 7655074 - DNA, 22 bp, Homo sapiens
acatttctgagcagggagctgt

SEQ ID NO: 7655075 - DNA, 22 bp, Homo sapiens
acatttctcttgatgtctctat

SEQ ID NO: 7655076 - DNA, 22 bp, Homo sapiens
acatttctgcatctcagagcta

SEQ ID NO: 7655077 - DNA, 22 bp, Homo sapiens
acatttctgcatctcagagcta

SEQ ID NO: 7655078 - DNA, 22 bp, Homo sapiens
acatttctgcatgtagggtaat

SEQ ID NO: 7655079 - DNA, 22 bp, Homo sapiens
acatttctgcatctcagagcta

SEQ ID NO: 7655080 - DNA, 22 bp, Homo sapiens
acatttctgcatctcagagcta

SEQ ID NO: 7655081 - DNA, 22 bp, Homo sapiens
acatttctgcatgtagggtaat

SEQ ID NO: 7655082 - DNA, 22 bp, Homo sapiens
acatttcttccctttagcagaa

SEQ ID NO: 7655083 - DNA, 22 bp, Homo sapiens
acatttcttccctttagcagaa

SEQ ID NO: 7655084 - DNA, 22 bp, Homo sapiens
acatttcttccctttagcagaa

SEQ ID NO: 7655085 - DNA, 22 bp, Homo sapiens
acatttcttccacatgctgctg

SEQ ID NO: 7655086 - DNA, 22 bp, Homo sapiens
acatttcttccacatgctgctg

SEQ ID NO: 7655087 - DNA, 22 bp, Homo sapiens
acatttcttccacatgctgctg

SEQ ID NO: 7655088 - DNA, 22 bp, Homo sapiens
acatttcttagcctagttccag

SEQ ID NO: 7655089 - DNA, 22 bp, Homo sapiens
acatttcttagcctagttccag

SEQ ID NO: 7655090 - DNA, 22 bp, Homo sapiens
acatttctgtcttagggactgt

SEQ ID NO: 7655091 - DNA, 22 bp, Homo sapiens
acatttcttagcctagttccag

SEQ ID NO: 7655092 - DNA, 22 bp, Homo sapiens
acatttcttccacatgctgctg

SEQ ID NO: 7655093 - DNA, 22 bp, Homo sapiens
acatttcttccctttagcagaa

SEQ ID NO: 7655094 - DNA, 22 bp, Homo sapiens
acatttcttccctttagcagaa

SEQ ID NO: 7655095 - DNA, 22 bp, Homo sapiens
acatttgtgcaacgtatccaca

SEQ ID NO: 7655096 - DNA, 22 bp, Homo sapiens
acatttcttcctaattatccct

SEQ ID NO: 7655097 - DNA, 22 bp, Homo sapiens
acatttcttcctaattatccct

SEQ ID NO: 7655098 - DNA, 22 bp, Homo sapiens
acatttgtgcaacgtatccaca

SEQ ID NO: 7655099 - DNA, 22 bp, Homo sapiens
acatttctggagtttctcaaca

SEQ ID NO: 7655100 - DNA, 22 bp, Homo sapiens
acatttctggagtttctcaaca

SEQ ID NO: 7655101 - DNA, 22 bp, Homo sapiens
acatttctggagtttctcaaca

SEQ ID NO: 7655102 - DNA, 22 bp, Homo sapiens
acatttctggagtttctcaaca

SEQ ID NO: 7655103 - DNA, 22 bp, Homo sapiens
acatttctggagtttctcaaca

SEQ ID NO: 7655104 - DNA, 22 bp, Homo sapiens
acatttctggagtttctcaaca

SEQ ID NO: 7655105 - DNA, 22 bp, Homo sapiens
acatttctgctagaataggtga

SEQ ID NO: 7655106 - DNA, 22 bp, Homo sapiens
acatttctgctagaataggtga

SEQ ID NO: 7655107 - DNA, 22 bp, Homo sapiens
acatttctgctagaataggtga

SEQ ID NO: 7655108 - DNA, 22 bp, Homo sapiens
acatttctgctagaataggtga

SEQ ID NO: 7655109 - DNA, 22 bp, Homo sapiens
acatttctgctagaataggtga

SEQ ID NO: 7655110 - DNA, 22 bp, Homo sapiens
acatttctggagtttctcaaca

SEQ ID NO: 7655111 - DNA, 22 bp, Homo sapiens
acatttctggagtttctcaaca

SEQ ID NO: 7655112 - DNA, 22 bp, Homo sapiens
acatttctggagtttctcaaca

SEQ ID NO: 7655113 - DNA, 22 bp, Homo sapiens
acatttctggagtttctcaaca

SEQ ID NO: 7655114 - DNA, 22 bp, Homo sapiens
acatttctggagtttctcaaca

SEQ ID NO: 7655115 - DNA, 22 bp, Homo sapiens
acatttctgtcttagggactgt

SEQ ID NO: 7655116 - DNA, 22 bp, Homo sapiens
acatttctgtcttagggactgt

SEQ ID NO: 7655117 - DNA, 22 bp, Homo sapiens
acatttctgtcttagggactgt

SEQ ID NO: 7655118 - DNA, 22 bp, Homo sapiens
acatttcttagcctagttccag

SEQ ID NO: 7655119 - DNA, 22 bp, Homo sapiens
aagatgcacaatgtggcaatta

SEQ ID NO: 7655120 - DNA, 22 bp, Homo sapiens
aagatgcacaatgtggcaatta

SEQ ID NO: 7655121 - DNA, 22 bp, Homo sapiens
aagatgcagcaaactacttttt

SEQ ID NO: 7655122 - DNA, 22 bp, Homo sapiens
aagatgcagcttccacttttgc

SEQ ID NO: 7655123 - DNA, 22 bp, Homo sapiens
aagatgcagcttccacttttgc

SEQ ID NO: 7655124 - DNA, 22 bp, Homo sapiens
aagatgcagcttccacttttgc

SEQ ID NO: 7655125 - DNA, 22 bp, Homo sapiens
aagatgcatgctgaagctggct

SEQ ID NO: 7655126 - DNA, 22 bp, Homo sapiens
aagatgcggttgaccatggtgt

SEQ ID NO: 7655127 - DNA, 22 bp, Homo sapiens
aagatgctaattgtggaagttg

SEQ ID NO: 7655128 - DNA, 22 bp, Homo sapiens
aagatgctaattgtggaagttg

SEQ ID NO: 7655129 - DNA, 22 bp, Homo sapiens
aagatgcatgctgaagctggct

SEQ ID NO: 7655130 - DNA, 22 bp, Homo sapiens
aagatgcatgctgaagctggct

SEQ ID NO: 7655131 - DNA, 22 bp, Homo sapiens
aagatgcctgtagcaggaagat

SEQ ID NO: 7655132 - DNA, 22 bp, Homo sapiens
aagatgactatttatctgtaag

SEQ ID NO: 7655133 - DNA, 22 bp, Homo sapiens
aagatgatagatctgtcaatgt

SEQ ID NO: 7655134 - DNA, 22 bp, Homo sapiens
aagatgaccctgagggcaattg

SEQ ID NO: 7655135 - DNA, 22 bp, Homo sapiens
aagatgatgttgtgttttcact

SEQ ID NO: 7655136 - DNA, 22 bp, Homo sapiens
aagatgatgcagactttgatgt

SEQ ID NO: 7655137 - DNA, 22 bp, Homo sapiens
aagatgatgcagactttgatgt

SEQ ID NO: 7655138 - DNA, 22 bp, Homo sapiens
aagatgatggtatatagggtat

SEQ ID NO: 7655139 - DNA, 22 bp, Homo sapiens
aagatgatgttgtgttttcact

SEQ ID NO: 7655140 - DNA, 22 bp, Homo sapiens
aagatgatgttgtgttttcact

SEQ ID NO: 7655141 - DNA, 22 bp, Homo sapiens
aagatgataggacttgcttaag

SEQ ID NO: 7655142 - DNA, 22 bp, Homo sapiens
aagatgataggacttgcttaag

SEQ ID NO: 7655143 - DNA, 22 bp, Homo sapiens
aagatgataggacttgcttaag

SEQ ID NO: 7655144 - DNA, 21 bp, Homo sapiens
aagatgatattttatctgtag

SEQ ID NO: 7655145 - DNA, 21 bp, Homo sapiens
aagatgatattttatctgtag

SEQ ID NO: 7655146 - DNA, 22 bp, Homo sapiens
aagatgtgatggtagcttttac

SEQ ID NO: 7655147 - DNA, 22 bp, Homo sapiens
aagatgtgatgggttaagggcc

SEQ ID NO: 7655148 - DNA, 22 bp, Homo sapiens
aagatgtgcagttcatggcagg

SEQ ID NO: 7655149 - DNA, 22 bp, Homo sapiens
aagatgtgaacagaaccacagg

SEQ ID NO: 7655150 - DNA, 22 bp, Homo sapiens
aagatgtgaaattgtctctggg

SEQ ID NO: 7655151 - DNA, 22 bp, Homo sapiens
aagatgtgatgggttaagggcc

SEQ ID NO: 7655152 - DNA, 22 bp, Homo sapiens
aagatgtatcagttaagtcttc

SEQ ID NO: 7655153 - DNA, 23 bp, Homo sapiens
aagatgtatttttaccaaatgtc

SEQ ID NO: 7655154 - DNA, 22 bp, Homo sapiens
aagatgtgaaattgtctctggg

SEQ ID NO: 7655155 - DNA, 22 bp, Homo sapiens
aagatgtgaaattgtctctggg

SEQ ID NO: 7655156 - DNA, 22 bp, Homo sapiens
aagatggtaaggcagctggcag

SEQ ID NO: 7655157 - DNA, 22 bp, Homo sapiens
aagatggtcttgagatattata

SEQ ID NO: 7655158 - DNA, 22 bp, Homo sapiens
aagatggtggccagagtggaaa

SEQ ID NO: 7655159 - DNA, 21 bp, Homo sapiens
aagatggttatgtgctaaaga

SEQ ID NO: 7655160 - DNA, 22 bp, Homo sapiens
aagatggtgtggtcaaggacca

SEQ ID NO: 7655161 - DNA, 22 bp, Homo sapiens
aagatggcatctcctatagatg

SEQ ID NO: 7655162 - DNA, 22 bp, Homo sapiens
aagatggttatttcatcaccta

SEQ ID NO: 7655163 - DNA, 22 bp, Homo sapiens
aagatggtttctgtaggtttat

SEQ ID NO: 7655164 - DNA, 22 bp, Homo sapiens
aagatgtatcagttaagtcttc

SEQ ID NO: 7655165 - DNA, 22 bp, Homo sapiens
aagatgtaaaggcaatataaag

SEQ ID NO: 7655166 - DNA, 22 bp, Homo sapiens
aagatgtaaaggcaatataaag

SEQ ID NO: 7655167 - DNA, 22 bp, Homo sapiens
aagatgtaaaggcaatataaag

SEQ ID NO: 7655168 - DNA, 22 bp, Homo sapiens
aagatggcaggaatcataagct

SEQ ID NO: 7655169 - DNA, 22 bp, Homo sapiens
aagatggagtagtgtaatggtt

SEQ ID NO: 7655170 - DNA, 22 bp, Homo sapiens
aagatggagtagtgtaatggtt

SEQ ID NO: 7655171 - DNA, 22 bp, Homo sapiens
aagatggagcacgagcagaagc

SEQ ID NO: 7655172 - DNA, 22 bp, Homo sapiens
aagatggagcacgagcagaagc

SEQ ID NO: 7655173 - DNA, 22 bp, Homo sapiens
aagatggtaaggcagctggcag

SEQ ID NO: 7655174 - DNA, 22 bp, Homo sapiens
aagatggcatctcctatagatg

SEQ ID NO: 7655175 - DNA, 22 bp, Homo sapiens
aagatggctgcagcaattccaa

SEQ ID NO: 7655176 - DNA, 22 bp, Homo sapiens
aagatggctgcagcaattccaa

SEQ ID NO: 7655177 - DNA, 22 bp, Homo sapiens
aagatgcttccactgcagtggc

SEQ ID NO: 7655178 - DNA, 22 bp, Homo sapiens
aagatgcttgcaaatttctgaa

SEQ ID NO: 7655179 - DNA, 22 bp, Homo sapiens
aagatgcttgcaaatttctgaa

SEQ ID NO: 7655180 - DNA, 22 bp, Homo sapiens
aagatgcttgcaaatttctgaa

SEQ ID NO: 7655181 - DNA, 22 bp, Homo sapiens
aagatgctggcaggaatagcta

SEQ ID NO: 7655182 - DNA, 22 bp, Homo sapiens
aagatgctggcaggaatagcta

SEQ ID NO: 7655183 - DNA, 22 bp, Homo sapiens
aagcaataatcccaaagtgctg

SEQ ID NO: 7655184 - DNA, 22 bp, Homo sapiens
aagcaataatcccaaagtgctg

SEQ ID NO: 7655185 - DNA, 22 bp, Homo sapiens
aagcaatagcaacaactttaca

SEQ ID NO: 7655186 - DNA, 22 bp, Homo sapiens
aagcaatagcaacaactttaca

SEQ ID NO: 7655187 - DNA, 22 bp, Homo sapiens
aagcaaggccggaaggaaactc

SEQ ID NO: 7655188 - DNA, 22 bp, Homo sapiens
aagcaagtaggtatttgacaaa

SEQ ID NO: 7655189 - DNA, 22 bp, Homo sapiens
aagcaagttctcatcatttata

SEQ ID NO: 7655190 - DNA, 22 bp, Homo sapiens
aagcaagtaggtatttgacaaa

SEQ ID NO: 7655191 - DNA, 22 bp, Homo sapiens
aagcaagttctcatcatttata

SEQ ID NO: 7655192 - DNA, 22 bp, Homo sapiens
aagcaataaataatttttagta

SEQ ID NO: 7655193 - DNA, 22 bp, Homo sapiens
aagcaataagccagatttggat

SEQ ID NO: 7655194 - DNA, 22 bp, Homo sapiens
aagcaataagccagatttggat

SEQ ID NO: 7655195 - DNA, 22 bp, Homo sapiens
aagcaaggccggaaggaaactc

SEQ ID NO: 7655196 - DNA, 22 bp, Homo sapiens
aagcaaggccggaaggaaactc

SEQ ID NO: 7655197 - DNA, 22 bp, Homo sapiens
aagcaaggccggaaggaaactc

SEQ ID NO: 7655198 - DNA, 22 bp, Homo sapiens
aagcaaggcccagagcatcagc

SEQ ID NO: 7655199 - DNA, 22 bp, Homo sapiens
aagcaaggcccagagcatcagc

SEQ ID NO: 7655200 - DNA, 22 bp, Homo sapiens
aagcaaggcccagagcatcagc

SEQ ID NO: 7655201 - DNA, 22 bp, Homo sapiens
aagcaaggcaacctatgtccag

SEQ ID NO: 7655202 - DNA, 22 bp, Homo sapiens
aagcaaggcaacctatgtccag

SEQ ID NO: 7655203 - DNA, 22 bp, Homo sapiens
aagcaaggcccagagcatcagc

SEQ ID NO: 7655204 - DNA, 22 bp, Homo sapiens
aagcaaggcccagagcatcagc

SEQ ID NO: 7655205 - DNA, 22 bp, Homo sapiens
aagcaaggcaacctatgtccag

SEQ ID NO: 7655206 - DNA, 22 bp, Homo sapiens
aagcaaggcaacctatgtccag

SEQ ID NO: 7655207 - DNA, 22 bp, Homo sapiens
aagcaaggcaacctatgtccag

SEQ ID NO: 7655208 - DNA, 22 bp, Homo sapiens
aagcaaggcaacctatgtccag

SEQ ID NO: 7655209 - DNA, 19 bp, Homo sapiens
aagcaagctttgagtgggt

SEQ ID NO: 7655210 - DNA, 19 bp, Homo sapiens
aagcaagctttgagtgggt

SEQ ID NO: 7655211 - DNA, 22 bp, Homo sapiens
aagcaagccaatctgttttgtt

SEQ ID NO: 7655212 - DNA, 22 bp, Homo sapiens
aagcaagctgttggcaataggg

SEQ ID NO: 7655213 - DNA, 22 bp, Homo sapiens
aagcaagcccaggctcagtcaa

SEQ ID NO: 7655214 - DNA, 22 bp, Homo sapiens
aagcaagagttggagtgatgtt

SEQ ID NO: 7655215 - DNA, 22 bp, Homo sapiens
aagcaagcagtgtggaatttta

SEQ ID NO: 7655216 - DNA, 22 bp, Homo sapiens
aagcaagagttggagtgatgtt

SEQ ID NO: 7655217 - DNA, 22 bp, Homo sapiens
aagcaagcaaggtgttacatat

SEQ ID NO: 7655218 - DNA, 22 bp, Homo sapiens
aagatgttaaatctgtagaatt

SEQ ID NO: 7655219 - DNA, 22 bp, Homo sapiens
aagatgttagaggtcatgcaga

SEQ ID NO: 7655220 - DNA, 22 bp, Homo sapiens
aagatgttagaggtcatgcaga

SEQ ID NO: 7655221 - DNA, 22 bp, Homo sapiens
aagatgttagaggtcatgcaga

SEQ ID NO: 7655222 - DNA, 22 bp, Homo sapiens
aagatgttactcaaccaggata

SEQ ID NO: 7655223 - DNA, 22 bp, Homo sapiens
aagatgttagaggtcatgcaga

SEQ ID NO: 7655224 - DNA, 22 bp, Homo sapiens
aagatgtgtctcatcagggtgt

SEQ ID NO: 7655225 - DNA, 22 bp, Homo sapiens
aagatgtgtccattctttgctc

SEQ ID NO: 7655226 - DNA, 22 bp, Homo sapiens
aagatgtgtccattctttgctc

SEQ ID NO: 7655227 - DNA, 22 bp, Homo sapiens
aagatgttaaatctgtagaatt

SEQ ID NO: 7655228 - DNA, 22 bp, Homo sapiens
aagatgtgcagttcatggcagg

SEQ ID NO: 7655229 - DNA, 22 bp, Homo sapiens
aagatgtgcagttcatggcagg

SEQ ID NO: 7655230 - DNA, 22 bp, Homo sapiens
aagatgtgcatgggtatgcaat

SEQ ID NO: 7655231 - DNA, 22 bp, Homo sapiens
aagatgtgctatcaactggaga

SEQ ID NO: 7655232 - DNA, 22 bp, Homo sapiens
aagatgtgctatcaactggaga

SEQ ID NO: 7655233 - DNA, 22 bp, Homo sapiens
aagatgtgctgtcttgccactc

SEQ ID NO: 7655234 - DNA, 22 bp, Homo sapiens
aagatgtgctgtcttgccactc

SEQ ID NO: 7655235 - DNA, 22 bp, Homo sapiens
aagatgtggacccagccaggct

SEQ ID NO: 7655236 - DNA, 22 bp, Homo sapiens
aagatgtgtcaccccatgactg

SEQ ID NO: 7655237 - DNA, 22 bp, Homo sapiens
aagatgtgtccattctttgctc

SEQ ID NO: 7655238 - DNA, 22 bp, Homo sapiens
aagcaagaggaaatgtggacct

SEQ ID NO: 7655239 - DNA, 22 bp, Homo sapiens
aagcaagacagaagttactgcc

SEQ ID NO: 7655240 - DNA, 22 bp, Homo sapiens
aagcaagaggaaatgtggacct

SEQ ID NO: 7655241 - DNA, 22 bp, Homo sapiens
aagcaagagttggagtgatgtt

SEQ ID NO: 7655242 - DNA, 22 bp, Homo sapiens
aagcaagacagaagttactgcc

SEQ ID NO: 7655243 - DNA, 22 bp, Homo sapiens
aagcaagagttggagtgatgtt

SEQ ID NO: 7655244 - DNA, 22 bp, Homo sapiens
aagcaagagttggagtgatgtt

SEQ ID NO: 7655245 - DNA, 22 bp, Homo sapiens
aagcaagagttggagtgatgtt

SEQ ID NO: 7655246 - DNA, 22 bp, Homo sapiens
aagcaagagttggagtgatgtt

SEQ ID NO: 7655247 - DNA, 22 bp, Homo sapiens
aagcaagagttggagtgatgtt

SEQ ID NO: 7655248 - DNA, 22 bp, Homo sapiens
aagcaagacagaagttactgcc

SEQ ID NO: 7655249 - DNA, 22 bp, Homo sapiens
aagcaaagagataaccttttgg

SEQ ID NO: 7655250 - DNA, 22 bp, Homo sapiens
aagcaaagagataaccttttgg

SEQ ID NO: 7655251 - DNA, 22 bp, Homo sapiens
aagcaaagagataaccttttgg

SEQ ID NO: 7655252 - DNA, 22 bp, Homo sapiens
aagcaaagacagtttgagtgga

SEQ ID NO: 7655253 - DNA, 22 bp, Homo sapiens
aagatgttattgtcttccttgc

SEQ ID NO: 7655254 - DNA, 22 bp, Homo sapiens
aagatgttattgtcttccttgc

SEQ ID NO: 7655255 - DNA, 22 bp, Homo sapiens
aagatgttattgtcttccttgc

SEQ ID NO: 7655256 - DNA, 22 bp, Homo sapiens
acacatttctaaatttttaccg

SEQ ID NO: 7655257 - DNA, 22 bp, Homo sapiens
acacatttctaaatttttaccg

SEQ ID NO: 7655258 - DNA, 22 bp, Homo sapiens
acacatttctaaatttttaccg

SEQ ID NO: 7655259 - DNA, 22 bp, Homo sapiens
acacatttctaaatttttaccg

SEQ ID NO: 7655260 - DNA, 22 bp, Homo sapiens
acacatttctaaatttttaccg

SEQ ID NO: 7655261 - DNA, 22 bp, Homo sapiens
acacatttctaaatttttaccg

SEQ ID NO: 7655262 - DNA, 22 bp, Homo sapiens
acacatttctaaatttttaccg

SEQ ID NO: 7655263 - DNA, 22 bp, Homo sapiens
acacatttattacatgcatgtg

SEQ ID NO: 7655264 - DNA, 22 bp, Homo sapiens
acacatttattacatgcatgtg

SEQ ID NO: 7655265 - DNA, 22 bp, Homo sapiens
acacatttattacatgcatgtg

SEQ ID NO: 7655266 - DNA, 22 bp, Homo sapiens
acacatttattacatgcatgtg

SEQ ID NO: 7655267 - DNA, 22 bp, Homo sapiens
acacatttattacatgcatgtg

SEQ ID NO: 7655268 - DNA, 22 bp, Homo sapiens
acacatttattacatgcatgtg

SEQ ID NO: 7655269 - DNA, 22 bp, Homo sapiens
acacatttattacatgcatgtg

SEQ ID NO: 7655270 - DNA, 22 bp, Homo sapiens
acacatttattacatgcatgtg

SEQ ID NO: 7655271 - DNA, 22 bp, Homo sapiens
acacatttatggatcgcagaaa

SEQ ID NO: 7655272 - DNA, 22 bp, Homo sapiens
acacatttatggatcgcagaaa

SEQ ID NO: 7655273 - DNA, 22 bp, Homo sapiens
acacatttagcaccaggtttat

SEQ ID NO: 7655274 - DNA, 22 bp, Homo sapiens
acacatttagcaccaggtttat

SEQ ID NO: 7655275 - DNA, 22 bp, Homo sapiens
acacatttagcaccaggtttat

SEQ ID NO: 7655276 - DNA, 22 bp, Homo sapiens
acacatttagcaccaggtttat

SEQ ID NO: 7655277 - DNA, 22 bp, Homo sapiens
aagatatagatggtggtataaa

SEQ ID NO: 7655278 - DNA, 22 bp, Homo sapiens
aagatatagatggtggtataaa

SEQ ID NO: 7655279 - DNA, 22 bp, Homo sapiens
aagatatagatggtggtataaa

SEQ ID NO: 7655280 - DNA, 22 bp, Homo sapiens
aagatatagatggtggtataaa

SEQ ID NO: 7655281 - DNA, 22 bp, Homo sapiens
aagatccttctcactgcagtgt

SEQ ID NO: 7655282 - DNA, 22 bp, Homo sapiens
aagatatagataaaactatgca

SEQ ID NO: 7655283 - DNA, 22 bp, Homo sapiens
acacatttctaaatttttaccg

SEQ ID NO: 7655284 - DNA, 22 bp, Homo sapiens
aagatatagataaaactatgca

SEQ ID NO: 7655285 - DNA, 22 bp, Homo sapiens
aagatatagataaaactatgca

SEQ ID NO: 7655286 - DNA, 22 bp, Homo sapiens
aagatatagataaaactatgca

SEQ ID NO: 7655287 - DNA, 22 bp, Homo sapiens
aagatgaatcagtatgtgtcct

SEQ ID NO: 7655288 - DNA, 22 bp, Homo sapiens
aagatgaatcagtatgtgtcct

SEQ ID NO: 7655289 - DNA, 22 bp, Homo sapiens
aagatgaactgtcttcacccat

SEQ ID NO: 7655290 - DNA, 22 bp, Homo sapiens
aagatgaagaacatgagcacac

SEQ ID NO: 7655291 - DNA, 22 bp, Homo sapiens
aagatgaaaatttactgtgatg

SEQ ID NO: 7655292 - DNA, 22 bp, Homo sapiens
aagatgaaaatttactgtgatg

SEQ ID NO: 7655293 - DNA, 22 bp, Homo sapiens
aagatgaaaatttactgtgatg

SEQ ID NO: 7655294 - DNA, 22 bp, Homo sapiens
aagatgaaaatttactgtgatg

SEQ ID NO: 7655295 - DNA, 22 bp, Homo sapiens
aagatgaaaatttactgtgatg

SEQ ID NO: 7655296 - DNA, 22 bp, Homo sapiens
aagatccttgggaaattgacct

SEQ ID NO: 7655297 - DNA, 22 bp, Homo sapiens
aagatccttctcactgcagtgt

SEQ ID NO: 7655298 - DNA, 22 bp, Homo sapiens
acacatttacatgtttacgtat

SEQ ID NO: 7655299 - DNA, 22 bp, Homo sapiens
acacatttacatgtttacgtat

SEQ ID NO: 7655300 - DNA, 22 bp, Homo sapiens
acacatttacatgtttacgtat

SEQ ID NO: 7655301 - DNA, 22 bp, Homo sapiens
acacatttaaaaaggaacatat

SEQ ID NO: 7655302 - DNA, 22 bp, Homo sapiens
acacatttaaaaaggaacatat

SEQ ID NO: 7655303 - DNA, 22 bp, Homo sapiens
acacatttaaaaaggaacatat

SEQ ID NO: 7655304 - DNA, 22 bp, Homo sapiens
acacatttacatgtttacgtat

SEQ ID NO: 7655305 - DNA, 22 bp, Homo sapiens
acacatttacatgtttacgtat

SEQ ID NO: 7655306 - DNA, 22 bp, Homo sapiens
acacatttaaaaaggaacatat

SEQ ID NO: 7655307 - DNA, 22 bp, Homo sapiens
acacatttacatgtttacgtat

SEQ ID NO: 7655308 - DNA, 22 bp, Homo sapiens
acacatttacatgtttacgtat

SEQ ID NO: 7655309 - DNA, 22 bp, Homo sapiens
acacattctttaaatgtctgtt

SEQ ID NO: 7655310 - DNA, 22 bp, Homo sapiens
acacattctttaaatgtctgtt

SEQ ID NO: 7655311 - DNA, 22 bp, Homo sapiens
acacattctttaaatgtctgtt

SEQ ID NO: 7655312 - DNA, 22 bp, Homo sapiens
acacattctttaaatgtctgtt

SEQ ID NO: 7655313 - DNA, 22 bp, Homo sapiens
acacattgcagacatctcatta

SEQ ID NO: 7655314 - DNA, 22 bp, Homo sapiens
acacattgcagacatctcatta

SEQ ID NO: 7655315 - DNA, 22 bp, Homo sapiens
acacattgtcatttccatacta

SEQ ID NO: 7655316 - DNA, 22 bp, Homo sapiens
acacattcctgcagacatgatg

SEQ ID NO: 7655317 - DNA, 22 bp, Homo sapiens
acacattcctgcagacatgatg

SEQ ID NO: 7655318 - DNA, 22 bp, Homo sapiens
acacattcctgcagacatgatg

SEQ ID NO: 7655319 - DNA, 22 bp, Homo sapiens
acacattcatgagtgcatgcac

SEQ ID NO: 7655320 - DNA, 21 bp, Homo sapiens
acacattatgagcatagactc

SEQ ID NO: 7655321 - DNA, 22 bp, Homo sapiens
acacattcatgagtgcatgcac

SEQ ID NO: 7655322 - DNA, 22 bp, Homo sapiens
acacattcatgagtgcatgcac

SEQ ID NO: 7655323 - DNA, 21 bp, Homo sapiens
acacattatgagcatagactc

SEQ ID NO: 7655324 - DNA, 22 bp, Homo sapiens
acacattatgagcagttgtctt

SEQ ID NO: 7655325 - DNA, 22 bp, Homo sapiens
acacattatctcattaaatact

SEQ ID NO: 7655326 - DNA, 22 bp, Homo sapiens
acacatgctgataagaatataa

SEQ ID NO: 7655327 - DNA, 22 bp, Homo sapiens
acacatgctgataagaatataa

SEQ ID NO: 7655328 - DNA, 22 bp, Homo sapiens
acacatgctgataagaatataa

SEQ ID NO: 7655329 - DNA, 22 bp, Homo sapiens
acacattatctcattaaatact

SEQ ID NO: 7655330 - DNA, 19 bp, Homo sapiens
acacatgctcctggagcct

SEQ ID NO: 7655331 - DNA, 22 bp, Homo sapiens
acacatgctcataaataaatag

SEQ ID NO: 7655332 - DNA, 19 bp, Homo sapiens
acacatgctcctggagcct

SEQ ID NO: 7655333 - DNA, 22 bp, Homo sapiens
acacatgctcataaataaatag

SEQ ID NO: 7655334 - DNA, 22 bp, Homo sapiens
acacatgctccagtctccagga

SEQ ID NO: 7655335 - DNA, 22 bp, Homo sapiens
acacatgctcataaataaatag

SEQ ID NO: 7655336 - DNA, 22 bp, Homo sapiens
acacatgctcataaataaatag

SEQ ID NO: 7655337 - DNA, 22 bp, Homo sapiens
acacatgcataagccttccctt

SEQ ID NO: 7655338 - DNA, 20 bp, Homo sapiens
acacatgcatagagagagag

SEQ ID NO: 7655339 - DNA, 22 bp, Homo sapiens
acacatgcaggtatacatgttc

SEQ ID NO: 7655340 - DNA, 22 bp, Homo sapiens
acacatgcaggtatacatgttc

SEQ ID NO: 7655341 - DNA, 22 bp, Homo sapiens
acacatgcaggtatacatgttc

SEQ ID NO: 7655342 - DNA, 22 bp, Homo sapiens
acacatgcaggtatacatgttc

SEQ ID NO: 7655343 - DNA, 22 bp, Homo sapiens
acacatgcaggtatacatgttc

SEQ ID NO: 7655344 - DNA, 22 bp, Homo sapiens
acacatgcaggtatacatgttc

SEQ ID NO: 7655345 - DNA, 22 bp, Homo sapiens
acacatgataagaaagtttaaa

SEQ ID NO: 7655346 - DNA, 22 bp, Homo sapiens
acacatgcacaacagttctttc

SEQ ID NO: 7655347 - DNA, 22 bp, Homo sapiens
acacatgagttctcatcttgtg

SEQ ID NO: 7655348 - DNA, 22 bp, Homo sapiens
acacatgataagaaagtttaaa

SEQ ID NO: 7655349 - DNA, 22 bp, Homo sapiens
acacatgagttctcatcttgtg

SEQ ID NO: 7655350 - DNA, 22 bp, Homo sapiens
acacatgagttctcatcttgtg

SEQ ID NO: 7655351 - DNA, 22 bp, Homo sapiens
acacatgaggatgaggggatca

SEQ ID NO: 7655352 - DNA, 19 bp, Homo sapiens
acacatgaggagggacccc

SEQ ID NO: 7655353 - DNA, 19 bp, Homo sapiens
acacatgaggagggacccc

SEQ ID NO: 7655354 - DNA, 22 bp, Homo sapiens
acacatgagaaacatcagttgt

SEQ ID NO: 7655355 - DNA, 22 bp, Homo sapiens
acacatgacctccgcagcagca

SEQ ID NO: 7655356 - DNA, 22 bp, Homo sapiens
acacatgagaaacatcagttgt

SEQ ID NO: 7655357 - DNA, 22 bp, Homo sapiens
acacatcttagactgaaatatg

SEQ ID NO: 7655358 - DNA, 22 bp, Homo sapiens
acacatatatgtcgaagtcctc

SEQ ID NO: 7655359 - DNA, 22 bp, Homo sapiens
acacatatatgtcgaagtcctc

SEQ ID NO: 7655360 - DNA, 17 bp, Homo sapiens
acacatcttggctttgc

SEQ ID NO: 7655361 - DNA, 17 bp, Homo sapiens
acacatcttggctttgc

SEQ ID NO: 7655362 - DNA, 22 bp, Homo sapiens
acacatatatacatatttgtgc

SEQ ID NO: 7655363 - DNA, 19 bp, Homo sapiens
aagagcagggaaagaattg

SEQ ID NO: 7655364 - DNA, 22 bp, Homo sapiens
acacatatatacatatttgtgc

SEQ ID NO: 7655365 - DNA, 22 bp, Homo sapiens
acacatgaaataatattatgca

SEQ ID NO: 7655366 - DNA, 17 bp, Homo sapiens
acacatcttggctttgc

SEQ ID NO: 7655367 - DNA, 22 bp, Homo sapiens
acacatgaaataatattatgca

SEQ ID NO: 7655368 - DNA, 22 bp, Homo sapiens
acacatgaatcactggtggaag

SEQ ID NO: 7655369 - DNA, 22 bp, Homo sapiens
aagagcaggctgtcaatggggc

SEQ ID NO: 7655370 - DNA, 19 bp, Homo sapiens
aagagcagggaaagaattg

SEQ ID NO: 7655371 - DNA, 22 bp, Homo sapiens
aagagcaggctgtcaatggggc

SEQ ID NO: 7655372 - DNA, 22 bp, Homo sapiens
aagagcaggctgtcaatggggc

SEQ ID NO: 7655373 - DNA, 22 bp, Homo sapiens
aagagcaggctgctgtggagta

SEQ ID NO: 7655374 - DNA, 22 bp, Homo sapiens
aagagcaggctgctgtggagta

SEQ ID NO: 7655375 - DNA, 22 bp, Homo sapiens
aagagcaggctgtcaatggggc

SEQ ID NO: 7655376 - DNA, 22 bp, Homo sapiens
aagagcagcctccaggggtgga

SEQ ID NO: 7655377 - DNA, 22 bp, Homo sapiens
aagagcaggacagaatcagaac

SEQ ID NO: 7655378 - DNA, 22 bp, Homo sapiens
aagagcaggacagaatcagaac

SEQ ID NO: 7655379 - DNA, 22 bp, Homo sapiens
aagagcaggctgctgtggagta

SEQ ID NO: 7655380 - DNA, 22 bp, Homo sapiens
aagagcaggacagaatcagaac

SEQ ID NO: 7655381 - DNA, 22 bp, Homo sapiens
aagagcaggctgctgtggagta

SEQ ID NO: 7655382 - DNA, 22 bp, Homo sapiens
aagagcaggctgctgtggagta

SEQ ID NO: 7655383 - DNA, 22 bp, Homo sapiens
aagagcaggctgctgtggagta

SEQ ID NO: 7655384 - DNA, 22 bp, Homo sapiens
aagcacacttggctctgtgtac

SEQ ID NO: 7655385 - DNA, 22 bp, Homo sapiens
aagcacattttccagcagctct

SEQ ID NO: 7655386 - DNA, 22 bp, Homo sapiens
aagcaccctttgtctggacatg

SEQ ID NO: 7655387 - DNA, 22 bp, Homo sapiens
aagcacccaatttacagcagtt

SEQ ID NO: 7655388 - DNA, 22 bp, Homo sapiens
aagcacccaatttacagcagtt

SEQ ID NO: 7655389 - DNA, 22 bp, Homo sapiens
aagcacacctccctggcaggag

SEQ ID NO: 7655390 - DNA, 22 bp, Homo sapiens
aagcacacatctctggctgggt

SEQ ID NO: 7655391 - DNA, 22 bp, Homo sapiens
aagcacacagaggcggaaggac

SEQ ID NO: 7655392 - DNA, 22 bp, Homo sapiens
aagcacacagcaaaggggagct

SEQ ID NO: 7655393 - DNA, 22 bp, Homo sapiens
aagcacacagcaaaggggagct

SEQ ID NO: 7655394 - DNA, 22 bp, Homo sapiens
aagcacacatctctggctgggt

SEQ ID NO: 7655395 - DNA, 22 bp, Homo sapiens
aagcacaatttaggactgaaat

SEQ ID NO: 7655396 - DNA, 22 bp, Homo sapiens
aagcaattcagcaaacctagaa

SEQ ID NO: 7655397 - DNA, 22 bp, Homo sapiens
aagcaattcacagttcacttaa

SEQ ID NO: 7655398 - DNA, 22 bp, Homo sapiens
aagcaattcacagttcacttaa

SEQ ID NO: 7655399 - DNA, 22 bp, Homo sapiens
aagcaattcacagttcacttaa

SEQ ID NO: 7655400 - DNA, 22 bp, Homo sapiens
aagcaattcacagttcacttaa

SEQ ID NO: 7655401 - DNA, 22 bp, Homo sapiens
aagcaattcacagttcacttaa

SEQ ID NO: 7655402 - DNA, 22 bp, Homo sapiens
aagcaatgtgtttgaaaggcca

SEQ ID NO: 7655403 - DNA, 22 bp, Homo sapiens
aagcaattggttttagtaaaat

SEQ ID NO: 7655404 - DNA, 22 bp, Homo sapiens
aagcaattcagcaaacctagaa

SEQ ID NO: 7655405 - DNA, 22 bp, Homo sapiens
aagcaattgagtgaaacctctt

SEQ ID NO: 7655406 - DNA, 22 bp, Homo sapiens
aagcaattgtcctgtctctaca

SEQ ID NO: 7655407 - DNA, 22 bp, Homo sapiens
aagcaattgtcctgtctctaca

SEQ ID NO: 7655408 - DNA, 22 bp, Homo sapiens
aagcaattgtcctgtctctaca

SEQ ID NO: 7655409 - DNA, 22 bp, Homo sapiens
aagcacaatgaacatcttagat

SEQ ID NO: 7655410 - DNA, 22 bp, Homo sapiens
aagcaatttgacagtacatatc

SEQ ID NO: 7655411 - DNA, 22 bp, Homo sapiens
aagcaattgtcctgtctctaca

SEQ ID NO: 7655412 - DNA, 22 bp, Homo sapiens
aagcaatttgacagtacatatc

SEQ ID NO: 7655413 - DNA, 22 bp, Homo sapiens
aagcaatttgacagtacatatc

SEQ ID NO: 7655414 - DNA, 22 bp, Homo sapiens
aagcaatttgacagtacatatc

SEQ ID NO: 7655415 - DNA, 22 bp, Homo sapiens
aagcaatttgacagtacatatc

SEQ ID NO: 7655416 - DNA, 22 bp, Homo sapiens
aagcacaatttaggactgaaat

SEQ ID NO: 7655417 - DNA, 22 bp, Homo sapiens
aagcacaatttaggactgaaat

SEQ ID NO: 7655418 - DNA, 22 bp, Homo sapiens
aagcacaatttaggactgaaat

SEQ ID NO: 7655419 - DNA, 22 bp, Homo sapiens
aagcacaatttaggactgaaat

SEQ ID NO: 7655420 - DNA, 22 bp, Homo sapiens
aagcacaatgaacatcttagat

SEQ ID NO: 7655421 - DNA, 22 bp, Homo sapiens
aagcacaatgaacatcttagat

SEQ ID NO: 7655422 - DNA, 22 bp, Homo sapiens
aagcacaatgaacatcttagat

SEQ ID NO: 7655423 - DNA, 22 bp, Homo sapiens
aagcacaatgaacatcttagat

SEQ ID NO: 7655424 - DNA, 21 bp, Homo sapiens
aagcaattaccttcccatgtg

SEQ ID NO: 7655425 - DNA, 19 bp, Homo sapiens
aagcaatgttgtgaatcta

SEQ ID NO: 7655426 - DNA, 19 bp, Homo sapiens
aagcaatgttgtgaatcta

SEQ ID NO: 7655427 - DNA, 19 bp, Homo sapiens
aagcaatgttgtgaatcta

SEQ ID NO: 7655428 - DNA, 22 bp, Homo sapiens
aagcaatgtgtttgaaaggcca

SEQ ID NO: 7655429 - DNA, 22 bp, Homo sapiens
aagcaatgtgtttgaaaggcca

SEQ ID NO: 7655430 - DNA, 22 bp, Homo sapiens
aagcaatgttagaggccttagg

SEQ ID NO: 7655431 - DNA, 22 bp, Homo sapiens
aagcaatgttagaggccttagg

SEQ ID NO: 7655432 - DNA, 22 bp, Homo sapiens
aagcaatgttagaggccttagg

SEQ ID NO: 7655433 - DNA, 23 bp, Homo sapiens
aagcaatgctgagccagttctga

SEQ ID NO: 7655434 - DNA, 22 bp, Homo sapiens
aagcaatgtgttaatgaatgag

SEQ ID NO: 7655435 - DNA, 22 bp, Homo sapiens
aagcaatgtgttaatgaatgag

SEQ ID NO: 7655436 - DNA, 22 bp, Homo sapiens
aagcaatgtgttaatgaatgag

SEQ ID NO: 7655437 - DNA, 23 bp, Homo sapiens
aagcaatgctgagccagttctga

SEQ ID NO: 7655438 - DNA, 23 bp, Homo sapiens
aagcaatgctgagccagttctga

SEQ ID NO: 7655439 - DNA, 22 bp, Homo sapiens
aagcaatgtgttaatgaatgag

SEQ ID NO: 7655440 - DNA, 22 bp, Homo sapiens
aagcaatgtgttaatgaatgag

SEQ ID NO: 7655441 - DNA, 22 bp, Homo sapiens
aagcaatgtgtttgaaaggcca

SEQ ID NO: 7655442 - DNA, 22 bp, Homo sapiens
aagcaatgtgttaatgaatgag

SEQ ID NO: 7655443 - DNA, 22 bp, Homo sapiens
aagcaatgtgttaatgaatgag

SEQ ID NO: 7655444 - DNA, 20 bp, Homo sapiens
aagcaatatagtgcaaatgt

SEQ ID NO: 7655445 - DNA, 22 bp, Homo sapiens
aagcaatatactgatatgatta

SEQ ID NO: 7655446 - DNA, 20 bp, Homo sapiens
aagcaatatagtgcaaatgt

SEQ ID NO: 7655447 - DNA, 20 bp, Homo sapiens
aagcaatatagtgcaaatgt

SEQ ID NO: 7655448 - DNA, 20 bp, Homo sapiens
aagcaatatagtgcaaatgt

SEQ ID NO: 7655449 - DNA, 20 bp, Homo sapiens
aagcaatatagtgcaaatgt

SEQ ID NO: 7655450 - DNA, 22 bp, Homo sapiens
aagcaatagggtaatctactca

SEQ ID NO: 7655451 - DNA, 22 bp, Homo sapiens
aagcaatatactgatatgatta

SEQ ID NO: 7655452 - DNA, 22 bp, Homo sapiens
aagcaatatactgatatgatta

SEQ ID NO: 7655453 - DNA, 22 bp, Homo sapiens
aagcaatatactgatatgatta

SEQ ID NO: 7655454 - DNA, 22 bp, Homo sapiens
aagcaatatactgatatgatta

SEQ ID NO: 7655455 - DNA, 22 bp, Homo sapiens
aagcaatagggtaatctactca

SEQ ID NO: 7655456 - DNA, 22 bp, Homo sapiens
aagcaatagggtaatctactca

SEQ ID NO: 7655457 - DNA, 22 bp, Homo sapiens
aagcaatagggtaatctactca

SEQ ID NO: 7655458 - DNA, 22 bp, Homo sapiens
aagcagagaccggctaatggag

SEQ ID NO: 7655459 - DNA, 22 bp, Homo sapiens
aagcagagaccggctaatggag

SEQ ID NO: 7655460 - DNA, 22 bp, Homo sapiens
aagcagagagcagaattaagtt

SEQ ID NO: 7655461 - DNA, 22 bp, Homo sapiens
aagcagagagcagaattaagtt

SEQ ID NO: 7655462 - DNA, 22 bp, Homo sapiens
aagcagagagcagaattaagtt

SEQ ID NO: 7655463 - DNA, 22 bp, Homo sapiens
aagcagagaatctgggagcgag

SEQ ID NO: 7655464 - DNA, 22 bp, Homo sapiens
aagcagagaatctgggagcgag

SEQ ID NO: 7655465 - DNA, 22 bp, Homo sapiens
aagcagagaccggctaatggag

SEQ ID NO: 7655466 - DNA, 22 bp, Homo sapiens
aagcagagaatctgggagcgag

SEQ ID NO: 7655467 - DNA, 22 bp, Homo sapiens
aagcagagaatctgggagcgag

SEQ ID NO: 7655468 - DNA, 22 bp, Homo sapiens
aagcagagaatctgggagcgag

SEQ ID NO: 7655469 - DNA, 22 bp, Homo sapiens
aagcagagaatctgggagcgag

SEQ ID NO: 7655470 - DNA, 22 bp, Homo sapiens
aagcagagaaaagcttaggttc

SEQ ID NO: 7655471 - DNA, 22 bp, Homo sapiens
aagcagagaaaagcttaggttc

SEQ ID NO: 7655472 - DNA, 19 bp, Homo sapiens
aagcagactctgagccagg

SEQ ID NO: 7655473 - DNA, 19 bp, Homo sapiens
aagcagactctgagccagg

SEQ ID NO: 7655474 - DNA, 19 bp, Homo sapiens
aagcagactctgagccagg

SEQ ID NO: 7655475 - DNA, 22 bp, Homo sapiens
aagcagactcccggccagctca

SEQ ID NO: 7655476 - DNA, 19 bp, Homo sapiens
aagcagactctgagccagg

SEQ ID NO: 7655477 - DNA, 22 bp, Homo sapiens
aagcagactgggccataaggaa

SEQ ID NO: 7655478 - DNA, 22 bp, Homo sapiens
aagcagactgggccataaggaa

SEQ ID NO: 7655479 - DNA, 22 bp, Homo sapiens
aagcagagcctgagacagggat

SEQ ID NO: 7655480 - DNA, 22 bp, Homo sapiens
aagcagagcctgagacagggat

SEQ ID NO: 7655481 - DNA, 22 bp, Homo sapiens
aagcagaggaccgacggaggga

SEQ ID NO: 7655482 - DNA, 22 bp, Homo sapiens
aagcagagcctgagacagggat

SEQ ID NO: 7655483 - DNA, 22 bp, Homo sapiens
aagcagagcctgagacagggat

SEQ ID NO: 7655484 - DNA, 22 bp, Homo sapiens
aagcagagcctgagacagggat

SEQ ID NO: 7655485 - DNA, 22 bp, Homo sapiens
aagcagagcctgagacagggat

SEQ ID NO: 7655486 - DNA, 22 bp, Homo sapiens
aagcagagcctgagacagggat

SEQ ID NO: 7655487 - DNA, 22 bp, Homo sapiens
aagcagagcctgagacagggat

SEQ ID NO: 7655488 - DNA, 22 bp, Homo sapiens
aagcagagcctgagacagggat

SEQ ID NO: 7655489 - DNA, 22 bp, Homo sapiens
aagcagagcctgagacagggat

SEQ ID NO: 7655490 - DNA, 22 bp, Homo sapiens
aagcagagcaagcgtatttatt

SEQ ID NO: 7655491 - DNA, 22 bp, Homo sapiens
aagcagagcaagcgtatttatt

SEQ ID NO: 7655492 - DNA, 22 bp, Homo sapiens
aagcagagccaccagctttgga

SEQ ID NO: 7655493 - DNA, 22 bp, Homo sapiens
aagcagagagcagaattaagtt

SEQ ID NO: 7655494 - DNA, 22 bp, Homo sapiens
aagcagagcaagcgtatttatt

SEQ ID NO: 7655495 - DNA, 22 bp, Homo sapiens
aagcagagcaagcgtatttatt

SEQ ID NO: 7655496 - DNA, 22 bp, Homo sapiens
aagcagagcaagcgtatttatt

SEQ ID NO: 7655497 - DNA, 22 bp, Homo sapiens
aagcagagccaccagctttgga

SEQ ID NO: 7655498 - DNA, 22 bp, Homo sapiens
aagcagagccaccagctttgga

SEQ ID NO: 7655499 - DNA, 22 bp, Homo sapiens
aagcagagccaccagctttgga

SEQ ID NO: 7655500 - DNA, 22 bp, Homo sapiens
aagcagaatttcccactagttg

SEQ ID NO: 7655501 - DNA, 22 bp, Homo sapiens
aagcagaatttcccactagttg

SEQ ID NO: 7655502 - DNA, 22 bp, Homo sapiens
aagcagaatttcccactagttg

SEQ ID NO: 7655503 - DNA, 22 bp, Homo sapiens
aagcagaatttaatagaaaggt

SEQ ID NO: 7655504 - DNA, 22 bp, Homo sapiens
aagcagaatttaatagaaaggt

SEQ ID NO: 7655505 - DNA, 22 bp, Homo sapiens
aagcagaatttaatagaaaggt

SEQ ID NO: 7655506 - DNA, 22 bp, Homo sapiens
aagcagaatttaatagaaaggt

SEQ ID NO: 7655507 - DNA, 22 bp, Homo sapiens
aagcagaatttaatagaaaggt

SEQ ID NO: 7655508 - DNA, 22 bp, Homo sapiens
aagcagaatttaatagaaaggt

SEQ ID NO: 7655509 - DNA, 22 bp, Homo sapiens
aagcagaatttcccactagttg

SEQ ID NO: 7655510 - DNA, 22 bp, Homo sapiens
aagcagaatttcccactagttg

SEQ ID NO: 7655511 - DNA, 22 bp, Homo sapiens
aagcagacagagaatgggtttg

SEQ ID NO: 7655512 - DNA, 22 bp, Homo sapiens
aagcagacagagaatgggtttg

SEQ ID NO: 7655513 - DNA, 21 bp, Homo sapiens
aagcagacctgagcacagaac

SEQ ID NO: 7655514 - DNA, 21 bp, Homo sapiens
aagcagacctgagcacagaac

SEQ ID NO: 7655515 - DNA, 18 bp, Homo sapiens
aagcagacagcagacagt

SEQ ID NO: 7655516 - DNA, 22 bp, Homo sapiens
aagcagacatcccatacttttg

SEQ ID NO: 7655517 - DNA, 22 bp, Homo sapiens
aagcagaatagaggcccttccc

SEQ ID NO: 7655518 - DNA, 22 bp, Homo sapiens
aagcagaatagaggcccttccc

SEQ ID NO: 7655519 - DNA, 22 bp, Homo sapiens
aagcagaatagaggcccttccc

SEQ ID NO: 7655520 - DNA, 22 bp, Homo sapiens
aagcagaagttgatctaccata

SEQ ID NO: 7655521 - DNA, 22 bp, Homo sapiens
aagcagaatttaatagaaaggt

SEQ ID NO: 7655522 - DNA, 22 bp, Homo sapiens
aagcagaagttgatctaccata

SEQ ID NO: 7655523 - DNA, 22 bp, Homo sapiens
aagcagaagttgatctaccata

SEQ ID NO: 7655524 - DNA, 22 bp, Homo sapiens
aagcagaagttgatctaccata

SEQ ID NO: 7655525 - DNA, 22 bp, Homo sapiens
aagcagaagttgatctaccata

SEQ ID NO: 7655526 - DNA, 22 bp, Homo sapiens
aagcagaagttgatctaccata

SEQ ID NO: 7655527 - DNA, 22 bp, Homo sapiens
aagcagaagttgatctaccata

SEQ ID NO: 7655528 - DNA, 22 bp, Homo sapiens
aagcagaagttgatctaccata

SEQ ID NO: 7655529 - DNA, 22 bp, Homo sapiens
aagcagaactgggaagtagtgg

SEQ ID NO: 7655530 - DNA, 22 bp, Homo sapiens
aagcacctagcacagtagatta

SEQ ID NO: 7655531 - DNA, 22 bp, Homo sapiens
aagcagaactgggaagtagtgg

SEQ ID NO: 7655532 - DNA, 20 bp, Homo sapiens
aagcagaagctgctctcagc

SEQ ID NO: 7655533 - DNA, 20 bp, Homo sapiens
aagcagaagctgctctcagc

SEQ ID NO: 7655534 - DNA, 20 bp, Homo sapiens
aagcagaagctgctctcagc

SEQ ID NO: 7655535 - DNA, 20 bp, Homo sapiens
aagcagaagctgctctcagc

SEQ ID NO: 7655536 - DNA, 20 bp, Homo sapiens
aagcagaagctgctctcagc

SEQ ID NO: 7655537 - DNA, 20 bp, Homo sapiens
aagcagaagctgctctcagc

SEQ ID NO: 7655538 - DNA, 22 bp, Homo sapiens
aagcagaaggggaataatattt

SEQ ID NO: 7655539 - DNA, 22 bp, Homo sapiens
aagcagaaggggaataatattt

SEQ ID NO: 7655540 - DNA, 22 bp, Homo sapiens
aagcagaaggggaataatattt

SEQ ID NO: 7655541 - DNA, 22 bp, Homo sapiens
aagcagaaggggaataatattt

SEQ ID NO: 7655542 - DNA, 22 bp, Homo sapiens
aagcagaaggggaataatattt

SEQ ID NO: 7655543 - DNA, 22 bp, Homo sapiens
aagcagaggccacagagtgggc

SEQ ID NO: 7655544 - DNA, 22 bp, Homo sapiens
aagcagaggccacagagtgggc

SEQ ID NO: 7655545 - DNA, 22 bp, Homo sapiens
aagcagagggtatggccaggtt

SEQ ID NO: 7655546 - DNA, 22 bp, Homo sapiens
aagcagagggtatggccaggtt

SEQ ID NO: 7655547 - DNA, 22 bp, Homo sapiens
aagcagagggtatggccaggtt

SEQ ID NO: 7655548 - DNA, 22 bp, Homo sapiens
aagcagagggtatggccaggtt

SEQ ID NO: 7655549 - DNA, 22 bp, Homo sapiens
aagcagaggccacagagtgggc

SEQ ID NO: 7655550 - DNA, 22 bp, Homo sapiens
aagcagaggccacagagtgggc

SEQ ID NO: 7655551 - DNA, 22 bp, Homo sapiens
aagcagaggccacagagtgggc

SEQ ID NO: 7655552 - DNA, 22 bp, Homo sapiens
aagcagaggccacagagtgggc

SEQ ID NO: 7655553 - DNA, 22 bp, Homo sapiens
aagcagaggccacagagtgggc

SEQ ID NO: 7655554 - DNA, 22 bp, Homo sapiens
aagcagaggccacagagtgggc

SEQ ID NO: 7655555 - DNA, 22 bp, Homo sapiens
aagcagaggccacagagtgggc

SEQ ID NO: 7655556 - DNA, 22 bp, Homo sapiens
aagcagaggccacagagtgggc

SEQ ID NO: 7655557 - DNA, 22 bp, Homo sapiens
aagcagaggccacagagtgggc

SEQ ID NO: 7655558 - DNA, 22 bp, Homo sapiens
aagcagaggccacagagtgggc

SEQ ID NO: 7655559 - DNA, 22 bp, Homo sapiens
aagcagaggaccgacggaggga

SEQ ID NO: 7655560 - DNA, 22 bp, Homo sapiens
aagcagaggaccgacggaggga

SEQ ID NO: 7655561 - DNA, 22 bp, Homo sapiens
aagcagaggaccgacggaggga

SEQ ID NO: 7655562 - DNA, 22 bp, Homo sapiens
aagcagaggaccgacggaggga

SEQ ID NO: 7655563 - DNA, 22 bp, Homo sapiens
aagcagaggaccgacggaggga

SEQ ID NO: 7655564 - DNA, 22 bp, Homo sapiens
aagcagaggaccgacggaggga

SEQ ID NO: 7655565 - DNA, 22 bp, Homo sapiens
aagcagaggaccgacggaggga

SEQ ID NO: 7655566 - DNA, 22 bp, Homo sapiens
aagcagaggccacagagtgggc

SEQ ID NO: 7655567 - DNA, 22 bp, Homo sapiens
aagcagaggaccgacggaggga

SEQ ID NO: 7655568 - DNA, 22 bp, Homo sapiens
aagcagaggaccgacggaggga

SEQ ID NO: 7655569 - DNA, 22 bp, Homo sapiens
acagcagaccccagtgccatgg

SEQ ID NO: 7655570 - DNA, 22 bp, Homo sapiens
acagcagaccccagtgccatgg

SEQ ID NO: 7655571 - DNA, 22 bp, Homo sapiens
acagcaaaagacaagaacttaa

SEQ ID NO: 7655572 - DNA, 22 bp, Homo sapiens
acagcaaaagacaagaacttaa

SEQ ID NO: 7655573 - DNA, 22 bp, Homo sapiens
acagcaaaagacaagaacttaa

SEQ ID NO: 7655574 - DNA, 22 bp, Homo sapiens
acagcaaaagacaagaacttaa

SEQ ID NO: 7655575 - DNA, 22 bp, Homo sapiens
acagcaaaagacaagaacttaa

SEQ ID NO: 7655576 - DNA, 22 bp, Homo sapiens
acagcaaaagacaagaacttaa

SEQ ID NO: 7655577 - DNA, 22 bp, Homo sapiens
acagcaaaagacaagaacttaa

SEQ ID NO: 7655578 - DNA, 22 bp, Homo sapiens
acagcaaaagacaagaacttaa

SEQ ID NO: 7655579 - DNA, 22 bp, Homo sapiens
aagcagagggtatggccaggtt

SEQ ID NO: 7655580 - DNA, 22 bp, Homo sapiens
aagcagagggtatggccaggtt

SEQ ID NO: 7655581 - DNA, 22 bp, Homo sapiens
aagcagaggtagggtgtgcagt

SEQ ID NO: 7655582 - DNA, 22 bp, Homo sapiens
aagcagagggtatggccaggtt

SEQ ID NO: 7655583 - DNA, 22 bp, Homo sapiens
aagcagagggtatggccaggtt

SEQ ID NO: 7655584 - DNA, 22 bp, Homo sapiens
aagcagaggccacagagtgggc

SEQ ID NO: 7655585 - DNA, 22 bp, Homo sapiens
aagcagaggtagggtgtgcagt

SEQ ID NO: 7655586 - DNA, 22 bp, Homo sapiens
aagcagaggtagggtgtgcagt

SEQ ID NO: 7655587 - DNA, 22 bp, Homo sapiens
aagcagaggtagggtgtgcagt

SEQ ID NO: 7655588 - DNA, 22 bp, Homo sapiens
aagcagaggtagggtgtgcagt

SEQ ID NO: 7655589 - DNA, 22 bp, Homo sapiens
acagcagagccagtggctctag

SEQ ID NO: 7655590 - DNA, 22 bp, Homo sapiens
acagcagagccagtggctctag

SEQ ID NO: 7655591 - DNA, 22 bp, Homo sapiens
acagcagagccagtggctctag

SEQ ID NO: 7655592 - DNA, 22 bp, Homo sapiens
acagcagagccagtggctctag

SEQ ID NO: 7655593 - DNA, 22 bp, Homo sapiens
acagcagagccagtggctctag

SEQ ID NO: 7655594 - DNA, 22 bp, Homo sapiens
acagcagagccagtggctctag

SEQ ID NO: 7655595 - DNA, 22 bp, Homo sapiens
acagcagagcaccagggccact

SEQ ID NO: 7655596 - DNA, 22 bp, Homo sapiens
acagcagagcaccagggccact

SEQ ID NO: 7655597 - DNA, 22 bp, Homo sapiens
acagcagagcaccagggccact

SEQ ID NO: 7655598 - DNA, 22 bp, Homo sapiens
acagcagagcaccagggccact

SEQ ID NO: 7655599 - DNA, 21 bp, Homo sapiens
acagcagagatcaagactaag

SEQ ID NO: 7655600 - DNA, 21 bp, Homo sapiens
acagcagagatcaagactaag

SEQ ID NO: 7655601 - DNA, 21 bp, Homo sapiens
acagcagagatcaagactaag

SEQ ID NO: 7655602 - DNA, 21 bp, Homo sapiens
acagcagagatcaagactaag

SEQ ID NO: 7655603 - DNA, 22 bp, Homo sapiens
acagcagagacactcaggaggc

SEQ ID NO: 7655604 - DNA, 21 bp, Homo sapiens
acagcagagatcaagactaag

SEQ ID NO: 7655605 - DNA, 22 bp, Homo sapiens
acagcagagacactcaggaggc

SEQ ID NO: 7655606 - DNA, 22 bp, Homo sapiens
acagcagagacactcaggaggc

SEQ ID NO: 7655607 - DNA, 22 bp, Homo sapiens
acagcagagacactcaggaggc

SEQ ID NO: 7655608 - DNA, 22 bp, Homo sapiens
acagcagagacactcaggaggc

SEQ ID NO: 7655609 - DNA, 22 bp, Homo sapiens
acagcagagacactcaggaggc

SEQ ID NO: 7655610 - DNA, 22 bp, Homo sapiens
acagcagagacactcaggaggc

SEQ ID NO: 7655611 - DNA, 22 bp, Homo sapiens
acagcagagacactcaggaggc

SEQ ID NO: 7655612 - DNA, 22 bp, Homo sapiens
acagcagagacactcaggaggc

SEQ ID NO: 7655613 - DNA, 22 bp, Homo sapiens
acagcagagacactcaggaggc

SEQ ID NO: 7655614 - DNA, 22 bp, Homo sapiens
acagcagagacactcaggaggc

SEQ ID NO: 7655615 - DNA, 22 bp, Homo sapiens
acagcagagacactcaggaggc

SEQ ID NO: 7655616 - DNA, 22 bp, Homo sapiens
acagcagagaactttagagggt

SEQ ID NO: 7655617 - DNA, 22 bp, Homo sapiens
acagcagagaactttagagggt

SEQ ID NO: 7655618 - DNA, 22 bp, Homo sapiens
acagcagactttctacagctca

SEQ ID NO: 7655619 - DNA, 22 bp, Homo sapiens
acagcagaccccagtgccatgg

SEQ ID NO: 7655620 - DNA, 22 bp, Homo sapiens
acagcagagcctagcttaatct

SEQ ID NO: 7655621 - DNA, 22 bp, Homo sapiens
acagcagagcctagcttaatct

SEQ ID NO: 7655622 - DNA, 22 bp, Homo sapiens
acagcagagcctagcttaatct

SEQ ID NO: 7655623 - DNA, 22 bp, Homo sapiens
acagcagagcctagcttaatct

SEQ ID NO: 7655624 - DNA, 22 bp, Homo sapiens
acagcagagcctggtacttact

SEQ ID NO: 7655625 - DNA, 22 bp, Homo sapiens
acagcagagcctggtacttact

SEQ ID NO: 7655626 - DNA, 22 bp, Homo sapiens
acagcagaggaaaagtctgata

SEQ ID NO: 7655627 - DNA, 22 bp, Homo sapiens
acagcagagtagttttccaact

SEQ ID NO: 7655628 - DNA, 22 bp, Homo sapiens
acagcagagtagttttccaact

SEQ ID NO: 7655629 - DNA, 22 bp, Homo sapiens
acagcagagtagttttccaact

SEQ ID NO: 7655630 - DNA, 22 bp, Homo sapiens
acagcagaggaaaagtctgata

SEQ ID NO: 7655631 - DNA, 22 bp, Homo sapiens
acagcagaggaaaagtctgata

SEQ ID NO: 7655632 - DNA, 22 bp, Homo sapiens
acagcagaggaaaagtctgata

SEQ ID NO: 7655633 - DNA, 22 bp, Homo sapiens
acagcagagtggagatgagcac

SEQ ID NO: 7655634 - DNA, 22 bp, Homo sapiens
acagcagagtggagatgagcac

SEQ ID NO: 7655635 - DNA, 22 bp, Homo sapiens
acagcagagtggagatgagcac

SEQ ID NO: 7655636 - DNA, 22 bp, Homo sapiens
acagcagagtggagatgagcac

SEQ ID NO: 7655637 - DNA, 22 bp, Homo sapiens
acagcagagtggagatgagcac

SEQ ID NO: 7655638 - DNA, 22 bp, Homo sapiens
aagcagctgatttcacagctca

SEQ ID NO: 7655639 - DNA, 22 bp, Homo sapiens
aagcagctgcaggttcaaagga

SEQ ID NO: 7655640 - DNA, 22 bp, Homo sapiens
aagcagctgcaggttcaaagga

SEQ ID NO: 7655641 - DNA, 22 bp, Homo sapiens
aagcagctgcaggttcaaagga

SEQ ID NO: 7655642 - DNA, 22 bp, Homo sapiens
aagcagctggaagagtaagatg

SEQ ID NO: 7655643 - DNA, 22 bp, Homo sapiens
aagcagctgcaggttcaaagga

SEQ ID NO: 7655644 - DNA, 22 bp, Homo sapiens
aagcagctgtgtgacataatct

SEQ ID NO: 7655645 - DNA, 22 bp, Homo sapiens
aagcagctggaagagtaagatg

SEQ ID NO: 7655646 - DNA, 22 bp, Homo sapiens
aagcagctgtgtgacataatct

SEQ ID NO: 7655647 - DNA, 22 bp, Homo sapiens
aagcagctggaagagtaagatg

SEQ ID NO: 7655648 - DNA, 22 bp, Homo sapiens
aagcagctggaagagtaagatg

SEQ ID NO: 7655649 - DNA, 22 bp, Homo sapiens
aagcagctggaagagtaagatg

SEQ ID NO: 7655650 - DNA, 22 bp, Homo sapiens
aagcagctggaagagtaagatg

SEQ ID NO: 7655651 - DNA, 22 bp, Homo sapiens
aagcagcttaaattagagcctg

SEQ ID NO: 7655652 - DNA, 22 bp, Homo sapiens
aagcagctgtgtgacataatct

SEQ ID NO: 7655653 - DNA, 22 bp, Homo sapiens
aagcagctgtgtgacataatct

SEQ ID NO: 7655654 - DNA, 22 bp, Homo sapiens
aagcagctgtgtgacataatct

SEQ ID NO: 7655655 - DNA, 22 bp, Homo sapiens
aagcagcttaaattagagcctg

SEQ ID NO: 7655656 - DNA, 22 bp, Homo sapiens
aagcagcttaaattagagcctg

SEQ ID NO: 7655657 - DNA, 22 bp, Homo sapiens
aagcagcttaaattagagcctg

SEQ ID NO: 7655658 - DNA, 21 bp, Homo sapiens
aagcagcttaataaagtatgt

SEQ ID NO: 7655659 - DNA, 21 bp, Homo sapiens
aagcagcttaataaagtatgt

SEQ ID NO: 7655660 - DNA, 21 bp, Homo sapiens
aagcagcttaataaagtatgt

SEQ ID NO: 7655661 - DNA, 22 bp, Homo sapiens
aagcaggaagctcaggtccttg

SEQ ID NO: 7655662 - DNA, 22 bp, Homo sapiens
aagcaggaagctcaggtccttg

SEQ ID NO: 7655663 - DNA, 21 bp, Homo sapiens
aagcaggaacttcaaagggac

SEQ ID NO: 7655664 - DNA, 21 bp, Homo sapiens
aagcaggaacttcaaagggac

SEQ ID NO: 7655665 - DNA, 22 bp, Homo sapiens
aagcaggaagctcaggtccttg

SEQ ID NO: 7655666 - DNA, 22 bp, Homo sapiens
aagcaggaagctcaggtccttg

SEQ ID NO: 7655667 - DNA, 22 bp, Homo sapiens
acagccagggcattgtcgccga

SEQ ID NO: 7655668 - DNA, 22 bp, Homo sapiens
acagccagggcattgtcgccga

SEQ ID NO: 7655669 - DNA, 22 bp, Homo sapiens
aagcaggaagctcaggtccttg

SEQ ID NO: 7655670 - DNA, 22 bp, Homo sapiens
aagcaggaagctcaggtccttg

SEQ ID NO: 7655671 - DNA, 22 bp, Homo sapiens
aagcaggaaggagcccagggca

SEQ ID NO: 7655672 - DNA, 22 bp, Homo sapiens
acagccagggtctcaggaggcg

SEQ ID NO: 7655673 - DNA, 22 bp, Homo sapiens
acagccagggtctcaggaggcg

SEQ ID NO: 7655674 - DNA, 22 bp, Homo sapiens
acagcctgctgcctgcttcttg

SEQ ID NO: 7655675 - DNA, 22 bp, Homo sapiens
acagccagggtctcaggaggcg

SEQ ID NO: 7655676 - DNA, 22 bp, Homo sapiens
acagccagggcattgtcgccga

SEQ ID NO: 7655677 - DNA, 22 bp, Homo sapiens
acagcctggactggctctctgc

SEQ ID NO: 7655678 - DNA, 22 bp, Homo sapiens
acagcctggactggctctctgc

SEQ ID NO: 7655679 - DNA, 22 bp, Homo sapiens
acagcctggactggctctctgc

SEQ ID NO: 7655680 - DNA, 22 bp, Homo sapiens
acagcctggactggctctctgc

SEQ ID NO: 7655681 - DNA, 22 bp, Homo sapiens
acagcctggactggctctctgc

SEQ ID NO: 7655682 - DNA, 22 bp, Homo sapiens
acagcctggactggctctctgc

SEQ ID NO: 7655683 - DNA, 22 bp, Homo sapiens
acagcctggactggctctctgc

SEQ ID NO: 7655684 - DNA, 21 bp, Homo sapiens
aagcaggaacttcaaagggac

SEQ ID NO: 7655685 - DNA, 22 bp, Homo sapiens
aagcagcttttgaagagtgagg

SEQ ID NO: 7655686 - DNA, 22 bp, Homo sapiens
aagcagcttttgaagagtgagg

SEQ ID NO: 7655687 - DNA, 22 bp, Homo sapiens
aagcagcttttgaagagtgagg

SEQ ID NO: 7655688 - DNA, 22 bp, Homo sapiens
aagcagcttttgaagagtgagg

SEQ ID NO: 7655689 - DNA, 22 bp, Homo sapiens
aagcagcttttgaagagtgagg

SEQ ID NO: 7655690 - DNA, 22 bp, Homo sapiens
aagcagcttttgaagagtgagg

SEQ ID NO: 7655691 - DNA, 22 bp, Homo sapiens
aagcagctttctttcctgtgaa

SEQ ID NO: 7655692 - DNA, 22 bp, Homo sapiens
aagcagctttctttcctgtgaa

SEQ ID NO: 7655693 - DNA, 22 bp, Homo sapiens
aagcagctttctttcctgtgaa

SEQ ID NO: 7655694 - DNA, 22 bp, Homo sapiens
aagcagctttctttcctgtgaa

SEQ ID NO: 7655695 - DNA, 22 bp, Homo sapiens
aagcagctttctttcctgtgaa

SEQ ID NO: 7655696 - DNA, 22 bp, Homo sapiens
aagcagcttccccaaagtgcct

SEQ ID NO: 7655697 - DNA, 21 bp, Homo sapiens
aagcagcttaataaagtatgt

SEQ ID NO: 7655698 - DNA, 22 bp, Homo sapiens
aagcagcttccccaaagtgcct

SEQ ID NO: 7655699 - DNA, 22 bp, Homo sapiens
aagcagcttccccaaagtgcct

SEQ ID NO: 7655700 - DNA, 22 bp, Homo sapiens
aagcagcttccccaaagtgcct

SEQ ID NO: 7655701 - DNA, 22 bp, Homo sapiens
aagcagcttccccaaagtgcct

SEQ ID NO: 7655702 - DNA, 22 bp, Homo sapiens
aagcagcttccctggctcctgg

SEQ ID NO: 7655703 - DNA, 22 bp, Homo sapiens
aagcagcttccctggctcctgg

SEQ ID NO: 7655704 - DNA, 22 bp, Homo sapiens
aagcagcttccctggctcctgg

SEQ ID NO: 7655705 - DNA, 22 bp, Homo sapiens
aagcagcttccctggctcctgg

SEQ ID NO: 7655706 - DNA, 22 bp, Homo sapiens
aagcagcttccctggctcctgg

SEQ ID NO: 7655707 - DNA, 22 bp, Homo sapiens
aagcagcttccctggctcctgg

SEQ ID NO: 7655708 - DNA, 22 bp, Homo sapiens
aagcagcttccctggctcctgg

SEQ ID NO: 7655709 - DNA, 22 bp, Homo sapiens
aagagaaggtgaggaagccggt

SEQ ID NO: 7655710 - DNA, 22 bp, Homo sapiens
aagagaatacaagcaggcagga

SEQ ID NO: 7655711 - DNA, 22 bp, Homo sapiens
aagagaatacaagcaggcagga

SEQ ID NO: 7655712 - DNA, 22 bp, Homo sapiens
aagagaatacaagcaggcagga

SEQ ID NO: 7655713 - DNA, 22 bp, Homo sapiens
aagagaatgacaaggagaacct

SEQ ID NO: 7655714 - DNA, 22 bp, Homo sapiens
aagagaaggtgaggaagccggt

SEQ ID NO: 7655715 - DNA, 22 bp, Homo sapiens
aagagaaggtgaggaagccggt

SEQ ID NO: 7655716 - DNA, 22 bp, Homo sapiens
aagagaaggccctgacccaccc

SEQ ID NO: 7655717 - DNA, 22 bp, Homo sapiens
aagagaaggtgaggaagccggt

SEQ ID NO: 7655718 - DNA, 22 bp, Homo sapiens
aagagaaggccctgacccaccc

SEQ ID NO: 7655719 - DNA, 22 bp, Homo sapiens
aagagaaggccctgacccaccc

SEQ ID NO: 7655720 - DNA, 22 bp, Homo sapiens
aagagaaggattctgagcctgg

SEQ ID NO: 7655721 - DNA, 22 bp, Homo sapiens
aagagaaggccctgacccaccc

SEQ ID NO: 7655722 - DNA, 22 bp, Homo sapiens
aagagaaggccctgacccaccc

SEQ ID NO: 7655723 - DNA, 22 bp, Homo sapiens
aagagacatgaatactcgaagg

SEQ ID NO: 7655724 - DNA, 22 bp, Homo sapiens
aagagacatgaatactcgaagg

SEQ ID NO: 7655725 - DNA, 22 bp, Homo sapiens
aagagacagagccatgtttcta

SEQ ID NO: 7655726 - DNA, 22 bp, Homo sapiens
aagagacagagccatgtttcta

SEQ ID NO: 7655727 - DNA, 22 bp, Homo sapiens
aagagacagagccatgtttcta

SEQ ID NO: 7655728 - DNA, 22 bp, Homo sapiens
aagagacagagccatgtttcta

SEQ ID NO: 7655729 - DNA, 22 bp, Homo sapiens
aagagacagagccatgtttcta

SEQ ID NO: 7655730 - DNA, 22 bp, Homo sapiens
aagagacaatgacacttgggag

SEQ ID NO: 7655731 - DNA, 22 bp, Homo sapiens
aagagacaatgtcttttggata

SEQ ID NO: 7655732 - DNA, 22 bp, Homo sapiens
aagagacaatgtcttttggata

SEQ ID NO: 7655733 - DNA, 22 bp, Homo sapiens
aagagacaatgtcttttggata

SEQ ID NO: 7655734 - DNA, 22 bp, Homo sapiens
aagagacaagaattccaacgct

SEQ ID NO: 7655735 - DNA, 22 bp, Homo sapiens
aagagacaagaattccaacgct

SEQ ID NO: 7655736 - DNA, 22 bp, Homo sapiens
aagagaatgacaaggagaacct

SEQ ID NO: 7655737 - DNA, 22 bp, Homo sapiens
aagagacaagaattccaacgct

SEQ ID NO: 7655738 - DNA, 22 bp, Homo sapiens
aagagacaagaattccaacgct

SEQ ID NO: 7655739 - DNA, 22 bp, Homo sapiens
aagagacaatgacacttgggag

SEQ ID NO: 7655740 - DNA, 22 bp, Homo sapiens
aagagacaatgacacttgggag

SEQ ID NO: 7655741 - DNA, 22 bp, Homo sapiens
aagagacaatgacacttgggag

SEQ ID NO: 7655742 - DNA, 22 bp, Homo sapiens
aagagaatgacaaggagaacct

SEQ ID NO: 7655743 - DNA, 22 bp, Homo sapiens
aagagaatgacaaggagaacct

SEQ ID NO: 7655744 - DNA, 22 bp, Homo sapiens
aagagaatgacaaggagaacct

SEQ ID NO: 7655745 - DNA, 22 bp, Homo sapiens
aagagaattctggttttcctat

SEQ ID NO: 7655746 - DNA, 22 bp, Homo sapiens
aagagaattctggttttcctat

SEQ ID NO: 7655747 - DNA, 22 bp, Homo sapiens
aagagaattctggttttcctat

SEQ ID NO: 7655748 - DNA, 22 bp, Homo sapiens
acacaaaatcaaagtcctaggc

SEQ ID NO: 7655749 - DNA, 22 bp, Homo sapiens
acacaaaatcaaagtcctaggc

SEQ ID NO: 7655750 - DNA, 22 bp, Homo sapiens
acaatgttttgaaacatctagg

SEQ ID NO: 7655751 - DNA, 22 bp, Homo sapiens
acacaaaatcaaagtcctaggc

SEQ ID NO: 7655752 - DNA, 22 bp, Homo sapiens
acacaaaatcaaagtcctaggc

SEQ ID NO: 7655753 - DNA, 22 bp, Homo sapiens
acaatgttttgaaacatctagg

SEQ ID NO: 7655754 - DNA, 22 bp, Homo sapiens
acaatgttttgaaacatctagg

SEQ ID NO: 7655755 - DNA, 22 bp, Homo sapiens
acaatgttttgaaacatctagg

SEQ ID NO: 7655756 - DNA, 22 bp, Homo sapiens
acaatgtttctctttagtcatt

SEQ ID NO: 7655757 - DNA, 22 bp, Homo sapiens
acaatgtttctctttagtcatt

SEQ ID NO: 7655758 - DNA, 22 bp, Homo sapiens
acaatgtttctctttagtcatt

SEQ ID NO: 7655759 - DNA, 19 bp, Homo sapiens
acaatgttgttggacactc

SEQ ID NO: 7655760 - DNA, 19 bp, Homo sapiens
acaatgttgttggacactc

SEQ ID NO: 7655761 - DNA, 22 bp, Homo sapiens
aagagactttgcagtgtcccta

SEQ ID NO: 7655762 - DNA, 22 bp, Homo sapiens
aagagagaacacagcttgggca

SEQ ID NO: 7655763 - DNA, 22 bp, Homo sapiens
acaatgttctgtctgacttgtc

SEQ ID NO: 7655764 - DNA, 22 bp, Homo sapiens
aagagagaacacagcttgggca

SEQ ID NO: 7655765 - DNA, 22 bp, Homo sapiens
acaatgttctgtctgacttgtc

SEQ ID NO: 7655766 - DNA, 22 bp, Homo sapiens
aagagacttgtccgaagttgta

SEQ ID NO: 7655767 - DNA, 22 bp, Homo sapiens
aagagactttgcagtgtcccta

SEQ ID NO: 7655768 - DNA, 22 bp, Homo sapiens
aagagactttgcagtgtcccta

SEQ ID NO: 7655769 - DNA, 22 bp, Homo sapiens
aagagacttgtccgaagttgta

SEQ ID NO: 7655770 - DNA, 22 bp, Homo sapiens
aagagacttgtccgaagttgta

SEQ ID NO: 7655771 - DNA, 22 bp, Homo sapiens
aagagacttctagatttgttga

SEQ ID NO: 7655772 - DNA, 22 bp, Homo sapiens
aagagacttctagatttgttga

SEQ ID NO: 7655773 - DNA, 21 bp, Homo sapiens
aagagacatttctcatcagca

SEQ ID NO: 7655774 - DNA, 22 bp, Homo sapiens
aagagactaagaaagggcaata

SEQ ID NO: 7655775 - DNA, 22 bp, Homo sapiens
aagagactatggtgtctatgaa

SEQ ID NO: 7655776 - DNA, 22 bp, Homo sapiens
aagagactatggtgtctatgaa

SEQ ID NO: 7655777 - DNA, 22 bp, Homo sapiens
aagagactatggtgtctatgaa

SEQ ID NO: 7655778 - DNA, 22 bp, Homo sapiens
aagagactggaaactagggtca

SEQ ID NO: 7655779 - DNA, 22 bp, Homo sapiens
aagagactggaaactagggtca

SEQ ID NO: 7655780 - DNA, 22 bp, Homo sapiens
aagagactgtaaaggcgtgagt

SEQ ID NO: 7655781 - DNA, 21 bp, Homo sapiens
aagagacatttctcatcagca

SEQ ID NO: 7655782 - DNA, 21 bp, Homo sapiens
aagagacatttctcatcagca

SEQ ID NO: 7655783 - DNA, 21 bp, Homo sapiens
aagagacatttctcatcagca

SEQ ID NO: 7655784 - DNA, 21 bp, Homo sapiens
aagagacatttctcatcagca

SEQ ID NO: 7655785 - DNA, 21 bp, Homo sapiens
aagagacatttctcatcagca

SEQ ID NO: 7655786 - DNA, 21 bp, Homo sapiens
aagagacatttctcatcagca

SEQ ID NO: 7655787 - DNA, 21 bp, Homo sapiens
aagagacatttctcatcagca

SEQ ID NO: 7655788 - DNA, 22 bp, Homo sapiens
aagagacatgaatactcgaagg

SEQ ID NO: 7655789 - DNA, 22 bp, Homo sapiens
aagagacatgaatactcgaagg

SEQ ID NO: 7655790 - DNA, 22 bp, Homo sapiens
aagagacatgaatactcgaagg

SEQ ID NO: 7655791 - DNA, 21 bp, Homo sapiens
acacaaacctcctcagcctgg

SEQ ID NO: 7655792 - DNA, 21 bp, Homo sapiens
acacaaacctcctcagcctgg

SEQ ID NO: 7655793 - DNA, 21 bp, Homo sapiens
acacaaacctcctcagcctgg

SEQ ID NO: 7655794 - DNA, 22 bp, Homo sapiens
acacaaactgctagaaaattgg

SEQ ID NO: 7655795 - DNA, 22 bp, Homo sapiens
acacaaactgctagaaaattgg

SEQ ID NO: 7655796 - DNA, 22 bp, Homo sapiens
acacaaactgctagaaaattgg

SEQ ID NO: 7655797 - DNA, 21 bp, Homo sapiens
acacaaacctcctcagcctgg

SEQ ID NO: 7655798 - DNA, 21 bp, Homo sapiens
acacaaacctcctcagcctgg

SEQ ID NO: 7655799 - DNA, 22 bp, Homo sapiens
acacaaacagtctatagcacca

SEQ ID NO: 7655800 - DNA, 22 bp, Homo sapiens
acacaaacagtctatagcacca

SEQ ID NO: 7655801 - DNA, 22 bp, Homo sapiens
acacaaacagtctatagcacca

SEQ ID NO: 7655802 - DNA, 22 bp, Homo sapiens
acacaaacagtctatagcacca

SEQ ID NO: 7655803 - DNA, 22 bp, Homo sapiens
acacaaacagtctatagcacca

SEQ ID NO: 7655804 - DNA, 22 bp, Homo sapiens
acacaaacagtctatagcacca

SEQ ID NO: 7655805 - DNA, 22 bp, Homo sapiens
acacaaacagtctatagcacca

SEQ ID NO: 7655806 - DNA, 22 bp, Homo sapiens
acacaaaatcaaagtcctaggc

SEQ ID NO: 7655807 - DNA, 22 bp, Homo sapiens
acacaaaatcaaagtcctaggc

SEQ ID NO: 7655808 - DNA, 22 bp, Homo sapiens
acacaaagttggatgacaaaat

SEQ ID NO: 7655809 - DNA, 22 bp, Homo sapiens
acacaaagttggatgacaaaat

SEQ ID NO: 7655810 - DNA, 22 bp, Homo sapiens
acacaaagttggatgacaaaat

SEQ ID NO: 7655811 - DNA, 22 bp, Homo sapiens
acacaaagttggatgacaaaat

SEQ ID NO: 7655812 - DNA, 22 bp, Homo sapiens
acacaaagttggatgacaaaat

SEQ ID NO: 7655813 - DNA, 22 bp, Homo sapiens
acacaaagttggatgacaaaat

SEQ ID NO: 7655814 - DNA, 22 bp, Homo sapiens
acacaaagttggatgacaaaat

SEQ ID NO: 7655815 - DNA, 22 bp, Homo sapiens
acacaaagttggatgacaaaat

SEQ ID NO: 7655816 - DNA, 22 bp, Homo sapiens
acacaaagttggatgacaaaat

SEQ ID NO: 7655817 - DNA, 20 bp, Homo sapiens
acacaaagcaatggagtaca

SEQ ID NO: 7655818 - DNA, 22 bp, Homo sapiens
acacaaactgctagaaaattgg

SEQ ID NO: 7655819 - DNA, 22 bp, Homo sapiens
acacaaactgctagaaaattgg

SEQ ID NO: 7655820 - DNA, 22 bp, Homo sapiens
acacaaactgctagaaaattgg

SEQ ID NO: 7655821 - DNA, 22 bp, Homo sapiens
acacaaagctattgagtgtcat

SEQ ID NO: 7655822 - DNA, 20 bp, Homo sapiens
acacaaagcaatggagtaca

SEQ ID NO: 7655823 - DNA, 20 bp, Homo sapiens
acacaaagcaatggagtaca

SEQ ID NO: 7655824 - DNA, 22 bp, Homo sapiens
acacaaagctattgagtgtcat

SEQ ID NO: 7655825 - DNA, 22 bp, Homo sapiens
acacaaagctattgagtgtcat

SEQ ID NO: 7655826 - DNA, 22 bp, Homo sapiens
aagagcaacttggaaacactca

SEQ ID NO: 7655827 - DNA, 22 bp, Homo sapiens
aagagcaacttggaaacactca

SEQ ID NO: 7655828 - DNA, 22 bp, Homo sapiens
aagagcaacttggaaacactca

SEQ ID NO: 7655829 - DNA, 22 bp, Homo sapiens
aagagatttctgtaaaatgtaa

SEQ ID NO: 7655830 - DNA, 22 bp, Homo sapiens
aagagatttctgtaaaatgtaa

SEQ ID NO: 7655831 - DNA, 22 bp, Homo sapiens
acacaaattgtaggataattgc

SEQ ID NO: 7655832 - DNA, 22 bp, Homo sapiens
acacaaattgtaggataattgc

SEQ ID NO: 7655833 - DNA, 22 bp, Homo sapiens
acacaaattgtaggataattgc

SEQ ID NO: 7655834 - DNA, 22 bp, Homo sapiens
acacaaagttggatgacaaaat

SEQ ID NO: 7655835 - DNA, 22 bp, Homo sapiens
acacaaagttggatgacaaaat

SEQ ID NO: 7655836 - DNA, 22 bp, Homo sapiens
aagagcaacttggaaacactca

SEQ ID NO: 7655837 - DNA, 22 bp, Homo sapiens
aagagcaacttggaaacactca

SEQ ID NO: 7655838 - DNA, 22 bp, Homo sapiens
aagagcaacttggaaacactca

SEQ ID NO: 7655839 - DNA, 22 bp, Homo sapiens
aagagcaacttggaaacactca

SEQ ID NO: 7655840 - DNA, 22 bp, Homo sapiens
aagagcaacttggaaacactca

SEQ ID NO: 7655841 - DNA, 22 bp, Homo sapiens
aagagcaacttggaaacactca

SEQ ID NO: 7655842 - DNA, 22 bp, Homo sapiens
aagagcaagtgggtagtgaagc

SEQ ID NO: 7655843 - DNA, 22 bp, Homo sapiens
aagagcaagtgggtagtgaagc

SEQ ID NO: 7655844 - DNA, 22 bp, Homo sapiens
aagagcaagtgggtagtgaagc

SEQ ID NO: 7655845 - DNA, 22 bp, Homo sapiens
aagagcaagtgggtagtgaagc

SEQ ID NO: 7655846 - DNA, 22 bp, Homo sapiens
aagagcaagtgggtagtgaagc

SEQ ID NO: 7655847 - DNA, 22 bp, Homo sapiens
aagagcaagtgggtagtgaagc

SEQ ID NO: 7655848 - DNA, 22 bp, Homo sapiens
aagagcaagtgggtagtgaagc

SEQ ID NO: 7655849 - DNA, 22 bp, Homo sapiens
aagagcaagtgggtagtgaagc

SEQ ID NO: 7655850 - DNA, 22 bp, Homo sapiens
aagagcagaagtccttggatcc

SEQ ID NO: 7655851 - DNA, 22 bp, Homo sapiens
aagagcagattcctagtggagc

SEQ ID NO: 7655852 - DNA, 22 bp, Homo sapiens
aagagcagattcctagtggagc

SEQ ID NO: 7655853 - DNA, 22 bp, Homo sapiens
aagagcagcctccaggggtgga

SEQ ID NO: 7655854 - DNA, 22 bp, Homo sapiens
aagagcagcctccaggggtgga

SEQ ID NO: 7655855 - DNA, 22 bp, Homo sapiens
aagagcagattcctagtggagc

SEQ ID NO: 7655856 - DNA, 22 bp, Homo sapiens
aagagcagcctccaggggtgga

SEQ ID NO: 7655857 - DNA, 22 bp, Homo sapiens
aagagcagcctccaggggtgga

SEQ ID NO: 7655858 - DNA, 22 bp, Homo sapiens
aagagcagcctccaggggtgga

SEQ ID NO: 7655859 - DNA, 22 bp, Homo sapiens
aagagcaccttaattatgcaga

SEQ ID NO: 7655860 - DNA, 22 bp, Homo sapiens
aagagcaccttaattatgcaga

SEQ ID NO: 7655861 - DNA, 22 bp, Homo sapiens
aagagcaccttaattatgcaga

SEQ ID NO: 7655862 - DNA, 22 bp, Homo sapiens
aagagcaagtgggtagtgaagc

SEQ ID NO: 7655863 - DNA, 22 bp, Homo sapiens
aagagcaagtgggtagtgaagc

SEQ ID NO: 7655864 - DNA, 22 bp, Homo sapiens
aagagcaagtgggtagtgaagc

SEQ ID NO: 7655865 - DNA, 22 bp, Homo sapiens
aagagcaccgcagcagcccaac

SEQ ID NO: 7655866 - DNA, 22 bp, Homo sapiens
aagagcacttttcttatctgca

SEQ ID NO: 7655867 - DNA, 22 bp, Homo sapiens
aagagcactaacagagctgata

SEQ ID NO: 7655868 - DNA, 22 bp, Homo sapiens
aagagcactaacagagctgata

SEQ ID NO: 7655869 - DNA, 22 bp, Homo sapiens
aagagcactaacagagctgata

SEQ ID NO: 7655870 - DNA, 22 bp, Homo sapiens
aattttacaaaatacctccgat

SEQ ID NO: 7655871 - DNA, 20 bp, Homo sapiens
aattttactgtcctatagag

SEQ ID NO: 7655872 - DNA, 22 bp, Homo sapiens
aattttactaatctgagtgtga

SEQ ID NO: 7655873 - DNA, 22 bp, Homo sapiens
aattttactaatctgagtgtga

SEQ ID NO: 7655874 - DNA, 22 bp, Homo sapiens
aattttaatcagtggtgctgag

SEQ ID NO: 7655875 - DNA, 22 bp, Homo sapiens
aattttaatcagtggtgctgag

SEQ ID NO: 7655876 - DNA, 22 bp, Homo sapiens
aattttaatcagtggtgctgag

SEQ ID NO: 7655877 - DNA, 22 bp, Homo sapiens
aattttaatcagtggtgctgag

SEQ ID NO: 7655878 - DNA, 22 bp, Homo sapiens
aattttaatcagtggtgctgag

SEQ ID NO: 7655879 - DNA, 22 bp, Homo sapiens
aattttaagcatatgactggtt

SEQ ID NO: 7655880 - DNA, 22 bp, Homo sapiens
aattttaatcagtggtgctgag

SEQ ID NO: 7655881 - DNA, 22 bp, Homo sapiens
aattttaatcagtggtgctgag

SEQ ID NO: 7655882 - DNA, 22 bp, Homo sapiens
aattttaatcagtggtgctgag

SEQ ID NO: 7655883 - DNA, 22 bp, Homo sapiens
aattttaagcatatgactggtt

SEQ ID NO: 7655884 - DNA, 22 bp, Homo sapiens
aattttaagcatatgactggtt

SEQ ID NO: 7655885 - DNA, 22 bp, Homo sapiens
aattttaagcatatgactggtt

SEQ ID NO: 7655886 - DNA, 22 bp, Homo sapiens
aattttaagcatatgactggtt

SEQ ID NO: 7655887 - DNA, 22 bp, Homo sapiens
aattttaagcatatgactggtt

SEQ ID NO: 7655888 - DNA, 22 bp, Homo sapiens
aattttaagcatatgactggtt

SEQ ID NO: 7655889 - DNA, 22 bp, Homo sapiens
aatttgttttcaagtcactgga

SEQ ID NO: 7655890 - DNA, 22 bp, Homo sapiens
aatttgttataacttgggctga

SEQ ID NO: 7655891 - DNA, 22 bp, Homo sapiens
aatttgttttcaagtcactgga

SEQ ID NO: 7655892 - DNA, 22 bp, Homo sapiens
aatttgttttcaagtcactgga

SEQ ID NO: 7655893 - DNA, 22 bp, Homo sapiens
aatttgttacacagcaatataa

SEQ ID NO: 7655894 - DNA, 22 bp, Homo sapiens
aatttgttacacagcaatataa

SEQ ID NO: 7655895 - DNA, 22 bp, Homo sapiens
aatttgttagcatactctagtt

SEQ ID NO: 7655896 - DNA, 22 bp, Homo sapiens
aatttgttagcatactctagtt

SEQ ID NO: 7655897 - DNA, 22 bp, Homo sapiens
aatttgttagcatactctagtt

SEQ ID NO: 7655898 - DNA, 22 bp, Homo sapiens
aatttccagatcagatgactca

SEQ ID NO: 7655899 - DNA, 22 bp, Homo sapiens
aatttccagaccccatccacag

SEQ ID NO: 7655900 - DNA, 22 bp, Homo sapiens
aatttcagatgtcataaatata

SEQ ID NO: 7655901 - DNA, 22 bp, Homo sapiens
aatttcagatgtcataaatata

SEQ ID NO: 7655902 - DNA, 22 bp, Homo sapiens
aatttcagatgtcataaatata

SEQ ID NO: 7655903 - DNA, 22 bp, Homo sapiens
aatttcagctcaaacttgtgtt

SEQ ID NO: 7655904 - DNA, 22 bp, Homo sapiens
aatttcagctcaaacttgtgtt

SEQ ID NO: 7655905 - DNA, 22 bp, Homo sapiens
aatttcagctcaaacttgtgtt

SEQ ID NO: 7655906 - DNA, 22 bp, Homo sapiens
aatttcagttgctaataagttc

SEQ ID NO: 7655907 - DNA, 22 bp, Homo sapiens
aatttcagtatgaagtttcaca

SEQ ID NO: 7655908 - DNA, 22 bp, Homo sapiens
aatttcagtatgaagtttcaca

SEQ ID NO: 7655909 - DNA, 22 bp, Homo sapiens
aatttcagtatgaagtttcaca

SEQ ID NO: 7655910 - DNA, 22 bp, Homo sapiens
aatttcagtatgaagtttcaca

SEQ ID NO: 7655911 - DNA, 22 bp, Homo sapiens
aatttcagttgctaataagttc

SEQ ID NO: 7655912 - DNA, 22 bp, Homo sapiens
aatttccaaatttctgtcacac

SEQ ID NO: 7655913 - DNA, 22 bp, Homo sapiens
aatttccaaatttctgtcacac

SEQ ID NO: 7655914 - DNA, 22 bp, Homo sapiens
aatttcagttgctaataagttc

SEQ ID NO: 7655915 - DNA, 22 bp, Homo sapiens
aatttcagaacccaaattagcg

SEQ ID NO: 7655916 - DNA, 22 bp, Homo sapiens
aatttcagaacccaaattagcg

SEQ ID NO: 7655917 - DNA, 22 bp, Homo sapiens
aatttcagaacccaaattagcg

SEQ ID NO: 7655918 - DNA, 22 bp, Homo sapiens
aatttcagaacccaaattagcg

SEQ ID NO: 7655919 - DNA, 22 bp, Homo sapiens
aatttcagaccatttgcaatta

SEQ ID NO: 7655920 - DNA, 22 bp, Homo sapiens
aatttcagaactatctgggagt

SEQ ID NO: 7655921 - DNA, 21 bp, Homo sapiens
aatttcagacccattttgcct

SEQ ID NO: 7655922 - DNA, 22 bp, Homo sapiens
aatttcagatattaaagaatga

SEQ ID NO: 7655923 - DNA, 21 bp, Homo sapiens
aatttcagacccattttgcct

SEQ ID NO: 7655924 - DNA, 22 bp, Homo sapiens
aatttcagatattaaagaatga

SEQ ID NO: 7655925 - DNA, 22 bp, Homo sapiens
aatttcagatgtcataaatata

SEQ ID NO: 7655926 - DNA, 22 bp, Homo sapiens
aatttcagatattaaagaatga

SEQ ID NO: 7655927 - DNA, 22 bp, Homo sapiens
aatttcagatattaaagaatga

SEQ ID NO: 7655928 - DNA, 22 bp, Homo sapiens
aagagaaagcagactttgtcat

SEQ ID NO: 7655929 - DNA, 22 bp, Homo sapiens
aagagaacagtcaccatgcaca

SEQ ID NO: 7655930 - DNA, 22 bp, Homo sapiens
aagagaacagtcaccatgcaca

SEQ ID NO: 7655931 - DNA, 22 bp, Homo sapiens
aagagaacagtcaccatgcaca

SEQ ID NO: 7655932 - DNA, 22 bp, Homo sapiens
aagagaacagtcaccatgcaca

SEQ ID NO: 7655933 - DNA, 22 bp, Homo sapiens
aagagaagaaagtgtctacaca

SEQ ID NO: 7655934 - DNA, 22 bp, Homo sapiens
aagagaagaaagtgtctacaca

SEQ ID NO: 7655935 - DNA, 22 bp, Homo sapiens
aagagaacagtcaccatgcaca

SEQ ID NO: 7655936 - DNA, 22 bp, Homo sapiens
aagagaagaaagtgtctacaca

SEQ ID NO: 7655937 - DNA, 22 bp, Homo sapiens
aagagaacagtcaccatgcaca

SEQ ID NO: 7655938 - DNA, 22 bp, Homo sapiens
aagagaaagcagactttgtcat

SEQ ID NO: 7655939 - DNA, 22 bp, Homo sapiens
aagagaaagcagactttgtcat

SEQ ID NO: 7655940 - DNA, 22 bp, Homo sapiens
aagagaaagcagactttgtcat

SEQ ID NO: 7655941 - DNA, 22 bp, Homo sapiens
aagagaaagcagactttgtcat

SEQ ID NO: 7655942 - DNA, 22 bp, Homo sapiens
aagagaaagcagactttgtcat

SEQ ID NO: 7655943 - DNA, 22 bp, Homo sapiens
aagagaaagcagactttgtcat

SEQ ID NO: 7655944 - DNA, 22 bp, Homo sapiens
aagactttctggggtgtaaagg

SEQ ID NO: 7655945 - DNA, 22 bp, Homo sapiens
aagactttctcccaaatcctca

SEQ ID NO: 7655946 - DNA, 22 bp, Homo sapiens
aagagaaagcagactttgtcat

SEQ ID NO: 7655947 - DNA, 22 bp, Homo sapiens
aagagaaagcagactttgtcat

SEQ ID NO: 7655948 - DNA, 22 bp, Homo sapiens
aagagaaagcagactttgtcat

SEQ ID NO: 7655949 - DNA, 22 bp, Homo sapiens
aagagaaagcagactttgtcat

SEQ ID NO: 7655950 - DNA, 22 bp, Homo sapiens
aagactttctgtaaagctacag

SEQ ID NO: 7655951 - DNA, 20 bp, Homo sapiens
aagagaagaagtctttgaaa

SEQ ID NO: 7655952 - DNA, 22 bp, Homo sapiens
aagagaagaaagtgtctacaca

SEQ ID NO: 7655953 - DNA, 22 bp, Homo sapiens
aagagaagaaagtgtctacaca

SEQ ID NO: 7655954 - DNA, 22 bp, Homo sapiens
aagagaagaaagtgtctacaca

SEQ ID NO: 7655955 - DNA, 22 bp, Homo sapiens
aagagaagaaagtgtctacaca

SEQ ID NO: 7655956 - DNA, 22 bp, Homo sapiens
aagagaagaaagtgtctacaca

SEQ ID NO: 7655957 - DNA, 22 bp, Homo sapiens
aagagaagaaagtgtctacaca

SEQ ID NO: 7655958 - DNA, 22 bp, Homo sapiens
aagagaagaaagtgtctacaca

SEQ ID NO: 7655959 - DNA, 22 bp, Homo sapiens
aagagaaggattctgagcctgg

SEQ ID NO: 7655960 - DNA, 22 bp, Homo sapiens
aagagaaggattctgagcctgg

SEQ ID NO: 7655961 - DNA, 22 bp, Homo sapiens
aagagaaggattctgagcctgg

SEQ ID NO: 7655962 - DNA, 22 bp, Homo sapiens
aagagaaggattctgagcctgg

SEQ ID NO: 7655963 - DNA, 22 bp, Homo sapiens
aagagaaggattctgagcctgg

SEQ ID NO: 7655964 - DNA, 20 bp, Homo sapiens
aagagaagaagtctttgaaa

SEQ ID NO: 7655965 - DNA, 20 bp, Homo sapiens
aagagaagaagtctttgaaa

SEQ ID NO: 7655966 - DNA, 20 bp, Homo sapiens
aagagaagaagtctttgaaa

SEQ ID NO: 7655967 - DNA, 20 bp, Homo sapiens
aattttatctccatcctttg

SEQ ID NO: 7655968 - DNA, 20 bp, Homo sapiens
aattttatctccatcctttg

SEQ ID NO: 7655969 - DNA, 20 bp, Homo sapiens
aattttatctccatcctttg

SEQ ID NO: 7655970 - DNA, 20 bp, Homo sapiens
aattttatctccatcctttg

SEQ ID NO: 7655971 - DNA, 20 bp, Homo sapiens
aattttatctccatcctttg

SEQ ID NO: 7655972 - DNA, 22 bp, Homo sapiens
aattttacttccctcagtgtag

SEQ ID NO: 7655973 - DNA, 22 bp, Homo sapiens
aattttacttccctcagtgtag

SEQ ID NO: 7655974 - DNA, 20 bp, Homo sapiens
aattttatctccatcctttg

SEQ ID NO: 7655975 - DNA, 22 bp, Homo sapiens
aattttatctctaagcaggctt

SEQ ID NO: 7655976 - DNA, 22 bp, Homo sapiens
aattttatctctaagcaggctt

SEQ ID NO: 7655977 - DNA, 22 bp, Homo sapiens
aattttatctctaagcaggctt

SEQ ID NO: 7655978 - DNA, 22 bp, Homo sapiens
aattttatctctaagcaggctt

SEQ ID NO: 7655979 - DNA, 22 bp, Homo sapiens
aagaccataatgtaagatgaat

SEQ ID NO: 7655980 - DNA, 20 bp, Homo sapiens
aattttatctccatcctttg

SEQ ID NO: 7655981 - DNA, 20 bp, Homo sapiens
aattttatctccatcctttg

SEQ ID NO: 7655982 - DNA, 20 bp, Homo sapiens
aattttatctccatcctttg

SEQ ID NO: 7655983 - DNA, 22 bp, Homo sapiens
aagacttaagtgaaaatccaca

SEQ ID NO: 7655984 - DNA, 22 bp, Homo sapiens
aagacttgaccaggttgaaggc

SEQ ID NO: 7655985 - DNA, 22 bp, Homo sapiens
aagaccatcacagagacacttg

SEQ ID NO: 7655986 - DNA, 22 bp, Homo sapiens
aagaccatcacagagacacttg

SEQ ID NO: 7655987 - DNA, 22 bp, Homo sapiens
aagaccattgctgtatttgtag

SEQ ID NO: 7655988 - DNA, 22 bp, Homo sapiens
aagacttgaccaggttgaaggc

SEQ ID NO: 7655989 - DNA, 22 bp, Homo sapiens
aagacttgaccaggttgaaggc

SEQ ID NO: 7655990 - DNA, 22 bp, Homo sapiens
aagacttgaccaggttgaaggc

SEQ ID NO: 7655991 - DNA, 22 bp, Homo sapiens
aagacttgaccaggttgaaggc

SEQ ID NO: 7655992 - DNA, 22 bp, Homo sapiens
aagactttcaagtatgcatgca

SEQ ID NO: 7655993 - DNA, 22 bp, Homo sapiens
aagactttcaagtatgcatgca

SEQ ID NO: 7655994 - DNA, 22 bp, Homo sapiens
aagacttgaccaggttgaaggc

SEQ ID NO: 7655995 - DNA, 22 bp, Homo sapiens
aagactttcaaacctatgtttg

SEQ ID NO: 7655996 - DNA, 22 bp, Homo sapiens
aagactttccctcatcagaacg

SEQ ID NO: 7655997 - DNA, 22 bp, Homo sapiens
aagactttccctcatcagaacg

SEQ ID NO: 7655998 - DNA, 22 bp, Homo sapiens
aagactttctcccaaatcctca

SEQ ID NO: 7655999 - DNA, 22 bp, Homo sapiens
aagaaaagaaacctgaggcttt

SEQ ID NO: 7656000 - DNA, 22 bp, Homo sapiens
aagaaaacgttttgaggagttt

SEQ ID NO: 7656001 - DNA, 20 bp, Homo sapiens
aagaaaacgtcttcagggga

SEQ ID NO: 7656002 - DNA, 22 bp, Homo sapiens
aagaaaacgttttgaggagttt

SEQ ID NO: 7656003 - DNA, 22 bp, Homo sapiens
aagaaaacgttttgaggagttt

SEQ ID NO: 7656004 - DNA, 20 bp, Homo sapiens
aagaaaacgtcttcagggga

SEQ ID NO: 7656005 - DNA, 20 bp, Homo sapiens
aagaaaacgtcttcagggga

SEQ ID NO: 7656006 - DNA, 20 bp, Homo sapiens
aagaaaacgtcttcagggga

SEQ ID NO: 7656007 - DNA, 22 bp, Homo sapiens
aagaaaacatgatctaatttaa

SEQ ID NO: 7656008 - DNA, 22 bp, Homo sapiens
aagaaaacatgatctaatttaa

SEQ ID NO: 7656009 - DNA, 22 bp, Homo sapiens
aagaaaacatgatctaatttaa

SEQ ID NO: 7656010 - DNA, 22 bp, Homo sapiens
aagaaaacaatgacttgccagc

SEQ ID NO: 7656011 - DNA, 22 bp, Homo sapiens
aagaaaacaatgacttgccagc

SEQ ID NO: 7656012 - DNA, 22 bp, Homo sapiens
aagaaaacaatgacttgccagc

SEQ ID NO: 7656013 - DNA, 22 bp, Homo sapiens
aagaaaacaatgacttgccagc

SEQ ID NO: 7656014 - DNA, 22 bp, Homo sapiens
aagaaaacaatgacttgccagc

SEQ ID NO: 7656015 - DNA, 22 bp, Homo sapiens
aagaaaacaatgacttgccagc

SEQ ID NO: 7656016 - DNA, 22 bp, Homo sapiens
aagaaaacatgatctaatttaa

SEQ ID NO: 7656017 - DNA, 22 bp, Homo sapiens
aagaaaacatgatctaatttaa

SEQ ID NO: 7656018 - DNA, 22 bp, Homo sapiens
aagaaaacatgatctaatttaa

SEQ ID NO: 7656019 - DNA, 22 bp, Homo sapiens
aagaaaacatgatctaatttaa

SEQ ID NO: 7656020 - DNA, 22 bp, Homo sapiens
aagaaaagaaacctgaggcttt

SEQ ID NO: 7656021 - DNA, 22 bp, Homo sapiens
aagaaaagaaacctgaggcttt

SEQ ID NO: 7656022 - DNA, 22 bp, Homo sapiens
aagaaaagaaacctgaggcttt

SEQ ID NO: 7656023 - DNA, 22 bp, Homo sapiens
aagaaaagaaacctgaggcttt

SEQ ID NO: 7656024 - DNA, 22 bp, Homo sapiens
aagaaaagaaacctgaggcttt

SEQ ID NO: 7656025 - DNA, 22 bp, Homo sapiens
aagaaaagaaacctgaggcttt

SEQ ID NO: 7656026 - DNA, 22 bp, Homo sapiens
aagaaaagatgtttggttttca

SEQ ID NO: 7656027 - DNA, 22 bp, Homo sapiens
aagaaaagatgtttggttttca

SEQ ID NO: 7656028 - DNA, 22 bp, Homo sapiens
aagaaaagatgtttggttttca

SEQ ID NO: 7656029 - DNA, 22 bp, Homo sapiens
aagaaaagaaacctgaggcttt

SEQ ID NO: 7656030 - DNA, 22 bp, Homo sapiens
aagaaaagaaacctgaggcttt

SEQ ID NO: 7656031 - DNA, 22 bp, Homo sapiens
aagaaaaggtaaccgcttatct

SEQ ID NO: 7656032 - DNA, 22 bp, Homo sapiens
aagaaaaggtaaccgcttatct

SEQ ID NO: 7656033 - DNA, 22 bp, Homo sapiens
aagaaaaggtaaccgcttatct

SEQ ID NO: 7656034 - DNA, 22 bp, Homo sapiens
aagaaaagatgtttggttttca

SEQ ID NO: 7656035 - DNA, 22 bp, Homo sapiens
aagaaaagatgtttggttttca

SEQ ID NO: 7656036 - DNA, 22 bp, Homo sapiens
aagaaaagatgtttggttttca

SEQ ID NO: 7656037 - DNA, 22 bp, Homo sapiens
aagaaaagatgtttggttttca

SEQ ID NO: 7656038 - DNA, 22 bp, Homo sapiens
aagaaaatcagttctggtcagt

SEQ ID NO: 7656039 - DNA, 22 bp, Homo sapiens
aagaaaatcagttctggtcagt

SEQ ID NO: 7656040 - DNA, 22 bp, Homo sapiens
aagaaaatcagttctggtcagt

SEQ ID NO: 7656041 - DNA, 22 bp, Homo sapiens
aagaaaaggtaaccgcttatct

SEQ ID NO: 7656042 - DNA, 22 bp, Homo sapiens
aagaaaaggtaaccgcttatct

SEQ ID NO: 7656043 - DNA, 22 bp, Homo sapiens
aagaaaaggtaaccgcttatct

SEQ ID NO: 7656044 - DNA, 22 bp, Homo sapiens
aagaaaatcagttctggtcagt

SEQ ID NO: 7656045 - DNA, 22 bp, Homo sapiens
aagaaaatcagttctggtcagt

SEQ ID NO: 7656046 - DNA, 22 bp, Homo sapiens
aagaaaatcagttctggtcagt

SEQ ID NO: 7656047 - DNA, 22 bp, Homo sapiens
aagaaacaaccactgctctcct

SEQ ID NO: 7656048 - DNA, 22 bp, Homo sapiens
aagaaaatcagttctggtcagt

SEQ ID NO: 7656049 - DNA, 22 bp, Homo sapiens
aagaaacaaccactgctctcct

SEQ ID NO: 7656050 - DNA, 22 bp, Homo sapiens
aagaaacaaccactgctctcct

SEQ ID NO: 7656051 - DNA, 22 bp, Homo sapiens
aagaaaatcagttctggtcagt

SEQ ID NO: 7656052 - DNA, 22 bp, Homo sapiens
aagaaaatcagttctggtcagt

SEQ ID NO: 7656053 - DNA, 22 bp, Homo sapiens
aagaaaatcagttctggtcagt

SEQ ID NO: 7656054 - DNA, 22 bp, Homo sapiens
aagaaaatcagttctggtcagt

SEQ ID NO: 7656055 - DNA, 22 bp, Homo sapiens
aagaaacaaccactgctctcct

SEQ ID NO: 7656056 - DNA, 22 bp, Homo sapiens
aagaaacaaccactgctctcct

SEQ ID NO: 7656057 - DNA, 22 bp, Homo sapiens
aagaaacaaccactgctctcct

SEQ ID NO: 7656058 - DNA, 22 bp, Homo sapiens
aagaaacaaccactgctctcct

SEQ ID NO: 7656059 - DNA, 22 bp, Homo sapiens
aagaaacaaccactgctctcct

SEQ ID NO: 7656060 - DNA, 22 bp, Homo sapiens
aagaaacaaccactgctctcct

SEQ ID NO: 7656061 - DNA, 22 bp, Homo sapiens
aagaaacaaccactgctctcct

SEQ ID NO: 7656062 - DNA, 22 bp, Homo sapiens
aagaaaccaaccctgccagcac

SEQ ID NO: 7656063 - DNA, 22 bp, Homo sapiens
aagaaaccaaccctgccagcac

SEQ ID NO: 7656064 - DNA, 22 bp, Homo sapiens
aagaaacaaccactgctctcct

SEQ ID NO: 7656065 - DNA, 22 bp, Homo sapiens
aagaaacctagtctggagcagc

SEQ ID NO: 7656066 - DNA, 22 bp, Homo sapiens
aagaaacctagtctggagcagc

SEQ ID NO: 7656067 - DNA, 22 bp, Homo sapiens
aagaaactcactttgggaggca

SEQ ID NO: 7656068 - DNA, 22 bp, Homo sapiens
aagaaactgaaagtggcttcat

SEQ ID NO: 7656069 - DNA, 22 bp, Homo sapiens
aagaaactgaaagtggcttcat

SEQ ID NO: 7656070 - DNA, 22 bp, Homo sapiens
aagaaactggaatatagagagc

SEQ ID NO: 7656071 - DNA, 22 bp, Homo sapiens
aagaaactggaatatagagagc

SEQ ID NO: 7656072 - DNA, 22 bp, Homo sapiens
aagaaactggaatatagagagc

SEQ ID NO: 7656073 - DNA, 22 bp, Homo sapiens
aagaaactggaatatagagagc

SEQ ID NO: 7656074 - DNA, 22 bp, Homo sapiens
aagaaactgttgcgtgacagcg

SEQ ID NO: 7656075 - DNA, 22 bp, Homo sapiens
aagaaactgttgcgtgacagcg

SEQ ID NO: 7656076 - DNA, 22 bp, Homo sapiens
aagaaactgttgcgtgacagcg

SEQ ID NO: 7656077 - DNA, 22 bp, Homo sapiens
aagaaactgttgcgtgacagcg

SEQ ID NO: 7656078 - DNA, 20 bp, Homo sapiens
aagaaacttgaaagtacaag

SEQ ID NO: 7656079 - DNA, 20 bp, Homo sapiens
aagaaacttgaaagtacaag

SEQ ID NO: 7656080 - DNA, 22 bp, Homo sapiens
aagaaactgttgcgtgacagcg

SEQ ID NO: 7656081 - DNA, 22 bp, Homo sapiens
aagaaactgttgcgtgacagcg

SEQ ID NO: 7656082 - DNA, 22 bp, Homo sapiens
aactggagcccctctgccactg

SEQ ID NO: 7656083 - DNA, 22 bp, Homo sapiens
aactggagggcaaatggcttgt

SEQ ID NO: 7656084 - DNA, 22 bp, Homo sapiens
aactggacactggtctgtactg

SEQ ID NO: 7656085 - DNA, 22 bp, Homo sapiens
aactggacactggtctgtactg

SEQ ID NO: 7656086 - DNA, 22 bp, Homo sapiens
aactggaatgaaatttacgatg

SEQ ID NO: 7656087 - DNA, 22 bp, Homo sapiens
aactggaatgaaatttacgatg

SEQ ID NO: 7656088 - DNA, 22 bp, Homo sapiens
aactggaatgaaatttacgatg

SEQ ID NO: 7656089 - DNA, 22 bp, Homo sapiens
aactggaatgaaatttacgatg

SEQ ID NO: 7656090 - DNA, 22 bp, Homo sapiens
aactggagggcaaatggcttgt

SEQ ID NO: 7656091 - DNA, 22 bp, Homo sapiens
aactggatcagttgagggaggc

SEQ ID NO: 7656092 - DNA, 22 bp, Homo sapiens
aactgggcccagtctgagttgg

SEQ ID NO: 7656093 - DNA, 22 bp, Homo sapiens
aactggcatatgaacttgttct

SEQ ID NO: 7656094 - DNA, 22 bp, Homo sapiens
aactggctgggaacacctagag

SEQ ID NO: 7656095 - DNA, 21 bp, Homo sapiens
aactggcagaccaactatggc

SEQ ID NO: 7656096 - DNA, 22 bp, Homo sapiens
aactggattttgatgagcagtt

SEQ ID NO: 7656097 - DNA, 22 bp, Homo sapiens
aactggatttaggaacagagaa

SEQ ID NO: 7656098 - DNA, 22 bp, Homo sapiens
aactggtagctgattaagtata

SEQ ID NO: 7656099 - DNA, 22 bp, Homo sapiens
aactggtagaaagcagtaagtg

SEQ ID NO: 7656100 - DNA, 22 bp, Homo sapiens
aactggtagaaagcagtaagtg

SEQ ID NO: 7656101 - DNA, 22 bp, Homo sapiens
aactggtatctcttcagtgtaa

SEQ ID NO: 7656102 - DNA, 22 bp, Homo sapiens
aactggtagaaagcagtaagtg

SEQ ID NO: 7656103 - DNA, 22 bp, Homo sapiens
aactggtagctgattaagtata

SEQ ID NO: 7656104 - DNA, 22 bp, Homo sapiens
aactggtatctcttcagtgtaa

SEQ ID NO: 7656105 - DNA, 22 bp, Homo sapiens
aactggtatggtgagaagagag

SEQ ID NO: 7656106 - DNA, 22 bp, Homo sapiens
aactggtgagataaattattta

SEQ ID NO: 7656107 - DNA, 22 bp, Homo sapiens
aactggtcttatgcaagcacta

SEQ ID NO: 7656108 - DNA, 22 bp, Homo sapiens
aactggtcctcaaattttgatg

SEQ ID NO: 7656109 - DNA, 22 bp, Homo sapiens
aactttctgtctgagctgcaga

SEQ ID NO: 7656110 - DNA, 22 bp, Homo sapiens
aactttctgtctgagctgcaga

SEQ ID NO: 7656111 - DNA, 22 bp, Homo sapiens
aactggtgagataaattattta

SEQ ID NO: 7656112 - DNA, 22 bp, Homo sapiens
aactttctgtctgagctgcaga

SEQ ID NO: 7656113 - DNA, 22 bp, Homo sapiens
aactttctgttacgtccccaga

SEQ ID NO: 7656114 - DNA, 22 bp, Homo sapiens
aactttcttgtgacatttgggg

SEQ ID NO: 7656115 - DNA, 22 bp, Homo sapiens
aactttcttggatgtctcaaca

SEQ ID NO: 7656116 - DNA, 22 bp, Homo sapiens
aactttcttggatgtctcaaca

SEQ ID NO: 7656117 - DNA, 22 bp, Homo sapiens
aactttcttgtgacatttgggg

SEQ ID NO: 7656118 - DNA, 22 bp, Homo sapiens
aagaaaacaatgacttgccagc

SEQ ID NO: 7656119 - DNA, 22 bp, Homo sapiens
aatgggaaaagagtatgattta

SEQ ID NO: 7656120 - DNA, 22 bp, Homo sapiens
aatgggaaagagactagatgct

SEQ ID NO: 7656121 - DNA, 22 bp, Homo sapiens
aactgcttgtaaataatgttga

SEQ ID NO: 7656122 - DNA, 22 bp, Homo sapiens
aactgcttgagatatgtttgtc

SEQ ID NO: 7656123 - DNA, 22 bp, Homo sapiens
aatgggaagccagaagacaagg

SEQ ID NO: 7656124 - DNA, 22 bp, Homo sapiens
aatggcttttgcacttaaatcg

SEQ ID NO: 7656125 - DNA, 22 bp, Homo sapiens
aatggcttttgcacttaaatcg

SEQ ID NO: 7656126 - DNA, 22 bp, Homo sapiens
aatggcttttaaaaatagcatt

SEQ ID NO: 7656127 - DNA, 22 bp, Homo sapiens
aatggcttttaaaaatagcatt

SEQ ID NO: 7656128 - DNA, 22 bp, Homo sapiens
aatggcttttgcacttaaatcg

SEQ ID NO: 7656129 - DNA, 22 bp, Homo sapiens
aatggcttttgcacttaaatcg

SEQ ID NO: 7656130 - DNA, 22 bp, Homo sapiens
aatggctttgacattttcaaat

SEQ ID NO: 7656131 - DNA, 22 bp, Homo sapiens
aatggctttgacattttcaaat

SEQ ID NO: 7656132 - DNA, 22 bp, Homo sapiens
aatggctttgagtattttctgg

SEQ ID NO: 7656133 - DNA, 22 bp, Homo sapiens
aatggctttggtctgggtccca

SEQ ID NO: 7656134 - DNA, 22 bp, Homo sapiens
aatggctttggtctgggtccca

SEQ ID NO: 7656135 - DNA, 22 bp, Homo sapiens
aatggctttggcaggaatttca

SEQ ID NO: 7656136 - DNA, 22 bp, Homo sapiens
aactggaaagatcagtaggaag

SEQ ID NO: 7656137 - DNA, 22 bp, Homo sapiens
aactggaaagatcagtaggaag

SEQ ID NO: 7656138 - DNA, 17 bp, Homo sapiens
aactgctttttttagcc

SEQ ID NO: 7656139 - DNA, 22 bp, Homo sapiens
aactgcttgtaaataatgttga

SEQ ID NO: 7656140 - DNA, 22 bp, Homo sapiens
aactgcttgtagtgacttgcct

SEQ ID NO: 7656141 - DNA, 22 bp, Homo sapiens
aactgctttgtgagctttctgg

SEQ ID NO: 7656142 - DNA, 22 bp, Homo sapiens
aactggaactggtagtgttggt

SEQ ID NO: 7656143 - DNA, 22 bp, Homo sapiens
aactggaaccttttattcagtc

SEQ ID NO: 7656144 - DNA, 22 bp, Homo sapiens
aactggaaccttttattcagtc

SEQ ID NO: 7656145 - DNA, 22 bp, Homo sapiens
aactggaaccttttattcagtc

SEQ ID NO: 7656146 - DNA, 22 bp, Homo sapiens
aactggaactggtagtgttggt

SEQ ID NO: 7656147 - DNA, 22 bp, Homo sapiens
aactggaagagtgaatataact

SEQ ID NO: 7656148 - DNA, 22 bp, Homo sapiens
aactggaagagtgaatataact

SEQ ID NO: 7656149 - DNA, 22 bp, Homo sapiens
aactggaatagcacaggaaaag

SEQ ID NO: 7656150 - DNA, 22 bp, Homo sapiens
aactggaatagcacaggaaaag

SEQ ID NO: 7656151 - DNA, 22 bp, Homo sapiens
aactggaaggattgcagatgtc

SEQ ID NO: 7656152 - DNA, 22 bp, Homo sapiens
aatttaagaacatttcaggact

SEQ ID NO: 7656153 - DNA, 22 bp, Homo sapiens
aatttaagagcatagctccaac

SEQ ID NO: 7656154 - DNA, 22 bp, Homo sapiens
aatttaaggaggccttcactct

SEQ ID NO: 7656155 - DNA, 22 bp, Homo sapiens
aatttaatcaagttctgctctg

SEQ ID NO: 7656156 - DNA, 22 bp, Homo sapiens
aatttaaggaggccttcactct

SEQ ID NO: 7656157 - DNA, 22 bp, Homo sapiens
aagaacagattcagcctgaact

SEQ ID NO: 7656158 - DNA, 22 bp, Homo sapiens
aagaacaactgctttaaaagca

SEQ ID NO: 7656159 - DNA, 22 bp, Homo sapiens
aagaacaactgctttaaaagca

SEQ ID NO: 7656160 - DNA, 17 bp, Homo sapiens
aagaacactcaatagca

SEQ ID NO: 7656161 - DNA, 17 bp, Homo sapiens
aagaacactcaatagca

SEQ ID NO: 7656162 - DNA, 17 bp, Homo sapiens
aagaacactcaatagca

SEQ ID NO: 7656163 - DNA, 22 bp, Homo sapiens
aatttcactgtggagcacattt

SEQ ID NO: 7656164 - DNA, 22 bp, Homo sapiens
aatttcactggaaaagataatt

SEQ ID NO: 7656165 - DNA, 22 bp, Homo sapiens
aatttcactggaaaagataatt

SEQ ID NO: 7656166 - DNA, 22 bp, Homo sapiens
aatttcactggaaaagataatt

SEQ ID NO: 7656167 - DNA, 22 bp, Homo sapiens
aatttcactggaaaagataatt

SEQ ID NO: 7656168 - DNA, 22 bp, Homo sapiens
aatttcactggaaaagataatt

SEQ ID NO: 7656169 - DNA, 22 bp, Homo sapiens
aatttcacctatcacttaagcc

SEQ ID NO: 7656170 - DNA, 22 bp, Homo sapiens
aatttacacttcatttggaggg

SEQ ID NO: 7656171 - DNA, 22 bp, Homo sapiens
aatttacacttcatttggaggg

SEQ ID NO: 7656172 - DNA, 22 bp, Homo sapiens
aatttacacttcatttggaggg

SEQ ID NO: 7656173 - DNA, 22 bp, Homo sapiens
aatttacacttcatttggaggg

SEQ ID NO: 7656174 - DNA, 22 bp, Homo sapiens
aattctgagaacaaaaggtact

SEQ ID NO: 7656175 - DNA, 22 bp, Homo sapiens
aattctgagaacaaaaggtact

SEQ ID NO: 7656176 - DNA, 22 bp, Homo sapiens
aagaaatgtagagcctagtaaa

SEQ ID NO: 7656177 - DNA, 22 bp, Homo sapiens
aagaaatgtagagcctagtaaa

SEQ ID NO: 7656178 - DNA, 22 bp, Homo sapiens
aagaaatgtagagcctagtaaa

SEQ ID NO: 7656179 - DNA, 22 bp, Homo sapiens
aagaaatgtagagcctagtaaa

SEQ ID NO: 7656180 - DNA, 22 bp, Homo sapiens
aagaaatgtgaatattgaatag

SEQ ID NO: 7656181 - DNA, 22 bp, Homo sapiens
aagaaatgtgaatattgaatag

SEQ ID NO: 7656182 - DNA, 22 bp, Homo sapiens
aagaaatgtgaatattgaatag

SEQ ID NO: 7656183 - DNA, 22 bp, Homo sapiens
aagaaatgtagagcctagtaaa

SEQ ID NO: 7656184 - DNA, 22 bp, Homo sapiens
aagaaatgtgaatattgaatag

SEQ ID NO: 7656185 - DNA, 22 bp, Homo sapiens
aagaaatgtgaatattgaatag

SEQ ID NO: 7656186 - DNA, 22 bp, Homo sapiens
aagaaatgtgaatattgaatag

SEQ ID NO: 7656187 - DNA, 22 bp, Homo sapiens
aagaaattaatgtgccattact

SEQ ID NO: 7656188 - DNA, 22 bp, Homo sapiens
aagaacaactgctttaaaagca

SEQ ID NO: 7656189 - DNA, 22 bp, Homo sapiens
aagaacaactgctttaaaagca

SEQ ID NO: 7656190 - DNA, 22 bp, Homo sapiens
aagaacaactgctttaaaagca

SEQ ID NO: 7656191 - DNA, 22 bp, Homo sapiens
aagaacaactgctttaaaagca

SEQ ID NO: 7656192 - DNA, 22 bp, Homo sapiens
aagaacaactgctttaaaagca

SEQ ID NO: 7656193 - DNA, 22 bp, Homo sapiens
aagaacaactgctttaaaagca

SEQ ID NO: 7656194 - DNA, 22 bp, Homo sapiens
aagaacaactgctttaaaagca

SEQ ID NO: 7656195 - DNA, 22 bp, Homo sapiens
aagaacaactgctttaaaagca

SEQ ID NO: 7656196 - DNA, 22 bp, Homo sapiens
aagaacaactgctttaaaagca

SEQ ID NO: 7656197 - DNA, 22 bp, Homo sapiens
aagaaattaaggaatgcaacga

SEQ ID NO: 7656198 - DNA, 22 bp, Homo sapiens
aagaaattaaggaatgcaacga

SEQ ID NO: 7656199 - DNA, 22 bp, Homo sapiens
aagaaattaaggaatgcaacga

SEQ ID NO: 7656200 - DNA, 22 bp, Homo sapiens
aagaaattaaggaatgcaacga

SEQ ID NO: 7656201 - DNA, 22 bp, Homo sapiens
aagaaattaaggaatgcaacga

SEQ ID NO: 7656202 - DNA, 22 bp, Homo sapiens
aagaaattaaggaatgcaacga

SEQ ID NO: 7656203 - DNA, 22 bp, Homo sapiens
aagaaattaatgtgccattact

SEQ ID NO: 7656204 - DNA, 22 bp, Homo sapiens
aagaaattaaggaatgcaacga

SEQ ID NO: 7656205 - DNA, 22 bp, Homo sapiens
aagaaattaatgtgccattact

SEQ ID NO: 7656206 - DNA, 22 bp, Homo sapiens
aagaaattaatgtgccattact

SEQ ID NO: 7656207 - DNA, 22 bp, Homo sapiens
aattctcaggaatttcatctgt

SEQ ID NO: 7656208 - DNA, 22 bp, Homo sapiens
aattctatgttcttgagtaaga

SEQ ID NO: 7656209 - DNA, 22 bp, Homo sapiens
aattctcaggaatttcatctgt

SEQ ID NO: 7656210 - DNA, 22 bp, Homo sapiens
aattctcaggaatttcatctgt

SEQ ID NO: 7656211 - DNA, 22 bp, Homo sapiens
aattctatgttcttgagtaaga

SEQ ID NO: 7656212 - DNA, 22 bp, Homo sapiens
aattctatgttcttgagtaaga

SEQ ID NO: 7656213 - DNA, 22 bp, Homo sapiens
aattctagcccaggcaaaacta

SEQ ID NO: 7656214 - DNA, 22 bp, Homo sapiens
aattctataggcaagctatttt

SEQ ID NO: 7656215 - DNA, 22 bp, Homo sapiens
aattctctccagggtaacatca

SEQ ID NO: 7656216 - DNA, 22 bp, Homo sapiens
aattctctccagggtaacatca

SEQ ID NO: 7656217 - DNA, 22 bp, Homo sapiens
aattctgagaacaaaaggtact

SEQ ID NO: 7656218 - DNA, 22 bp, Homo sapiens
aattctgaaagattccttattc

SEQ ID NO: 7656219 - DNA, 22 bp, Homo sapiens
aattctctccagggtaacatca

SEQ ID NO: 7656220 - DNA, 22 bp, Homo sapiens
aattctctccagggtaacatca

SEQ ID NO: 7656221 - DNA, 22 bp, Homo sapiens
aattctctactgtttggtgctc

SEQ ID NO: 7656222 - DNA, 22 bp, Homo sapiens
aattctcaggtaaaagttaagt

SEQ ID NO: 7656223 - DNA, 22 bp, Homo sapiens
aattctcaggtaaaagttaagt

SEQ ID NO: 7656224 - DNA, 22 bp, Homo sapiens
aattctaaatgtaatttagaat

SEQ ID NO: 7656225 - DNA, 22 bp, Homo sapiens
aattctaaatgtaatttagaat

SEQ ID NO: 7656226 - DNA, 22 bp, Homo sapiens
aattctaaatgtaatttagaat

SEQ ID NO: 7656227 - DNA, 22 bp, Homo sapiens
aattctacattggttcacattt

SEQ ID NO: 7656228 - DNA, 22 bp, Homo sapiens
aattctataggcaagctatttt

SEQ ID NO: 7656229 - DNA, 22 bp, Homo sapiens
aattctataggcaagctatttt

SEQ ID NO: 7656230 - DNA, 22 bp, Homo sapiens
aattctataggcaagctatttt

SEQ ID NO: 7656231 - DNA, 22 bp, Homo sapiens
aattctagcattgtgaaaatat

SEQ ID NO: 7656232 - DNA, 22 bp, Homo sapiens
aattcctttggatcttctggag

SEQ ID NO: 7656233 - DNA, 22 bp, Homo sapiens
aattcctttggatcttctggag

SEQ ID NO: 7656234 - DNA, 22 bp, Homo sapiens
aattcctctatctttcttcaag

SEQ ID NO: 7656235 - DNA, 22 bp, Homo sapiens
aattcctgggcttcaccccaga

SEQ ID NO: 7656236 - DNA, 23 bp, Homo sapiens
aattcctgtcttgctttatcgga

SEQ ID NO: 7656237 - DNA, 23 bp, Homo sapiens
aattcctgtcttgctttatcgga

SEQ ID NO: 7656238 - DNA, 23 bp, Homo sapiens
aattcctgtcttgctttatcgga

SEQ ID NO: 7656239 - DNA, 22 bp, Homo sapiens
aattcctctatctttcttcaag

SEQ ID NO: 7656240 - DNA, 22 bp, Homo sapiens
aattcctctatctttcttcaag

SEQ ID NO: 7656241 - DNA, 22 bp, Homo sapiens
aattcctagtccttttccctcc

SEQ ID NO: 7656242 - DNA, 23 bp, Homo sapiens
aattcctagtcgatctaaatcag

SEQ ID NO: 7656243 - DNA, 22 bp, Homo sapiens
aattcctagttgtacttagtga

SEQ ID NO: 7656244 - DNA, 22 bp, Homo sapiens
aattcctagtccagatgtgttg

SEQ ID NO: 7656245 - DNA, 22 bp, Homo sapiens
aattcctaggtatgatttttgg

SEQ ID NO: 7656246 - DNA, 22 bp, Homo sapiens
aattcctagtccttttccctcc

SEQ ID NO: 7656247 - DNA, 22 bp, Homo sapiens
aattcctagttgtacttagtga

SEQ ID NO: 7656248 - DNA, 22 bp, Homo sapiens
aagaaagataaggtttgcttgg

SEQ ID NO: 7656249 - DNA, 22 bp, Homo sapiens
aagaaagataaggtttgcttgg

SEQ ID NO: 7656250 - DNA, 22 bp, Homo sapiens
aagaaagataaggtttgcttgg

SEQ ID NO: 7656251 - DNA, 22 bp, Homo sapiens
aagaaagataaggtttgcttgg

SEQ ID NO: 7656252 - DNA, 22 bp, Homo sapiens
aagaaagataaggtttgcttgg

SEQ ID NO: 7656253 - DNA, 22 bp, Homo sapiens
aagaaagataaggtttgcttgg

SEQ ID NO: 7656254 - DNA, 22 bp, Homo sapiens
aagaaagagatcactcctccat

SEQ ID NO: 7656255 - DNA, 22 bp, Homo sapiens
aagaaagagatcactcctccat

SEQ ID NO: 7656256 - DNA, 22 bp, Homo sapiens
aagaaagagatcactcctccat

SEQ ID NO: 7656257 - DNA, 22 bp, Homo sapiens
aagaaagagatcactcctccat

SEQ ID NO: 7656258 - DNA, 22 bp, Homo sapiens
aagaaagagatcactcctccat

SEQ ID NO: 7656259 - DNA, 22 bp, Homo sapiens
aagaaagagatcactcctccat

SEQ ID NO: 7656260 - DNA, 20 bp, Homo sapiens
aagaaacttgaaagtacaag

SEQ ID NO: 7656261 - DNA, 20 bp, Homo sapiens
aagaaacttgaaagtacaag

SEQ ID NO: 7656262 - DNA, 20 bp, Homo sapiens
aagaaacttgaaagtacaag

SEQ ID NO: 7656263 - DNA, 20 bp, Homo sapiens
aagaaacttgaaagtacaag

SEQ ID NO: 7656264 - DNA, 20 bp, Homo sapiens
aagaaacttgaaagtacaag

SEQ ID NO: 7656265 - DNA, 20 bp, Homo sapiens
aagaaacttgaaagtacaag

SEQ ID NO: 7656266 - DNA, 22 bp, Homo sapiens
aattccctcaggggactccttt

SEQ ID NO: 7656267 - DNA, 15 bp, Homo sapiens
aattcctacttttaa

SEQ ID NO: 7656268 - DNA, 22 bp, Homo sapiens
aattcccatttgcagaaaatca

SEQ ID NO: 7656269 - DNA, 22 bp, Homo sapiens
aattcccactatatgccaagca

SEQ ID NO: 7656270 - DNA, 22 bp, Homo sapiens
aattcccatttgcagaaaatca

SEQ ID NO: 7656271 - DNA, 22 bp, Homo sapiens
aattcacaattatgttgggaga

SEQ ID NO: 7656272 - DNA, 22 bp, Homo sapiens
aattcccaccttctctcttttg

SEQ ID NO: 7656273 - DNA, 22 bp, Homo sapiens
aattcccaccttctctcttttg

SEQ ID NO: 7656274 - DNA, 22 bp, Homo sapiens
aattcccactatatgccaagca

SEQ ID NO: 7656275 - DNA, 21 bp, Homo sapiens
aattcccagaaacagcacaag

SEQ ID NO: 7656276 - DNA, 22 bp, Homo sapiens
aattcacaatgtgtagtcatgc

SEQ ID NO: 7656277 - DNA, 22 bp, Homo sapiens
aattcacaatgtgtagtcatgc

SEQ ID NO: 7656278 - DNA, 22 bp, Homo sapiens
aattcacaatgtgtagtcatgc

SEQ ID NO: 7656279 - DNA, 21 bp, Homo sapiens
aagaaagataattaaggaccc

SEQ ID NO: 7656280 - DNA, 22 bp, Homo sapiens
aattcacaatgtgtagtcatgc

SEQ ID NO: 7656281 - DNA, 22 bp, Homo sapiens
aattcacaatgtgtagtcatgc

SEQ ID NO: 7656282 - DNA, 22 bp, Homo sapiens
aattcacaattatgttgggaga

SEQ ID NO: 7656283 - DNA, 22 bp, Homo sapiens
aattcacaattatgttgggaga

SEQ ID NO: 7656284 - DNA, 22 bp, Homo sapiens
aacatctttgataaacttagtg

SEQ ID NO: 7656285 - DNA, 22 bp, Homo sapiens
aacatctttgataaacttagtg

SEQ ID NO: 7656286 - DNA, 19 bp, Homo sapiens
aacatctttccagtagagg

SEQ ID NO: 7656287 - DNA, 22 bp, Homo sapiens
aacatctttgataaacttagtg

SEQ ID NO: 7656288 - DNA, 22 bp, Homo sapiens
aacatctttgtagtgttctcct

SEQ ID NO: 7656289 - DNA, 22 bp, Homo sapiens
aacatctttgccaaattgctat

SEQ ID NO: 7656290 - DNA, 22 bp, Homo sapiens
aacatctttgtagtgttctcct

SEQ ID NO: 7656291 - DNA, 22 bp, Homo sapiens
aacatctttgtagtgttctcct

SEQ ID NO: 7656292 - DNA, 22 bp, Homo sapiens
aacatctttttgtttgctgaaa

SEQ ID NO: 7656293 - DNA, 22 bp, Homo sapiens
aacatgaaaactacctgtgatt

SEQ ID NO: 7656294 - DNA, 22 bp, Homo sapiens
aacatgaaaactacctgtgatt

SEQ ID NO: 7656295 - DNA, 22 bp, Homo sapiens
aacatgaaaactacctgtgatt

SEQ ID NO: 7656296 - DNA, 22 bp, Homo sapiens
aacatctttttgtttgctgaaa

SEQ ID NO: 7656297 - DNA, 22 bp, Homo sapiens
aacatctttttgtttgctgaaa

SEQ ID NO: 7656298 - DNA, 22 bp, Homo sapiens
aacatgaaaacctccacagcaa

SEQ ID NO: 7656299 - DNA, 22 bp, Homo sapiens
aacatgaaaacctccacagcaa

SEQ ID NO: 7656300 - DNA, 22 bp, Homo sapiens
aatagacaagcaccctggtaaa

SEQ ID NO: 7656301 - DNA, 22 bp, Homo sapiens
aatagacaagcaccctggtaaa

SEQ ID NO: 7656302 - DNA, 22 bp, Homo sapiens
aatagaatttgtactgtgtttt

SEQ ID NO: 7656303 - DNA, 22 bp, Homo sapiens
aatacatgttttctactattct

SEQ ID NO: 7656304 - DNA, 22 bp, Homo sapiens
aatacatgttttctactattct

SEQ ID NO: 7656305 - DNA, 22 bp, Homo sapiens
aatacatgttttctactattct

SEQ ID NO: 7656306 - DNA, 22 bp, Homo sapiens
aatacatgttttctactattct

SEQ ID NO: 7656307 - DNA, 22 bp, Homo sapiens
aatacatgttttctactattct

SEQ ID NO: 7656308 - DNA, 20 bp, Homo sapiens
aatacatgagcacactttca

SEQ ID NO: 7656309 - DNA, 20 bp, Homo sapiens
aatacatgagcacactttca

SEQ ID NO: 7656310 - DNA, 22 bp, Homo sapiens
aacatgaaaagcccagagaggt

SEQ ID NO: 7656311 - DNA, 20 bp, Homo sapiens
aatacatgagcacactttca

SEQ ID NO: 7656312 - DNA, 20 bp, Homo sapiens
aatacatgagcacactttca

SEQ ID NO: 7656313 - DNA, 20 bp, Homo sapiens
aatacatgagcacactttca

SEQ ID NO: 7656314 - DNA, 22 bp, Homo sapiens
aacatgaaaagcccagagaggt

SEQ ID NO: 7656315 - DNA, 22 bp, Homo sapiens
aacatgaaaagcccagagaggt

SEQ ID NO: 7656316 - DNA, 22 bp, Homo sapiens
aacatgaaaagcccagagaggt

SEQ ID NO: 7656317 - DNA, 22 bp, Homo sapiens
aacatgaaaagcccagagaggt

SEQ ID NO: 7656318 - DNA, 19 bp, Homo sapiens
aacatctttccagtagagg

SEQ ID NO: 7656319 - DNA, 19 bp, Homo sapiens
aacatctttccagtagagg

SEQ ID NO: 7656320 - DNA, 19 bp, Homo sapiens
aacatctttccagtagagg

SEQ ID NO: 7656321 - DNA, 22 bp, Homo sapiens
aacatctttacaacagacctag

SEQ ID NO: 7656322 - DNA, 22 bp, Homo sapiens
aacatcttgtctaatgtcagct

SEQ ID NO: 7656323 - DNA, 22 bp, Homo sapiens
aacatcttgtctaatgtcagct

SEQ ID NO: 7656324 - DNA, 22 bp, Homo sapiens
aacatcttgtctaatgtcagct

SEQ ID NO: 7656325 - DNA, 22 bp, Homo sapiens
aacatcttgtcaaatgtccaca

SEQ ID NO: 7656326 - DNA, 22 bp, Homo sapiens
aacatcttgtcaaatgtccaca

SEQ ID NO: 7656327 - DNA, 22 bp, Homo sapiens
aacatcttgtccttagattaaa

SEQ ID NO: 7656328 - DNA, 22 bp, Homo sapiens
aacatcttgtccttagattaaa

SEQ ID NO: 7656329 - DNA, 22 bp, Homo sapiens
aacatcttgtccttagattaaa

SEQ ID NO: 7656330 - DNA, 22 bp, Homo sapiens
aacatcttgtccttagattaaa

SEQ ID NO: 7656331 - DNA, 22 bp, Homo sapiens
aacatcttgtccttagattaaa

SEQ ID NO: 7656332 - DNA, 22 bp, Homo sapiens
aacatcttgtccttagattaaa

SEQ ID NO: 7656333 - DNA, 22 bp, Homo sapiens
aacatcttatctgcatgatccc

SEQ ID NO: 7656334 - DNA, 22 bp, Homo sapiens
aacatcttatctgcatgatccc

SEQ ID NO: 7656335 - DNA, 22 bp, Homo sapiens
aacatcttatctgcatgatccc

SEQ ID NO: 7656336 - DNA, 22 bp, Homo sapiens
aacatcttatctgcatgatccc

SEQ ID NO: 7656337 - DNA, 22 bp, Homo sapiens
aacatcttaagatagaagggga

SEQ ID NO: 7656338 - DNA, 22 bp, Homo sapiens
aacatcttaagatagaagggga

SEQ ID NO: 7656339 - DNA, 22 bp, Homo sapiens
aacatcttaagatagaagggga

SEQ ID NO: 7656340 - DNA, 22 bp, Homo sapiens
aacatcttcagagaagctaagt

SEQ ID NO: 7656341 - DNA, 22 bp, Homo sapiens
aacatcttcagagaagctaagt

SEQ ID NO: 7656342 - DNA, 22 bp, Homo sapiens
aacatcttcagagaagctaagt

SEQ ID NO: 7656343 - DNA, 22 bp, Homo sapiens
aacatcttcagagaagctaagt

SEQ ID NO: 7656344 - DNA, 22 bp, Homo sapiens
aacatcttcagagaagctaagt

SEQ ID NO: 7656345 - DNA, 22 bp, Homo sapiens
aacatcttgtactgcacatttt

SEQ ID NO: 7656346 - DNA, 22 bp, Homo sapiens
aacatcttgtactgcacatttt

SEQ ID NO: 7656347 - DNA, 22 bp, Homo sapiens
aacatctcagaagtgaccctga

SEQ ID NO: 7656348 - DNA, 22 bp, Homo sapiens
aacatctcagaagtgaccctga

SEQ ID NO: 7656349 - DNA, 22 bp, Homo sapiens
aacatctcagaagtgaccctga

SEQ ID NO: 7656350 - DNA, 22 bp, Homo sapiens
aacatctcatggactacattct

SEQ ID NO: 7656351 - DNA, 22 bp, Homo sapiens
aacatctcatggactacattct

SEQ ID NO: 7656352 - DNA, 22 bp, Homo sapiens
aacatctcatggactacattct

SEQ ID NO: 7656353 - DNA, 22 bp, Homo sapiens
aacatctaggttctcatcgata

SEQ ID NO: 7656354 - DNA, 22 bp, Homo sapiens
aacatctaggttctcatcgata

SEQ ID NO: 7656355 - DNA, 22 bp, Homo sapiens
aacatctaggttctcatcgata

SEQ ID NO: 7656356 - DNA, 22 bp, Homo sapiens
aacatctagttcctatataata

SEQ ID NO: 7656357 - DNA, 22 bp, Homo sapiens
aacatctagttcctatataata

SEQ ID NO: 7656358 - DNA, 22 bp, Homo sapiens
aacatctagttcctatataata

SEQ ID NO: 7656359 - DNA, 22 bp, Homo sapiens
aacatctagttcctatataata

SEQ ID NO: 7656360 - DNA, 22 bp, Homo sapiens
aacatctctgtattttatagac

SEQ ID NO: 7656361 - DNA, 22 bp, Homo sapiens
aacatctctgtattttatagac

SEQ ID NO: 7656362 - DNA, 22 bp, Homo sapiens
aacatctccaacctacatccac

SEQ ID NO: 7656363 - DNA, 22 bp, Homo sapiens
aacatctccaacctacatccac

SEQ ID NO: 7656364 - DNA, 22 bp, Homo sapiens
aacatctccaacctacatccac

SEQ ID NO: 7656365 - DNA, 22 bp, Homo sapiens
aacatctgggccctgattttgg

SEQ ID NO: 7656366 - DNA, 22 bp, Homo sapiens
aacatctgggccctgattttgg

SEQ ID NO: 7656367 - DNA, 22 bp, Homo sapiens
aacatctgatcgaacagtgcca

SEQ ID NO: 7656368 - DNA, 22 bp, Homo sapiens
aacatctgatcgaacagtgcca

SEQ ID NO: 7656369 - DNA, 22 bp, Homo sapiens
aacatctgatcgaacagtgcca

SEQ ID NO: 7656370 - DNA, 22 bp, Homo sapiens
aacatctgtgaactccgaaaat

SEQ ID NO: 7656371 - DNA, 19 bp, Homo sapiens
aacatctgtaactattttc

SEQ ID NO: 7656372 - DNA, 22 bp, Homo sapiens
aatagaggtggcatgttataga

SEQ ID NO: 7656373 - DNA, 22 bp, Homo sapiens
aatagaggtggcatgttataga

SEQ ID NO: 7656374 - DNA, 22 bp, Homo sapiens
aatagaggtggcatgttataga

SEQ ID NO: 7656375 - DNA, 22 bp, Homo sapiens
aatagagtattttagcatctta

SEQ ID NO: 7656376 - DNA, 22 bp, Homo sapiens
aatagagtattttagcatctta

SEQ ID NO: 7656377 - DNA, 22 bp, Homo sapiens
aatagaggagctttggactccc

SEQ ID NO: 7656378 - DNA, 22 bp, Homo sapiens
aatagaggaagaaacctgattg

SEQ ID NO: 7656379 - DNA, 22 bp, Homo sapiens
aatagaggagctttggactccc

SEQ ID NO: 7656380 - DNA, 22 bp, Homo sapiens
aatagactttctttttagaaca

SEQ ID NO: 7656381 - DNA, 22 bp, Homo sapiens
aatacatgttttctactattct

SEQ ID NO: 7656382 - DNA, 22 bp, Homo sapiens
aatagactttgtataatttccc

SEQ ID NO: 7656383 - DNA, 22 bp, Homo sapiens
aatagagacctagatgccatga

SEQ ID NO: 7656384 - DNA, 22 bp, Homo sapiens
aatagagacctagatgccatga

SEQ ID NO: 7656385 - DNA, 22 bp, Homo sapiens
aatagactttgtataatttccc

SEQ ID NO: 7656386 - DNA, 22 bp, Homo sapiens
aatagacaattctagccaacat

SEQ ID NO: 7656387 - DNA, 22 bp, Homo sapiens
aatagacaattctagccaacat

SEQ ID NO: 7656388 - DNA, 22 bp, Homo sapiens
aatagacattatttctctatga

SEQ ID NO: 7656389 - DNA, 22 bp, Homo sapiens
aatagacattatttctctatga

SEQ ID NO: 7656390 - DNA, 22 bp, Homo sapiens
aatagacattatttctctatga

SEQ ID NO: 7656391 - DNA, 22 bp, Homo sapiens
aatagactccagggtctatttt

SEQ ID NO: 7656392 - DNA, 22 bp, Homo sapiens
aatagactccagggtctatttt

SEQ ID NO: 7656393 - DNA, 19 bp, Homo sapiens
aatagattaattatcctct

SEQ ID NO: 7656394 - DNA, 19 bp, Homo sapiens
aatagattaattatcctct

SEQ ID NO: 7656395 - DNA, 19 bp, Homo sapiens
aatagattaattatcctct

SEQ ID NO: 7656396 - DNA, 19 bp, Homo sapiens
aatagattaattatcctct

SEQ ID NO: 7656397 - DNA, 22 bp, Homo sapiens
aatagatgggttaaacagcaaa

SEQ ID NO: 7656398 - DNA, 22 bp, Homo sapiens
aatagatactacttagatgtag

SEQ ID NO: 7656399 - DNA, 22 bp, Homo sapiens
aatagatactacttagatgtag

SEQ ID NO: 7656400 - DNA, 22 bp, Homo sapiens
aatagagtcagttctacattct

SEQ ID NO: 7656401 - DNA, 22 bp, Homo sapiens
aatagagtattttagcatctta

SEQ ID NO: 7656402 - DNA, 22 bp, Homo sapiens
aatagagtcagttctacattct

SEQ ID NO: 7656403 - DNA, 22 bp, Homo sapiens
aatagatactacttagatgtag

SEQ ID NO: 7656404 - DNA, 22 bp, Homo sapiens
aatagatactacttagatgtag

SEQ ID NO: 7656405 - DNA, 22 bp, Homo sapiens
aatagatactacttagatgtag

SEQ ID NO: 7656406 - DNA, 22 bp, Homo sapiens
aatagatactacttagatgtag

SEQ ID NO: 7656407 - DNA, 22 bp, Homo sapiens
aatagatactacttagatgtag

SEQ ID NO: 7656408 - DNA, 22 bp, Homo sapiens
aatagatactacttagatgtag

SEQ ID NO: 7656409 - DNA, 22 bp, Homo sapiens
aatagcaaacactggtaaagtt

SEQ ID NO: 7656410 - DNA, 22 bp, Homo sapiens
aatagattcatggttaagagca

SEQ ID NO: 7656411 - DNA, 22 bp, Homo sapiens
aatagattcatggttaagagca

SEQ ID NO: 7656412 - DNA, 19 bp, Homo sapiens
aatagattaattatcctct

SEQ ID NO: 7656413 - DNA, 22 bp, Homo sapiens
aatagattcatggttaagagca

SEQ ID NO: 7656414 - DNA, 22 bp, Homo sapiens
aatagattcatggttaagagca

SEQ ID NO: 7656415 - DNA, 22 bp, Homo sapiens
aatagcaaacactggtaaagtt

SEQ ID NO: 7656416 - DNA, 22 bp, Homo sapiens
aatagcaaacactggtaaagtt

SEQ ID NO: 7656417 - DNA, 22 bp, Homo sapiens
aatagcaaacagacatgcacaa

SEQ ID NO: 7656418 - DNA, 22 bp, Homo sapiens
aacatgtaaccagcattcatct

SEQ ID NO: 7656419 - DNA, 22 bp, Homo sapiens
aacatgtaaccagcattcatct

SEQ ID NO: 7656420 - DNA, 22 bp, Homo sapiens
aacatgtaaccagcattcatct

SEQ ID NO: 7656421 - DNA, 22 bp, Homo sapiens
aacatgtaaccagcattcatct

SEQ ID NO: 7656422 - DNA, 22 bp, Homo sapiens
aacatgtaaccagcattcatct

SEQ ID NO: 7656423 - DNA, 22 bp, Homo sapiens
aacatgtacctacaatcagaat

SEQ ID NO: 7656424 - DNA, 22 bp, Homo sapiens
aacatgtacctacaatcagaat

SEQ ID NO: 7656425 - DNA, 22 bp, Homo sapiens
aacatgtacctacaatcagaat

SEQ ID NO: 7656426 - DNA, 22 bp, Homo sapiens
aacatgtacctacaatcagaat

SEQ ID NO: 7656427 - DNA, 22 bp, Homo sapiens
aacatgtacctacaatcagaat

SEQ ID NO: 7656428 - DNA, 22 bp, Homo sapiens
aacatgtgagcaggttttttat

SEQ ID NO: 7656429 - DNA, 22 bp, Homo sapiens
aacatgtctttagagaaacatt

SEQ ID NO: 7656430 - DNA, 22 bp, Homo sapiens
aacatgtctttagagaaacatt

SEQ ID NO: 7656431 - DNA, 22 bp, Homo sapiens
aacatgtctttagagaaacatt

SEQ ID NO: 7656432 - DNA, 22 bp, Homo sapiens
aacatgtctttagagaaacatt

SEQ ID NO: 7656433 - DNA, 22 bp, Homo sapiens
aacatgtcttactttgctttct

SEQ ID NO: 7656434 - DNA, 22 bp, Homo sapiens
aacatgtcttactttgctttct

SEQ ID NO: 7656435 - DNA, 22 bp, Homo sapiens
aacatgtctgggtattcacaag

SEQ ID NO: 7656436 - DNA, 22 bp, Homo sapiens
aacatgtatcgctttttaatat

SEQ ID NO: 7656437 - DNA, 22 bp, Homo sapiens
aacatgtagcagaaacgactaa

SEQ ID NO: 7656438 - DNA, 22 bp, Homo sapiens
aacatgtagcagaaacgactaa

SEQ ID NO: 7656439 - DNA, 22 bp, Homo sapiens
aacatgtctgggtattcacaag

SEQ ID NO: 7656440 - DNA, 22 bp, Homo sapiens
aacatgtatcgctttttaatat

SEQ ID NO: 7656441 - DNA, 22 bp, Homo sapiens
aacatgtatcgctttttaatat

SEQ ID NO: 7656442 - DNA, 22 bp, Homo sapiens
aagtgtacatgaacacatgaca

SEQ ID NO: 7656443 - DNA, 22 bp, Homo sapiens
aagtgtacatagaaagcttggt

SEQ ID NO: 7656444 - DNA, 22 bp, Homo sapiens
aagtgtataacgacctacagga

SEQ ID NO: 7656445 - DNA, 22 bp, Homo sapiens
aagtgtataacgacctacagga

SEQ ID NO: 7656446 - DNA, 22 bp, Homo sapiens
aagtgtaagcaaagctcaagct

SEQ ID NO: 7656447 - DNA, 22 bp, Homo sapiens
aagtgtacagcaacttctcagc

SEQ ID NO: 7656448 - DNA, 23 bp, Homo sapiens
aagtggttttgaacccggaccct

SEQ ID NO: 7656449 - DNA, 22 bp, Homo sapiens
aagtggttttaagaggttcctt

SEQ ID NO: 7656450 - DNA, 22 bp, Homo sapiens
aagtggtttgattcagtttatg

SEQ ID NO: 7656451 - DNA, 22 bp, Homo sapiens
aagtggtttgagcacagtgctg

SEQ ID NO: 7656452 - DNA, 21 bp, Homo sapiens
aagtggtttaggttaccgggg

SEQ ID NO: 7656453 - DNA, 21 bp, Homo sapiens
aagtggtttacatccagctgt

SEQ ID NO: 7656454 - DNA, 21 bp, Homo sapiens
aagtggtttacatccagctgt

SEQ ID NO: 7656455 - DNA, 22 bp, Homo sapiens
aagtggttattttgatctagaa

SEQ ID NO: 7656456 - DNA, 22 bp, Homo sapiens
aagtggttgcttgtgagtcccc

SEQ ID NO: 7656457 - DNA, 22 bp, Homo sapiens
aagtgcttggattgcaggtatg

SEQ ID NO: 7656458 - DNA, 22 bp, Homo sapiens
aagtgcttggattgcaggtatg

SEQ ID NO: 7656459 - DNA, 22 bp, Homo sapiens
aagtgcttctgggattaggagt

SEQ ID NO: 7656460 - DNA, 22 bp, Homo sapiens
aagtgcttctgggattaggagt

SEQ ID NO: 7656461 - DNA, 22 bp, Homo sapiens
aagtgcttcgttctgtattggg

SEQ ID NO: 7656462 - DNA, 22 bp, Homo sapiens
aagtgcttctgggattaggagt

SEQ ID NO: 7656463 - DNA, 22 bp, Homo sapiens
aagtgcttctgggattaggagt

SEQ ID NO: 7656464 - DNA, 22 bp, Homo sapiens
aagtgcttggagcatacctgtt

SEQ ID NO: 7656465 - DNA, 22 bp, Homo sapiens
aagtgcttgatcatagttctca

SEQ ID NO: 7656466 - DNA, 22 bp, Homo sapiens
aagtgcttgatcatagttctca

SEQ ID NO: 7656467 - DNA, 22 bp, Homo sapiens
aagtgcttgatcatagttctca

SEQ ID NO: 7656468 - DNA, 22 bp, Homo sapiens
aagtggttgcttgtgagtcccc

SEQ ID NO: 7656469 - DNA, 22 bp, Homo sapiens
aagtggttgcttgtgagtcccc

SEQ ID NO: 7656470 - DNA, 22 bp, Homo sapiens
aagtggttattttgatctagaa

SEQ ID NO: 7656471 - DNA, 22 bp, Homo sapiens
aagtggtggtatgaaccgaggg

SEQ ID NO: 7656472 - DNA, 22 bp, Homo sapiens
aagtggtgtgttggaagaaatc

SEQ ID NO: 7656473 - DNA, 22 bp, Homo sapiens
aagtggtagagagagcataagc

SEQ ID NO: 7656474 - DNA, 22 bp, Homo sapiens
aagtggtagagagagcataagc

SEQ ID NO: 7656475 - DNA, 22 bp, Homo sapiens
aagtggtagacaaagataattg

SEQ ID NO: 7656476 - DNA, 22 bp, Homo sapiens
aagtggtaggaagagagcactg

SEQ ID NO: 7656477 - DNA, 22 bp, Homo sapiens
aagtggtaggaagagagcactg

SEQ ID NO: 7656478 - DNA, 22 bp, Homo sapiens
aagtggtaggaagagagcactg

SEQ ID NO: 7656479 - DNA, 22 bp, Homo sapiens
aagtggtcagtcatgggagatt

SEQ ID NO: 7656480 - DNA, 22 bp, Homo sapiens
aacagcctgagagaacaatgat

SEQ ID NO: 7656481 - DNA, 22 bp, Homo sapiens
aagtgtctagcacctggatgca

SEQ ID NO: 7656482 - DNA, 22 bp, Homo sapiens
aagtgtctagcacctggatgca

SEQ ID NO: 7656483 - DNA, 22 bp, Homo sapiens
aagtgtctacatttgctaacca

SEQ ID NO: 7656484 - DNA, 22 bp, Homo sapiens
aagtgtctaactggttacttct

SEQ ID NO: 7656485 - DNA, 22 bp, Homo sapiens
aagtgtatatatgacttataaa

SEQ ID NO: 7656486 - DNA, 22 bp, Homo sapiens
aagtgtatatatgacttataaa

SEQ ID NO: 7656487 - DNA, 22 bp, Homo sapiens
aagtgtataacgacctacagga

SEQ ID NO: 7656488 - DNA, 22 bp, Homo sapiens
aagtgtatatatgacttataaa

SEQ ID NO: 7656489 - DNA, 22 bp, Homo sapiens
aagtgtatatatgacttataaa

SEQ ID NO: 7656490 - DNA, 22 bp, Homo sapiens
aagtgtcaatatttttgtaggt

SEQ ID NO: 7656491 - DNA, 22 bp, Homo sapiens
aagtgtatttttgtactaacat

SEQ ID NO: 7656492 - DNA, 22 bp, Homo sapiens
aagtgtcaatatttttgtaggt

SEQ ID NO: 7656493 - DNA, 22 bp, Homo sapiens
aagtgtcctcattcaacatgca

SEQ ID NO: 7656494 - DNA, 22 bp, Homo sapiens
aagtgtcaatatttttgtaggt

SEQ ID NO: 7656495 - DNA, 22 bp, Homo sapiens
aagtgtcctcattcaacatgca

SEQ ID NO: 7656496 - DNA, 22 bp, Homo sapiens
aacagctagtaccaatccacta

SEQ ID NO: 7656497 - DNA, 22 bp, Homo sapiens
aacagctagtaccaatccacta

SEQ ID NO: 7656498 - DNA, 22 bp, Homo sapiens
aacagctagtggtctagacttt

SEQ ID NO: 7656499 - DNA, 22 bp, Homo sapiens
aacagctagtggtctagacttt

SEQ ID NO: 7656500 - DNA, 22 bp, Homo sapiens
aacagctattagaacttcatgg

SEQ ID NO: 7656501 - DNA, 22 bp, Homo sapiens
aacagctattagaacttcatgg

SEQ ID NO: 7656502 - DNA, 22 bp, Homo sapiens
aacagctattcactactatggg

SEQ ID NO: 7656503 - DNA, 20 bp, Homo sapiens
aacagctctcgacttatctt

SEQ ID NO: 7656504 - DNA, 20 bp, Homo sapiens
aacagctctcgacttatctt

SEQ ID NO: 7656505 - DNA, 22 bp, Homo sapiens
aacagctgcaaaaggttgcctg

SEQ ID NO: 7656506 - DNA, 22 bp, Homo sapiens
aacagctgcttctatcttttca

SEQ ID NO: 7656507 - DNA, 22 bp, Homo sapiens
aacatcatcatgaacaactaat

SEQ ID NO: 7656508 - DNA, 22 bp, Homo sapiens
aacatcatcatgaacaactaat

SEQ ID NO: 7656509 - DNA, 22 bp, Homo sapiens
aacatcatcagatgggtgcttg

SEQ ID NO: 7656510 - DNA, 22 bp, Homo sapiens
aacatcatcagatgggtgcttg

SEQ ID NO: 7656511 - DNA, 22 bp, Homo sapiens
aacatcatcatgaacaactaat

SEQ ID NO: 7656512 - DNA, 22 bp, Homo sapiens
aacatcatcatgaacaactaat

SEQ ID NO: 7656513 - DNA, 22 bp, Homo sapiens
aacatcatcatgaacaactaat

SEQ ID NO: 7656514 - DNA, 22 bp, Homo sapiens
aacatcatcctttgagtattta

SEQ ID NO: 7656515 - DNA, 22 bp, Homo sapiens
aacatcatcctttgagtattta

SEQ ID NO: 7656516 - DNA, 22 bp, Homo sapiens
aacatcatcctttgagtattta

SEQ ID NO: 7656517 - DNA, 22 bp, Homo sapiens
aacatcatcatgaacaactaat

SEQ ID NO: 7656518 - DNA, 22 bp, Homo sapiens
aacatcatcatgaacaactaat

SEQ ID NO: 7656519 - DNA, 19 bp, Homo sapiens
aacatcatggctctttcca

SEQ ID NO: 7656520 - DNA, 22 bp, Homo sapiens
aacatcattatgtccattaatg

SEQ ID NO: 7656521 - DNA, 19 bp, Homo sapiens
aacatcatggctctttcca

SEQ ID NO: 7656522 - DNA, 19 bp, Homo sapiens
aacatcatggctctttcca

SEQ ID NO: 7656523 - DNA, 22 bp, Homo sapiens
aacatcattatgtccattaatg

SEQ ID NO: 7656524 - DNA, 22 bp, Homo sapiens
aacatcattatgtccattaatg

SEQ ID NO: 7656525 - DNA, 22 bp, Homo sapiens
aacatcattatgtccattaatg

SEQ ID NO: 7656526 - DNA, 22 bp, Homo sapiens
aacatccccagcgtctcctagg

SEQ ID NO: 7656527 - DNA, 22 bp, Homo sapiens
aacatctacagtgagatgttag

SEQ ID NO: 7656528 - DNA, 22 bp, Homo sapiens
aacatctacagtgagatgttag

SEQ ID NO: 7656529 - DNA, 22 bp, Homo sapiens
aacatctacagtgagatgttag

SEQ ID NO: 7656530 - DNA, 22 bp, Homo sapiens
aacatcagaatatccatgttgg

SEQ ID NO: 7656531 - DNA, 22 bp, Homo sapiens
aacatcagaagtagaagactca

SEQ ID NO: 7656532 - DNA, 22 bp, Homo sapiens
aacatcagaagtagaagactca

SEQ ID NO: 7656533 - DNA, 22 bp, Homo sapiens
aacatcagaagtagaagactca

SEQ ID NO: 7656534 - DNA, 22 bp, Homo sapiens
aacatcagaagtagaagactca

SEQ ID NO: 7656535 - DNA, 22 bp, Homo sapiens
aacatcagaagtagaagactca

SEQ ID NO: 7656536 - DNA, 22 bp, Homo sapiens
aacatcagaagtagaagactca

SEQ ID NO: 7656537 - DNA, 22 bp, Homo sapiens
aacatcacaatttcatttatgc

SEQ ID NO: 7656538 - DNA, 22 bp, Homo sapiens
aacatcagcacacaatagcaag

SEQ ID NO: 7656539 - DNA, 22 bp, Homo sapiens
aacatcagcacacaatagcaag

SEQ ID NO: 7656540 - DNA, 22 bp, Homo sapiens
aacatcagcacacaatagcaag

SEQ ID NO: 7656541 - DNA, 22 bp, Homo sapiens
aacatcaggatcttgttacagt

SEQ ID NO: 7656542 - DNA, 22 bp, Homo sapiens
aacatcaggatcttgttacagt

SEQ ID NO: 7656543 - DNA, 22 bp, Homo sapiens
aacatcaggatcttgttacagt

SEQ ID NO: 7656544 - DNA, 22 bp, Homo sapiens
aacatcagtattctcatctgta

SEQ ID NO: 7656545 - DNA, 22 bp, Homo sapiens
aacatcagtattctcatctgta

SEQ ID NO: 7656546 - DNA, 22 bp, Homo sapiens
aacagcttcatcacatggcata

SEQ ID NO: 7656547 - DNA, 22 bp, Homo sapiens
aacagcttagaaatgttgctaa

SEQ ID NO: 7656548 - DNA, 22 bp, Homo sapiens
aacagcttagaaatgttgctaa

SEQ ID NO: 7656549 - DNA, 22 bp, Homo sapiens
aacagcttcatcacatggcata

SEQ ID NO: 7656550 - DNA, 22 bp, Homo sapiens
aacagcttcatcacatggcata

SEQ ID NO: 7656551 - DNA, 22 bp, Homo sapiens
aacagcttgagactggatatgc

SEQ ID NO: 7656552 - DNA, 22 bp, Homo sapiens
aacagcttgagactggatatgc

SEQ ID NO: 7656553 - DNA, 22 bp, Homo sapiens
aacagcttagaaatgttgctaa

SEQ ID NO: 7656554 - DNA, 22 bp, Homo sapiens
aacagcttactcaatggtgatt

SEQ ID NO: 7656555 - DNA, 22 bp, Homo sapiens
aacagcttactcaatggtgatt

SEQ ID NO: 7656556 - DNA, 22 bp, Homo sapiens
aacagctgttcgcagatgtagg

SEQ ID NO: 7656557 - DNA, 22 bp, Homo sapiens
aacatattcagatgccaagtcc

SEQ ID NO: 7656558 - DNA, 22 bp, Homo sapiens
aacatattcagatgccaagtcc

SEQ ID NO: 7656559 - DNA, 22 bp, Homo sapiens
aacatatcataggatgtcattg

SEQ ID NO: 7656560 - DNA, 22 bp, Homo sapiens
aacatatctacggatacgatta

SEQ ID NO: 7656561 - DNA, 22 bp, Homo sapiens
aacatatctacggatacgatta

SEQ ID NO: 7656562 - DNA, 22 bp, Homo sapiens
aacatatcatttaaccctcacc

SEQ ID NO: 7656563 - DNA, 22 bp, Homo sapiens
aacatatcataggatgtcattg

SEQ ID NO: 7656564 - DNA, 22 bp, Homo sapiens
aacatatttggctgatattccc

SEQ ID NO: 7656565 - DNA, 22 bp, Homo sapiens
aacatatttggctgatattccc

SEQ ID NO: 7656566 - DNA, 22 bp, Homo sapiens
aacatatttggctgatattccc

SEQ ID NO: 7656567 - DNA, 22 bp, Homo sapiens
aacatattcagatgccaagtcc

SEQ ID NO: 7656568 - DNA, 22 bp, Homo sapiens
aacatattcagatgccaagtcc

SEQ ID NO: 7656569 - DNA, 22 bp, Homo sapiens
aacataaatttgaagtggcaaa

SEQ ID NO: 7656570 - DNA, 22 bp, Homo sapiens
aacataaatttgaagtggcaaa

SEQ ID NO: 7656571 - DNA, 22 bp, Homo sapiens
aacataaatttgaagtggcaaa

SEQ ID NO: 7656572 - DNA, 22 bp, Homo sapiens
aacatataaactcttaagttca

SEQ ID NO: 7656573 - DNA, 22 bp, Homo sapiens
aacataaatttgaagtggcaaa

SEQ ID NO: 7656574 - DNA, 22 bp, Homo sapiens
aacatatcataggatgtcattg

SEQ ID NO: 7656575 - DNA, 22 bp, Homo sapiens
aacatatcataggatgtcattg

SEQ ID NO: 7656576 - DNA, 22 bp, Homo sapiens
aatgacagtgttgggccagatg

SEQ ID NO: 7656577 - DNA, 22 bp, Homo sapiens
aatgacataagtgcagatgcta

SEQ ID NO: 7656578 - DNA, 22 bp, Homo sapiens
aatgacataagtgcagatgcta

SEQ ID NO: 7656579 - DNA, 23 bp, Homo sapiens
aatgacagtgtgtgattgaagaa

SEQ ID NO: 7656580 - DNA, 22 bp, Homo sapiens
aatgacagtattccctttatca

SEQ ID NO: 7656581 - DNA, 22 bp, Homo sapiens
aatgacatgctttttaattata

SEQ ID NO: 7656582 - DNA, 22 bp, Homo sapiens
aatgacatgctttttaattata

SEQ ID NO: 7656583 - DNA, 22 bp, Homo sapiens
aatgacatgctttttaattata

SEQ ID NO: 7656584 - DNA, 22 bp, Homo sapiens
aatgacatgctttttaattata

SEQ ID NO: 7656585 - DNA, 22 bp, Homo sapiens
aactactaccacagtcaagaca

SEQ ID NO: 7656586 - DNA, 22 bp, Homo sapiens
aactacttgaagagttcagcag

SEQ ID NO: 7656587 - DNA, 22 bp, Homo sapiens
aactacttgaagagttcagcag

SEQ ID NO: 7656588 - DNA, 22 bp, Homo sapiens
aactactaccagtagtagtagt

SEQ ID NO: 7656589 - DNA, 22 bp, Homo sapiens
aactactaccagtagtagtagt

SEQ ID NO: 7656590 - DNA, 22 bp, Homo sapiens
aactagaaagaacatatttcca

SEQ ID NO: 7656591 - DNA, 22 bp, Homo sapiens
aactagaaagaacatatttcca

SEQ ID NO: 7656592 - DNA, 22 bp, Homo sapiens
aactagaaagaacatatttcca

SEQ ID NO: 7656593 - DNA, 20 bp, Homo sapiens
aactagaaagcacccatgga

SEQ ID NO: 7656594 - DNA, 22 bp, Homo sapiens
aactagaaaacaagatgctgat

SEQ ID NO: 7656595 - DNA, 22 bp, Homo sapiens
aactagaaaacaagatgctgat

SEQ ID NO: 7656596 - DNA, 22 bp, Homo sapiens
aactacttgactgacagattca

SEQ ID NO: 7656597 - DNA, 22 bp, Homo sapiens
aactagaaaaagactttctgag

SEQ ID NO: 7656598 - DNA, 22 bp, Homo sapiens
aactagaaaaagactttctgag

SEQ ID NO: 7656599 - DNA, 22 bp, Homo sapiens
aactagaacctgcattttaaca

SEQ ID NO: 7656600 - DNA, 22 bp, Homo sapiens
aactagaacctgcattttaaca

SEQ ID NO: 7656601 - DNA, 22 bp, Homo sapiens
aactagaaccacttgtatttcc

SEQ ID NO: 7656602 - DNA, 22 bp, Homo sapiens
aactagaacgagaaagctgaac

SEQ ID NO: 7656603 - DNA, 22 bp, Homo sapiens
aactagaacgagaaagctgaac

SEQ ID NO: 7656604 - DNA, 22 bp, Homo sapiens
aactagaacgagaaagctgaac

SEQ ID NO: 7656605 - DNA, 22 bp, Homo sapiens
aactagaaccacttgtatttcc

SEQ ID NO: 7656606 - DNA, 22 bp, Homo sapiens
aactagaaccacttgtatttcc

SEQ ID NO: 7656607 - DNA, 19 bp, Homo sapiens
aactagaaaggttttgaga

SEQ ID NO: 7656608 - DNA, 22 bp, Homo sapiens
aactagaaatcactacaggtat

SEQ ID NO: 7656609 - DNA, 22 bp, Homo sapiens
aactagaaatcactacaggtat

SEQ ID NO: 7656610 - DNA, 22 bp, Homo sapiens
aatgacaatattaatttggagg

SEQ ID NO: 7656611 - DNA, 22 bp, Homo sapiens
aatgacaatattaatttggagg

SEQ ID NO: 7656612 - DNA, 22 bp, Homo sapiens
aatgacaatattaatttggagg

SEQ ID NO: 7656613 - DNA, 22 bp, Homo sapiens
aatgacaatattaatttggagg

SEQ ID NO: 7656614 - DNA, 22 bp, Homo sapiens
aatgacaatattaatttggagg

SEQ ID NO: 7656615 - DNA, 22 bp, Homo sapiens
aatgacaatggcagaggtagaa

SEQ ID NO: 7656616 - DNA, 22 bp, Homo sapiens
aatgacaatggcagaggtagaa

SEQ ID NO: 7656617 - DNA, 22 bp, Homo sapiens
aatgacaatggcagaggtagaa

SEQ ID NO: 7656618 - DNA, 22 bp, Homo sapiens
aatgacaatggcagaggtagaa

SEQ ID NO: 7656619 - DNA, 23 bp, Homo sapiens
aatgacacctcataggtaacttc

SEQ ID NO: 7656620 - DNA, 23 bp, Homo sapiens
aatgacacctcataggtaacttc

SEQ ID NO: 7656621 - DNA, 22 bp, Homo sapiens
aatgacagagcactgaacttgg

SEQ ID NO: 7656622 - DNA, 22 bp, Homo sapiens
aatgacagccagattcttctct

SEQ ID NO: 7656623 - DNA, 22 bp, Homo sapiens
aatgacagccctctagtctggg

SEQ ID NO: 7656624 - DNA, 22 bp, Homo sapiens
aatgacagagcactgaacttgg

SEQ ID NO: 7656625 - DNA, 21 bp, Homo sapiens
aatgacagccagatcctttta

SEQ ID NO: 7656626 - DNA, 22 bp, Homo sapiens
aatgacagccctctagtctggg

SEQ ID NO: 7656627 - DNA, 22 bp, Homo sapiens
aatgacaataatcattaacttt

SEQ ID NO: 7656628 - DNA, 22 bp, Homo sapiens
aatgacaataatcattaacttt

SEQ ID NO: 7656629 - DNA, 22 bp, Homo sapiens
aatgacaagacatagtctctga

SEQ ID NO: 7656630 - DNA, 22 bp, Homo sapiens
aatgacaagacatagtctctga

SEQ ID NO: 7656631 - DNA, 22 bp, Homo sapiens
aatgacaataatcattaacttt

SEQ ID NO: 7656632 - DNA, 22 bp, Homo sapiens
aatgacaataatcattaacttt

SEQ ID NO: 7656633 - DNA, 22 bp, Homo sapiens
aatgacaataatcattaacttt

SEQ ID NO: 7656634 - DNA, 22 bp, Homo sapiens
aatgacaataatcattaacttt

SEQ ID NO: 7656635 - DNA, 22 bp, Homo sapiens
aatgacaataatcattaacttt

SEQ ID NO: 7656636 - DNA, 22 bp, Homo sapiens
aatgacaataatcattaacttt

SEQ ID NO: 7656637 - DNA, 22 bp, Homo sapiens
aatgacaataatcattaacttt

SEQ ID NO: 7656638 - DNA, 22 bp, Homo sapiens
aatgacaaccacaatggtgctg

SEQ ID NO: 7656639 - DNA, 22 bp, Homo sapiens
aatgacaaccacaatggtgctg

SEQ ID NO: 7656640 - DNA, 22 bp, Homo sapiens
aatgacaaatatggaagcctga

SEQ ID NO: 7656641 - DNA, 22 bp, Homo sapiens
aatgacaaatatggaagcctga

SEQ ID NO: 7656642 - DNA, 22 bp, Homo sapiens
aatgaattgcagtactgacttg

SEQ ID NO: 7656643 - DNA, 22 bp, Homo sapiens
aatgacaaccacaatggtgctg

SEQ ID NO: 7656644 - DNA, 22 bp, Homo sapiens
aatgacaaccacaatggtgctg

SEQ ID NO: 7656645 - DNA, 22 bp, Homo sapiens
aatgacaagacatagtctctga

SEQ ID NO: 7656646 - DNA, 22 bp, Homo sapiens
aatgacaagacatagtctctga

SEQ ID NO: 7656647 - DNA, 22 bp, Homo sapiens
aatgacaagacatagtctctga

SEQ ID NO: 7656648 - DNA, 22 bp, Homo sapiens
aatgacaagacatagtctctga

SEQ ID NO: 7656649 - DNA, 22 bp, Homo sapiens
aatgacaagacatagtctctga

SEQ ID NO: 7656650 - DNA, 22 bp, Homo sapiens
aatgctttctcagagtccttca

SEQ ID NO: 7656651 - DNA, 22 bp, Homo sapiens
aactataatggggttaggaaat

SEQ ID NO: 7656652 - DNA, 22 bp, Homo sapiens
aactataatggggttaggaaat

SEQ ID NO: 7656653 - DNA, 22 bp, Homo sapiens
aatgctttcaaaaatgtgcagt

SEQ ID NO: 7656654 - DNA, 22 bp, Homo sapiens
aactataatggggttaggaaat

SEQ ID NO: 7656655 - DNA, 22 bp, Homo sapiens
aactagttttagctctagcaac

SEQ ID NO: 7656656 - DNA, 22 bp, Homo sapiens
aactagttttagctctagcaac

SEQ ID NO: 7656657 - DNA, 22 bp, Homo sapiens
aactagtttagctttttaagac

SEQ ID NO: 7656658 - DNA, 22 bp, Homo sapiens
aactagtttagctttttaagac

SEQ ID NO: 7656659 - DNA, 22 bp, Homo sapiens
aactagttttagccacagaaca

SEQ ID NO: 7656660 - DNA, 22 bp, Homo sapiens
aatgctttcttataaccactgc

SEQ ID NO: 7656661 - DNA, 22 bp, Homo sapiens
aatgctttcttataaccactgc

SEQ ID NO: 7656662 - DNA, 22 bp, Homo sapiens
aatgctttcttataaccactgc

SEQ ID NO: 7656663 - DNA, 22 bp, Homo sapiens
aatgctttcttataaccactgc

SEQ ID NO: 7656664 - DNA, 22 bp, Homo sapiens
aatggccatatcattgcagagc

SEQ ID NO: 7656665 - DNA, 22 bp, Homo sapiens
aatggccatatcattgcagagc

SEQ ID NO: 7656666 - DNA, 22 bp, Homo sapiens
aactagtaaaagcaacagtata

SEQ ID NO: 7656667 - DNA, 22 bp, Homo sapiens
aactaggtccctggtaggtatg

SEQ ID NO: 7656668 - DNA, 22 bp, Homo sapiens
aactaggatatatttctgacca

SEQ ID NO: 7656669 - DNA, 22 bp, Homo sapiens
aactaggagtttttcttgagaa

SEQ ID NO: 7656670 - DNA, 22 bp, Homo sapiens
aactagctgtgtgacttgtgta

SEQ ID NO: 7656671 - DNA, 22 bp, Homo sapiens
aactagcagctaagacataatt

SEQ ID NO: 7656672 - DNA, 22 bp, Homo sapiens
aactagcagctaagacataatt

SEQ ID NO: 7656673 - DNA, 22 bp, Homo sapiens
aactagcagctaagacataatt

SEQ ID NO: 7656674 - DNA, 22 bp, Homo sapiens
aactagcagctaagacataatt

SEQ ID NO: 7656675 - DNA, 22 bp, Homo sapiens
aactagcagctaagacataatt

SEQ ID NO: 7656676 - DNA, 22 bp, Homo sapiens
aactagcagctaagacataatt

SEQ ID NO: 7656677 - DNA, 22 bp, Homo sapiens
aactagagcttccagcttcttg

SEQ ID NO: 7656678 - DNA, 22 bp, Homo sapiens
aactagagcttccagcttcttg

SEQ ID NO: 7656679 - DNA, 22 bp, Homo sapiens
aactagaacgtctagttgctgg

SEQ ID NO: 7656680 - DNA, 22 bp, Homo sapiens
aactagaacgtctagttgctgg

SEQ ID NO: 7656681 - DNA, 22 bp, Homo sapiens
aactagaacgtctagttgctgg

SEQ ID NO: 7656682 - DNA, 22 bp, Homo sapiens
aactagaacgtctagttgctgg

SEQ ID NO: 7656683 - DNA, 22 bp, Homo sapiens
aactagaacgtctagttgctgg

SEQ ID NO: 7656684 - DNA, 22 bp, Homo sapiens
aatggcttctgaagcacacttt

SEQ ID NO: 7656685 - DNA, 22 bp, Homo sapiens
aatggcttagctcagcgctcag

SEQ ID NO: 7656686 - DNA, 21 bp, Homo sapiens
aatggcttatacagaagtaag

SEQ ID NO: 7656687 - DNA, 20 bp, Homo sapiens
aatggcttatagcatgctac

SEQ ID NO: 7656688 - DNA, 22 bp, Homo sapiens
aatggcttatgtaatgctgttt

SEQ ID NO: 7656689 - DNA, 22 bp, Homo sapiens
aatggcttcatgtctgtggaaa

SEQ ID NO: 7656690 - DNA, 22 bp, Homo sapiens
aatggcttctttttggtataat

SEQ ID NO: 7656691 - DNA, 22 bp, Homo sapiens
aatggcttctttttggtataat

SEQ ID NO: 7656692 - DNA, 22 bp, Homo sapiens
aatggcttgcaaatgggtccat

SEQ ID NO: 7656693 - DNA, 22 bp, Homo sapiens
aatggcttgcaaatgggtccat

SEQ ID NO: 7656694 - DNA, 22 bp, Homo sapiens
aatggctttaagtagtctcaca

SEQ ID NO: 7656695 - DNA, 22 bp, Homo sapiens
aatggctttaggaatccagtgc

SEQ ID NO: 7656696 - DNA, 22 bp, Homo sapiens
aatggctttaggaatccagtgc

SEQ ID NO: 7656697 - DNA, 22 bp, Homo sapiens
aatggctttcagcaaggataga

SEQ ID NO: 7656698 - DNA, 22 bp, Homo sapiens
aatggcttagtgcttcacttct

SEQ ID NO: 7656699 - DNA, 22 bp, Homo sapiens
aatggcttagctcagcgctcag

SEQ ID NO: 7656700 - DNA, 22 bp, Homo sapiens
aatggcttaccctggattgtgt

SEQ ID NO: 7656701 - DNA, 22 bp, Homo sapiens
aatggcttagcagagttagaag

SEQ ID NO: 7656702 - DNA, 22 bp, Homo sapiens
aatggcttagcagagttagaag

SEQ ID NO: 7656703 - DNA, 18 bp, Homo sapiens
aatggctgggttgttgcc

SEQ ID NO: 7656704 - DNA, 22 bp, Homo sapiens
aatggctgggtttcattttgta

SEQ ID NO: 7656705 - DNA, 22 bp, Homo sapiens
aatggctgggtttcattttgta

SEQ ID NO: 7656706 - DNA, 22 bp, Homo sapiens
aatggctgttatttcagcagat

SEQ ID NO: 7656707 - DNA, 22 bp, Homo sapiens
aatggctgttctctgtgattgg

SEQ ID NO: 7656708 - DNA, 22 bp, Homo sapiens
aatggcttaagtataagtgaga

SEQ ID NO: 7656709 - DNA, 22 bp, Homo sapiens
aatggcttaagtataagtgaga

SEQ ID NO: 7656710 - DNA, 22 bp, Homo sapiens
aatggcttaatgataccttatc

SEQ ID NO: 7656711 - DNA, 22 bp, Homo sapiens
aatggcttaatgataccttatc

SEQ ID NO: 7656712 - DNA, 22 bp, Homo sapiens
aatggctgccagggcaggaggt

SEQ ID NO: 7656713 - DNA, 21 bp, Homo sapiens
aatggctgggcaaggtctctc

SEQ ID NO: 7656714 - DNA, 21 bp, Homo sapiens
aatggctgggcaaggtctctc

SEQ ID NO: 7656715 - DNA, 22 bp, Homo sapiens
aatggctgggagtgtattttgg

SEQ ID NO: 7656716 - DNA, 21 bp, Homo sapiens
aatggctgggcaaggtctctc

SEQ ID NO: 7656717 - DNA, 21 bp, Homo sapiens
aatggctgggcaaggtctctc

SEQ ID NO: 7656718 - DNA, 22 bp, Homo sapiens
aatggctgccagggcaggaggt

SEQ ID NO: 7656719 - DNA, 22 bp, Homo sapiens
aatggctgccagggcaggaggt

SEQ ID NO: 7656720 - DNA, 22 bp, Homo sapiens
aatggctgatgccaggtctagg

SEQ ID NO: 7656721 - DNA, 22 bp, Homo sapiens
aatggctgatgccaggtctagg

SEQ ID NO: 7656722 - DNA, 22 bp, Homo sapiens
aatggctgatgtttctgatgac

SEQ ID NO: 7656723 - DNA, 22 bp, Homo sapiens
aatggctctgatgttgttgtga

SEQ ID NO: 7656724 - DNA, 22 bp, Homo sapiens
aatggctctttgaggacagaag

SEQ ID NO: 7656725 - DNA, 22 bp, Homo sapiens
aatggctctttgaggacagaag

SEQ ID NO: 7656726 - DNA, 22 bp, Homo sapiens
aatggctgaagaagtgtggcca

SEQ ID NO: 7656727 - DNA, 22 bp, Homo sapiens
aatggctgaagaagtgtggcca

SEQ ID NO: 7656728 - DNA, 22 bp, Homo sapiens
aatggctctgatgttgttgtga

SEQ ID NO: 7656729 - DNA, 22 bp, Homo sapiens
aatggctctgatgttgttgtga

SEQ ID NO: 7656730 - DNA, 22 bp, Homo sapiens
aatggctctgatgttgttgtga

SEQ ID NO: 7656731 - DNA, 22 bp, Homo sapiens
aatggctctgatgttgttgtga

SEQ ID NO: 7656732 - DNA, 22 bp, Homo sapiens
aatggctctgatgttgttgtga

SEQ ID NO: 7656733 - DNA, 22 bp, Homo sapiens
aaccttgagggatgaggtagtg

SEQ ID NO: 7656734 - DNA, 19 bp, Homo sapiens
aacctttagatcattctcc

SEQ ID NO: 7656735 - DNA, 19 bp, Homo sapiens
aaccttgcatgtcattata

SEQ ID NO: 7656736 - DNA, 19 bp, Homo sapiens
aaccttgcatgtcattata

SEQ ID NO: 7656737 - DNA, 22 bp, Homo sapiens
aaccttgtataaaactttgaga

SEQ ID NO: 7656738 - DNA, 22 bp, Homo sapiens
aaccttatcatgcataagtaga

SEQ ID NO: 7656739 - DNA, 22 bp, Homo sapiens
aacctgagggcaggaccccata

SEQ ID NO: 7656740 - DNA, 22 bp, Homo sapiens
aaccttcacttgcttcatttga

SEQ ID NO: 7656741 - DNA, 22 bp, Homo sapiens
aaccttcacttgcttcatttga

SEQ ID NO: 7656742 - DNA, 22 bp, Homo sapiens
aaccttcctgaggaaagtctaa

SEQ ID NO: 7656743 - DNA, 22 bp, Homo sapiens
aaccttcttgtgcagaactgta

SEQ ID NO: 7656744 - DNA, 22 bp, Homo sapiens
aaccttcttgtgcagaactgta

SEQ ID NO: 7656745 - DNA, 22 bp, Homo sapiens
aacgaatagggatttttctaac

SEQ ID NO: 7656746 - DNA, 23 bp, Homo sapiens
aacgacagctacaggcatcccac

SEQ ID NO: 7656747 - DNA, 23 bp, Homo sapiens
aacgacagctacaggcatcccac

SEQ ID NO: 7656748 - DNA, 22 bp, Homo sapiens
aaccttttgcaagtgccttgac

SEQ ID NO: 7656749 - DNA, 22 bp, Homo sapiens
aaccttttgcaagtgccttgac

SEQ ID NO: 7656750 - DNA, 22 bp, Homo sapiens
aaccttttgcaagtgccttgac

SEQ ID NO: 7656751 - DNA, 22 bp, Homo sapiens
aacctttcaattatcctcatct

SEQ ID NO: 7656752 - DNA, 22 bp, Homo sapiens
aacctttatttggtactattct

SEQ ID NO: 7656753 - DNA, 22 bp, Homo sapiens
aacctttgaggggagctctttc

SEQ ID NO: 7656754 - DNA, 22 bp, Homo sapiens
aacgcccagccttgatcaaatg

SEQ ID NO: 7656755 - DNA, 22 bp, Homo sapiens
aacgcccagccttgatcaaatg

SEQ ID NO: 7656756 - DNA, 22 bp, Homo sapiens
aacgcccagccttgatcaaatg

SEQ ID NO: 7656757 - DNA, 22 bp, Homo sapiens
aacgcccagccttgatcaaatg

SEQ ID NO: 7656758 - DNA, 22 bp, Homo sapiens
aacgcccgtggttgccaaggta

SEQ ID NO: 7656759 - DNA, 23 bp, Homo sapiens
aacgacagctacaggcatcccac

SEQ ID NO: 7656760 - DNA, 22 bp, Homo sapiens
aatgaacaacactgaaggaaga

SEQ ID NO: 7656761 - DNA, 22 bp, Homo sapiens
aacgcccgtggttgccaaggta

SEQ ID NO: 7656762 - DNA, 22 bp, Homo sapiens
aacgcccgtggttgccaaggta

SEQ ID NO: 7656763 - DNA, 22 bp, Homo sapiens
aatgaacaacactgaaggaaga

SEQ ID NO: 7656764 - DNA, 22 bp, Homo sapiens
aatgaacaacactgaaggaaga

SEQ ID NO: 7656765 - DNA, 22 bp, Homo sapiens
aatgaacaacactgaaggaaga

SEQ ID NO: 7656766 - DNA, 22 bp, Homo sapiens
aatgaatgttttaaggcataaa

SEQ ID NO: 7656767 - DNA, 22 bp, Homo sapiens
aatgaattcgagtgaaggaaag

SEQ ID NO: 7656768 - DNA, 22 bp, Homo sapiens
aatgaacaagaaagactttgag

SEQ ID NO: 7656769 - DNA, 22 bp, Homo sapiens
aatgaacaacttgatttttgcc

SEQ ID NO: 7656770 - DNA, 22 bp, Homo sapiens
aatgaacaacttgatttttgcc

SEQ ID NO: 7656771 - DNA, 22 bp, Homo sapiens
aatgaacaacttgatttttgcc

SEQ ID NO: 7656772 - DNA, 22 bp, Homo sapiens
aatgaattgcagtactgacttg

SEQ ID NO: 7656773 - DNA, 22 bp, Homo sapiens
aatgaattgcagtactgacttg

SEQ ID NO: 7656774 - DNA, 22 bp, Homo sapiens
aatgaattgcagtactgacttg

SEQ ID NO: 7656775 - DNA, 22 bp, Homo sapiens
aatgaattctgaagtcttccaa

SEQ ID NO: 7656776 - DNA, 22 bp, Homo sapiens
aatgaattctgaagtcttccaa

SEQ ID NO: 7656777 - DNA, 22 bp, Homo sapiens
aatgaattcgagtgaaggaaag

SEQ ID NO: 7656778 - DNA, 22 bp, Homo sapiens
aacctgagtcttttgatttgct

SEQ ID NO: 7656779 - DNA, 22 bp, Homo sapiens
aacctggccctaatcccagtag

SEQ ID NO: 7656780 - DNA, 22 bp, Homo sapiens
aacctggccccagattccccat

SEQ ID NO: 7656781 - DNA, 22 bp, Homo sapiens
aacctggccccagattccccat

SEQ ID NO: 7656782 - DNA, 22 bp, Homo sapiens
aacctggctcatgcagaaccct

SEQ ID NO: 7656783 - DNA, 22 bp, Homo sapiens
aacctggccctaatcccagtag

SEQ ID NO: 7656784 - DNA, 22 bp, Homo sapiens
aacctgggcttgaacagtgcct

SEQ ID NO: 7656785 - DNA, 22 bp, Homo sapiens
aacctgtacctggctgtgctca

SEQ ID NO: 7656786 - DNA, 22 bp, Homo sapiens
aacctgttccctggtccttgac

SEQ ID NO: 7656787 - DNA, 22 bp, Homo sapiens
aacctgttccctggtccttgac

SEQ ID NO: 7656788 - DNA, 22 bp, Homo sapiens
aacctgttttggttgcatttca

SEQ ID NO: 7656789 - DNA, 22 bp, Homo sapiens
aacctgttttcttctcatctag

SEQ ID NO: 7656790 - DNA, 22 bp, Homo sapiens
aacctgagcgcgttgctttcta

SEQ ID NO: 7656791 - DNA, 22 bp, Homo sapiens
aacctgagatactggtctttat

SEQ ID NO: 7656792 - DNA, 21 bp, Homo sapiens
aacctgagacccacgggacta

SEQ ID NO: 7656793 - DNA, 21 bp, Homo sapiens
aacctgagacccacgggacta

SEQ ID NO: 7656794 - DNA, 20 bp, Homo sapiens
aacctgaggcagtgttccag

SEQ ID NO: 7656795 - DNA, 22 bp, Homo sapiens
aacctgctttctcagagaaggg

SEQ ID NO: 7656796 - DNA, 22 bp, Homo sapiens
aacctgaatttaattgaaatga

SEQ ID NO: 7656797 - DNA, 23 bp, Homo sapiens
aacctgaactagggtcttgcata

SEQ ID NO: 7656798 - DNA, 22 bp, Homo sapiens
aacccgggaggcggaggttgtg

SEQ ID NO: 7656799 - DNA, 22 bp, Homo sapiens
aacccgggaggcggaggttgtg

SEQ ID NO: 7656800 - DNA, 22 bp, Homo sapiens
aacccgggaggcggaggttgtg

SEQ ID NO: 7656801 - DNA, 22 bp, Homo sapiens
aacccgggaggcggaggttgtg

SEQ ID NO: 7656802 - DNA, 22 bp, Homo sapiens
aacccgggaggcggaggttgtg

SEQ ID NO: 7656803 - DNA, 22 bp, Homo sapiens
aacccgggaggcggaggttgtg

SEQ ID NO: 7656804 - DNA, 22 bp, Homo sapiens
aacccgggaggcagaggttgtg

SEQ ID NO: 7656805 - DNA, 22 bp, Homo sapiens
aacccacaaaggatttcagctc

SEQ ID NO: 7656806 - DNA, 22 bp, Homo sapiens
aacccgggaggcagaggttgtg

SEQ ID NO: 7656807 - DNA, 22 bp, Homo sapiens
aacccgggaggcagaggttgtg

SEQ ID NO: 7656808 - DNA, 22 bp, Homo sapiens
aacccgggaggcggaggttgtg

SEQ ID NO: 7656809 - DNA, 22 bp, Homo sapiens
aacccgggaggcggaggttgtg

SEQ ID NO: 7656810 - DNA, 22 bp, Homo sapiens
aacccgggaggcggaggttgtg

SEQ ID NO: 7656811 - DNA, 22 bp, Homo sapiens
aacccgggaggcggaggttgtg

SEQ ID NO: 7656812 - DNA, 22 bp, Homo sapiens
aacccgggaggcggaggttgtg

SEQ ID NO: 7656813 - DNA, 22 bp, Homo sapiens
aacccgggaggtggaggttatg

SEQ ID NO: 7656814 - DNA, 22 bp, Homo sapiens
aacccgtgatcctgactcccct

SEQ ID NO: 7656815 - DNA, 22 bp, Homo sapiens
aacccgtgatcctgactcccct

SEQ ID NO: 7656816 - DNA, 22 bp, Homo sapiens
aacccgggaggtggaggttatg

SEQ ID NO: 7656817 - DNA, 22 bp, Homo sapiens
aacccgggaggtggaggttatg

SEQ ID NO: 7656818 - DNA, 22 bp, Homo sapiens
aacccgggaggcggaggttgtg

SEQ ID NO: 7656819 - DNA, 22 bp, Homo sapiens
aacccgggaggtggaggttatg

SEQ ID NO: 7656820 - DNA, 22 bp, Homo sapiens
aacatgttgctttaataatatt

SEQ ID NO: 7656821 - DNA, 22 bp, Homo sapiens
aacatgttgctttaataatatt

SEQ ID NO: 7656822 - DNA, 22 bp, Homo sapiens
aacatgttgctttaataatatt

SEQ ID NO: 7656823 - DNA, 22 bp, Homo sapiens
aacatgttgctttaataatatt

SEQ ID NO: 7656824 - DNA, 22 bp, Homo sapiens
aacatgttgctttaataatatt

SEQ ID NO: 7656825 - DNA, 22 bp, Homo sapiens
aaccatttgcagttactgagac

SEQ ID NO: 7656826 - DNA, 22 bp, Homo sapiens
aaccatttgcagttactgagac

SEQ ID NO: 7656827 - DNA, 22 bp, Homo sapiens
aacatgttgctttaataatatt

SEQ ID NO: 7656828 - DNA, 22 bp, Homo sapiens
aaccattcactgaacagttcaa

SEQ ID NO: 7656829 - DNA, 22 bp, Homo sapiens
aaccatttgcagttactgagac

SEQ ID NO: 7656830 - DNA, 22 bp, Homo sapiens
aaccatttgccattatcttaag

SEQ ID NO: 7656831 - DNA, 22 bp, Homo sapiens
aaccatttgccattatcttaag

SEQ ID NO: 7656832 - DNA, 22 bp, Homo sapiens
aaccatttgcagttactgagac

SEQ ID NO: 7656833 - DNA, 22 bp, Homo sapiens
aacatgtgtctggctagattgt

SEQ ID NO: 7656834 - DNA, 22 bp, Homo sapiens
aacatgtgtcttgcatttcttg

SEQ ID NO: 7656835 - DNA, 22 bp, Homo sapiens
aacatgttgagttgaaagtagc

SEQ ID NO: 7656836 - DNA, 22 bp, Homo sapiens
aacatgtgtcttgcatttcttg

SEQ ID NO: 7656837 - DNA, 22 bp, Homo sapiens
aacatgtgtcttgcatttcttg

SEQ ID NO: 7656838 - DNA, 22 bp, Homo sapiens
aacatgttgctttaataatatt

SEQ ID NO: 7656839 - DNA, 22 bp, Homo sapiens
aacatgttgagttgaaagtagc

SEQ ID NO: 7656840 - DNA, 22 bp, Homo sapiens
aacatgttgagttgaaagtagc

SEQ ID NO: 7656841 - DNA, 22 bp, Homo sapiens
aacatgttgagttgaaagtagc

SEQ ID NO: 7656842 - DNA, 22 bp, Homo sapiens
aacatgttgagttgaaagtagc

SEQ ID NO: 7656843 - DNA, 22 bp, Homo sapiens
aacccttaagcaaactcattta

SEQ ID NO: 7656844 - DNA, 22 bp, Homo sapiens
aacccttaagcaaactcattta

SEQ ID NO: 7656845 - DNA, 22 bp, Homo sapiens
aaccctggggctgctctgcctg

SEQ ID NO: 7656846 - DNA, 22 bp, Homo sapiens
aaccctgggtcggcaccatttt

SEQ ID NO: 7656847 - DNA, 22 bp, Homo sapiens
aaccctttcttgcttgttctaa

SEQ ID NO: 7656848 - DNA, 22 bp, Homo sapiens
aaccctttgttcggtgttctgg

SEQ ID NO: 7656849 - DNA, 22 bp, Homo sapiens
aaccctggggcagctgctaggg

SEQ ID NO: 7656850 - DNA, 22 bp, Homo sapiens
aaccctggggctgctctgcctg

SEQ ID NO: 7656851 - DNA, 22 bp, Homo sapiens
aaccctggggcagctgctaggg

SEQ ID NO: 7656852 - DNA, 22 bp, Homo sapiens
aaccctggggctgctctgcctg

SEQ ID NO: 7656853 - DNA, 22 bp, Homo sapiens
aaccctggggcagctgctaggg

SEQ ID NO: 7656854 - DNA, 22 bp, Homo sapiens
aaccctggggcagctgctaggg

SEQ ID NO: 7656855 - DNA, 22 bp, Homo sapiens
aaccctgggaggcagctcagtt

SEQ ID NO: 7656856 - DNA, 22 bp, Homo sapiens
aaccctgggctcccgacttacg

SEQ ID NO: 7656857 - DNA, 22 bp, Homo sapiens
aaccctgggaggcagctcagtt

SEQ ID NO: 7656858 - DNA, 22 bp, Homo sapiens
aaccctggccctggaataggca

SEQ ID NO: 7656859 - DNA, 22 bp, Homo sapiens
aaccctggagaaggctttggat

SEQ ID NO: 7656860 - DNA, 22 bp, Homo sapiens
aaccctggccctggaataggca

SEQ ID NO: 7656861 - DNA, 22 bp, Homo sapiens
aaccctggccctggaataggca

SEQ ID NO: 7656862 - DNA, 22 bp, Homo sapiens
aaccctggctttccctaattct

SEQ ID NO: 7656863 - DNA, 22 bp, Homo sapiens
aaccctgggaaacttaatgtca

SEQ ID NO: 7656864 - DNA, 22 bp, Homo sapiens
aaccctgggaggcagctcagtt

SEQ ID NO: 7656865 - DNA, 22 bp, Homo sapiens
aaccctgggaggcagctcagtt

SEQ ID NO: 7656866 - DNA, 22 bp, Homo sapiens
aaccctgattttacaaatgtct

SEQ ID NO: 7656867 - DNA, 22 bp, Homo sapiens
aaccctggagaaggctttggat

SEQ ID NO: 7656868 - DNA, 22 bp, Homo sapiens
aaccctggagaaggctttggat

SEQ ID NO: 7656869 - DNA, 22 bp, Homo sapiens
aacccgtgatcctgactcccct

SEQ ID NO: 7656870 - DNA, 22 bp, Homo sapiens
aaccctctcttattctttgcca

SEQ ID NO: 7656871 - DNA, 22 bp, Homo sapiens
aacctcaaactcttgggcttaa

SEQ ID NO: 7656872 - DNA, 22 bp, Homo sapiens
aacctcaaactcttgggcttaa

SEQ ID NO: 7656873 - DNA, 22 bp, Homo sapiens
aacctcaaactcttgggcttaa

SEQ ID NO: 7656874 - DNA, 22 bp, Homo sapiens
aacctcaaactcttgggcttaa

SEQ ID NO: 7656875 - DNA, 22 bp, Homo sapiens
aacctaggactatagatatcat

SEQ ID NO: 7656876 - DNA, 22 bp, Homo sapiens
aacctagactgacatatgtgta

SEQ ID NO: 7656877 - DNA, 23 bp, Homo sapiens
aacctagactacttactatgtgg

SEQ ID NO: 7656878 - DNA, 23 bp, Homo sapiens
aacctagactacttactatgtgg

SEQ ID NO: 7656879 - DNA, 22 bp, Homo sapiens
aacctctccctttgtgtccctg

SEQ ID NO: 7656880 - DNA, 22 bp, Homo sapiens
aacctctctgtgccctgacttt

SEQ ID NO: 7656881 - DNA, 22 bp, Homo sapiens
aacctgaaactacattcttgat

SEQ ID NO: 7656882 - DNA, 16 bp, Homo sapiens
aacctctctactgtgg

SEQ ID NO: 7656883 - DNA, 22 bp, Homo sapiens
aacctctccctttgtgtccctg

SEQ ID NO: 7656884 - DNA, 22 bp, Homo sapiens
aacctctacatccaggaaagga

SEQ ID NO: 7656885 - DNA, 22 bp, Homo sapiens
aacctcatttccttctttgtaa

SEQ ID NO: 7656886 - DNA, 22 bp, Homo sapiens
aacctcataggacttgaacata

SEQ ID NO: 7656887 - DNA, 22 bp, Homo sapiens
aacctcaggctctctggacaat

SEQ ID NO: 7656888 - DNA, 22 bp, Homo sapiens
aacctcaaactcttgggcttaa

SEQ ID NO: 7656889 - DNA, 22 bp, Homo sapiens
aacctcaggctctctggacaat

SEQ ID NO: 7656890 - DNA, 22 bp, Homo sapiens
aacctcaaactcttgggcttaa

SEQ ID NO: 7656891 - DNA, 22 bp, Homo sapiens
aaattattgggtcccaccccag

SEQ ID NO: 7656892 - DNA, 23 bp, Homo sapiens
aaattattgctcttcaattgcct

SEQ ID NO: 7656893 - DNA, 22 bp, Homo sapiens
aaattattgggtcccaccccag

SEQ ID NO: 7656894 - DNA, 23 bp, Homo sapiens
aaattattgctcttcaattgcct

SEQ ID NO: 7656895 - DNA, 23 bp, Homo sapiens
aaattattgctcttcaattgcct

SEQ ID NO: 7656896 - DNA, 22 bp, Homo sapiens
aaattattttcagaatggagaa

SEQ ID NO: 7656897 - DNA, 22 bp, Homo sapiens
aaattattttcagaatggagaa

SEQ ID NO: 7656898 - DNA, 22 bp, Homo sapiens
aaattattttcagaatggagaa

SEQ ID NO: 7656899 - DNA, 22 bp, Homo sapiens
aaattattgggtcccaccccag

SEQ ID NO: 7656900 - DNA, 22 bp, Homo sapiens
aaattattttcagaatggagaa

SEQ ID NO: 7656901 - DNA, 22 bp, Homo sapiens
aaattattttcagaatggagaa

SEQ ID NO: 7656902 - DNA, 22 bp, Homo sapiens
aaattattttcagaatggagaa

SEQ ID NO: 7656903 - DNA, 22 bp, Homo sapiens
aaattattttcagaatggagaa

SEQ ID NO: 7656904 - DNA, 22 bp, Homo sapiens
aaattattttcagaatggagaa

SEQ ID NO: 7656905 - DNA, 22 bp, Homo sapiens
aaattcaattaactttcatgct

SEQ ID NO: 7656906 - DNA, 22 bp, Homo sapiens
aaattcaattaactttcatgct

SEQ ID NO: 7656907 - DNA, 22 bp, Homo sapiens
aaattcaattaactttcatgct

SEQ ID NO: 7656908 - DNA, 22 bp, Homo sapiens
aaattcaatgatcactggctca

SEQ ID NO: 7656909 - DNA, 22 bp, Homo sapiens
aaattattttcagaatggagaa

SEQ ID NO: 7656910 - DNA, 22 bp, Homo sapiens
aaattcacaagagcattgcctg

SEQ ID NO: 7656911 - DNA, 22 bp, Homo sapiens
aaattcaattaactttcatgct

SEQ ID NO: 7656912 - DNA, 22 bp, Homo sapiens
aaattcacaagagcattgcctg

SEQ ID NO: 7656913 - DNA, 22 bp, Homo sapiens
aaattcacaagagcattgcctg

SEQ ID NO: 7656914 - DNA, 22 bp, Homo sapiens
aaattcaattaactttcatgct

SEQ ID NO: 7656915 - DNA, 23 bp, Homo sapiens
aaattattgctcttcaattgcct

SEQ ID NO: 7656916 - DNA, 23 bp, Homo sapiens
aaattattgctcttcaattgcct

SEQ ID NO: 7656917 - DNA, 23 bp, Homo sapiens
aaattattgctcttcaattgcct

SEQ ID NO: 7656918 - DNA, 23 bp, Homo sapiens
aaattattgctcttcaattgcct

SEQ ID NO: 7656919 - DNA, 23 bp, Homo sapiens
aaattattgctcttcaattgcct

SEQ ID NO: 7656920 - DNA, 23 bp, Homo sapiens
aaattattgctcttcaattgcct

SEQ ID NO: 7656921 - DNA, 23 bp, Homo sapiens
aaattattgctcttcaattgcct

SEQ ID NO: 7656922 - DNA, 18 bp, Homo sapiens
aaattattcttccttttc

SEQ ID NO: 7656923 - DNA, 18 bp, Homo sapiens
aaattattcttccttttc

SEQ ID NO: 7656924 - DNA, 18 bp, Homo sapiens
aaattattcttccttttc

SEQ ID NO: 7656925 - DNA, 18 bp, Homo sapiens
aaattattcttccttttc

SEQ ID NO: 7656926 - DNA, 18 bp, Homo sapiens
aaattattcttccttttc

SEQ ID NO: 7656927 - DNA, 18 bp, Homo sapiens
aaattattcttccttttc

SEQ ID NO: 7656928 - DNA, 22 bp, Homo sapiens
aaattattctcatgtgtttctt

SEQ ID NO: 7656929 - DNA, 22 bp, Homo sapiens
aaattattctcatgtgtttctt

SEQ ID NO: 7656930 - DNA, 22 bp, Homo sapiens
aaattattctcatgtgtttctt

SEQ ID NO: 7656931 - DNA, 22 bp, Homo sapiens
aaattattcaaaaagctgtgtt

SEQ ID NO: 7656932 - DNA, 22 bp, Homo sapiens
aaattattcaaaaagctgtgtt

SEQ ID NO: 7656933 - DNA, 22 bp, Homo sapiens
aaattattcaaaaagctgtgtt

SEQ ID NO: 7656934 - DNA, 22 bp, Homo sapiens
aaattattcaaaaagctgtgtt

SEQ ID NO: 7656935 - DNA, 18 bp, Homo sapiens
aaattattcttccttttc

SEQ ID NO: 7656936 - DNA, 18 bp, Homo sapiens
aaattattcttccttttc

SEQ ID NO: 7656937 - DNA, 18 bp, Homo sapiens
aaattattcttccttttc

SEQ ID NO: 7656938 - DNA, 22 bp, Homo sapiens
aaattattctcatgtgtttctt

SEQ ID NO: 7656939 - DNA, 22 bp, Homo sapiens
aaattattctcatgtgtttctt

SEQ ID NO: 7656940 - DNA, 22 bp, Homo sapiens
aaattattctcatgtgtttctt

SEQ ID NO: 7656941 - DNA, 22 bp, Homo sapiens
aaattattctcatgtgtttctt

SEQ ID NO: 7656942 - DNA, 21 bp, Homo sapiens
aaattcacctagtaaaacttc

SEQ ID NO: 7656943 - DNA, 21 bp, Homo sapiens
aaattcacctagtaaaacttc

SEQ ID NO: 7656944 - DNA, 21 bp, Homo sapiens
aaattcacctagtaaaacttc

SEQ ID NO: 7656945 - DNA, 21 bp, Homo sapiens
aaattcacctagtaaaacttc

SEQ ID NO: 7656946 - DNA, 21 bp, Homo sapiens
aaattcacctagtaaaacttc

SEQ ID NO: 7656947 - DNA, 21 bp, Homo sapiens
aaattcacctagtaaaacttc

SEQ ID NO: 7656948 - DNA, 22 bp, Homo sapiens
aaattcacaagagcattgcctg

SEQ ID NO: 7656949 - DNA, 22 bp, Homo sapiens
aaggctgagagtcacagtccta

SEQ ID NO: 7656950 - DNA, 22 bp, Homo sapiens
aaggctgagagtcacagtccta

SEQ ID NO: 7656951 - DNA, 22 bp, Homo sapiens
aaggctgggtaacctgtccact

SEQ ID NO: 7656952 - DNA, 22 bp, Homo sapiens
aaggctgggtaacctgtccact

SEQ ID NO: 7656953 - DNA, 22 bp, Homo sapiens
aaggctgggtaacctgtccact

SEQ ID NO: 7656954 - DNA, 22 bp, Homo sapiens
aaggctgggtaacctgtccact

SEQ ID NO: 7656955 - DNA, 22 bp, Homo sapiens
aaggctgggtaacctgtccact

SEQ ID NO: 7656956 - DNA, 22 bp, Homo sapiens
aaggctgggtaacctgtccact

SEQ ID NO: 7656957 - DNA, 22 bp, Homo sapiens
aaggctggggtgcagacggcct

SEQ ID NO: 7656958 - DNA, 22 bp, Homo sapiens
aaggctggggtgcagacggcct

SEQ ID NO: 7656959 - DNA, 22 bp, Homo sapiens
aaggctgggtaacctgtccact

SEQ ID NO: 7656960 - DNA, 22 bp, Homo sapiens
aaggctgagccagggcccctat

SEQ ID NO: 7656961 - DNA, 22 bp, Homo sapiens
aaggctgagccagggcccctat

SEQ ID NO: 7656962 - DNA, 22 bp, Homo sapiens
aaggctgagccagggcccctat

SEQ ID NO: 7656963 - DNA, 19 bp, Homo sapiens
aaggctggtaccataggtt

SEQ ID NO: 7656964 - DNA, 19 bp, Homo sapiens
aaggctggtaccataggtt

SEQ ID NO: 7656965 - DNA, 22 bp, Homo sapiens
aaggctggtcagatgtggtgaa

SEQ ID NO: 7656966 - DNA, 19 bp, Homo sapiens
aaggctggtaccataggtt

SEQ ID NO: 7656967 - DNA, 19 bp, Homo sapiens
aaggctggtaccataggtt

SEQ ID NO: 7656968 - DNA, 19 bp, Homo sapiens
aaggctggtaccataggtt

SEQ ID NO: 7656969 - DNA, 22 bp, Homo sapiens
aaggctgggtttgggatgtgat

SEQ ID NO: 7656970 - DNA, 19 bp, Homo sapiens
aaggctggtaccataggtt

SEQ ID NO: 7656971 - DNA, 22 bp, Homo sapiens
aaggctgggtttgggatgtgat

SEQ ID NO: 7656972 - DNA, 22 bp, Homo sapiens
aaggctgggtttgggatgtgat

SEQ ID NO: 7656973 - DNA, 22 bp, Homo sapiens
aaggctgggtttgggatgtgat

SEQ ID NO: 7656974 - DNA, 22 bp, Homo sapiens
aaggctgggtttgggatgtgat

SEQ ID NO: 7656975 - DNA, 22 bp, Homo sapiens
aaggctgggtttgggatgtgat

SEQ ID NO: 7656976 - DNA, 22 bp, Homo sapiens
aaggctgggtttgggatgtgat

SEQ ID NO: 7656977 - DNA, 22 bp, Homo sapiens
aaggctgggtttgggatgtgat

SEQ ID NO: 7656978 - DNA, 22 bp, Homo sapiens
aaattattcaaaaagctgtgtt

SEQ ID NO: 7656979 - DNA, 22 bp, Homo sapiens
aaattattcaaaaagctgtgtt

SEQ ID NO: 7656980 - DNA, 22 bp, Homo sapiens
aaattattcaaaaagctgtgtt

SEQ ID NO: 7656981 - DNA, 22 bp, Homo sapiens
aaattattcaaaaagctgtgtt

SEQ ID NO: 7656982 - DNA, 22 bp, Homo sapiens
aaattattcaaaaagctgtgtt

SEQ ID NO: 7656983 - DNA, 22 bp, Homo sapiens
aaattattcaaaaagctgtgtt

SEQ ID NO: 7656984 - DNA, 22 bp, Homo sapiens
aaggcagccctggctcagcctg

SEQ ID NO: 7656985 - DNA, 22 bp, Homo sapiens
aaggcagccctggctcagcctg

SEQ ID NO: 7656986 - DNA, 22 bp, Homo sapiens
aaggcagccctggctcagcctg

SEQ ID NO: 7656987 - DNA, 22 bp, Homo sapiens
aaggcagccatagcaccatcca

SEQ ID NO: 7656988 - DNA, 22 bp, Homo sapiens
aaggcagccatagcaccatcca

SEQ ID NO: 7656989 - DNA, 22 bp, Homo sapiens
aaggcagccatagcaccatcca

SEQ ID NO: 7656990 - DNA, 22 bp, Homo sapiens
aaggcagccatgtgctttgggt

SEQ ID NO: 7656991 - DNA, 22 bp, Homo sapiens
aaggcagccatgtgctttgggt

SEQ ID NO: 7656992 - DNA, 22 bp, Homo sapiens
aaggcagccatgtgctttgggt

SEQ ID NO: 7656993 - DNA, 22 bp, Homo sapiens
aaggcagccctggctcagcctg

SEQ ID NO: 7656994 - DNA, 22 bp, Homo sapiens
aaggcagccctggctcagcctg

SEQ ID NO: 7656995 - DNA, 22 bp, Homo sapiens
aaggcagccctggctcagcctg

SEQ ID NO: 7656996 - DNA, 22 bp, Homo sapiens
aaggcagcaggatttggtgact

SEQ ID NO: 7656997 - DNA, 22 bp, Homo sapiens
aaggcagcaggatttggtgact

SEQ ID NO: 7656998 - DNA, 22 bp, Homo sapiens
aaggcagcaggatttggtgact

SEQ ID NO: 7656999 - DNA, 22 bp, Homo sapiens
aaggcagcaggatttggtgact

SEQ ID NO: 7657000 - DNA, 22 bp, Homo sapiens
aaggcagcaggatttggtgact

SEQ ID NO: 7657001 - DNA, 22 bp, Homo sapiens
aaggcagcaggatttggtgact

SEQ ID NO: 7657002 - DNA, 19 bp, Homo sapiens
aaggcagcagtagcatcca

SEQ ID NO: 7657003 - DNA, 19 bp, Homo sapiens
aaggcagcagtagcatcca

SEQ ID NO: 7657004 - DNA, 19 bp, Homo sapiens
aaggcagcagtagcatcca

SEQ ID NO: 7657005 - DNA, 19 bp, Homo sapiens
aaggcagcagtagcatcca

SEQ ID NO: 7657006 - DNA, 22 bp, Homo sapiens
aaggcagcagtgcacgactgat

SEQ ID NO: 7657007 - DNA, 22 bp, Homo sapiens
aaggcagcagtgcacgactgat

SEQ ID NO: 7657008 - DNA, 22 bp, Homo sapiens
aaggcagcagtgcacgactgat

SEQ ID NO: 7657009 - DNA, 22 bp, Homo sapiens
aaggcagcagtgcacgactgat

SEQ ID NO: 7657010 - DNA, 22 bp, Homo sapiens
aaggcagcatgaatccctgtac

SEQ ID NO: 7657011 - DNA, 22 bp, Homo sapiens
aaggcagcatgaatccctgtac

SEQ ID NO: 7657012 - DNA, 22 bp, Homo sapiens
aaggcagcatgaatccctgtac

SEQ ID NO: 7657013 - DNA, 22 bp, Homo sapiens
aaggcagcatgaatccctgtac

SEQ ID NO: 7657014 - DNA, 22 bp, Homo sapiens
aaggcagccagatcctttgggt

SEQ ID NO: 7657015 - DNA, 22 bp, Homo sapiens
aaggcagccagatcctttgggt

SEQ ID NO: 7657016 - DNA, 22 bp, Homo sapiens
aaggcagccagatcctttgggt

SEQ ID NO: 7657017 - DNA, 22 bp, Homo sapiens
aaggcagccagatcctttgggt

SEQ ID NO: 7657018 - DNA, 22 bp, Homo sapiens
aaggcagcagaggaaaggtgct

SEQ ID NO: 7657019 - DNA, 22 bp, Homo sapiens
aaggcagcaggatttggtgact

SEQ ID NO: 7657020 - DNA, 22 bp, Homo sapiens
aaggcagcagaggaaaggtgct

SEQ ID NO: 7657021 - DNA, 22 bp, Homo sapiens
aaggcagcagaggaaaggtgct

SEQ ID NO: 7657022 - DNA, 22 bp, Homo sapiens
aaggcagcagaggaaaggtgct

SEQ ID NO: 7657023 - DNA, 22 bp, Homo sapiens
aaggcagcagaggaaaggtgct

SEQ ID NO: 7657024 - DNA, 22 bp, Homo sapiens
aaggcagcaccgcctcctgaaa

SEQ ID NO: 7657025 - DNA, 22 bp, Homo sapiens
aaggcagcaccgcctcctgaaa

SEQ ID NO: 7657026 - DNA, 22 bp, Homo sapiens
aaggcagcaccgcctcctgaaa

SEQ ID NO: 7657027 - DNA, 22 bp, Homo sapiens
aaggcagcaagaattccaggtt

SEQ ID NO: 7657028 - DNA, 22 bp, Homo sapiens
aaggcagcaagaattccaggtt

SEQ ID NO: 7657029 - DNA, 22 bp, Homo sapiens
aaggcagcaagaattccaggtt

SEQ ID NO: 7657030 - DNA, 22 bp, Homo sapiens
aaggcagcaagaattccaggtt

SEQ ID NO: 7657031 - DNA, 22 bp, Homo sapiens
aaggcagcaagaattccaggtt

SEQ ID NO: 7657032 - DNA, 22 bp, Homo sapiens
aaggcagcacagcaactgctca

SEQ ID NO: 7657033 - DNA, 22 bp, Homo sapiens
aaggcagcacagcaactgctca

SEQ ID NO: 7657034 - DNA, 22 bp, Homo sapiens
aaggcagcaactaatggatctc

SEQ ID NO: 7657035 - DNA, 22 bp, Homo sapiens
aaggcagcaactaatggatctc

SEQ ID NO: 7657036 - DNA, 22 bp, Homo sapiens
aaggcagcaactaatggatctc

SEQ ID NO: 7657037 - DNA, 22 bp, Homo sapiens
aaggcagcaagaattccaggtt

SEQ ID NO: 7657038 - DNA, 22 bp, Homo sapiens
aaggcagatataaagactagag

SEQ ID NO: 7657039 - DNA, 22 bp, Homo sapiens
aaggcagatataaagactagag

SEQ ID NO: 7657040 - DNA, 22 bp, Homo sapiens
aaggcagatataaagactagag

SEQ ID NO: 7657041 - DNA, 22 bp, Homo sapiens
aaggcactgtactagttagtta

SEQ ID NO: 7657042 - DNA, 22 bp, Homo sapiens
aaatgtctacttcccatctgta

SEQ ID NO: 7657043 - DNA, 22 bp, Homo sapiens
aaatgtctacttcccatctgta

SEQ ID NO: 7657044 - DNA, 22 bp, Homo sapiens
aaggcacttaacgtgggaggat

SEQ ID NO: 7657045 - DNA, 22 bp, Homo sapiens
aaggcactgtactagttagtta

SEQ ID NO: 7657046 - DNA, 22 bp, Homo sapiens
aaggcagatataaagactagag

SEQ ID NO: 7657047 - DNA, 22 bp, Homo sapiens
aaggcacttaacgtgggaggat

SEQ ID NO: 7657048 - DNA, 22 bp, Homo sapiens
aaggcagatataaagactagag

SEQ ID NO: 7657049 - DNA, 22 bp, Homo sapiens
aaggcagatataaagactagag

SEQ ID NO: 7657050 - DNA, 22 bp, Homo sapiens
aaggaagagaatccttctcaga

SEQ ID NO: 7657051 - DNA, 22 bp, Homo sapiens
aaggaagagaatccttctcaga

SEQ ID NO: 7657052 - DNA, 22 bp, Homo sapiens
aaggaagagaatccttctcaga

SEQ ID NO: 7657053 - DNA, 22 bp, Homo sapiens
aaggaagagaatccttctcaga

SEQ ID NO: 7657054 - DNA, 22 bp, Homo sapiens
aaggaagagaatccttctcaga

SEQ ID NO: 7657055 - DNA, 22 bp, Homo sapiens
aaggaagagaatccttctcaga

SEQ ID NO: 7657056 - DNA, 22 bp, Homo sapiens
aaggaagagaatccttctcaga

SEQ ID NO: 7657057 - DNA, 22 bp, Homo sapiens
aaggaagagcaaagaattatgt

SEQ ID NO: 7657058 - DNA, 22 bp, Homo sapiens
aaggaagagcaaagaattatgt

SEQ ID NO: 7657059 - DNA, 22 bp, Homo sapiens
aaggaagagcaaagaattatgt

SEQ ID NO: 7657060 - DNA, 22 bp, Homo sapiens
aaggaagagcaaagaattatgt

SEQ ID NO: 7657061 - DNA, 22 bp, Homo sapiens
aaggaagagcaaagaattatgt

SEQ ID NO: 7657062 - DNA, 22 bp, Homo sapiens
aaggaagagaatccttctcaga

SEQ ID NO: 7657063 - DNA, 22 bp, Homo sapiens
aaggaagagaatccttctcaga

SEQ ID NO: 7657064 - DNA, 22 bp, Homo sapiens
aaggaagagaatccttctcaga

SEQ ID NO: 7657065 - DNA, 22 bp, Homo sapiens
aaggaagacttgagaaggttcc

SEQ ID NO: 7657066 - DNA, 22 bp, Homo sapiens
aaggaagacttgagaaggttcc

SEQ ID NO: 7657067 - DNA, 22 bp, Homo sapiens
aaggaagacttgagaaggttcc

SEQ ID NO: 7657068 - DNA, 22 bp, Homo sapiens
aaggaagacttgagaaggttcc

SEQ ID NO: 7657069 - DNA, 22 bp, Homo sapiens
aaggaagactcgcaggtctatg

SEQ ID NO: 7657070 - DNA, 22 bp, Homo sapiens
aaggaagacttgagaaggttcc

SEQ ID NO: 7657071 - DNA, 22 bp, Homo sapiens
aaggaagacttgagaaggttcc

SEQ ID NO: 7657072 - DNA, 22 bp, Homo sapiens
aaggaagacttgagaaggttcc

SEQ ID NO: 7657073 - DNA, 22 bp, Homo sapiens
aaggaagacttgagaaggttcc

SEQ ID NO: 7657074 - DNA, 22 bp, Homo sapiens
aaggaagacacagatgaagtga

SEQ ID NO: 7657075 - DNA, 22 bp, Homo sapiens
aaggaagacacagatgaagtga

SEQ ID NO: 7657076 - DNA, 22 bp, Homo sapiens
aaggaagactcgcaggtctatg

SEQ ID NO: 7657077 - DNA, 22 bp, Homo sapiens
aaggaagactcgcaggtctatg

SEQ ID NO: 7657078 - DNA, 22 bp, Homo sapiens
aaggaagacacagatgaagtga

SEQ ID NO: 7657079 - DNA, 22 bp, Homo sapiens
aaggaagactcgcaggtctatg

SEQ ID NO: 7657080 - DNA, 22 bp, Homo sapiens
aaggaagactcgcaggtctatg

SEQ ID NO: 7657081 - DNA, 22 bp, Homo sapiens
aaggaagactcgcaggtctatg

SEQ ID NO: 7657082 - DNA, 22 bp, Homo sapiens
aaggaagactcgcaggtctatg

SEQ ID NO: 7657083 - DNA, 22 bp, Homo sapiens
aaggaagactcgcaggtctatg

SEQ ID NO: 7657084 - DNA, 22 bp, Homo sapiens
aaggaagactcgcaggtctatg

SEQ ID NO: 7657085 - DNA, 22 bp, Homo sapiens
aaggaagacacagatgaagtga

SEQ ID NO: 7657086 - DNA, 22 bp, Homo sapiens
aaggaagacacagatgaagtga

SEQ ID NO: 7657087 - DNA, 22 bp, Homo sapiens
aaggaagacacagatgaagtga

SEQ ID NO: 7657088 - DNA, 22 bp, Homo sapiens
aaggaagacacagatgaagtga

SEQ ID NO: 7657089 - DNA, 22 bp, Homo sapiens
aaggaagacacagatgaagtga

SEQ ID NO: 7657090 - DNA, 22 bp, Homo sapiens
aaggaagacacagatgaagtga

SEQ ID NO: 7657091 - DNA, 22 bp, Homo sapiens
aaggaagacacagatgaagtga

SEQ ID NO: 7657092 - DNA, 22 bp, Homo sapiens
aaggaaagacaggacggaattc

SEQ ID NO: 7657093 - DNA, 22 bp, Homo sapiens
aaggaaagacaggacggaattc

SEQ ID NO: 7657094 - DNA, 22 bp, Homo sapiens
aaatgcatgtatgtaatatgct

SEQ ID NO: 7657095 - DNA, 22 bp, Homo sapiens
aaatgcatgtatgtaatatgct

SEQ ID NO: 7657096 - DNA, 22 bp, Homo sapiens
aaatgcatgtatgtaatatgct

SEQ ID NO: 7657097 - DNA, 22 bp, Homo sapiens
aaatgcatgtatgtaatatgct

SEQ ID NO: 7657098 - DNA, 22 bp, Homo sapiens
aaatgcatgtatgtaatatgct

SEQ ID NO: 7657099 - DNA, 22 bp, Homo sapiens
aaatgcatgtatgtaatatgct

SEQ ID NO: 7657100 - DNA, 22 bp, Homo sapiens
aaatgcatgtgctatagatgtg

SEQ ID NO: 7657101 - DNA, 22 bp, Homo sapiens
aaatgcatgtatgtaatatgct

SEQ ID NO: 7657102 - DNA, 22 bp, Homo sapiens
aaatgcatgtgctatagatgtg

SEQ ID NO: 7657103 - DNA, 22 bp, Homo sapiens
aaatgcattctgttttcactag

SEQ ID NO: 7657104 - DNA, 22 bp, Homo sapiens
aaatgcattctgttttcactag

SEQ ID NO: 7657105 - DNA, 22 bp, Homo sapiens
aaatgcattaagtcagaacaat

SEQ ID NO: 7657106 - DNA, 22 bp, Homo sapiens
aaatgcattaagtcagaacaat

SEQ ID NO: 7657107 - DNA, 22 bp, Homo sapiens
aaatgcattaagtcagaacaat

SEQ ID NO: 7657108 - DNA, 22 bp, Homo sapiens
aaatgcattggtttctacttgt

SEQ ID NO: 7657109 - DNA, 22 bp, Homo sapiens
aaatgcattggtttctacttgt

SEQ ID NO: 7657110 - DNA, 22 bp, Homo sapiens
aaatgcattggtttctacttgt

SEQ ID NO: 7657111 - DNA, 22 bp, Homo sapiens
aaatgcatttcactaatgtttc

SEQ ID NO: 7657112 - DNA, 22 bp, Homo sapiens
aaatgcatttcactaatgtttc

SEQ ID NO: 7657113 - DNA, 22 bp, Homo sapiens
aaatgcattggtttctacttgt

SEQ ID NO: 7657114 - DNA, 22 bp, Homo sapiens
aaatgcattggtttctacttgt

SEQ ID NO: 7657115 - DNA, 22 bp, Homo sapiens
aaatgcatttcactaatgtttc

SEQ ID NO: 7657116 - DNA, 22 bp, Homo sapiens
aaatgcatttcactaatgtttc

SEQ ID NO: 7657117 - DNA, 22 bp, Homo sapiens
aaggaaagacaggacggaattc

SEQ ID NO: 7657118 - DNA, 22 bp, Homo sapiens
aaggaaagacaggacggaattc

SEQ ID NO: 7657119 - DNA, 22 bp, Homo sapiens
aaggaaagacaggacggaattc

SEQ ID NO: 7657120 - DNA, 22 bp, Homo sapiens
aaggaaagacaggacggaattc

SEQ ID NO: 7657121 - DNA, 22 bp, Homo sapiens
aaatgcatttttaattagaccc

SEQ ID NO: 7657122 - DNA, 22 bp, Homo sapiens
aaatgcatttcactaatgtttc

SEQ ID NO: 7657123 - DNA, 22 bp, Homo sapiens
aaatgcatttttaattagaccc

SEQ ID NO: 7657124 - DNA, 22 bp, Homo sapiens
aaatgcatttttaattagaccc

SEQ ID NO: 7657125 - DNA, 22 bp, Homo sapiens
aaatgcatttcactaatgtttc

SEQ ID NO: 7657126 - DNA, 22 bp, Homo sapiens
aaatgcatttcactaatgtttc

SEQ ID NO: 7657127 - DNA, 22 bp, Homo sapiens
aaatgtctactcctgtgtttat

SEQ ID NO: 7657128 - DNA, 22 bp, Homo sapiens
aaatgtctactcctgtgtttat

SEQ ID NO: 7657129 - DNA, 22 bp, Homo sapiens
aaatgtctactcctgtgtttat

SEQ ID NO: 7657130 - DNA, 22 bp, Homo sapiens
aaatgtccttagagaaaagtca

SEQ ID NO: 7657131 - DNA, 22 bp, Homo sapiens
aaatgtctactcctgtgtttat

SEQ ID NO: 7657132 - DNA, 22 bp, Homo sapiens
aaatgtccattgaatggatgag

SEQ ID NO: 7657133 - DNA, 22 bp, Homo sapiens
aaatgtcatatttaagtaggaa

SEQ ID NO: 7657134 - DNA, 22 bp, Homo sapiens
aaatgtcagaggaacatattga

SEQ ID NO: 7657135 - DNA, 22 bp, Homo sapiens
aaatgtcctgagattcaactta

SEQ ID NO: 7657136 - DNA, 22 bp, Homo sapiens
aaatgtcatatttaagtaggaa

SEQ ID NO: 7657137 - DNA, 22 bp, Homo sapiens
aaatgtcatatttaagtaggaa

SEQ ID NO: 7657138 - DNA, 22 bp, Homo sapiens
aaatgtcaggtggtggatggct

SEQ ID NO: 7657139 - DNA, 22 bp, Homo sapiens
aaatgtcagaggaacatattga

SEQ ID NO: 7657140 - DNA, 22 bp, Homo sapiens
aaatgtcaggtggtggatggct

SEQ ID NO: 7657141 - DNA, 22 bp, Homo sapiens
aaatgtcagaggaacatattga

SEQ ID NO: 7657142 - DNA, 22 bp, Homo sapiens
aaatgtcagaggaacatattga

SEQ ID NO: 7657143 - DNA, 22 bp, Homo sapiens
aaatgtcaaggtgatagatgca

SEQ ID NO: 7657144 - DNA, 22 bp, Homo sapiens
aaatgtcaaggtgatagatgca

SEQ ID NO: 7657145 - DNA, 22 bp, Homo sapiens
aaatgtcagaaaacatggagtg

SEQ ID NO: 7657146 - DNA, 22 bp, Homo sapiens
aaatgtcagaaaacatggagtg

SEQ ID NO: 7657147 - DNA, 22 bp, Homo sapiens
aaatgtcagaaaacatggagtg

SEQ ID NO: 7657148 - DNA, 22 bp, Homo sapiens
aaatgtcagaaaacatggagtg

SEQ ID NO: 7657149 - DNA, 22 bp, Homo sapiens
aaatgtcagaaaacatggagtg

SEQ ID NO: 7657150 - DNA, 22 bp, Homo sapiens
aaatgtcagaagctttacttct

SEQ ID NO: 7657151 - DNA, 22 bp, Homo sapiens
aaatgtcagaggaacatattga

SEQ ID NO: 7657152 - DNA, 22 bp, Homo sapiens
aaatgtcagaggaacatattga

SEQ ID NO: 7657153 - DNA, 22 bp, Homo sapiens
aaatgtcagaggaacatattga

SEQ ID NO: 7657154 - DNA, 22 bp, Homo sapiens
aaatgtcagaggaacatattga

SEQ ID NO: 7657155 - DNA, 22 bp, Homo sapiens
aaatgtcagaggaacatattga

SEQ ID NO: 7657156 - DNA, 22 bp, Homo sapiens
aaatgtcagaagctttacttct

SEQ ID NO: 7657157 - DNA, 22 bp, Homo sapiens
aaatgtcagaagctttacttct

SEQ ID NO: 7657158 - DNA, 22 bp, Homo sapiens
aaatgtcagaagctttacttct

SEQ ID NO: 7657159 - DNA, 22 bp, Homo sapiens
aaatgtcagaagctttacttct

SEQ ID NO: 7657160 - DNA, 22 bp, Homo sapiens
aaatgtcagaagctttacttct

SEQ ID NO: 7657161 - DNA, 22 bp, Homo sapiens
aaatgtcagaagctttacttct

SEQ ID NO: 7657162 - DNA, 22 bp, Homo sapiens
aaggaagagtctagaacaggca

SEQ ID NO: 7657163 - DNA, 22 bp, Homo sapiens
aaggaagagtctagaacaggca

SEQ ID NO: 7657164 - DNA, 22 bp, Homo sapiens
aaggaagagtctagaacaggca

SEQ ID NO: 7657165 - DNA, 22 bp, Homo sapiens
aaggaagagtctagaacaggca

SEQ ID NO: 7657166 - DNA, 22 bp, Homo sapiens
aaggaagagtctagaacaggca

SEQ ID NO: 7657167 - DNA, 22 bp, Homo sapiens
aaggaagagtctagaacaggca

SEQ ID NO: 7657168 - DNA, 22 bp, Homo sapiens
aaggaagatatatcaagcttaa

SEQ ID NO: 7657169 - DNA, 22 bp, Homo sapiens
aaggaagatatatcaagcttaa

SEQ ID NO: 7657170 - DNA, 22 bp, Homo sapiens
aaggaagatatatcaagcttaa

SEQ ID NO: 7657171 - DNA, 22 bp, Homo sapiens
aaggaagagtctagaacaggca

SEQ ID NO: 7657172 - DNA, 22 bp, Homo sapiens
aaggaagagaatccttctcaga

SEQ ID NO: 7657173 - DNA, 22 bp, Homo sapiens
aaggaagagtctagaacaggca

SEQ ID NO: 7657174 - DNA, 22 bp, Homo sapiens
aaggaagagtctagaacaggca

SEQ ID NO: 7657175 - DNA, 22 bp, Homo sapiens
aaggaagagtctagaacaggca

SEQ ID NO: 7657176 - DNA, 22 bp, Homo sapiens
aaggaagagtctagaacaggca

SEQ ID NO: 7657177 - DNA, 22 bp, Homo sapiens
aaggaagaggcaggttttgctg

SEQ ID NO: 7657178 - DNA, 22 bp, Homo sapiens
aaggaagaggcaggttttgctg

SEQ ID NO: 7657179 - DNA, 22 bp, Homo sapiens
aaggaagaggcaggttttgctg

SEQ ID NO: 7657180 - DNA, 22 bp, Homo sapiens
aaggaagagcaaagaattatgt

SEQ ID NO: 7657181 - DNA, 22 bp, Homo sapiens
aaggaagagcaaagaattatgt

SEQ ID NO: 7657182 - DNA, 22 bp, Homo sapiens
aaggaagagcaaagaattatgt

SEQ ID NO: 7657183 - DNA, 22 bp, Homo sapiens
aaggaagagcaaagaattatgt

SEQ ID NO: 7657184 - DNA, 22 bp, Homo sapiens
aaggaagagcaaagaattatgt

SEQ ID NO: 7657185 - DNA, 22 bp, Homo sapiens
aaatgtcaaggtgatagatgca

SEQ ID NO: 7657186 - DNA, 22 bp, Homo sapiens
aaatgtcaaggtgatagatgca

SEQ ID NO: 7657187 - DNA, 22 bp, Homo sapiens
aaatgtcaaggtgatagatgca

SEQ ID NO: 7657188 - DNA, 22 bp, Homo sapiens
aaatgtcaaggtgatagatgca

SEQ ID NO: 7657189 - DNA, 22 bp, Homo sapiens
aaatgtcaaggtgatagatgca

SEQ ID NO: 7657190 - DNA, 22 bp, Homo sapiens
aaatgtcaaggtgatagatgca

SEQ ID NO: 7657191 - DNA, 22 bp, Homo sapiens
aaatgtcaaggtgatagatgca

SEQ ID NO: 7657192 - DNA, 22 bp, Homo sapiens
aaggaagatgaggtgctgctta

SEQ ID NO: 7657193 - DNA, 22 bp, Homo sapiens
aaatgtcaaggtgatagatgca

SEQ ID NO: 7657194 - DNA, 22 bp, Homo sapiens
aaatgtcaaggtgatagatgca

SEQ ID NO: 7657195 - DNA, 22 bp, Homo sapiens
aaggaagatgaaagtactgcta

SEQ ID NO: 7657196 - DNA, 22 bp, Homo sapiens
aaggaagatgaggtgctgctta

SEQ ID NO: 7657197 - DNA, 22 bp, Homo sapiens
aaggaagatgaggtgctgctta

SEQ ID NO: 7657198 - DNA, 22 bp, Homo sapiens
aaggaagatgaggtgctgctta

SEQ ID NO: 7657199 - DNA, 22 bp, Homo sapiens
aaggaagatgaaagtactgcta

SEQ ID NO: 7657200 - DNA, 22 bp, Homo sapiens
aaggaagatgaaagtactgcta

SEQ ID NO: 7657201 - DNA, 22 bp, Homo sapiens
aaggaagatgaaagtactgcta

SEQ ID NO: 7657202 - DNA, 22 bp, Homo sapiens
aaggaagatgaaagtactgcta

SEQ ID NO: 7657203 - DNA, 22 bp, Homo sapiens
aaggaagatgaaagtactgcta

SEQ ID NO: 7657204 - DNA, 22 bp, Homo sapiens
aaggaagatatatcaagcttaa

SEQ ID NO: 7657205 - DNA, 22 bp, Homo sapiens
aaggaagatatatcaagcttaa

SEQ ID NO: 7657206 - DNA, 22 bp, Homo sapiens
aaggaagatatatcaagcttaa

SEQ ID NO: 7657207 - DNA, 22 bp, Homo sapiens
aaggaagatatatcaagcttaa

SEQ ID NO: 7657208 - DNA, 22 bp, Homo sapiens
aaggaagatatatcaagcttaa

SEQ ID NO: 7657209 - DNA, 22 bp, Homo sapiens
aacagacaactcctgtggctca

SEQ ID NO: 7657210 - DNA, 22 bp, Homo sapiens
aacagacaactcctgtggctca

SEQ ID NO: 7657211 - DNA, 22 bp, Homo sapiens
aacagacaactcctgtggctca

SEQ ID NO: 7657212 - DNA, 22 bp, Homo sapiens
aacagacaactcctgtggctca

SEQ ID NO: 7657213 - DNA, 22 bp, Homo sapiens
aacagaattgtacaccagggag

SEQ ID NO: 7657214 - DNA, 22 bp, Homo sapiens
aacagaattgtacaccagggag

SEQ ID NO: 7657215 - DNA, 22 bp, Homo sapiens
aacagaattgctgctgccaatg

SEQ ID NO: 7657216 - DNA, 22 bp, Homo sapiens
aacagaattgctgctgccaatg

SEQ ID NO: 7657217 - DNA, 22 bp, Homo sapiens
aacagaatgcaggggatgctgc

SEQ ID NO: 7657218 - DNA, 22 bp, Homo sapiens
aacagacagaaaaatgtgatct

SEQ ID NO: 7657219 - DNA, 22 bp, Homo sapiens
aacagacatatttttaatatgc

SEQ ID NO: 7657220 - DNA, 22 bp, Homo sapiens
aacagacatatttttaatatgc

SEQ ID NO: 7657221 - DNA, 22 bp, Homo sapiens
aacagacagaaaaatgtgatct

SEQ ID NO: 7657222 - DNA, 22 bp, Homo sapiens
aacagacagaaaaatgtgatct

SEQ ID NO: 7657223 - DNA, 22 bp, Homo sapiens
aacagacagaaaaatgtgatct

SEQ ID NO: 7657224 - DNA, 22 bp, Homo sapiens
aacagacagaaaaatgtgatct

SEQ ID NO: 7657225 - DNA, 22 bp, Homo sapiens
aacagagaggccacctcagcag

SEQ ID NO: 7657226 - DNA, 22 bp, Homo sapiens
aacagacttagagcatcccaat

SEQ ID NO: 7657227 - DNA, 22 bp, Homo sapiens
aacagacttagagcatcccaat

SEQ ID NO: 7657228 - DNA, 22 bp, Homo sapiens
aacagagaggccacctcagcag

SEQ ID NO: 7657229 - DNA, 22 bp, Homo sapiens
aacagagatcttaattcctgta

SEQ ID NO: 7657230 - DNA, 22 bp, Homo sapiens
aagtgcttcgttctgtattggg

SEQ ID NO: 7657231 - DNA, 22 bp, Homo sapiens
aagtgcttcgttctgtattggg

SEQ ID NO: 7657232 - DNA, 22 bp, Homo sapiens
aacagagctctgctctcagatt

SEQ ID NO: 7657233 - DNA, 22 bp, Homo sapiens
aacagactcacagctagagaag

SEQ ID NO: 7657234 - DNA, 22 bp, Homo sapiens
aacagacatatttttaatatgc

SEQ ID NO: 7657235 - DNA, 22 bp, Homo sapiens
aacagacatatttttaatatgc

SEQ ID NO: 7657236 - DNA, 22 bp, Homo sapiens
aacagacatatttttaatatgc

SEQ ID NO: 7657237 - DNA, 22 bp, Homo sapiens
aacagacatatttttaatatgc

SEQ ID NO: 7657238 - DNA, 22 bp, Homo sapiens
aacagacatatttttaatatgc

SEQ ID NO: 7657239 - DNA, 22 bp, Homo sapiens
aacagaactgttgttctggagg

SEQ ID NO: 7657240 - DNA, 22 bp, Homo sapiens
aacagaactgttgttctggagg

SEQ ID NO: 7657241 - DNA, 22 bp, Homo sapiens
aacagaacccgagtgtgaatct

SEQ ID NO: 7657242 - DNA, 22 bp, Homo sapiens
aacagaacccgagtgtgaatct

SEQ ID NO: 7657243 - DNA, 22 bp, Homo sapiens
aacagaacccgagtgtgaatct

SEQ ID NO: 7657244 - DNA, 22 bp, Homo sapiens
aacagaacccgagtgtgaatct

SEQ ID NO: 7657245 - DNA, 22 bp, Homo sapiens
aacagaagggggtatttacatt

SEQ ID NO: 7657246 - DNA, 22 bp, Homo sapiens
aacagaagggggtatttacatt

SEQ ID NO: 7657247 - DNA, 22 bp, Homo sapiens
aacagaagggggtatttacatt

SEQ ID NO: 7657248 - DNA, 22 bp, Homo sapiens
aacagaaaaggtaggtggcttt

SEQ ID NO: 7657249 - DNA, 22 bp, Homo sapiens
aacagaaaaggtaggtggcttt

SEQ ID NO: 7657250 - DNA, 22 bp, Homo sapiens
aacagaaaaggtaggtggcttt

SEQ ID NO: 7657251 - DNA, 22 bp, Homo sapiens
aacagaaaaggtaggtggcttt

SEQ ID NO: 7657252 - DNA, 22 bp, Homo sapiens
aacagaaaaggtaggtggcttt

SEQ ID NO: 7657253 - DNA, 22 bp, Homo sapiens
aacagaaatcatttagggctct

SEQ ID NO: 7657254 - DNA, 22 bp, Homo sapiens
aacagaaatcatttagggctct

SEQ ID NO: 7657255 - DNA, 22 bp, Homo sapiens
aacagaaatcatttagggctct

SEQ ID NO: 7657256 - DNA, 22 bp, Homo sapiens
aacagaaaaggtaggtggcttt

SEQ ID NO: 7657257 - DNA, 22 bp, Homo sapiens
aacagaaaaggtaggtggcttt

SEQ ID NO: 7657258 - DNA, 22 bp, Homo sapiens
aacagaaatcatttagggctct

SEQ ID NO: 7657259 - DNA, 22 bp, Homo sapiens
aacagaaatcatttagggctct

SEQ ID NO: 7657260 - DNA, 22 bp, Homo sapiens
aacagaaatcatttagggctct

SEQ ID NO: 7657261 - DNA, 22 bp, Homo sapiens
aacagaagggggtatttacatt

SEQ ID NO: 7657262 - DNA, 22 bp, Homo sapiens
aacagaatagttgatgtacagt

SEQ ID NO: 7657263 - DNA, 22 bp, Homo sapiens
aacagaatagttgatgtacagt

SEQ ID NO: 7657264 - DNA, 22 bp, Homo sapiens
aacagaatagttgatgtacagt

SEQ ID NO: 7657265 - DNA, 22 bp, Homo sapiens
aacagaatagttgatgtacagt

SEQ ID NO: 7657266 - DNA, 22 bp, Homo sapiens
aacagaatagttgatgtacagt

SEQ ID NO: 7657267 - DNA, 22 bp, Homo sapiens
aacagaatagttgatgtacagt

SEQ ID NO: 7657268 - DNA, 22 bp, Homo sapiens
aacagaatagttgatgtacagt

SEQ ID NO: 7657269 - DNA, 22 bp, Homo sapiens
aacagaatagttgatgtacagt

SEQ ID NO: 7657270 - DNA, 22 bp, Homo sapiens
aacagaatagttgatgtacagt

SEQ ID NO: 7657271 - DNA, 22 bp, Homo sapiens
aacagaatagttgatgtacagt

SEQ ID NO: 7657272 - DNA, 22 bp, Homo sapiens
aacagaatgcaggggatgctgc

SEQ ID NO: 7657273 - DNA, 22 bp, Homo sapiens
aacagaatgcaggggatgctgc

SEQ ID NO: 7657274 - DNA, 22 bp, Homo sapiens
aacagaatgcaggggatgctgc

SEQ ID NO: 7657275 - DNA, 22 bp, Homo sapiens
aacagaatcttgggttcttttc

SEQ ID NO: 7657276 - DNA, 22 bp, Homo sapiens
aacagaatcttgggttcttttc

SEQ ID NO: 7657277 - DNA, 22 bp, Homo sapiens
aacagaatcttgggttcttttc

SEQ ID NO: 7657278 - DNA, 22 bp, Homo sapiens
aacagaatcttgggttcttttc

SEQ ID NO: 7657279 - DNA, 22 bp, Homo sapiens
aacagaatattttgcctttctc

SEQ ID NO: 7657280 - DNA, 22 bp, Homo sapiens
aacagaatattttgcctttctc

SEQ ID NO: 7657281 - DNA, 22 bp, Homo sapiens
aacagaatatcaaaagattatg

SEQ ID NO: 7657282 - DNA, 22 bp, Homo sapiens
aacagaatatcaaaagattatg

SEQ ID NO: 7657283 - DNA, 22 bp, Homo sapiens
aacagaatatcaaaagattatg

SEQ ID NO: 7657284 - DNA, 22 bp, Homo sapiens
aacagaatatcaaaagattatg

SEQ ID NO: 7657285 - DNA, 22 bp, Homo sapiens
aacagaatatcaaaagattatg

SEQ ID NO: 7657286 - DNA, 22 bp, Homo sapiens
aacagaatatcaaaagattatg

SEQ ID NO: 7657287 - DNA, 22 bp, Homo sapiens
aacactttggaatagagatagg

SEQ ID NO: 7657288 - DNA, 22 bp, Homo sapiens
aacactttggaatagagatagg

SEQ ID NO: 7657289 - DNA, 22 bp, Homo sapiens
aacactttggaatagagatagg

SEQ ID NO: 7657290 - DNA, 22 bp, Homo sapiens
aacactttcttccttgctcagg

SEQ ID NO: 7657291 - DNA, 22 bp, Homo sapiens
aacactttcttccttgctcagg

SEQ ID NO: 7657292 - DNA, 22 bp, Homo sapiens
aacactttggaatagagatagg

SEQ ID NO: 7657293 - DNA, 22 bp, Homo sapiens
aacactttggaatagagatagg

SEQ ID NO: 7657294 - DNA, 22 bp, Homo sapiens
aacactttggaatagagatagg

SEQ ID NO: 7657295 - DNA, 22 bp, Homo sapiens
aacactttggatgcagaaccaa

SEQ ID NO: 7657296 - DNA, 22 bp, Homo sapiens
aacactttctattattatggtt

SEQ ID NO: 7657297 - DNA, 22 bp, Homo sapiens
aacactttcttccttgctcagg

SEQ ID NO: 7657298 - DNA, 22 bp, Homo sapiens
aacactttcttccttgctcagg

SEQ ID NO: 7657299 - DNA, 22 bp, Homo sapiens
aacactttcttccttgctcagg

SEQ ID NO: 7657300 - DNA, 22 bp, Homo sapiens
aacactttcttccttgctcagg

SEQ ID NO: 7657301 - DNA, 22 bp, Homo sapiens
aacactttctattattatggtt

SEQ ID NO: 7657302 - DNA, 22 bp, Homo sapiens
aacactttctattattatggtt

SEQ ID NO: 7657303 - DNA, 22 bp, Homo sapiens
aacactttttcctcctgtctgg

SEQ ID NO: 7657304 - DNA, 22 bp, Homo sapiens
aacactttttcctcctgtctgg

SEQ ID NO: 7657305 - DNA, 22 bp, Homo sapiens
aacactttttatatattgtatc

SEQ ID NO: 7657306 - DNA, 22 bp, Homo sapiens
aacactttttatatattgtatc

SEQ ID NO: 7657307 - DNA, 22 bp, Homo sapiens
aacactttttatatattgtatc

SEQ ID NO: 7657308 - DNA, 22 bp, Homo sapiens
aacactttttatatattgtatc

SEQ ID NO: 7657309 - DNA, 22 bp, Homo sapiens
aacactttttatatattgtatc

SEQ ID NO: 7657310 - DNA, 22 bp, Homo sapiens
aacactttttatatattgtatc

SEQ ID NO: 7657311 - DNA, 22 bp, Homo sapiens
aacactttttagtaaagattga

SEQ ID NO: 7657312 - DNA, 22 bp, Homo sapiens
aacactttttagtaaagattga

SEQ ID NO: 7657313 - DNA, 22 bp, Homo sapiens
aacactttttagtaaagattga

SEQ ID NO: 7657314 - DNA, 22 bp, Homo sapiens
aacactttttagtaaagattga

SEQ ID NO: 7657315 - DNA, 22 bp, Homo sapiens
aacactttgggcatggccttcc

SEQ ID NO: 7657316 - DNA, 22 bp, Homo sapiens
aacactttgttgcctatgaacg

SEQ ID NO: 7657317 - DNA, 22 bp, Homo sapiens
aacactttgttgcctatgaacg

SEQ ID NO: 7657318 - DNA, 22 bp, Homo sapiens
aacactttgttgcctatgaacg

SEQ ID NO: 7657319 - DNA, 22 bp, Homo sapiens
aacacagtcctgctcacttatt

SEQ ID NO: 7657320 - DNA, 22 bp, Homo sapiens
aacacagtcctgctcacttatt

SEQ ID NO: 7657321 - DNA, 22 bp, Homo sapiens
aacacagtcctgctcacttatt

SEQ ID NO: 7657322 - DNA, 22 bp, Homo sapiens
aacacagtcagttcctggatca

SEQ ID NO: 7657323 - DNA, 22 bp, Homo sapiens
aacacagttagtaagggaaata

SEQ ID NO: 7657324 - DNA, 22 bp, Homo sapiens
aacacagttagtaagggaaata

SEQ ID NO: 7657325 - DNA, 22 bp, Homo sapiens
aacacagtcattagaggcagcc

SEQ ID NO: 7657326 - DNA, 22 bp, Homo sapiens
aacacagtcagttcctggatca

SEQ ID NO: 7657327 - DNA, 22 bp, Homo sapiens
aacacaggtttgtggtaaataa

SEQ ID NO: 7657328 - DNA, 22 bp, Homo sapiens
aacacaggttgctgggcctcac

SEQ ID NO: 7657329 - DNA, 22 bp, Homo sapiens
aacacaggttgctgggcctcac

SEQ ID NO: 7657330 - DNA, 22 bp, Homo sapiens
aacacaggttcattctgtgagg

SEQ ID NO: 7657331 - DNA, 22 bp, Homo sapiens
aacacaggttcattctgtgagg

SEQ ID NO: 7657332 - DNA, 22 bp, Homo sapiens
aacacaggttcattctgtgagg

SEQ ID NO: 7657333 - DNA, 22 bp, Homo sapiens
aacacagggcagctgctgggaa

SEQ ID NO: 7657334 - DNA, 22 bp, Homo sapiens
aacacaggttgctgggcctcac

SEQ ID NO: 7657335 - DNA, 22 bp, Homo sapiens
aacacaggttgctgggcctcac

SEQ ID NO: 7657336 - DNA, 20 bp, Homo sapiens
aacacagggttaccatcaga

SEQ ID NO: 7657337 - DNA, 20 bp, Homo sapiens
aacacagggttaccatcaga

SEQ ID NO: 7657338 - DNA, 20 bp, Homo sapiens
aacacagggttaccatcaga

SEQ ID NO: 7657339 - DNA, 20 bp, Homo sapiens
aacacagggttaccatcaga

SEQ ID NO: 7657340 - DNA, 22 bp, Homo sapiens
aacacagggggttacaaattgt

SEQ ID NO: 7657341 - DNA, 20 bp, Homo sapiens
aacacagggttaccatcaga

SEQ ID NO: 7657342 - DNA, 20 bp, Homo sapiens
aacacagggttaccatcaga

SEQ ID NO: 7657343 - DNA, 22 bp, Homo sapiens
aacactgtatcagtcttcaata

SEQ ID NO: 7657344 - DNA, 22 bp, Homo sapiens
aacactgtatcagtcttcaata

SEQ ID NO: 7657345 - DNA, 22 bp, Homo sapiens
aacactgtatcagtcttcaata

SEQ ID NO: 7657346 - DNA, 22 bp, Homo sapiens
aacactgtatcagtcttcaata

SEQ ID NO: 7657347 - DNA, 22 bp, Homo sapiens
aacactgtatcagtcttcaata

SEQ ID NO: 7657348 - DNA, 22 bp, Homo sapiens
aacactgtatcagtcttcaata

SEQ ID NO: 7657349 - DNA, 22 bp, Homo sapiens
aacacagttttccaaaatagag

SEQ ID NO: 7657350 - DNA, 22 bp, Homo sapiens
aacacagtttctctatgagagt

SEQ ID NO: 7657351 - DNA, 22 bp, Homo sapiens
aacacagtttctctatgagagt

SEQ ID NO: 7657352 - DNA, 22 bp, Homo sapiens
aacacagtttctgcattggtag

SEQ ID NO: 7657353 - DNA, 22 bp, Homo sapiens
aacacagtttctgcattggtag

SEQ ID NO: 7657354 - DNA, 22 bp, Homo sapiens
aacacagtttctgcattggtag

SEQ ID NO: 7657355 - DNA, 22 bp, Homo sapiens
aacacagtcattagaggcagcc

SEQ ID NO: 7657356 - DNA, 22 bp, Homo sapiens
aacacagtttctctatgagagt

SEQ ID NO: 7657357 - DNA, 22 bp, Homo sapiens
aacacagttttccaaaatagag

SEQ ID NO: 7657358 - DNA, 22 bp, Homo sapiens
aacacagttttccaaaatagag

SEQ ID NO: 7657359 - DNA, 22 bp, Homo sapiens
aacacagttttccaaaatagag

SEQ ID NO: 7657360 - DNA, 22 bp, Homo sapiens
aacacagttttccaaaatagag

SEQ ID NO: 7657361 - DNA, 22 bp, Homo sapiens
aacacagttttccaaaatagag

SEQ ID NO: 7657362 - DNA, 22 bp, Homo sapiens
aacacagtttctgcattggtag

SEQ ID NO: 7657363 - DNA, 22 bp, Homo sapiens
aacacaggcatactggctccag

SEQ ID NO: 7657364 - DNA, 22 bp, Homo sapiens
aacacaggcatactggctccag

SEQ ID NO: 7657365 - DNA, 22 bp, Homo sapiens
aacacaggcatactggctccag

SEQ ID NO: 7657366 - DNA, 22 bp, Homo sapiens
aacacaggaggctatgttttct

SEQ ID NO: 7657367 - DNA, 22 bp, Homo sapiens
aacacaggaggctatgttttct

SEQ ID NO: 7657368 - DNA, 22 bp, Homo sapiens
aacacaggaaattggtaaatgg

SEQ ID NO: 7657369 - DNA, 22 bp, Homo sapiens
aacacaggaggctatgttttct

SEQ ID NO: 7657370 - DNA, 22 bp, Homo sapiens
aacacaggccagcctgtgcagt

SEQ ID NO: 7657371 - DNA, 22 bp, Homo sapiens
aacacaggccagcctgtgcagt

SEQ ID NO: 7657372 - DNA, 22 bp, Homo sapiens
aacacaggccagcctgtgcagt

SEQ ID NO: 7657373 - DNA, 22 bp, Homo sapiens
aacacaggccagcctgtgcagt

SEQ ID NO: 7657374 - DNA, 22 bp, Homo sapiens
aacacaggccagcctgtgcagt

SEQ ID NO: 7657375 - DNA, 22 bp, Homo sapiens
aacacagggcagctgctgggaa

SEQ ID NO: 7657376 - DNA, 22 bp, Homo sapiens
aacacaggggcgtggctcttac

SEQ ID NO: 7657377 - DNA, 22 bp, Homo sapiens
aacacaggggcgtggctcttac

SEQ ID NO: 7657378 - DNA, 22 bp, Homo sapiens
aacacaggggcgtggctcttac

SEQ ID NO: 7657379 - DNA, 22 bp, Homo sapiens
aacacagggggttacaaattgt

SEQ ID NO: 7657380 - DNA, 22 bp, Homo sapiens
aacacagggggttacaaattgt

SEQ ID NO: 7657381 - DNA, 22 bp, Homo sapiens
aacacagggactcccaggagaa

SEQ ID NO: 7657382 - DNA, 22 bp, Homo sapiens
aacacagggactcccaggagaa

SEQ ID NO: 7657383 - DNA, 22 bp, Homo sapiens
aacacagggactcccaggagaa

SEQ ID NO: 7657384 - DNA, 22 bp, Homo sapiens
aacacagggcagctgctgggaa

SEQ ID NO: 7657385 - DNA, 22 bp, Homo sapiens
aacacagggactcccaggagaa

SEQ ID NO: 7657386 - DNA, 22 bp, Homo sapiens
aacacagggcagctgctgggaa

SEQ ID NO: 7657387 - DNA, 22 bp, Homo sapiens
aacacagggcagctgctgggaa

SEQ ID NO: 7657388 - DNA, 22 bp, Homo sapiens
aacacagatcaaaatatttcct

SEQ ID NO: 7657389 - DNA, 20 bp, Homo sapiens
aacacagataccaaaggttg

SEQ ID NO: 7657390 - DNA, 20 bp, Homo sapiens
aacacagataccaaaggttg

SEQ ID NO: 7657391 - DNA, 20 bp, Homo sapiens
aacacagataccaaaggttg

SEQ ID NO: 7657392 - DNA, 22 bp, Homo sapiens
aacacagatcaaaatatttcct

SEQ ID NO: 7657393 - DNA, 22 bp, Homo sapiens
aacacagatcaaaatatttcct

SEQ ID NO: 7657394 - DNA, 22 bp, Homo sapiens
aacacagatcaaaatatttcct

SEQ ID NO: 7657395 - DNA, 22 bp, Homo sapiens
aacacagatcaaaatatttcct

SEQ ID NO: 7657396 - DNA, 22 bp, Homo sapiens
aacacagatcaaaatatttcct

SEQ ID NO: 7657397 - DNA, 22 bp, Homo sapiens
aacacagctaatttctgtcaat

SEQ ID NO: 7657398 - DNA, 22 bp, Homo sapiens
aacacagctaatttctgtcaat

SEQ ID NO: 7657399 - DNA, 22 bp, Homo sapiens
aacacagctaatttctgtcaat

SEQ ID NO: 7657400 - DNA, 22 bp, Homo sapiens
aacacagctaatttctgtcaat

SEQ ID NO: 7657401 - DNA, 22 bp, Homo sapiens
aacacagctaatttctgtcaat

SEQ ID NO: 7657402 - DNA, 22 bp, Homo sapiens
aacacagatcaaaatatttcct

SEQ ID NO: 7657403 - DNA, 22 bp, Homo sapiens
aacacacctggttaacctcttt

SEQ ID NO: 7657404 - DNA, 22 bp, Homo sapiens
aacacaatcttccagtttgctg

SEQ ID NO: 7657405 - DNA, 22 bp, Homo sapiens
aacacaatcttccagtttgctg

SEQ ID NO: 7657406 - DNA, 22 bp, Homo sapiens
aacacaatcttccagtttgctg

SEQ ID NO: 7657407 - DNA, 22 bp, Homo sapiens
aacacaatcttccagtttgctg

SEQ ID NO: 7657408 - DNA, 22 bp, Homo sapiens
aacacagaagtgccaagagcca

SEQ ID NO: 7657409 - DNA, 22 bp, Homo sapiens
aacacagaagtgccaagagcca

SEQ ID NO: 7657410 - DNA, 20 bp, Homo sapiens
aacacactggtggcatcagg

SEQ ID NO: 7657411 - DNA, 22 bp, Homo sapiens
aacacagaagtgccaagagcca

SEQ ID NO: 7657412 - DNA, 22 bp, Homo sapiens
aacacagacatagtgattacag

SEQ ID NO: 7657413 - DNA, 22 bp, Homo sapiens
aacacagaagtgccaagagcca

SEQ ID NO: 7657414 - DNA, 22 bp, Homo sapiens
aacacagaagtgccaagagcca

SEQ ID NO: 7657415 - DNA, 22 bp, Homo sapiens
aacacagaagtgccaagagcca

SEQ ID NO: 7657416 - DNA, 22 bp, Homo sapiens
aacacagaagtgccaagagcca

SEQ ID NO: 7657417 - DNA, 22 bp, Homo sapiens
aacacagaagtgccaagagcca

SEQ ID NO: 7657418 - DNA, 22 bp, Homo sapiens
aacacagaagtgccaagagcca

SEQ ID NO: 7657419 - DNA, 22 bp, Homo sapiens
aacacagaagtgccaagagcca

SEQ ID NO: 7657420 - DNA, 22 bp, Homo sapiens
aacacagaagtgccaagagcca

SEQ ID NO: 7657421 - DNA, 22 bp, Homo sapiens
aacacagagtatttgaagcatt

SEQ ID NO: 7657422 - DNA, 22 bp, Homo sapiens
aacacagagtatttgaagcatt

SEQ ID NO: 7657423 - DNA, 22 bp, Homo sapiens
aacacagagtatttgaagcatt

SEQ ID NO: 7657424 - DNA, 22 bp, Homo sapiens
aacacagagtatttgaagcatt

SEQ ID NO: 7657425 - DNA, 22 bp, Homo sapiens
aacacagagtatttgaagcatt

SEQ ID NO: 7657426 - DNA, 20 bp, Homo sapiens
aacacagataccaaaggttg

SEQ ID NO: 7657427 - DNA, 20 bp, Homo sapiens
aacacagataccaaaggttg

SEQ ID NO: 7657428 - DNA, 20 bp, Homo sapiens
aacacagataccaaaggttg

SEQ ID NO: 7657429 - DNA, 20 bp, Homo sapiens
aacacagataccaaaggttg

SEQ ID NO: 7657430 - DNA, 20 bp, Homo sapiens
aacacagataccaaaggttg

SEQ ID NO: 7657431 - DNA, 20 bp, Homo sapiens
aacacagataccaaaggttg

SEQ ID NO: 7657432 - DNA, 20 bp, Homo sapiens
aacacagataccaaaggttg

SEQ ID NO: 7657433 - DNA, 22 bp, Homo sapiens
aacacagacatagtgattacag

SEQ ID NO: 7657434 - DNA, 22 bp, Homo sapiens
aacacagacatagtgattacag

SEQ ID NO: 7657435 - DNA, 22 bp, Homo sapiens
aacacagacatagtgattacag

SEQ ID NO: 7657436 - DNA, 22 bp, Homo sapiens
aacacagacatagtgattacag

SEQ ID NO: 7657437 - DNA, 22 bp, Homo sapiens
aacacagacatagtgattacag

SEQ ID NO: 7657438 - DNA, 22 bp, Homo sapiens
aacacagacatagtgattacag

SEQ ID NO: 7657439 - DNA, 22 bp, Homo sapiens
aacacagagtatttgaagcatt

SEQ ID NO: 7657440 - DNA, 22 bp, Homo sapiens
aacacagagtatttgaagcatt

SEQ ID NO: 7657441 - DNA, 22 bp, Homo sapiens
aacacagagtatttgaagcatt

SEQ ID NO: 7657442 - DNA, 22 bp, Homo sapiens
aacacagacatagtgattacag

SEQ ID NO: 7657443 - DNA, 22 bp, Homo sapiens
aacacagagtatttgaagcatt

SEQ ID NO: 7657444 - DNA, 22 bp, Homo sapiens
aacacagagtatttgaagcatt

SEQ ID NO: 7657445 - DNA, 22 bp, Homo sapiens
aacacagagtatttgaagcatt

SEQ ID NO: 7657446 - DNA, 22 bp, Homo sapiens
aaatttgttcaatgtctatttg

SEQ ID NO: 7657447 - DNA, 22 bp, Homo sapiens
aaattttaaggctggaacttaa

SEQ ID NO: 7657448 - DNA, 22 bp, Homo sapiens
aaattttaaggctggaacttaa

SEQ ID NO: 7657449 - DNA, 22 bp, Homo sapiens
aaattttaaggctggaacttaa

SEQ ID NO: 7657450 - DNA, 22 bp, Homo sapiens
aaattttaaggctggaacttaa

SEQ ID NO: 7657451 - DNA, 22 bp, Homo sapiens
aaattttagaccaggcaaaact

SEQ ID NO: 7657452 - DNA, 22 bp, Homo sapiens
aaattttagaccaggcaaaact

SEQ ID NO: 7657453 - DNA, 22 bp, Homo sapiens
aacaatgcttgccaagtgtgat

SEQ ID NO: 7657454 - DNA, 22 bp, Homo sapiens
aaattttaaggctggaacttaa

SEQ ID NO: 7657455 - DNA, 22 bp, Homo sapiens
aaattttaaggctggaacttaa

SEQ ID NO: 7657456 - DNA, 22 bp, Homo sapiens
aacaatgtctcatcctatgtgg

SEQ ID NO: 7657457 - DNA, 22 bp, Homo sapiens
aacaatgtcctgtgagatgata

SEQ ID NO: 7657458 - DNA, 22 bp, Homo sapiens
aacaatgtcctgtgagatgata

SEQ ID NO: 7657459 - DNA, 22 bp, Homo sapiens
aacaatgtaatctactctgctc

SEQ ID NO: 7657460 - DNA, 22 bp, Homo sapiens
aacaatgtaatctactctgctc

SEQ ID NO: 7657461 - DNA, 22 bp, Homo sapiens
aacaatgtaatctactctgctc

SEQ ID NO: 7657462 - DNA, 22 bp, Homo sapiens
aacaatgtgaagtgctgttcag

SEQ ID NO: 7657463 - DNA, 22 bp, Homo sapiens
aacaatgtctcatcctatgtgg

SEQ ID NO: 7657464 - DNA, 22 bp, Homo sapiens
aacaatgtgaagtgctgttcag

SEQ ID NO: 7657465 - DNA, 23 bp, Homo sapiens
aacacaaagctgattccagtggc

SEQ ID NO: 7657466 - DNA, 23 bp, Homo sapiens
aacacaaagctgattccagtggc

SEQ ID NO: 7657467 - DNA, 23 bp, Homo sapiens
aacacaaagctgattccagtggc

SEQ ID NO: 7657468 - DNA, 22 bp, Homo sapiens
aacaatgtgaagtgctgttcag

SEQ ID NO: 7657469 - DNA, 22 bp, Homo sapiens
aaatttcttgaggctctctagc

SEQ ID NO: 7657470 - DNA, 22 bp, Homo sapiens
aaatttcttgaggctctctagc

SEQ ID NO: 7657471 - DNA, 22 bp, Homo sapiens
aaatttctgttgttttgagcca

SEQ ID NO: 7657472 - DNA, 22 bp, Homo sapiens
aaatttcttgaggctctctagc

SEQ ID NO: 7657473 - DNA, 22 bp, Homo sapiens
aaatttcttgaggctctctagc

SEQ ID NO: 7657474 - DNA, 22 bp, Homo sapiens
aaatttctgttgttttgagcca

SEQ ID NO: 7657475 - DNA, 22 bp, Homo sapiens
aaatttctgttgttttgagcca

SEQ ID NO: 7657476 - DNA, 22 bp, Homo sapiens
aaatttctgttgttttgagcca

SEQ ID NO: 7657477 - DNA, 22 bp, Homo sapiens
aaatttctgttgttttgagcca

SEQ ID NO: 7657478 - DNA, 22 bp, Homo sapiens
aaatttgataagccattgttac

SEQ ID NO: 7657479 - DNA, 22 bp, Homo sapiens
aaatttgataagccattgttac

SEQ ID NO: 7657480 - DNA, 22 bp, Homo sapiens
aaatttgttcaatgtctatttg

SEQ ID NO: 7657481 - DNA, 22 bp, Homo sapiens
aaatttgtcaacttcatatgtt

SEQ ID NO: 7657482 - DNA, 22 bp, Homo sapiens
aaatttctggaagtgtcagagt

SEQ ID NO: 7657483 - DNA, 22 bp, Homo sapiens
aaatttctggaagtgtcagagt

SEQ ID NO: 7657484 - DNA, 22 bp, Homo sapiens
aaatttctggaagtgtcagagt

SEQ ID NO: 7657485 - DNA, 22 bp, Homo sapiens
aaatttctggaagtgtcagagt

SEQ ID NO: 7657486 - DNA, 21 bp, Homo sapiens
aaatttctgcaagcctcaact

SEQ ID NO: 7657487 - DNA, 22 bp, Homo sapiens
aaatttctaagtcaagaagaac

SEQ ID NO: 7657488 - DNA, 22 bp, Homo sapiens
aaatttctaagtcaagaagaac

SEQ ID NO: 7657489 - DNA, 22 bp, Homo sapiens
aaatttctaagtcaagaagaac

SEQ ID NO: 7657490 - DNA, 22 bp, Homo sapiens
aaggctggttccatccctggtg

SEQ ID NO: 7657491 - DNA, 22 bp, Homo sapiens
aaatttctaagtcaagaagaac

SEQ ID NO: 7657492 - DNA, 22 bp, Homo sapiens
aaggctggtttccttgatgttt

SEQ ID NO: 7657493 - DNA, 22 bp, Homo sapiens
aaatttctaagtcaagaagaac

SEQ ID NO: 7657494 - DNA, 22 bp, Homo sapiens
aaatttctaagtcaagaagaac

SEQ ID NO: 7657495 - DNA, 22 bp, Homo sapiens
aaggctggtggattatgaggtc

SEQ ID NO: 7657496 - DNA, 22 bp, Homo sapiens
aaggctggtggattatgaggtc

SEQ ID NO: 7657497 - DNA, 22 bp, Homo sapiens
aaggctggtggattatgaggtc

SEQ ID NO: 7657498 - DNA, 22 bp, Homo sapiens
aaggctggtggattatgaggtc

SEQ ID NO: 7657499 - DNA, 22 bp, Homo sapiens
aaggctggtggattatgaggtc

SEQ ID NO: 7657500 - DNA, 22 bp, Homo sapiens
aaggctggtcagatgtggtgaa

SEQ ID NO: 7657501 - DNA, 22 bp, Homo sapiens
aaggctggtcagatgtggtgaa

SEQ ID NO: 7657502 - DNA, 22 bp, Homo sapiens
aaggctggtcagatgtggtgaa

SEQ ID NO: 7657503 - DNA, 22 bp, Homo sapiens
aaggctggtcagatgtggtgaa

SEQ ID NO: 7657504 - DNA, 22 bp, Homo sapiens
aaggctggtcagatgtggtgaa

SEQ ID NO: 7657505 - DNA, 22 bp, Homo sapiens
aaggctggtcagatgtggtgaa

SEQ ID NO: 7657506 - DNA, 22 bp, Homo sapiens
aaggctggtggattatgaggtc

SEQ ID NO: 7657507 - DNA, 22 bp, Homo sapiens
aaggctggttccatccctggtg

SEQ ID NO: 7657508 - DNA, 22 bp, Homo sapiens
aaggctggttccatccctggtg

SEQ ID NO: 7657509 - DNA, 22 bp, Homo sapiens
aaggctggttccatccctggtg

SEQ ID NO: 7657510 - DNA, 22 bp, Homo sapiens
aaggctggttccatccctggtg

SEQ ID NO: 7657511 - DNA, 22 bp, Homo sapiens
aaggctggttccatccctggtg

SEQ ID NO: 7657512 - DNA, 22 bp, Homo sapiens
aaaagtaattgtggtttttgcc

SEQ ID NO: 7657513 - DNA, 22 bp, Homo sapiens
aaacagcttgtttcaggaaagt

SEQ ID NO: 7657514 - DNA, 22 bp, Homo sapiens
aaaagtaattgtggtttttgcc

SEQ ID NO: 7657515 - DNA, 22 bp, Homo sapiens
aaaagtaattgtggtttttgcc

SEQ ID NO: 7657516 - DNA, 22 bp, Homo sapiens
aaaagtaattgtggtttttgcc

SEQ ID NO: 7657517 - DNA, 22 bp, Homo sapiens
aaaagtaattgtggtttttgcc

SEQ ID NO: 7657518 - DNA, 22 bp, Homo sapiens
aaaagtaattgtggtttttgcc

SEQ ID NO: 7657519 - DNA, 22 bp, Homo sapiens
aaaagtaattgtggtttttgcc

SEQ ID NO: 7657520 - DNA, 22 bp, Homo sapiens
aaacagcttgtttcaggaaagt

SEQ ID NO: 7657521 - DNA, 22 bp, Homo sapiens
aaacagctttcagaatctctca

SEQ ID NO: 7657522 - DNA, 22 bp, Homo sapiens
aaacagctttcagaatctctca

SEQ ID NO: 7657523 - DNA, 22 bp, Homo sapiens
aaacagctttcagaatctctca

SEQ ID NO: 7657524 - DNA, 22 bp, Homo sapiens
aaaagtaattgtggttttggcc

SEQ ID NO: 7657525 - DNA, 22 bp, Homo sapiens
aaaagtaattgtggttttggcc

SEQ ID NO: 7657526 - DNA, 22 bp, Homo sapiens
aaaagtaattgtggttttggcc

SEQ ID NO: 7657527 - DNA, 22 bp, Homo sapiens
aaaagtaattgcggtttttgct

SEQ ID NO: 7657528 - DNA, 22 bp, Homo sapiens
aaaagtaattgcggtttttgct

SEQ ID NO: 7657529 - DNA, 22 bp, Homo sapiens
aaaagtaattgcggtttttgct

SEQ ID NO: 7657530 - DNA, 22 bp, Homo sapiens
aaaagtaattgcggtttttgct

SEQ ID NO: 7657531 - DNA, 22 bp, Homo sapiens
aaaagtaattgcggtttttgct

SEQ ID NO: 7657532 - DNA, 22 bp, Homo sapiens
aaaagtaattgcggtttttgct

SEQ ID NO: 7657533 - DNA, 22 bp, Homo sapiens
aaaagtaattgcggtttttgct

SEQ ID NO: 7657534 - DNA, 22 bp, Homo sapiens
aaaagtaattgcggtttttgcc

SEQ ID NO: 7657535 - DNA, 22 bp, Homo sapiens
aaaagtaattgcggtttttgcc

SEQ ID NO: 7657536 - DNA, 22 bp, Homo sapiens
aaaagtaattgcggtttttgcc

SEQ ID NO: 7657537 - DNA, 22 bp, Homo sapiens
aaaagtaattgcggtttttgcc

SEQ ID NO: 7657538 - DNA, 22 bp, Homo sapiens
aaaagtaattgcggtttttgcc

SEQ ID NO: 7657539 - DNA, 22 bp, Homo sapiens
aaaagtaattgcggtttttgcc

SEQ ID NO: 7657540 - DNA, 22 bp, Homo sapiens
aaaagtaattgcggtttttgcc

SEQ ID NO: 7657541 - DNA, 22 bp, Homo sapiens
aaaagtaattgcagtttttgcc

SEQ ID NO: 7657542 - DNA, 22 bp, Homo sapiens
aaaagtaattgcagttttcgcc

SEQ ID NO: 7657543 - DNA, 22 bp, Homo sapiens
aaaagtaattgcagttttcgcc

SEQ ID NO: 7657544 - DNA, 22 bp, Homo sapiens
aaaagtaattgcagttttcgcc

SEQ ID NO: 7657545 - DNA, 22 bp, Homo sapiens
aaaagtaattgcagttttcgcc

SEQ ID NO: 7657546 - DNA, 22 bp, Homo sapiens
aaaagtaattgcagttttcgcc

SEQ ID NO: 7657547 - DNA, 22 bp, Homo sapiens
aaaagtaattgcaattttgtag

SEQ ID NO: 7657548 - DNA, 22 bp, Homo sapiens
aaaagtaattgcaattttgtag

SEQ ID NO: 7657549 - DNA, 22 bp, Homo sapiens
aaaagtaattgcaattttgtag

SEQ ID NO: 7657550 - DNA, 22 bp, Homo sapiens
aaaagtaattgcagttttgcca

SEQ ID NO: 7657551 - DNA, 22 bp, Homo sapiens
aaaagtaattgcagttttgcca

SEQ ID NO: 7657552 - DNA, 22 bp, Homo sapiens
aaaagtaattgcagttttgcca

SEQ ID NO: 7657553 - DNA, 22 bp, Homo sapiens
aaaagtaattgcagttttgcca

SEQ ID NO: 7657554 - DNA, 22 bp, Homo sapiens
aaaagtaattgcagttttgcca

SEQ ID NO: 7657555 - DNA, 22 bp, Homo sapiens
aaaagtaattgcagtttttgcc

SEQ ID NO: 7657556 - DNA, 22 bp, Homo sapiens
aaaagtaattgcagtttttgcc

SEQ ID NO: 7657557 - DNA, 22 bp, Homo sapiens
aaaagtaattgcagtttttgcc

SEQ ID NO: 7657558 - DNA, 22 bp, Homo sapiens
aaaagtaattgcagtttttgcc

SEQ ID NO: 7657559 - DNA, 22 bp, Homo sapiens
aaaagtaattgcagtttttgcc

SEQ ID NO: 7657560 - DNA, 22 bp, Homo sapiens
aaaagtaattgcagtttttgcc

SEQ ID NO: 7657561 - DNA, 22 bp, Homo sapiens
aaaagtaattgcagttttgtca

SEQ ID NO: 7657562 - DNA, 22 bp, Homo sapiens
aaaagtaattgcagttttgtca

SEQ ID NO: 7657563 - DNA, 22 bp, Homo sapiens
aaaagtaattgcagttttgtca

SEQ ID NO: 7657564 - DNA, 22 bp, Homo sapiens
aaaagtaattgcagttttgtca

SEQ ID NO: 7657565 - DNA, 22 bp, Homo sapiens
aaaagtaattgcagttttgtca

SEQ ID NO: 7657566 - DNA, 22 bp, Homo sapiens
aaaagtaattgcagttttgtca

SEQ ID NO: 7657567 - DNA, 22 bp, Homo sapiens
aaaagtaattgcagttttgtca

SEQ ID NO: 7657568 - DNA, 22 bp, Homo sapiens
aaaagtaattgcagttttgtca

SEQ ID NO: 7657569 - DNA, 22 bp, Homo sapiens
aaaagtaattgcagttttgcca

SEQ ID NO: 7657570 - DNA, 22 bp, Homo sapiens
aaaagtaattgcagttttgtca

SEQ ID NO: 7657571 - DNA, 22 bp, Homo sapiens
aaaagtaattgcagttttgtca

SEQ ID NO: 7657572 - DNA, 22 bp, Homo sapiens
aaaagtaattgcaattttgtag

SEQ ID NO: 7657573 - DNA, 22 bp, Homo sapiens
aaaagtaattgcaattttgtag

SEQ ID NO: 7657574 - DNA, 22 bp, Homo sapiens
aaaagtaattgcaattttgtag

SEQ ID NO: 7657575 - DNA, 22 bp, Homo sapiens
aaaagtaattgcaattttgtag

SEQ ID NO: 7657576 - DNA, 22 bp, Homo sapiens
aaaagtaattgcaattttgtag

SEQ ID NO: 7657577 - DNA, 22 bp, Homo sapiens
aaaagtaattgcaattttgtag

SEQ ID NO: 7657578 - DNA, 22 bp, Homo sapiens
aaaagtaattgatgcaatcgta

SEQ ID NO: 7657579 - DNA, 22 bp, Homo sapiens
aaaagtaattgatgcaatcgta

SEQ ID NO: 7657580 - DNA, 22 bp, Homo sapiens
aaaagtaattgcaattttgtag

SEQ ID NO: 7657581 - DNA, 22 bp, Homo sapiens
aaaagtaattgcaattttgtag

SEQ ID NO: 7657582 - DNA, 22 bp, Homo sapiens
aaaagtaattgcaattttgtag

SEQ ID NO: 7657583 - DNA, 22 bp, Homo sapiens
aaaagtaattgcaattttgtag

SEQ ID NO: 7657584 - DNA, 22 bp, Homo sapiens
aaaagtaatcgcagtttttgcc

SEQ ID NO: 7657585 - DNA, 22 bp, Homo sapiens
aaaagtaattgatgcaatcgta

SEQ ID NO: 7657586 - DNA, 22 bp, Homo sapiens
aaaagtaatcgcagtttttgcc

SEQ ID NO: 7657587 - DNA, 22 bp, Homo sapiens
aaaagtaatcgcagtttttgcc

SEQ ID NO: 7657588 - DNA, 22 bp, Homo sapiens
aaaagtaatcgcagtttttgcc

SEQ ID NO: 7657589 - DNA, 22 bp, Homo sapiens
aaaaggttttgagtacaaatat

SEQ ID NO: 7657590 - DNA, 22 bp, Homo sapiens
aaaagtaatcgcagtttttgcc

SEQ ID NO: 7657591 - DNA, 22 bp, Homo sapiens
aaaagtaatcgcagtttttgcc

SEQ ID NO: 7657592 - DNA, 22 bp, Homo sapiens
aaaagtaatcgcagtttttgcc

SEQ ID NO: 7657593 - DNA, 22 bp, Homo sapiens
aaaaggttttgagtacaaatat

SEQ ID NO: 7657594 - DNA, 22 bp, Homo sapiens
aaaaggttttgagtacaaatat

SEQ ID NO: 7657595 - DNA, 22 bp, Homo sapiens
aaaaggttttgagtacaaatat

SEQ ID NO: 7657596 - DNA, 22 bp, Homo sapiens
aaaaggttttgagtacaaatat

SEQ ID NO: 7657597 - DNA, 22 bp, Homo sapiens
aaaaggtagttgccaaataagg

SEQ ID NO: 7657598 - DNA, 22 bp, Homo sapiens
aaaaggttttgagtacaaatat

SEQ ID NO: 7657599 - DNA, 22 bp, Homo sapiens
aaaaggtagttgccaaataagg

SEQ ID NO: 7657600 - DNA, 22 bp, Homo sapiens
aaaaggtagattctccttctat

SEQ ID NO: 7657601 - DNA, 22 bp, Homo sapiens
aaaaggtagttgccaaataagg

SEQ ID NO: 7657602 - DNA, 22 bp, Homo sapiens
aaaaggaggacatggttacaga

SEQ ID NO: 7657603 - DNA, 22 bp, Homo sapiens
aaaaggtagttgccaaataagg

SEQ ID NO: 7657604 - DNA, 22 bp, Homo sapiens
aaaaggtagttgccaaataagg

SEQ ID NO: 7657605 - DNA, 22 bp, Homo sapiens
aaaaggtagttgccaaataagg

SEQ ID NO: 7657606 - DNA, 19 bp, Homo sapiens
aaaaggagagatcagagtt

SEQ ID NO: 7657607 - DNA, 19 bp, Homo sapiens
aaaaggagagatcagagtt

SEQ ID NO: 7657608 - DNA, 22 bp, Homo sapiens
aaaagggactactctcagctcc

SEQ ID NO: 7657609 - DNA, 22 bp, Homo sapiens
aaaagggcaaaaccatcatgga

SEQ ID NO: 7657610 - DNA, 22 bp, Homo sapiens
aaaagggcaaaaccatcatgga

SEQ ID NO: 7657611 - DNA, 19 bp, Homo sapiens
aaaaggagagatcagagtt

SEQ ID NO: 7657612 - DNA, 19 bp, Homo sapiens
aaaaggagagatcagagtt

SEQ ID NO: 7657613 - DNA, 22 bp, Homo sapiens
aaaattcatggcttgggaaaag

SEQ ID NO: 7657614 - DNA, 22 bp, Homo sapiens
aaaattcatggcttgggaaaag

SEQ ID NO: 7657615 - DNA, 22 bp, Homo sapiens
aaaaggacaagctttggagtta

SEQ ID NO: 7657616 - DNA, 22 bp, Homo sapiens
aaaactttcagggatacagaaa

SEQ ID NO: 7657617 - DNA, 22 bp, Homo sapiens
aaaagaacctagctcctcagtc

SEQ ID NO: 7657618 - DNA, 22 bp, Homo sapiens
aaaagaacctagctcctcagtc

SEQ ID NO: 7657619 - DNA, 22 bp, Homo sapiens
aaaagaacctagctcctcagtc

SEQ ID NO: 7657620 - DNA, 22 bp, Homo sapiens
aaaagaacctagctcctcagtc

SEQ ID NO: 7657621 - DNA, 22 bp, Homo sapiens
aaaatgtgcagtttttaagctg

SEQ ID NO: 7657622 - DNA, 22 bp, Homo sapiens
aaaatgtgtttatgcatttcgt

SEQ ID NO: 7657623 - DNA, 22 bp, Homo sapiens
aaaatgtgcagtttttaagctg

SEQ ID NO: 7657624 - DNA, 22 bp, Homo sapiens
aaaatgtgtttatgcatttcgt

SEQ ID NO: 7657625 - DNA, 22 bp, Homo sapiens
aaaattaagtgtctgggaagcc

SEQ ID NO: 7657626 - DNA, 22 bp, Homo sapiens
aaaattaagtgtctgggaagcc

SEQ ID NO: 7657627 - DNA, 22 bp, Homo sapiens
aaaattaagtgtctgggaagcc

SEQ ID NO: 7657628 - DNA, 22 bp, Homo sapiens
aaaattaagtgtctgggaagcc

SEQ ID NO: 7657629 - DNA, 21 bp, Homo sapiens
aaaatgtttccttgttggtta

SEQ ID NO: 7657630 - DNA, 22 bp, Homo sapiens
aaaatgttcaagcatgctggtt

SEQ ID NO: 7657631 - DNA, 18 bp, Homo sapiens
aaaatgttcccccattaa

SEQ ID NO: 7657632 - DNA, 22 bp, Homo sapiens
aaaatgttcaagcatgctggtt

SEQ ID NO: 7657633 - DNA, 18 bp, Homo sapiens
aaaatgttcccccattaa

SEQ ID NO: 7657634 - DNA, 21 bp, Homo sapiens
aaaatgtttccttgttggtta

SEQ ID NO: 7657635 - DNA, 22 bp, Homo sapiens
aaaactgaggtttcctgaagaa

SEQ ID NO: 7657636 - DNA, 22 bp, Homo sapiens
aaaactgtaggaattgggtgcc

SEQ ID NO: 7657637 - DNA, 22 bp, Homo sapiens
aaaactgaaccttgagatcttt

SEQ ID NO: 7657638 - DNA, 22 bp, Homo sapiens
aaaactgaaccttgagatcttt

SEQ ID NO: 7657639 - DNA, 22 bp, Homo sapiens
aaaactgaaccttgagatcttt

SEQ ID NO: 7657640 - DNA, 22 bp, Homo sapiens
aaaactttcagggatacagaaa

SEQ ID NO: 7657641 - DNA, 22 bp, Homo sapiens
aaaactttcagggatacagaaa

SEQ ID NO: 7657642 - DNA, 22 bp, Homo sapiens
aaaacttagctaggcaagtttt

SEQ ID NO: 7657643 - DNA, 22 bp, Homo sapiens
aaaacttagctaggcaagtttt

SEQ ID NO: 7657644 - DNA, 22 bp, Homo sapiens
aaaactttcagggatacagaaa

SEQ ID NO: 7657645 - DNA, 22 bp, Homo sapiens
aaaactttcagggatacagaaa

SEQ ID NO: 7657646 - DNA, 22 bp, Homo sapiens
aaaactttcagggatacagaaa

SEQ ID NO: 7657647 - DNA, 22 bp, Homo sapiens
aaaacttagctaggcaagtttt

SEQ ID NO: 7657648 - DNA, 22 bp, Homo sapiens
aaaactgtatcttcttgggact

SEQ ID NO: 7657649 - DNA, 22 bp, Homo sapiens
aaaactgtatcttcttgggact

SEQ ID NO: 7657650 - DNA, 22 bp, Homo sapiens
aaaattatggagtatcccaaag

SEQ ID NO: 7657651 - DNA, 22 bp, Homo sapiens
aaaattatggagtatcccaaag

SEQ ID NO: 7657652 - DNA, 22 bp, Homo sapiens
aaaattatggagtatcccaaag

SEQ ID NO: 7657653 - DNA, 22 bp, Homo sapiens
aaaattatggagtatcccaaag

SEQ ID NO: 7657654 - DNA, 22 bp, Homo sapiens
aaaattatagatctagtgcctg

SEQ ID NO: 7657655 - DNA, 22 bp, Homo sapiens
aaaattatagatctagtgcctg

SEQ ID NO: 7657656 - DNA, 22 bp, Homo sapiens
aaaattatagatctagtgcctg

SEQ ID NO: 7657657 - DNA, 22 bp, Homo sapiens
aaaattatggagtatcccaaag

SEQ ID NO: 7657658 - DNA, 22 bp, Homo sapiens
aaaattatggagtatcccaaag

SEQ ID NO: 7657659 - DNA, 22 bp, Homo sapiens
aaaattatggagtatcccaaag

SEQ ID NO: 7657660 - DNA, 22 bp, Homo sapiens
aaaattatggagtatcccaaag

SEQ ID NO: 7657661 - DNA, 22 bp, Homo sapiens
aaaattaagtgtctgggaagcc

SEQ ID NO: 7657662 - DNA, 22 bp, Homo sapiens
aaaattaagtgtctgggaagcc

SEQ ID NO: 7657663 - DNA, 22 bp, Homo sapiens
aaaattaagtgtctgggaagcc

SEQ ID NO: 7657664 - DNA, 22 bp, Homo sapiens
aaaattaagtgtctgggaagcc

SEQ ID NO: 7657665 - DNA, 22 bp, Homo sapiens
aaaattatagatctagtgcctg

SEQ ID NO: 7657666 - DNA, 22 bp, Homo sapiens
aaaattatagatctagtgcctg

SEQ ID NO: 7657667 - DNA, 22 bp, Homo sapiens
aaaattactattgttcctgggc

SEQ ID NO: 7657668 - DNA, 22 bp, Homo sapiens
aaaattactattgttcctgggc

SEQ ID NO: 7657669 - DNA, 22 bp, Homo sapiens
aaaattattcatggcttttgga

SEQ ID NO: 7657670 - DNA, 22 bp, Homo sapiens
aaaattattcatggcttttgga

SEQ ID NO: 7657671 - DNA, 22 bp, Homo sapiens
aaaattattcatggcttttgga

SEQ ID NO: 7657672 - DNA, 22 bp, Homo sapiens
aaaattattcatggcttttgga

SEQ ID NO: 7657673 - DNA, 22 bp, Homo sapiens
aaaattatggagtatcccaaag

SEQ ID NO: 7657674 - DNA, 22 bp, Homo sapiens
aaaattattcatggcttttgga

SEQ ID NO: 7657675 - DNA, 22 bp, Homo sapiens
aaaattatggagtatcccaaag

SEQ ID NO: 7657676 - DNA, 22 bp, Homo sapiens
aaaattcatggcttgggaaaag

SEQ ID NO: 7657677 - DNA, 22 bp, Homo sapiens
aaaattcatggcttgggaaaag

SEQ ID NO: 7657678 - DNA, 22 bp, Homo sapiens
aaaattcatggcttgggaaaag

SEQ ID NO: 7657679 - DNA, 22 bp, Homo sapiens
aaaattcatggcttgggaaaag

SEQ ID NO: 7657680 - DNA, 22 bp, Homo sapiens
aaaattcatggcttgggaaaag

SEQ ID NO: 7657681 - DNA, 22 bp, Homo sapiens
aaaattcatagaactgtacgct

SEQ ID NO: 7657682 - DNA, 22 bp, Homo sapiens
aaaattcatagaactgtacgct

SEQ ID NO: 7657683 - DNA, 22 bp, Homo sapiens
aaaattcatagaactgtacgct

SEQ ID NO: 7657684 - DNA, 22 bp, Homo sapiens
aaaattcatagaactgtacgct

SEQ ID NO: 7657685 - DNA, 22 bp, Homo sapiens
aaaattcatagaactgtacgct

SEQ ID NO: 7657686 - DNA, 22 bp, Homo sapiens
aaaattcatagaactgtacgct

SEQ ID NO: 7657687 - DNA, 22 bp, Homo sapiens
aaaaaggttgatccagattagg

SEQ ID NO: 7657688 - DNA, 22 bp, Homo sapiens
aaaaaggttgatccagattagg

SEQ ID NO: 7657689 - DNA, 22 bp, Homo sapiens
aaaaagtattggccatggttga

SEQ ID NO: 7657690 - DNA, 22 bp, Homo sapiens
aaaaagtattggccatggttga

SEQ ID NO: 7657691 - DNA, 22 bp, Homo sapiens
aaaaagtattggccatggttga

SEQ ID NO: 7657692 - DNA, 22 bp, Homo sapiens
aaaaaggttgatccagattagg

SEQ ID NO: 7657693 - DNA, 22 bp, Homo sapiens
aaaaagtattggccatggttga

SEQ ID NO: 7657694 - DNA, 22 bp, Homo sapiens
aaaaagtattggccatggttga

SEQ ID NO: 7657695 - DNA, 22 bp, Homo sapiens
aaaaagtattggccatggttga

SEQ ID NO: 7657696 - DNA, 22 bp, Homo sapiens
aaaaagtattggccatggttga

SEQ ID NO: 7657697 - DNA, 22 bp, Homo sapiens
aaaaagtattggccatggttga

SEQ ID NO: 7657698 - DNA, 22 bp, Homo sapiens
aaaaaggctaagcatcttgtgc

SEQ ID NO: 7657699 - DNA, 22 bp, Homo sapiens
aaaaaggctaagcatcttgtgc

SEQ ID NO: 7657700 - DNA, 22 bp, Homo sapiens
aaaaagcttaaatgagcagttc

SEQ ID NO: 7657701 - DNA, 22 bp, Homo sapiens
aaaaaggctaagcatcttgtgc

SEQ ID NO: 7657702 - DNA, 22 bp, Homo sapiens
aaaaaggctaagcatcttgtgc

SEQ ID NO: 7657703 - DNA, 22 bp, Homo sapiens
aaaaagcttaaatgagcagttc

SEQ ID NO: 7657704 - DNA, 22 bp, Homo sapiens
aaaaagcttaaatgagcagttc

SEQ ID NO: 7657705 - DNA, 22 bp, Homo sapiens
aaaaagggatttgtgatccagg

SEQ ID NO: 7657706 - DNA, 22 bp, Homo sapiens
aaaaaggctaagcatcttgtgc

SEQ ID NO: 7657707 - DNA, 21 bp, Homo sapiens
aaaaagctggggcatgcatgc

SEQ ID NO: 7657708 - DNA, 21 bp, Homo sapiens
aaaaagctggggcatgcatgc

SEQ ID NO: 7657709 - DNA, 21 bp, Homo sapiens
aaaaagctggggcatgcatgc

SEQ ID NO: 7657710 - DNA, 22 bp, Homo sapiens
aaaaagcttaaatgagcagttc

SEQ ID NO: 7657711 - DNA, 21 bp, Homo sapiens
aaaaagctggggcatgcatgc

SEQ ID NO: 7657712 - DNA, 22 bp, Homo sapiens
aaaaagcttaaatgagcagttc

SEQ ID NO: 7657713 - DNA, 22 bp, Homo sapiens
aaaaagatgtcctgaagtttag

SEQ ID NO: 7657714 - DNA, 22 bp, Homo sapiens
aaaaactggtaactattcccca

SEQ ID NO: 7657715 - DNA, 22 bp, Homo sapiens
aaaaagatgtcctgaagtttag

SEQ ID NO: 7657716 - DNA, 22 bp, Homo sapiens
aaaaactggtaactattcccca

SEQ ID NO: 7657717 - DNA, 22 bp, Homo sapiens
aaaaactgcaattacttttgtc

SEQ ID NO: 7657718 - DNA, 22 bp, Homo sapiens
aaaaactgcaattacttttgtc

SEQ ID NO: 7657719 - DNA, 22 bp, Homo sapiens
aaaaatacttcacttctgggtg

SEQ ID NO: 7657720 - DNA, 22 bp, Homo sapiens
aaaaatacttcacttctgggtg

SEQ ID NO: 7657721 - DNA, 22 bp, Homo sapiens
aaaaggaggcaaacagcctaga

SEQ ID NO: 7657722 - DNA, 22 bp, Homo sapiens
aaaaatacttcacttctgggtg

SEQ ID NO: 7657723 - DNA, 22 bp, Homo sapiens
aaaaatacttcacttctgggtg

SEQ ID NO: 7657724 - DNA, 22 bp, Homo sapiens
aaaaatacttcacttctgggtg

SEQ ID NO: 7657725 - DNA, 21 bp, Homo sapiens
aaaaggaggcaggtgaacagc

SEQ ID NO: 7657726 - DNA, 21 bp, Homo sapiens
aaaaggaggcaggtgaacagc

SEQ ID NO: 7657727 - DNA, 22 bp, Homo sapiens
aaaaggaggtcactttattcct

SEQ ID NO: 7657728 - DNA, 21 bp, Homo sapiens
aaaaggaggcaggtgaacagc

SEQ ID NO: 7657729 - DNA, 21 bp, Homo sapiens
aaaaggaggcaggtgaacagc

SEQ ID NO: 7657730 - DNA, 21 bp, Homo sapiens
aaaaggaggcaggtgaacagc

SEQ ID NO: 7657731 - DNA, 22 bp, Homo sapiens
aaaaggaggtcactttattcct

SEQ ID NO: 7657732 - DNA, 22 bp, Homo sapiens
aaaaggaggtcactttattcct

SEQ ID NO: 7657733 - DNA, 22 bp, Homo sapiens
aaaaggatcagattttgagcag

SEQ ID NO: 7657734 - DNA, 22 bp, Homo sapiens
aaaaagtttcaactgccaactc

SEQ ID NO: 7657735 - DNA, 22 bp, Homo sapiens
aaaaagtttcaactgccaactc

SEQ ID NO: 7657736 - DNA, 22 bp, Homo sapiens
aaaaagtttcaactgccaactc

SEQ ID NO: 7657737 - DNA, 22 bp, Homo sapiens
aaaaatacttcacttctgggtg

SEQ ID NO: 7657738 - DNA, 22 bp, Homo sapiens
aaaaatacttcacttctgggtg

SEQ ID NO: 7657739 - DNA, 22 bp, Homo sapiens
aaaaatacttcacttctgggtg

SEQ ID NO: 7657740 - DNA, 22 bp, Homo sapiens
aaaaagtttcaactgccaactc

SEQ ID NO: 7657741 - DNA, 18 bp, Homo sapiens
aaaaagtgctcaggccta

SEQ ID NO: 7657742 - DNA, 22 bp, Homo sapiens
aaaaagtctgcaaaggaggttg

SEQ ID NO: 7657743 - DNA, 22 bp, Homo sapiens
aaaaagtcatattcttgttcct

SEQ ID NO: 7657744 - DNA, 22 bp, Homo sapiens
aaaaagtcatattcttgttcct

SEQ ID NO: 7657745 - DNA, 22 bp, Homo sapiens
aaaaagtcatattcttgttcct

SEQ ID NO: 7657746 - DNA, 22 bp, Homo sapiens
aaaaagtcatattcttgttcct

SEQ ID NO: 7657747 - DNA, 22 bp, Homo sapiens
aaaaagtattggccatggttga

SEQ ID NO: 7657748 - DNA, 22 bp, Homo sapiens
aaaaagtattggccatggttga

SEQ ID NO: 7657749 - DNA, 22 bp, Homo sapiens
aaaaagtattggccatggttga

SEQ ID NO: 7657750 - DNA, 22 bp, Homo sapiens
aaaaagtattggccatggttga

SEQ ID NO: 7657751 - DNA, 22 bp, Homo sapiens
aaaacagtttttgctaactgct

SEQ ID NO: 7657752 - DNA, 22 bp, Homo sapiens
aaaaggctcttcaaaatggaag

SEQ ID NO: 7657753 - DNA, 22 bp, Homo sapiens
aaaaggctcttcaaaatggaag

SEQ ID NO: 7657754 - DNA, 22 bp, Homo sapiens
aaaaggctagctagtaacagaa

SEQ ID NO: 7657755 - DNA, 22 bp, Homo sapiens
aaaaggctagctagtaacagaa

SEQ ID NO: 7657756 - DNA, 22 bp, Homo sapiens
aaaaggctagctagtaacagaa

SEQ ID NO: 7657757 - DNA, 22 bp, Homo sapiens
aaaaggctaattaagttttgga

SEQ ID NO: 7657758 - DNA, 22 bp, Homo sapiens
aaaaggctaattaagttttgga

SEQ ID NO: 7657759 - DNA, 22 bp, Homo sapiens
aaaaggctaattaagttttgga

SEQ ID NO: 7657760 - DNA, 22 bp, Homo sapiens
aaaaggctaatccagagcaact

SEQ ID NO: 7657761 - DNA, 22 bp, Homo sapiens
aaaaggcattttgtcaaccata

SEQ ID NO: 7657762 - DNA, 22 bp, Homo sapiens
aaaaggctaatccagagcaact

SEQ ID NO: 7657763 - DNA, 22 bp, Homo sapiens
aaaaggctaatccagagcaact

SEQ ID NO: 7657764 - DNA, 22 bp, Homo sapiens
aaaaggcattttgtcaaccata

SEQ ID NO: 7657765 - DNA, 22 bp, Homo sapiens
aaaaggcattttgtcaaccata

SEQ ID NO: 7657766 - DNA, 22 bp, Homo sapiens
aaaaggcattttgtcaaccata

SEQ ID NO: 7657767 - DNA, 22 bp, Homo sapiens
aaaaggcatggaggttgatagt

SEQ ID NO: 7657768 - DNA, 22 bp, Homo sapiens
aaaaggcatggaggttgatagt

SEQ ID NO: 7657769 - DNA, 22 bp, Homo sapiens
aaaaggcattttgtcaaccata

SEQ ID NO: 7657770 - DNA, 22 bp, Homo sapiens
aaaaggcattttgtcaaccata

SEQ ID NO: 7657771 - DNA, 22 bp, Homo sapiens
aaaaggcatggaggttgatagt

SEQ ID NO: 7657772 - DNA, 22 bp, Homo sapiens
aaaaggcatggaggttgatagt

SEQ ID NO: 7657773 - DNA, 22 bp, Homo sapiens
aaaaggcatggaggttgatagt

SEQ ID NO: 7657774 - DNA, 22 bp, Homo sapiens
aaaaggcatggaggttgatagt

SEQ ID NO: 7657775 - DNA, 22 bp, Homo sapiens
aaaaggcagtgcaagagagggt

SEQ ID NO: 7657776 - DNA, 22 bp, Homo sapiens
aaaaggcatggaggttgatagt

SEQ ID NO: 7657777 - DNA, 22 bp, Homo sapiens
aaaaggcagtgcaagagagggt

SEQ ID NO: 7657778 - DNA, 22 bp, Homo sapiens
aaaaggcatggaggttgatagt

SEQ ID NO: 7657779 - DNA, 22 bp, Homo sapiens
aaaaggcatggaggttgatagt

SEQ ID NO: 7657780 - DNA, 22 bp, Homo sapiens
aaaaggcagtgcaagagagggt

SEQ ID NO: 7657781 - DNA, 22 bp, Homo sapiens
aaaaggcagtgcaagagagggt

SEQ ID NO: 7657782 - DNA, 22 bp, Homo sapiens
aaaaggatgttttcatgaaaca

SEQ ID NO: 7657783 - DNA, 22 bp, Homo sapiens
aaaaggatgttttcatgaaaca

SEQ ID NO: 7657784 - DNA, 22 bp, Homo sapiens
aaaaggatgttttcatgaaaca

SEQ ID NO: 7657785 - DNA, 22 bp, Homo sapiens
aaaaggatgttttcatgaaaca

SEQ ID NO: 7657786 - DNA, 22 bp, Homo sapiens
aaaaggcagtgcaagagagggt

SEQ ID NO: 7657787 - DNA, 22 bp, Homo sapiens
aaaaggcagtgcaagagagggt

SEQ ID NO: 7657788 - DNA, 22 bp, Homo sapiens
aaaaggcagtgcaagagagggt

SEQ ID NO: 7657789 - DNA, 22 bp, Homo sapiens
aaaaggcagtgcaagagagggt

SEQ ID NO: 7657790 - DNA, 22 bp, Homo sapiens
aaaaggcagtgcaagagagggt

SEQ ID NO: 7657791 - DNA, 22 bp, Homo sapiens
aaaaggatgttttcatgaaaca

SEQ ID NO: 7657792 - DNA, 22 bp, Homo sapiens
aaaaggatgttttcatgaaaca

SEQ ID NO: 7657793 - DNA, 22 bp, Homo sapiens
aaaaggcagtgcaagagagggt

SEQ ID NO: 7657794 - DNA, 22 bp, Homo sapiens
aaaacataaactgacagcccat

SEQ ID NO: 7657795 - DNA, 22 bp, Homo sapiens
aaaacataaactgacagcccat

SEQ ID NO: 7657796 - DNA, 22 bp, Homo sapiens
aaaacataaactgacagcccat

SEQ ID NO: 7657797 - DNA, 22 bp, Homo sapiens
aaaacataaactgacagcccat

SEQ ID NO: 7657798 - DNA, 22 bp, Homo sapiens
aaaacataaactgacagcccat

SEQ ID NO: 7657799 - DNA, 22 bp, Homo sapiens
aaaaccaggcttgctgtgctcg

SEQ ID NO: 7657800 - DNA, 22 bp, Homo sapiens
aaaaccaggtagcaaaggagac

SEQ ID NO: 7657801 - DNA, 22 bp, Homo sapiens
aaaaccttctagactttatatt

SEQ ID NO: 7657802 - DNA, 22 bp, Homo sapiens
aaaaccttcaggtttggagttt

SEQ ID NO: 7657803 - DNA, 22 bp, Homo sapiens
aaaacctgattgaattctattt

SEQ ID NO: 7657804 - DNA, 22 bp, Homo sapiens
aaaacctgattgaattctattt

SEQ ID NO: 7657805 - DNA, 22 bp, Homo sapiens
aaaacctgtgaatagttaactc

SEQ ID NO: 7657806 - DNA, 22 bp, Homo sapiens
aaaacctcagttctgctcttaa

SEQ ID NO: 7657807 - DNA, 22 bp, Homo sapiens
aaaacctcagttctgctcttaa

SEQ ID NO: 7657808 - DNA, 22 bp, Homo sapiens
aaaacccttctgcagactctga

SEQ ID NO: 7657809 - DNA, 22 bp, Homo sapiens
aaaacctcagttctgctcttaa

SEQ ID NO: 7657810 - DNA, 22 bp, Homo sapiens
aaaacctgattgaattctattt

SEQ ID NO: 7657811 - DNA, 22 bp, Homo sapiens
aaaacctgattgaattctattt

SEQ ID NO: 7657812 - DNA, 22 bp, Homo sapiens
aaaactacatttgacattttgt

SEQ ID NO: 7657813 - DNA, 22 bp, Homo sapiens
aaaactacatttgacattttgt

SEQ ID NO: 7657814 - DNA, 22 bp, Homo sapiens
aaaactaaatacgctttgcctc

SEQ ID NO: 7657815 - DNA, 22 bp, Homo sapiens
aaaactaaatacgctttgcctc

SEQ ID NO: 7657816 - DNA, 22 bp, Homo sapiens
aaaactacatttgacattttgt

SEQ ID NO: 7657817 - DNA, 22 bp, Homo sapiens
aaaactacatttgacattttgt

SEQ ID NO: 7657818 - DNA, 22 bp, Homo sapiens
aaaactacatttgacattttgt

SEQ ID NO: 7657819 - DNA, 22 bp, Homo sapiens
aaaacgttatgcattgtttatc

SEQ ID NO: 7657820 - DNA, 22 bp, Homo sapiens
aaaacgatgtttaaaagctctg

SEQ ID NO: 7657821 - DNA, 22 bp, Homo sapiens
aaaaccttctagactttatatt

SEQ ID NO: 7657822 - DNA, 22 bp, Homo sapiens
aaaactctgcagttagtttcta

SEQ ID NO: 7657823 - DNA, 22 bp, Homo sapiens
aaaactctgcagttagtttcta

SEQ ID NO: 7657824 - DNA, 22 bp, Homo sapiens
aaaactctgcagttagtttcta

SEQ ID NO: 7657825 - DNA, 22 bp, Homo sapiens
aaaactcaaacattttggcata

SEQ ID NO: 7657826 - DNA, 22 bp, Homo sapiens
aaaactgaaccttgagatcttt

SEQ ID NO: 7657827 - DNA, 22 bp, Homo sapiens
aaaactgaaccttgagatcttt

SEQ ID NO: 7657828 - DNA, 22 bp, Homo sapiens
aaaactctgcagttagtttcta

SEQ ID NO: 7657829 - DNA, 22 bp, Homo sapiens
aaaactctgcagttagtttcta

SEQ ID NO: 7657830 - DNA, 22 bp, Homo sapiens
aaagagctggcatttatagtct

SEQ ID NO: 7657831 - DNA, 22 bp, Homo sapiens
aaagagctgatagcatctgttt

SEQ ID NO: 7657832 - DNA, 22 bp, Homo sapiens
aaagagctgggacttaaagtgc

SEQ ID NO: 7657833 - DNA, 22 bp, Homo sapiens
aaagagctggcatttatagtct

SEQ ID NO: 7657834 - DNA, 22 bp, Homo sapiens
aaagagctgatagcatctgttt

SEQ ID NO: 7657835 - DNA, 22 bp, Homo sapiens
aaagagctgagacctggtggag

SEQ ID NO: 7657836 - DNA, 22 bp, Homo sapiens
aaagagctcttactctagtgta

SEQ ID NO: 7657837 - DNA, 22 bp, Homo sapiens
aaagagctcttactctagtgta

SEQ ID NO: 7657838 - DNA, 22 bp, Homo sapiens
aaagagctcggaaagtgttgaa

SEQ ID NO: 7657839 - DNA, 22 bp, Homo sapiens
aaagagctcacagtccactgga

SEQ ID NO: 7657840 - DNA, 22 bp, Homo sapiens
aaagagctcacagtccactgga

SEQ ID NO: 7657841 - DNA, 22 bp, Homo sapiens
aaagagctcacagtccactgga

SEQ ID NO: 7657842 - DNA, 22 bp, Homo sapiens
aaagagctatacaaccatgtcc

SEQ ID NO: 7657843 - DNA, 22 bp, Homo sapiens
aaagagctgggacttaaagtgc

SEQ ID NO: 7657844 - DNA, 22 bp, Homo sapiens
aaagagcttcatttccatttat

SEQ ID NO: 7657845 - DNA, 22 bp, Homo sapiens
aaacacaagaggcagggtacag

SEQ ID NO: 7657846 - DNA, 17 bp, Homo sapiens
aaagagcttggagtgtt

SEQ ID NO: 7657847 - DNA, 17 bp, Homo sapiens
aaagagcttggagtgtt

SEQ ID NO: 7657848 - DNA, 17 bp, Homo sapiens
aaagagcttggagtgtt

SEQ ID NO: 7657849 - DNA, 22 bp, Homo sapiens
aaagagcttgcttgctttatat

SEQ ID NO: 7657850 - DNA, 22 bp, Homo sapiens
aaagagcttgcttgctttatat

SEQ ID NO: 7657851 - DNA, 17 bp, Homo sapiens
aaagagcttggagtgtt

SEQ ID NO: 7657852 - DNA, 22 bp, Homo sapiens
aaacacaagaggcagggtacag

SEQ ID NO: 7657853 - DNA, 22 bp, Homo sapiens
aaacacaagatggcctcttctg

SEQ ID NO: 7657854 - DNA, 22 bp, Homo sapiens
aaacacaagatggcctcttctg

SEQ ID NO: 7657855 - DNA, 22 bp, Homo sapiens
aaacacatcattcatgtcgtca

SEQ ID NO: 7657856 - DNA, 22 bp, Homo sapiens
aaacaccagcactgtttacaaa

SEQ ID NO: 7657857 - DNA, 22 bp, Homo sapiens
aaacaccaagagctagctatta

SEQ ID NO: 7657858 - DNA, 22 bp, Homo sapiens
aaacaccaagagctagctatta

SEQ ID NO: 7657859 - DNA, 22 bp, Homo sapiens
aaacaccaagagctagctatta

SEQ ID NO: 7657860 - DNA, 22 bp, Homo sapiens
aaacaccaagagctagctatta

SEQ ID NO: 7657861 - DNA, 22 bp, Homo sapiens
aaacaccagtcccagtatacac

SEQ ID NO: 7657862 - DNA, 22 bp, Homo sapiens
aaacaccagtcccagtatacac

SEQ ID NO: 7657863 - DNA, 22 bp, Homo sapiens
aaacactaataacagtggctgg

SEQ ID NO: 7657864 - DNA, 22 bp, Homo sapiens
aaacaccagtcccagtatacac

SEQ ID NO: 7657865 - DNA, 22 bp, Homo sapiens
aaacaccagtcccagtatacac

SEQ ID NO: 7657866 - DNA, 22 bp, Homo sapiens
aaacaccagtcccagtatacac

SEQ ID NO: 7657867 - DNA, 22 bp, Homo sapiens
aaacactagcaggaagcactga

SEQ ID NO: 7657868 - DNA, 22 bp, Homo sapiens
aaacactagcaggaagcactga

SEQ ID NO: 7657869 - DNA, 22 bp, Homo sapiens
aaacactcatgtgttactctcc

SEQ ID NO: 7657870 - DNA, 22 bp, Homo sapiens
aaacactcatgtgttactctcc

SEQ ID NO: 7657871 - DNA, 22 bp, Homo sapiens
aaacactcatgtgttactctcc

SEQ ID NO: 7657872 - DNA, 22 bp, Homo sapiens
aaacactaataacagtggctgg

SEQ ID NO: 7657873 - DNA, 22 bp, Homo sapiens
aaacactagcaggaagcactga

SEQ ID NO: 7657874 - DNA, 22 bp, Homo sapiens
aaacactaataacagtggctgg

SEQ ID NO: 7657875 - DNA, 22 bp, Homo sapiens
aaacactagcaggaagcactga

SEQ ID NO: 7657876 - DNA, 22 bp, Homo sapiens
aaacaccaagagctagctatta

SEQ ID NO: 7657877 - DNA, 22 bp, Homo sapiens
aaacaccaagagctagctatta

SEQ ID NO: 7657878 - DNA, 22 bp, Homo sapiens
aaacaccaagagctagctatta

SEQ ID NO: 7657879 - DNA, 22 bp, Homo sapiens
aaacacattttaggaaaatcta

SEQ ID NO: 7657880 - DNA, 22 bp, Homo sapiens
aaacacattttaggaaaatcta

SEQ ID NO: 7657881 - DNA, 22 bp, Homo sapiens
aaacacattttaggaaaatcta

SEQ ID NO: 7657882 - DNA, 22 bp, Homo sapiens
aaacacattttaggaaaatcta

SEQ ID NO: 7657883 - DNA, 22 bp, Homo sapiens
aaacacattttaggaaaatcta

SEQ ID NO: 7657884 - DNA, 22 bp, Homo sapiens
aaacacattttaggaaaatcta

SEQ ID NO: 7657885 - DNA, 22 bp, Homo sapiens
aaacacattttaggaaaatcta

SEQ ID NO: 7657886 - DNA, 22 bp, Homo sapiens
aaacacattagccctgtggaaa

SEQ ID NO: 7657887 - DNA, 22 bp, Homo sapiens
aaacacattagccctgtggaaa

SEQ ID NO: 7657888 - DNA, 22 bp, Homo sapiens
aaacacattagccctgtggaaa

SEQ ID NO: 7657889 - DNA, 22 bp, Homo sapiens
aaacacattagccctgtggaaa

SEQ ID NO: 7657890 - DNA, 22 bp, Homo sapiens
aaacacattagccctgtggaaa

SEQ ID NO: 7657891 - DNA, 22 bp, Homo sapiens
aaacacattagccctgtggaaa

SEQ ID NO: 7657892 - DNA, 22 bp, Homo sapiens
aaacacattttaggaaaatcta

SEQ ID NO: 7657893 - DNA, 22 bp, Homo sapiens
aaacacattttaggaaaatcta

SEQ ID NO: 7657894 - DNA, 22 bp, Homo sapiens
aaacacattttaggaaaatcta

SEQ ID NO: 7657895 - DNA, 22 bp, Homo sapiens
aaacacattttaggaaaatcta

SEQ ID NO: 7657896 - DNA, 22 bp, Homo sapiens
aaaatgtgatctacaaatgcaa

SEQ ID NO: 7657897 - DNA, 22 bp, Homo sapiens
aaaattcattcctcagactgcc

SEQ ID NO: 7657898 - DNA, 22 bp, Homo sapiens
aaaattcattcctcagactgcc

SEQ ID NO: 7657899 - DNA, 22 bp, Homo sapiens
aaaattcattcctcagactgcc

SEQ ID NO: 7657900 - DNA, 22 bp, Homo sapiens
aaaattctcttgatcttgacag

SEQ ID NO: 7657901 - DNA, 22 bp, Homo sapiens
aaaattctcttgatcttgacag

SEQ ID NO: 7657902 - DNA, 22 bp, Homo sapiens
aaaattctcttgatcttgacag

SEQ ID NO: 7657903 - DNA, 22 bp, Homo sapiens
aaaattctcttgatcttgacag

SEQ ID NO: 7657904 - DNA, 22 bp, Homo sapiens
aaaattctaacatgcagccaag

SEQ ID NO: 7657905 - DNA, 17 bp, Homo sapiens
aaaattctgtaaagagg

SEQ ID NO: 7657906 - DNA, 17 bp, Homo sapiens
aaaattctgtaaagagg

SEQ ID NO: 7657907 - DNA, 22 bp, Homo sapiens
aaaattctcttgatcttgacag

SEQ ID NO: 7657908 - DNA, 22 bp, Homo sapiens
aaaattctcttgatcttgacag

SEQ ID NO: 7657909 - DNA, 22 bp, Homo sapiens
aaaattgagagtcttgtgcaag

SEQ ID NO: 7657910 - DNA, 22 bp, Homo sapiens
aaaattgaagtgatcaggaact

SEQ ID NO: 7657911 - DNA, 22 bp, Homo sapiens
aaaattgaagtgatcaggaact

SEQ ID NO: 7657912 - DNA, 22 bp, Homo sapiens
aaaattgaagtgatcaggaact

SEQ ID NO: 7657913 - DNA, 22 bp, Homo sapiens
aaaattgaagtgatcaggaact

SEQ ID NO: 7657914 - DNA, 22 bp, Homo sapiens
aaaattgaagtgatcaggaact

SEQ ID NO: 7657915 - DNA, 22 bp, Homo sapiens
aaaattctgtcattaaattgtg

SEQ ID NO: 7657916 - DNA, 17 bp, Homo sapiens
aaaattctgtaaagagg

SEQ ID NO: 7657917 - DNA, 17 bp, Homo sapiens
aaaattctgtaaagagg

SEQ ID NO: 7657918 - DNA, 17 bp, Homo sapiens
aaaattctgtaaagagg

SEQ ID NO: 7657919 - DNA, 22 bp, Homo sapiens
aaaattctgtcattaaattgtg

SEQ ID NO: 7657920 - DNA, 22 bp, Homo sapiens
aaaattctgtcattaaattgtg

SEQ ID NO: 7657921 - DNA, 17 bp, Homo sapiens
aaaattctgtaaagagg

SEQ ID NO: 7657922 - DNA, 17 bp, Homo sapiens
aaaattctgtaaagagg

SEQ ID NO: 7657923 - DNA, 22 bp, Homo sapiens
aaaattctgtcattaaattgtg

SEQ ID NO: 7657924 - DNA, 22 bp, Homo sapiens
aaaattctgtcattaaattgtg

SEQ ID NO: 7657925 - DNA, 22 bp, Homo sapiens
aaaattctgtcattaaattgtg

SEQ ID NO: 7657926 - DNA, 22 bp, Homo sapiens
aaagagcccttccatgactctt

SEQ ID NO: 7657927 - DNA, 20 bp, Homo sapiens
aaagagcccttggagcaggc

SEQ ID NO: 7657928 - DNA, 20 bp, Homo sapiens
aaagagcccttggagcaggc

SEQ ID NO: 7657929 - DNA, 22 bp, Homo sapiens
aaagagcctatattcagctgca

SEQ ID NO: 7657930 - DNA, 22 bp, Homo sapiens
aaagagcctatattcagctgca

SEQ ID NO: 7657931 - DNA, 22 bp, Homo sapiens
aaagagccgctgatgtcagccc

SEQ ID NO: 7657932 - DNA, 22 bp, Homo sapiens
aaagagcctatattcagctgca

SEQ ID NO: 7657933 - DNA, 22 bp, Homo sapiens
aaagagctatacaaccatgtcc

SEQ ID NO: 7657934 - DNA, 22 bp, Homo sapiens
aaagagctaacattgccgagat

SEQ ID NO: 7657935 - DNA, 22 bp, Homo sapiens
aaagagctaacattgccgagat

SEQ ID NO: 7657936 - DNA, 22 bp, Homo sapiens
aaagagctaacattgccgagat

SEQ ID NO: 7657937 - DNA, 22 bp, Homo sapiens
aaagagctaacattgccgagat

SEQ ID NO: 7657938 - DNA, 22 bp, Homo sapiens
aaagagccagctacctcagttt

SEQ ID NO: 7657939 - DNA, 18 bp, Homo sapiens
aaagagccacccagggcc

SEQ ID NO: 7657940 - DNA, 22 bp, Homo sapiens
aaaattggttcctttctgaggc

SEQ ID NO: 7657941 - DNA, 22 bp, Homo sapiens
aaagagccagggcattaggtga

SEQ ID NO: 7657942 - DNA, 21 bp, Homo sapiens
aaagagcccgctgagaggttc

SEQ ID NO: 7657943 - DNA, 22 bp, Homo sapiens
aaagagcccttccatgactctt

SEQ ID NO: 7657944 - DNA, 22 bp, Homo sapiens
aaaattgagagtcttgtgcaag

SEQ ID NO: 7657945 - DNA, 22 bp, Homo sapiens
aaaattgagagttatagatggt

SEQ ID NO: 7657946 - DNA, 22 bp, Homo sapiens
aaaattgagagttatagatggt

SEQ ID NO: 7657947 - DNA, 22 bp, Homo sapiens
aaaattgaggctcatgttaaat

SEQ ID NO: 7657948 - DNA, 22 bp, Homo sapiens
aaaattgaggctcatgttaaat

SEQ ID NO: 7657949 - DNA, 22 bp, Homo sapiens
aaaattgaggctcatgttaaat

SEQ ID NO: 7657950 - DNA, 22 bp, Homo sapiens
aaaattgaggctcatgttaaat

SEQ ID NO: 7657951 - DNA, 22 bp, Homo sapiens
aaaattgaggctcatgttaaat

SEQ ID NO: 7657952 - DNA, 19 bp, Homo sapiens
aaaattgcgtattttgagg

SEQ ID NO: 7657953 - DNA, 22 bp, Homo sapiens
aaaattgaggctcatgttaaat

SEQ ID NO: 7657954 - DNA, 22 bp, Homo sapiens
aaacaggtagccctagccttct

SEQ ID NO: 7657955 - DNA, 22 bp, Homo sapiens
aaacaggtctgaaaatagctac

SEQ ID NO: 7657956 - DNA, 22 bp, Homo sapiens
aaacaggtctgaaaatagctac

SEQ ID NO: 7657957 - DNA, 22 bp, Homo sapiens
aaacaggcttttaagtcaatag

SEQ ID NO: 7657958 - DNA, 22 bp, Homo sapiens
aaacaggcttttaagtcaatag

SEQ ID NO: 7657959 - DNA, 22 bp, Homo sapiens
aaacaggcttgcaacatgtttt

SEQ ID NO: 7657960 - DNA, 22 bp, Homo sapiens
aaacaggcttgcaacatgtttt

SEQ ID NO: 7657961 - DNA, 22 bp, Homo sapiens
aaacaggcttgcaacatgtttt

SEQ ID NO: 7657962 - DNA, 22 bp, Homo sapiens
aaacaggcttccattagagcaa

SEQ ID NO: 7657963 - DNA, 22 bp, Homo sapiens
aaacaggcttccattagagcaa

SEQ ID NO: 7657964 - DNA, 22 bp, Homo sapiens
aaacaggctctgcgggatgctc

SEQ ID NO: 7657965 - DNA, 19 bp, Homo sapiens
aaacaggccgagtgcctaa

SEQ ID NO: 7657966 - DNA, 22 bp, Homo sapiens
aaacaggcatcactcagcaaag

SEQ ID NO: 7657967 - DNA, 22 bp, Homo sapiens
aaacaggcatcactcagcaaag

SEQ ID NO: 7657968 - DNA, 22 bp, Homo sapiens
aaacaggcatcactcagcaaag

SEQ ID NO: 7657969 - DNA, 22 bp, Homo sapiens
aaacaggagttgaccaagtaca

SEQ ID NO: 7657970 - DNA, 22 bp, Homo sapiens
aaacaggcacatagtaacattt

SEQ ID NO: 7657971 - DNA, 22 bp, Homo sapiens
aaacaggcacatagtaacattt

SEQ ID NO: 7657972 - DNA, 22 bp, Homo sapiens
aaacagctttcagaatctctca

SEQ ID NO: 7657973 - DNA, 22 bp, Homo sapiens
aaacagctttcagaatctctca

SEQ ID NO: 7657974 - DNA, 22 bp, Homo sapiens
aaacaggagttgaccaagtaca

SEQ ID NO: 7657975 - DNA, 22 bp, Homo sapiens
aaacaggagttgaccaagtaca

SEQ ID NO: 7657976 - DNA, 22 bp, Homo sapiens
aaacagtaagttctagtattat

SEQ ID NO: 7657977 - DNA, 22 bp, Homo sapiens
aaacagtaagttctagtattat

SEQ ID NO: 7657978 - DNA, 22 bp, Homo sapiens
aaacaggtctgaaaatagctac

SEQ ID NO: 7657979 - DNA, 22 bp, Homo sapiens
aaacagtaagttctagtattat

SEQ ID NO: 7657980 - DNA, 22 bp, Homo sapiens
aaacagtactcgatttttgtag

SEQ ID NO: 7657981 - DNA, 22 bp, Homo sapiens
aaacagtaagttctagtattat

SEQ ID NO: 7657982 - DNA, 22 bp, Homo sapiens
aaacagtactcgatttttgtag

SEQ ID NO: 7657983 - DNA, 22 bp, Homo sapiens
aaacagtactcgatttttgtag

SEQ ID NO: 7657984 - DNA, 22 bp, Homo sapiens
aaacagtactcgatttttgtag

SEQ ID NO: 7657985 - DNA, 22 bp, Homo sapiens
aaacagtagaagtgtattttat

SEQ ID NO: 7657986 - DNA, 22 bp, Homo sapiens
aaacagtagaagtgtattttat

SEQ ID NO: 7657987 - DNA, 22 bp, Homo sapiens
aaacagtagaagtgtattttat

SEQ ID NO: 7657988 - DNA, 22 bp, Homo sapiens
aaacagtagaagtgtattttat

SEQ ID NO: 7657989 - DNA, 22 bp, Homo sapiens
aaacagtattatcaatatattt

SEQ ID NO: 7657990 - DNA, 22 bp, Homo sapiens
aaacagtattatcaatatattt

SEQ ID NO: 7657991 - DNA, 22 bp, Homo sapiens
aaacagtattatcaatatattt

SEQ ID NO: 7657992 - DNA, 22 bp, Homo sapiens
aaacagtattatcaatatattt

SEQ ID NO: 7657993 - DNA, 22 bp, Homo sapiens
aaacagtattatcaatatattt

SEQ ID NO: 7657994 - DNA, 20 bp, Homo sapiens
aaaatatgtataactcttct

SEQ ID NO: 7657995 - DNA, 20 bp, Homo sapiens
aaaatatgtataactcttct

SEQ ID NO: 7657996 - DNA, 20 bp, Homo sapiens
aaaatatgtataactcttct

SEQ ID NO: 7657997 - DNA, 20 bp, Homo sapiens
aaaatatgtataactcttct

SEQ ID NO: 7657998 - DNA, 20 bp, Homo sapiens
aaaatatgtataactcttct

SEQ ID NO: 7657999 - DNA, 20 bp, Homo sapiens
aaaatatgtataactcttct

SEQ ID NO: 7658000 - DNA, 20 bp, Homo sapiens
aaaatatgtataactcttct

SEQ ID NO: 7658001 - DNA, 22 bp, Homo sapiens
aaaatatggggtgagcccagag

SEQ ID NO: 7658002 - DNA, 22 bp, Homo sapiens
aaaatatgaagttgtcagtatg

SEQ ID NO: 7658003 - DNA, 22 bp, Homo sapiens
aaaatatgaagttgtcagtatg

SEQ ID NO: 7658004 - DNA, 22 bp, Homo sapiens
aaaatatgactgtgctccttaa

SEQ ID NO: 7658005 - DNA, 22 bp, Homo sapiens
aaaatatgactgtgctccttaa

SEQ ID NO: 7658006 - DNA, 22 bp, Homo sapiens
aaaatatgactgtgctccttaa

SEQ ID NO: 7658007 - DNA, 22 bp, Homo sapiens
aaaatatggggtgagcccagag

SEQ ID NO: 7658008 - DNA, 22 bp, Homo sapiens
aaaatagttaacgttcagagta

SEQ ID NO: 7658009 - DNA, 22 bp, Homo sapiens
aaaatatcagcaaagggtgaca

SEQ ID NO: 7658010 - DNA, 22 bp, Homo sapiens
aaaatactgtggagtgttgaaa

SEQ ID NO: 7658011 - DNA, 22 bp, Homo sapiens
aaaatactgtggagtgttgaaa

SEQ ID NO: 7658012 - DNA, 22 bp, Homo sapiens
aaaatatgaagttgtcagtatg

SEQ ID NO: 7658013 - DNA, 22 bp, Homo sapiens
aaaatatgaagttgtcagtatg

SEQ ID NO: 7658014 - DNA, 22 bp, Homo sapiens
aaaatatgaagttgtcagtatg

SEQ ID NO: 7658015 - DNA, 22 bp, Homo sapiens
aaaatatgaagttgtcagtatg

SEQ ID NO: 7658016 - DNA, 22 bp, Homo sapiens
aaaatatcagcaaagggtgaca

SEQ ID NO: 7658017 - DNA, 22 bp, Homo sapiens
aaaatatcagcaaagggtgaca

SEQ ID NO: 7658018 - DNA, 22 bp, Homo sapiens
aaacagtattatcaatatattt

SEQ ID NO: 7658019 - DNA, 22 bp, Homo sapiens
aaacagtattatcaatatattt

SEQ ID NO: 7658020 - DNA, 22 bp, Homo sapiens
aaacagtattatcaatatattt

SEQ ID NO: 7658021 - DNA, 22 bp, Homo sapiens
aaacagtattatcaatatattt

SEQ ID NO: 7658022 - DNA, 22 bp, Homo sapiens
aaaatactgtggagtgttgaaa

SEQ ID NO: 7658023 - DNA, 22 bp, Homo sapiens
aaacagtcctctttatttagtc

SEQ ID NO: 7658024 - DNA, 22 bp, Homo sapiens
aaacagtcaaaggcctaagcta

SEQ ID NO: 7658025 - DNA, 22 bp, Homo sapiens
aaaatactgtggagtgttgaaa

SEQ ID NO: 7658026 - DNA, 21 bp, Homo sapiens
aaaatgtgagcgtgatgctta

SEQ ID NO: 7658027 - DNA, 22 bp, Homo sapiens
aaactggtagcaatttaagggt

SEQ ID NO: 7658028 - DNA, 22 bp, Homo sapiens
aaactggtattcaaatgtttgg

SEQ ID NO: 7658029 - DNA, 22 bp, Homo sapiens
aaactggtagcaatttaagggt

SEQ ID NO: 7658030 - DNA, 22 bp, Homo sapiens
aaactggtaatcggcaagtgag

SEQ ID NO: 7658031 - DNA, 22 bp, Homo sapiens
aaactggtaatcggcaagtgag

SEQ ID NO: 7658032 - DNA, 22 bp, Homo sapiens
aaactggtaataaaatggatta

SEQ ID NO: 7658033 - DNA, 22 bp, Homo sapiens
aaactggattaccaggctggtg

SEQ ID NO: 7658034 - DNA, 22 bp, Homo sapiens
aaactggattaccaggctggtg

SEQ ID NO: 7658035 - DNA, 22 bp, Homo sapiens
aaactggattaccaggctggtg

SEQ ID NO: 7658036 - DNA, 22 bp, Homo sapiens
aaactggattaccaggctggtg

SEQ ID NO: 7658037 - DNA, 17 bp, Homo sapiens
aaactggggtcaggagc

SEQ ID NO: 7658038 - DNA, 17 bp, Homo sapiens
aaactggggtcaggagc

SEQ ID NO: 7658039 - DNA, 17 bp, Homo sapiens
aaactggggtcaggagc

SEQ ID NO: 7658040 - DNA, 18 bp, Homo sapiens
aaactggcttggcctgtg

SEQ ID NO: 7658041 - DNA, 22 bp, Homo sapiens
aaactgggattcttcacaaggt

SEQ ID NO: 7658042 - DNA, 22 bp, Homo sapiens
aaactgcatgaagctgatttta

SEQ ID NO: 7658043 - DNA, 22 bp, Homo sapiens
aaactgccaaaagaccttggat

SEQ ID NO: 7658044 - DNA, 22 bp, Homo sapiens
aaactgccaaaagaccttggat

SEQ ID NO: 7658045 - DNA, 22 bp, Homo sapiens
aaactgcatgaagctgatttta

SEQ ID NO: 7658046 - DNA, 23 bp, Homo sapiens
aaactgcatctctgagcctcagc

SEQ ID NO: 7658047 - DNA, 23 bp, Homo sapiens
aaactgcatctctgagcctcagc

SEQ ID NO: 7658048 - DNA, 22 bp, Homo sapiens
aaactgcagccttgagttcagg

SEQ ID NO: 7658049 - DNA, 22 bp, Homo sapiens
aaactgcagccttgagttcagg

SEQ ID NO: 7658050 - DNA, 22 bp, Homo sapiens
aaactgcagccttgagttcagg

SEQ ID NO: 7658051 - DNA, 22 bp, Homo sapiens
aaactgcaggtcatgacccatt

SEQ ID NO: 7658052 - DNA, 22 bp, Homo sapiens
aaactgcaggtcatgacccatt

SEQ ID NO: 7658053 - DNA, 23 bp, Homo sapiens
aaactgcttccaattcctgccat

SEQ ID NO: 7658054 - DNA, 22 bp, Homo sapiens
aaactgctggttgctggccagc

SEQ ID NO: 7658055 - DNA, 22 bp, Homo sapiens
aaactgccacaagagggacatc

SEQ ID NO: 7658056 - DNA, 22 bp, Homo sapiens
aaactgcctcctgggcaactaa

SEQ ID NO: 7658057 - DNA, 22 bp, Homo sapiens
aaactgctgggcatatatttct

SEQ ID NO: 7658058 - DNA, 22 bp, Homo sapiens
aaactgctgggcatatatttct

SEQ ID NO: 7658059 - DNA, 22 bp, Homo sapiens
aaaatattttagggccaggaga

SEQ ID NO: 7658060 - DNA, 22 bp, Homo sapiens
aaaatattttagggccaggaga

SEQ ID NO: 7658061 - DNA, 22 bp, Homo sapiens
aaaatattttagggccaggaga

SEQ ID NO: 7658062 - DNA, 22 bp, Homo sapiens
aaaatattttagggccaggaga

SEQ ID NO: 7658063 - DNA, 22 bp, Homo sapiens
aaactgcacaagggtgcatagc

SEQ ID NO: 7658064 - DNA, 22 bp, Homo sapiens
aaactgcacaagggtgcatagc

SEQ ID NO: 7658065 - DNA, 22 bp, Homo sapiens
aaactgcaattatttttgcaat

SEQ ID NO: 7658066 - DNA, 22 bp, Homo sapiens
aaactgcaattatttttgcaat

SEQ ID NO: 7658067 - DNA, 22 bp, Homo sapiens
aaaatattttagggccaggaga

SEQ ID NO: 7658068 - DNA, 22 bp, Homo sapiens
aaaatattttagggccaggaga

SEQ ID NO: 7658069 - DNA, 22 bp, Homo sapiens
aaactgcacacgatgtgcctga

SEQ ID NO: 7658070 - DNA, 22 bp, Homo sapiens
aaactgcacacgatgtgcctga

SEQ ID NO: 7658071 - DNA, 22 bp, Homo sapiens
aaactgcacaagggtgcatagc

SEQ ID NO: 7658072 - DNA, 22 bp, Homo sapiens
aaactgcacatgaggctggtgc

SEQ ID NO: 7658073 - DNA, 22 bp, Homo sapiens
aaactgcacacgatgtgcctga

SEQ ID NO: 7658074 - DNA, 22 bp, Homo sapiens
aaactgcacacgatgtgcctga

SEQ ID NO: 7658075 - DNA, 22 bp, Homo sapiens
aaactgcagagccatggttcaa

SEQ ID NO: 7658076 - DNA, 22 bp, Homo sapiens
aaactgcagagccatggttcaa

SEQ ID NO: 7658077 - DNA, 22 bp, Homo sapiens
aaactgcactttattttgtcaa

SEQ ID NO: 7658078 - DNA, 22 bp, Homo sapiens
aaactgcacatgaggctggtgc

SEQ ID NO: 7658079 - DNA, 22 bp, Homo sapiens
aaactgcactttattttgtcaa

SEQ ID NO: 7658080 - DNA, 22 bp, Homo sapiens
aaactgcactttattttgtcaa

SEQ ID NO: 7658081 - DNA, 22 bp, Homo sapiens
aaaatattttagggccaggaga

SEQ ID NO: 7658082 - DNA, 22 bp, Homo sapiens
aaaatattttagggccaggaga

SEQ ID NO: 7658083 - DNA, 22 bp, Homo sapiens
aaaatatgtataactcttctgc

SEQ ID NO: 7658084 - DNA, 22 bp, Homo sapiens
aaaatattttagggccaggaga

SEQ ID NO: 7658085 - DNA, 22 bp, Homo sapiens
aaaatattttagggccaggaga

SEQ ID NO: 7658086 - DNA, 22 bp, Homo sapiens
aaaatattttagggccaggaga

SEQ ID NO: 7658087 - DNA, 22 bp, Homo sapiens
aaaatatgtataactcttctgc

SEQ ID NO: 7658088 - DNA, 22 bp, Homo sapiens
aaaatatgtataactcttctgc

SEQ ID NO: 7658089 - DNA, 20 bp, Homo sapiens
aaaatatgtataactcttct

SEQ ID NO: 7658090 - DNA, 22 bp, Homo sapiens
aaaatatgtataactcttctgc

SEQ ID NO: 7658091 - DNA, 22 bp, Homo sapiens
aaaatatgtataactcttctgc

SEQ ID NO: 7658092 - DNA, 22 bp, Homo sapiens
aaaatatgtataactcttctgc

SEQ ID NO: 7658093 - DNA, 22 bp, Homo sapiens
aaacatgctggatttagaatat

SEQ ID NO: 7658094 - DNA, 22 bp, Homo sapiens
aaacatgctggatttagaatat

SEQ ID NO: 7658095 - DNA, 22 bp, Homo sapiens
aaacatgctggatttagaatat

SEQ ID NO: 7658096 - DNA, 22 bp, Homo sapiens
aaacatgctggatttagaatat

SEQ ID NO: 7658097 - DNA, 22 bp, Homo sapiens
aaacatggccattcagactgtg

SEQ ID NO: 7658098 - DNA, 22 bp, Homo sapiens
aaacatgggcttcctgatgcga

SEQ ID NO: 7658099 - DNA, 18 bp, Homo sapiens
aaacatggcttaaaggct

SEQ ID NO: 7658100 - DNA, 18 bp, Homo sapiens
aaacatggcttaaaggct

SEQ ID NO: 7658101 - DNA, 18 bp, Homo sapiens
aaacatggcttaaaggct

SEQ ID NO: 7658102 - DNA, 22 bp, Homo sapiens
aaacatgctggatttagaatat

SEQ ID NO: 7658103 - DNA, 22 bp, Homo sapiens
aaacatggccattcagactgtg

SEQ ID NO: 7658104 - DNA, 22 bp, Homo sapiens
aaacatggccattcagactgtg

SEQ ID NO: 7658105 - DNA, 22 bp, Homo sapiens
aaacatgcattcaagaaaatct

SEQ ID NO: 7658106 - DNA, 22 bp, Homo sapiens
aaacatgcattcaagaaaatct

SEQ ID NO: 7658107 - DNA, 23 bp, Homo sapiens
aaacatgcagcacatgaatgcta

SEQ ID NO: 7658108 - DNA, 22 bp, Homo sapiens
aaacatgcattcaagaaaatct

SEQ ID NO: 7658109 - DNA, 22 bp, Homo sapiens
aaacatgcattcaagaaaatct

SEQ ID NO: 7658110 - DNA, 22 bp, Homo sapiens
aaacatgcattcaagaaaatct

SEQ ID NO: 7658111 - DNA, 23 bp, Homo sapiens
aaacatgcagcacatgaatgcta

SEQ ID NO: 7658112 - DNA, 23 bp, Homo sapiens
aaacatgcagcacatgaatgcta

SEQ ID NO: 7658113 - DNA, 22 bp, Homo sapiens
aaacatgatgtcatatatgcca

SEQ ID NO: 7658114 - DNA, 22 bp, Homo sapiens
aaacatgatgtcatatatgcca

SEQ ID NO: 7658115 - DNA, 22 bp, Homo sapiens
aaacatgtagtgcatgaggatc

SEQ ID NO: 7658116 - DNA, 22 bp, Homo sapiens
aaacatgtaattctgcttaaga

SEQ ID NO: 7658117 - DNA, 22 bp, Homo sapiens
aaacatgtaattctgcttaaga

SEQ ID NO: 7658118 - DNA, 22 bp, Homo sapiens
aaacatgtagtgcatgaggatc

SEQ ID NO: 7658119 - DNA, 22 bp, Homo sapiens
aaacatgtttagaaagcagctg

SEQ ID NO: 7658120 - DNA, 22 bp, Homo sapiens
aaacatgtttagaaagcagctg

SEQ ID NO: 7658121 - DNA, 22 bp, Homo sapiens
aaacatgtttagaaagcagctg

SEQ ID NO: 7658122 - DNA, 22 bp, Homo sapiens
aaacatgtttagaaagcagctg

SEQ ID NO: 7658123 - DNA, 22 bp, Homo sapiens
aaacatgtttagaaagcagctg

SEQ ID NO: 7658124 - DNA, 22 bp, Homo sapiens
aaacatgtaagttcagatcacc

SEQ ID NO: 7658125 - DNA, 22 bp, Homo sapiens
aaacatgtaagttcagatcacc

SEQ ID NO: 7658126 - DNA, 22 bp, Homo sapiens
aaacatgtaagttcagatcacc

SEQ ID NO: 7658127 - DNA, 22 bp, Homo sapiens
aaacatgggcttcctgatgcga

SEQ ID NO: 7658128 - DNA, 22 bp, Homo sapiens
aaacatgggcttcctgatgcga

SEQ ID NO: 7658129 - DNA, 22 bp, Homo sapiens
aaacatgtaagttcagatcacc

SEQ ID NO: 7658130 - DNA, 22 bp, Homo sapiens
aaacatgtaagttcagatcacc

SEQ ID NO: 7658131 - DNA, 22 bp, Homo sapiens
aaacatgtaattctgcttaaga

SEQ ID NO: 7658132 - DNA, 22 bp, Homo sapiens
aaacatgtaagttcagatcacc

SEQ ID NO: 7658133 - DNA, 22 bp, Homo sapiens
aaacatgtaagttcagatcacc

SEQ ID NO: 7658134 - DNA, 22 bp, Homo sapiens
aaacattagacaccatatgctc

SEQ ID NO: 7658135 - DNA, 22 bp, Homo sapiens
aaacattagacaccatatgctc

SEQ ID NO: 7658136 - DNA, 22 bp, Homo sapiens
aaacatgttttctgaatatttt

SEQ ID NO: 7658137 - DNA, 22 bp, Homo sapiens
aaacattagacaccatatgctc

SEQ ID NO: 7658138 - DNA, 22 bp, Homo sapiens
aaacattagacaccatatgctc

SEQ ID NO: 7658139 - DNA, 22 bp, Homo sapiens
aaacatgttttctgaatatttt

SEQ ID NO: 7658140 - DNA, 22 bp, Homo sapiens
aaacatgttttctgaatatttt

SEQ ID NO: 7658141 - DNA, 22 bp, Homo sapiens
aaacatgttttctgaatatttt

SEQ ID NO: 7658142 - DNA, 22 bp, Homo sapiens
aaacatgttttctgaatatttt

SEQ ID NO: 7658143 - DNA, 22 bp, Homo sapiens
aaacattagacaccatatgctc

SEQ ID NO: 7658144 - DNA, 22 bp, Homo sapiens
aaacattagacaccatatgctc

SEQ ID NO: 7658145 - DNA, 22 bp, Homo sapiens
aaacattagacaccatatgctc

SEQ ID NO: 7658146 - DNA, 22 bp, Homo sapiens
aaacattagacaccatatgctc

SEQ ID NO: 7658147 - DNA, 22 bp, Homo sapiens
aaacattcaaagcaggatgtgt

SEQ ID NO: 7658148 - DNA, 22 bp, Homo sapiens
aaacattcaaagcaggatgtgt

SEQ ID NO: 7658149 - DNA, 22 bp, Homo sapiens
aaacattcaaagcaggatgtgt

SEQ ID NO: 7658150 - DNA, 22 bp, Homo sapiens
aaacattcactctcaattttag

SEQ ID NO: 7658151 - DNA, 22 bp, Homo sapiens
aaacattcactctcaattttag

SEQ ID NO: 7658152 - DNA, 22 bp, Homo sapiens
aaacattcacatttgctagtaa

SEQ ID NO: 7658153 - DNA, 22 bp, Homo sapiens
aaacattcaaagcaggatgtgt

SEQ ID NO: 7658154 - DNA, 22 bp, Homo sapiens
aaacattcaaagcaggatgtgt

SEQ ID NO: 7658155 - DNA, 22 bp, Homo sapiens
aaacattcacatttgctagtaa

SEQ ID NO: 7658156 - DNA, 22 bp, Homo sapiens
aaacattcacatttgctagtaa

SEQ ID NO: 7658157 - DNA, 22 bp, Homo sapiens
aaacattcacatttgctagtaa

SEQ ID NO: 7658158 - DNA, 22 bp, Homo sapiens
aaacattccatttctatgtaag

SEQ ID NO: 7658159 - DNA, 22 bp, Homo sapiens
aaacattccatttctatgtaag

SEQ ID NO: 7658160 - DNA, 22 bp, Homo sapiens
aaacattccatttctatgtaag

SEQ ID NO: 7658161 - DNA, 22 bp, Homo sapiens
aaacattccatttctatgtaag

SEQ ID NO: 7658162 - DNA, 22 bp, Homo sapiens
aaacattccatttctatgtaag

SEQ ID NO: 7658163 - DNA, 22 bp, Homo sapiens
aaacattccatttctatgtaag

SEQ ID NO: 7658164 - DNA, 22 bp, Homo sapiens
aaacattccatttctatgtaag

SEQ ID NO: 7658165 - DNA, 22 bp, Homo sapiens
aaacattccatatataccttgt

SEQ ID NO: 7658166 - DNA, 22 bp, Homo sapiens
aaacattccatttctatgtaag

SEQ ID NO: 7658167 - DNA, 20 bp, Homo sapiens
aaacattcatgtacaagtga

SEQ ID NO: 7658168 - DNA, 20 bp, Homo sapiens
aaacattcatgtacaagtga

SEQ ID NO: 7658169 - DNA, 20 bp, Homo sapiens
aaacattcatgtacaagtga

SEQ ID NO: 7658170 - DNA, 22 bp, Homo sapiens
aaacattcactctcaattttag

SEQ ID NO: 7658171 - DNA, 22 bp, Homo sapiens
aaacattcactctcaattttag

SEQ ID NO: 7658172 - DNA, 22 bp, Homo sapiens
aaacattcactctcaattttag

SEQ ID NO: 7658173 - DNA, 20 bp, Homo sapiens
aaacattcatgtacaagtga

SEQ ID NO: 7658174 - DNA, 20 bp, Homo sapiens
aaacattcatgtacaagtga

SEQ ID NO: 7658175 - DNA, 20 bp, Homo sapiens
aaacattcatgtacaagtga

SEQ ID NO: 7658176 - DNA, 20 bp, Homo sapiens
aaacattcatgtacaagtga

SEQ ID NO: 7658177 - DNA, 22 bp, Homo sapiens
aaactgtatagggaaaagtaga

SEQ ID NO: 7658178 - DNA, 22 bp, Homo sapiens
aaactgtatagggaaaagtaga

SEQ ID NO: 7658179 - DNA, 22 bp, Homo sapiens
aaactgtatagggaaaagtaga

SEQ ID NO: 7658180 - DNA, 22 bp, Homo sapiens
aaactgtatagggaaaagtaga

SEQ ID NO: 7658181 - DNA, 22 bp, Homo sapiens
aaactgtatagggaaaagtaga

SEQ ID NO: 7658182 - DNA, 22 bp, Homo sapiens
aaactgtatagggaaaagtaga

SEQ ID NO: 7658183 - DNA, 22 bp, Homo sapiens
aaactgtatagggaaaagtaga

SEQ ID NO: 7658184 - DNA, 22 bp, Homo sapiens
aaactgtagtgcttcgatctga

SEQ ID NO: 7658185 - DNA, 22 bp, Homo sapiens
aaactgtagtgcttcgatctga

SEQ ID NO: 7658186 - DNA, 22 bp, Homo sapiens
aaactgtaatgcaggatcaaga

SEQ ID NO: 7658187 - DNA, 22 bp, Homo sapiens
aaactgtaagtttgaggggaaa

SEQ ID NO: 7658188 - DNA, 22 bp, Homo sapiens
aaactgtaggagggaaaggaag

SEQ ID NO: 7658189 - DNA, 22 bp, Homo sapiens
aaactgtaatgcaggatcaaga

SEQ ID NO: 7658190 - DNA, 22 bp, Homo sapiens
aaactgtaggagggaaaggaag

SEQ ID NO: 7658191 - DNA, 22 bp, Homo sapiens
aaactgtaagagaataaactac

SEQ ID NO: 7658192 - DNA, 22 bp, Homo sapiens
aaactgtaagagaataaactac

SEQ ID NO: 7658193 - DNA, 22 bp, Homo sapiens
aaactgtaagagaataaactac

SEQ ID NO: 7658194 - DNA, 22 bp, Homo sapiens
aaactgtaagagaataaactac

SEQ ID NO: 7658195 - DNA, 22 bp, Homo sapiens
aaactgtaagagaataaactac

SEQ ID NO: 7658196 - DNA, 22 bp, Homo sapiens
aaactgtaagagaataaactac

SEQ ID NO: 7658197 - DNA, 22 bp, Homo sapiens
aaactgtaagtgcctcaaggtc

SEQ ID NO: 7658198 - DNA, 22 bp, Homo sapiens
aaactgtaagtgcctcaaggtc

SEQ ID NO: 7658199 - DNA, 22 bp, Homo sapiens
aaactgtaagagaataaactac

SEQ ID NO: 7658200 - DNA, 22 bp, Homo sapiens
aaactgtaagagaataaactac

SEQ ID NO: 7658201 - DNA, 22 bp, Homo sapiens
aaactgtatatttatggcatgt

SEQ ID NO: 7658202 - DNA, 22 bp, Homo sapiens
aaactgtatatttatggcatgt

SEQ ID NO: 7658203 - DNA, 22 bp, Homo sapiens
aaactgtatatttatggcatgt

SEQ ID NO: 7658204 - DNA, 22 bp, Homo sapiens
aaactgtatagggaaaagtaga

SEQ ID NO: 7658205 - DNA, 22 bp, Homo sapiens
aaactgtatagggaaaagtaga

SEQ ID NO: 7658206 - DNA, 22 bp, Homo sapiens
aaactgtatatttatggcatgt

SEQ ID NO: 7658207 - DNA, 22 bp, Homo sapiens
aaactgtatatttatggcatgt

SEQ ID NO: 7658208 - DNA, 22 bp, Homo sapiens
aaactgtatgttgagatgacag

SEQ ID NO: 7658209 - DNA, 22 bp, Homo sapiens
aaactgtatgttgagatgacag

SEQ ID NO: 7658210 - DNA, 22 bp, Homo sapiens
aaactgtatgttgagatgacag

SEQ ID NO: 7658211 - DNA, 22 bp, Homo sapiens
aaactgtatgttgagatgacag

SEQ ID NO: 7658212 - DNA, 22 bp, Homo sapiens
aaactgtcattttatatagtta

SEQ ID NO: 7658213 - DNA, 22 bp, Homo sapiens
aaactgtcattttatatagtta

SEQ ID NO: 7658214 - DNA, 22 bp, Homo sapiens
aaactgtcattggatgcatttg

SEQ ID NO: 7658215 - DNA, 22 bp, Homo sapiens
aaactgtcacctaatgtatttt

SEQ ID NO: 7658216 - DNA, 22 bp, Homo sapiens
aaactgtcacctaatgtatttt

SEQ ID NO: 7658217 - DNA, 22 bp, Homo sapiens
aaactgtcattggatgcatttg

SEQ ID NO: 7658218 - DNA, 22 bp, Homo sapiens
aaactgtattccatcctcatca

SEQ ID NO: 7658219 - DNA, 22 bp, Homo sapiens
aaactgtattccatcctcatca

SEQ ID NO: 7658220 - DNA, 22 bp, Homo sapiens
aaactgtattccatcctcatca

SEQ ID NO: 7658221 - DNA, 22 bp, Homo sapiens
aaactgtcacctaatgtatttt

SEQ ID NO: 7658222 - DNA, 22 bp, Homo sapiens
aaactgtcacctaatgtatttt

SEQ ID NO: 7658223 - DNA, 18 bp, Homo sapiens
aaactgtatttctttcta

SEQ ID NO: 7658224 - DNA, 18 bp, Homo sapiens
aaactgtatttctttcta

SEQ ID NO: 7658225 - DNA, 18 bp, Homo sapiens
aaactgtatttctttcta

SEQ ID NO: 7658226 - DNA, 22 bp, Homo sapiens
aaactgtaaacacagcagtaca

SEQ ID NO: 7658227 - DNA, 22 bp, Homo sapiens
aaactgtaaacacagcagtaca

SEQ ID NO: 7658228 - DNA, 22 bp, Homo sapiens
aaactgtaaacacagcagtaca

SEQ ID NO: 7658229 - DNA, 22 bp, Homo sapiens
aaactgcaattatttttgcaat

SEQ ID NO: 7658230 - DNA, 22 bp, Homo sapiens
aaactgcaattatgtttgcaga

SEQ ID NO: 7658231 - DNA, 22 bp, Homo sapiens
aaactgcaattatgtttgcaga

SEQ ID NO: 7658232 - DNA, 22 bp, Homo sapiens
aaactgcaattacttttgcacc

SEQ ID NO: 7658233 - DNA, 22 bp, Homo sapiens
aaactgcaattacttttgcagc

SEQ ID NO: 7658234 - DNA, 22 bp, Homo sapiens
aaactgcaattacttttgcacc

SEQ ID NO: 7658235 - DNA, 22 bp, Homo sapiens
aaactgcaattacttttgcacc

SEQ ID NO: 7658236 - DNA, 22 bp, Homo sapiens
aaactgcaattacttttgcagc

SEQ ID NO: 7658237 - DNA, 22 bp, Homo sapiens
aaactgcaattacttttgcagc

SEQ ID NO: 7658238 - DNA, 22 bp, Homo sapiens
aaactgtaagagaataaactac

SEQ ID NO: 7658239 - DNA, 22 bp, Homo sapiens
aaactgtaagagaataaactac

SEQ ID NO: 7658240 - DNA, 22 bp, Homo sapiens
aaactgtaagagaataaactac

SEQ ID NO: 7658241 - DNA, 22 bp, Homo sapiens
aaactgtaagagaataaactac

SEQ ID NO: 7658242 - DNA, 22 bp, Homo sapiens
aaactgtaaatactagtaagtg

SEQ ID NO: 7658243 - DNA, 22 bp, Homo sapiens
aaactgtaaatactagtaagtg

SEQ ID NO: 7658244 - DNA, 22 bp, Homo sapiens
aaactgtaaacacagcagtaca

SEQ ID NO: 7658245 - DNA, 22 bp, Homo sapiens
aaactgtaaacacagcagtaca

SEQ ID NO: 7658246 - DNA, 22 bp, Homo sapiens
aaactgtaaagcaggtgagtag

SEQ ID NO: 7658247 - DNA, 22 bp, Homo sapiens
aaactgtaaagcaggtgagtag

SEQ ID NO: 7658248 - DNA, 22 bp, Homo sapiens
aaactgtaaatactagtaagtg

SEQ ID NO: 7658249 - DNA, 22 bp, Homo sapiens
aaacattgatgggaagtttaat

SEQ ID NO: 7658250 - DNA, 22 bp, Homo sapiens
aaacattgatgggaagtttaat

SEQ ID NO: 7658251 - DNA, 22 bp, Homo sapiens
aaacattgatgggaagtttaat

SEQ ID NO: 7658252 - DNA, 22 bp, Homo sapiens
aaacattgatgggaagtttaat

SEQ ID NO: 7658253 - DNA, 22 bp, Homo sapiens
aaacattgatgggaagtttaat

SEQ ID NO: 7658254 - DNA, 22 bp, Homo sapiens
aaacattgtaattttagcatgg

SEQ ID NO: 7658255 - DNA, 22 bp, Homo sapiens
aaacattgtaattttagcatgg

SEQ ID NO: 7658256 - DNA, 22 bp, Homo sapiens
aaactgcaatgacaggtaggag

SEQ ID NO: 7658257 - DNA, 22 bp, Homo sapiens
aaacattgtaattttagcatgg

SEQ ID NO: 7658258 - DNA, 22 bp, Homo sapiens
aaacattgctaaataatgctgc

SEQ ID NO: 7658259 - DNA, 22 bp, Homo sapiens
aaacattccctaatgtgtccgt

SEQ ID NO: 7658260 - DNA, 22 bp, Homo sapiens
aaacattccctaatgtgtccgt

SEQ ID NO: 7658261 - DNA, 22 bp, Homo sapiens
aaacattctcagccctgcttgc

SEQ ID NO: 7658262 - DNA, 22 bp, Homo sapiens
aaacattgacctcatcctggca

SEQ ID NO: 7658263 - DNA, 22 bp, Homo sapiens
aaacattgagcacttgctattt

SEQ ID NO: 7658264 - DNA, 22 bp, Homo sapiens
aaacattgagcacttgctattt

SEQ ID NO: 7658265 - DNA, 22 bp, Homo sapiens
aaacattgagcacttgctattt

SEQ ID NO: 7658266 - DNA, 22 bp, Homo sapiens
aaacactgtgggacatcttact

SEQ ID NO: 7658267 - DNA, 22 bp, Homo sapiens
aaacactgtgggacatcttact

SEQ ID NO: 7658268 - DNA, 22 bp, Homo sapiens
aaacactgtgggacatcttact

SEQ ID NO: 7658269 - DNA, 22 bp, Homo sapiens
aaacactgtgggacatcttact

SEQ ID NO: 7658270 - DNA, 22 bp, Homo sapiens
aaagccaggctggcctggggtt

SEQ ID NO: 7658271 - DNA, 22 bp, Homo sapiens
aaagccaggctggcctggggtt

SEQ ID NO: 7658272 - DNA, 22 bp, Homo sapiens
aaagccaggctggcctggggtt

SEQ ID NO: 7658273 - DNA, 22 bp, Homo sapiens
aaagccaggctggcctggggtt

SEQ ID NO: 7658274 - DNA, 22 bp, Homo sapiens
aaagccaggctggcctggggtt

SEQ ID NO: 7658275 - DNA, 22 bp, Homo sapiens
aaagccaggcagccaagccagt

SEQ ID NO: 7658276 - DNA, 22 bp, Homo sapiens
aaagccaggcagccaagccagt

SEQ ID NO: 7658277 - DNA, 22 bp, Homo sapiens
aaagccaggcagccaagccagt

SEQ ID NO: 7658278 - DNA, 22 bp, Homo sapiens
aaagccaggcagccaagccagt

SEQ ID NO: 7658279 - DNA, 22 bp, Homo sapiens
aaagccagctctgagctgcacc

SEQ ID NO: 7658280 - DNA, 22 bp, Homo sapiens
aaagccagctctgagctgcacc

SEQ ID NO: 7658281 - DNA, 22 bp, Homo sapiens
aaagccagctctgagctgcacc

SEQ ID NO: 7658282 - DNA, 22 bp, Homo sapiens
aaagccagctctgagctgcacc

SEQ ID NO: 7658283 - DNA, 22 bp, Homo sapiens
aaagccaggaggagggcgctcg

SEQ ID NO: 7658284 - DNA, 22 bp, Homo sapiens
aaagccaggaggagggcgctcg

SEQ ID NO: 7658285 - DNA, 22 bp, Homo sapiens
aaagccaggaggagggcgctcg

SEQ ID NO: 7658286 - DNA, 22 bp, Homo sapiens
aaacagataagggacaatttca

SEQ ID NO: 7658287 - DNA, 22 bp, Homo sapiens
aaacagataagggacaatttca

SEQ ID NO: 7658288 - DNA, 22 bp, Homo sapiens
aaacagataagggacaatttca

SEQ ID NO: 7658289 - DNA, 22 bp, Homo sapiens
aaacagataatgctataaatgg

SEQ ID NO: 7658290 - DNA, 22 bp, Homo sapiens
aaacagataatgctataaatgg

SEQ ID NO: 7658291 - DNA, 22 bp, Homo sapiens
aaacagataatgctataaatgg

SEQ ID NO: 7658292 - DNA, 22 bp, Homo sapiens
aaacagataatgctataaatgg

SEQ ID NO: 7658293 - DNA, 22 bp, Homo sapiens
aaacagataatgctataaatgg

SEQ ID NO: 7658294 - DNA, 22 bp, Homo sapiens
aaacagataatgctataaatgg

SEQ ID NO: 7658295 - DNA, 22 bp, Homo sapiens
aaacagataatgctataaatgg

SEQ ID NO: 7658296 - DNA, 22 bp, Homo sapiens
aaacagataagggacaatttca

SEQ ID NO: 7658297 - DNA, 22 bp, Homo sapiens
aaacagataagggacaatttca

SEQ ID NO: 7658298 - DNA, 22 bp, Homo sapiens
aaacagataagggacaatttca

SEQ ID NO: 7658299 - DNA, 22 bp, Homo sapiens
aaacagataagggacaatttca

SEQ ID NO: 7658300 - DNA, 22 bp, Homo sapiens
aaacagagtttggtaaatagcc

SEQ ID NO: 7658301 - DNA, 22 bp, Homo sapiens
aaacagagtttggtaaatagcc

SEQ ID NO: 7658302 - DNA, 22 bp, Homo sapiens
aaacagagtttggtaaatagcc

SEQ ID NO: 7658303 - DNA, 22 bp, Homo sapiens
aaacagagtttggtaaatagcc

SEQ ID NO: 7658304 - DNA, 22 bp, Homo sapiens
aaacactgaaaattttggtcat

SEQ ID NO: 7658305 - DNA, 22 bp, Homo sapiens
aaacactgaaaattttggtcat

SEQ ID NO: 7658306 - DNA, 22 bp, Homo sapiens
aaacactgaaaattttggtcat

SEQ ID NO: 7658307 - DNA, 22 bp, Homo sapiens
aaacactgaagacctatctggt

SEQ ID NO: 7658308 - DNA, 22 bp, Homo sapiens
aaacactgaagacctatctggt

SEQ ID NO: 7658309 - DNA, 22 bp, Homo sapiens
aaacactgaagacctatctggt

SEQ ID NO: 7658310 - DNA, 22 bp, Homo sapiens
aaacactgaagacctatctggt

SEQ ID NO: 7658311 - DNA, 22 bp, Homo sapiens
aaacactgaagacctatctggt

SEQ ID NO: 7658312 - DNA, 22 bp, Homo sapiens
aaacactgatggatatttttcc

SEQ ID NO: 7658313 - DNA, 22 bp, Homo sapiens
aaacactgatggatatttttcc

SEQ ID NO: 7658314 - DNA, 22 bp, Homo sapiens
aaacactgaagacctatctggt

SEQ ID NO: 7658315 - DNA, 20 bp, Homo sapiens
aaagccactggcaagagact

SEQ ID NO: 7658316 - DNA, 22 bp, Homo sapiens
aaagccactgcatgtgtagtat

SEQ ID NO: 7658317 - DNA, 20 bp, Homo sapiens
aaagccactggcaagagact

SEQ ID NO: 7658318 - DNA, 20 bp, Homo sapiens
aaagccactggcaagagact

SEQ ID NO: 7658319 - DNA, 22 bp, Homo sapiens
aaagccactgcatgtgtagtat

SEQ ID NO: 7658320 - DNA, 22 bp, Homo sapiens
aaagccactgcatgtgtagtat

SEQ ID NO: 7658321 - DNA, 20 bp, Homo sapiens
aaagccactggcaagagact

SEQ ID NO: 7658322 - DNA, 22 bp, Homo sapiens
aaagccagaattcgtccagcct

SEQ ID NO: 7658323 - DNA, 22 bp, Homo sapiens
aaagccagaattcgtccagcct

SEQ ID NO: 7658324 - DNA, 22 bp, Homo sapiens
aaagccagaattcgtccagcct

SEQ ID NO: 7658325 - DNA, 22 bp, Homo sapiens
aaagccagaattcgtccagcct

SEQ ID NO: 7658326 - DNA, 22 bp, Homo sapiens
aaagccagagcaagctgtcaca

SEQ ID NO: 7658327 - DNA, 22 bp, Homo sapiens
aaagccagagcaagctgtcaca

SEQ ID NO: 7658328 - DNA, 22 bp, Homo sapiens
aaagccagagcaagctgtcaca

SEQ ID NO: 7658329 - DNA, 22 bp, Homo sapiens
aaagccagagcaagctgtcaca

SEQ ID NO: 7658330 - DNA, 22 bp, Homo sapiens
aaagccagctctgagctgcacc

SEQ ID NO: 7658331 - DNA, 22 bp, Homo sapiens
aaagccagctctgagctgcacc

SEQ ID NO: 7658332 - DNA, 22 bp, Homo sapiens
aaagccagcaaggtgagtttca

SEQ ID NO: 7658333 - DNA, 22 bp, Homo sapiens
aaagccagcaaggtgagtttca

SEQ ID NO: 7658334 - DNA, 22 bp, Homo sapiens
aaagccagagtgtgttagagac

SEQ ID NO: 7658335 - DNA, 22 bp, Homo sapiens
aaagccagagcaagctgtcaca

SEQ ID NO: 7658336 - DNA, 22 bp, Homo sapiens
aaagccagagtgtgttagagac

SEQ ID NO: 7658337 - DNA, 22 bp, Homo sapiens
aaagccagagtgtgttagagac

SEQ ID NO: 7658338 - DNA, 22 bp, Homo sapiens
aaagccagagtgtgttagagac

SEQ ID NO: 7658339 - DNA, 22 bp, Homo sapiens
aaacagctaagtacattcaagg

SEQ ID NO: 7658340 - DNA, 20 bp, Homo sapiens
aaacagctaaaccagctctc

SEQ ID NO: 7658341 - DNA, 22 bp, Homo sapiens
aaacagcaggaacatcttgcca

SEQ ID NO: 7658342 - DNA, 22 bp, Homo sapiens
aaacagccatgtcagctttgca

SEQ ID NO: 7658343 - DNA, 22 bp, Homo sapiens
aaacagccatgtcagctttgca

SEQ ID NO: 7658344 - DNA, 20 bp, Homo sapiens
aaacagctaaaccagctctc

SEQ ID NO: 7658345 - DNA, 22 bp, Homo sapiens
aaacagcaggaacatcttgcca

SEQ ID NO: 7658346 - DNA, 22 bp, Homo sapiens
aaacagcagctgtttaatttgc

SEQ ID NO: 7658347 - DNA, 22 bp, Homo sapiens
aaacagcagctgtttaatttgc

SEQ ID NO: 7658348 - DNA, 22 bp, Homo sapiens
aaacagctacttctgtataatg

SEQ ID NO: 7658349 - DNA, 22 bp, Homo sapiens
aaacagctaatggccaggaata

SEQ ID NO: 7658350 - DNA, 22 bp, Homo sapiens
aaacagctaatggccaggaata

SEQ ID NO: 7658351 - DNA, 22 bp, Homo sapiens
aaacagctaagtacattcaagg

SEQ ID NO: 7658352 - DNA, 22 bp, Homo sapiens
aaacagctaagtacattcaagg

SEQ ID NO: 7658353 - DNA, 22 bp, Homo sapiens
aaacagctaagtacattcaagg

SEQ ID NO: 7658354 - DNA, 22 bp, Homo sapiens
aaacagctaagtacattcaagg

SEQ ID NO: 7658355 - DNA, 22 bp, Homo sapiens
aaacagctaagtacattcaagg

SEQ ID NO: 7658356 - DNA, 22 bp, Homo sapiens
aaacagctaagtacattcaagg

SEQ ID NO: 7658357 - DNA, 22 bp, Homo sapiens
aaacagcaatggagaagccagg

SEQ ID NO: 7658358 - DNA, 22 bp, Homo sapiens
aaacagcaatggagaagccagg

SEQ ID NO: 7658359 - DNA, 22 bp, Homo sapiens
aaacagcaatggagaagccagg

SEQ ID NO: 7658360 - DNA, 22 bp, Homo sapiens
aaacagatgagttataatagcc

SEQ ID NO: 7658361 - DNA, 22 bp, Homo sapiens
aaacagattgaaattcgtagta

SEQ ID NO: 7658362 - DNA, 22 bp, Homo sapiens
aaacagattgaaattcgtagta

SEQ ID NO: 7658363 - DNA, 22 bp, Homo sapiens
aaacagatgagttataatagcc

SEQ ID NO: 7658364 - DNA, 22 bp, Homo sapiens
aaacagatgagttataatagcc

SEQ ID NO: 7658365 - DNA, 22 bp, Homo sapiens
aaacagatgagttataatagcc

SEQ ID NO: 7658366 - DNA, 22 bp, Homo sapiens
aaacagcaatggagaagccagg

SEQ ID NO: 7658367 - DNA, 22 bp, Homo sapiens
aaacagcaatggagaagccagg

SEQ ID NO: 7658368 - DNA, 22 bp, Homo sapiens
aaacagcaatggagaagccagg

SEQ ID NO: 7658369 - DNA, 22 bp, Homo sapiens
aaacagcagctgtttaatttgc

SEQ ID NO: 7658370 - DNA, 22 bp, Homo sapiens
aaacagcagctgtttaatttgc

SEQ ID NO: 7658371 - DNA, 22 bp, Homo sapiens
aaacagcaattacttttgcacc

SEQ ID NO: 7658372 - DNA, 22 bp, Homo sapiens
aaacagctgggaggtagaggcg

SEQ ID NO: 7658373 - DNA, 22 bp, Homo sapiens
aaacagctggtctcaaatgttc

SEQ ID NO: 7658374 - DNA, 22 bp, Homo sapiens
aaacagctgggaggtagaggcg

SEQ ID NO: 7658375 - DNA, 22 bp, Homo sapiens
aaacagctgggaggtagaggcg

SEQ ID NO: 7658376 - DNA, 22 bp, Homo sapiens
aaacagctgcactgctgatgtc

SEQ ID NO: 7658377 - DNA, 22 bp, Homo sapiens
aaacagctgcactgctgatgtc

SEQ ID NO: 7658378 - DNA, 22 bp, Homo sapiens
aaacagctgcactgctgatgtc

SEQ ID NO: 7658379 - DNA, 22 bp, Homo sapiens
aaacagctgcagtacacggcct

SEQ ID NO: 7658380 - DNA, 22 bp, Homo sapiens
aaacagctgcagtacacggcct

SEQ ID NO: 7658381 - DNA, 22 bp, Homo sapiens
aaacagctccttagtttccatc

SEQ ID NO: 7658382 - DNA, 22 bp, Homo sapiens
aaacagctccttagtttccatc

SEQ ID NO: 7658383 - DNA, 22 bp, Homo sapiens
aaacagctcaagaagttactct

SEQ ID NO: 7658384 - DNA, 22 bp, Homo sapiens
aaacagctcaagaagttactct

SEQ ID NO: 7658385 - DNA, 22 bp, Homo sapiens
aaacagctcaagaagttactct

SEQ ID NO: 7658386 - DNA, 22 bp, Homo sapiens
aaacagctacttctgtataatg

SEQ ID NO: 7658387 - DNA, 22 bp, Homo sapiens
aaacagctcaagaagttactct

SEQ ID NO: 7658388 - DNA, 22 bp, Homo sapiens
aaacagctcaagaagttactct

SEQ ID NO: 7658389 - DNA, 21 bp, Homo sapiens
aaacatctctgcttttgtgtc

SEQ ID NO: 7658390 - DNA, 22 bp, Homo sapiens
aaacatctcaaagaggtatttg

SEQ ID NO: 7658391 - DNA, 22 bp, Homo sapiens
aaacatctcaaagaggtatttg

SEQ ID NO: 7658392 - DNA, 21 bp, Homo sapiens
aaacatctctgcttttgtgtc

SEQ ID NO: 7658393 - DNA, 22 bp, Homo sapiens
aaacatgatgcctgtactaaga

SEQ ID NO: 7658394 - DNA, 22 bp, Homo sapiens
aaacatgatgtcatatatgcca

SEQ ID NO: 7658395 - DNA, 22 bp, Homo sapiens
aaacatgatgcctgtactaaga

SEQ ID NO: 7658396 - DNA, 22 bp, Homo sapiens
aaacatctcaaagaggtatttg

SEQ ID NO: 7658397 - DNA, 22 bp, Homo sapiens
aaacatctcaaagaggtatttg

SEQ ID NO: 7658398 - DNA, 22 bp, Homo sapiens
aaacatctcaaagaggtatttg

SEQ ID NO: 7658399 - DNA, 22 bp, Homo sapiens
aaacatctattatgtgctgagc

SEQ ID NO: 7658400 - DNA, 22 bp, Homo sapiens
aaacagctggtctcaaatgttc

SEQ ID NO: 7658401 - DNA, 22 bp, Homo sapiens
aaacagctgtcattgttttaaa

SEQ ID NO: 7658402 - DNA, 22 bp, Homo sapiens
aaacagctgtcattgttttaaa

SEQ ID NO: 7658403 - DNA, 22 bp, Homo sapiens
aaagagaaaatgatctgtacat

SEQ ID NO: 7658404 - DNA, 22 bp, Homo sapiens
aaagagaaaatgatctgtacat

SEQ ID NO: 7658405 - DNA, 22 bp, Homo sapiens
aaagagaaaatgatctgtacat

SEQ ID NO: 7658406 - DNA, 22 bp, Homo sapiens
aaagagaaaatgatctgtacat

SEQ ID NO: 7658407 - DNA, 22 bp, Homo sapiens
aaagagaaaatgatctgtacat

SEQ ID NO: 7658408 - DNA, 22 bp, Homo sapiens
aaagagaaaatgatctgtacat

SEQ ID NO: 7658409 - DNA, 22 bp, Homo sapiens
aaagagaaaaagatcccggctc

SEQ ID NO: 7658410 - DNA, 22 bp, Homo sapiens
aaagagaaaaagatcccggctc

SEQ ID NO: 7658411 - DNA, 22 bp, Homo sapiens
aaagagaaaaagatcccggctc

SEQ ID NO: 7658412 - DNA, 22 bp, Homo sapiens
aaagagaaacttagaagcctga

SEQ ID NO: 7658413 - DNA, 22 bp, Homo sapiens
aaagagaaacttagaagcctga

SEQ ID NO: 7658414 - DNA, 22 bp, Homo sapiens
aaagagaaacttagaagcctga

SEQ ID NO: 7658415 - DNA, 22 bp, Homo sapiens
aaagagaaacttagaagcctga

SEQ ID NO: 7658416 - DNA, 22 bp, Homo sapiens
aaagagaaacttagaagcctga

SEQ ID NO: 7658417 - DNA, 22 bp, Homo sapiens
aaagagaaacttagaagcctga

SEQ ID NO: 7658418 - DNA, 22 bp, Homo sapiens
aaagagaaacttagaagcctga

SEQ ID NO: 7658419 - DNA, 22 bp, Homo sapiens
aaagagaaacttagaagcctga

SEQ ID NO: 7658420 - DNA, 22 bp, Homo sapiens
aaagagaaacttagaagcctga

SEQ ID NO: 7658421 - DNA, 22 bp, Homo sapiens
aaagagaaacttagaagcctga

SEQ ID NO: 7658422 - DNA, 22 bp, Homo sapiens
aaagagaaacttagaagcctga

SEQ ID NO: 7658423 - DNA, 22 bp, Homo sapiens
aaagagaaacttagaagcctga

SEQ ID NO: 7658424 - DNA, 20 bp, Homo sapiens
aaagagaagcctcaccttgt

SEQ ID NO: 7658425 - DNA, 22 bp, Homo sapiens
aaagagaacttttacccaagaa

SEQ ID NO: 7658426 - DNA, 22 bp, Homo sapiens
aaagagaacttttacccaagaa

SEQ ID NO: 7658427 - DNA, 22 bp, Homo sapiens
aaagagaacttttacccaagaa

SEQ ID NO: 7658428 - DNA, 22 bp, Homo sapiens
aaagagaacttttacccaagaa

SEQ ID NO: 7658429 - DNA, 22 bp, Homo sapiens
aaagagaaacttagaagcctga

SEQ ID NO: 7658430 - DNA, 21 bp, Homo sapiens
aaagagacaaatggcatatac

SEQ ID NO: 7658431 - DNA, 20 bp, Homo sapiens
aaagagaagcctcaccttgt

SEQ ID NO: 7658432 - DNA, 22 bp, Homo sapiens
aaagagacaccaaagactctag

SEQ ID NO: 7658433 - DNA, 20 bp, Homo sapiens
aaagagaagcctcaccttgt

SEQ ID NO: 7658434 - DNA, 20 bp, Homo sapiens
aaagagaagcctcaccttgt

SEQ ID NO: 7658435 - DNA, 20 bp, Homo sapiens
aaagagaagcctcaccttgt

SEQ ID NO: 7658436 - DNA, 20 bp, Homo sapiens
aaagagaagcctcaccttgt

SEQ ID NO: 7658437 - DNA, 22 bp, Homo sapiens
aaagagaacttttacccaagaa

SEQ ID NO: 7658438 - DNA, 20 bp, Homo sapiens
aaagagaagcctcaccttgt

SEQ ID NO: 7658439 - DNA, 20 bp, Homo sapiens
aaagagaagcctcaccttgt

SEQ ID NO: 7658440 - DNA, 20 bp, Homo sapiens
aaagagaagcctcaccttgt

SEQ ID NO: 7658441 - DNA, 20 bp, Homo sapiens
aaagagaagcctcaccttgt

SEQ ID NO: 7658442 - DNA, 22 bp, Homo sapiens
aaagatcatgctgttttgtgat

SEQ ID NO: 7658443 - DNA, 22 bp, Homo sapiens
aaagatcatgctgttttgtgat

SEQ ID NO: 7658444 - DNA, 22 bp, Homo sapiens
aaagatgtgtaagaaataaaca

SEQ ID NO: 7658445 - DNA, 22 bp, Homo sapiens
aaagatcagtctgaagcaacat

SEQ ID NO: 7658446 - DNA, 22 bp, Homo sapiens
aaagatcagtctgaagcaacat

SEQ ID NO: 7658447 - DNA, 22 bp, Homo sapiens
aaagatcagtctgaagcaacat

SEQ ID NO: 7658448 - DNA, 22 bp, Homo sapiens
aaagatgttaatagcaccattt

SEQ ID NO: 7658449 - DNA, 22 bp, Homo sapiens
aaagatgttaatagcaccattt

SEQ ID NO: 7658450 - DNA, 22 bp, Homo sapiens
aaagatgttatgaaataactat

SEQ ID NO: 7658451 - DNA, 22 bp, Homo sapiens
aaagatgttatgaaataactat

SEQ ID NO: 7658452 - DNA, 22 bp, Homo sapiens
aaagatgttatgaaataactat

SEQ ID NO: 7658453 - DNA, 22 bp, Homo sapiens
aaagatgttatgaaataactat

SEQ ID NO: 7658454 - DNA, 22 bp, Homo sapiens
aaagatgttatgaaataactat

SEQ ID NO: 7658455 - DNA, 23 bp, Homo sapiens
aaagatgttcccaaagttcacgt

SEQ ID NO: 7658456 - DNA, 23 bp, Homo sapiens
aaagatgttcccaaagttcacgt

SEQ ID NO: 7658457 - DNA, 22 bp, Homo sapiens
aaagatgttgctgctccgccct

SEQ ID NO: 7658458 - DNA, 21 bp, Homo sapiens
aaagatgtttcatctgagaaa

SEQ ID NO: 7658459 - DNA, 21 bp, Homo sapiens
aaagatgtttcatctgagaaa

SEQ ID NO: 7658460 - DNA, 21 bp, Homo sapiens
aaagatgtttcatctgagaaa

SEQ ID NO: 7658461 - DNA, 21 bp, Homo sapiens
aaagatgtttcatctgagaaa

SEQ ID NO: 7658462 - DNA, 22 bp, Homo sapiens
aaagagcaccctcaatgtctga

SEQ ID NO: 7658463 - DNA, 22 bp, Homo sapiens
aaagagcaccctcaatgtctga

SEQ ID NO: 7658464 - DNA, 22 bp, Homo sapiens
aaagagcaccctcaatgtctga

SEQ ID NO: 7658465 - DNA, 22 bp, Homo sapiens
aaagatcagtctgaagcaacat

SEQ ID NO: 7658466 - DNA, 22 bp, Homo sapiens
aaagatcagtctgaagcaacat

SEQ ID NO: 7658467 - DNA, 22 bp, Homo sapiens
aaagagcaagggctttgaggct

SEQ ID NO: 7658468 - DNA, 22 bp, Homo sapiens
aaagagcaagggctttgaggct

SEQ ID NO: 7658469 - DNA, 22 bp, Homo sapiens
aaagagcaagggctttgaggct

SEQ ID NO: 7658470 - DNA, 22 bp, Homo sapiens
aaagagcaagctgagatttgaa

SEQ ID NO: 7658471 - DNA, 22 bp, Homo sapiens
aaagagcaagctgagatttgaa

SEQ ID NO: 7658472 - DNA, 22 bp, Homo sapiens
aaagagacaccaaagactctag

SEQ ID NO: 7658473 - DNA, 22 bp, Homo sapiens
aaagagacaccaaagactctag

SEQ ID NO: 7658474 - DNA, 23 bp, Homo sapiens
aaagagactgatacggaagttcc

SEQ ID NO: 7658475 - DNA, 22 bp, Homo sapiens
aaagagatgtgccaaatagcct

SEQ ID NO: 7658476 - DNA, 22 bp, Homo sapiens
aaagagcaagctgagatttgaa

SEQ ID NO: 7658477 - DNA, 22 bp, Homo sapiens
aaagagcaagctgagatttgaa

SEQ ID NO: 7658478 - DNA, 22 bp, Homo sapiens
aaagagcaagctgagatttgaa

SEQ ID NO: 7658479 - DNA, 22 bp, Homo sapiens
aaagagatgtgccaaatagcct

SEQ ID NO: 7658480 - DNA, 22 bp, Homo sapiens
aaagagatgtgccaaatagcct

SEQ ID NO: 7658481 - DNA, 22 bp, Homo sapiens
aaagagatgtgccaaatagcct

SEQ ID NO: 7658482 - DNA, 22 bp, Homo sapiens
aaagagatgtgccaaatagcct

SEQ ID NO: 7658483 - DNA, 22 bp, Homo sapiens
aaagactggtgtgttacatata

SEQ ID NO: 7658484 - DNA, 22 bp, Homo sapiens
aaagactggtgtgttacatata

SEQ ID NO: 7658485 - DNA, 22 bp, Homo sapiens
aaagactggtgtgttacatata

SEQ ID NO: 7658486 - DNA, 22 bp, Homo sapiens
aaagactggtgtgttacatata

SEQ ID NO: 7658487 - DNA, 22 bp, Homo sapiens
aaagactgggactgcagcaggc

SEQ ID NO: 7658488 - DNA, 23 bp, Homo sapiens
aaagactgctgagaattttagga

SEQ ID NO: 7658489 - DNA, 22 bp, Homo sapiens
aaagactggaaggtgaggctgt

SEQ ID NO: 7658490 - DNA, 22 bp, Homo sapiens
aaagactgggactgcagcaggc

SEQ ID NO: 7658491 - DNA, 22 bp, Homo sapiens
aaagactgaggggaaagtgatg

SEQ ID NO: 7658492 - DNA, 22 bp, Homo sapiens
aaagactgaggggaaagtgatg

SEQ ID NO: 7658493 - DNA, 22 bp, Homo sapiens
aaagactgaggggaaagtgatg

SEQ ID NO: 7658494 - DNA, 22 bp, Homo sapiens
aaagactgcaaaaacgcacaga

SEQ ID NO: 7658495 - DNA, 22 bp, Homo sapiens
aaagactgaggggaaagtgatg

SEQ ID NO: 7658496 - DNA, 23 bp, Homo sapiens
aaagactgctgagaattttagga

SEQ ID NO: 7658497 - DNA, 23 bp, Homo sapiens
aaagactgctgagaattttagga

SEQ ID NO: 7658498 - DNA, 22 bp, Homo sapiens
aaagactgcaaaaacgcacaga

SEQ ID NO: 7658499 - DNA, 22 bp, Homo sapiens
aaagactttcacctagcaaaga

SEQ ID NO: 7658500 - DNA, 22 bp, Homo sapiens
aaagactttcacctagcaaaga

SEQ ID NO: 7658501 - DNA, 22 bp, Homo sapiens
aaagactttcacctagcaaaga

SEQ ID NO: 7658502 - DNA, 22 bp, Homo sapiens
aaagactttcacctagcaaaga

SEQ ID NO: 7658503 - DNA, 22 bp, Homo sapiens
aaagacttgggtgaagtaattt

SEQ ID NO: 7658504 - DNA, 22 bp, Homo sapiens
aaagacttgggagcagtatgct

SEQ ID NO: 7658505 - DNA, 22 bp, Homo sapiens
aaagacttggcttatgatttgc

SEQ ID NO: 7658506 - DNA, 22 bp, Homo sapiens
aaagacttggcttatgatttgc

SEQ ID NO: 7658507 - DNA, 22 bp, Homo sapiens
aaagacttgggagcagtatgct

SEQ ID NO: 7658508 - DNA, 22 bp, Homo sapiens
aaagaacagatgtgtggtgcat

SEQ ID NO: 7658509 - DNA, 21 bp, Homo sapiens
aaagaacaggcagatgttctt

SEQ ID NO: 7658510 - DNA, 21 bp, Homo sapiens
aaagaacaggcagatgttctt

SEQ ID NO: 7658511 - DNA, 22 bp, Homo sapiens
aaagaacagatgtgtggtgcat

SEQ ID NO: 7658512 - DNA, 21 bp, Homo sapiens
aaagaacaggcagatgttctt

SEQ ID NO: 7658513 - DNA, 22 bp, Homo sapiens
aaagacatgacacattggagag

SEQ ID NO: 7658514 - DNA, 21 bp, Homo sapiens
aaagaacaggcagatgttctt

SEQ ID NO: 7658515 - DNA, 22 bp, Homo sapiens
aaagaacaatgtggaatctcct

SEQ ID NO: 7658516 - DNA, 22 bp, Homo sapiens
aaagaacaatgtggaatctcct

SEQ ID NO: 7658517 - DNA, 22 bp, Homo sapiens
aaagaacaatgtggaatctcct

SEQ ID NO: 7658518 - DNA, 22 bp, Homo sapiens
aaagaacaatgtggaatctcct

SEQ ID NO: 7658519 - DNA, 22 bp, Homo sapiens
aaagaacaatgtggaatctcct

SEQ ID NO: 7658520 - DNA, 22 bp, Homo sapiens
aaagaacaatgtggaatctcct

SEQ ID NO: 7658521 - DNA, 22 bp, Homo sapiens
aaagaacaatgtggaatctcct

SEQ ID NO: 7658522 - DNA, 22 bp, Homo sapiens
aaagaacaaattagctgtttta

SEQ ID NO: 7658523 - DNA, 22 bp, Homo sapiens
aaagaacaaattagctgtttta

SEQ ID NO: 7658524 - DNA, 22 bp, Homo sapiens
aaagacatgacacattggagag

SEQ ID NO: 7658525 - DNA, 22 bp, Homo sapiens
aaagacatgacacattggagag

SEQ ID NO: 7658526 - DNA, 22 bp, Homo sapiens
aaagactaagaagagtattatt

SEQ ID NO: 7658527 - DNA, 22 bp, Homo sapiens
aaagacatggaactagagatgg

SEQ ID NO: 7658528 - DNA, 22 bp, Homo sapiens
aaagacatggaactagagatgg

SEQ ID NO: 7658529 - DNA, 22 bp, Homo sapiens
aaagacatggaactagagatgg

SEQ ID NO: 7658530 - DNA, 22 bp, Homo sapiens
aaagacatggaactagagatgg

SEQ ID NO: 7658531 - DNA, 22 bp, Homo sapiens
aaagactaagaagagtattatt

SEQ ID NO: 7658532 - DNA, 22 bp, Homo sapiens
aaagactacacgggaaagagct

SEQ ID NO: 7658533 - DNA, 22 bp, Homo sapiens
aaagactaagaagagtattatt

SEQ ID NO: 7658534 - DNA, 22 bp, Homo sapiens
aaagactacacgggaaagagct

SEQ ID NO: 7658535 - DNA, 22 bp, Homo sapiens
aaagactagcatttatatgtac

SEQ ID NO: 7658536 - DNA, 22 bp, Homo sapiens
aaagactagcatttatatgtac

SEQ ID NO: 7658537 - DNA, 22 bp, Homo sapiens
aaagactcaattgttccctaat

SEQ ID NO: 7658538 - DNA, 22 bp, Homo sapiens
aaagactcaattgttccctaat

SEQ ID NO: 7658539 - DNA, 22 bp, Homo sapiens
aaagactctaggtagcttataa

SEQ ID NO: 7658540 - DNA, 23 bp, Homo sapiens
aaagactgaggaaagtctctgtc

SEQ ID NO: 7658541 - DNA, 22 bp, Homo sapiens
aaagactcttaactccctagcg

SEQ ID NO: 7658542 - DNA, 22 bp, Homo sapiens
aaagactcttaactccctagcg

SEQ ID NO: 7658543 - DNA, 23 bp, Homo sapiens
aaagactctccagagggaagtag

SEQ ID NO: 7658544 - DNA, 22 bp, Homo sapiens
aaagactcttaactccctagcg

SEQ ID NO: 7658545 - DNA, 22 bp, Homo sapiens
aaatagttgtttggatcaataa

SEQ ID NO: 7658546 - DNA, 22 bp, Homo sapiens
aaatagttgtttggatcaataa

SEQ ID NO: 7658547 - DNA, 22 bp, Homo sapiens
aaatagttgtttggatcaataa

SEQ ID NO: 7658548 - DNA, 22 bp, Homo sapiens
aaatagttgtttggatcaataa

SEQ ID NO: 7658549 - DNA, 22 bp, Homo sapiens
aaatagttgtttggatcaataa

SEQ ID NO: 7658550 - DNA, 22 bp, Homo sapiens
aaatagttgtttggatcaataa

SEQ ID NO: 7658551 - DNA, 22 bp, Homo sapiens
aaatagtttagctctcatttca

SEQ ID NO: 7658552 - DNA, 22 bp, Homo sapiens
aaatagtttagctctcatttca

SEQ ID NO: 7658553 - DNA, 22 bp, Homo sapiens
aaatagtttagctctcatttca

SEQ ID NO: 7658554 - DNA, 22 bp, Homo sapiens
aaatagtttagctctcatttca

SEQ ID NO: 7658555 - DNA, 22 bp, Homo sapiens
aaatagtttagctctcatttca

SEQ ID NO: 7658556 - DNA, 22 bp, Homo sapiens
aaatagtttagctctcatttca

SEQ ID NO: 7658557 - DNA, 22 bp, Homo sapiens
aaacttcattttcaactgcaaa

SEQ ID NO: 7658558 - DNA, 22 bp, Homo sapiens
aaacttcattttcaactgcaaa

SEQ ID NO: 7658559 - DNA, 22 bp, Homo sapiens
aaacttcattttcaactgcaaa

SEQ ID NO: 7658560 - DNA, 22 bp, Homo sapiens
aaacttctctccctactttgtg

SEQ ID NO: 7658561 - DNA, 22 bp, Homo sapiens
aaacttcattttcaactgcaaa

SEQ ID NO: 7658562 - DNA, 22 bp, Homo sapiens
aaatagtttagctctcatttca

SEQ ID NO: 7658563 - DNA, 22 bp, Homo sapiens
aaatagtttagctctcatttca

SEQ ID NO: 7658564 - DNA, 22 bp, Homo sapiens
aaactttcatgtatctctttca

SEQ ID NO: 7658565 - DNA, 22 bp, Homo sapiens
aaactttggtatgtagcaaaac

SEQ ID NO: 7658566 - DNA, 22 bp, Homo sapiens
aaactttggtatgtagcaaaac

SEQ ID NO: 7658567 - DNA, 22 bp, Homo sapiens
aaacttctggctacaagcaata

SEQ ID NO: 7658568 - DNA, 22 bp, Homo sapiens
aaacttctctccctactttgtg

SEQ ID NO: 7658569 - DNA, 22 bp, Homo sapiens
aaactttcatgtatctctttca

SEQ ID NO: 7658570 - DNA, 22 bp, Homo sapiens
aaactttcatgtatctctttca

SEQ ID NO: 7658571 - DNA, 22 bp, Homo sapiens
aaactttaggaaggaatttaca

SEQ ID NO: 7658572 - DNA, 22 bp, Homo sapiens
aaactttcatgtatctctttca

SEQ ID NO: 7658573 - DNA, 22 bp, Homo sapiens
aaactttcatgtatctctttca

SEQ ID NO: 7658574 - DNA, 22 bp, Homo sapiens
aaactttggtatgtagcaaaac

SEQ ID NO: 7658575 - DNA, 22 bp, Homo sapiens
aaacttttcctgctcttgtcct

SEQ ID NO: 7658576 - DNA, 22 bp, Homo sapiens
aaacttttcctgctcttgtcct

SEQ ID NO: 7658577 - DNA, 22 bp, Homo sapiens
aaacttttcctgctcttgtcct

SEQ ID NO: 7658578 - DNA, 22 bp, Homo sapiens
aaacttttcctgctcttgtcct

SEQ ID NO: 7658579 - DNA, 22 bp, Homo sapiens
aaacttttataaagctgcagat

SEQ ID NO: 7658580 - DNA, 22 bp, Homo sapiens
aaacttttcctgctcttgtcct

SEQ ID NO: 7658581 - DNA, 22 bp, Homo sapiens
aaacttttcctgctcttgtcct

SEQ ID NO: 7658582 - DNA, 22 bp, Homo sapiens
aaacttttcctgctcttgtcct

SEQ ID NO: 7658583 - DNA, 22 bp, Homo sapiens
aaatagttagccctgcatatat

SEQ ID NO: 7658584 - DNA, 22 bp, Homo sapiens
aaatagttagccctgcatatat

SEQ ID NO: 7658585 - DNA, 22 bp, Homo sapiens
aaatagttagccctgcatatat

SEQ ID NO: 7658586 - DNA, 22 bp, Homo sapiens
aaatagttagccctgcatatat

SEQ ID NO: 7658587 - DNA, 22 bp, Homo sapiens
aaatagttagccctgcatatat

SEQ ID NO: 7658588 - DNA, 22 bp, Homo sapiens
aaatagttagccctgcatatat

SEQ ID NO: 7658589 - DNA, 22 bp, Homo sapiens
aaatagttagccctgcatatat

SEQ ID NO: 7658590 - DNA, 22 bp, Homo sapiens
aaatagttagccctgcatatat

SEQ ID NO: 7658591 - DNA, 22 bp, Homo sapiens
aaatagttacttctgctgtctt

SEQ ID NO: 7658592 - DNA, 22 bp, Homo sapiens
aaatagttacttctgctgtctt

SEQ ID NO: 7658593 - DNA, 20 bp, Homo sapiens
aaactgtctgtcagtatcta

SEQ ID NO: 7658594 - DNA, 22 bp, Homo sapiens
aaactgtgaagcaagtacaagg

SEQ ID NO: 7658595 - DNA, 22 bp, Homo sapiens
aaatagtcctgggaatagtact

SEQ ID NO: 7658596 - DNA, 22 bp, Homo sapiens
aaactgtgaagcaagtacaagg

SEQ ID NO: 7658597 - DNA, 20 bp, Homo sapiens
aaactgtctgtcagtatcta

SEQ ID NO: 7658598 - DNA, 22 bp, Homo sapiens
aaactgtcattttatatagtta

SEQ ID NO: 7658599 - DNA, 22 bp, Homo sapiens
aaactgtcattttatatagtta

SEQ ID NO: 7658600 - DNA, 22 bp, Homo sapiens
aaactgtcctcccgaggtttcc

SEQ ID NO: 7658601 - DNA, 22 bp, Homo sapiens
aaactgtcctcccgaggtttcc

SEQ ID NO: 7658602 - DNA, 22 bp, Homo sapiens
aaatagttcagcttgtaaaccc

SEQ ID NO: 7658603 - DNA, 22 bp, Homo sapiens
aaatagttcagcttgtaaaccc

SEQ ID NO: 7658604 - DNA, 22 bp, Homo sapiens
aaatagttcagcttgtaaaccc

SEQ ID NO: 7658605 - DNA, 22 bp, Homo sapiens
aaatagttcagcttgtaaaccc

SEQ ID NO: 7658606 - DNA, 22 bp, Homo sapiens
aaatagttcagcttgtaaaccc

SEQ ID NO: 7658607 - DNA, 22 bp, Homo sapiens
aaatagttagccctgcatatat

SEQ ID NO: 7658608 - DNA, 22 bp, Homo sapiens
aaatagttagccctgcatatat

SEQ ID NO: 7658609 - DNA, 22 bp, Homo sapiens
aaatagttagccctgcatatat

SEQ ID NO: 7658610 - DNA, 22 bp, Homo sapiens
aaatagttagccctgcatatat

SEQ ID NO: 7658611 - DNA, 22 bp, Homo sapiens
aaatagttcagccacggtgact

SEQ ID NO: 7658612 - DNA, 22 bp, Homo sapiens
aaatagttcagcttgtaaaccc

SEQ ID NO: 7658613 - DNA, 22 bp, Homo sapiens
aaatagttcagcttgtaaaccc

SEQ ID NO: 7658614 - DNA, 22 bp, Homo sapiens
aaatagttcagcttgtaaaccc

SEQ ID NO: 7658615 - DNA, 22 bp, Homo sapiens
aaatagttcagcttgtaaaccc

SEQ ID NO: 7658616 - DNA, 22 bp, Homo sapiens
aaatagttcagcttgtaaaccc

SEQ ID NO: 7658617 - DNA, 22 bp, Homo sapiens
aaatagttcagcttgtaaaccc

SEQ ID NO: 7658618 - DNA, 22 bp, Homo sapiens
aaatagttcagccacggtgact

SEQ ID NO: 7658619 - DNA, 22 bp, Homo sapiens
aaatagttcagccacggtgact

SEQ ID NO: 7658620 - DNA, 22 bp, Homo sapiens
aaagaaatacctttctcagctt

SEQ ID NO: 7658621 - DNA, 22 bp, Homo sapiens
aaagaaatacctttctcagctt

SEQ ID NO: 7658622 - DNA, 22 bp, Homo sapiens
aaagaaatacctttctcagctt

SEQ ID NO: 7658623 - DNA, 22 bp, Homo sapiens
aaagaaatacctttctcagctt

SEQ ID NO: 7658624 - DNA, 22 bp, Homo sapiens
aaagaaatacctttctcagctt

SEQ ID NO: 7658625 - DNA, 22 bp, Homo sapiens
aaagaaatacctttctcagctt

SEQ ID NO: 7658626 - DNA, 22 bp, Homo sapiens
aaagaaatacctttctcagctt

SEQ ID NO: 7658627 - DNA, 22 bp, Homo sapiens
aaagaaacctatcagccacatg

SEQ ID NO: 7658628 - DNA, 22 bp, Homo sapiens
aaagaaacctatcagccacatg

SEQ ID NO: 7658629 - DNA, 22 bp, Homo sapiens
aaagaaacctatcagccacatg

SEQ ID NO: 7658630 - DNA, 22 bp, Homo sapiens
aaagaaacctatcagccacatg

SEQ ID NO: 7658631 - DNA, 22 bp, Homo sapiens
aaagaaacctatcagccacatg

SEQ ID NO: 7658632 - DNA, 16 bp, Homo sapiens
aaagaaacaggtgtcc

SEQ ID NO: 7658633 - DNA, 22 bp, Homo sapiens
aaacttttttaggttcataggc

SEQ ID NO: 7658634 - DNA, 22 bp, Homo sapiens
aaagaaacctatcagccacatg

SEQ ID NO: 7658635 - DNA, 22 bp, Homo sapiens
aaagaaacctatcagccacatg

SEQ ID NO: 7658636 - DNA, 22 bp, Homo sapiens
aaagaaacctatcagccacatg

SEQ ID NO: 7658637 - DNA, 22 bp, Homo sapiens
aaagaaacctatcagccacatg

SEQ ID NO: 7658638 - DNA, 22 bp, Homo sapiens
aaagaaacctatcagccacatg

SEQ ID NO: 7658639 - DNA, 22 bp, Homo sapiens
aaagaaacctatcagccacatg

SEQ ID NO: 7658640 - DNA, 22 bp, Homo sapiens
aaagaaacctatcagccacatg

SEQ ID NO: 7658641 - DNA, 22 bp, Homo sapiens
aaactttttcttaggtatgtct

SEQ ID NO: 7658642 - DNA, 22 bp, Homo sapiens
aaactttttattctaatgtcta

SEQ ID NO: 7658643 - DNA, 22 bp, Homo sapiens
aaactttttattctaatgtcta

SEQ ID NO: 7658644 - DNA, 22 bp, Homo sapiens
aaacttttcttggggacctgcc

SEQ ID NO: 7658645 - DNA, 22 bp, Homo sapiens
aaacttttggtcctcatgggtt

SEQ ID NO: 7658646 - DNA, 22 bp, Homo sapiens
aaacttttttaggttcataggc

SEQ ID NO: 7658647 - DNA, 22 bp, Homo sapiens
aaacttttttaggttcataggc

SEQ ID NO: 7658648 - DNA, 22 bp, Homo sapiens
aaacttttttaggttcataggc

SEQ ID NO: 7658649 - DNA, 22 bp, Homo sapiens
aaacttttttaggttcataggc

SEQ ID NO: 7658650 - DNA, 22 bp, Homo sapiens
aaacttttttaggttcataggc

SEQ ID NO: 7658651 - DNA, 22 bp, Homo sapiens
aaacttttttaggttcataggc

SEQ ID NO: 7658652 - DNA, 22 bp, Homo sapiens
aaacttttttaggttcataggc

SEQ ID NO: 7658653 - DNA, 22 bp, Homo sapiens
aaacttttttaggttcataggc

SEQ ID NO: 7658654 - DNA, 22 bp, Homo sapiens
aaacttttttaggttcataggc

SEQ ID NO: 7658655 - DNA, 16 bp, Homo sapiens
aaagaaacaggtgtcc

SEQ ID NO: 7658656 - DNA, 22 bp, Homo sapiens
aaagaaatagatggcatttaaa

SEQ ID NO: 7658657 - DNA, 22 bp, Homo sapiens
aaagaaatagatggcatttaaa

SEQ ID NO: 7658658 - DNA, 22 bp, Homo sapiens
aaagaaatagatggcatttaaa

SEQ ID NO: 7658659 - DNA, 22 bp, Homo sapiens
aaagaaatagatggcatttaaa

SEQ ID NO: 7658660 - DNA, 22 bp, Homo sapiens
aaagaaatagatggcatttaaa

SEQ ID NO: 7658661 - DNA, 22 bp, Homo sapiens
aaagaaatagatggcatttaaa

SEQ ID NO: 7658662 - DNA, 22 bp, Homo sapiens
aaagaaatagatggcatttaaa

SEQ ID NO: 7658663 - DNA, 22 bp, Homo sapiens
aaagaaatacctttctcagctt

SEQ ID NO: 7658664 - DNA, 22 bp, Homo sapiens
aaagaaatagatggcatttaaa

SEQ ID NO: 7658665 - DNA, 22 bp, Homo sapiens
aaagaaatagatggcatttaaa

SEQ ID NO: 7658666 - DNA, 22 bp, Homo sapiens
aaagaaatagatggcatttaaa

SEQ ID NO: 7658667 - DNA, 22 bp, Homo sapiens
aaagaaatagatggcatttaaa

SEQ ID NO: 7658668 - DNA, 22 bp, Homo sapiens
aaagaaatagatggcatttaaa

SEQ ID NO: 7658669 - DNA, 22 bp, Homo sapiens
aaagaaatagatggcatttaaa

SEQ ID NO: 7658670 - DNA, 22 bp, Homo sapiens
aaagaaatagatggcatttaaa

SEQ ID NO: 7658671 - DNA, 22 bp, Homo sapiens
aaagaaatagatggcatttaaa

SEQ ID NO: 7658672 - DNA, 22 bp, Homo sapiens
aaagaaatagatggcatttaaa

SEQ ID NO: 7658673 - DNA, 22 bp, Homo sapiens
aaagaaatagatggcatttaaa

SEQ ID NO: 7658674 - DNA, 21 bp, Homo sapiens
aaagaaatctcccattggtag

SEQ ID NO: 7658675 - DNA, 21 bp, Homo sapiens
aaagaaatctcccattggtag

SEQ ID NO: 7658676 - DNA, 21 bp, Homo sapiens
aaagaaatctcccattggtag

SEQ ID NO: 7658677 - DNA, 21 bp, Homo sapiens
aaagaaatctcccattggtag

SEQ ID NO: 7658678 - DNA, 22 bp, Homo sapiens
aaagaacaaattagctgtttta

SEQ ID NO: 7658679 - DNA, 22 bp, Homo sapiens
aaagaacaaattagctgtttta

SEQ ID NO: 7658680 - DNA, 22 bp, Homo sapiens
aaagaacaaattagctgtttta

SEQ ID NO: 7658681 - DNA, 22 bp, Homo sapiens
aaagaacaaattagctgtttta

SEQ ID NO: 7658682 - DNA, 22 bp, Homo sapiens
aaagaacaaatgatatatggtt

SEQ ID NO: 7658683 - DNA, 22 bp, Homo sapiens
aaagaacaaatgatatatggtt

SEQ ID NO: 7658684 - DNA, 22 bp, Homo sapiens
aaagaacaaatgatatatggtt

SEQ ID NO: 7658685 - DNA, 22 bp, Homo sapiens
aaagaacaaatgatatatggtt

SEQ ID NO: 7658686 - DNA, 22 bp, Homo sapiens
aaagaacaaatgatatatggtt

SEQ ID NO: 7658687 - DNA, 22 bp, Homo sapiens
aaagaacaaatgatatatggtt

SEQ ID NO: 7658688 - DNA, 22 bp, Homo sapiens
aaagaacaaatgatatatggtt

SEQ ID NO: 7658689 - DNA, 22 bp, Homo sapiens
aaagaacaaatgatatatggtt

SEQ ID NO: 7658690 - DNA, 22 bp, Homo sapiens
aaatactagaattcagagttga

SEQ ID NO: 7658691 - DNA, 22 bp, Homo sapiens
aaatactagaattcagagttga

SEQ ID NO: 7658692 - DNA, 22 bp, Homo sapiens
aaatactagaattcagagttga

SEQ ID NO: 7658693 - DNA, 23 bp, Homo sapiens
aaatacctgaattagatattatc

SEQ ID NO: 7658694 - DNA, 23 bp, Homo sapiens
aaatacctgaattagatattatc

SEQ ID NO: 7658695 - DNA, 23 bp, Homo sapiens
aaatacctgaattagatattatc

SEQ ID NO: 7658696 - DNA, 23 bp, Homo sapiens
aaatacctgaattagatattatc

SEQ ID NO: 7658697 - DNA, 23 bp, Homo sapiens
aaatacctgaattagatattatc

SEQ ID NO: 7658698 - DNA, 23 bp, Homo sapiens
aaatacctgaattagatattatc

SEQ ID NO: 7658699 - DNA, 22 bp, Homo sapiens
aaatacatttacagtcgtggct

SEQ ID NO: 7658700 - DNA, 22 bp, Homo sapiens
aaatacatttacagtcgtggct

SEQ ID NO: 7658701 - DNA, 22 bp, Homo sapiens
aaatacatttacagtcgtggct

SEQ ID NO: 7658702 - DNA, 22 bp, Homo sapiens
aaatacatttacagtcgtggct

SEQ ID NO: 7658703 - DNA, 22 bp, Homo sapiens
aaatacatttacagtcgtggct

SEQ ID NO: 7658704 - DNA, 22 bp, Homo sapiens
aaatacattagacggagagtta

SEQ ID NO: 7658705 - DNA, 22 bp, Homo sapiens
aaatacattagacggagagtta

SEQ ID NO: 7658706 - DNA, 22 bp, Homo sapiens
aagaggggtggtctgtgaggat

SEQ ID NO: 7658707 - DNA, 22 bp, Homo sapiens
aagaggggtggtctgtgaggat

SEQ ID NO: 7658708 - DNA, 22 bp, Homo sapiens
aagaggggtggtctgtgaggat

SEQ ID NO: 7658709 - DNA, 22 bp, Homo sapiens
aagaggggtggtctgtgaggat

SEQ ID NO: 7658710 - DNA, 22 bp, Homo sapiens
aagaggggtggtctgtgaggat

SEQ ID NO: 7658711 - DNA, 22 bp, Homo sapiens
aagaggggtgtgtgtcaaccca

SEQ ID NO: 7658712 - DNA, 22 bp, Homo sapiens
aagaggggtggtctgtgaggat

SEQ ID NO: 7658713 - DNA, 22 bp, Homo sapiens
aagaggtagcagtcacaaaaga

SEQ ID NO: 7658714 - DNA, 22 bp, Homo sapiens
aagaggtaatgactgcttgagt

SEQ ID NO: 7658715 - DNA, 22 bp, Homo sapiens
aagaggtaatgactgcttgagt

SEQ ID NO: 7658716 - DNA, 22 bp, Homo sapiens
aagaggtaaccatagcaaccac

SEQ ID NO: 7658717 - DNA, 22 bp, Homo sapiens
aagaggtaaccatagcaaccac

SEQ ID NO: 7658718 - DNA, 22 bp, Homo sapiens
aagaggggtgtgtgtcaaccca

SEQ ID NO: 7658719 - DNA, 22 bp, Homo sapiens
aagaggggtgtgtgtcaaccca

SEQ ID NO: 7658720 - DNA, 22 bp, Homo sapiens
aagaggtaaccatagcaaccac

SEQ ID NO: 7658721 - DNA, 22 bp, Homo sapiens
aaatactcatcccaggaactgg

SEQ ID NO: 7658722 - DNA, 22 bp, Homo sapiens
aaatactattgaccaggtctct

SEQ ID NO: 7658723 - DNA, 22 bp, Homo sapiens
aaatactcatcccaggaactgg

SEQ ID NO: 7658724 - DNA, 22 bp, Homo sapiens
aaatactctcaataaagaaagt

SEQ ID NO: 7658725 - DNA, 19 bp, Homo sapiens
aaatactgaagttgttcat

SEQ ID NO: 7658726 - DNA, 19 bp, Homo sapiens
aaatactgaagttgttcat

SEQ ID NO: 7658727 - DNA, 22 bp, Homo sapiens
aaatactgctgctattcctttt

SEQ ID NO: 7658728 - DNA, 22 bp, Homo sapiens
aaatactgctgctattcctttt

SEQ ID NO: 7658729 - DNA, 22 bp, Homo sapiens
aaatactgctgctattcctttt

SEQ ID NO: 7658730 - DNA, 22 bp, Homo sapiens
aaatactggcaagtgctaattc

SEQ ID NO: 7658731 - DNA, 22 bp, Homo sapiens
aaatactggcaagtgctaattc

SEQ ID NO: 7658732 - DNA, 22 bp, Homo sapiens
aaatactggcaagtgctaattc

SEQ ID NO: 7658733 - DNA, 22 bp, Homo sapiens
aaatactggcaagtgctaattc

SEQ ID NO: 7658734 - DNA, 22 bp, Homo sapiens
aaatactggcaagtgctaattc

SEQ ID NO: 7658735 - DNA, 22 bp, Homo sapiens
aaatactgctgctattcctttt

SEQ ID NO: 7658736 - DNA, 22 bp, Homo sapiens
aagataaactcttgatttctga

SEQ ID NO: 7658737 - DNA, 22 bp, Homo sapiens
aagataaactcttgatttctga

SEQ ID NO: 7658738 - DNA, 22 bp, Homo sapiens
aagataaactcttgatttctga

SEQ ID NO: 7658739 - DNA, 22 bp, Homo sapiens
aagataaactcttgatttctga

SEQ ID NO: 7658740 - DNA, 22 bp, Homo sapiens
aagataaactcttgatttctga

SEQ ID NO: 7658741 - DNA, 22 bp, Homo sapiens
aagataacaggaggagtttgta

SEQ ID NO: 7658742 - DNA, 22 bp, Homo sapiens
aagataaactcttgatttctga

SEQ ID NO: 7658743 - DNA, 22 bp, Homo sapiens
aagataacaggaggagtttgta

SEQ ID NO: 7658744 - DNA, 22 bp, Homo sapiens
aagatatattcgacgtgaatga

SEQ ID NO: 7658745 - DNA, 22 bp, Homo sapiens
aagatatattcgacgtgaatga

SEQ ID NO: 7658746 - DNA, 22 bp, Homo sapiens
aaatactgggctcaaaagggtt

SEQ ID NO: 7658747 - DNA, 22 bp, Homo sapiens
aaatactgggctcaaaagggtt

SEQ ID NO: 7658748 - DNA, 22 bp, Homo sapiens
aaatactgggctcaaaagggtt

SEQ ID NO: 7658749 - DNA, 22 bp, Homo sapiens
aagataaactcttgatttctga

SEQ ID NO: 7658750 - DNA, 22 bp, Homo sapiens
aagataaactcttgatttctga

SEQ ID NO: 7658751 - DNA, 22 bp, Homo sapiens
aaatactggttttggagatgct

SEQ ID NO: 7658752 - DNA, 22 bp, Homo sapiens
aaatactggttttggagatgct

SEQ ID NO: 7658753 - DNA, 21 bp, Homo sapiens
aaatactgggcagtgacttga

SEQ ID NO: 7658754 - DNA, 21 bp, Homo sapiens
aaatactgggcagtgacttga

SEQ ID NO: 7658755 - DNA, 21 bp, Homo sapiens
aaatactgggcagtgacttga

SEQ ID NO: 7658756 - DNA, 22 bp, Homo sapiens
aagagggaagtcacctggaggt

SEQ ID NO: 7658757 - DNA, 22 bp, Homo sapiens
aagagggaagtcacctggaggt

SEQ ID NO: 7658758 - DNA, 22 bp, Homo sapiens
aagagggaaattgttggctgct

SEQ ID NO: 7658759 - DNA, 22 bp, Homo sapiens
aagagggaaattgttggctgct

SEQ ID NO: 7658760 - DNA, 22 bp, Homo sapiens
aagagggaagtcacctggaggt

SEQ ID NO: 7658761 - DNA, 22 bp, Homo sapiens
aagagggaagtcacctggaggt

SEQ ID NO: 7658762 - DNA, 22 bp, Homo sapiens
aagagggagggcaaaggcactg

SEQ ID NO: 7658763 - DNA, 22 bp, Homo sapiens
aagagggagggcaaaggcactg

SEQ ID NO: 7658764 - DNA, 22 bp, Homo sapiens
aagagggagggcaaaggcactg

SEQ ID NO: 7658765 - DNA, 18 bp, Homo sapiens
aagaggaggagcaggttg

SEQ ID NO: 7658766 - DNA, 22 bp, Homo sapiens
aaagttttatatgctgcagcga

SEQ ID NO: 7658767 - DNA, 22 bp, Homo sapiens
aagaggaggatgctttacagct

SEQ ID NO: 7658768 - DNA, 22 bp, Homo sapiens
aagaggaggatgctttacagct

SEQ ID NO: 7658769 - DNA, 22 bp, Homo sapiens
aagaggaggatgctttacagct

SEQ ID NO: 7658770 - DNA, 19 bp, Homo sapiens
aagagggaaagtgctatgc

SEQ ID NO: 7658771 - DNA, 22 bp, Homo sapiens
aagagggaaattgttggctgct

SEQ ID NO: 7658772 - DNA, 22 bp, Homo sapiens
aagagggaaattgttggctgct

SEQ ID NO: 7658773 - DNA, 22 bp, Homo sapiens
aagagggaaattgttggctgct

SEQ ID NO: 7658774 - DNA, 22 bp, Homo sapiens
aagagggaggtgcgggtgcaga

SEQ ID NO: 7658775 - DNA, 22 bp, Homo sapiens
aagagggagggcaaaggcactg

SEQ ID NO: 7658776 - DNA, 22 bp, Homo sapiens
aagagggaggtgcgggtgcaga

SEQ ID NO: 7658777 - DNA, 22 bp, Homo sapiens
aagagggaggtgcgggtgcaga

SEQ ID NO: 7658778 - DNA, 22 bp, Homo sapiens
aagagggcagcacaggtgggtc

SEQ ID NO: 7658779 - DNA, 22 bp, Homo sapiens
aagagggcagcacaggtgggtc

SEQ ID NO: 7658780 - DNA, 22 bp, Homo sapiens
aagagggcagcacaggtgggtc

SEQ ID NO: 7658781 - DNA, 22 bp, Homo sapiens
aagagggaggtgcgggtgcaga

SEQ ID NO: 7658782 - DNA, 22 bp, Homo sapiens
aagagggaggtgcgggtgcaga

SEQ ID NO: 7658783 - DNA, 22 bp, Homo sapiens
aagagggaggtgcgggtgcaga

SEQ ID NO: 7658784 - DNA, 22 bp, Homo sapiens
aagagggctgcaatcttattgc

SEQ ID NO: 7658785 - DNA, 22 bp, Homo sapiens
aagagggctgcaatcttattgc

SEQ ID NO: 7658786 - DNA, 22 bp, Homo sapiens
aagagggctcgatttggcaaaa

SEQ ID NO: 7658787 - DNA, 22 bp, Homo sapiens
aagagggctcgatttggcaaaa

SEQ ID NO: 7658788 - DNA, 22 bp, Homo sapiens
aagagggctgcaatcttattgc

SEQ ID NO: 7658789 - DNA, 22 bp, Homo sapiens
aagagggctgcaatcttattgc

SEQ ID NO: 7658790 - DNA, 22 bp, Homo sapiens
aagagggctgcaatcttattgc

SEQ ID NO: 7658791 - DNA, 22 bp, Homo sapiens
aaagttttagaactaggaagca

SEQ ID NO: 7658792 - DNA, 22 bp, Homo sapiens
aaagttttagctgtccagttcc

SEQ ID NO: 7658793 - DNA, 22 bp, Homo sapiens
aaagttttagaactaggaagca

SEQ ID NO: 7658794 - DNA, 22 bp, Homo sapiens
aaagttttagaactaggaagca

SEQ ID NO: 7658795 - DNA, 22 bp, Homo sapiens
aaagttttagaactaggaagca

SEQ ID NO: 7658796 - DNA, 22 bp, Homo sapiens
aaagttttatatgctgcagcga

SEQ ID NO: 7658797 - DNA, 22 bp, Homo sapiens
aaagttttagctgtccagttcc

SEQ ID NO: 7658798 - DNA, 22 bp, Homo sapiens
aaagttttagctgtccagttcc

SEQ ID NO: 7658799 - DNA, 22 bp, Homo sapiens
aaagttttagctgtccagttcc

SEQ ID NO: 7658800 - DNA, 22 bp, Homo sapiens
aaagttttagctgtccagttcc

SEQ ID NO: 7658801 - DNA, 22 bp, Homo sapiens
aaagttttagaactaggaagca

SEQ ID NO: 7658802 - DNA, 22 bp, Homo sapiens
aaagtttgttgcttacaaagaa

SEQ ID NO: 7658803 - DNA, 22 bp, Homo sapiens
aaagttttagaactaggaagca

SEQ ID NO: 7658804 - DNA, 22 bp, Homo sapiens
aaagtttgttatatgataagga

SEQ ID NO: 7658805 - DNA, 22 bp, Homo sapiens
aaagtttgttatatgataagga

SEQ ID NO: 7658806 - DNA, 22 bp, Homo sapiens
aaagtttgttgcttacaaagaa

SEQ ID NO: 7658807 - DNA, 22 bp, Homo sapiens
aaagtttgttgcttacaaagaa

SEQ ID NO: 7658808 - DNA, 22 bp, Homo sapiens
aaagtttggattagcagttaga

SEQ ID NO: 7658809 - DNA, 22 bp, Homo sapiens
aaagtttgtcacttggctagaa

SEQ ID NO: 7658810 - DNA, 22 bp, Homo sapiens
aaagtttggatccagcaaaaga

SEQ ID NO: 7658811 - DNA, 22 bp, Homo sapiens
aaagtttgcaatttatgttaat

SEQ ID NO: 7658812 - DNA, 22 bp, Homo sapiens
aaagtttggatccagcaaaaga

SEQ ID NO: 7658813 - DNA, 22 bp, Homo sapiens
aaagtttggatccagcaaaaga

SEQ ID NO: 7658814 - DNA, 22 bp, Homo sapiens
aaagtttattttccctggttag

SEQ ID NO: 7658815 - DNA, 22 bp, Homo sapiens
aaagtttcaatagaggaagtgg

SEQ ID NO: 7658816 - DNA, 22 bp, Homo sapiens
aaagtttcaatagaggaagtgg

SEQ ID NO: 7658817 - DNA, 22 bp, Homo sapiens
aaagtttatcatagccggggac

SEQ ID NO: 7658818 - DNA, 22 bp, Homo sapiens
aaagtttatcatagccggggac

SEQ ID NO: 7658819 - DNA, 22 bp, Homo sapiens
aaagtttattttccctggttag

SEQ ID NO: 7658820 - DNA, 22 bp, Homo sapiens
aaagtttattttccctggttag

SEQ ID NO: 7658821 - DNA, 22 bp, Homo sapiens
aaagtttattttccctggttag

SEQ ID NO: 7658822 - DNA, 22 bp, Homo sapiens
aaagtttcaatagaggaagtgg

SEQ ID NO: 7658823 - DNA, 22 bp, Homo sapiens
aaagtttcccaaagtaatgtga

SEQ ID NO: 7658824 - DNA, 22 bp, Homo sapiens
aaagtttcccaaagtaatgtga

SEQ ID NO: 7658825 - DNA, 22 bp, Homo sapiens
aaagtttcctgctaagtgctat

SEQ ID NO: 7658826 - DNA, 22 bp, Homo sapiens
aaagtttcctgctaagtgctat

SEQ ID NO: 7658827 - DNA, 22 bp, Homo sapiens
aaagtttgagtgatttgacaca

SEQ ID NO: 7658828 - DNA, 22 bp, Homo sapiens
aaagtttgcaatttatgttaat

SEQ ID NO: 7658829 - DNA, 22 bp, Homo sapiens
aaagtttgcaatttatgttaat

SEQ ID NO: 7658830 - DNA, 22 bp, Homo sapiens
aaagtttgcaatttatgttaat

SEQ ID NO: 7658831 - DNA, 22 bp, Homo sapiens
aaagtttgaatgatatattagt

SEQ ID NO: 7658832 - DNA, 22 bp, Homo sapiens
aaagtttgaatgatatattagt

SEQ ID NO: 7658833 - DNA, 22 bp, Homo sapiens
aaagtttgaatgatatattagt

SEQ ID NO: 7658834 - DNA, 22 bp, Homo sapiens
aaagtttgagtgatttgacaca

SEQ ID NO: 7658835 - DNA, 23 bp, Homo sapiens
aaagtttgaagcaacagtagttg

SEQ ID NO: 7658836 - DNA, 22 bp, Homo sapiens
aaagtttcctgctaagtgctat

SEQ ID NO: 7658837 - DNA, 22 bp, Homo sapiens
aaagtttcctgctaagtgctat

SEQ ID NO: 7658838 - DNA, 23 bp, Homo sapiens
aaagtttgaagcaacagtagttg

SEQ ID NO: 7658839 - DNA, 23 bp, Homo sapiens
aaagtttgaagcaacagtagttg

SEQ ID NO: 7658840 - DNA, 22 bp, Homo sapiens
aaagtttagtgtcctctaccac

SEQ ID NO: 7658841 - DNA, 22 bp, Homo sapiens
aaagtttaggctttgaaaccag

SEQ ID NO: 7658842 - DNA, 22 bp, Homo sapiens
aaagtttagtgtcctctaccac

SEQ ID NO: 7658843 - DNA, 22 bp, Homo sapiens
aaagtttaggctttgaaaccag

SEQ ID NO: 7658844 - DNA, 22 bp, Homo sapiens
aaagtttaggctttgaaaccag

SEQ ID NO: 7658845 - DNA, 22 bp, Homo sapiens
aaagtttacagtgcacatgggt

SEQ ID NO: 7658846 - DNA, 22 bp, Homo sapiens
aaagtttacagtgcacatgggt

SEQ ID NO: 7658847 - DNA, 22 bp, Homo sapiens
aaagtttaggctttgaaaccag

SEQ ID NO: 7658848 - DNA, 22 bp, Homo sapiens
aaagtttacagtgcacatgggt

SEQ ID NO: 7658849 - DNA, 22 bp, Homo sapiens
aaagtttacagtgcacatgggt

SEQ ID NO: 7658850 - DNA, 22 bp, Homo sapiens
aaagtttacagtgcacatgggt

SEQ ID NO: 7658851 - DNA, 22 bp, Homo sapiens
aaagttgtttcctaaggtctaa

SEQ ID NO: 7658852 - DNA, 22 bp, Homo sapiens
aaagttgttgttcacaggttat

SEQ ID NO: 7658853 - DNA, 22 bp, Homo sapiens
aaagttgtttcctaaggtctaa

SEQ ID NO: 7658854 - DNA, 22 bp, Homo sapiens
aagactgtgtctatggctactc

SEQ ID NO: 7658855 - DNA, 22 bp, Homo sapiens
aagactgtctgggacaagatga

SEQ ID NO: 7658856 - DNA, 22 bp, Homo sapiens
aagactgtctgggacaagatga

SEQ ID NO: 7658857 - DNA, 22 bp, Homo sapiens
aagactctatctttagagatca

SEQ ID NO: 7658858 - DNA, 22 bp, Homo sapiens
aagactctatctttagagatca

SEQ ID NO: 7658859 - DNA, 22 bp, Homo sapiens
aagactctatctttagagatca

SEQ ID NO: 7658860 - DNA, 22 bp, Homo sapiens
aagactcttgcctaatacatct

SEQ ID NO: 7658861 - DNA, 22 bp, Homo sapiens
aagactcttgcctaatacatct

SEQ ID NO: 7658862 - DNA, 22 bp, Homo sapiens
aagactcttgcctaatacatct

SEQ ID NO: 7658863 - DNA, 22 bp, Homo sapiens
aagactgagttcaaatcacagc

SEQ ID NO: 7658864 - DNA, 22 bp, Homo sapiens
aagactgagtggcttaagaaaa

SEQ ID NO: 7658865 - DNA, 22 bp, Homo sapiens
aagactgtatgagacaatataa

SEQ ID NO: 7658866 - DNA, 22 bp, Homo sapiens
aagactgtatgagacaatataa

SEQ ID NO: 7658867 - DNA, 22 bp, Homo sapiens
aagactgtatattgagaaaaga

SEQ ID NO: 7658868 - DNA, 22 bp, Homo sapiens
aagactgtatgagacaatataa

SEQ ID NO: 7658869 - DNA, 22 bp, Homo sapiens
aagactgtatattgagaaaaga

SEQ ID NO: 7658870 - DNA, 22 bp, Homo sapiens
aagactgtatattgagaaaaga

SEQ ID NO: 7658871 - DNA, 22 bp, Homo sapiens
aagactgtacattttccagtct

SEQ ID NO: 7658872 - DNA, 22 bp, Homo sapiens
aagactgagttcaaatcacagc

SEQ ID NO: 7658873 - DNA, 22 bp, Homo sapiens
aagactgatgtccagtcccatg

SEQ ID NO: 7658874 - DNA, 22 bp, Homo sapiens
aagactgtacattttccagtct

SEQ ID NO: 7658875 - DNA, 23 bp, Homo sapiens
aagactaattcttaattgcttag

SEQ ID NO: 7658876 - DNA, 22 bp, Homo sapiens
aagactacttttggcagtgtgt

SEQ ID NO: 7658877 - DNA, 22 bp, Homo sapiens
aagactagggtgtgtttaatct

SEQ ID NO: 7658878 - DNA, 22 bp, Homo sapiens
aagactaaatgtgttctaaagt

SEQ ID NO: 7658879 - DNA, 22 bp, Homo sapiens
aagactaaatgtgttctaaagt

SEQ ID NO: 7658880 - DNA, 23 bp, Homo sapiens
aagactaattcttaattgcttag

SEQ ID NO: 7658881 - DNA, 22 bp, Homo sapiens
aagactcaaggaacaacacagt

SEQ ID NO: 7658882 - DNA, 22 bp, Homo sapiens
aagactcaaggaacaacacagt

SEQ ID NO: 7658883 - DNA, 22 bp, Homo sapiens
aagactcaaggaacaacacagt

SEQ ID NO: 7658884 - DNA, 22 bp, Homo sapiens
aagactcaaggaacaacacagt

SEQ ID NO: 7658885 - DNA, 22 bp, Homo sapiens
aagactataccatcttagttac

SEQ ID NO: 7658886 - DNA, 22 bp, Homo sapiens
aagactagtgaaacatcaaact

SEQ ID NO: 7658887 - DNA, 22 bp, Homo sapiens
aagacgggagtcaggtgagctc

SEQ ID NO: 7658888 - DNA, 22 bp, Homo sapiens
aagacgatggaatggctcccct

SEQ ID NO: 7658889 - DNA, 22 bp, Homo sapiens
aagacgcaccctttgagggcac

SEQ ID NO: 7658890 - DNA, 22 bp, Homo sapiens
aagaccttgtctaaacatgtag

SEQ ID NO: 7658891 - DNA, 22 bp, Homo sapiens
aagacctgggagagattgggtt

SEQ ID NO: 7658892 - DNA, 22 bp, Homo sapiens
aagacctgggatggccctgaag

SEQ ID NO: 7658893 - DNA, 22 bp, Homo sapiens
aagacctgcgttatcctgcctg

SEQ ID NO: 7658894 - DNA, 22 bp, Homo sapiens
aagacctgcgttatcctgcctg

SEQ ID NO: 7658895 - DNA, 22 bp, Homo sapiens
aagacctgggagagattgggtt

SEQ ID NO: 7658896 - DNA, 22 bp, Homo sapiens
aagacctattttaggatatgaa

SEQ ID NO: 7658897 - DNA, 22 bp, Homo sapiens
aagacctaaaattccctcagat

SEQ ID NO: 7658898 - DNA, 22 bp, Homo sapiens
aagaccctatactcagtgaccc

SEQ ID NO: 7658899 - DNA, 22 bp, Homo sapiens
aagaccctatactcagtgaccc

SEQ ID NO: 7658900 - DNA, 22 bp, Homo sapiens
aagacccttctctgaggaggaa

SEQ ID NO: 7658901 - DNA, 22 bp, Homo sapiens
aagacctgcatgcggactaaca

SEQ ID NO: 7658902 - DNA, 22 bp, Homo sapiens
aagacctgcagtttctctacct

SEQ ID NO: 7658903 - DNA, 22 bp, Homo sapiens
aagacctctggagggcaatgtc

SEQ ID NO: 7658904 - DNA, 22 bp, Homo sapiens
aagacctctgaggtagaagttc

SEQ ID NO: 7658905 - DNA, 22 bp, Homo sapiens
aagacagatgcaacctgctagc

SEQ ID NO: 7658906 - DNA, 22 bp, Homo sapiens
aagacagatgcaacctgctagc

SEQ ID NO: 7658907 - DNA, 22 bp, Homo sapiens
aagaccctacccctggagagga

SEQ ID NO: 7658908 - DNA, 22 bp, Homo sapiens
aagaccctacccctggagagga

SEQ ID NO: 7658909 - DNA, 17 bp, Homo sapiens
aagaccctagtctaccc

SEQ ID NO: 7658910 - DNA, 17 bp, Homo sapiens
aagaccctagtctaccc

SEQ ID NO: 7658911 - DNA, 17 bp, Homo sapiens
aagaccctagtctaccc

SEQ ID NO: 7658912 - DNA, 22 bp, Homo sapiens
aagaccctatactcagtgaccc

SEQ ID NO: 7658913 - DNA, 22 bp, Homo sapiens
aaagtgcagaactgttctcact

SEQ ID NO: 7658914 - DNA, 22 bp, Homo sapiens
aaagtgcagaactgttctcact

SEQ ID NO: 7658915 - DNA, 22 bp, Homo sapiens
aaagtgcagaactgttctcact

SEQ ID NO: 7658916 - DNA, 22 bp, Homo sapiens
aaagtgcagaactgttctcact

SEQ ID NO: 7658917 - DNA, 22 bp, Homo sapiens
aaagtgcagaactgttctcact

SEQ ID NO: 7658918 - DNA, 22 bp, Homo sapiens
aaagtgcagaactgttctcact

SEQ ID NO: 7658919 - DNA, 22 bp, Homo sapiens
aaagtgcagctgaaaacatcct

SEQ ID NO: 7658920 - DNA, 22 bp, Homo sapiens
aaagtgcagctgaaaacatcct

SEQ ID NO: 7658921 - DNA, 22 bp, Homo sapiens
aaagtgcagctgaaaacatcct

SEQ ID NO: 7658922 - DNA, 22 bp, Homo sapiens
aaagtgcactctcagtgctgct

SEQ ID NO: 7658923 - DNA, 22 bp, Homo sapiens
aaagtgcactctcagtgctgct

SEQ ID NO: 7658924 - DNA, 22 bp, Homo sapiens
aaagtgcactctcagtgctgct

SEQ ID NO: 7658925 - DNA, 22 bp, Homo sapiens
aaagtgcactctcagtgctgct

SEQ ID NO: 7658926 - DNA, 22 bp, Homo sapiens
aaagtgcactctcagtgctgct

SEQ ID NO: 7658927 - DNA, 22 bp, Homo sapiens
aaagtgcactagaatccagatt

SEQ ID NO: 7658928 - DNA, 22 bp, Homo sapiens
aaagtgcagctgaaaacatcct

SEQ ID NO: 7658929 - DNA, 22 bp, Homo sapiens
aaagtgcagctgaaaacatcct

SEQ ID NO: 7658930 - DNA, 22 bp, Homo sapiens
aagacagagggaagcaatgatg

SEQ ID NO: 7658931 - DNA, 22 bp, Homo sapiens
aaagtgcagctgaaaacatcct

SEQ ID NO: 7658932 - DNA, 22 bp, Homo sapiens
aagacagagggaagcaatgatg

SEQ ID NO: 7658933 - DNA, 22 bp, Homo sapiens
aagacagagggaagcaatgatg

SEQ ID NO: 7658934 - DNA, 22 bp, Homo sapiens
aagacagatgcaacctgctagc

SEQ ID NO: 7658935 - DNA, 22 bp, Homo sapiens
aagacagatgcaacctgctagc

SEQ ID NO: 7658936 - DNA, 20 bp, Homo sapiens
aaagtgcacagatacagctc

SEQ ID NO: 7658937 - DNA, 20 bp, Homo sapiens
aaagtgcacagatacagctc

SEQ ID NO: 7658938 - DNA, 15 bp, Homo sapiens
aaagtgcacccaata

SEQ ID NO: 7658939 - DNA, 15 bp, Homo sapiens
aaagtgcacccaata

SEQ ID NO: 7658940 - DNA, 22 bp, Homo sapiens
aaagtgcactagaatccagatt

SEQ ID NO: 7658941 - DNA, 22 bp, Homo sapiens
aaagtgcactagaatccagatt

SEQ ID NO: 7658942 - DNA, 22 bp, Homo sapiens
aaagtgcactagaatccagatt

SEQ ID NO: 7658943 - DNA, 22 bp, Homo sapiens
aaagtgcacctgcttcttcttg

SEQ ID NO: 7658944 - DNA, 22 bp, Homo sapiens
aaagtgcacctgcttcttcttg

SEQ ID NO: 7658945 - DNA, 22 bp, Homo sapiens
aaagtgcacctgcttcttcttg

SEQ ID NO: 7658946 - DNA, 22 bp, Homo sapiens
aaagtgcactagaatccagatt

SEQ ID NO: 7658947 - DNA, 22 bp, Homo sapiens
aaagtgcaatcagttagaccat

SEQ ID NO: 7658948 - DNA, 22 bp, Homo sapiens
aaagtgcaatcagttagaccat

SEQ ID NO: 7658949 - DNA, 22 bp, Homo sapiens
aaagtgcaatcagttagaccat

SEQ ID NO: 7658950 - DNA, 19 bp, Homo sapiens
aaagtgattttttctggca

SEQ ID NO: 7658951 - DNA, 22 bp, Homo sapiens
aaagtgcaaggattacaggcat

SEQ ID NO: 7658952 - DNA, 22 bp, Homo sapiens
aaagtgcaaggattacaggcat

SEQ ID NO: 7658953 - DNA, 19 bp, Homo sapiens
aaagtgattttttctggca

SEQ ID NO: 7658954 - DNA, 22 bp, Homo sapiens
aaagtgatttaagtacctcagg

SEQ ID NO: 7658955 - DNA, 22 bp, Homo sapiens
aaagtgatgccaggagtctggt

SEQ ID NO: 7658956 - DNA, 22 bp, Homo sapiens
aaagtgattatgctgtcaaaga

SEQ ID NO: 7658957 - DNA, 22 bp, Homo sapiens
aaagtgatttaagtacctcagg

SEQ ID NO: 7658958 - DNA, 22 bp, Homo sapiens
aaagtgatttaagtacctcagg

SEQ ID NO: 7658959 - DNA, 22 bp, Homo sapiens
aaagtgatgccaggagtctggt

SEQ ID NO: 7658960 - DNA, 23 bp, Homo sapiens
aaagtgattagcatttctgcaga

SEQ ID NO: 7658961 - DNA, 22 bp, Homo sapiens
aaagtgaggacttgagtactgt

SEQ ID NO: 7658962 - DNA, 22 bp, Homo sapiens
aaagtgatgccaggagtctggt

SEQ ID NO: 7658963 - DNA, 22 bp, Homo sapiens
aaagtgatgaactctgtgacct

SEQ ID NO: 7658964 - DNA, 23 bp, Homo sapiens
aaagtgacttttataccactaac

SEQ ID NO: 7658965 - DNA, 22 bp, Homo sapiens
aaagtgaggacttgagtactgt

SEQ ID NO: 7658966 - DNA, 22 bp, Homo sapiens
aaagtgacaaccatttattaag

SEQ ID NO: 7658967 - DNA, 22 bp, Homo sapiens
aaagtgaattgatttaagggga

SEQ ID NO: 7658968 - DNA, 22 bp, Homo sapiens
aaagtgacaaccagcaggactt

SEQ ID NO: 7658969 - DNA, 22 bp, Homo sapiens
aaagtgacaaccagcaggactt

SEQ ID NO: 7658970 - DNA, 22 bp, Homo sapiens
aagaacatggtaggataacaaa

SEQ ID NO: 7658971 - DNA, 22 bp, Homo sapiens
aagaacatgttaaaagattcac

SEQ ID NO: 7658972 - DNA, 19 bp, Homo sapiens
aaagtgaatgctgttttct

SEQ ID NO: 7658973 - DNA, 19 bp, Homo sapiens
aaagtgaatgctgttttct

SEQ ID NO: 7658974 - DNA, 19 bp, Homo sapiens
aaagtgaatgctgttttct

SEQ ID NO: 7658975 - DNA, 22 bp, Homo sapiens
aaagtgaatgtatcccgtaagt

SEQ ID NO: 7658976 - DNA, 22 bp, Homo sapiens
aaagtgaatgtatcccgtaagt

SEQ ID NO: 7658977 - DNA, 22 bp, Homo sapiens
aaagtgaatgtatcccgtaagt

SEQ ID NO: 7658978 - DNA, 22 bp, Homo sapiens
aagaacatggtaggataacaaa

SEQ ID NO: 7658979 - DNA, 22 bp, Homo sapiens
aagaacatggtaggataacaaa

SEQ ID NO: 7658980 - DNA, 22 bp, Homo sapiens
aagaacatggtaggataacaaa

SEQ ID NO: 7658981 - DNA, 22 bp, Homo sapiens
aagaacatggtaggataacaaa

SEQ ID NO: 7658982 - DNA, 22 bp, Homo sapiens
aagaacatgctataattatctt

SEQ ID NO: 7658983 - DNA, 22 bp, Homo sapiens
aagaacatgctataattatctt

SEQ ID NO: 7658984 - DNA, 22 bp, Homo sapiens
aagaacatggtaggataacaaa

SEQ ID NO: 7658985 - DNA, 22 bp, Homo sapiens
aagaacatggtaggataacaaa

SEQ ID NO: 7658986 - DNA, 22 bp, Homo sapiens
aagaacatggtaggataacaaa

SEQ ID NO: 7658987 - DNA, 22 bp, Homo sapiens
aagaacatggtaggataacaaa

SEQ ID NO: 7658988 - DNA, 22 bp, Homo sapiens
aagaacatggtaggataacaaa

SEQ ID NO: 7658989 - DNA, 22 bp, Homo sapiens
aagaacatggtaggataacaaa

SEQ ID NO: 7658990 - DNA, 22 bp, Homo sapiens
aagaacatgctataattatctt

SEQ ID NO: 7658991 - DNA, 22 bp, Homo sapiens
aagaacatgctataattatctt

SEQ ID NO: 7658992 - DNA, 22 bp, Homo sapiens
aagaacatgctataattatctt

SEQ ID NO: 7658993 - DNA, 22 bp, Homo sapiens
aagaacatgctataattatctt

SEQ ID NO: 7658994 - DNA, 22 bp, Homo sapiens
aagaacatgctataattatctt

SEQ ID NO: 7658995 - DNA, 22 bp, Homo sapiens
aagaacatgatggccatgtgca

SEQ ID NO: 7658996 - DNA, 22 bp, Homo sapiens
aagaacatgatggccatgtgca

SEQ ID NO: 7658997 - DNA, 22 bp, Homo sapiens
aagaacatgatggccatgtgca

SEQ ID NO: 7658998 - DNA, 22 bp, Homo sapiens
aagaacatgagttatgatgatt

SEQ ID NO: 7658999 - DNA, 22 bp, Homo sapiens
aagaacatgagttatgatgatt

SEQ ID NO: 7659000 - DNA, 22 bp, Homo sapiens
aagaacatgatggccatgtgca

SEQ ID NO: 7659001 - DNA, 22 bp, Homo sapiens
aagccctgttctttctctcacc

SEQ ID NO: 7659002 - DNA, 22 bp, Homo sapiens
aagccctgttctttctctcacc

SEQ ID NO: 7659003 - DNA, 22 bp, Homo sapiens
aagccctgttctttctctcacc

SEQ ID NO: 7659004 - DNA, 22 bp, Homo sapiens
aagccctgttaggcactgggga

SEQ ID NO: 7659005 - DNA, 22 bp, Homo sapiens
aagccctgttaggcactgggga

SEQ ID NO: 7659006 - DNA, 22 bp, Homo sapiens
aagccctgttctttctctcacc

SEQ ID NO: 7659007 - DNA, 22 bp, Homo sapiens
aagccctgttctttctctcacc

SEQ ID NO: 7659008 - DNA, 22 bp, Homo sapiens
aagccctgttctttctctcacc

SEQ ID NO: 7659009 - DNA, 22 bp, Homo sapiens
aagccctgttaggcactgggga

SEQ ID NO: 7659010 - DNA, 22 bp, Homo sapiens
aagccctgttaggcactgggga

SEQ ID NO: 7659011 - DNA, 22 bp, Homo sapiens
aagccctgttaggcactgggga

SEQ ID NO: 7659012 - DNA, 22 bp, Homo sapiens
aagccctgttaggcactgggga

SEQ ID NO: 7659013 - DNA, 22 bp, Homo sapiens
aagccctgtaaattgcccttaa

SEQ ID NO: 7659014 - DNA, 22 bp, Homo sapiens
aagccctggggttgcacaaggc

SEQ ID NO: 7659015 - DNA, 22 bp, Homo sapiens
aagccctgtcaccctgacttca

SEQ ID NO: 7659016 - DNA, 22 bp, Homo sapiens
aagccctgtaaattgcccttaa

SEQ ID NO: 7659017 - DNA, 22 bp, Homo sapiens
aagccctgtaaattgcccttaa

SEQ ID NO: 7659018 - DNA, 22 bp, Homo sapiens
aagccctgtcaccctgacttca

SEQ ID NO: 7659019 - DNA, 22 bp, Homo sapiens
aagccctgtcaccctgacttca

SEQ ID NO: 7659020 - DNA, 22 bp, Homo sapiens
aagccctgtcaccctgacttca

SEQ ID NO: 7659021 - DNA, 22 bp, Homo sapiens
aagccctgtccggggggaagaa

SEQ ID NO: 7659022 - DNA, 22 bp, Homo sapiens
aagccctgtccggggggaagaa

SEQ ID NO: 7659023 - DNA, 22 bp, Homo sapiens
aagccctgtccggggggaagaa

SEQ ID NO: 7659024 - DNA, 22 bp, Homo sapiens
aagcccttggcagagttcccca

SEQ ID NO: 7659025 - DNA, 22 bp, Homo sapiens
aagccctgttctttctctcacc

SEQ ID NO: 7659026 - DNA, 22 bp, Homo sapiens
aagccctgttctttctctcacc

SEQ ID NO: 7659027 - DNA, 21 bp, Homo sapiens
aagcccttgaaatagatatat

SEQ ID NO: 7659028 - DNA, 22 bp, Homo sapiens
aagcccttggcgcacaccgggc

SEQ ID NO: 7659029 - DNA, 22 bp, Homo sapiens
aagcccttttcaagatacaaca

SEQ ID NO: 7659030 - DNA, 22 bp, Homo sapiens
aagccctttttcctggtagttt

SEQ ID NO: 7659031 - DNA, 22 bp, Homo sapiens
aagcccttggcgcacaccgggc

SEQ ID NO: 7659032 - DNA, 22 bp, Homo sapiens
aagcccttggcgcacaccgggc

SEQ ID NO: 7659033 - DNA, 22 bp, Homo sapiens
aagccggctgggccgaggctgc

SEQ ID NO: 7659034 - DNA, 22 bp, Homo sapiens
aagccgaggccacacagcagga

SEQ ID NO: 7659035 - DNA, 22 bp, Homo sapiens
aagccgaggccacacagcagga

SEQ ID NO: 7659036 - DNA, 21 bp, Homo sapiens
aagcctcaagcagaagacaga

SEQ ID NO: 7659037 - DNA, 21 bp, Homo sapiens
aagcctcaagcagaagacaga

SEQ ID NO: 7659038 - DNA, 22 bp, Homo sapiens
aagcctaggcctactctggttt

SEQ ID NO: 7659039 - DNA, 22 bp, Homo sapiens
aagccgggcctgagaaatgaca

SEQ ID NO: 7659040 - DNA, 22 bp, Homo sapiens
aagcctaaatgatgctattatg

SEQ ID NO: 7659041 - DNA, 22 bp, Homo sapiens
aaatgcatgtatgtaatatgct

SEQ ID NO: 7659042 - DNA, 22 bp, Homo sapiens
aaatgcatgtagaataatagag

SEQ ID NO: 7659043 - DNA, 22 bp, Homo sapiens
aaatgcatggtaaatgattgcc

SEQ ID NO: 7659044 - DNA, 22 bp, Homo sapiens
aaatgcatgtagaataatagag

SEQ ID NO: 7659045 - DNA, 22 bp, Homo sapiens
aaatgcatgtagaataatagag

SEQ ID NO: 7659046 - DNA, 22 bp, Homo sapiens
aaatgcatgtagaataatagag

SEQ ID NO: 7659047 - DNA, 22 bp, Homo sapiens
aaatgcatgtagaataatagag

SEQ ID NO: 7659048 - DNA, 22 bp, Homo sapiens
aaatgcatgtagaataatagag

SEQ ID NO: 7659049 - DNA, 22 bp, Homo sapiens
aaatgcatgtagaataatagag

SEQ ID NO: 7659050 - DNA, 22 bp, Homo sapiens
aaatgcatggtaaatgattgcc

SEQ ID NO: 7659051 - DNA, 22 bp, Homo sapiens
aaatgcatggctgttttaaagc

SEQ ID NO: 7659052 - DNA, 22 bp, Homo sapiens
aagccttcagtccgttgcagag

SEQ ID NO: 7659053 - DNA, 22 bp, Homo sapiens
aaatgcatggctgttttaaagc

SEQ ID NO: 7659054 - DNA, 22 bp, Homo sapiens
aagccttccctttttgagctca

SEQ ID NO: 7659055 - DNA, 22 bp, Homo sapiens
aaatgcatggctgttttaaagc

SEQ ID NO: 7659056 - DNA, 22 bp, Homo sapiens
aaatgcatggtaaatgattgcc

SEQ ID NO: 7659057 - DNA, 22 bp, Homo sapiens
aaatgcatggtaaatgattgcc

SEQ ID NO: 7659058 - DNA, 22 bp, Homo sapiens
aagcctgctttgttccacagca

SEQ ID NO: 7659059 - DNA, 22 bp, Homo sapiens
aagcctggactatcgcgtgtgc

SEQ ID NO: 7659060 - DNA, 22 bp, Homo sapiens
aagcctggcacattggagtctg

SEQ ID NO: 7659061 - DNA, 22 bp, Homo sapiens
aagcctggcacattggagtctg

SEQ ID NO: 7659062 - DNA, 22 bp, Homo sapiens
aagcctggcacattggagtctg

SEQ ID NO: 7659063 - DNA, 22 bp, Homo sapiens
aagcctggcacattggagtctg

SEQ ID NO: 7659064 - DNA, 22 bp, Homo sapiens
aagccttcagtccgttgcagag

SEQ ID NO: 7659065 - DNA, 22 bp, Homo sapiens
aagccttcagagttggctggtc

SEQ ID NO: 7659066 - DNA, 22 bp, Homo sapiens
aagccttcagagttggctggtc

SEQ ID NO: 7659067 - DNA, 22 bp, Homo sapiens
aagcctggcacattggagtctg

SEQ ID NO: 7659068 - DNA, 22 bp, Homo sapiens
aagcctccttattaaaggatat

SEQ ID NO: 7659069 - DNA, 22 bp, Homo sapiens
aagcctcaccttttagaagcta

SEQ ID NO: 7659070 - DNA, 22 bp, Homo sapiens
aagcctcaccttttagaagcta

SEQ ID NO: 7659071 - DNA, 22 bp, Homo sapiens
aagcctctggggcctcatctgt

SEQ ID NO: 7659072 - DNA, 22 bp, Homo sapiens
aagcctctggggcctcatctgt

SEQ ID NO: 7659073 - DNA, 22 bp, Homo sapiens
aagcctctggggcctcatctgt

SEQ ID NO: 7659074 - DNA, 22 bp, Homo sapiens
aagcctgagggtgttgctagat

SEQ ID NO: 7659075 - DNA, 22 bp, Homo sapiens
aaatctgtttctcatagggtag

SEQ ID NO: 7659076 - DNA, 22 bp, Homo sapiens
aaatctgtttcaggtatatttg

SEQ ID NO: 7659077 - DNA, 21 bp, Homo sapiens
aaatctgttcctggctccaaa

SEQ ID NO: 7659078 - DNA, 22 bp, Homo sapiens
aaatctgttgtaatgtttttta

SEQ ID NO: 7659079 - DNA, 22 bp, Homo sapiens
aaatcttcctgaaatttgttca

SEQ ID NO: 7659080 - DNA, 22 bp, Homo sapiens
aaatctttccctttactatcca

SEQ ID NO: 7659081 - DNA, 22 bp, Homo sapiens
aaatctttccctttactatcca

SEQ ID NO: 7659082 - DNA, 22 bp, Homo sapiens
aaatctttccctttactatcca

SEQ ID NO: 7659083 - DNA, 22 bp, Homo sapiens
aaatctttccctttactatcca

SEQ ID NO: 7659084 - DNA, 22 bp, Homo sapiens
aaatctttccctttactatcca

SEQ ID NO: 7659085 - DNA, 22 bp, Homo sapiens
aagcccagatgggagcatttca

SEQ ID NO: 7659086 - DNA, 22 bp, Homo sapiens
aagcccagatgggagcatttca

SEQ ID NO: 7659087 - DNA, 22 bp, Homo sapiens
aagcccagatgagatccctgga

SEQ ID NO: 7659088 - DNA, 22 bp, Homo sapiens
aagcccagatgggagcatttca

SEQ ID NO: 7659089 - DNA, 22 bp, Homo sapiens
aagcccagatgtgagaactgag

SEQ ID NO: 7659090 - DNA, 22 bp, Homo sapiens
aagcccagatgtgagaactgag

SEQ ID NO: 7659091 - DNA, 22 bp, Homo sapiens
aagcccagatgtgagaactgag

SEQ ID NO: 7659092 - DNA, 22 bp, Homo sapiens
aagcccagatgggagcatttca

SEQ ID NO: 7659093 - DNA, 22 bp, Homo sapiens
aaatctgggtcaaggtggagtg

SEQ ID NO: 7659094 - DNA, 22 bp, Homo sapiens
aaatctgttgtaatgtttttta

SEQ ID NO: 7659095 - DNA, 22 bp, Homo sapiens
aaatctgtaagcaattgctcag

SEQ ID NO: 7659096 - DNA, 22 bp, Homo sapiens
aaatctgtaagcaattgctcag

SEQ ID NO: 7659097 - DNA, 22 bp, Homo sapiens
aaatctctggtcacagaactta

SEQ ID NO: 7659098 - DNA, 22 bp, Homo sapiens
aaatctgaaatagtgtgaagta

SEQ ID NO: 7659099 - DNA, 22 bp, Homo sapiens
aaatctgagaaatattgtccag

SEQ ID NO: 7659100 - DNA, 22 bp, Homo sapiens
aaatctgagaaatattgtccag

SEQ ID NO: 7659101 - DNA, 22 bp, Homo sapiens
aaatctctgcaggcaaatgtga

SEQ ID NO: 7659102 - DNA, 22 bp, Homo sapiens
aaatctctgcaggcaaatgtga

SEQ ID NO: 7659103 - DNA, 22 bp, Homo sapiens
aaatctctgcaggcaaatgtga

SEQ ID NO: 7659104 - DNA, 22 bp, Homo sapiens
aaatctctggcagaaataaact

SEQ ID NO: 7659105 - DNA, 22 bp, Homo sapiens
aaatctctggtcacagaactta

SEQ ID NO: 7659106 - DNA, 22 bp, Homo sapiens
aagcaggccctgggccagggga

SEQ ID NO: 7659107 - DNA, 22 bp, Homo sapiens
aagcaggcgagggcctggagca

SEQ ID NO: 7659108 - DNA, 22 bp, Homo sapiens
aagcaggcgagggcctggagca

SEQ ID NO: 7659109 - DNA, 22 bp, Homo sapiens
aaatctcaatttgaattgtagc

SEQ ID NO: 7659110 - DNA, 22 bp, Homo sapiens
aaatctcaatttgaattgtagc

SEQ ID NO: 7659111 - DNA, 22 bp, Homo sapiens
aagcaggcgagggcctggagca

SEQ ID NO: 7659112 - DNA, 22 bp, Homo sapiens
aaatctcaatttgaattgtagc

SEQ ID NO: 7659113 - DNA, 22 bp, Homo sapiens
aaatctcaatttgaattgtagc

SEQ ID NO: 7659114 - DNA, 22 bp, Homo sapiens
aaatctcaatttgaattgtagc

SEQ ID NO: 7659115 - DNA, 22 bp, Homo sapiens
aagcaggccctgggccagggga

SEQ ID NO: 7659116 - DNA, 22 bp, Homo sapiens
aagcaggccctgggccagggga

SEQ ID NO: 7659117 - DNA, 22 bp, Homo sapiens
aagcaggcattccagagacaat

SEQ ID NO: 7659118 - DNA, 22 bp, Homo sapiens
aagcaggcatgggaggccatcc

SEQ ID NO: 7659119 - DNA, 22 bp, Homo sapiens
aagcaggcattccagagacaat

SEQ ID NO: 7659120 - DNA, 22 bp, Homo sapiens
aagcaggcattccagagacaat

SEQ ID NO: 7659121 - DNA, 22 bp, Homo sapiens
aaatctcattatttataccata

SEQ ID NO: 7659122 - DNA, 22 bp, Homo sapiens
aaatctcattatttataccata

SEQ ID NO: 7659123 - DNA, 22 bp, Homo sapiens
aaatctcattatttataccata

SEQ ID NO: 7659124 - DNA, 22 bp, Homo sapiens
aaatctcattatttataccata

SEQ ID NO: 7659125 - DNA, 22 bp, Homo sapiens
aaatctcctttgatatcccatc

SEQ ID NO: 7659126 - DNA, 22 bp, Homo sapiens
aaatctctgaacttaataatgc

SEQ ID NO: 7659127 - DNA, 22 bp, Homo sapiens
aaatctcagtgttctaagcatt

SEQ ID NO: 7659128 - DNA, 22 bp, Homo sapiens
aaatctcagtgttctaagcatt

SEQ ID NO: 7659129 - DNA, 22 bp, Homo sapiens
aaatctcagtgttctaagcatt

SEQ ID NO: 7659130 - DNA, 22 bp, Homo sapiens
aaatctcagtgttctaagcatt

SEQ ID NO: 7659131 - DNA, 22 bp, Homo sapiens
aaatctcactggcaggcaggca

SEQ ID NO: 7659132 - DNA, 22 bp, Homo sapiens
aaatctcactgtagtcaaagtg

SEQ ID NO: 7659133 - DNA, 22 bp, Homo sapiens
aaatctcactgtagtcaaagtg

SEQ ID NO: 7659134 - DNA, 22 bp, Homo sapiens
aaatctcactgtagtcaaagtg

SEQ ID NO: 7659135 - DNA, 22 bp, Homo sapiens
aaatctcactgtagtcaaagtg

SEQ ID NO: 7659136 - DNA, 22 bp, Homo sapiens
aaatctcaggcctctatttact

SEQ ID NO: 7659137 - DNA, 22 bp, Homo sapiens
aaatctcaggcctctatttact

SEQ ID NO: 7659138 - DNA, 21 bp, Homo sapiens
aaatctcagctggcctctgtg

SEQ ID NO: 7659139 - DNA, 22 bp, Homo sapiens
aaatctcagcccttattttaga

SEQ ID NO: 7659140 - DNA, 22 bp, Homo sapiens
aaatctcagcccttattttaga

SEQ ID NO: 7659141 - DNA, 22 bp, Homo sapiens
aaatctcagcccttattttaga

SEQ ID NO: 7659142 - DNA, 22 bp, Homo sapiens
aagattactacggaacatgacc

SEQ ID NO: 7659143 - DNA, 22 bp, Homo sapiens
aagattaaaggggagacaagct

SEQ ID NO: 7659144 - DNA, 22 bp, Homo sapiens
aagattaaaggggagacaagct

SEQ ID NO: 7659145 - DNA, 22 bp, Homo sapiens
aagattaaaggggagacaagct

SEQ ID NO: 7659146 - DNA, 22 bp, Homo sapiens
aagattaaaggggagacaagct

SEQ ID NO: 7659147 - DNA, 22 bp, Homo sapiens
aagatgttttaatatttcgagg

SEQ ID NO: 7659148 - DNA, 22 bp, Homo sapiens
aagatgtttagatttatacaat

SEQ ID NO: 7659149 - DNA, 22 bp, Homo sapiens
aagatgtttagatttatacaat

SEQ ID NO: 7659150 - DNA, 22 bp, Homo sapiens
aagatgtttaggtaaaaagttt

SEQ ID NO: 7659151 - DNA, 22 bp, Homo sapiens
aagatgttttaatatttcgagg

SEQ ID NO: 7659152 - DNA, 18 bp, Homo sapiens
aagatgtttaatgggaag

SEQ ID NO: 7659153 - DNA, 22 bp, Homo sapiens
aagatgtttagatttatacaat

SEQ ID NO: 7659154 - DNA, 22 bp, Homo sapiens
aagatgtttagatttatacaat

SEQ ID NO: 7659155 - DNA, 22 bp, Homo sapiens
aagatgtttagatttatacaat

SEQ ID NO: 7659156 - DNA, 22 bp, Homo sapiens
aagatgtttagatttatacaat

SEQ ID NO: 7659157 - DNA, 22 bp, Homo sapiens
aagatgttgtcgttagtgatga

SEQ ID NO: 7659158 - DNA, 22 bp, Homo sapiens
aagatgttgtcgttagtgatga

SEQ ID NO: 7659159 - DNA, 22 bp, Homo sapiens
aagatcataatatttatctcat

SEQ ID NO: 7659160 - DNA, 22 bp, Homo sapiens
aagatccaggcaaaagttggaa

SEQ ID NO: 7659161 - DNA, 22 bp, Homo sapiens
aagatccatgggaatgtttggc

SEQ ID NO: 7659162 - DNA, 23 bp, Homo sapiens
aagatccattcaaattatgtatc

SEQ ID NO: 7659163 - DNA, 23 bp, Homo sapiens
aagatccattcaaattatgtatc

SEQ ID NO: 7659164 - DNA, 23 bp, Homo sapiens
aagatccattcaaattatgtatc

SEQ ID NO: 7659165 - DNA, 22 bp, Homo sapiens
aagatccatgggaatgtttggc

SEQ ID NO: 7659166 - DNA, 22 bp, Homo sapiens
aagatccatgggaatgtttggc

SEQ ID NO: 7659167 - DNA, 22 bp, Homo sapiens
aagatgttgcattagaatacct

SEQ ID NO: 7659168 - DNA, 22 bp, Homo sapiens
aagatgttgcaagggactcttc

SEQ ID NO: 7659169 - DNA, 22 bp, Homo sapiens
aagatgttgcattagaatacct

SEQ ID NO: 7659170 - DNA, 22 bp, Homo sapiens
aagatgttgcattagaatacct

SEQ ID NO: 7659171 - DNA, 22 bp, Homo sapiens
aagatcctgcttttgcttctgt

SEQ ID NO: 7659172 - DNA, 22 bp, Homo sapiens
aagatcctgtactttcctcact

SEQ ID NO: 7659173 - DNA, 22 bp, Homo sapiens
aagatcctgtactttcctcact

SEQ ID NO: 7659174 - DNA, 22 bp, Homo sapiens
aagatcaggcgtggaaaacact

SEQ ID NO: 7659175 - DNA, 22 bp, Homo sapiens
aagatcaggcgtggaaaacact

SEQ ID NO: 7659176 - DNA, 22 bp, Homo sapiens
aagatcaggcgtggaaaacact

SEQ ID NO: 7659177 - DNA, 22 bp, Homo sapiens
aagatcagaactttatacagga

SEQ ID NO: 7659178 - DNA, 22 bp, Homo sapiens
aagatcagctcccgagtctgag

SEQ ID NO: 7659179 - DNA, 22 bp, Homo sapiens
aagatcagctcccgagtctgag

SEQ ID NO: 7659180 - DNA, 22 bp, Homo sapiens
aagatcaccttgacatgaaaag

SEQ ID NO: 7659181 - DNA, 22 bp, Homo sapiens
aagatcagaactttatacagga

SEQ ID NO: 7659182 - DNA, 22 bp, Homo sapiens
aagatcaccttgacatgaaaag

SEQ ID NO: 7659183 - DNA, 22 bp, Homo sapiens
aagatcagaactttatacagga

SEQ ID NO: 7659184 - DNA, 22 bp, Homo sapiens
aagatcagaactttatacagga

SEQ ID NO: 7659185 - DNA, 22 bp, Homo sapiens
aagatcaagtgctggcagtgtt

SEQ ID NO: 7659186 - DNA, 22 bp, Homo sapiens
aagatcaagtgctggcagtgtt

SEQ ID NO: 7659187 - DNA, 22 bp, Homo sapiens
aagatcaagtgtactttatgta

SEQ ID NO: 7659188 - DNA, 22 bp, Homo sapiens
aagatcaagtgtactttatgta

SEQ ID NO: 7659189 - DNA, 22 bp, Homo sapiens
aagatcaatgttcattaagatg

SEQ ID NO: 7659190 - DNA, 18 bp, Homo sapiens
aagatcacaaaatagctg

SEQ ID NO: 7659191 - DNA, 18 bp, Homo sapiens
aagatcacaaaatagctg

SEQ ID NO: 7659192 - DNA, 14 bp, Homo sapiens
aagatcaccttcct

SEQ ID NO: 7659193 - DNA, 22 bp, Homo sapiens
aagatattttagaacattcact

SEQ ID NO: 7659194 - DNA, 22 bp, Homo sapiens
aagatattttagaacattcact

SEQ ID NO: 7659195 - DNA, 22 bp, Homo sapiens
aagatattttagaacattcact

SEQ ID NO: 7659196 - DNA, 22 bp, Homo sapiens
aagatcaagatcagagaacagc

SEQ ID NO: 7659197 - DNA, 22 bp, Homo sapiens
aagatcaagatcagagaacagc

SEQ ID NO: 7659198 - DNA, 22 bp, Homo sapiens
aagatattttagaacattcact

SEQ ID NO: 7659199 - DNA, 22 bp, Homo sapiens
aagatattcaaagatttattag

SEQ ID NO: 7659200 - DNA, 22 bp, Homo sapiens
aagatattcaaagatttattag

SEQ ID NO: 7659201 - DNA, 22 bp, Homo sapiens
aagatattcaaagatttattag

SEQ ID NO: 7659202 - DNA, 22 bp, Homo sapiens
aagatattcaaagatttattag

SEQ ID NO: 7659203 - DNA, 22 bp, Homo sapiens
aagatatgaggtcacctgctgg

SEQ ID NO: 7659204 - DNA, 22 bp, Homo sapiens
aagatatattttggtgatttca

SEQ ID NO: 7659205 - DNA, 22 bp, Homo sapiens
aagatatattttggtgatttca

SEQ ID NO: 7659206 - DNA, 22 bp, Homo sapiens
aagcaggagatgggtgcttttc

SEQ ID NO: 7659207 - DNA, 22 bp, Homo sapiens
aagcaggagatgcaggaatgta

SEQ ID NO: 7659208 - DNA, 22 bp, Homo sapiens
aagcaggagatgggtgcttttc

SEQ ID NO: 7659209 - DNA, 22 bp, Homo sapiens
aagcaggatggaggttgagtta

SEQ ID NO: 7659210 - DNA, 22 bp, Homo sapiens
aagcaggatggaggttgagtta

SEQ ID NO: 7659211 - DNA, 22 bp, Homo sapiens
aagcaggagatgcaggaatgta

SEQ ID NO: 7659212 - DNA, 22 bp, Homo sapiens
aagcaggagatgcaggaatgta

SEQ ID NO: 7659213 - DNA, 22 bp, Homo sapiens
aagcaggagatgcaggaatgta

SEQ ID NO: 7659214 - DNA, 22 bp, Homo sapiens
aagcaggagagcctgggtgagc

SEQ ID NO: 7659215 - DNA, 22 bp, Homo sapiens
aagcaggagatgcaggaatgta

SEQ ID NO: 7659216 - DNA, 22 bp, Homo sapiens
aagcaggagatgcaggaatgta

SEQ ID NO: 7659217 - DNA, 22 bp, Homo sapiens
aagcaggagatgcaggaatgta

SEQ ID NO: 7659218 - DNA, 22 bp, Homo sapiens
aagcaggagatgcaggaatgta

SEQ ID NO: 7659219 - DNA, 22 bp, Homo sapiens
aagcaggagatgcaggaatgta

SEQ ID NO: 7659220 - DNA, 22 bp, Homo sapiens
aagcaggagatgcaggaatgta

SEQ ID NO: 7659221 - DNA, 22 bp, Homo sapiens
aagcaggagagcctgggcgagc

SEQ ID NO: 7659222 - DNA, 22 bp, Homo sapiens
aagcaggagagcctgggcgagc

SEQ ID NO: 7659223 - DNA, 22 bp, Homo sapiens
aagcaggagagcctgggtgagc

SEQ ID NO: 7659224 - DNA, 22 bp, Homo sapiens
aagcaggagagcctgggtgagc

SEQ ID NO: 7659225 - DNA, 22 bp, Homo sapiens
aagcaggagagcctgggtgagc

SEQ ID NO: 7659226 - DNA, 22 bp, Homo sapiens
aagcaggagagcctgggtgagc

SEQ ID NO: 7659227 - DNA, 22 bp, Homo sapiens
aagcaggagagcctgggtgagc

SEQ ID NO: 7659228 - DNA, 22 bp, Homo sapiens
aagcaggcatgggaggccatcc

SEQ ID NO: 7659229 - DNA, 22 bp, Homo sapiens
aagcaggcatgggaggccatcc

SEQ ID NO: 7659230 - DNA, 22 bp, Homo sapiens
aagcaggcatcttggaggtcaa

SEQ ID NO: 7659231 - DNA, 22 bp, Homo sapiens
aagcaggcatcttggaggtcaa

SEQ ID NO: 7659232 - DNA, 22 bp, Homo sapiens
aagcaggcatcttggaggtcaa

SEQ ID NO: 7659233 - DNA, 22 bp, Homo sapiens
aagcaggcatcttggaggtcaa

SEQ ID NO: 7659234 - DNA, 22 bp, Homo sapiens
aagcaggcaaggttgtggggca

SEQ ID NO: 7659235 - DNA, 22 bp, Homo sapiens
aagcaggatggatctagtgttc

SEQ ID NO: 7659236 - DNA, 22 bp, Homo sapiens
aagcaggatggatctagtgttc

SEQ ID NO: 7659237 - DNA, 22 bp, Homo sapiens
aagcaggatggaggttgagtta

SEQ ID NO: 7659238 - DNA, 22 bp, Homo sapiens
aagcaggatggatctagtgttc

SEQ ID NO: 7659239 - DNA, 22 bp, Homo sapiens
aagcaggcagggtggagagttt

SEQ ID NO: 7659240 - DNA, 22 bp, Homo sapiens
aagcaggcagggtggagagttt

SEQ ID NO: 7659241 - DNA, 22 bp, Homo sapiens
aagcaggcagggtggagagttt

SEQ ID NO: 7659242 - DNA, 22 bp, Homo sapiens
aagcaggcaaggttgtggggca

SEQ ID NO: 7659243 - DNA, 22 bp, Homo sapiens
aagattctagaggaacttctta

SEQ ID NO: 7659244 - DNA, 22 bp, Homo sapiens
aagcagcatatgacagcatcca

SEQ ID NO: 7659245 - DNA, 22 bp, Homo sapiens
aagcagcatatgacagcatcca

SEQ ID NO: 7659246 - DNA, 22 bp, Homo sapiens
aagcagcatcctgggcagacct

SEQ ID NO: 7659247 - DNA, 22 bp, Homo sapiens
aagcagcatatgacagcatcca

SEQ ID NO: 7659248 - DNA, 22 bp, Homo sapiens
aagcagcatatgacagcatcca

SEQ ID NO: 7659249 - DNA, 22 bp, Homo sapiens
aagattctcactgctcaacttt

SEQ ID NO: 7659250 - DNA, 22 bp, Homo sapiens
aagattctcactgctcaacttt

SEQ ID NO: 7659251 - DNA, 22 bp, Homo sapiens
aagattctcagaaaaaggctat

SEQ ID NO: 7659252 - DNA, 22 bp, Homo sapiens
aagattctcactgctcaacttt

SEQ ID NO: 7659253 - DNA, 22 bp, Homo sapiens
aagattctcactgctcaacttt

SEQ ID NO: 7659254 - DNA, 22 bp, Homo sapiens
aagattctagaggaacttctta

SEQ ID NO: 7659255 - DNA, 22 bp, Homo sapiens
aagattctacagtaggtacatt

SEQ ID NO: 7659256 - DNA, 22 bp, Homo sapiens
aagattcccagagaagttccac

SEQ ID NO: 7659257 - DNA, 22 bp, Homo sapiens
aagattctacagtaggtacatt

SEQ ID NO: 7659258 - DNA, 22 bp, Homo sapiens
aagattctacagtaggtacatt

SEQ ID NO: 7659259 - DNA, 22 bp, Homo sapiens
aagattctagaggaacttctta

SEQ ID NO: 7659260 - DNA, 22 bp, Homo sapiens
aagattctagaggaacttctta

SEQ ID NO: 7659261 - DNA, 22 bp, Homo sapiens
aagattctagaggaacttctta

SEQ ID NO: 7659262 - DNA, 22 bp, Homo sapiens
aagattcccagagaagttccac

SEQ ID NO: 7659263 - DNA, 20 bp, Homo sapiens
aagattcattgtaattaggg

SEQ ID NO: 7659264 - DNA, 22 bp, Homo sapiens
aagattctacaaactctggtaa

SEQ ID NO: 7659265 - DNA, 22 bp, Homo sapiens
aagattctacagtaggtacatt

SEQ ID NO: 7659266 - DNA, 22 bp, Homo sapiens
aagattctacagtaggtacatt

SEQ ID NO: 7659267 - DNA, 22 bp, Homo sapiens
aagattccctgaatggttcacc

SEQ ID NO: 7659268 - DNA, 22 bp, Homo sapiens
aagattccctgaatggttcacc

SEQ ID NO: 7659269 - DNA, 22 bp, Homo sapiens
aagattctacaaactctggtaa

SEQ ID NO: 7659270 - DNA, 22 bp, Homo sapiens
aagattctacaaactctggtaa

SEQ ID NO: 7659271 - DNA, 22 bp, Homo sapiens
aagattatggcagataacaatt

SEQ ID NO: 7659272 - DNA, 22 bp, Homo sapiens
aagattatggcagataacaatt

SEQ ID NO: 7659273 - DNA, 22 bp, Homo sapiens
aagattactacggaacatgacc

SEQ ID NO: 7659274 - DNA, 22 bp, Homo sapiens
aagattatggcagataacaatt

SEQ ID NO: 7659275 - DNA, 22 bp, Homo sapiens
aagattatggcagataacaatt

SEQ ID NO: 7659276 - DNA, 22 bp, Homo sapiens
aagattatggcagataacaatt

SEQ ID NO: 7659277 - DNA, 22 bp, Homo sapiens
aagattatttaagacaggaacc

SEQ ID NO: 7659278 - DNA, 22 bp, Homo sapiens
aagattatggcagataacaatt

SEQ ID NO: 7659279 - DNA, 22 bp, Homo sapiens
aagattatggcagataacaatt

SEQ ID NO: 7659280 - DNA, 22 bp, Homo sapiens
aagattatggcagataacaatt

SEQ ID NO: 7659281 - DNA, 20 bp, Homo sapiens
aagattcattgtaattaggg

SEQ ID NO: 7659282 - DNA, 22 bp, Homo sapiens
aagattcagttgatgtgttcca

SEQ ID NO: 7659283 - DNA, 22 bp, Homo sapiens
aagattcagccaaattgttcat

SEQ ID NO: 7659284 - DNA, 22 bp, Homo sapiens
aagattcagccaaattgttcat

SEQ ID NO: 7659285 - DNA, 22 bp, Homo sapiens
aagattcagccaaattgttcat

SEQ ID NO: 7659286 - DNA, 22 bp, Homo sapiens
aagattatttaagacaggaacc

SEQ ID NO: 7659287 - DNA, 22 bp, Homo sapiens
aagattcacagagtgaatgaaa

SEQ ID NO: 7659288 - DNA, 22 bp, Homo sapiens
aagattcacagagtgaatgaaa

SEQ ID NO: 7659289 - DNA, 22 bp, Homo sapiens
aagattcacagagtgaatgaaa

SEQ ID NO: 7659290 - DNA, 22 bp, Homo sapiens
aagattcacagagtgaatgaaa

SEQ ID NO: 7659291 - DNA, 22 bp, Homo sapiens
aagattcacagagtgaatgaaa

SEQ ID NO: 7659292 - DNA, 22 bp, Homo sapiens
aaagattaaggtattgttagct

SEQ ID NO: 7659293 - DNA, 22 bp, Homo sapiens
aaagattaaggtattgttagct

SEQ ID NO: 7659294 - DNA, 22 bp, Homo sapiens
aaagattaaggtattgttagct

SEQ ID NO: 7659295 - DNA, 22 bp, Homo sapiens
aaagattaaggtattgttagct

SEQ ID NO: 7659296 - DNA, 22 bp, Homo sapiens
aaagattagataagatagattt

SEQ ID NO: 7659297 - DNA, 22 bp, Homo sapiens
aaagattagataagatagattt

SEQ ID NO: 7659298 - DNA, 22 bp, Homo sapiens
aaagattagataagatagattt

SEQ ID NO: 7659299 - DNA, 22 bp, Homo sapiens
aaagattagataagatagattt

SEQ ID NO: 7659300 - DNA, 22 bp, Homo sapiens
aaagattagataagatagattt

SEQ ID NO: 7659301 - DNA, 22 bp, Homo sapiens
aaagattagataagatagattt

SEQ ID NO: 7659302 - DNA, 22 bp, Homo sapiens
aaagattagataagatagattt

SEQ ID NO: 7659303 - DNA, 22 bp, Homo sapiens
aaagattaggcggcaactgggc

SEQ ID NO: 7659304 - DNA, 22 bp, Homo sapiens
aaagattaggcggcaactgggc

SEQ ID NO: 7659305 - DNA, 22 bp, Homo sapiens
aaagattatggcattgaaatac

SEQ ID NO: 7659306 - DNA, 22 bp, Homo sapiens
aaagattatggcattgaaatac

SEQ ID NO: 7659307 - DNA, 22 bp, Homo sapiens
aaagattatggcattgaaatac

SEQ ID NO: 7659308 - DNA, 22 bp, Homo sapiens
aaagattatggcattgaaatac

SEQ ID NO: 7659309 - DNA, 22 bp, Homo sapiens
aaagattatggcattgaaatac

SEQ ID NO: 7659310 - DNA, 22 bp, Homo sapiens
aaagattatggcattgaaatac

SEQ ID NO: 7659311 - DNA, 22 bp, Homo sapiens
aaagattatggcattgaaatac

SEQ ID NO: 7659312 - DNA, 22 bp, Homo sapiens
aaagattatggaacacacatga

SEQ ID NO: 7659313 - DNA, 22 bp, Homo sapiens
aaagattatggaacacacatga

SEQ ID NO: 7659314 - DNA, 22 bp, Homo sapiens
aaagattatggaacacacatga

SEQ ID NO: 7659315 - DNA, 22 bp, Homo sapiens
aaagattatggaacacacatga

SEQ ID NO: 7659316 - DNA, 22 bp, Homo sapiens
aaagattaggcggcaactgggc

SEQ ID NO: 7659317 - DNA, 22 bp, Homo sapiens
aaagattatggaacacacatga

SEQ ID NO: 7659318 - DNA, 22 bp, Homo sapiens
aaagattatggaacacacatga

SEQ ID NO: 7659319 - DNA, 22 bp, Homo sapiens
aaagattaaatcaaattggtca

SEQ ID NO: 7659320 - DNA, 22 bp, Homo sapiens
aaagattaaatcaaattggtca

SEQ ID NO: 7659321 - DNA, 22 bp, Homo sapiens
aaagattaaatcaaattggtca

SEQ ID NO: 7659322 - DNA, 22 bp, Homo sapiens
aaagattaaatcaaattggtca

SEQ ID NO: 7659323 - DNA, 22 bp, Homo sapiens
aaagatgttttataagttatgg

SEQ ID NO: 7659324 - DNA, 22 bp, Homo sapiens
aaagatgttttataagttatgg

SEQ ID NO: 7659325 - DNA, 22 bp, Homo sapiens
aaagatgttttataagttatgg

SEQ ID NO: 7659326 - DNA, 22 bp, Homo sapiens
aaagatgttttataagttatgg

SEQ ID NO: 7659327 - DNA, 22 bp, Homo sapiens
aaagatgttttataagttatgg

SEQ ID NO: 7659328 - DNA, 22 bp, Homo sapiens
aaagatgttttataagttatgg

SEQ ID NO: 7659329 - DNA, 22 bp, Homo sapiens
aaagatgttttacatagcacct

SEQ ID NO: 7659330 - DNA, 22 bp, Homo sapiens
aaagatgttttacatagcacct

SEQ ID NO: 7659331 - DNA, 22 bp, Homo sapiens
aaagatgttttacatagcacct

SEQ ID NO: 7659332 - DNA, 22 bp, Homo sapiens
aaagatgtttgttccaaaattc

SEQ ID NO: 7659333 - DNA, 22 bp, Homo sapiens
aaagatgtttgttccaaaattc

SEQ ID NO: 7659334 - DNA, 21 bp, Homo sapiens
aaagatgtttcttttcctcac

SEQ ID NO: 7659335 - DNA, 21 bp, Homo sapiens
aaagatgtttcatctgagaaa

SEQ ID NO: 7659336 - DNA, 22 bp, Homo sapiens
aaagattatggcattgaaatac

SEQ ID NO: 7659337 - DNA, 22 bp, Homo sapiens
aaagattcgagcgatgtataaa

SEQ ID NO: 7659338 - DNA, 22 bp, Homo sapiens
aaagattcgagcgatgtataaa

SEQ ID NO: 7659339 - DNA, 22 bp, Homo sapiens
aaagattcctttattctccaag

SEQ ID NO: 7659340 - DNA, 22 bp, Homo sapiens
aaagattcctttattctccaag

SEQ ID NO: 7659341 - DNA, 22 bp, Homo sapiens
aaagatttaagaataatttgtg

SEQ ID NO: 7659342 - DNA, 22 bp, Homo sapiens
aaagatttaagaataatttgtg

SEQ ID NO: 7659343 - DNA, 22 bp, Homo sapiens
aaagattgatcatgaattgaca

SEQ ID NO: 7659344 - DNA, 22 bp, Homo sapiens
aaagattcgagcgatgtataaa

SEQ ID NO: 7659345 - DNA, 22 bp, Homo sapiens
aaagattcgagcgatgtataaa

SEQ ID NO: 7659346 - DNA, 22 bp, Homo sapiens
aaagattgaaagagaatttgtc

SEQ ID NO: 7659347 - DNA, 22 bp, Homo sapiens
aaagattgaaagagaatttgtc

SEQ ID NO: 7659348 - DNA, 22 bp, Homo sapiens
aaagatttaagaataatttgtg

SEQ ID NO: 7659349 - DNA, 22 bp, Homo sapiens
aaagatttatgaagttcaatta

SEQ ID NO: 7659350 - DNA, 22 bp, Homo sapiens
aaagatttatgaagttcaatta

SEQ ID NO: 7659351 - DNA, 22 bp, Homo sapiens
aaagatttaagaataatttgtg

SEQ ID NO: 7659352 - DNA, 22 bp, Homo sapiens
aaagatttaagaataatttgtg

SEQ ID NO: 7659353 - DNA, 22 bp, Homo sapiens
aaagatttaagaataatttgtg

SEQ ID NO: 7659354 - DNA, 22 bp, Homo sapiens
aaagatttaagaataatttgtg

SEQ ID NO: 7659355 - DNA, 22 bp, Homo sapiens
aaagatttaagaataatttgtg

SEQ ID NO: 7659356 - DNA, 22 bp, Homo sapiens
aaagatttgagttctgcttata

SEQ ID NO: 7659357 - DNA, 22 bp, Homo sapiens
aaagatttgaaattaggcatca

SEQ ID NO: 7659358 - DNA, 22 bp, Homo sapiens
aaagatttgagttctgcttata

SEQ ID NO: 7659359 - DNA, 22 bp, Homo sapiens
aaagatttgagttctgcttata

SEQ ID NO: 7659360 - DNA, 22 bp, Homo sapiens
aaagatttgagttctgcttata

SEQ ID NO: 7659361 - DNA, 22 bp, Homo sapiens
aaagatttgaaattaggcatca

SEQ ID NO: 7659362 - DNA, 22 bp, Homo sapiens
aaagatttcagaagcctgtgcc

SEQ ID NO: 7659363 - DNA, 22 bp, Homo sapiens
aaagatttcagaagcctgtgcc

SEQ ID NO: 7659364 - DNA, 22 bp, Homo sapiens
aaagatttatgaagttcaatta

SEQ ID NO: 7659365 - DNA, 22 bp, Homo sapiens
aaagatttatgaagttcaatta

SEQ ID NO: 7659366 - DNA, 22 bp, Homo sapiens
aaagatttatgaagttcaatta

SEQ ID NO: 7659367 - DNA, 22 bp, Homo sapiens
aacacttaaggagagatcaaat

SEQ ID NO: 7659368 - DNA, 22 bp, Homo sapiens
aacacttaaggagagatcaaat

SEQ ID NO: 7659369 - DNA, 22 bp, Homo sapiens
aacactgtggtcttttcagtaa

SEQ ID NO: 7659370 - DNA, 22 bp, Homo sapiens
aacacttatccacatttgaaag

SEQ ID NO: 7659371 - DNA, 22 bp, Homo sapiens
aacacttatccacatttgaaag

SEQ ID NO: 7659372 - DNA, 22 bp, Homo sapiens
aacacttatccacatttgaaag

SEQ ID NO: 7659373 - DNA, 22 bp, Homo sapiens
aacacttaaggagagatcaaat

SEQ ID NO: 7659374 - DNA, 22 bp, Homo sapiens
aacacttaaggagagatcaaat

SEQ ID NO: 7659375 - DNA, 22 bp, Homo sapiens
aacacttcaagcagaaggttgg

SEQ ID NO: 7659376 - DNA, 22 bp, Homo sapiens
aacacttcccatcagagggaca

SEQ ID NO: 7659377 - DNA, 22 bp, Homo sapiens
aacacttcccatcagagggaca

SEQ ID NO: 7659378 - DNA, 22 bp, Homo sapiens
aacacttcccgaccatatggct

SEQ ID NO: 7659379 - DNA, 22 bp, Homo sapiens
aacacttcccgaccatatggct

SEQ ID NO: 7659380 - DNA, 22 bp, Homo sapiens
aacacttctgttgataataagc

SEQ ID NO: 7659381 - DNA, 22 bp, Homo sapiens
aacacttctgttgataataagc

SEQ ID NO: 7659382 - DNA, 22 bp, Homo sapiens
aacacttgaatgtgtagcagct

SEQ ID NO: 7659383 - DNA, 22 bp, Homo sapiens
aacacttgaatgtgtagcagct

SEQ ID NO: 7659384 - DNA, 22 bp, Homo sapiens
aacacttctgttgataataagc

SEQ ID NO: 7659385 - DNA, 22 bp, Homo sapiens
aacacttctcatcactgcaagc

SEQ ID NO: 7659386 - DNA, 22 bp, Homo sapiens
aacacttctcatcactgcaagc

SEQ ID NO: 7659387 - DNA, 22 bp, Homo sapiens
aacactgtggtcttttcagtaa

SEQ ID NO: 7659388 - DNA, 22 bp, Homo sapiens
aacactgtggtcttttcagtaa

SEQ ID NO: 7659389 - DNA, 22 bp, Homo sapiens
aacactgtgctccccaggctgt

SEQ ID NO: 7659390 - DNA, 22 bp, Homo sapiens
aacactgtggtcttttcagtaa

SEQ ID NO: 7659391 - DNA, 22 bp, Homo sapiens
aacactgtggtcttttcagtaa

SEQ ID NO: 7659392 - DNA, 22 bp, Homo sapiens
aacactgtgctccccaggctgt

SEQ ID NO: 7659393 - DNA, 20 bp, Homo sapiens
aacactgtgcgtggtaggtg

SEQ ID NO: 7659394 - DNA, 20 bp, Homo sapiens
aacactgtgcgtggtaggtg

SEQ ID NO: 7659395 - DNA, 20 bp, Homo sapiens
aacactgtgcgtggtaggtg

SEQ ID NO: 7659396 - DNA, 22 bp, Homo sapiens
aacactgtgaggtaatgaccta

SEQ ID NO: 7659397 - DNA, 22 bp, Homo sapiens
aacactgtgaggtaatgaccta

SEQ ID NO: 7659398 - DNA, 22 bp, Homo sapiens
aacactgtgcagtgtaatgctg

SEQ ID NO: 7659399 - DNA, 22 bp, Homo sapiens
aacactgtgaggtaatgaccta

SEQ ID NO: 7659400 - DNA, 22 bp, Homo sapiens
aacactgtgcccaccctagtcc

SEQ ID NO: 7659401 - DNA, 22 bp, Homo sapiens
aacactgtgcccaccctagtcc

SEQ ID NO: 7659402 - DNA, 22 bp, Homo sapiens
aacactgtgcccaccctagtcc

SEQ ID NO: 7659403 - DNA, 22 bp, Homo sapiens
aacactgtgcagtgtaatgctg

SEQ ID NO: 7659404 - DNA, 23 bp, Homo sapiens
aaagcaaggaattggcaacagag

SEQ ID NO: 7659405 - DNA, 23 bp, Homo sapiens
aaagcaaggaattggcaacagag

SEQ ID NO: 7659406 - DNA, 22 bp, Homo sapiens
aaagcaagtctctacaaagtac

SEQ ID NO: 7659407 - DNA, 22 bp, Homo sapiens
aaagcaagtctctacaaagtac

SEQ ID NO: 7659408 - DNA, 22 bp, Homo sapiens
aaagcaagtctctacaaagtac

SEQ ID NO: 7659409 - DNA, 22 bp, Homo sapiens
aaagcaagtctctacaaagtac

SEQ ID NO: 7659410 - DNA, 22 bp, Homo sapiens
aaagcaagtctctacaaagtac

SEQ ID NO: 7659411 - DNA, 22 bp, Homo sapiens
aaagcaagtctctacaaagtac

SEQ ID NO: 7659412 - DNA, 22 bp, Homo sapiens
aaagcaagatgcatccgtcaag

SEQ ID NO: 7659413 - DNA, 22 bp, Homo sapiens
aaagcaagatgcatccgtcaag

SEQ ID NO: 7659414 - DNA, 22 bp, Homo sapiens
aaagcaaacagaaccccaagct

SEQ ID NO: 7659415 - DNA, 22 bp, Homo sapiens
aaagcaaacagaaccccaagct

SEQ ID NO: 7659416 - DNA, 22 bp, Homo sapiens
aaagcaaacagaaccccaagct

SEQ ID NO: 7659417 - DNA, 22 bp, Homo sapiens
aaagcaaacagaaccccaagct

SEQ ID NO: 7659418 - DNA, 23 bp, Homo sapiens
aaagcaaggaattggcaacagag

SEQ ID NO: 7659419 - DNA, 23 bp, Homo sapiens
aaagcaaggaattggcaacagag

SEQ ID NO: 7659420 - DNA, 23 bp, Homo sapiens
aaagcaaggaattggcaacagag

SEQ ID NO: 7659421 - DNA, 23 bp, Homo sapiens
aaagcaaggaattggcaacagag

SEQ ID NO: 7659422 - DNA, 22 bp, Homo sapiens
aacactgtcttatacttcaatg

SEQ ID NO: 7659423 - DNA, 22 bp, Homo sapiens
aacactgtcttatacttcaatg

SEQ ID NO: 7659424 - DNA, 22 bp, Homo sapiens
aacactgtcttatacttcaatg

SEQ ID NO: 7659425 - DNA, 22 bp, Homo sapiens
aacactgtcttatacttcaatg

SEQ ID NO: 7659426 - DNA, 22 bp, Homo sapiens
aacactgtcttatacttcaatg

SEQ ID NO: 7659427 - DNA, 22 bp, Homo sapiens
aacactgtcagcctttgatgga

SEQ ID NO: 7659428 - DNA, 22 bp, Homo sapiens
aacactgtcagcctttgatgga

SEQ ID NO: 7659429 - DNA, 22 bp, Homo sapiens
aacactgtcagcctttgatgga

SEQ ID NO: 7659430 - DNA, 23 bp, Homo sapiens
aacaccaaggctcagagagataa

SEQ ID NO: 7659431 - DNA, 22 bp, Homo sapiens
aacacattttgcctaggcaata

SEQ ID NO: 7659432 - DNA, 22 bp, Homo sapiens
aacacattttgcctaggcaata

SEQ ID NO: 7659433 - DNA, 22 bp, Homo sapiens
aacacattttgcctaggcaata

SEQ ID NO: 7659434 - DNA, 22 bp, Homo sapiens
aacacattttgcctaggcaata

SEQ ID NO: 7659435 - DNA, 22 bp, Homo sapiens
aacacattttgcctaggcaata

SEQ ID NO: 7659436 - DNA, 22 bp, Homo sapiens
aacacattttgcctaggcaata

SEQ ID NO: 7659437 - DNA, 22 bp, Homo sapiens
aacacattttgcctaggcaata

SEQ ID NO: 7659438 - DNA, 22 bp, Homo sapiens
aacacattttgcctaggcaata

SEQ ID NO: 7659439 - DNA, 22 bp, Homo sapiens
aaagcaagtctctacaaagtac

SEQ ID NO: 7659440 - DNA, 22 bp, Homo sapiens
aaagcaagtctctacaaagtac

SEQ ID NO: 7659441 - DNA, 22 bp, Homo sapiens
aacacatttattaagggatgtt

SEQ ID NO: 7659442 - DNA, 23 bp, Homo sapiens
aacacttgcatgaacagctacac

SEQ ID NO: 7659443 - DNA, 22 bp, Homo sapiens
aacactttccgtaggtttagta

SEQ ID NO: 7659444 - DNA, 22 bp, Homo sapiens
aacactttccgtaggtttagta

SEQ ID NO: 7659445 - DNA, 23 bp, Homo sapiens
aacacttgcatgaacagctacac

SEQ ID NO: 7659446 - DNA, 23 bp, Homo sapiens
aacacttgcatgaacagctacac

SEQ ID NO: 7659447 - DNA, 22 bp, Homo sapiens
aacactttcctgcctttctgat

SEQ ID NO: 7659448 - DNA, 22 bp, Homo sapiens
aacactttcctgcctttctgat

SEQ ID NO: 7659449 - DNA, 22 bp, Homo sapiens
aacactttcctgcctttctgat

SEQ ID NO: 7659450 - DNA, 22 bp, Homo sapiens
aaagcactcgttagtatttctg

SEQ ID NO: 7659451 - DNA, 22 bp, Homo sapiens
aacactttcctgcctttctgat

SEQ ID NO: 7659452 - DNA, 22 bp, Homo sapiens
aaagcacttcaggagcagtttg

SEQ ID NO: 7659453 - DNA, 22 bp, Homo sapiens
aaagcacttcaggagcagtttg

SEQ ID NO: 7659454 - DNA, 22 bp, Homo sapiens
aaagcacttcaggagcagtttg

SEQ ID NO: 7659455 - DNA, 22 bp, Homo sapiens
aaagcacttcaggagcagtttg

SEQ ID NO: 7659456 - DNA, 22 bp, Homo sapiens
aaagcactctatcctttgtaga

SEQ ID NO: 7659457 - DNA, 22 bp, Homo sapiens
aaagcactgcacatatatttgc

SEQ ID NO: 7659458 - DNA, 22 bp, Homo sapiens
aaagcactgcacatatatttgc

SEQ ID NO: 7659459 - DNA, 22 bp, Homo sapiens
aaagcactcgttagtatttctg

SEQ ID NO: 7659460 - DNA, 22 bp, Homo sapiens
aaagcactcgttagtatttctg

SEQ ID NO: 7659461 - DNA, 22 bp, Homo sapiens
aaagcactcgttagtatttctg

SEQ ID NO: 7659462 - DNA, 22 bp, Homo sapiens
aaagcactctatcctttgtaga

SEQ ID NO: 7659463 - DNA, 22 bp, Homo sapiens
aaagcactctatcctttgtaga

SEQ ID NO: 7659464 - DNA, 22 bp, Homo sapiens
aaagcagagatcatggcttgta

SEQ ID NO: 7659465 - DNA, 22 bp, Homo sapiens
aaagcagactgatttgcatcac

SEQ ID NO: 7659466 - DNA, 22 bp, Homo sapiens
aaagcagagcagggcacttatg

SEQ ID NO: 7659467 - DNA, 22 bp, Homo sapiens
aaagcagagcagggcacttatg

SEQ ID NO: 7659468 - DNA, 19 bp, Homo sapiens
aaagcagaggagcatctga

SEQ ID NO: 7659469 - DNA, 19 bp, Homo sapiens
aaagcagaggagcatctga

SEQ ID NO: 7659470 - DNA, 22 bp, Homo sapiens
aaagcagactgatttgcatcac

SEQ ID NO: 7659471 - DNA, 22 bp, Homo sapiens
aaagcagactgatttgcatcac

SEQ ID NO: 7659472 - DNA, 22 bp, Homo sapiens
aaagcagaactgagagagctgg

SEQ ID NO: 7659473 - DNA, 22 bp, Homo sapiens
aaagcagaactgagagagctgg

SEQ ID NO: 7659474 - DNA, 22 bp, Homo sapiens
aaagcagaactgagagagctgg

SEQ ID NO: 7659475 - DNA, 22 bp, Homo sapiens
aaagcactttgagactgacagg

SEQ ID NO: 7659476 - DNA, 22 bp, Homo sapiens
aaagcactttgagactgacagg

SEQ ID NO: 7659477 - DNA, 22 bp, Homo sapiens
aaagcacttgaaatctggcagt

SEQ ID NO: 7659478 - DNA, 22 bp, Homo sapiens
aacagtgatatcaagacagaca

SEQ ID NO: 7659479 - DNA, 22 bp, Homo sapiens
aacagtgatatcaagacagaca

SEQ ID NO: 7659480 - DNA, 22 bp, Homo sapiens
aacagtgatatcaagacagaca

SEQ ID NO: 7659481 - DNA, 22 bp, Homo sapiens
aacataagggagcttcaaaact

SEQ ID NO: 7659482 - DNA, 22 bp, Homo sapiens
aacataagggagcttcaaaact

SEQ ID NO: 7659483 - DNA, 22 bp, Homo sapiens
aacataagggagcttcaaaact

SEQ ID NO: 7659484 - DNA, 22 bp, Homo sapiens
aacagtgagttgatgactgaat

SEQ ID NO: 7659485 - DNA, 22 bp, Homo sapiens
aacagtgagttgatgactgaat

SEQ ID NO: 7659486 - DNA, 22 bp, Homo sapiens
aacagtgaggtgaatatgctcc

SEQ ID NO: 7659487 - DNA, 22 bp, Homo sapiens
aacagtgaggtgaatatgctcc

SEQ ID NO: 7659488 - DNA, 22 bp, Homo sapiens
aacagtgatatcaagacagaca

SEQ ID NO: 7659489 - DNA, 22 bp, Homo sapiens
aacagtgagttgatgactgaat

SEQ ID NO: 7659490 - DNA, 22 bp, Homo sapiens
aaagcagcaaatacttttgcac

SEQ ID NO: 7659491 - DNA, 22 bp, Homo sapiens
aaagcagcaaatacttttgcac

SEQ ID NO: 7659492 - DNA, 22 bp, Homo sapiens
aaagcagattctgatgcagtag

SEQ ID NO: 7659493 - DNA, 22 bp, Homo sapiens
aacagtgaggtgaatatgctcc

SEQ ID NO: 7659494 - DNA, 19 bp, Homo sapiens
aacagtgaggcccagcctg

SEQ ID NO: 7659495 - DNA, 19 bp, Homo sapiens
aacagtgaggcccagcctg

SEQ ID NO: 7659496 - DNA, 22 bp, Homo sapiens
aaagcagcaacagctgttagaa

SEQ ID NO: 7659497 - DNA, 22 bp, Homo sapiens
aaagcagcaacagctgttagaa

SEQ ID NO: 7659498 - DNA, 22 bp, Homo sapiens
aaagcagcaacagctgttagaa

SEQ ID NO: 7659499 - DNA, 22 bp, Homo sapiens
aaagcagaggtgatatgactta

SEQ ID NO: 7659500 - DNA, 22 bp, Homo sapiens
aaagcagaggtgatatgactta

SEQ ID NO: 7659501 - DNA, 19 bp, Homo sapiens
aaagcagaggagcatctga

SEQ ID NO: 7659502 - DNA, 19 bp, Homo sapiens
aaagcagaggagcatctga

SEQ ID NO: 7659503 - DNA, 19 bp, Homo sapiens
aaagcagaggagcatctga

SEQ ID NO: 7659504 - DNA, 22 bp, Homo sapiens
aaagcagaggtgatatgactta

SEQ ID NO: 7659505 - DNA, 22 bp, Homo sapiens
aaagcagaggtgatatgactta

SEQ ID NO: 7659506 - DNA, 22 bp, Homo sapiens
aaagcagaggtgatatgactta

SEQ ID NO: 7659507 - DNA, 22 bp, Homo sapiens
aaagcagaggtgatatgactta

SEQ ID NO: 7659508 - DNA, 22 bp, Homo sapiens
aaagcagaggtgatatgactta

SEQ ID NO: 7659509 - DNA, 22 bp, Homo sapiens
aaagcagattctgatgcagtag

SEQ ID NO: 7659510 - DNA, 22 bp, Homo sapiens
aaagcagattctgatgcagtag

SEQ ID NO: 7659511 - DNA, 22 bp, Homo sapiens
aaagcagaggttgcagtgagct

SEQ ID NO: 7659512 - DNA, 22 bp, Homo sapiens
aaagcagaggttgcagtgagct

SEQ ID NO: 7659513 - DNA, 22 bp, Homo sapiens
aaagcagaggttgcagtgagct

SEQ ID NO: 7659514 - DNA, 22 bp, Homo sapiens
aaagcagaggttgcagtgagct

SEQ ID NO: 7659515 - DNA, 22 bp, Homo sapiens
aaagcagaggttgcagtgagct

SEQ ID NO: 7659516 - DNA, 22 bp, Homo sapiens
aaagcagaggttgcagtgagct

SEQ ID NO: 7659517 - DNA, 22 bp, Homo sapiens
aaagcagaggttgcagtgagct

SEQ ID NO: 7659518 - DNA, 22 bp, Homo sapiens
aaagcagaggttgcagtgagct

SEQ ID NO: 7659519 - DNA, 22 bp, Homo sapiens
aaagccattacaaaatttcata

SEQ ID NO: 7659520 - DNA, 22 bp, Homo sapiens
aaagccattacaaaatttcata

SEQ ID NO: 7659521 - DNA, 22 bp, Homo sapiens
aaagccattgaactgtacttta

SEQ ID NO: 7659522 - DNA, 22 bp, Homo sapiens
aaagccattacaaaatttcata

SEQ ID NO: 7659523 - DNA, 22 bp, Homo sapiens
aaagccattgaactgtacttta

SEQ ID NO: 7659524 - DNA, 22 bp, Homo sapiens
aaagccattgcagagcaggatt

SEQ ID NO: 7659525 - DNA, 22 bp, Homo sapiens
aaagcctcccaggttatgagta

SEQ ID NO: 7659526 - DNA, 22 bp, Homo sapiens
aaagcctcccaggttatgagta

SEQ ID NO: 7659527 - DNA, 22 bp, Homo sapiens
aaagcctcccaggttatgagta

SEQ ID NO: 7659528 - DNA, 22 bp, Homo sapiens
aaagcctcccaggttatgagta

SEQ ID NO: 7659529 - DNA, 22 bp, Homo sapiens
aaagcccccctgatctgagatg

SEQ ID NO: 7659530 - DNA, 22 bp, Homo sapiens
aaagcccccctgatctgagatg

SEQ ID NO: 7659531 - DNA, 22 bp, Homo sapiens
aaagcccatgtggaagtacagg

SEQ ID NO: 7659532 - DNA, 22 bp, Homo sapiens
aaagcccatgtggaagtacagg

SEQ ID NO: 7659533 - DNA, 22 bp, Homo sapiens
aaagcccatgtggaagtacagg

SEQ ID NO: 7659534 - DNA, 22 bp, Homo sapiens
aacatataaactcttaagttca

SEQ ID NO: 7659535 - DNA, 22 bp, Homo sapiens
aacatagctttactcaaatgac

SEQ ID NO: 7659536 - DNA, 22 bp, Homo sapiens
aacatataaactcttaagttca

SEQ ID NO: 7659537 - DNA, 22 bp, Homo sapiens
aacatataaactcttaagttca

SEQ ID NO: 7659538 - DNA, 22 bp, Homo sapiens
aacatataaactcttaagttca

SEQ ID NO: 7659539 - DNA, 22 bp, Homo sapiens
aacatataaactcttaagttca

SEQ ID NO: 7659540 - DNA, 22 bp, Homo sapiens
aaagccatgggtctttggcata

SEQ ID NO: 7659541 - DNA, 22 bp, Homo sapiens
aacatataaactcttaagttca

SEQ ID NO: 7659542 - DNA, 22 bp, Homo sapiens
aacatagagacaggaagtgctt

SEQ ID NO: 7659543 - DNA, 22 bp, Homo sapiens
aacatagagacaggaagtgctt

SEQ ID NO: 7659544 - DNA, 22 bp, Homo sapiens
aacatagagacaggaagtgctt

SEQ ID NO: 7659545 - DNA, 22 bp, Homo sapiens
aacatagccagaatgtctcctg

SEQ ID NO: 7659546 - DNA, 22 bp, Homo sapiens
aacatagcgagacactgtgtct

SEQ ID NO: 7659547 - DNA, 22 bp, Homo sapiens
aacatagcgagacactgtgtct

SEQ ID NO: 7659548 - DNA, 23 bp, Homo sapiens
aacatagcattccattcattagt

SEQ ID NO: 7659549 - DNA, 22 bp, Homo sapiens
aacatagctttactcaaatgac

SEQ ID NO: 7659550 - DNA, 22 bp, Homo sapiens
aacatagacccagttcaacaaa

SEQ ID NO: 7659551 - DNA, 22 bp, Homo sapiens
aacatagacccagttcaacaaa

SEQ ID NO: 7659552 - DNA, 22 bp, Homo sapiens
aacatagacccagttcaacaaa

SEQ ID NO: 7659553 - DNA, 22 bp, Homo sapiens
aacatagacccagttcaacaaa

SEQ ID NO: 7659554 - DNA, 22 bp, Homo sapiens
aacatagaattgttatattttc

SEQ ID NO: 7659555 - DNA, 22 bp, Homo sapiens
aacatacatatttcagtgtcca

SEQ ID NO: 7659556 - DNA, 22 bp, Homo sapiens
aacatacatatttcagtgtcca

SEQ ID NO: 7659557 - DNA, 22 bp, Homo sapiens
aacatacatatttcagtgtcca

SEQ ID NO: 7659558 - DNA, 22 bp, Homo sapiens
aacatacatatttcagtgtcca

SEQ ID NO: 7659559 - DNA, 22 bp, Homo sapiens
aacatacatatttcagtgtcca

SEQ ID NO: 7659560 - DNA, 22 bp, Homo sapiens
aacatacatatttcagtgtcca

SEQ ID NO: 7659561 - DNA, 22 bp, Homo sapiens
aacatacagtgagcagtggact

SEQ ID NO: 7659562 - DNA, 22 bp, Homo sapiens
aacatacagtgagcagtggact

SEQ ID NO: 7659563 - DNA, 22 bp, Homo sapiens
aacatacagtgagcagtggact

SEQ ID NO: 7659564 - DNA, 22 bp, Homo sapiens
aacatacagtgagcagtggact

SEQ ID NO: 7659565 - DNA, 22 bp, Homo sapiens
aacatacagtgagcagtggact

SEQ ID NO: 7659566 - DNA, 22 bp, Homo sapiens
aacatacagtgagcagtggact

SEQ ID NO: 7659567 - DNA, 22 bp, Homo sapiens
aacatacagtgagcagtggact

SEQ ID NO: 7659568 - DNA, 22 bp, Homo sapiens
aacataatgtggccaaagtcac

SEQ ID NO: 7659569 - DNA, 22 bp, Homo sapiens
aacataagtggcactttgccca

SEQ ID NO: 7659570 - DNA, 22 bp, Homo sapiens
aacataagtggcactttgccca

SEQ ID NO: 7659571 - DNA, 22 bp, Homo sapiens
aacataatgtggccaaagtcac

SEQ ID NO: 7659572 - DNA, 22 bp, Homo sapiens
aacataatgtggccaaagtcac

SEQ ID NO: 7659573 - DNA, 22 bp, Homo sapiens
aacataatgtggccaaagtcac

SEQ ID NO: 7659574 - DNA, 22 bp, Homo sapiens
aacataatgtggccaaagtcac

SEQ ID NO: 7659575 - DNA, 22 bp, Homo sapiens
aacatagaattgttatattttc

SEQ ID NO: 7659576 - DNA, 22 bp, Homo sapiens
aacatagaattgttatattttc

SEQ ID NO: 7659577 - DNA, 22 bp, Homo sapiens
aacatagaattgttatattttc

SEQ ID NO: 7659578 - DNA, 22 bp, Homo sapiens
aacatagaattgttatattttc

SEQ ID NO: 7659579 - DNA, 22 bp, Homo sapiens
aacatagaatggctccagagct

SEQ ID NO: 7659580 - DNA, 22 bp, Homo sapiens
aacatagaatggctccagagct

SEQ ID NO: 7659581 - DNA, 22 bp, Homo sapiens
aacatagaataaatgagttagg

SEQ ID NO: 7659582 - DNA, 22 bp, Homo sapiens
aacatagaataaatgagttagg

SEQ ID NO: 7659583 - DNA, 22 bp, Homo sapiens
aacatagaataaatgagttagg

SEQ ID NO: 7659584 - DNA, 22 bp, Homo sapiens
aacatagaataaatgagttagg

SEQ ID NO: 7659585 - DNA, 22 bp, Homo sapiens
aacatagaagatggttaattgt

SEQ ID NO: 7659586 - DNA, 22 bp, Homo sapiens
aacatagaagatggttaattgt

SEQ ID NO: 7659587 - DNA, 22 bp, Homo sapiens
aacatagaagatggttaattgt

SEQ ID NO: 7659588 - DNA, 23 bp, Homo sapiens
aacatactgtttaatattcacag

SEQ ID NO: 7659589 - DNA, 23 bp, Homo sapiens
aacatactgtttaatattcacag

SEQ ID NO: 7659590 - DNA, 22 bp, Homo sapiens
aacatacgagcagtttatagag

SEQ ID NO: 7659591 - DNA, 22 bp, Homo sapiens
aacatacttatactaaataatg

SEQ ID NO: 7659592 - DNA, 23 bp, Homo sapiens
aacatactgtttaatattcacag

SEQ ID NO: 7659593 - DNA, 22 bp, Homo sapiens
aacatacttatactaaataatg

SEQ ID NO: 7659594 - DNA, 22 bp, Homo sapiens
aacatacttatactaaataatg

SEQ ID NO: 7659595 - DNA, 22 bp, Homo sapiens
aacatacttatactaaataatg

SEQ ID NO: 7659596 - DNA, 22 bp, Homo sapiens
aacatacttgtactatgcatat

SEQ ID NO: 7659597 - DNA, 22 bp, Homo sapiens
aacatacttgtactatgcatat

SEQ ID NO: 7659598 - DNA, 22 bp, Homo sapiens
aacatacttgtactatgcatat

SEQ ID NO: 7659599 - DNA, 22 bp, Homo sapiens
aacatacttatactaaataatg

SEQ ID NO: 7659600 - DNA, 22 bp, Homo sapiens
aacatacttatactaaataatg

SEQ ID NO: 7659601 - DNA, 22 bp, Homo sapiens
aagaaataagacttctctgtcc

SEQ ID NO: 7659602 - DNA, 22 bp, Homo sapiens
aaagtaattgtggttcttgcca

SEQ ID NO: 7659603 - DNA, 22 bp, Homo sapiens
aagaaataagacttctctgtcc

SEQ ID NO: 7659604 - DNA, 22 bp, Homo sapiens
aagaaataagacttctctgtcc

SEQ ID NO: 7659605 - DNA, 22 bp, Homo sapiens
aagaaataagacttctctgtcc

SEQ ID NO: 7659606 - DNA, 22 bp, Homo sapiens
aagaaataagacttctctgtcc

SEQ ID NO: 7659607 - DNA, 22 bp, Homo sapiens
aaagtaattgcagtttctgcca

SEQ ID NO: 7659608 - DNA, 22 bp, Homo sapiens
aaagtaattgcagtttctgcca

SEQ ID NO: 7659609 - DNA, 22 bp, Homo sapiens
aaagtaattgcagtttctgcca

SEQ ID NO: 7659610 - DNA, 22 bp, Homo sapiens
aaagtaattaagaagctggaca

SEQ ID NO: 7659611 - DNA, 22 bp, Homo sapiens
aaagtaattaagaagctggaca

SEQ ID NO: 7659612 - DNA, 22 bp, Homo sapiens
aaagtaagggttaatctacttt

SEQ ID NO: 7659613 - DNA, 22 bp, Homo sapiens
aaagtaagatttgcatttcaga

SEQ ID NO: 7659614 - DNA, 22 bp, Homo sapiens
aaagtaagaccaagtgatcatt

SEQ ID NO: 7659615 - DNA, 22 bp, Homo sapiens
aaaggtttttatttatcctgga

SEQ ID NO: 7659616 - DNA, 22 bp, Homo sapiens
aaaggtttttcagcagggagat

SEQ ID NO: 7659617 - DNA, 22 bp, Homo sapiens
aaaggtttttcagcagggagat

SEQ ID NO: 7659618 - DNA, 22 bp, Homo sapiens
aaaggttttgttcatcgatttt

SEQ ID NO: 7659619 - DNA, 22 bp, Homo sapiens
aaaggttttggtaaggctttaa

SEQ ID NO: 7659620 - DNA, 22 bp, Homo sapiens
aaaggttttgttcatcgatttt

SEQ ID NO: 7659621 - DNA, 22 bp, Homo sapiens
aaaggtttttatttatcctgga

SEQ ID NO: 7659622 - DNA, 22 bp, Homo sapiens
aaaggttttgttcatcgatttt

SEQ ID NO: 7659623 - DNA, 22 bp, Homo sapiens
aaagtaacctagtaatagtgtc

SEQ ID NO: 7659624 - DNA, 22 bp, Homo sapiens
aaagtaacaataaggttctatt

SEQ ID NO: 7659625 - DNA, 22 bp, Homo sapiens
aaagtaaagattgggaatgtgt

SEQ ID NO: 7659626 - DNA, 22 bp, Homo sapiens
aaagtaacctagtaatagtgtc

SEQ ID NO: 7659627 - DNA, 22 bp, Homo sapiens
aaagtaacaaaactgtgtgcca

SEQ ID NO: 7659628 - DNA, 22 bp, Homo sapiens
aaagtaaagattgggaatgtgt

SEQ ID NO: 7659629 - DNA, 22 bp, Homo sapiens
aaagtaaagattgggaatgtgt

SEQ ID NO: 7659630 - DNA, 22 bp, Homo sapiens
aagaacatgagttatgatgatt

SEQ ID NO: 7659631 - DNA, 22 bp, Homo sapiens
aagaacatgagttatgatgatt

SEQ ID NO: 7659632 - DNA, 22 bp, Homo sapiens
aagaacatgagttatgatgatt

SEQ ID NO: 7659633 - DNA, 22 bp, Homo sapiens
aagaacatgagttatgatgatt

SEQ ID NO: 7659634 - DNA, 22 bp, Homo sapiens
aagaacatgagttatgatgatt

SEQ ID NO: 7659635 - DNA, 22 bp, Homo sapiens
aagaacatgagttatgatgatt

SEQ ID NO: 7659636 - DNA, 22 bp, Homo sapiens
aagaacatgagttatgatgatt

SEQ ID NO: 7659637 - DNA, 22 bp, Homo sapiens
aagaacatgaagtcacaaatgc

SEQ ID NO: 7659638 - DNA, 22 bp, Homo sapiens
aagaacatgaagtcacaaatgc

SEQ ID NO: 7659639 - DNA, 22 bp, Homo sapiens
aagaacatgaacacaatgttta

SEQ ID NO: 7659640 - DNA, 22 bp, Homo sapiens
aagaacatgaacctcttctaac

SEQ ID NO: 7659641 - DNA, 22 bp, Homo sapiens
aagaacatgaacctcttctaac

SEQ ID NO: 7659642 - DNA, 22 bp, Homo sapiens
aagaacatgaagtcacaaatgc

SEQ ID NO: 7659643 - DNA, 22 bp, Homo sapiens
aagaacatgaagtcacaaatgc

SEQ ID NO: 7659644 - DNA, 22 bp, Homo sapiens
aagaacatgaagtcacaaatgc

SEQ ID NO: 7659645 - DNA, 22 bp, Homo sapiens
aagaacatgaagtcacaaatgc

SEQ ID NO: 7659646 - DNA, 22 bp, Homo sapiens
aagaacatgaacctcttctaac

SEQ ID NO: 7659647 - DNA, 22 bp, Homo sapiens
aagaacatgaacctcttctaac

SEQ ID NO: 7659648 - DNA, 22 bp, Homo sapiens
aagaacataaacagaaggacag

SEQ ID NO: 7659649 - DNA, 22 bp, Homo sapiens
aagaacataaacagaaggacag

SEQ ID NO: 7659650 - DNA, 22 bp, Homo sapiens
aagaacagttgggaggtgagcc

SEQ ID NO: 7659651 - DNA, 22 bp, Homo sapiens
aagaacagttgggaggtgagcc

SEQ ID NO: 7659652 - DNA, 22 bp, Homo sapiens
aagaacagttgggaggtgagcc

SEQ ID NO: 7659653 - DNA, 22 bp, Homo sapiens
aagaacagttgggaggtgagcc

SEQ ID NO: 7659654 - DNA, 22 bp, Homo sapiens
aagaacagttgggaggtgagcc

SEQ ID NO: 7659655 - DNA, 22 bp, Homo sapiens
aagaacagttgggaggtgagcc

SEQ ID NO: 7659656 - DNA, 22 bp, Homo sapiens
aagaacagttgggaggtgagcc

SEQ ID NO: 7659657 - DNA, 22 bp, Homo sapiens
aagaacagtgtcctgggactcg

SEQ ID NO: 7659658 - DNA, 22 bp, Homo sapiens
aagaacataacagaagctgtgt

SEQ ID NO: 7659659 - DNA, 22 bp, Homo sapiens
aagaacataacagaagctgtgt

SEQ ID NO: 7659660 - DNA, 22 bp, Homo sapiens
aagaacatgaacacaatgttta

SEQ ID NO: 7659661 - DNA, 22 bp, Homo sapiens
aagaacatgaacacaatgttta

SEQ ID NO: 7659662 - DNA, 22 bp, Homo sapiens
aagaacatgaacacaatgttta

SEQ ID NO: 7659663 - DNA, 22 bp, Homo sapiens
aagaacataacagaagctgtgt

SEQ ID NO: 7659664 - DNA, 22 bp, Homo sapiens
aagaacataacagaagctgtgt

SEQ ID NO: 7659665 - DNA, 22 bp, Homo sapiens
aagaacataaacagaaggacag

SEQ ID NO: 7659666 - DNA, 22 bp, Homo sapiens
aagaacataacagaagctgtgt

SEQ ID NO: 7659667 - DNA, 22 bp, Homo sapiens
aagaacataacagaagctgtgt

SEQ ID NO: 7659668 - DNA, 22 bp, Homo sapiens
aactgtaatttttacatagtaa

SEQ ID NO: 7659669 - DNA, 22 bp, Homo sapiens
aactgtaatttttacatagtaa

SEQ ID NO: 7659670 - DNA, 19 bp, Homo sapiens
aactgtaattaatacccta

SEQ ID NO: 7659671 - DNA, 19 bp, Homo sapiens
aactgtaattaatacccta

SEQ ID NO: 7659672 - DNA, 22 bp, Homo sapiens
aactgtaatgaattgttcatga

SEQ ID NO: 7659673 - DNA, 22 bp, Homo sapiens
aactgtaagtggttggaagaag

SEQ ID NO: 7659674 - DNA, 22 bp, Homo sapiens
aactgtaatgaattgttcatga

SEQ ID NO: 7659675 - DNA, 22 bp, Homo sapiens
aactgtaatgaattgttcatga

SEQ ID NO: 7659676 - DNA, 22 bp, Homo sapiens
aactgtaatgaattgttcatga

SEQ ID NO: 7659677 - DNA, 22 bp, Homo sapiens
aactgtaatttttacatagtaa

SEQ ID NO: 7659678 - DNA, 22 bp, Homo sapiens
aactgtaatttttacatagtaa

SEQ ID NO: 7659679 - DNA, 22 bp, Homo sapiens
aactgtaatttttacatagtaa

SEQ ID NO: 7659680 - DNA, 22 bp, Homo sapiens
aactgtaatttttacatagtaa

SEQ ID NO: 7659681 - DNA, 22 bp, Homo sapiens
aactgtacgataataaatttgt

SEQ ID NO: 7659682 - DNA, 22 bp, Homo sapiens
aactgtacgataataaatttgt

SEQ ID NO: 7659683 - DNA, 22 bp, Homo sapiens
aactgtaatttttacatagtaa

SEQ ID NO: 7659684 - DNA, 22 bp, Homo sapiens
aactgtaatttttacatagtaa

SEQ ID NO: 7659685 - DNA, 22 bp, Homo sapiens
aactgtacgataataaatttgt

SEQ ID NO: 7659686 - DNA, 21 bp, Homo sapiens
aactgcaaatgatgctggaga

SEQ ID NO: 7659687 - DNA, 22 bp, Homo sapiens
aactgtaaaggttgagtggtaa

SEQ ID NO: 7659688 - DNA, 22 bp, Homo sapiens
aactgtaagaaataaaattctg

SEQ ID NO: 7659689 - DNA, 22 bp, Homo sapiens
aactgtaagaaataaaattctg

SEQ ID NO: 7659690 - DNA, 22 bp, Homo sapiens
aactgtaagaaataaaattctg

SEQ ID NO: 7659691 - DNA, 22 bp, Homo sapiens
aactgtaagacaaatgacttct

SEQ ID NO: 7659692 - DNA, 22 bp, Homo sapiens
aactgtaagacaaatgacttct

SEQ ID NO: 7659693 - DNA, 22 bp, Homo sapiens
aactgtaagacaaatgacttct

SEQ ID NO: 7659694 - DNA, 22 bp, Homo sapiens
aactgtaagagaataaatgtgt

SEQ ID NO: 7659695 - DNA, 22 bp, Homo sapiens
aactgtaagagaataaatgtgt

SEQ ID NO: 7659696 - DNA, 22 bp, Homo sapiens
aactgtaagagaataaatgtgt

SEQ ID NO: 7659697 - DNA, 22 bp, Homo sapiens
aactgtaaggcttagaacagca

SEQ ID NO: 7659698 - DNA, 22 bp, Homo sapiens
aactgtaaggcttagaacagca

SEQ ID NO: 7659699 - DNA, 22 bp, Homo sapiens
aactgtaaggcttagaacagca

SEQ ID NO: 7659700 - DNA, 22 bp, Homo sapiens
aactgtaagagaataaatgtgt

SEQ ID NO: 7659701 - DNA, 22 bp, Homo sapiens
aactgtaagagaataaatgtgt

SEQ ID NO: 7659702 - DNA, 22 bp, Homo sapiens
aactgtaagagaataaatgtgt

SEQ ID NO: 7659703 - DNA, 22 bp, Homo sapiens
aactgtaagagaataaatgtgt

SEQ ID NO: 7659704 - DNA, 22 bp, Homo sapiens
aactgtaagacaaatgacttct

SEQ ID NO: 7659705 - DNA, 22 bp, Homo sapiens
aactgtaagagaataaatgtgt

SEQ ID NO: 7659706 - DNA, 22 bp, Homo sapiens
aaaggttttggtaaggctttaa

SEQ ID NO: 7659707 - DNA, 22 bp, Homo sapiens
aaaggttttggtaaggctttaa

SEQ ID NO: 7659708 - DNA, 22 bp, Homo sapiens
aaaggttttggtaaggctttaa

SEQ ID NO: 7659709 - DNA, 22 bp, Homo sapiens
aaaggttttggtaaggctttaa

SEQ ID NO: 7659710 - DNA, 22 bp, Homo sapiens
aaaggttttctgacccttagta

SEQ ID NO: 7659711 - DNA, 22 bp, Homo sapiens
aaaggttttctgacccttagta

SEQ ID NO: 7659712 - DNA, 22 bp, Homo sapiens
aaaggttttgccctgggtattc

SEQ ID NO: 7659713 - DNA, 22 bp, Homo sapiens
aaaggttttgccctgggtattc

SEQ ID NO: 7659714 - DNA, 22 bp, Homo sapiens
aactgtggacttgagactgatg

SEQ ID NO: 7659715 - DNA, 22 bp, Homo sapiens
aactgtgggatgcattaattca

SEQ ID NO: 7659716 - DNA, 22 bp, Homo sapiens
aactgtgtccttagctctcact

SEQ ID NO: 7659717 - DNA, 22 bp, Homo sapiens
aactgtgtggtatacctgtgat

SEQ ID NO: 7659718 - DNA, 22 bp, Homo sapiens
aaaggttttctagggttgaggg

SEQ ID NO: 7659719 - DNA, 22 bp, Homo sapiens
aactgtcttgcctactcagcat

SEQ ID NO: 7659720 - DNA, 22 bp, Homo sapiens
aactgtgaggatgtgcaaattc

SEQ ID NO: 7659721 - DNA, 22 bp, Homo sapiens
aactgtgaggatgtgcaaattc

SEQ ID NO: 7659722 - DNA, 22 bp, Homo sapiens
aactgtcttaataacaaaagct

SEQ ID NO: 7659723 - DNA, 23 bp, Homo sapiens
aactgtcttgcaagtgtgatacc

SEQ ID NO: 7659724 - DNA, 23 bp, Homo sapiens
aactgtcttgcaagtgtgatacc

SEQ ID NO: 7659725 - DNA, 22 bp, Homo sapiens
aactgtcttatttatatttctg

SEQ ID NO: 7659726 - DNA, 22 bp, Homo sapiens
aactgtatacaattgtcagaca

SEQ ID NO: 7659727 - DNA, 22 bp, Homo sapiens
aactgtcatctttcaaggaaga

SEQ ID NO: 7659728 - DNA, 22 bp, Homo sapiens
aactgtctaaggagaatatgaa

SEQ ID NO: 7659729 - DNA, 22 bp, Homo sapiens
aactgtctaaggagaatatgaa

SEQ ID NO: 7659730 - DNA, 22 bp, Homo sapiens
aactgtatacaattgtcagaca

SEQ ID NO: 7659731 - DNA, 22 bp, Homo sapiens
aactgtagcaaagaacagctct

SEQ ID NO: 7659732 - DNA, 22 bp, Homo sapiens
aacccgagggccccaggctcgg

SEQ ID NO: 7659733 - DNA, 22 bp, Homo sapiens
aacccgagggccccaggctcgg

SEQ ID NO: 7659734 - DNA, 22 bp, Homo sapiens
aacccgagggccccaggctcgg

SEQ ID NO: 7659735 - DNA, 22 bp, Homo sapiens
aacccgggaggcagaggttgtg

SEQ ID NO: 7659736 - DNA, 22 bp, Homo sapiens
aacccgggaggcagaggttgtg

SEQ ID NO: 7659737 - DNA, 22 bp, Homo sapiens
aacccgggaggcagaggttgtg

SEQ ID NO: 7659738 - DNA, 22 bp, Homo sapiens
aacccgggaggcagaggttgtg

SEQ ID NO: 7659739 - DNA, 22 bp, Homo sapiens
aacccgggaggcagaggttgtg

SEQ ID NO: 7659740 - DNA, 22 bp, Homo sapiens
aaccccagtaccccaggatatg

SEQ ID NO: 7659741 - DNA, 22 bp, Homo sapiens
aaccccaggctggaggagtctc

SEQ ID NO: 7659742 - DNA, 22 bp, Homo sapiens
aaccccaacacaggaaatatct

SEQ ID NO: 7659743 - DNA, 22 bp, Homo sapiens
aaccccaggctggaggagtctc

SEQ ID NO: 7659744 - DNA, 22 bp, Homo sapiens
aaccccagtaccccaggatatg

SEQ ID NO: 7659745 - DNA, 22 bp, Homo sapiens
aaccccgctcaggctgggtgag

SEQ ID NO: 7659746 - DNA, 22 bp, Homo sapiens
aaccccaggctggaggagtctc

SEQ ID NO: 7659747 - DNA, 22 bp, Homo sapiens
aaccccaggctggaggagtctc

SEQ ID NO: 7659748 - DNA, 22 bp, Homo sapiens
aacccattaatccttgcaagca

SEQ ID NO: 7659749 - DNA, 22 bp, Homo sapiens
aacccattaatccttgcaagca

SEQ ID NO: 7659750 - DNA, 22 bp, Homo sapiens
aaccccaacacaggaaatatct

SEQ ID NO: 7659751 - DNA, 22 bp, Homo sapiens
aacccgggaggcagaggttgtg

SEQ ID NO: 7659752 - DNA, 22 bp, Homo sapiens
aacccgggaggcagaggttgtg

SEQ ID NO: 7659753 - DNA, 22 bp, Homo sapiens
aacccgggaggcagaggttgtg

SEQ ID NO: 7659754 - DNA, 22 bp, Homo sapiens
aacccgggaggcagaggttgtg

SEQ ID NO: 7659755 - DNA, 22 bp, Homo sapiens
aaaggcagagttgttggaggca

SEQ ID NO: 7659756 - DNA, 22 bp, Homo sapiens
aaaggcagagttgttggaggca

SEQ ID NO: 7659757 - DNA, 18 bp, Homo sapiens
aaaggcagattactggga

SEQ ID NO: 7659758 - DNA, 22 bp, Homo sapiens
aaaggcaggactgcagcatagg

SEQ ID NO: 7659759 - DNA, 22 bp, Homo sapiens
aaaggcaggactgcagcatagg

SEQ ID NO: 7659760 - DNA, 22 bp, Homo sapiens
aaaggcaggactgcagcatagg

SEQ ID NO: 7659761 - DNA, 22 bp, Homo sapiens
aaaggcaggactgcagcatagg

SEQ ID NO: 7659762 - DNA, 22 bp, Homo sapiens
aaaggcaggactgcagcatagg

SEQ ID NO: 7659763 - DNA, 22 bp, Homo sapiens
aaaggcagagttgttggaggca

SEQ ID NO: 7659764 - DNA, 22 bp, Homo sapiens
aaaggcagagttgttggaggca

SEQ ID NO: 7659765 - DNA, 22 bp, Homo sapiens
aaaggcagagttgttggaggca

SEQ ID NO: 7659766 - DNA, 22 bp, Homo sapiens
aaaggcagagttgttggaggca

SEQ ID NO: 7659767 - DNA, 22 bp, Homo sapiens
aaaggcagagttgttggaggca

SEQ ID NO: 7659768 - DNA, 18 bp, Homo sapiens
aaaggcagattactggga

SEQ ID NO: 7659769 - DNA, 18 bp, Homo sapiens
aaaggcagattactggga

SEQ ID NO: 7659770 - DNA, 22 bp, Homo sapiens
aaaggcagtgggtatgtggatc

SEQ ID NO: 7659771 - DNA, 22 bp, Homo sapiens
aaaggcagtgggtatgtggatc

SEQ ID NO: 7659772 - DNA, 19 bp, Homo sapiens
aaaggcagtgggtggcgtg

SEQ ID NO: 7659773 - DNA, 22 bp, Homo sapiens
aaaggcagtgggtatgtggatc

SEQ ID NO: 7659774 - DNA, 22 bp, Homo sapiens
aaaggcagtgggtatgtggatc

SEQ ID NO: 7659775 - DNA, 22 bp, Homo sapiens
aaaggcagtgggtatgtggatc

SEQ ID NO: 7659776 - DNA, 22 bp, Homo sapiens
aaaggcagtgggtatgtggatc

SEQ ID NO: 7659777 - DNA, 22 bp, Homo sapiens
aaaggcagtgggtatgtggatc

SEQ ID NO: 7659778 - DNA, 22 bp, Homo sapiens
aaaggcagtgggtatgtggatc

SEQ ID NO: 7659779 - DNA, 22 bp, Homo sapiens
aaaggcaggctttcacatctca

SEQ ID NO: 7659780 - DNA, 22 bp, Homo sapiens
aaaggcaggctttcacatctca

SEQ ID NO: 7659781 - DNA, 22 bp, Homo sapiens
aaaggcaggctttcacatctca

SEQ ID NO: 7659782 - DNA, 22 bp, Homo sapiens
aaaggcaggctttcacatctca

SEQ ID NO: 7659783 - DNA, 22 bp, Homo sapiens
aaaggcaggctttcacatctca

SEQ ID NO: 7659784 - DNA, 22 bp, Homo sapiens
aaaggcaggctttcacatctca

SEQ ID NO: 7659785 - DNA, 23 bp, Homo sapiens
aaaggcaggcctaggacatattg

SEQ ID NO: 7659786 - DNA, 23 bp, Homo sapiens
aaaggcaggcctaggacatattg

SEQ ID NO: 7659787 - DNA, 23 bp, Homo sapiens
aaaggcaggcctaggacatattg

SEQ ID NO: 7659788 - DNA, 23 bp, Homo sapiens
aaaggcaggcctaggacatattg

SEQ ID NO: 7659789 - DNA, 22 bp, Homo sapiens
aaaggcaggactgcagcatagg

SEQ ID NO: 7659790 - DNA, 22 bp, Homo sapiens
aaaggcagtgtgatactgtggt

SEQ ID NO: 7659791 - DNA, 22 bp, Homo sapiens
aaaggcagtgtgatactgtggt

SEQ ID NO: 7659792 - DNA, 18 bp, Homo sapiens
aaaggcatatatagaagt

SEQ ID NO: 7659793 - DNA, 22 bp, Homo sapiens
aaaggcataggatgtggaatcg

SEQ ID NO: 7659794 - DNA, 22 bp, Homo sapiens
aaaggcagtgtgatactgtggt

SEQ ID NO: 7659795 - DNA, 22 bp, Homo sapiens
aaaggcagtgtgatactgtggt

SEQ ID NO: 7659796 - DNA, 19 bp, Homo sapiens
aaaggcagtgggtggcgtg

SEQ ID NO: 7659797 - DNA, 19 bp, Homo sapiens
aaaggcagtgggtggcgtg

SEQ ID NO: 7659798 - DNA, 19 bp, Homo sapiens
aaaggcagtgggtggcgtg

SEQ ID NO: 7659799 - DNA, 22 bp, Homo sapiens
aaaggcatgattaattctgtgt

SEQ ID NO: 7659800 - DNA, 22 bp, Homo sapiens
aaaggcatgattaattctgtgt

SEQ ID NO: 7659801 - DNA, 22 bp, Homo sapiens
aactgcaaaataatcaagttgt

SEQ ID NO: 7659802 - DNA, 22 bp, Homo sapiens
aaaggcatcattagtaccaagt

SEQ ID NO: 7659803 - DNA, 18 bp, Homo sapiens
aaaggcatatatagaagt

SEQ ID NO: 7659804 - DNA, 22 bp, Homo sapiens
aaaggcatctagccaagttgag

SEQ ID NO: 7659805 - DNA, 22 bp, Homo sapiens
aaaggcatctagccaagttgag

SEQ ID NO: 7659806 - DNA, 22 bp, Homo sapiens
aactgcaaaataatcaagttgt

SEQ ID NO: 7659807 - DNA, 22 bp, Homo sapiens
aactgcaaaataatcaagttgt

SEQ ID NO: 7659808 - DNA, 22 bp, Homo sapiens
aactgcaaagccaatctcagga

SEQ ID NO: 7659809 - DNA, 22 bp, Homo sapiens
aactgcaaagccaatctcagga

SEQ ID NO: 7659810 - DNA, 22 bp, Homo sapiens
aactgcaaagccaatctcagga

SEQ ID NO: 7659811 - DNA, 21 bp, Homo sapiens
aactgcaaatcttagactgca

SEQ ID NO: 7659812 - DNA, 21 bp, Homo sapiens
aactgcaaatcttagactgca

SEQ ID NO: 7659813 - DNA, 21 bp, Homo sapiens
aactgcaaatcttagactgca

SEQ ID NO: 7659814 - DNA, 21 bp, Homo sapiens
aactgcaaatgatgctggaga

SEQ ID NO: 7659815 - DNA, 16 bp, Homo sapiens
aacccacagctcccga

SEQ ID NO: 7659816 - DNA, 22 bp, Homo sapiens
aacatttgtttggcttcaatta

SEQ ID NO: 7659817 - DNA, 22 bp, Homo sapiens
aacatttttaagaccaagtgct

SEQ ID NO: 7659818 - DNA, 22 bp, Homo sapiens
aacatttttaagaccaagtgct

SEQ ID NO: 7659819 - DNA, 22 bp, Homo sapiens
aacatttgtttggcttcaatta

SEQ ID NO: 7659820 - DNA, 22 bp, Homo sapiens
aacatttgtttcgttatgtgaa

SEQ ID NO: 7659821 - DNA, 22 bp, Homo sapiens
aacatttgtttcgttatgtgaa

SEQ ID NO: 7659822 - DNA, 22 bp, Homo sapiens
aacatttgtttcgttatgtgaa

SEQ ID NO: 7659823 - DNA, 22 bp, Homo sapiens
aaagccttttctgtttaacaca

SEQ ID NO: 7659824 - DNA, 22 bp, Homo sapiens
aaagccttttctgtttaacaca

SEQ ID NO: 7659825 - DNA, 22 bp, Homo sapiens
aaagccttttatgatcagttaa

SEQ ID NO: 7659826 - DNA, 22 bp, Homo sapiens
aaagccttttatgatcagttaa

SEQ ID NO: 7659827 - DNA, 22 bp, Homo sapiens
aaagccttttatgatcagttaa

SEQ ID NO: 7659828 - DNA, 22 bp, Homo sapiens
aaagcctttgtctcaggctctg

SEQ ID NO: 7659829 - DNA, 22 bp, Homo sapiens
aaagcctttgtctcaggctctg

SEQ ID NO: 7659830 - DNA, 22 bp, Homo sapiens
aaagccttctgtctagcagata

SEQ ID NO: 7659831 - DNA, 22 bp, Homo sapiens
aaagccttgcccgtcactggga

SEQ ID NO: 7659832 - DNA, 22 bp, Homo sapiens
aaagccttgggatttgtgatca

SEQ ID NO: 7659833 - DNA, 22 bp, Homo sapiens
aaagccttcaagtagatgtaag

SEQ ID NO: 7659834 - DNA, 22 bp, Homo sapiens
aaagccttcaagtagatgtaag

SEQ ID NO: 7659835 - DNA, 22 bp, Homo sapiens
aaagccttcaagtagatgtaag

SEQ ID NO: 7659836 - DNA, 22 bp, Homo sapiens
aaagccttgagatcctatagtt

SEQ ID NO: 7659837 - DNA, 22 bp, Homo sapiens
aaagccttcttcggtctgtgat

SEQ ID NO: 7659838 - DNA, 22 bp, Homo sapiens
aaagccttcttcggtctgtgat

SEQ ID NO: 7659839 - DNA, 22 bp, Homo sapiens
aaagcctcccaggttatgagta

SEQ ID NO: 7659840 - DNA, 22 bp, Homo sapiens
aaagcctcccaggttatgagta

SEQ ID NO: 7659841 - DNA, 22 bp, Homo sapiens
aaagcctcccaggttatgagta

SEQ ID NO: 7659842 - DNA, 22 bp, Homo sapiens
aaagcctcccaggttatgagta

SEQ ID NO: 7659843 - DNA, 22 bp, Homo sapiens
aaagcctcccaggttatgagta

SEQ ID NO: 7659844 - DNA, 22 bp, Homo sapiens
aaagcctcccaggttatgagta

SEQ ID NO: 7659845 - DNA, 22 bp, Homo sapiens
aaagcctcccaggttatgagta

SEQ ID NO: 7659846 - DNA, 22 bp, Homo sapiens
aaagcctgtctggtcatagcta

SEQ ID NO: 7659847 - DNA, 22 bp, Homo sapiens
aaagcctgggttcctcactatc

SEQ ID NO: 7659848 - DNA, 22 bp, Homo sapiens
aaagcctgggttcctcactatc

SEQ ID NO: 7659849 - DNA, 22 bp, Homo sapiens
aacccaggagacaggttgcagt

SEQ ID NO: 7659850 - DNA, 22 bp, Homo sapiens
aacccaggagacaggttgcagt

SEQ ID NO: 7659851 - DNA, 22 bp, Homo sapiens
aacccaggagacggagtttgtg

SEQ ID NO: 7659852 - DNA, 22 bp, Homo sapiens
aacccaggagatggaggttgtg

SEQ ID NO: 7659853 - DNA, 22 bp, Homo sapiens
aacccaggaggcagaggctgca

SEQ ID NO: 7659854 - DNA, 22 bp, Homo sapiens
aacccaggaggcagaggctgca

SEQ ID NO: 7659855 - DNA, 22 bp, Homo sapiens
aacccaggagatggaggttgtg

SEQ ID NO: 7659856 - DNA, 22 bp, Homo sapiens
aacccaggagccggaggttgtg

SEQ ID NO: 7659857 - DNA, 22 bp, Homo sapiens
aacccagagctggaggagagta

SEQ ID NO: 7659858 - DNA, 22 bp, Homo sapiens
aacccagagctggaggagagta

SEQ ID NO: 7659859 - DNA, 22 bp, Homo sapiens
aacccactctacctggctccat

SEQ ID NO: 7659860 - DNA, 22 bp, Homo sapiens
aacccactctacctggctccat

SEQ ID NO: 7659861 - DNA, 22 bp, Homo sapiens
aacccaggacagagctttgtgg

SEQ ID NO: 7659862 - DNA, 22 bp, Homo sapiens
aacccaggacagagctttgtgg

SEQ ID NO: 7659863 - DNA, 22 bp, Homo sapiens
aacccaggagacaggttgcagt

SEQ ID NO: 7659864 - DNA, 22 bp, Homo sapiens
aacccaggagacaggttgcagt

SEQ ID NO: 7659865 - DNA, 22 bp, Homo sapiens
aacccagagctggaggagagta

SEQ ID NO: 7659866 - DNA, 22 bp, Homo sapiens
aacccagggtggaggttgcagt

SEQ ID NO: 7659867 - DNA, 22 bp, Homo sapiens
aacccagggtggaggttgcagt

SEQ ID NO: 7659868 - DNA, 22 bp, Homo sapiens
aacccagggtggaggttgcagt

SEQ ID NO: 7659869 - DNA, 22 bp, Homo sapiens
aacccaggtctttggcttccag

SEQ ID NO: 7659870 - DNA, 22 bp, Homo sapiens
aacccaggtctttggcttccag

SEQ ID NO: 7659871 - DNA, 22 bp, Homo sapiens
aacccatgttggaagcttatca

SEQ ID NO: 7659872 - DNA, 22 bp, Homo sapiens
aacccagggtgaggggagtcta

SEQ ID NO: 7659873 - DNA, 22 bp, Homo sapiens
aacccagggtgaggggagtcta

SEQ ID NO: 7659874 - DNA, 22 bp, Homo sapiens
aacccagggtgaggggagtcta

SEQ ID NO: 7659875 - DNA, 22 bp, Homo sapiens
aacccagggtggaggttgcagt

SEQ ID NO: 7659876 - DNA, 22 bp, Homo sapiens
aacccaggaggtggaggttgtg

SEQ ID NO: 7659877 - DNA, 22 bp, Homo sapiens
aacccaggagttggaggctgtg

SEQ ID NO: 7659878 - DNA, 22 bp, Homo sapiens
aacccaggctggagtgcagtgg

SEQ ID NO: 7659879 - DNA, 22 bp, Homo sapiens
aacccaggctggagtgcagtgg

SEQ ID NO: 7659880 - DNA, 22 bp, Homo sapiens
aacccaggagttggaggctgtg

SEQ ID NO: 7659881 - DNA, 22 bp, Homo sapiens
aacccaggagttggaggctgtg

SEQ ID NO: 7659882 - DNA, 22 bp, Homo sapiens
aacccaggaggcggaggttgtg

SEQ ID NO: 7659883 - DNA, 22 bp, Homo sapiens
aacccaggaggtggaggttgtg

SEQ ID NO: 7659884 - DNA, 22 bp, Homo sapiens
aacccaggaggcggaggttgtg

SEQ ID NO: 7659885 - DNA, 22 bp, Homo sapiens
aacccaggagccggaggttgtg

SEQ ID NO: 7659886 - DNA, 22 bp, Homo sapiens
aacccaggaggcagatgttgtg

SEQ ID NO: 7659887 - DNA, 22 bp, Homo sapiens
aacccaggaggcagaggctgca

SEQ ID NO: 7659888 - DNA, 22 bp, Homo sapiens
gtatacttgcagacatttatat

SEQ ID NO: 7659889 - DNA, 22 bp, Homo sapiens
gtatactagatagacagtatca

SEQ ID NO: 7659890 - DNA, 22 bp, Homo sapiens
gtatagaaacccagaaagatag

SEQ ID NO: 7659891 - DNA, 22 bp, Homo sapiens
gtatagaaacccagaaagatag

SEQ ID NO: 7659892 - DNA, 22 bp, Homo sapiens
gtatagaacctcatcatgccca

SEQ ID NO: 7659893 - DNA, 20 bp, Homo sapiens
gtatataaccatagtgacta

SEQ ID NO: 7659894 - DNA, 20 bp, Homo sapiens
gtatataaccatagtgacta

SEQ ID NO: 7659895 - DNA, 20 bp, Homo sapiens
gtatataaccatagtgacta

SEQ ID NO: 7659896 - DNA, 20 bp, Homo sapiens
gtatataaccatagtgacta

SEQ ID NO: 7659897 - DNA, 20 bp, Homo sapiens
gtatataaccatagtgacta

SEQ ID NO: 7659898 - DNA, 22 bp, Homo sapiens
gtataggtgagggacttgatca

SEQ ID NO: 7659899 - DNA, 22 bp, Homo sapiens
gtataggtgagggacttgatca

SEQ ID NO: 7659900 - DNA, 22 bp, Homo sapiens
gtataggtgagggacttgatca

SEQ ID NO: 7659901 - DNA, 22 bp, Homo sapiens
gtatagttccaagcatattttg

SEQ ID NO: 7659902 - DNA, 22 bp, Homo sapiens
gtatagaaggatctggtgaatt

SEQ ID NO: 7659903 - DNA, 22 bp, Homo sapiens
gtatagaaggatctggtgaatt

SEQ ID NO: 7659904 - DNA, 22 bp, Homo sapiens
gtatagaacttttggaggctgc

SEQ ID NO: 7659905 - DNA, 22 bp, Homo sapiens
gtataggtgagggacttgatca

SEQ ID NO: 7659906 - DNA, 22 bp, Homo sapiens
gtatatatcggcactattttaa

SEQ ID NO: 7659907 - DNA, 22 bp, Homo sapiens
gtatatatcggcactattttaa

SEQ ID NO: 7659908 - DNA, 22 bp, Homo sapiens
gtatatatcggcactattttaa

SEQ ID NO: 7659909 - DNA, 22 bp, Homo sapiens
gtatatatcggcactattttaa

SEQ ID NO: 7659910 - DNA, 22 bp, Homo sapiens
gtatatatgtgtgaacatgtat

SEQ ID NO: 7659911 - DNA, 22 bp, Homo sapiens
gtatatatgtgtgaacatgtat

SEQ ID NO: 7659912 - DNA, 22 bp, Homo sapiens
gtatatatgtgtgaacatgtat

SEQ ID NO: 7659913 - DNA, 22 bp, Homo sapiens
gtatatatgtgtgaacatgtat

SEQ ID NO: 7659914 - DNA, 22 bp, Homo sapiens
gtatatatgtgtgaacatgtat

SEQ ID NO: 7659915 - DNA, 20 bp, Homo sapiens
gtatataaccatagtgacta

SEQ ID NO: 7659916 - DNA, 22 bp, Homo sapiens
gtatataaggtaaagcgattgt

SEQ ID NO: 7659917 - DNA, 22 bp, Homo sapiens
gtatataaggtaaagcgattgt

SEQ ID NO: 7659918 - DNA, 22 bp, Homo sapiens
gtatatatcggcactattttaa

SEQ ID NO: 7659919 - DNA, 22 bp, Homo sapiens
gtatatatcggcactattttaa

SEQ ID NO: 7659920 - DNA, 22 bp, Homo sapiens
gtatataaggtaaagcgattgt

SEQ ID NO: 7659921 - DNA, 22 bp, Homo sapiens
gtatataaggtaaagcgattgt

SEQ ID NO: 7659922 - DNA, 22 bp, Homo sapiens
gtatataaggtaaagcgattgt

SEQ ID NO: 7659923 - DNA, 22 bp, Homo sapiens
gtatatattggataaaccagag

SEQ ID NO: 7659924 - DNA, 22 bp, Homo sapiens
gtatatattggataaaccagag

SEQ ID NO: 7659925 - DNA, 22 bp, Homo sapiens
gtatatattggataaaccagag

SEQ ID NO: 7659926 - DNA, 22 bp, Homo sapiens
gtatatattggataaaccagag

SEQ ID NO: 7659927 - DNA, 22 bp, Homo sapiens
gtatatattggataaaccagag

SEQ ID NO: 7659928 - DNA, 22 bp, Homo sapiens
gtatatattggataaaccagag

SEQ ID NO: 7659929 - DNA, 22 bp, Homo sapiens
gtatatatgtgtgaacatgtat

SEQ ID NO: 7659930 - DNA, 22 bp, Homo sapiens
gtatatatgtgtgaacatgtat

SEQ ID NO: 7659931 - DNA, 22 bp, Homo sapiens
gtatatatgtgtgaacatgtat

SEQ ID NO: 7659932 - DNA, 22 bp, Homo sapiens
gtatatatgtgtgaacatgtat

SEQ ID NO: 7659933 - DNA, 22 bp, Homo sapiens
gtatatcagacactcatatgta

SEQ ID NO: 7659934 - DNA, 22 bp, Homo sapiens
gtatatcaccccaagcagctga

SEQ ID NO: 7659935 - DNA, 22 bp, Homo sapiens
gtatatctcttacatacacaca

SEQ ID NO: 7659936 - DNA, 22 bp, Homo sapiens
gtatatcaggcagaatgttctc

SEQ ID NO: 7659937 - DNA, 18 bp, Homo sapiens
gtatggtatggaagcatg

SEQ ID NO: 7659938 - DNA, 22 bp, Homo sapiens
gtatggtttatagggaaattgt

SEQ ID NO: 7659939 - DNA, 22 bp, Homo sapiens
gtatgtatacattgtggaatgg

SEQ ID NO: 7659940 - DNA, 22 bp, Homo sapiens
gtatggcttctgcagaagagct

SEQ ID NO: 7659941 - DNA, 22 bp, Homo sapiens
gtatggcttctgcagaagagct

SEQ ID NO: 7659942 - DNA, 22 bp, Homo sapiens
gtatggctgctgggatgacaac

SEQ ID NO: 7659943 - DNA, 22 bp, Homo sapiens
gtatggcttacataacttacta

SEQ ID NO: 7659944 - DNA, 22 bp, Homo sapiens
gtatggctaagacaattccaga

SEQ ID NO: 7659945 - DNA, 22 bp, Homo sapiens
gtatgtatacattgtggaatgg

SEQ ID NO: 7659946 - DNA, 21 bp, Homo sapiens
gtatgtatggataatgagagg

SEQ ID NO: 7659947 - DNA, 21 bp, Homo sapiens
gtatgtatggataatgagagg

SEQ ID NO: 7659948 - DNA, 21 bp, Homo sapiens
gtatgtatggataatgagagg

SEQ ID NO: 7659949 - DNA, 22 bp, Homo sapiens
gtatgtatgtatatgtttaaga

SEQ ID NO: 7659950 - DNA, 22 bp, Homo sapiens
gtatgtatgtatatgtttaaga

SEQ ID NO: 7659951 - DNA, 22 bp, Homo sapiens
gtatgtatgtatatgtttaaga

SEQ ID NO: 7659952 - DNA, 18 bp, Homo sapiens
gtatatctgcacatatac

SEQ ID NO: 7659953 - DNA, 22 bp, Homo sapiens
gtatatcttcagaaattatagg

SEQ ID NO: 7659954 - DNA, 22 bp, Homo sapiens
gtatatcttcagaaattatagg

SEQ ID NO: 7659955 - DNA, 22 bp, Homo sapiens
gtatggaagtataagttttgaa

SEQ ID NO: 7659956 - DNA, 22 bp, Homo sapiens
gtatatgagctctatgtaatgg

SEQ ID NO: 7659957 - DNA, 22 bp, Homo sapiens
gtacatctttaaattgttcagt

SEQ ID NO: 7659958 - DNA, 22 bp, Homo sapiens
gtacatctgtcttgttctgttg

SEQ ID NO: 7659959 - DNA, 22 bp, Homo sapiens
gtacatattataaaatacagct

SEQ ID NO: 7659960 - DNA, 22 bp, Homo sapiens
gtacatattataaaatacagct

SEQ ID NO: 7659961 - DNA, 22 bp, Homo sapiens
gtacatgtcaaaaaatgcataa

SEQ ID NO: 7659962 - DNA, 22 bp, Homo sapiens
gtacatgtgcacaacatgcatg

SEQ ID NO: 7659963 - DNA, 22 bp, Homo sapiens
gtacatgtgcacaatgtgcagg

SEQ ID NO: 7659964 - DNA, 22 bp, Homo sapiens
gtacatgtgcacaacatgcatg

SEQ ID NO: 7659965 - DNA, 22 bp, Homo sapiens
gtacatgttggttgtttccagt

SEQ ID NO: 7659966 - DNA, 22 bp, Homo sapiens
gtacatgttggttgtttccagt

SEQ ID NO: 7659967 - DNA, 22 bp, Homo sapiens
gtacatgtgcacaatgtgcagg

SEQ ID NO: 7659968 - DNA, 22 bp, Homo sapiens
gtacatgattccccataaaaag

SEQ ID NO: 7659969 - DNA, 22 bp, Homo sapiens
gtacatgcagattatagctaat

SEQ ID NO: 7659970 - DNA, 22 bp, Homo sapiens
gtacatgtcaaaaaatgcataa

SEQ ID NO: 7659971 - DNA, 22 bp, Homo sapiens
gtacatgtcaaaaaatgcataa

SEQ ID NO: 7659972 - DNA, 22 bp, Homo sapiens
gtacatgtatgagatatgtgta

SEQ ID NO: 7659973 - DNA, 22 bp, Homo sapiens
gtacatgtatgagatatgtgta

SEQ ID NO: 7659974 - DNA, 22 bp, Homo sapiens
gtacatttaggattcattgaaa

SEQ ID NO: 7659975 - DNA, 22 bp, Homo sapiens
gtacatttaggattcattgaaa

SEQ ID NO: 7659976 - DNA, 22 bp, Homo sapiens
gtacatttaggattcattgaaa

SEQ ID NO: 7659977 - DNA, 22 bp, Homo sapiens
gtacatttaggattcattgaaa

SEQ ID NO: 7659978 - DNA, 22 bp, Homo sapiens
gtacatttaggattcattgaaa

SEQ ID NO: 7659979 - DNA, 22 bp, Homo sapiens
gtatacatagatgatgaacaag

SEQ ID NO: 7659980 - DNA, 22 bp, Homo sapiens
gtatacatgtggtaaaatgcac

SEQ ID NO: 7659981 - DNA, 22 bp, Homo sapiens
gtatacatgtggtaaaatgcac

SEQ ID NO: 7659982 - DNA, 22 bp, Homo sapiens
gtatacatgtggtaaaatgcac

SEQ ID NO: 7659983 - DNA, 22 bp, Homo sapiens
gtatacatgtggtaaaatgcac

SEQ ID NO: 7659984 - DNA, 22 bp, Homo sapiens
gtatacatgtggtaaaatgcac

SEQ ID NO: 7659985 - DNA, 22 bp, Homo sapiens
gtatacatttattacaggtctt

SEQ ID NO: 7659986 - DNA, 22 bp, Homo sapiens
gtacattcatggttccaccagg

SEQ ID NO: 7659987 - DNA, 22 bp, Homo sapiens
gtacattctgtggacttggaca

SEQ ID NO: 7659988 - DNA, 22 bp, Homo sapiens
gtacattcagcttagcacttct

SEQ ID NO: 7659989 - DNA, 22 bp, Homo sapiens
gtacattcagcttagcacttct

SEQ ID NO: 7659990 - DNA, 22 bp, Homo sapiens
gtacatttactgatgaaaagta

SEQ ID NO: 7659991 - DNA, 22 bp, Homo sapiens
gtacattggcaactctcttaga

SEQ ID NO: 7659992 - DNA, 22 bp, Homo sapiens
gtacatttactgatgaaaagta

SEQ ID NO: 7659993 - DNA, 22 bp, Homo sapiens
gtacatttactgatgaaaagta

SEQ ID NO: 7659994 - DNA, 22 bp, Homo sapiens
gtacattctaaactgtatgccc

SEQ ID NO: 7659995 - DNA, 22 bp, Homo sapiens
gtacatttactgatgaaaagta

SEQ ID NO: 7659996 - DNA, 22 bp, Homo sapiens
gtacatttactgatgaaaagta

SEQ ID NO: 7659997 - DNA, 22 bp, Homo sapiens
gtacaggtcttatctcctagga

SEQ ID NO: 7659998 - DNA, 22 bp, Homo sapiens
gtacaggttggctctatcgctg

SEQ ID NO: 7659999 - DNA, 22 bp, Homo sapiens
gtacagtaaatgtaaatggatt

SEQ ID NO: 7660000 - DNA, 22 bp, Homo sapiens
gtacagtaatcccgttcttctg

SEQ ID NO: 7660001 - DNA, 22 bp, Homo sapiens
gtacagtagtaaaagtgaatga

SEQ ID NO: 7660002 - DNA, 22 bp, Homo sapiens
gtacagtagtaaaagtgaatga

SEQ ID NO: 7660003 - DNA, 22 bp, Homo sapiens
gtacagtagagccaggttcagt

SEQ ID NO: 7660004 - DNA, 22 bp, Homo sapiens
gtacagtagagccaggttcagt

SEQ ID NO: 7660005 - DNA, 22 bp, Homo sapiens
gtacagtacttcagaaccagcc

SEQ ID NO: 7660006 - DNA, 22 bp, Homo sapiens
gtacagtgccagacttctaggt

SEQ ID NO: 7660007 - DNA, 19 bp, Homo sapiens
gtacagtctgtgggtttgg

SEQ ID NO: 7660008 - DNA, 22 bp, Homo sapiens
gtacagtagtaaaagtgaatga

SEQ ID NO: 7660009 - DNA, 22 bp, Homo sapiens
gtacagttttcagtgttcactg

SEQ ID NO: 7660010 - DNA, 22 bp, Homo sapiens
gtacagttttcagtgttcactg

SEQ ID NO: 7660011 - DNA, 19 bp, Homo sapiens
gtacagtggtaagctatga

SEQ ID NO: 7660012 - DNA, 22 bp, Homo sapiens
gtacagtgtgactttggagtga

SEQ ID NO: 7660013 - DNA, 22 bp, Homo sapiens
gtacagtgggtgtagggaccag

SEQ ID NO: 7660014 - DNA, 22 bp, Homo sapiens
gtacagtggaggtctgtgttca

SEQ ID NO: 7660015 - DNA, 19 bp, Homo sapiens
gtacagtggtaagctatga

SEQ ID NO: 7660016 - DNA, 19 bp, Homo sapiens
gtacagtggtaagctatga

SEQ ID NO: 7660017 - DNA, 22 bp, Homo sapiens
gtacatatggcacatgctattt

SEQ ID NO: 7660018 - DNA, 22 bp, Homo sapiens
gtacatatggcacatgctattt

SEQ ID NO: 7660019 - DNA, 22 bp, Homo sapiens
gtacatacgtagatccatcatt

SEQ ID NO: 7660020 - DNA, 22 bp, Homo sapiens
gtacatatggcacatgctattt

SEQ ID NO: 7660021 - DNA, 22 bp, Homo sapiens
gtacatatggcacatgctattt

SEQ ID NO: 7660022 - DNA, 22 bp, Homo sapiens
gtacatatggcacatgctattt

SEQ ID NO: 7660023 - DNA, 22 bp, Homo sapiens
gtacatattacagacaaagctt

SEQ ID NO: 7660024 - DNA, 22 bp, Homo sapiens
gtacatattaaaggtctataaa

SEQ ID NO: 7660025 - DNA, 22 bp, Homo sapiens
gtacatattaaaggtctataaa

SEQ ID NO: 7660026 - DNA, 22 bp, Homo sapiens
gtacatattaaaggtctataaa

SEQ ID NO: 7660027 - DNA, 22 bp, Homo sapiens
gtacataagaaattactacaga

SEQ ID NO: 7660028 - DNA, 22 bp, Homo sapiens
gtacataagaaattactacaga

SEQ ID NO: 7660029 - DNA, 22 bp, Homo sapiens
gtacagttttcagtgttcactg

SEQ ID NO: 7660030 - DNA, 22 bp, Homo sapiens
gtacataaaatactgccatgta

SEQ ID NO: 7660031 - DNA, 22 bp, Homo sapiens
gtacataaaggaggctctttgc

SEQ ID NO: 7660032 - DNA, 22 bp, Homo sapiens
gtacatatcctttacgttttgt

SEQ ID NO: 7660033 - DNA, 22 bp, Homo sapiens
gtacataagaaattactacaga

SEQ ID NO: 7660034 - DNA, 23 bp, Homo sapiens
gtaaaatacgcagtgcagtgtga

SEQ ID NO: 7660035 - DNA, 23 bp, Homo sapiens
gtaaaatacgcagtgcagtgtga

SEQ ID NO: 7660036 - DNA, 23 bp, Homo sapiens
gtaaaatacgcagtgcagtgtga

SEQ ID NO: 7660037 - DNA, 22 bp, Homo sapiens
ggtgtcctgtcagctagagtga

SEQ ID NO: 7660038 - DNA, 22 bp, Homo sapiens
ggtgtcctcatgattttctaga

SEQ ID NO: 7660039 - DNA, 19 bp, Homo sapiens
ggtgtcctagagataagag

SEQ ID NO: 7660040 - DNA, 23 bp, Homo sapiens
gtaaaatacgcagtgcagtgtga

SEQ ID NO: 7660041 - DNA, 22 bp, Homo sapiens
gtaaaatagaataacgtggcta

SEQ ID NO: 7660042 - DNA, 23 bp, Homo sapiens
gtaaaatacgcagtgcagtgtga

SEQ ID NO: 7660043 - DNA, 22 bp, Homo sapiens
gtaaaatagaataacgtggcta

SEQ ID NO: 7660044 - DNA, 22 bp, Homo sapiens
gtaaaatagaataacgtggcta

SEQ ID NO: 7660045 - DNA, 22 bp, Homo sapiens
gtaaacatgctgtgtactcagc

SEQ ID NO: 7660046 - DNA, 22 bp, Homo sapiens
gtaaaatagaataacgtggcta

SEQ ID NO: 7660047 - DNA, 22 bp, Homo sapiens
gtaaacatgctgtgtactcagc

SEQ ID NO: 7660048 - DNA, 22 bp, Homo sapiens
gtaaacatgctgtgtactcagc

SEQ ID NO: 7660049 - DNA, 22 bp, Homo sapiens
gtaaacattactgtgctgtata

SEQ ID NO: 7660050 - DNA, 22 bp, Homo sapiens
gtaaacattactgtgctgtata

SEQ ID NO: 7660051 - DNA, 22 bp, Homo sapiens
gtaaacattactgtgctgtata

SEQ ID NO: 7660052 - DNA, 22 bp, Homo sapiens
gtaaacattactgtgctgtata

SEQ ID NO: 7660053 - DNA, 22 bp, Homo sapiens
gtaaacattttcatctgtgccc

SEQ ID NO: 7660054 - DNA, 22 bp, Homo sapiens
gtaaacattttcatctgtgccc

SEQ ID NO: 7660055 - DNA, 22 bp, Homo sapiens
gtaaaccaatgaaatgtgtgca

SEQ ID NO: 7660056 - DNA, 22 bp, Homo sapiens
gtaaacattactgtgctgtata

SEQ ID NO: 7660057 - DNA, 22 bp, Homo sapiens
gtaaacattttcatctgtgccc

SEQ ID NO: 7660058 - DNA, 22 bp, Homo sapiens
gtaaagttctatttgaatttag

SEQ ID NO: 7660059 - DNA, 22 bp, Homo sapiens
gtaaagttctactagaatcaac

SEQ ID NO: 7660060 - DNA, 22 bp, Homo sapiens
gtaaagttctactagaatcaac

SEQ ID NO: 7660061 - DNA, 22 bp, Homo sapiens
gtaaagttctatttgaatttag

SEQ ID NO: 7660062 - DNA, 22 bp, Homo sapiens
gtaaataactggtaattggggt

SEQ ID NO: 7660063 - DNA, 22 bp, Homo sapiens
gtaaataactggtaattggggt

SEQ ID NO: 7660064 - DNA, 22 bp, Homo sapiens
gtaaagtacaagcctcattaca

SEQ ID NO: 7660065 - DNA, 22 bp, Homo sapiens
gtaaagtaaacccactttgtag

SEQ ID NO: 7660066 - DNA, 22 bp, Homo sapiens
gtaaagtacaagcctcattaca

SEQ ID NO: 7660067 - DNA, 22 bp, Homo sapiens
gtaaagtcctacatatgtcagg

SEQ ID NO: 7660068 - DNA, 22 bp, Homo sapiens
gtaaagtctggctgaaacatgc

SEQ ID NO: 7660069 - DNA, 22 bp, Homo sapiens
gtaaagtacatacatgaactca

SEQ ID NO: 7660070 - DNA, 22 bp, Homo sapiens
gtaaagtacatacatgaactca

SEQ ID NO: 7660071 - DNA, 22 bp, Homo sapiens
gtaaaggctctgataagtactg

SEQ ID NO: 7660072 - DNA, 22 bp, Homo sapiens
gtaaagctctcatttaatatca

SEQ ID NO: 7660073 - DNA, 22 bp, Homo sapiens
gtaaagctgtttctccaccgtc

SEQ ID NO: 7660074 - DNA, 22 bp, Homo sapiens
gtaaagctggagaggtctttta

SEQ ID NO: 7660075 - DNA, 22 bp, Homo sapiens
gtaaagcaggtagttgggacac

SEQ ID NO: 7660076 - DNA, 22 bp, Homo sapiens
gtaaagctccttggccagtgcc

SEQ ID NO: 7660077 - DNA, 22 bp, Homo sapiens
gtaaagctctcatttaatatca

SEQ ID NO: 7660078 - DNA, 20 bp, Homo sapiens
gtaaagcattcttggcatac

SEQ ID NO: 7660079 - DNA, 20 bp, Homo sapiens
gtaaagcattcttggcatac

SEQ ID NO: 7660080 - DNA, 22 bp, Homo sapiens
gtaaagaaggcaacctggttat

SEQ ID NO: 7660081 - DNA, 22 bp, Homo sapiens
gtaaagaaggcaacctggttat

SEQ ID NO: 7660082 - DNA, 22 bp, Homo sapiens
gtaaagaaggcaacctggttat

SEQ ID NO: 7660083 - DNA, 22 bp, Homo sapiens
gtaaagaaggcaacctggttat

SEQ ID NO: 7660084 - DNA, 22 bp, Homo sapiens
gtaaactgaattggatactgtg

SEQ ID NO: 7660085 - DNA, 22 bp, Homo sapiens
gtaaactgaattggatactgtg

SEQ ID NO: 7660086 - DNA, 22 bp, Homo sapiens
gtaaagaagtttttgaatgcat

SEQ ID NO: 7660087 - DNA, 22 bp, Homo sapiens
gtaaagatgagcggtaatacaa

SEQ ID NO: 7660088 - DNA, 22 bp, Homo sapiens
gtaaagatgagcggtaatacaa

SEQ ID NO: 7660089 - DNA, 22 bp, Homo sapiens
gtaaagatgagcggtaatacaa

SEQ ID NO: 7660090 - DNA, 22 bp, Homo sapiens
gtaaagatggtattttggagtt

SEQ ID NO: 7660091 - DNA, 22 bp, Homo sapiens
gtaaagcaaaatgtagagattg

SEQ ID NO: 7660092 - DNA, 22 bp, Homo sapiens
gtaaagcaaaatgtagagattg

SEQ ID NO: 7660093 - DNA, 22 bp, Homo sapiens
gtaaagcaaaatgtagagattg

SEQ ID NO: 7660094 - DNA, 22 bp, Homo sapiens
gtaaagaagtttttgaatgcat

SEQ ID NO: 7660095 - DNA, 22 bp, Homo sapiens
gtaaagaagtttttgaatgcat

SEQ ID NO: 7660096 - DNA, 22 bp, Homo sapiens
gtaaagaagtttttgaatgcat

SEQ ID NO: 7660097 - DNA, 22 bp, Homo sapiens
gtaaagaagtttttgaatgcat

SEQ ID NO: 7660098 - DNA, 22 bp, Homo sapiens
gtaaagaagtttttgaatgcat

SEQ ID NO: 7660099 - DNA, 18 bp, Homo sapiens
gtacacaaagtcaaagta

SEQ ID NO: 7660100 - DNA, 18 bp, Homo sapiens
gtacacaaagtcaaagta

SEQ ID NO: 7660101 - DNA, 18 bp, Homo sapiens
gtacacaaagtcaaagta

SEQ ID NO: 7660102 - DNA, 22 bp, Homo sapiens
gtacacaaagtgagacttgata

SEQ ID NO: 7660103 - DNA, 22 bp, Homo sapiens
gtacacaaagtgagacttgata

SEQ ID NO: 7660104 - DNA, 22 bp, Homo sapiens
gtaaatattccctcggttccta

SEQ ID NO: 7660105 - DNA, 22 bp, Homo sapiens
gtaaatattaaaggctgctaga

SEQ ID NO: 7660106 - DNA, 22 bp, Homo sapiens
gtaaatattccctcggttccta

SEQ ID NO: 7660107 - DNA, 22 bp, Homo sapiens
gtaaatattccctcggttccta

SEQ ID NO: 7660108 - DNA, 22 bp, Homo sapiens
gtaaatataaatgctagctgcc

SEQ ID NO: 7660109 - DNA, 22 bp, Homo sapiens
gtaaatataaatgctagctgcc

SEQ ID NO: 7660110 - DNA, 22 bp, Homo sapiens
gtaaatattaaaggctgctaga

SEQ ID NO: 7660111 - DNA, 22 bp, Homo sapiens
gtaaatataaatgctagctgcc

SEQ ID NO: 7660112 - DNA, 22 bp, Homo sapiens
gtaaatattaaaggctgctaga

SEQ ID NO: 7660113 - DNA, 22 bp, Homo sapiens
gtaaatattaaaggctgctaga

SEQ ID NO: 7660114 - DNA, 22 bp, Homo sapiens
gtaaatattaaaggctgctaga

SEQ ID NO: 7660115 - DNA, 22 bp, Homo sapiens
gtaaatattaaaggctgctaga

SEQ ID NO: 7660116 - DNA, 22 bp, Homo sapiens
gtaaatattaaaggctgctaga

SEQ ID NO: 7660117 - DNA, 22 bp, Homo sapiens
gtaaatattaaaggctgctaga

SEQ ID NO: 7660118 - DNA, 22 bp, Homo sapiens
gtaaataactggtaattggggt

SEQ ID NO: 7660119 - DNA, 22 bp, Homo sapiens
gtaaataactggtaattggggt

SEQ ID NO: 7660120 - DNA, 22 bp, Homo sapiens
gtaaataactggtaattggggt

SEQ ID NO: 7660121 - DNA, 22 bp, Homo sapiens
gtaaataactggtaattggggt

SEQ ID NO: 7660122 - DNA, 22 bp, Homo sapiens
gtaaataactggtaattggggt

SEQ ID NO: 7660123 - DNA, 22 bp, Homo sapiens
gtaaagtttctcagtgatgttc

SEQ ID NO: 7660124 - DNA, 22 bp, Homo sapiens
gtaaataactggtaattggggt

SEQ ID NO: 7660125 - DNA, 22 bp, Homo sapiens
gtaaataactggtaattggggt

SEQ ID NO: 7660126 - DNA, 22 bp, Homo sapiens
gtaaataactggtaattggggt

SEQ ID NO: 7660127 - DNA, 22 bp, Homo sapiens
gtaaatataaatgctagctgcc

SEQ ID NO: 7660128 - DNA, 22 bp, Homo sapiens
gtaaatataaatgctagctgcc

SEQ ID NO: 7660129 - DNA, 22 bp, Homo sapiens
gtaaatataaatgctagctgcc

SEQ ID NO: 7660130 - DNA, 22 bp, Homo sapiens
gtaaatataaatgctagctgcc

SEQ ID NO: 7660131 - DNA, 22 bp, Homo sapiens
gtaaatataaatgctagctgcc

SEQ ID NO: 7660132 - DNA, 22 bp, Homo sapiens
gtaaatataaatgctagctgcc

SEQ ID NO: 7660133 - DNA, 22 bp, Homo sapiens
gtacacaaataataaagttaca

SEQ ID NO: 7660134 - DNA, 22 bp, Homo sapiens
gtacacaaataataaagttaca

SEQ ID NO: 7660135 - DNA, 22 bp, Homo sapiens
gtacacaaataataaagttaca

SEQ ID NO: 7660136 - DNA, 22 bp, Homo sapiens
gtacacaaataataaagttaca

SEQ ID NO: 7660137 - DNA, 22 bp, Homo sapiens
gtacacaaagtgagacttgata

SEQ ID NO: 7660138 - DNA, 22 bp, Homo sapiens
gtacacttgtcttgaacagcct

SEQ ID NO: 7660139 - DNA, 22 bp, Homo sapiens
gtacagaaagtacccatagaag

SEQ ID NO: 7660140 - DNA, 22 bp, Homo sapiens
gtacagaaagtacccatagaag

SEQ ID NO: 7660141 - DNA, 21 bp, Homo sapiens
gtacacacaggtggatgggct

SEQ ID NO: 7660142 - DNA, 22 bp, Homo sapiens
gtacagaaggatttctagtagt

SEQ ID NO: 7660143 - DNA, 22 bp, Homo sapiens
gtacagaaggatttctagtagt

SEQ ID NO: 7660144 - DNA, 22 bp, Homo sapiens
gtacagaaggagctttggattc

SEQ ID NO: 7660145 - DNA, 22 bp, Homo sapiens
gtacagaaggagctttggattc

SEQ ID NO: 7660146 - DNA, 22 bp, Homo sapiens
gtacagaaatgtgatgacgcaa

SEQ ID NO: 7660147 - DNA, 22 bp, Homo sapiens
gtacagaaatggggccccaggt

SEQ ID NO: 7660148 - DNA, 22 bp, Homo sapiens
gtacagaattatgccatgaggg

SEQ ID NO: 7660149 - DNA, 22 bp, Homo sapiens
gtacagaattatgccatgaggg

SEQ ID NO: 7660150 - DNA, 22 bp, Homo sapiens
gtacagaatgcttggtaaggca

SEQ ID NO: 7660151 - DNA, 22 bp, Homo sapiens
gtacagaatgcttggtaaggca

SEQ ID NO: 7660152 - DNA, 22 bp, Homo sapiens
gtacagctaagaatttcatctt

SEQ ID NO: 7660153 - DNA, 22 bp, Homo sapiens
gtacagcatttgaaattactgg

SEQ ID NO: 7660154 - DNA, 22 bp, Homo sapiens
gtacaggaaggagggagtttca

SEQ ID NO: 7660155 - DNA, 22 bp, Homo sapiens
gtacagcacagagcatcgcaca

SEQ ID NO: 7660156 - DNA, 22 bp, Homo sapiens
gtacagcatttgaaattactgg

SEQ ID NO: 7660157 - DNA, 22 bp, Homo sapiens
gtacagattaataatatactga

SEQ ID NO: 7660158 - DNA, 22 bp, Homo sapiens
gtacagattaataatatactga

SEQ ID NO: 7660159 - DNA, 22 bp, Homo sapiens
gtacagaggttgctggaggctc

SEQ ID NO: 7660160 - DNA, 22 bp, Homo sapiens
gtacagaggtgatatttgagct

SEQ ID NO: 7660161 - DNA, 22 bp, Homo sapiens
gtacagattaataatatactga

SEQ ID NO: 7660162 - DNA, 22 bp, Homo sapiens
gtacaggaccgcggccccctgg

SEQ ID NO: 7660163 - DNA, 22 bp, Homo sapiens
gtacaggacatagacagagtag

SEQ ID NO: 7660164 - DNA, 22 bp, Homo sapiens
gtacaggacatagacagagtag

SEQ ID NO: 7660165 - DNA, 22 bp, Homo sapiens
gtacagctaagaatttcatctt

SEQ ID NO: 7660166 - DNA, 22 bp, Homo sapiens
gtacaggaaggagggagtttca

SEQ ID NO: 7660167 - DNA, 22 bp, Homo sapiens
gtacagggcccctcagcagggc

SEQ ID NO: 7660168 - DNA, 22 bp, Homo sapiens
gtacaggccaccactgaatttt

SEQ ID NO: 7660169 - DNA, 22 bp, Homo sapiens
gtacaggatgtgtaaacttggg

SEQ ID NO: 7660170 - DNA, 22 bp, Homo sapiens
gtacaggcagcaaacaccataa

SEQ ID NO: 7660171 - DNA, 22 bp, Homo sapiens
gtacaggcagcaaacaccataa

SEQ ID NO: 7660172 - DNA, 22 bp, Homo sapiens
gtacaggcagcaaacaccataa

SEQ ID NO: 7660173 - DNA, 22 bp, Homo sapiens
ggtgtagctctgtgtcccactg

SEQ ID NO: 7660174 - DNA, 22 bp, Homo sapiens
ggtggttgcataggccagcagc

SEQ ID NO: 7660175 - DNA, 18 bp, Homo sapiens
ggtggtttggaagcaggt

SEQ ID NO: 7660176 - DNA, 23 bp, Homo sapiens
ggtggtggtgagtcacgggctca

SEQ ID NO: 7660177 - DNA, 22 bp, Homo sapiens
ggtggttcacgcctataatccc

SEQ ID NO: 7660178 - DNA, 22 bp, Homo sapiens
ggtggttgcataggccagcagc

SEQ ID NO: 7660179 - DNA, 22 bp, Homo sapiens
ggtgtcaatgctcccaccttgg

SEQ ID NO: 7660180 - DNA, 22 bp, Homo sapiens
ggtgtcaaaataccatttcagg

SEQ ID NO: 7660181 - DNA, 22 bp, Homo sapiens
ggtgtcaaattattgagtttca

SEQ ID NO: 7660182 - DNA, 22 bp, Homo sapiens
ggtgtcagaagtgggatattac

SEQ ID NO: 7660183 - DNA, 22 bp, Homo sapiens
ggtgtcagactttgcatatcct

SEQ ID NO: 7660184 - DNA, 22 bp, Homo sapiens
ggtgtatacctacacatttttg

SEQ ID NO: 7660185 - DNA, 22 bp, Homo sapiens
ggtgtatacctacacatttttg

SEQ ID NO: 7660186 - DNA, 17 bp, Homo sapiens
ggtgtatggggagggaa

SEQ ID NO: 7660187 - DNA, 22 bp, Homo sapiens
ggtgtagctctgtgtcccactg

SEQ ID NO: 7660188 - DNA, 22 bp, Homo sapiens
ggtgtagctctgtgtcccactg

SEQ ID NO: 7660189 - DNA, 22 bp, Homo sapiens
ggtggccctaaccgcagcctcc

SEQ ID NO: 7660190 - DNA, 22 bp, Homo sapiens
ggtggcccagtgctttctgaag

SEQ ID NO: 7660191 - DNA, 22 bp, Homo sapiens
ggtggccctaaccgcagcctcc

SEQ ID NO: 7660192 - DNA, 22 bp, Homo sapiens
ggtggtggtcccgacttgggag

SEQ ID NO: 7660193 - DNA, 22 bp, Homo sapiens
ggtggtggtcccgacttgggag

SEQ ID NO: 7660194 - DNA, 22 bp, Homo sapiens
ggtggccatggtcaggtagcgg

SEQ ID NO: 7660195 - DNA, 22 bp, Homo sapiens
ggtggccatggtcaggtagcgg

SEQ ID NO: 7660196 - DNA, 22 bp, Homo sapiens
ggtggccattctaccgccttct

SEQ ID NO: 7660197 - DNA, 22 bp, Homo sapiens
ggtggccattctaccgccttct

SEQ ID NO: 7660198 - DNA, 22 bp, Homo sapiens
ggtggccatggtcaggtagcgg

SEQ ID NO: 7660199 - DNA, 22 bp, Homo sapiens
ggtggccatggtcaggtagcgg

SEQ ID NO: 7660200 - DNA, 22 bp, Homo sapiens
ggtggtgtttggaaggaggtgc

SEQ ID NO: 7660201 - DNA, 22 bp, Homo sapiens
ggtggtgtttggaaggaggtgc

SEQ ID NO: 7660202 - DNA, 23 bp, Homo sapiens
ggtggtggtgagtcacgggctca

SEQ ID NO: 7660203 - DNA, 23 bp, Homo sapiens
ggtggtggtgagtcacgggctca

SEQ ID NO: 7660204 - DNA, 23 bp, Homo sapiens
ggtggtggtgagtcacgggctca

SEQ ID NO: 7660205 - DNA, 22 bp, Homo sapiens
ggtggtggtcccgacttgggag

SEQ ID NO: 7660206 - DNA, 23 bp, Homo sapiens
ggtggtggtgagtcacgggctca

SEQ ID NO: 7660207 - DNA, 23 bp, Homo sapiens
ggtggtggtgagtcacgggctca

SEQ ID NO: 7660208 - DNA, 23 bp, Homo sapiens
ggtggtggtgagtcacgggctca

SEQ ID NO: 7660209 - DNA, 22 bp, Homo sapiens
ggtgtcagtgagagcacagtac

SEQ ID NO: 7660210 - DNA, 22 bp, Homo sapiens
ggtgtcagtctgggatgagact

SEQ ID NO: 7660211 - DNA, 22 bp, Homo sapiens
ggtgtcagtgaaggtagagttt

SEQ ID NO: 7660212 - DNA, 20 bp, Homo sapiens
ggtgtcagggccatgcctgg

SEQ ID NO: 7660213 - DNA, 22 bp, Homo sapiens
ggtgtcagtgagagcacagtac

SEQ ID NO: 7660214 - DNA, 22 bp, Homo sapiens
ggtgtcagttgctcatcagagt

SEQ ID NO: 7660215 - DNA, 22 bp, Homo sapiens
ggtgtcagcctgggagcctagc

SEQ ID NO: 7660216 - DNA, 22 bp, Homo sapiens
ggtgtcagatttgacatccaga

SEQ ID NO: 7660217 - DNA, 22 bp, Homo sapiens
ggtgtcagccactttgtcggag

SEQ ID NO: 7660218 - DNA, 22 bp, Homo sapiens
ggtgtcaggaaaatctcagtgt

SEQ ID NO: 7660219 - DNA, 20 bp, Homo sapiens
ggtgtcagggccatgcctgg

SEQ ID NO: 7660220 - DNA, 19 bp, Homo sapiens
ggtgtcaggcctctctcct

SEQ ID NO: 7660221 - DNA, 22 bp, Homo sapiens
ggtgtccgcgctgtagaaggtc

SEQ ID NO: 7660222 - DNA, 22 bp, Homo sapiens
ggtgtccgcgctgtagaaggtc

SEQ ID NO: 7660223 - DNA, 22 bp, Homo sapiens
ggtgtcccaggccagctgtgtg

SEQ ID NO: 7660224 - DNA, 22 bp, Homo sapiens
ggtgtcctacagggccgcaggc

SEQ ID NO: 7660225 - DNA, 22 bp, Homo sapiens
ggtgtccatcaggctgtgcttc

SEQ ID NO: 7660226 - DNA, 21 bp, Homo sapiens
ggtgtccagaggagtccccag

SEQ ID NO: 7660227 - DNA, 22 bp, Homo sapiens
ggtgtccactcagcccgtcctg

SEQ ID NO: 7660228 - DNA, 22 bp, Homo sapiens
ggtgtccatcaggctgtgcttc

SEQ ID NO: 7660229 - DNA, 22 bp, Homo sapiens
ggtgtccatcaggctgtgcttc

SEQ ID NO: 7660230 - DNA, 22 bp, Homo sapiens
ggtgtccatcaggctgtgcttc

SEQ ID NO: 7660231 - DNA, 22 bp, Homo sapiens
ggtgtcccaggccagctgtgtg

SEQ ID NO: 7660232 - DNA, 22 bp, Homo sapiens
ggtggccaggccagctctggcc

SEQ ID NO: 7660233 - DNA, 22 bp, Homo sapiens
ggtggccaggccagctctggcc

SEQ ID NO: 7660234 - DNA, 22 bp, Homo sapiens
ggtggccaggagacatttgtca

SEQ ID NO: 7660235 - DNA, 22 bp, Homo sapiens
ggtggccaggagacatttgtca

SEQ ID NO: 7660236 - DNA, 22 bp, Homo sapiens
ggtggcatttaaattaattaag

SEQ ID NO: 7660237 - DNA, 22 bp, Homo sapiens
ggtggcattcagaagagctggc

SEQ ID NO: 7660238 - DNA, 22 bp, Homo sapiens
ggtggcattcagaagagctggc

SEQ ID NO: 7660239 - DNA, 22 bp, Homo sapiens
ggtggcattcagaagagctggc

SEQ ID NO: 7660240 - DNA, 22 bp, Homo sapiens
ggtggcattcagtaagtatata

SEQ ID NO: 7660241 - DNA, 22 bp, Homo sapiens
ggtggcattgatccctcccagc

SEQ ID NO: 7660242 - DNA, 22 bp, Homo sapiens
ggtggccataggaccagcctgg

SEQ ID NO: 7660243 - DNA, 22 bp, Homo sapiens
ggtggccataggaccagcctgg

SEQ ID NO: 7660244 - DNA, 22 bp, Homo sapiens
ggtggccataggaccagcctgg

SEQ ID NO: 7660245 - DNA, 22 bp, Homo sapiens
ggtggccataggaccagcctgg

SEQ ID NO: 7660246 - DNA, 22 bp, Homo sapiens
ggtggccataggaccagcctgg

SEQ ID NO: 7660247 - DNA, 22 bp, Homo sapiens
ggtggccaggccagctctggcc

SEQ ID NO: 7660248 - DNA, 22 bp, Homo sapiens
ggtggccaggccagctctggcc

SEQ ID NO: 7660249 - DNA, 22 bp, Homo sapiens
ggtggccaggccagctctggcc

SEQ ID NO: 7660250 - DNA, 22 bp, Homo sapiens
ggtggccaggccagctctggcc

SEQ ID NO: 7660251 - DNA, 22 bp, Homo sapiens
ggtggcatacatttctgtcttg

SEQ ID NO: 7660252 - DNA, 22 bp, Homo sapiens
ggtggcatacatttctgtcttg

SEQ ID NO: 7660253 - DNA, 22 bp, Homo sapiens
ggtggcatacatttctgtcttg

SEQ ID NO: 7660254 - DNA, 22 bp, Homo sapiens
ggtggcatcacagtactggggg

SEQ ID NO: 7660255 - DNA, 22 bp, Homo sapiens
ggtggcatctcagttcatgggc

SEQ ID NO: 7660256 - DNA, 22 bp, Homo sapiens
ggtggcatggcagttgatgtaa

SEQ ID NO: 7660257 - DNA, 22 bp, Homo sapiens
ggtggcatggcaaagaaatagc

SEQ ID NO: 7660258 - DNA, 22 bp, Homo sapiens
ggtggcatggcagttgatgtaa

SEQ ID NO: 7660259 - DNA, 22 bp, Homo sapiens
ggtggcatctctttccagattt

SEQ ID NO: 7660260 - DNA, 22 bp, Homo sapiens
ggtggcatctctttccagattt

SEQ ID NO: 7660261 - DNA, 22 bp, Homo sapiens
ggtggcatctctttccagattt

SEQ ID NO: 7660262 - DNA, 22 bp, Homo sapiens
ggtggcagttacaggggcaaat

SEQ ID NO: 7660263 - DNA, 22 bp, Homo sapiens
ggtggcagttacaggggcaaat

SEQ ID NO: 7660264 - DNA, 22 bp, Homo sapiens
ggtggcagttacaggggcaaat

SEQ ID NO: 7660265 - DNA, 22 bp, Homo sapiens
ggtggcataagaacactaaaga

SEQ ID NO: 7660266 - DNA, 22 bp, Homo sapiens
ggtggcatacaacatagaggct

SEQ ID NO: 7660267 - DNA, 22 bp, Homo sapiens
ggtggcaggctggcattggcaa

SEQ ID NO: 7660268 - DNA, 22 bp, Homo sapiens
ggtggcaggctggcattggcaa

SEQ ID NO: 7660269 - DNA, 22 bp, Homo sapiens
ggtggcagttacaggggcaaat

SEQ ID NO: 7660270 - DNA, 22 bp, Homo sapiens
ggtggcaggccctgagcatccc

SEQ ID NO: 7660271 - DNA, 22 bp, Homo sapiens
ggtggcaggccctgagcatccc

SEQ ID NO: 7660272 - DNA, 22 bp, Homo sapiens
ggtggcaggccctgagcatccc

SEQ ID NO: 7660273 - DNA, 22 bp, Homo sapiens
ggtggcaggccctgagcatccc

SEQ ID NO: 7660274 - DNA, 22 bp, Homo sapiens
ggtggcaggccctgagcatccc

SEQ ID NO: 7660275 - DNA, 22 bp, Homo sapiens
ggtggcaggccctgagcatccc

SEQ ID NO: 7660276 - DNA, 22 bp, Homo sapiens
ggtggcaggccctgagcatccc

SEQ ID NO: 7660277 - DNA, 22 bp, Homo sapiens
ggtggcaggctggcattggcaa

SEQ ID NO: 7660278 - DNA, 22 bp, Homo sapiens
ggtggcaggctggcattggcaa

SEQ ID NO: 7660279 - DNA, 22 bp, Homo sapiens
ggtggcaggctggcattggcaa

SEQ ID NO: 7660280 - DNA, 22 bp, Homo sapiens
ggtggcaggctggcattggcaa

SEQ ID NO: 7660281 - DNA, 22 bp, Homo sapiens
ggtggcaggctggcattggcaa

SEQ ID NO: 7660282 - DNA, 22 bp, Homo sapiens
ggtggcaggctggcattggcaa

SEQ ID NO: 7660283 - DNA, 22 bp, Homo sapiens
ggtggcaggctggcattggcaa

SEQ ID NO: 7660284 - DNA, 22 bp, Homo sapiens
ggtggcaggctggcattggcaa

SEQ ID NO: 7660285 - DNA, 19 bp, Homo sapiens
ggtggcaggaataaaggtc

SEQ ID NO: 7660286 - DNA, 19 bp, Homo sapiens
ggtggcaggaataaaggtc

SEQ ID NO: 7660287 - DNA, 19 bp, Homo sapiens
ggtggcaggaataaaggtc

SEQ ID NO: 7660288 - DNA, 22 bp, Homo sapiens
ggtggcagcgtctatctgacat

SEQ ID NO: 7660289 - DNA, 22 bp, Homo sapiens
ggtggcagcatggtcccagtgt

SEQ ID NO: 7660290 - DNA, 22 bp, Homo sapiens
ggtggcagcatggtcccagtgt

SEQ ID NO: 7660291 - DNA, 22 bp, Homo sapiens
ggtggcagcgtctatctgacat

SEQ ID NO: 7660292 - DNA, 22 bp, Homo sapiens
ggtggcagcgtctatctgacat

SEQ ID NO: 7660293 - DNA, 22 bp, Homo sapiens
ggtggcagcgtctatctgacat

SEQ ID NO: 7660294 - DNA, 22 bp, Homo sapiens
ggtggcagcatggtcccagtgt

SEQ ID NO: 7660295 - DNA, 19 bp, Homo sapiens
ggtggcaggaataaaggtc

SEQ ID NO: 7660296 - DNA, 23 bp, Homo sapiens
ggtggcaggagtggatgctgagc

SEQ ID NO: 7660297 - DNA, 23 bp, Homo sapiens
ggtggcaggagtggatgctgagc

SEQ ID NO: 7660298 - DNA, 23 bp, Homo sapiens
ggtggcaggagtggatgctgagc

SEQ ID NO: 7660299 - DNA, 23 bp, Homo sapiens
ggtggcaggagtggatgctgagc

SEQ ID NO: 7660300 - DNA, 23 bp, Homo sapiens
ggtggcaggagtggatgctgagc

SEQ ID NO: 7660301 - DNA, 23 bp, Homo sapiens
ggtggcaggagtggatgctgagc

SEQ ID NO: 7660302 - DNA, 22 bp, Homo sapiens
ggtggcaggccctgagcatccc

SEQ ID NO: 7660303 - DNA, 22 bp, Homo sapiens
gggtgggcctgtctggccatgt

SEQ ID NO: 7660304 - DNA, 22 bp, Homo sapiens
gggtggggccaggcaatttgca

SEQ ID NO: 7660305 - DNA, 22 bp, Homo sapiens
gggtggggccaggcaatttgca

SEQ ID NO: 7660306 - DNA, 22 bp, Homo sapiens
gggtggggccaggcaatttgca

SEQ ID NO: 7660307 - DNA, 22 bp, Homo sapiens
gggtgggcctgtctggccatgt

SEQ ID NO: 7660308 - DNA, 22 bp, Homo sapiens
gggtggggccaggcaatttgca

SEQ ID NO: 7660309 - DNA, 22 bp, Homo sapiens
gggtggggccaggcaatttgca

SEQ ID NO: 7660310 - DNA, 22 bp, Homo sapiens
gggtggggcccaggaaatctat

SEQ ID NO: 7660311 - DNA, 22 bp, Homo sapiens
gggtggggcccaggaaatctat

SEQ ID NO: 7660312 - DNA, 22 bp, Homo sapiens
gggtggggcccaggaaatctat

SEQ ID NO: 7660313 - DNA, 22 bp, Homo sapiens
gggtggggcccaggaaatctat

SEQ ID NO: 7660314 - DNA, 22 bp, Homo sapiens
gggtggggcccaggaaatctat

SEQ ID NO: 7660315 - DNA, 22 bp, Homo sapiens
gggtggggcccaggaaatctat

SEQ ID NO: 7660316 - DNA, 22 bp, Homo sapiens
gggtggggcccaggaaatctat

SEQ ID NO: 7660317 - DNA, 22 bp, Homo sapiens
gggtggggcccaggaaatctat

SEQ ID NO: 7660318 - DNA, 22 bp, Homo sapiens
gggtggggcccaggaaatctat

SEQ ID NO: 7660319 - DNA, 22 bp, Homo sapiens
gggtggggttcaggaatcttca

SEQ ID NO: 7660320 - DNA, 22 bp, Homo sapiens
gggtggggttcaggaatcttca

SEQ ID NO: 7660321 - DNA, 22 bp, Homo sapiens
gggtggggttcaggaatcttca

SEQ ID NO: 7660322 - DNA, 22 bp, Homo sapiens
gggtggggttcaggaatcttca

SEQ ID NO: 7660323 - DNA, 22 bp, Homo sapiens
gggtggggttcaggaatcttca

SEQ ID NO: 7660324 - DNA, 22 bp, Homo sapiens
gggtggggttcaggaatcttca

SEQ ID NO: 7660325 - DNA, 22 bp, Homo sapiens
gggtggggtgtatcggatccta

SEQ ID NO: 7660326 - DNA, 22 bp, Homo sapiens
gggtggggtgtatcggatccta

SEQ ID NO: 7660327 - DNA, 22 bp, Homo sapiens
gggtggggtgtatcggatccta

SEQ ID NO: 7660328 - DNA, 22 bp, Homo sapiens
gggtggggtgtatcggatccta

SEQ ID NO: 7660329 - DNA, 22 bp, Homo sapiens
gggtggggtgtatcggatccta

SEQ ID NO: 7660330 - DNA, 22 bp, Homo sapiens
gggtggggtgtatcggatccta

SEQ ID NO: 7660331 - DNA, 22 bp, Homo sapiens
gggtggggtgtatcggatccta

SEQ ID NO: 7660332 - DNA, 22 bp, Homo sapiens
gggtggggtgtatcggatccta

SEQ ID NO: 7660333 - DNA, 22 bp, Homo sapiens
ggtgagggtaaactaaaacatc

SEQ ID NO: 7660334 - DNA, 22 bp, Homo sapiens
ggtgagggtaaatataggcaaa

SEQ ID NO: 7660335 - DNA, 22 bp, Homo sapiens
ggtgagggtaaatataggcaaa

SEQ ID NO: 7660336 - DNA, 22 bp, Homo sapiens
ggtgagggtaaatataggcaaa

SEQ ID NO: 7660337 - DNA, 22 bp, Homo sapiens
ggtgagggtaaatataggcaaa

SEQ ID NO: 7660338 - DNA, 22 bp, Homo sapiens
ggtgagggtaaatataggcaaa

SEQ ID NO: 7660339 - DNA, 22 bp, Homo sapiens
ggtgagggtaaatataggcaaa

SEQ ID NO: 7660340 - DNA, 22 bp, Homo sapiens
ggtgagggtaaatataggcaaa

SEQ ID NO: 7660341 - DNA, 22 bp, Homo sapiens
ggtgagggtaaatataggcaaa

SEQ ID NO: 7660342 - DNA, 22 bp, Homo sapiens
ggtgagggtaaatataggcaaa

SEQ ID NO: 7660343 - DNA, 22 bp, Homo sapiens
ggtgaggggcgcctctgcccgg

SEQ ID NO: 7660344 - DNA, 22 bp, Homo sapiens
ggtgaggggcgcctctgcccgg

SEQ ID NO: 7660345 - DNA, 22 bp, Homo sapiens
ggtgaggggctcctctgcccgg

SEQ ID NO: 7660346 - DNA, 22 bp, Homo sapiens
ggtgaggggcgcctctgcccgg

SEQ ID NO: 7660347 - DNA, 22 bp, Homo sapiens
ggtgaggggctcctctgcccgg

SEQ ID NO: 7660348 - DNA, 22 bp, Homo sapiens
ggtgaggggctcctctgcccgg

SEQ ID NO: 7660349 - DNA, 22 bp, Homo sapiens
ggtgagggtaaactaaaacatc

SEQ ID NO: 7660350 - DNA, 22 bp, Homo sapiens
ggtgaggggctcctctgcccgg

SEQ ID NO: 7660351 - DNA, 22 bp, Homo sapiens
ggtgaggggctcctctgcccgg

SEQ ID NO: 7660352 - DNA, 22 bp, Homo sapiens
ggtgaggggctcctctgcccgg

SEQ ID NO: 7660353 - DNA, 22 bp, Homo sapiens
ggtgaggggcacctctgcccgg

SEQ ID NO: 7660354 - DNA, 22 bp, Homo sapiens
ggtgaggggcacctctgcccgg

SEQ ID NO: 7660355 - DNA, 22 bp, Homo sapiens
ggtgaggggcacctctgcccgg

SEQ ID NO: 7660356 - DNA, 22 bp, Homo sapiens
ggtgaggggcacctctgcccgg

SEQ ID NO: 7660357 - DNA, 22 bp, Homo sapiens
ggtgaggggagagtgaaagaaa

SEQ ID NO: 7660358 - DNA, 22 bp, Homo sapiens
ggtgaggggagagtgaaagaaa

SEQ ID NO: 7660359 - DNA, 22 bp, Homo sapiens
ggtgaggggagagtgaaagaaa

SEQ ID NO: 7660360 - DNA, 22 bp, Homo sapiens
ggtgaggggagagtgaaagaaa

SEQ ID NO: 7660361 - DNA, 22 bp, Homo sapiens
ggtgaggggagagtgaaagaaa

SEQ ID NO: 7660362 - DNA, 22 bp, Homo sapiens
ggtgaggggagagtgaaagaaa

SEQ ID NO: 7660363 - DNA, 22 bp, Homo sapiens
ggtgaggggcacctctgcccgg

SEQ ID NO: 7660364 - DNA, 22 bp, Homo sapiens
ggtgaggggcacctctgcccgg

SEQ ID NO: 7660365 - DNA, 22 bp, Homo sapiens
ggtgaggggcgcctctgcccag

SEQ ID NO: 7660366 - DNA, 22 bp, Homo sapiens
ggtgaggggcgcctctgcccag

SEQ ID NO: 7660367 - DNA, 22 bp, Homo sapiens
ggtgaggggcgcctctgcccag

SEQ ID NO: 7660368 - DNA, 22 bp, Homo sapiens
ggtgaggggcgcctctgcccag

SEQ ID NO: 7660369 - DNA, 22 bp, Homo sapiens
ggtgaggggcgcctctgcccag

SEQ ID NO: 7660370 - DNA, 22 bp, Homo sapiens
ggtgaggggcgcctctgcccgg

SEQ ID NO: 7660371 - DNA, 22 bp, Homo sapiens
ggtgaggggcgcctctgcccag

SEQ ID NO: 7660372 - DNA, 22 bp, Homo sapiens
ggtgaggggcgcctctgcccgg

SEQ ID NO: 7660373 - DNA, 22 bp, Homo sapiens
ggtgaggggcgcctctgcccgg

SEQ ID NO: 7660374 - DNA, 22 bp, Homo sapiens
ggtgagtttcatggttgtttac

SEQ ID NO: 7660375 - DNA, 22 bp, Homo sapiens
ggtgatgtttgagttgagacag

SEQ ID NO: 7660376 - DNA, 22 bp, Homo sapiens
ggtgatcttgaactaaataaac

SEQ ID NO: 7660377 - DNA, 22 bp, Homo sapiens
ggtgatgaaaagtgcctttatc

SEQ ID NO: 7660378 - DNA, 22 bp, Homo sapiens
ggtgattttcgagtttcatgtt

SEQ ID NO: 7660379 - DNA, 22 bp, Homo sapiens
ggtgatttccttttgcaaagtc

SEQ ID NO: 7660380 - DNA, 21 bp, Homo sapiens
ggtgattttagagaattgctg

SEQ ID NO: 7660381 - DNA, 22 bp, Homo sapiens
ggtgcaaaaataattgcggttt

SEQ ID NO: 7660382 - DNA, 22 bp, Homo sapiens
ggtgcaaaaatctatcaccagc

SEQ ID NO: 7660383 - DNA, 22 bp, Homo sapiens
ggtgatttatccattttctggt

SEQ ID NO: 7660384 - DNA, 22 bp, Homo sapiens
ggtgattctgtgaggggctgac

SEQ ID NO: 7660385 - DNA, 22 bp, Homo sapiens
ggtgagtgcctggcctggccac

SEQ ID NO: 7660386 - DNA, 22 bp, Homo sapiens
ggtgagtgtcaatggttagagt

SEQ ID NO: 7660387 - DNA, 17 bp, Homo sapiens
ggtgagtgtccaggtgg

SEQ ID NO: 7660388 - DNA, 22 bp, Homo sapiens
ggtgagggtaaatataggcaaa

SEQ ID NO: 7660389 - DNA, 22 bp, Homo sapiens
ggtgagggtaaatataggcaaa

SEQ ID NO: 7660390 - DNA, 22 bp, Homo sapiens
ggtgagtgcctggcctggccac

SEQ ID NO: 7660391 - DNA, 22 bp, Homo sapiens
ggtgagtcatttggctcaagag

SEQ ID NO: 7660392 - DNA, 22 bp, Homo sapiens
ggtgagtcatttggctcaagag

SEQ ID NO: 7660393 - DNA, 22 bp, Homo sapiens
ggtgagtccagagtccaaatcc

SEQ ID NO: 7660394 - DNA, 22 bp, Homo sapiens
ggtgcaggagcggggtgctcgg

SEQ ID NO: 7660395 - DNA, 22 bp, Homo sapiens
ggtgcaggagcggggtgctcgg

SEQ ID NO: 7660396 - DNA, 22 bp, Homo sapiens
ggtgcaggacgaagtgggggtt

SEQ ID NO: 7660397 - DNA, 22 bp, Homo sapiens
ggtgcaggacgaagtgggggtt

SEQ ID NO: 7660398 - DNA, 22 bp, Homo sapiens
ggtgcaggacgaagtgggggtt

SEQ ID NO: 7660399 - DNA, 22 bp, Homo sapiens
ggtgcaggacgaagtgggggtt

SEQ ID NO: 7660400 - DNA, 22 bp, Homo sapiens
ggtgcaggacgaagtgggggtt

SEQ ID NO: 7660401 - DNA, 22 bp, Homo sapiens
ggtgcaggacgaagtgggggtt

SEQ ID NO: 7660402 - DNA, 22 bp, Homo sapiens
ggtgcaggacgaagtgggggtt

SEQ ID NO: 7660403 - DNA, 22 bp, Homo sapiens
ggtgcaggacgaagtgggggtt

SEQ ID NO: 7660404 - DNA, 22 bp, Homo sapiens
ggtgcaggaaaattacctggag

SEQ ID NO: 7660405 - DNA, 22 bp, Homo sapiens
ggtgcaggaaaattacctggag

SEQ ID NO: 7660406 - DNA, 22 bp, Homo sapiens
ggtgcaaaagtaattgcggttt

SEQ ID NO: 7660407 - DNA, 22 bp, Homo sapiens
ggtgcaggaaaattacctggag

SEQ ID NO: 7660408 - DNA, 22 bp, Homo sapiens
ggtgcaggaaaattacctggag

SEQ ID NO: 7660409 - DNA, 22 bp, Homo sapiens
ggtgcaaaagtaatttggtttt

SEQ ID NO: 7660410 - DNA, 22 bp, Homo sapiens
ggtgcaaaagtaatttggtttt

SEQ ID NO: 7660411 - DNA, 22 bp, Homo sapiens
ggtgcaaaagtaatcacagttt

SEQ ID NO: 7660412 - DNA, 22 bp, Homo sapiens
ggtgcaggaatctgcaattgaa

SEQ ID NO: 7660413 - DNA, 22 bp, Homo sapiens
ggtgcaggaatctgcaattgaa

SEQ ID NO: 7660414 - DNA, 22 bp, Homo sapiens
ggtgcaggaatctgcaattgaa

SEQ ID NO: 7660415 - DNA, 22 bp, Homo sapiens
ggtgcaggagcggggtgctcgg

SEQ ID NO: 7660416 - DNA, 22 bp, Homo sapiens
ggtgcaggagcggggtgctcgg

SEQ ID NO: 7660417 - DNA, 22 bp, Homo sapiens
ggtgcaggagcggggtgctcgg

SEQ ID NO: 7660418 - DNA, 22 bp, Homo sapiens
ggtgcaggagcggggtgctcgg

SEQ ID NO: 7660419 - DNA, 22 bp, Homo sapiens
ggtgcaggagcggggtgctcgg

SEQ ID NO: 7660420 - DNA, 22 bp, Homo sapiens
ggtgcaggcggtggggcaagta

SEQ ID NO: 7660421 - DNA, 22 bp, Homo sapiens
ggtgcaggagcggggtgctcgg

SEQ ID NO: 7660422 - DNA, 22 bp, Homo sapiens
ggtgcaggagcggggtgctcgg

SEQ ID NO: 7660423 - DNA, 22 bp, Homo sapiens
ggtgcaggcggtggggcaagta

SEQ ID NO: 7660424 - DNA, 22 bp, Homo sapiens
ggtgcaggcggtggggcaagta

SEQ ID NO: 7660425 - DNA, 22 bp, Homo sapiens
ggtgcaggcggtggggcaagta

SEQ ID NO: 7660426 - DNA, 22 bp, Homo sapiens
ggtgcaggcggtggggcaagta

SEQ ID NO: 7660427 - DNA, 22 bp, Homo sapiens
ggtgcaggcggtggggcaagta

SEQ ID NO: 7660428 - DNA, 22 bp, Homo sapiens
ggtgcaggcggtggggcaagta

SEQ ID NO: 7660429 - DNA, 22 bp, Homo sapiens
ggtgcaggcggtggggcaagta

SEQ ID NO: 7660430 - DNA, 22 bp, Homo sapiens
ggtggcagagaggaggtagttt

SEQ ID NO: 7660431 - DNA, 22 bp, Homo sapiens
ggtgcaggcggtggggcaagta

SEQ ID NO: 7660432 - DNA, 22 bp, Homo sapiens
ggtggcagagaggaggtagttt

SEQ ID NO: 7660433 - DNA, 22 bp, Homo sapiens
ggtgcaggcggtggggcaagta

SEQ ID NO: 7660434 - DNA, 22 bp, Homo sapiens
ggtgcaggcggtggggcaagta

SEQ ID NO: 7660435 - DNA, 22 bp, Homo sapiens
ggtgcaggcggtggggcaagta

SEQ ID NO: 7660436 - DNA, 22 bp, Homo sapiens
ggtggcagcatggtcccagtgt

SEQ ID NO: 7660437 - DNA, 22 bp, Homo sapiens
ggtggcagcatggtcccagtgt

SEQ ID NO: 7660438 - DNA, 22 bp, Homo sapiens
ggtggcagaggtgcatcagccc

SEQ ID NO: 7660439 - DNA, 22 bp, Homo sapiens
ggtggcagaggtgcatcagccc

SEQ ID NO: 7660440 - DNA, 22 bp, Homo sapiens
ggtggcagaggtgcatcagccc

SEQ ID NO: 7660441 - DNA, 22 bp, Homo sapiens
ggtggcagaggtgcatcagccc

SEQ ID NO: 7660442 - DNA, 22 bp, Homo sapiens
ggtggcagaggtgcatcagccc

SEQ ID NO: 7660443 - DNA, 22 bp, Homo sapiens
ggtggcagaggtgcatcagccc

SEQ ID NO: 7660444 - DNA, 22 bp, Homo sapiens
ggtggcagaggtgcatcagccc

SEQ ID NO: 7660445 - DNA, 22 bp, Homo sapiens
ggtggcagaggtgcatcagccc

SEQ ID NO: 7660446 - DNA, 22 bp, Homo sapiens
ggtggcagaggtgcatcagccc

SEQ ID NO: 7660447 - DNA, 22 bp, Homo sapiens
ggtggcagagaggaggtagttt

SEQ ID NO: 7660448 - DNA, 22 bp, Homo sapiens
ggtggcagagaggaggtagttt

SEQ ID NO: 7660449 - DNA, 22 bp, Homo sapiens
ggtggcagagaggaggtagttt

SEQ ID NO: 7660450 - DNA, 22 bp, Homo sapiens
gtctgcaaagattggaagccac

SEQ ID NO: 7660451 - DNA, 22 bp, Homo sapiens
gtctgcacagccccatagtggt

SEQ ID NO: 7660452 - DNA, 21 bp, Homo sapiens
gtctgatgcttgatgcagttg

SEQ ID NO: 7660453 - DNA, 21 bp, Homo sapiens
gtctgatgcttgatgcagttg

SEQ ID NO: 7660454 - DNA, 21 bp, Homo sapiens
gtctgatgcttgatgcagttg

SEQ ID NO: 7660455 - DNA, 22 bp, Homo sapiens
gtctgcacgtgccagggagggg

SEQ ID NO: 7660456 - DNA, 22 bp, Homo sapiens
gtctgcactgtggagtactgtg

SEQ ID NO: 7660457 - DNA, 21 bp, Homo sapiens
gtctgcagaccccttcattgc

SEQ ID NO: 7660458 - DNA, 22 bp, Homo sapiens
gtctgagggttgtgctggagga

SEQ ID NO: 7660459 - DNA, 22 bp, Homo sapiens
gtctgagggttgtgctggagga

SEQ ID NO: 7660460 - DNA, 22 bp, Homo sapiens
gtctgagggttgtgctggagga

SEQ ID NO: 7660461 - DNA, 22 bp, Homo sapiens
gtctgagggtcatgggtctcac

SEQ ID NO: 7660462 - DNA, 22 bp, Homo sapiens
gtctgagggttgtgctggagga

SEQ ID NO: 7660463 - DNA, 22 bp, Homo sapiens
gtctgaggtcattagctctctt

SEQ ID NO: 7660464 - DNA, 22 bp, Homo sapiens
gtctgaggtcattagctctctt

SEQ ID NO: 7660465 - DNA, 22 bp, Homo sapiens
gtctgccatgtggagaaagcca

SEQ ID NO: 7660466 - DNA, 22 bp, Homo sapiens
gtctgccatgtggagaaagcca

SEQ ID NO: 7660467 - DNA, 22 bp, Homo sapiens
gtctgcccagaagacatcccct

SEQ ID NO: 7660468 - DNA, 22 bp, Homo sapiens
gtctgccatgtggagaaagcca

SEQ ID NO: 7660469 - DNA, 22 bp, Homo sapiens
gtctgccagcaccataaattag

SEQ ID NO: 7660470 - DNA, 22 bp, Homo sapiens
gtctgccagcaccataaattag

SEQ ID NO: 7660471 - DNA, 22 bp, Homo sapiens
gtctgccagcaccataaattag

SEQ ID NO: 7660472 - DNA, 18 bp, Homo sapiens
gtctgccaacaactatca

SEQ ID NO: 7660473 - DNA, 22 bp, Homo sapiens
gtctgcccagaagacatcccct

SEQ ID NO: 7660474 - DNA, 19 bp, Homo sapiens
gtctggatttttcggtaac

SEQ ID NO: 7660475 - DNA, 22 bp, Homo sapiens
gtctggcacataagaggagctc

SEQ ID NO: 7660476 - DNA, 21 bp, Homo sapiens
gtctggatgcccttctcttgg

SEQ ID NO: 7660477 - DNA, 18 bp, Homo sapiens
gtctgccaacaactatca

SEQ ID NO: 7660478 - DNA, 18 bp, Homo sapiens
gtctgccaacaactatca

SEQ ID NO: 7660479 - DNA, 22 bp, Homo sapiens
gtctgcattgaccctactagtc

SEQ ID NO: 7660480 - DNA, 22 bp, Homo sapiens
gtctgcattggagacaagagtc

SEQ ID NO: 7660481 - DNA, 20 bp, Homo sapiens
gtctgcagtaagagggaata

SEQ ID NO: 7660482 - DNA, 20 bp, Homo sapiens
gtctgcagtaagagggaata

SEQ ID NO: 7660483 - DNA, 22 bp, Homo sapiens
gtctgcagcacatagattagaa

SEQ ID NO: 7660484 - DNA, 22 bp, Homo sapiens
gtctgcagcctccacctcctgg

SEQ ID NO: 7660485 - DNA, 22 bp, Homo sapiens
gtctgcagagggaaggcttcag

SEQ ID NO: 7660486 - DNA, 22 bp, Homo sapiens
gtctgcagacaacttagaagca

SEQ ID NO: 7660487 - DNA, 22 bp, Homo sapiens
gtctggctccgaggagtggcag

SEQ ID NO: 7660488 - DNA, 22 bp, Homo sapiens
gtctggctccgaggagtggcag

SEQ ID NO: 7660489 - DNA, 22 bp, Homo sapiens
gtctggctccgaggagtggcag

SEQ ID NO: 7660490 - DNA, 22 bp, Homo sapiens
gtctggctccgaggagtggcag

SEQ ID NO: 7660491 - DNA, 22 bp, Homo sapiens
gtctggctcccactcttacaaa

SEQ ID NO: 7660492 - DNA, 22 bp, Homo sapiens
gtctggctcctggattttccgg

SEQ ID NO: 7660493 - DNA, 22 bp, Homo sapiens
gtctggctccgaggagtggcag

SEQ ID NO: 7660494 - DNA, 22 bp, Homo sapiens
gtctggctccgaggagtggcag

SEQ ID NO: 7660495 - DNA, 22 bp, Homo sapiens
gtctggctctggaaggcaaagg

SEQ ID NO: 7660496 - DNA, 22 bp, Homo sapiens
gtctggctctggaaggcaaagg

SEQ ID NO: 7660497 - DNA, 22 bp, Homo sapiens
gtctggctgttcctgcctgtga

SEQ ID NO: 7660498 - DNA, 22 bp, Homo sapiens
gtctggctgttcctgcctgtga

SEQ ID NO: 7660499 - DNA, 20 bp, Homo sapiens
gtctggcttcgtgattctgg

SEQ ID NO: 7660500 - DNA, 22 bp, Homo sapiens
gtctggctgttcctgcctgtga

SEQ ID NO: 7660501 - DNA, 22 bp, Homo sapiens
gtctggctgttcctgcctgtga

SEQ ID NO: 7660502 - DNA, 22 bp, Homo sapiens
gtctggctgataaaatgctctt

SEQ ID NO: 7660503 - DNA, 22 bp, Homo sapiens
gtctggctgataaaatgctctt

SEQ ID NO: 7660504 - DNA, 22 bp, Homo sapiens
gtctggctgataaaatgctctt

SEQ ID NO: 7660505 - DNA, 22 bp, Homo sapiens
gtctggctccaggatctcatga

SEQ ID NO: 7660506 - DNA, 22 bp, Homo sapiens
gtctggctccaggatctcatga

SEQ ID NO: 7660507 - DNA, 22 bp, Homo sapiens
gtctggctaggcacgccgtgtt

SEQ ID NO: 7660508 - DNA, 22 bp, Homo sapiens
gtctggctaggcacgccgtgtt

SEQ ID NO: 7660509 - DNA, 22 bp, Homo sapiens
gtctggctcagtcctagctgta

SEQ ID NO: 7660510 - DNA, 22 bp, Homo sapiens
gtctggctaattttggtaattt

SEQ ID NO: 7660511 - DNA, 22 bp, Homo sapiens
gtctggctaattttggtaattt

SEQ ID NO: 7660512 - DNA, 22 bp, Homo sapiens
gtctggcctgccagctctggtg

SEQ ID NO: 7660513 - DNA, 22 bp, Homo sapiens
gtctggcctgccagctctggtg

SEQ ID NO: 7660514 - DNA, 22 bp, Homo sapiens
gtctggcctttttagcttgtgg

SEQ ID NO: 7660515 - DNA, 22 bp, Homo sapiens
gtctggcatatgcaaagtgcat

SEQ ID NO: 7660516 - DNA, 22 bp, Homo sapiens
gtctggcagatcgagcagccca

SEQ ID NO: 7660517 - DNA, 22 bp, Homo sapiens
gtctggcattcttcctggagaa

SEQ ID NO: 7660518 - DNA, 22 bp, Homo sapiens
gtctggccatttgcccattgtg

SEQ ID NO: 7660519 - DNA, 22 bp, Homo sapiens
gtctggccatttgcccattgtg

SEQ ID NO: 7660520 - DNA, 16 bp, Homo sapiens
gtctggcctacctgcc

SEQ ID NO: 7660521 - DNA, 22 bp, Homo sapiens
gtctggcccagcaatttgctca

SEQ ID NO: 7660522 - DNA, 22 bp, Homo sapiens
gtctggctttgctcagatgctg

SEQ ID NO: 7660523 - DNA, 22 bp, Homo sapiens
gtctggctttcatggctctgca

SEQ ID NO: 7660524 - DNA, 22 bp, Homo sapiens
gtctggctttcatggctctgca

SEQ ID NO: 7660525 - DNA, 22 bp, Homo sapiens
gtctggctttcatggctctgca

SEQ ID NO: 7660526 - DNA, 22 bp, Homo sapiens
gtctggctttcatggctctgca

SEQ ID NO: 7660527 - DNA, 22 bp, Homo sapiens
gtctggctttcatggctctgca

SEQ ID NO: 7660528 - DNA, 22 bp, Homo sapiens
gtctggctttgctcagatgctg

SEQ ID NO: 7660529 - DNA, 22 bp, Homo sapiens
gtctggctttatatttgctatt

SEQ ID NO: 7660530 - DNA, 20 bp, Homo sapiens
gtctggcttcgtgattctgg

SEQ ID NO: 7660531 - DNA, 22 bp, Homo sapiens
gtctggctttatatttgctatt

SEQ ID NO: 7660532 - DNA, 22 bp, Homo sapiens
gtctggcttttgccctgtgttt

SEQ ID NO: 7660533 - DNA, 22 bp, Homo sapiens
gtctggcttttgccctgtgttt

SEQ ID NO: 7660534 - DNA, 22 bp, Homo sapiens
gtctggctttgctcagatgctg

SEQ ID NO: 7660535 - DNA, 22 bp, Homo sapiens
gtctgggagtttggtgctgccg

SEQ ID NO: 7660536 - DNA, 22 bp, Homo sapiens
gtctgggacaggactggggaac

SEQ ID NO: 7660537 - DNA, 22 bp, Homo sapiens
gtctgggacaggactggggaac

SEQ ID NO: 7660538 - DNA, 22 bp, Homo sapiens
gtctgggcaagggagatggcgc

SEQ ID NO: 7660539 - DNA, 22 bp, Homo sapiens
gtctgggattggggtaaagaag

SEQ ID NO: 7660540 - DNA, 22 bp, Homo sapiens
gtctgggcaagggagatggcgc

SEQ ID NO: 7660541 - DNA, 22 bp, Homo sapiens
gtctgggcaagggagatggcgc

SEQ ID NO: 7660542 - DNA, 22 bp, Homo sapiens
gtctgggcaagggagatggcgc

SEQ ID NO: 7660543 - DNA, 22 bp, Homo sapiens
gtctgggcacctggcctgggaa

SEQ ID NO: 7660544 - DNA, 22 bp, Homo sapiens
gtctgggcaagggagatggcgc

SEQ ID NO: 7660545 - DNA, 22 bp, Homo sapiens
gtctgggcaagggagatggcgc

SEQ ID NO: 7660546 - DNA, 22 bp, Homo sapiens
gtctgggcacctggcctgggaa

SEQ ID NO: 7660547 - DNA, 22 bp, Homo sapiens
gtctgggcacctggcctgggaa

SEQ ID NO: 7660548 - DNA, 22 bp, Homo sapiens
gtctgggcacctggcctgggaa

SEQ ID NO: 7660549 - DNA, 22 bp, Homo sapiens
gtctgggcacctggcctgggaa

SEQ ID NO: 7660550 - DNA, 22 bp, Homo sapiens
gtctgggccaggcgagccgagg

SEQ ID NO: 7660551 - DNA, 22 bp, Homo sapiens
gtctgggcatcagactgcgggc

SEQ ID NO: 7660552 - DNA, 22 bp, Homo sapiens
gtctgggcagcagcatttctta

SEQ ID NO: 7660553 - DNA, 22 bp, Homo sapiens
gtctgggggtccgggtgcctgc

SEQ ID NO: 7660554 - DNA, 22 bp, Homo sapiens
gtctgggggtccgggtgcctgc

SEQ ID NO: 7660555 - DNA, 22 bp, Homo sapiens
gtctggggcagcaaggcgcgcg

SEQ ID NO: 7660556 - DNA, 22 bp, Homo sapiens
gtctgggggtccgggtgcctgc

SEQ ID NO: 7660557 - DNA, 22 bp, Homo sapiens
gtctggggaagtcagggcatca

SEQ ID NO: 7660558 - DNA, 22 bp, Homo sapiens
gtctggggcagcaaggcgcgcg

SEQ ID NO: 7660559 - DNA, 22 bp, Homo sapiens
gtctggggcagcaaggcgcgcg

SEQ ID NO: 7660560 - DNA, 22 bp, Homo sapiens
gtctggggcagcaaggcgcgcg

SEQ ID NO: 7660561 - DNA, 22 bp, Homo sapiens
gtctggggaagtcagggcatca

SEQ ID NO: 7660562 - DNA, 22 bp, Homo sapiens
gtctggggaagtcagggcatca

SEQ ID NO: 7660563 - DNA, 22 bp, Homo sapiens
gtctggggaagtcagggcatca

SEQ ID NO: 7660564 - DNA, 22 bp, Homo sapiens
gtctggggaagtcagggcatca

SEQ ID NO: 7660565 - DNA, 22 bp, Homo sapiens
gtctggggaagtcagggcatca

SEQ ID NO: 7660566 - DNA, 22 bp, Homo sapiens
gtctggggaagtcagggcatca

SEQ ID NO: 7660567 - DNA, 22 bp, Homo sapiens
gtctggggaagtcagggcatca

SEQ ID NO: 7660568 - DNA, 17 bp, Homo sapiens
gtctgggctttagagac

SEQ ID NO: 7660569 - DNA, 22 bp, Homo sapiens
gtctgggcttagggacatggca

SEQ ID NO: 7660570 - DNA, 22 bp, Homo sapiens
gtctgggcttagggacatggca

SEQ ID NO: 7660571 - DNA, 22 bp, Homo sapiens
gtctgggctcctggcaggcagc

SEQ ID NO: 7660572 - DNA, 22 bp, Homo sapiens
gtctgggctcctggcaggcagc

SEQ ID NO: 7660573 - DNA, 22 bp, Homo sapiens
gtctgggcttagggacatggca

SEQ ID NO: 7660574 - DNA, 22 bp, Homo sapiens
gtctgggctcctggcaggcagc

SEQ ID NO: 7660575 - DNA, 22 bp, Homo sapiens
gtctgggctcctggcaggcagc

SEQ ID NO: 7660576 - DNA, 22 bp, Homo sapiens
gtctgggctcccagggtcggcg

SEQ ID NO: 7660577 - DNA, 22 bp, Homo sapiens
gtctgggctcccagggtcggcg

SEQ ID NO: 7660578 - DNA, 22 bp, Homo sapiens
gtctgggctcccagggtcggcg

SEQ ID NO: 7660579 - DNA, 22 bp, Homo sapiens
gtctgggccaggcgagccgagg

SEQ ID NO: 7660580 - DNA, 22 bp, Homo sapiens
gtctgggctcccagggtcggcg

SEQ ID NO: 7660581 - DNA, 22 bp, Homo sapiens
gtccttggaggtgtggaatctg

SEQ ID NO: 7660582 - DNA, 22 bp, Homo sapiens
gtccttggaggtgtggaatctg

SEQ ID NO: 7660583 - DNA, 22 bp, Homo sapiens
gtccttggaggtgtggaatctg

SEQ ID NO: 7660584 - DNA, 22 bp, Homo sapiens
gtccttggaggtgtggaatctg

SEQ ID NO: 7660585 - DNA, 22 bp, Homo sapiens
gtccttggagtcaggcaaggct

SEQ ID NO: 7660586 - DNA, 22 bp, Homo sapiens
gtccttggagtcaggcaaggct

SEQ ID NO: 7660587 - DNA, 22 bp, Homo sapiens
gtccttggagtcaggcaaggct

SEQ ID NO: 7660588 - DNA, 22 bp, Homo sapiens
gtccttgctttggagcaggcta

SEQ ID NO: 7660589 - DNA, 22 bp, Homo sapiens
gtccttgcttgagacaggcagt

SEQ ID NO: 7660590 - DNA, 22 bp, Homo sapiens
gtccttggagctcccctctgta

SEQ ID NO: 7660591 - DNA, 22 bp, Homo sapiens
gtccttggaaagtctaatctct

SEQ ID NO: 7660592 - DNA, 22 bp, Homo sapiens
gtccttggagctcccctctgta

SEQ ID NO: 7660593 - DNA, 22 bp, Homo sapiens
gtccttggagctcccctctgta

SEQ ID NO: 7660594 - DNA, 22 bp, Homo sapiens
gtccttggagctcccctctgta

SEQ ID NO: 7660595 - DNA, 22 bp, Homo sapiens
gtccttggccttcttgtaggca

SEQ ID NO: 7660596 - DNA, 22 bp, Homo sapiens
gtccttggccttcttgtaggca

SEQ ID NO: 7660597 - DNA, 22 bp, Homo sapiens
gtccttggcctgggtagagtgg

SEQ ID NO: 7660598 - DNA, 22 bp, Homo sapiens
gtccttggcattctgagtcttg

SEQ ID NO: 7660599 - DNA, 22 bp, Homo sapiens
gtccttggcattctgagtcttg

SEQ ID NO: 7660600 - DNA, 22 bp, Homo sapiens
gtccttggcattctgagtcttg

SEQ ID NO: 7660601 - DNA, 22 bp, Homo sapiens
gtccttggcacccatgtgattc

SEQ ID NO: 7660602 - DNA, 22 bp, Homo sapiens
gtccttggcagcagtccacccc

SEQ ID NO: 7660603 - DNA, 22 bp, Homo sapiens
gtccttggcatcatgatttggt

SEQ ID NO: 7660604 - DNA, 22 bp, Homo sapiens
gtccttggcatcatgatttggt

SEQ ID NO: 7660605 - DNA, 22 bp, Homo sapiens
gtccttggcacccatgtgattc

SEQ ID NO: 7660606 - DNA, 22 bp, Homo sapiens
gtccttggcacccatgtgattc

SEQ ID NO: 7660607 - DNA, 22 bp, Homo sapiens
gtccttggcacccatgtgattc

SEQ ID NO: 7660608 - DNA, 22 bp, Homo sapiens
gtcctttcttaaattcctgctt

SEQ ID NO: 7660609 - DNA, 22 bp, Homo sapiens
gtcctttcttaaattcctgctt

SEQ ID NO: 7660610 - DNA, 22 bp, Homo sapiens
gtcctttgaaggcaaaaggaga

SEQ ID NO: 7660611 - DNA, 22 bp, Homo sapiens
gtccttgggatagaaagatgaa

SEQ ID NO: 7660612 - DNA, 22 bp, Homo sapiens
gtcgatcacctcgtcctccgtg

SEQ ID NO: 7660613 - DNA, 22 bp, Homo sapiens
gtcctttttgtaaaatattcat

SEQ ID NO: 7660614 - DNA, 22 bp, Homo sapiens
gtcctttttgtaaaatattcat

SEQ ID NO: 7660615 - DNA, 22 bp, Homo sapiens
gtcctttgaaggcaaaaggaga

SEQ ID NO: 7660616 - DNA, 22 bp, Homo sapiens
gtcggccacgcaggtgcggtag

SEQ ID NO: 7660617 - DNA, 22 bp, Homo sapiens
gtcggccacgcaggtgcggtag

SEQ ID NO: 7660618 - DNA, 22 bp, Homo sapiens
gtcgctgaggagatgtgcaagg

SEQ ID NO: 7660619 - DNA, 22 bp, Homo sapiens
gtccttgggatagaaagatgaa

SEQ ID NO: 7660620 - DNA, 22 bp, Homo sapiens
gtccttggcttgaggcacctca

SEQ ID NO: 7660621 - DNA, 22 bp, Homo sapiens
gtccttggggtcatccattatc

SEQ ID NO: 7660622 - DNA, 22 bp, Homo sapiens
gtccttggtatgaccaaggttt

SEQ ID NO: 7660623 - DNA, 22 bp, Homo sapiens
gtccttgtattccaagatacaa

SEQ ID NO: 7660624 - DNA, 22 bp, Homo sapiens
gtccttggctgggcttgcctcg

SEQ ID NO: 7660625 - DNA, 22 bp, Homo sapiens
gtccttggctgtggctgtaatg

SEQ ID NO: 7660626 - DNA, 22 bp, Homo sapiens
gtccttggctgtggctgtaatg

SEQ ID NO: 7660627 - DNA, 22 bp, Homo sapiens
gtccttggctgtggctgtaatg

SEQ ID NO: 7660628 - DNA, 22 bp, Homo sapiens
gtccttggcttcttgttgactg

SEQ ID NO: 7660629 - DNA, 22 bp, Homo sapiens
gtccttggcttcttgttgactg

SEQ ID NO: 7660630 - DNA, 22 bp, Homo sapiens
gtccttggcttcttgttgactg

SEQ ID NO: 7660631 - DNA, 22 bp, Homo sapiens
gtccttccccagccagctctgg

SEQ ID NO: 7660632 - DNA, 22 bp, Homo sapiens
gtccttcctgcagggatggatg

SEQ ID NO: 7660633 - DNA, 22 bp, Homo sapiens
gtccttcctgcagggatggatg

SEQ ID NO: 7660634 - DNA, 22 bp, Homo sapiens
gtccttcctgcagggatggatg

SEQ ID NO: 7660635 - DNA, 22 bp, Homo sapiens
gtccttctcaaatcctgtgttt

SEQ ID NO: 7660636 - DNA, 22 bp, Homo sapiens
gtccttccacatggccaacttc

SEQ ID NO: 7660637 - DNA, 22 bp, Homo sapiens
gtccttcatttcctgatctcta

SEQ ID NO: 7660638 - DNA, 22 bp, Homo sapiens
gtccttccccagccagctctgg

SEQ ID NO: 7660639 - DNA, 22 bp, Homo sapiens
gtccttccccagccagctctgg

SEQ ID NO: 7660640 - DNA, 22 bp, Homo sapiens
gtccttgaggaaacagatgtga

SEQ ID NO: 7660641 - DNA, 22 bp, Homo sapiens
gtccttgcttgagacaggcagt

SEQ ID NO: 7660642 - DNA, 22 bp, Homo sapiens
gtccttgagtaagtcatggtgg

SEQ ID NO: 7660643 - DNA, 22 bp, Homo sapiens
gtccttgaagccatttcagggc

SEQ ID NO: 7660644 - DNA, 22 bp, Homo sapiens
gtccttcttttcatccctggtt

SEQ ID NO: 7660645 - DNA, 22 bp, Homo sapiens
gtccttcatctggagcctggtc

SEQ ID NO: 7660646 - DNA, 22 bp, Homo sapiens
gtccttcagggagtcaaacact

SEQ ID NO: 7660647 - DNA, 22 bp, Homo sapiens
gtccttcagctttatctgaaca

SEQ ID NO: 7660648 - DNA, 22 bp, Homo sapiens
gtccttcagctttatctgaaca

SEQ ID NO: 7660649 - DNA, 22 bp, Homo sapiens
gtccttcatctggagcctggtc

SEQ ID NO: 7660650 - DNA, 22 bp, Homo sapiens
gtccttcatatcatggattata

SEQ ID NO: 7660651 - DNA, 22 bp, Homo sapiens
gtccttcatggagttacagcct

SEQ ID NO: 7660652 - DNA, 22 bp, Homo sapiens
gtccttcatggagttacagcct

SEQ ID NO: 7660653 - DNA, 21 bp, Homo sapiens
gtccttcattatcaagtcaaa

SEQ ID NO: 7660654 - DNA, 22 bp, Homo sapiens
gtccttcatttcctgatctcta

SEQ ID NO: 7660655 - DNA, 22 bp, Homo sapiens
gtccttcaagtaacctgggacc

SEQ ID NO: 7660656 - DNA, 22 bp, Homo sapiens
gtccttcaagtaacctgggacc

SEQ ID NO: 7660657 - DNA, 21 bp, Homo sapiens
gtccttcagcaagttagtggc

SEQ ID NO: 7660658 - DNA, 22 bp, Homo sapiens
gtccttcagcacctccctcggc

SEQ ID NO: 7660659 - DNA, 22 bp, Homo sapiens
gtccttcagcacctccctcggc

SEQ ID NO: 7660660 - DNA, 22 bp, Homo sapiens
gtctgaggaagatgcaggggga

SEQ ID NO: 7660661 - DNA, 22 bp, Homo sapiens
gtctgagcccccgggaagctgg

SEQ ID NO: 7660662 - DNA, 22 bp, Homo sapiens
gtctgagaggaggcagcctcgg

SEQ ID NO: 7660663 - DNA, 22 bp, Homo sapiens
gtctgagaggagccaagtattg

SEQ ID NO: 7660664 - DNA, 22 bp, Homo sapiens
gtctgagattagggaagatttt

SEQ ID NO: 7660665 - DNA, 22 bp, Homo sapiens
gtctgagcaccctggcctgtca

SEQ ID NO: 7660666 - DNA, 20 bp, Homo sapiens
gtctgaggagcagtgggaaa

SEQ ID NO: 7660667 - DNA, 20 bp, Homo sapiens
gtctgaggagcagtgggaaa

SEQ ID NO: 7660668 - DNA, 22 bp, Homo sapiens
gtctgaggcctgaggccctggg

SEQ ID NO: 7660669 - DNA, 22 bp, Homo sapiens
gtctgaggcctgaggccctggg

SEQ ID NO: 7660670 - DNA, 20 bp, Homo sapiens
gtctgaggagcagtgggaaa

SEQ ID NO: 7660671 - DNA, 22 bp, Homo sapiens
gtctgagggagaaggatctggg

SEQ ID NO: 7660672 - DNA, 22 bp, Homo sapiens
gtctgaggggtttcccaggaca

SEQ ID NO: 7660673 - DNA, 22 bp, Homo sapiens
gtctgagggagaaggatctggg

SEQ ID NO: 7660674 - DNA, 22 bp, Homo sapiens
gtctgaggggtttcccaggaca

SEQ ID NO: 7660675 - DNA, 22 bp, Homo sapiens
gtctgaggggtttcccaggaca

SEQ ID NO: 7660676 - DNA, 22 bp, Homo sapiens
gtctgaggggtttcccaggaca

SEQ ID NO: 7660677 - DNA, 22 bp, Homo sapiens
gtctgagggtcatgggtctcac

SEQ ID NO: 7660678 - DNA, 22 bp, Homo sapiens
gtctgagggacagagtcctggc

SEQ ID NO: 7660679 - DNA, 22 bp, Homo sapiens
gtctgagggacagagtcctggc

SEQ ID NO: 7660680 - DNA, 22 bp, Homo sapiens
gtctgagggacagagtcctggc

SEQ ID NO: 7660681 - DNA, 22 bp, Homo sapiens
gtctgagggacagagtcctggc

SEQ ID NO: 7660682 - DNA, 22 bp, Homo sapiens
gtctgagggacagagtcctggc

SEQ ID NO: 7660683 - DNA, 22 bp, Homo sapiens
gtctgaggcgaggcctgagaac

SEQ ID NO: 7660684 - DNA, 22 bp, Homo sapiens
gtctgaggcgaggcctgagaac

SEQ ID NO: 7660685 - DNA, 22 bp, Homo sapiens
gtctgaggaagatgcaggggga

SEQ ID NO: 7660686 - DNA, 22 bp, Homo sapiens
gtctgaggcgaggcctgagaac

SEQ ID NO: 7660687 - DNA, 19 bp, Homo sapiens
gtctctgctccagggtctc

SEQ ID NO: 7660688 - DNA, 19 bp, Homo sapiens
gtctctgctccagggtctc

SEQ ID NO: 7660689 - DNA, 22 bp, Homo sapiens
gtctctgagctctgagctggct

SEQ ID NO: 7660690 - DNA, 22 bp, Homo sapiens
gtctctgcctggggggatcaga

SEQ ID NO: 7660691 - DNA, 22 bp, Homo sapiens
gtctctgagctctgagctggct

SEQ ID NO: 7660692 - DNA, 22 bp, Homo sapiens
gtcggccacgcaggtgcggtag

SEQ ID NO: 7660693 - DNA, 22 bp, Homo sapiens
gtctctgagctctgagctggct

SEQ ID NO: 7660694 - DNA, 22 bp, Homo sapiens
gtctctgagctctgagctggct

SEQ ID NO: 7660695 - DNA, 22 bp, Homo sapiens
gtctctgagctctgagctggct

SEQ ID NO: 7660696 - DNA, 22 bp, Homo sapiens
gtctgaaaatatgattttgcct

SEQ ID NO: 7660697 - DNA, 22 bp, Homo sapiens
gtctgaaaatgccctacgattg

SEQ ID NO: 7660698 - DNA, 22 bp, Homo sapiens
gtctgaaaatgccctacgattg

SEQ ID NO: 7660699 - DNA, 22 bp, Homo sapiens
gtctgaaaatgccctacgattg

SEQ ID NO: 7660700 - DNA, 22 bp, Homo sapiens
gtctcttttatggtgagttgat

SEQ ID NO: 7660701 - DNA, 22 bp, Homo sapiens
gtctcttttatggtgagttgat

SEQ ID NO: 7660702 - DNA, 22 bp, Homo sapiens
gtctcttttatggtgagttgat

SEQ ID NO: 7660703 - DNA, 22 bp, Homo sapiens
gtctctgctctagagtctgtga

SEQ ID NO: 7660704 - DNA, 19 bp, Homo sapiens
gtctctggatttcaggtcc

SEQ ID NO: 7660705 - DNA, 22 bp, Homo sapiens
gtctgacacctagagtccagga

SEQ ID NO: 7660706 - DNA, 22 bp, Homo sapiens
gtctgaatgatgagtgggactc

SEQ ID NO: 7660707 - DNA, 22 bp, Homo sapiens
gtctgaatacgtacttgtgaag

SEQ ID NO: 7660708 - DNA, 22 bp, Homo sapiens
gtctgaagccagtggtagtccg

SEQ ID NO: 7660709 - DNA, 22 bp, Homo sapiens
gtctgactcataagatctcttg

SEQ ID NO: 7660710 - DNA, 22 bp, Homo sapiens
gtctgacttcctaatccatcac

SEQ ID NO: 7660711 - DNA, 22 bp, Homo sapiens
gtctgagaaagaattctgggga

SEQ ID NO: 7660712 - DNA, 22 bp, Homo sapiens
gtctgacacctagagtccagga

SEQ ID NO: 7660713 - DNA, 22 bp, Homo sapiens
gtctgagaactactgaggataa

SEQ ID NO: 7660714 - DNA, 22 bp, Homo sapiens
gtctgagaatcttgcatatcat

SEQ ID NO: 7660715 - DNA, 22 bp, Homo sapiens
gtctgagaatcttgcatatcat

SEQ ID NO: 7660716 - DNA, 22 bp, Homo sapiens
gtctgagactgggcacatacct

SEQ ID NO: 7660717 - DNA, 22 bp, Homo sapiens
gtctgagacccactcccagaga

SEQ ID NO: 7660718 - DNA, 22 bp, Homo sapiens
gtctgagactgggcacatacct

SEQ ID NO: 7660719 - DNA, 22 bp, Homo sapiens
gtctgagactttttctgtgtgg

SEQ ID NO: 7660720 - DNA, 22 bp, Homo sapiens
gtcctgtgtaagtacttgctca

SEQ ID NO: 7660721 - DNA, 22 bp, Homo sapiens
gtcctgtgtactcctgatactt

SEQ ID NO: 7660722 - DNA, 22 bp, Homo sapiens
gtcctgtgtgacttcccaaatg

SEQ ID NO: 7660723 - DNA, 22 bp, Homo sapiens
gtcctggtagctggcttggtca

SEQ ID NO: 7660724 - DNA, 22 bp, Homo sapiens
gtcctggtagggctctgtgtct

SEQ ID NO: 7660725 - DNA, 22 bp, Homo sapiens
gtcctgtgtaagccaggacaat

SEQ ID NO: 7660726 - DNA, 22 bp, Homo sapiens
gtcctgggtccccgcaggtcag

SEQ ID NO: 7660727 - DNA, 22 bp, Homo sapiens
gtcctgggtccccgcaggtcag

SEQ ID NO: 7660728 - DNA, 22 bp, Homo sapiens
gtcctgggtccccgcaggtcag

SEQ ID NO: 7660729 - DNA, 22 bp, Homo sapiens
gtcctgttggggtgttgcagtc

SEQ ID NO: 7660730 - DNA, 22 bp, Homo sapiens
gtcctgttggggtgttgcagtc

SEQ ID NO: 7660731 - DNA, 22 bp, Homo sapiens
gtcctgtttgtatttgctggaa

SEQ ID NO: 7660732 - DNA, 22 bp, Homo sapiens
gtcctgttaagatgcagagtcc

SEQ ID NO: 7660733 - DNA, 22 bp, Homo sapiens
gtcctgtgtgttgccggctgaa

SEQ ID NO: 7660734 - DNA, 22 bp, Homo sapiens
gtcctgtgtgttgccggctgaa

SEQ ID NO: 7660735 - DNA, 22 bp, Homo sapiens
gtcctgtgtgagtgcaccacct

SEQ ID NO: 7660736 - DNA, 22 bp, Homo sapiens
gtcctgtgtgagtgcaccacct

SEQ ID NO: 7660737 - DNA, 22 bp, Homo sapiens
gtcctgtgtgagtgcaccacct

SEQ ID NO: 7660738 - DNA, 22 bp, Homo sapiens
gtcctgtgtgagtgcaccacct

SEQ ID NO: 7660739 - DNA, 22 bp, Homo sapiens
gtccttcaaaggcacgcagtta

SEQ ID NO: 7660740 - DNA, 22 bp, Homo sapiens
gtccttcaagagtcccctactg

SEQ ID NO: 7660741 - DNA, 22 bp, Homo sapiens
gtccttcaaggtccttggtgtg

SEQ ID NO: 7660742 - DNA, 22 bp, Homo sapiens
gtccttcaaggtccttggtgtg

SEQ ID NO: 7660743 - DNA, 22 bp, Homo sapiens
gtccttcaagagtcccctactg

SEQ ID NO: 7660744 - DNA, 22 bp, Homo sapiens
gtccttaatctgattggtgcag

SEQ ID NO: 7660745 - DNA, 22 bp, Homo sapiens
gtccttaacaaacggggaaaag

SEQ ID NO: 7660746 - DNA, 22 bp, Homo sapiens
gtccttaaagagagcatcattc

SEQ ID NO: 7660747 - DNA, 22 bp, Homo sapiens
gtcccataagtagtgcaacttg

SEQ ID NO: 7660748 - DNA, 22 bp, Homo sapiens
gtcccataagtagtgcaacttg

SEQ ID NO: 7660749 - DNA, 22 bp, Homo sapiens
gtcccataagtagtgcaacttg

SEQ ID NO: 7660750 - DNA, 22 bp, Homo sapiens
gtcccataagtagtgcaacttg

SEQ ID NO: 7660751 - DNA, 22 bp, Homo sapiens
gtcccaggtgggctccacctct

SEQ ID NO: 7660752 - DNA, 22 bp, Homo sapiens
gtcccaggtgggctccacctct

SEQ ID NO: 7660753 - DNA, 22 bp, Homo sapiens
gtcccagttcctcctgtcagca

SEQ ID NO: 7660754 - DNA, 22 bp, Homo sapiens
gtcccagttcctcctgtcagca

SEQ ID NO: 7660755 - DNA, 22 bp, Homo sapiens
gtcccagttcctcctgtcagca

SEQ ID NO: 7660756 - DNA, 22 bp, Homo sapiens
gtcccaggtgggctccacctct

SEQ ID NO: 7660757 - DNA, 22 bp, Homo sapiens
gtcccaggtgcccagtgggcag

SEQ ID NO: 7660758 - DNA, 22 bp, Homo sapiens
gtcccaggtgcccagtgggcag

SEQ ID NO: 7660759 - DNA, 22 bp, Homo sapiens
gtcccaggtgcccagtgggcag

SEQ ID NO: 7660760 - DNA, 22 bp, Homo sapiens
gtcccaggtgcccagtgggcag

SEQ ID NO: 7660761 - DNA, 22 bp, Homo sapiens
gtcccaggtgcccagtgggcag

SEQ ID NO: 7660762 - DNA, 22 bp, Homo sapiens
gtcccaggtgcccagtgggcag

SEQ ID NO: 7660763 - DNA, 22 bp, Homo sapiens
gtcccaggtgcccagtgggcag

SEQ ID NO: 7660764 - DNA, 22 bp, Homo sapiens
gtcccaggtgcccagtgggcag

SEQ ID NO: 7660765 - DNA, 22 bp, Homo sapiens
gtcccaggtcccagcacatctg

SEQ ID NO: 7660766 - DNA, 22 bp, Homo sapiens
gtcccagggccaccatatatag

SEQ ID NO: 7660767 - DNA, 22 bp, Homo sapiens
gtcccagggccaccatatatag

SEQ ID NO: 7660768 - DNA, 22 bp, Homo sapiens
gtcccaggtcccagcacatctg

SEQ ID NO: 7660769 - DNA, 22 bp, Homo sapiens
gtcccagggatgcagacatgag

SEQ ID NO: 7660770 - DNA, 22 bp, Homo sapiens
gtcccagggatgcagacatgag

SEQ ID NO: 7660771 - DNA, 22 bp, Homo sapiens
gtcccagggatgcagacatgag

SEQ ID NO: 7660772 - DNA, 22 bp, Homo sapiens
gtcccagggatgcagacatgag

SEQ ID NO: 7660773 - DNA, 22 bp, Homo sapiens
gtcccagggatgcagacatgag

SEQ ID NO: 7660774 - DNA, 22 bp, Homo sapiens
gtcccagggatgcagacatgag

SEQ ID NO: 7660775 - DNA, 22 bp, Homo sapiens
gtcccagggaggttcagggctt

SEQ ID NO: 7660776 - DNA, 22 bp, Homo sapiens
gtcccagggaggttcagggctt

SEQ ID NO: 7660777 - DNA, 22 bp, Homo sapiens
gtcccagggaggttcagggctt

SEQ ID NO: 7660778 - DNA, 22 bp, Homo sapiens
gtcccagggaggttcagggctt

SEQ ID NO: 7660779 - DNA, 22 bp, Homo sapiens
gtcccagggaggttcagggctt

SEQ ID NO: 7660780 - DNA, 22 bp, Homo sapiens
gtcccagggcaaggctgtttct

SEQ ID NO: 7660781 - DNA, 22 bp, Homo sapiens
gtcccagggcaaggctgtttct

SEQ ID NO: 7660782 - DNA, 22 bp, Homo sapiens
gtcccagggatgcagacatgag

SEQ ID NO: 7660783 - DNA, 22 bp, Homo sapiens
gtcccagggatgcagacatgag

SEQ ID NO: 7660784 - DNA, 22 bp, Homo sapiens
gtcccagggatgcagacatgag

SEQ ID NO: 7660785 - DNA, 22 bp, Homo sapiens
gtccagtgtcttctacataaca

SEQ ID NO: 7660786 - DNA, 22 bp, Homo sapiens
gtccagtgtcttctacataaca

SEQ ID NO: 7660787 - DNA, 22 bp, Homo sapiens
gtccagtgtcttctacataaca

SEQ ID NO: 7660788 - DNA, 22 bp, Homo sapiens
gtccagtgtgtttatcttggat

SEQ ID NO: 7660789 - DNA, 20 bp, Homo sapiens
gtccagtgggccttcatttc

SEQ ID NO: 7660790 - DNA, 20 bp, Homo sapiens
gtccagtgggccttcatttc

SEQ ID NO: 7660791 - DNA, 22 bp, Homo sapiens
gtccagtggtcaattatctgga

SEQ ID NO: 7660792 - DNA, 22 bp, Homo sapiens
gtccagtggtcaattatctgga

SEQ ID NO: 7660793 - DNA, 22 bp, Homo sapiens
gtccatacaggcagtggctctg

SEQ ID NO: 7660794 - DNA, 22 bp, Homo sapiens
gtccatacaggcagtggctctg

SEQ ID NO: 7660795 - DNA, 22 bp, Homo sapiens
gtccagtgttggaggttttacc

SEQ ID NO: 7660796 - DNA, 19 bp, Homo sapiens
gtccagtgttttccagtca

SEQ ID NO: 7660797 - DNA, 22 bp, Homo sapiens
gtccagttgtatgtccagtgtc

SEQ ID NO: 7660798 - DNA, 22 bp, Homo sapiens
gtccagttgtatgtccagtgtc

SEQ ID NO: 7660799 - DNA, 22 bp, Homo sapiens
gtccatccacctctcgtctacc

SEQ ID NO: 7660800 - DNA, 22 bp, Homo sapiens
gtccatccacgcccacacactc

SEQ ID NO: 7660801 - DNA, 22 bp, Homo sapiens
gtccatatgtcaggtgtgaatt

SEQ ID NO: 7660802 - DNA, 22 bp, Homo sapiens
gtccatacagtggcacacatct

SEQ ID NO: 7660803 - DNA, 22 bp, Homo sapiens
gtccatccagaggccaccatgg

SEQ ID NO: 7660804 - DNA, 18 bp, Homo sapiens
gtccatccaggcagtgtc

SEQ ID NO: 7660805 - DNA, 18 bp, Homo sapiens
gtccatccaggcagtgtc

SEQ ID NO: 7660806 - DNA, 22 bp, Homo sapiens
gtccatccagggtcaccatgac

SEQ ID NO: 7660807 - DNA, 22 bp, Homo sapiens
gtccatccagggtcaccatgac

SEQ ID NO: 7660808 - DNA, 22 bp, Homo sapiens
gtccatccagggtcaccatgac

SEQ ID NO: 7660809 - DNA, 22 bp, Homo sapiens
gtccatccatgttgtattatgt

SEQ ID NO: 7660810 - DNA, 22 bp, Homo sapiens
gtccatccatgttgtattatgt

SEQ ID NO: 7660811 - DNA, 22 bp, Homo sapiens
gtccatccattgaatataatag

SEQ ID NO: 7660812 - DNA, 22 bp, Homo sapiens
gtccatccctatctgcattgct

SEQ ID NO: 7660813 - DNA, 22 bp, Homo sapiens
gtccatccctatctgcattgct

SEQ ID NO: 7660814 - DNA, 22 bp, Homo sapiens
gtccatccctcgagttagggtg

SEQ ID NO: 7660815 - DNA, 22 bp, Homo sapiens
gtccatccggccacctccagcc

SEQ ID NO: 7660816 - DNA, 22 bp, Homo sapiens
gtccatccggccacctccagcc

SEQ ID NO: 7660817 - DNA, 22 bp, Homo sapiens
gtccatccgtggtagcatggat

SEQ ID NO: 7660818 - DNA, 22 bp, Homo sapiens
gtccatccgtggtagcatggat

SEQ ID NO: 7660819 - DNA, 22 bp, Homo sapiens
gtccagggggcttaagcaaact

SEQ ID NO: 7660820 - DNA, 22 bp, Homo sapiens
gtccaggtctggaccctgagcc

SEQ ID NO: 7660821 - DNA, 22 bp, Homo sapiens
gtccaggtctggaccctgagcc

SEQ ID NO: 7660822 - DNA, 22 bp, Homo sapiens
gtccaggtctggaccctgagcc

SEQ ID NO: 7660823 - DNA, 22 bp, Homo sapiens
gtccagggctaaatcaggttcc

SEQ ID NO: 7660824 - DNA, 22 bp, Homo sapiens
gtccagggggcttaagcaaact

SEQ ID NO: 7660825 - DNA, 22 bp, Homo sapiens
gtccagggggcttaagcaaact

SEQ ID NO: 7660826 - DNA, 22 bp, Homo sapiens
gtccagggccccgagcaccagg

SEQ ID NO: 7660827 - DNA, 22 bp, Homo sapiens
gtccagggctaaatcaggttcc

SEQ ID NO: 7660828 - DNA, 22 bp, Homo sapiens
gtccagggctaaatcaggttcc

SEQ ID NO: 7660829 - DNA, 22 bp, Homo sapiens
gtccagggccccgagcaccagg

SEQ ID NO: 7660830 - DNA, 22 bp, Homo sapiens
gtccagggccccgagcaccagg

SEQ ID NO: 7660831 - DNA, 22 bp, Homo sapiens
gtccagggccccgagcaccagg

SEQ ID NO: 7660832 - DNA, 21 bp, Homo sapiens
gtccagtggaggaggacagga

SEQ ID NO: 7660833 - DNA, 22 bp, Homo sapiens
gtccagtgcttatagaatcagt

SEQ ID NO: 7660834 - DNA, 22 bp, Homo sapiens
gtccagtgcttatagaatcagt

SEQ ID NO: 7660835 - DNA, 22 bp, Homo sapiens
gtccagtgctaacaggttgagg

SEQ ID NO: 7660836 - DNA, 22 bp, Homo sapiens
gtccagtcactgtcaatgttcc

SEQ ID NO: 7660837 - DNA, 22 bp, Homo sapiens
gtccagtcactgtcaatgttcc

SEQ ID NO: 7660838 - DNA, 22 bp, Homo sapiens
gtccagtctctttccaagccca

SEQ ID NO: 7660839 - DNA, 22 bp, Homo sapiens
gtccagtgacaagtagctggcc

SEQ ID NO: 7660840 - DNA, 22 bp, Homo sapiens
gtcccagaaacatattgctggt

SEQ ID NO: 7660841 - DNA, 22 bp, Homo sapiens
gtcccagaaacatattgctggt

SEQ ID NO: 7660842 - DNA, 22 bp, Homo sapiens
gtcccactgggcaactagaaaa

SEQ ID NO: 7660843 - DNA, 22 bp, Homo sapiens
gtcccactgggcaactagaaaa

SEQ ID NO: 7660844 - DNA, 22 bp, Homo sapiens
gtcccagggaggttcagggctt

SEQ ID NO: 7660845 - DNA, 22 bp, Homo sapiens
gtcccagggaagaaggcagcac

SEQ ID NO: 7660846 - DNA, 22 bp, Homo sapiens
gtcccagggaagaaggcagcac

SEQ ID NO: 7660847 - DNA, 22 bp, Homo sapiens
gtcccacaggaactcggtggag

SEQ ID NO: 7660848 - DNA, 22 bp, Homo sapiens
gtcccacaggaactcggtggag

SEQ ID NO: 7660849 - DNA, 22 bp, Homo sapiens
gtcccacaccttgaggggtctt

SEQ ID NO: 7660850 - DNA, 22 bp, Homo sapiens
gtccattttattcagagacttt

SEQ ID NO: 7660851 - DNA, 22 bp, Homo sapiens
gtccattccttgcctctgggcc

SEQ ID NO: 7660852 - DNA, 21 bp, Homo sapiens
gtccattgagcgtctccgtgg

SEQ ID NO: 7660853 - DNA, 22 bp, Homo sapiens
gtccattgttctatggctcaaa

SEQ ID NO: 7660854 - DNA, 22 bp, Homo sapiens
gtccatgcagtcacctccagct

SEQ ID NO: 7660855 - DNA, 22 bp, Homo sapiens
gtccatgcagtcacctccagct

SEQ ID NO: 7660856 - DNA, 22 bp, Homo sapiens
gtccatgattctgtgtagtaga

SEQ ID NO: 7660857 - DNA, 19 bp, Homo sapiens
gtccatgcttagaggggcc

SEQ ID NO: 7660858 - DNA, 22 bp, Homo sapiens
gtccatctgtcacttatagtcg

SEQ ID NO: 7660859 - DNA, 22 bp, Homo sapiens
gtccatcttattacagagcttt

SEQ ID NO: 7660860 - DNA, 22 bp, Homo sapiens
gtccatcttcttggtgtagcat

SEQ ID NO: 7660861 - DNA, 22 bp, Homo sapiens
gtccatctttgatgaaaactta

SEQ ID NO: 7660862 - DNA, 22 bp, Homo sapiens
gtccatgactgtgactcacatg

SEQ ID NO: 7660863 - DNA, 22 bp, Homo sapiens
gtccatgactgtgactcacatg

SEQ ID NO: 7660864 - DNA, 22 bp, Homo sapiens
gtccatctcttattgatcctaa

SEQ ID NO: 7660865 - DNA, 22 bp, Homo sapiens
gtccatctcttattgatcctaa

SEQ ID NO: 7660866 - DNA, 22 bp, Homo sapiens
gtccatctgtaggagggacaca

SEQ ID NO: 7660867 - DNA, 22 bp, Homo sapiens
gtccatctaagtatccagcctg

SEQ ID NO: 7660868 - DNA, 22 bp, Homo sapiens
gtccatccgtggtagcatggat

SEQ ID NO: 7660869 - DNA, 22 bp, Homo sapiens
gtccatctagaatttatttcta

SEQ ID NO: 7660870 - DNA, 22 bp, Homo sapiens
gtccatctaagtatccagcctg

SEQ ID NO: 7660871 - DNA, 22 bp, Homo sapiens
gtccatctagaatttatttcta

SEQ ID NO: 7660872 - DNA, 22 bp, Homo sapiens
gtccatctccaccatctgggag

SEQ ID NO: 7660873 - DNA, 22 bp, Homo sapiens
gtcagaggaggctgagtaggaa

SEQ ID NO: 7660874 - DNA, 18 bp, Homo sapiens
gtcagaggatggggaaat

SEQ ID NO: 7660875 - DNA, 18 bp, Homo sapiens
gtcagaggatggggaaat

SEQ ID NO: 7660876 - DNA, 18 bp, Homo sapiens
gtcagaggatggggaaat

SEQ ID NO: 7660877 - DNA, 18 bp, Homo sapiens
gtcagaggatggggaaat

SEQ ID NO: 7660878 - DNA, 22 bp, Homo sapiens
gtcagaggggcagctgccaggc

SEQ ID NO: 7660879 - DNA, 22 bp, Homo sapiens
gtcagaggggacaagacacaga

SEQ ID NO: 7660880 - DNA, 22 bp, Homo sapiens
gtcagaggggacaagacacaga

SEQ ID NO: 7660881 - DNA, 22 bp, Homo sapiens
gtcagaggggacaagacacaga

SEQ ID NO: 7660882 - DNA, 18 bp, Homo sapiens
gtcagaggatggggaaat

SEQ ID NO: 7660883 - DNA, 22 bp, Homo sapiens
gtattacaaataaatgttactg

SEQ ID NO: 7660884 - DNA, 22 bp, Homo sapiens
gtattacaaataaatgttactg

SEQ ID NO: 7660885 - DNA, 20 bp, Homo sapiens
gtattacaggcttagaacca

SEQ ID NO: 7660886 - DNA, 22 bp, Homo sapiens
gtattacaaataaatgttactg

SEQ ID NO: 7660887 - DNA, 22 bp, Homo sapiens
gtattacatttagtaattaggc

SEQ ID NO: 7660888 - DNA, 22 bp, Homo sapiens
gtattacatttagtaattaggc

SEQ ID NO: 7660889 - DNA, 20 bp, Homo sapiens
gtattacaggcttagaacca

SEQ ID NO: 7660890 - DNA, 20 bp, Homo sapiens
gtattacaggcttagaacca

SEQ ID NO: 7660891 - DNA, 22 bp, Homo sapiens
gtatgtcaaaatctgcatgata

SEQ ID NO: 7660892 - DNA, 22 bp, Homo sapiens
gtatgtcacctctcctaagcac

SEQ ID NO: 7660893 - DNA, 22 bp, Homo sapiens
gtatgtcacctctcctaagcac

SEQ ID NO: 7660894 - DNA, 22 bp, Homo sapiens
gtatgtcaaaatctgcatgata

SEQ ID NO: 7660895 - DNA, 22 bp, Homo sapiens
gtatgtatatatgtgtacacac

SEQ ID NO: 7660896 - DNA, 22 bp, Homo sapiens
gtatgtcatgagccttgtgcgt

SEQ ID NO: 7660897 - DNA, 22 bp, Homo sapiens
gtatgtctgagtaataatgtgt

SEQ ID NO: 7660898 - DNA, 22 bp, Homo sapiens
gtatgtctgagtaataatgtgt

SEQ ID NO: 7660899 - DNA, 22 bp, Homo sapiens
gtatgtgaggttggtttccagg

SEQ ID NO: 7660900 - DNA, 22 bp, Homo sapiens
gtatgtgaggttggtttccagg

SEQ ID NO: 7660901 - DNA, 22 bp, Homo sapiens
gtatgtgaggttggtttccagg

SEQ ID NO: 7660902 - DNA, 22 bp, Homo sapiens
gtatgtgtgcaaatgtaaatat

SEQ ID NO: 7660903 - DNA, 22 bp, Homo sapiens
gtatgtgtaagtatgccacctt

SEQ ID NO: 7660904 - DNA, 22 bp, Homo sapiens
gtatgtgctgagctttccccgc

SEQ ID NO: 7660905 - DNA, 22 bp, Homo sapiens
gtatgtgtaagtatgccacctt

SEQ ID NO: 7660906 - DNA, 22 bp, Homo sapiens
gtatgtgaggttggtttccagg

SEQ ID NO: 7660907 - DNA, 22 bp, Homo sapiens
gtatgtgaggttggtttccagg

SEQ ID NO: 7660908 - DNA, 22 bp, Homo sapiens
gtatgtgaggttggtttccagg

SEQ ID NO: 7660909 - DNA, 21 bp, Homo sapiens
gtcagctgtgtgtgaggaccc

SEQ ID NO: 7660910 - DNA, 21 bp, Homo sapiens
gtcagctgtgtgtgaggaccc

SEQ ID NO: 7660911 - DNA, 21 bp, Homo sapiens
gtcagctgtgtgtgaggaccc

SEQ ID NO: 7660912 - DNA, 21 bp, Homo sapiens
gtcagctgtgtgtgaggaccc

SEQ ID NO: 7660913 - DNA, 22 bp, Homo sapiens
gtcagctgtctccccagagtgg

SEQ ID NO: 7660914 - DNA, 22 bp, Homo sapiens
gtcagctgtctccccagagtgg

SEQ ID NO: 7660915 - DNA, 22 bp, Homo sapiens
gtcagctgggcatctgcagatg

SEQ ID NO: 7660916 - DNA, 22 bp, Homo sapiens
gtcagctgggcatctgcagatg

SEQ ID NO: 7660917 - DNA, 22 bp, Homo sapiens
gtcagctgtctccccagagtgg

SEQ ID NO: 7660918 - DNA, 22 bp, Homo sapiens
gtcaggaaaaattgataatttt

SEQ ID NO: 7660919 - DNA, 22 bp, Homo sapiens
gtcaggaaaacccgggttgact

SEQ ID NO: 7660920 - DNA, 22 bp, Homo sapiens
gtcaggaaaacccgggttgact

SEQ ID NO: 7660921 - DNA, 22 bp, Homo sapiens
gtcagcttccctttggtttatt

SEQ ID NO: 7660922 - DNA, 23 bp, Homo sapiens
gtcagcttgaccagtggagagtc

SEQ ID NO: 7660923 - DNA, 22 bp, Homo sapiens
gtcagcttcctcatctagcctt

SEQ ID NO: 7660924 - DNA, 22 bp, Homo sapiens
gtcagcttggaaataagggtgg

SEQ ID NO: 7660925 - DNA, 22 bp, Homo sapiens
gtcagaggggcagctgccaggc

SEQ ID NO: 7660926 - DNA, 22 bp, Homo sapiens
gtcagaggggcagctgccaggc

SEQ ID NO: 7660927 - DNA, 22 bp, Homo sapiens
gtcagaggggcagctgccaggc

SEQ ID NO: 7660928 - DNA, 22 bp, Homo sapiens
gtcagaggggacaagacacaga

SEQ ID NO: 7660929 - DNA, 22 bp, Homo sapiens
gtcagaggggcagctgccaggc

SEQ ID NO: 7660930 - DNA, 22 bp, Homo sapiens
gtcagaggggcagctgccaggc

SEQ ID NO: 7660931 - DNA, 22 bp, Homo sapiens
gtcagctcagcaggtgggagtg

SEQ ID NO: 7660932 - DNA, 22 bp, Homo sapiens
gtcagctcagcaggtgggagtg

SEQ ID NO: 7660933 - DNA, 22 bp, Homo sapiens
gtcagctactgcagggaacttt

SEQ ID NO: 7660934 - DNA, 22 bp, Homo sapiens
gtcagctaatagggtgtgtgtc

SEQ ID NO: 7660935 - DNA, 22 bp, Homo sapiens
gtcagctagaggatgtgacatt

SEQ ID NO: 7660936 - DNA, 22 bp, Homo sapiens
gtcagctcctagcaccccccaa

SEQ ID NO: 7660937 - DNA, 22 bp, Homo sapiens
gtcagctcatccatcccggtgg

SEQ ID NO: 7660938 - DNA, 22 bp, Homo sapiens
gtcagctcagcaggtgggagtg

SEQ ID NO: 7660939 - DNA, 22 bp, Homo sapiens
gtcagctatgtctgttgttgag

SEQ ID NO: 7660940 - DNA, 22 bp, Homo sapiens
gtcagctcatccatcccggtgg

SEQ ID NO: 7660941 - DNA, 22 bp, Homo sapiens
gtcagctgcacaggtgggagct

SEQ ID NO: 7660942 - DNA, 22 bp, Homo sapiens
gtcagctgcacaggtgggagct

SEQ ID NO: 7660943 - DNA, 22 bp, Homo sapiens
gtcagctcctagcaccccccaa

SEQ ID NO: 7660944 - DNA, 22 bp, Homo sapiens
gtcagctctcttatccatgagg

SEQ ID NO: 7660945 - DNA, 22 bp, Homo sapiens
gtcagctgcacaggtgggagct

SEQ ID NO: 7660946 - DNA, 22 bp, Homo sapiens
gtcagctgcagtgggcacagcc

SEQ ID NO: 7660947 - DNA, 22 bp, Homo sapiens
gtcagctgcagtgggcacagcc

SEQ ID NO: 7660948 - DNA, 19 bp, Homo sapiens
gtcagctggaactctgaaa

SEQ ID NO: 7660949 - DNA, 19 bp, Homo sapiens
gtcagctggaactctgaaa

SEQ ID NO: 7660950 - DNA, 19 bp, Homo sapiens
gtcagctggaactctgaaa

SEQ ID NO: 7660951 - DNA, 22 bp, Homo sapiens
gtcagctgggcatctgcagatg

SEQ ID NO: 7660952 - DNA, 22 bp, Homo sapiens
gtcaggagagacctgttctcct

SEQ ID NO: 7660953 - DNA, 22 bp, Homo sapiens
gtcaggagagatcaggacagca

SEQ ID NO: 7660954 - DNA, 22 bp, Homo sapiens
gtcaggagagatcaggacagca

SEQ ID NO: 7660955 - DNA, 22 bp, Homo sapiens
gtcaggagagatcaggacagca

SEQ ID NO: 7660956 - DNA, 22 bp, Homo sapiens
gtcaggagagatcaggacagca

SEQ ID NO: 7660957 - DNA, 22 bp, Homo sapiens
gtcaggagagatcaggacagca

SEQ ID NO: 7660958 - DNA, 22 bp, Homo sapiens
gtcaggagatagggcaagcttc

SEQ ID NO: 7660959 - DNA, 22 bp, Homo sapiens
gtcaggagaggccatcagcttt

SEQ ID NO: 7660960 - DNA, 22 bp, Homo sapiens
gtcaggagaggccatcagcttt

SEQ ID NO: 7660961 - DNA, 20 bp, Homo sapiens
gtcaggattagtaaactctg

SEQ ID NO: 7660962 - DNA, 22 bp, Homo sapiens
gtcaggagatagggcaagcttc

SEQ ID NO: 7660963 - DNA, 22 bp, Homo sapiens
gtcaggagatagggcaagcttc

SEQ ID NO: 7660964 - DNA, 22 bp, Homo sapiens
gtcaggagatagggcaagcttc

SEQ ID NO: 7660965 - DNA, 21 bp, Homo sapiens
gtcaggagccgtcttacattc

SEQ ID NO: 7660966 - DNA, 22 bp, Homo sapiens
gtcaggactctgacccgtcccg

SEQ ID NO: 7660967 - DNA, 22 bp, Homo sapiens
gtcaggacattttaccatcctg

SEQ ID NO: 7660968 - DNA, 22 bp, Homo sapiens
gtcaggacattttaccatcctg

SEQ ID NO: 7660969 - DNA, 22 bp, Homo sapiens
gtcaggacaggctctggactga

SEQ ID NO: 7660970 - DNA, 22 bp, Homo sapiens
gtcaggacaggctctggactga

SEQ ID NO: 7660971 - DNA, 22 bp, Homo sapiens
gtcaggacaaggtggtctccag

SEQ ID NO: 7660972 - DNA, 22 bp, Homo sapiens
gtcaggactctgacccgtcccg

SEQ ID NO: 7660973 - DNA, 22 bp, Homo sapiens
gtcaggactctgacccgtcccg

SEQ ID NO: 7660974 - DNA, 22 bp, Homo sapiens
gtcaggactctgacccgtcccg

SEQ ID NO: 7660975 - DNA, 22 bp, Homo sapiens
gtcaggactctgacccgtcccg

SEQ ID NO: 7660976 - DNA, 19 bp, Homo sapiens
gtcaggaagtactttccgg

SEQ ID NO: 7660977 - DNA, 19 bp, Homo sapiens
gtcaggaagtactttccgg

SEQ ID NO: 7660978 - DNA, 22 bp, Homo sapiens
gtcaggaagcaaggttgggcat

SEQ ID NO: 7660979 - DNA, 22 bp, Homo sapiens
gtcaggaaaacccgggttgact

SEQ ID NO: 7660980 - DNA, 22 bp, Homo sapiens
gtcaggacaaggtggtctccag

SEQ ID NO: 7660981 - DNA, 22 bp, Homo sapiens
gtcaggaagtggcattggagaa

SEQ ID NO: 7660982 - DNA, 22 bp, Homo sapiens
gtcaggacaaggtggtctccag

SEQ ID NO: 7660983 - DNA, 22 bp, Homo sapiens
gtcaggacaaggtggtctccag

SEQ ID NO: 7660984 - DNA, 22 bp, Homo sapiens
gtcaggaagtggcattggagaa

SEQ ID NO: 7660985 - DNA, 21 bp, Homo sapiens
gtcaggcccatagcagtgcct

SEQ ID NO: 7660986 - DNA, 21 bp, Homo sapiens
gtcaggcccatagcagtgcct

SEQ ID NO: 7660987 - DNA, 22 bp, Homo sapiens
gtcaggccctggcagccgtgac

SEQ ID NO: 7660988 - DNA, 22 bp, Homo sapiens
gtcaggccctggcagccgtgac

SEQ ID NO: 7660989 - DNA, 22 bp, Homo sapiens
gtcaggccctggcagccgtgac

SEQ ID NO: 7660990 - DNA, 22 bp, Homo sapiens
gtcaggccaatactctccagca

SEQ ID NO: 7660991 - DNA, 22 bp, Homo sapiens
gtcaggccaatactctccagca

SEQ ID NO: 7660992 - DNA, 22 bp, Homo sapiens
gtcaggccaatactctccagca

SEQ ID NO: 7660993 - DNA, 21 bp, Homo sapiens
gtcaggcccatagcagtgcct

SEQ ID NO: 7660994 - DNA, 21 bp, Homo sapiens
gtcaggcccatagcagtgcct

SEQ ID NO: 7660995 - DNA, 22 bp, Homo sapiens
gtcaggccaatactctccagca

SEQ ID NO: 7660996 - DNA, 22 bp, Homo sapiens
gtcaggccaatactctccagca

SEQ ID NO: 7660997 - DNA, 22 bp, Homo sapiens
gtcaggccctggcagccgtgac

SEQ ID NO: 7660998 - DNA, 22 bp, Homo sapiens
gtcaggctgctggagcttgggt

SEQ ID NO: 7660999 - DNA, 22 bp, Homo sapiens
gtcaggctgctggagcttgggt

SEQ ID NO: 7661000 - DNA, 22 bp, Homo sapiens
gtcaggctgccagtctttattg

SEQ ID NO: 7661001 - DNA, 22 bp, Homo sapiens
gtccagggaaatagcgacaggg

SEQ ID NO: 7661002 - DNA, 22 bp, Homo sapiens
gtccagggaaatagcgacaggg

SEQ ID NO: 7661003 - DNA, 22 bp, Homo sapiens
gtccagggaaatagcgacaggg

SEQ ID NO: 7661004 - DNA, 18 bp, Homo sapiens
gtcaggcatgaatctggg

SEQ ID NO: 7661005 - DNA, 22 bp, Homo sapiens
gtcaggcagcctggagattcag

SEQ ID NO: 7661006 - DNA, 22 bp, Homo sapiens
gtcaggcatttaggatgagttc

SEQ ID NO: 7661007 - DNA, 22 bp, Homo sapiens
gtcaggcatttaggatgagttc

SEQ ID NO: 7661008 - DNA, 22 bp, Homo sapiens
gtcaggcagtggaaattaaaaa

SEQ ID NO: 7661009 - DNA, 18 bp, Homo sapiens
gtcaggcatgaatctggg

SEQ ID NO: 7661010 - DNA, 22 bp, Homo sapiens
gtcaggcagcctggagattcag

SEQ ID NO: 7661011 - DNA, 22 bp, Homo sapiens
gtcaggcagcctggagattcag

SEQ ID NO: 7661012 - DNA, 22 bp, Homo sapiens
gtcaggcagcctggagattcag

SEQ ID NO: 7661013 - DNA, 19 bp, Homo sapiens
gtcaggcacgtgagagcat

SEQ ID NO: 7661014 - DNA, 19 bp, Homo sapiens
gtcaggcacgtgagagcat

SEQ ID NO: 7661015 - DNA, 22 bp, Homo sapiens
gtcaggattataatccccatgg

SEQ ID NO: 7661016 - DNA, 22 bp, Homo sapiens
gtcaggattggggtcatgagtc

SEQ ID NO: 7661017 - DNA, 19 bp, Homo sapiens
gtcaggcacgtgagagcat

SEQ ID NO: 7661018 - DNA, 19 bp, Homo sapiens
gtcaggcacgtgagagcat

SEQ ID NO: 7661019 - DNA, 19 bp, Homo sapiens
gtcaggcacgtgagagcat

SEQ ID NO: 7661020 - DNA, 19 bp, Homo sapiens
gtcaggcacgtgagagcat

SEQ ID NO: 7661021 - DNA, 19 bp, Homo sapiens
gtcaggcacgtgagagcat

SEQ ID NO: 7661022 - DNA, 19 bp, Homo sapiens
gtcaggcacgtgagagcat

SEQ ID NO: 7661023 - DNA, 22 bp, Homo sapiens
gtggcagctgtgttgcagtttt

SEQ ID NO: 7661024 - DNA, 22 bp, Homo sapiens
gtggcagctgtgttgcagtttt

SEQ ID NO: 7661025 - DNA, 22 bp, Homo sapiens
gtggcagctgtgggacactggt

SEQ ID NO: 7661026 - DNA, 22 bp, Homo sapiens
gtggcagctgtgttgcagtttt

SEQ ID NO: 7661027 - DNA, 22 bp, Homo sapiens
gtggcagctgtgttgcagtttt

SEQ ID NO: 7661028 - DNA, 22 bp, Homo sapiens
gtggcaggagactggaagatgg

SEQ ID NO: 7661029 - DNA, 22 bp, Homo sapiens
gtggcaggagactggaagatgg

SEQ ID NO: 7661030 - DNA, 22 bp, Homo sapiens
gtggcaggagactggaagatgg

SEQ ID NO: 7661031 - DNA, 22 bp, Homo sapiens
gtggcaggagagacacagccat

SEQ ID NO: 7661032 - DNA, 22 bp, Homo sapiens
gtggcaggagactggaagatgg

SEQ ID NO: 7661033 - DNA, 22 bp, Homo sapiens
gtggcagctgtgggacactggt

SEQ ID NO: 7661034 - DNA, 22 bp, Homo sapiens
gtggcagctggtatgcagacag

SEQ ID NO: 7661035 - DNA, 22 bp, Homo sapiens
gtggcagctgtgggacactggt

SEQ ID NO: 7661036 - DNA, 22 bp, Homo sapiens
gtggcagctgtgggacactggt

SEQ ID NO: 7661037 - DNA, 22 bp, Homo sapiens
gtggcagctggtatgcagacag

SEQ ID NO: 7661038 - DNA, 22 bp, Homo sapiens
gtggcagctggtatgcagacag

SEQ ID NO: 7661039 - DNA, 22 bp, Homo sapiens
gtggcagctctcttgatttccc

SEQ ID NO: 7661040 - DNA, 22 bp, Homo sapiens
gtggcagctggtatgcagacag

SEQ ID NO: 7661041 - DNA, 22 bp, Homo sapiens
gtggcaggagagacacagccat

SEQ ID NO: 7661042 - DNA, 22 bp, Homo sapiens
gtggcaggagagacacagccat

SEQ ID NO: 7661043 - DNA, 22 bp, Homo sapiens
gtggcaggagagacacagccat

SEQ ID NO: 7661044 - DNA, 22 bp, Homo sapiens
gtggcaggagagacacagccat

SEQ ID NO: 7661045 - DNA, 22 bp, Homo sapiens
gtggcaggagagacacagccat

SEQ ID NO: 7661046 - DNA, 22 bp, Homo sapiens
gtggcaggagagacacagccat

SEQ ID NO: 7661047 - DNA, 22 bp, Homo sapiens
gtggcaggatcacggctcactg

SEQ ID NO: 7661048 - DNA, 22 bp, Homo sapiens
gtggcaggatcacggctcactg

SEQ ID NO: 7661049 - DNA, 22 bp, Homo sapiens
gtggcaggatcacggctcactg

SEQ ID NO: 7661050 - DNA, 22 bp, Homo sapiens
gtggcaggagtgggccttgaag

SEQ ID NO: 7661051 - DNA, 22 bp, Homo sapiens
gtggcaggatcacggctcactg

SEQ ID NO: 7661052 - DNA, 22 bp, Homo sapiens
gtggcaggagtgggccttgaag

SEQ ID NO: 7661053 - DNA, 22 bp, Homo sapiens
gtggcaggagtgggccttgaag

SEQ ID NO: 7661054 - DNA, 22 bp, Homo sapiens
gtggcaggagtgggccttgaag

SEQ ID NO: 7661055 - DNA, 22 bp, Homo sapiens
gtggcaggagtgggccttgaag

SEQ ID NO: 7661056 - DNA, 22 bp, Homo sapiens
gtggcaggagtgggccttgaag

SEQ ID NO: 7661057 - DNA, 22 bp, Homo sapiens
gtggcaggatcacggctcactg

SEQ ID NO: 7661058 - DNA, 22 bp, Homo sapiens
gtggcaggatcacggctcactg

SEQ ID NO: 7661059 - DNA, 22 bp, Homo sapiens
gtggcaggatcacggctcactg

SEQ ID NO: 7661060 - DNA, 22 bp, Homo sapiens
gtggcaggatcacggctcactg

SEQ ID NO: 7661061 - DNA, 22 bp, Homo sapiens
gtggcaggatcacggctcactg

SEQ ID NO: 7661062 - DNA, 20 bp, Homo sapiens
gtggcaggcagtgaaggagc

SEQ ID NO: 7661063 - DNA, 20 bp, Homo sapiens
gtggcaggcagtgaaggagc

SEQ ID NO: 7661064 - DNA, 20 bp, Homo sapiens
gtggcaggcagtgaaggagc

SEQ ID NO: 7661065 - DNA, 20 bp, Homo sapiens
gtggcaggcagtgaaggagc

SEQ ID NO: 7661066 - DNA, 20 bp, Homo sapiens
gtggcaggcagtgaaggagc

SEQ ID NO: 7661067 - DNA, 20 bp, Homo sapiens
gtggcaggcagtgaaggagc

SEQ ID NO: 7661068 - DNA, 20 bp, Homo sapiens
gtggcaggcagtgaaggagc

SEQ ID NO: 7661069 - DNA, 20 bp, Homo sapiens
gtggcaggcagtgaaggagc

SEQ ID NO: 7661070 - DNA, 20 bp, Homo sapiens
gtggcaggcagtgaaggagc

SEQ ID NO: 7661071 - DNA, 20 bp, Homo sapiens
gtggcaggcagtgaaggagc

SEQ ID NO: 7661072 - DNA, 20 bp, Homo sapiens
gtggcaggcagtgaaggagc

SEQ ID NO: 7661073 - DNA, 22 bp, Homo sapiens
gtggcagggctttgctgttctt

SEQ ID NO: 7661074 - DNA, 22 bp, Homo sapiens
gtggcagggctttgctgttctt

SEQ ID NO: 7661075 - DNA, 22 bp, Homo sapiens
gtggcaggggcgggctgttccg

SEQ ID NO: 7661076 - DNA, 22 bp, Homo sapiens
gtggcagggctttgctgttctt

SEQ ID NO: 7661077 - DNA, 22 bp, Homo sapiens
gtggcagggcaatgctccctct

SEQ ID NO: 7661078 - DNA, 22 bp, Homo sapiens
gtggcagggctttgctgttctt

SEQ ID NO: 7661079 - DNA, 22 bp, Homo sapiens
gtggcagggagaagccattggg

SEQ ID NO: 7661080 - DNA, 22 bp, Homo sapiens
gtggcagggagaagccattggg

SEQ ID NO: 7661081 - DNA, 20 bp, Homo sapiens
gtggcaggcagtgaaggagc

SEQ ID NO: 7661082 - DNA, 22 bp, Homo sapiens
gtggcagggagaagccattggg

SEQ ID NO: 7661083 - DNA, 22 bp, Homo sapiens
gtggcagggcaatgctccctct

SEQ ID NO: 7661084 - DNA, 22 bp, Homo sapiens
gtggcagggcaatgctccctct

SEQ ID NO: 7661085 - DNA, 22 bp, Homo sapiens
gtggcagggcaatgctccctct

SEQ ID NO: 7661086 - DNA, 22 bp, Homo sapiens
gtggcagggcaatgctccctct

SEQ ID NO: 7661087 - DNA, 22 bp, Homo sapiens
gtggcagggagaagccattggg

SEQ ID NO: 7661088 - DNA, 22 bp, Homo sapiens
gtggcagggagaagccattggg

SEQ ID NO: 7661089 - DNA, 22 bp, Homo sapiens
gtggcagggcaatgctccctct

SEQ ID NO: 7661090 - DNA, 22 bp, Homo sapiens
gtggcattctcggcaccatctg

SEQ ID NO: 7661091 - DNA, 22 bp, Homo sapiens
gtggcattctcggcaccatctg

SEQ ID NO: 7661092 - DNA, 22 bp, Homo sapiens
gtggcattgacatgtaaacagt

SEQ ID NO: 7661093 - DNA, 22 bp, Homo sapiens
gtggcattaggccaggtgcata

SEQ ID NO: 7661094 - DNA, 22 bp, Homo sapiens
gtggcatggccctcattccagt

SEQ ID NO: 7661095 - DNA, 22 bp, Homo sapiens
gtggcatggccctcattccagt

SEQ ID NO: 7661096 - DNA, 22 bp, Homo sapiens
gtggcatgtgcctgtaatctca

SEQ ID NO: 7661097 - DNA, 22 bp, Homo sapiens
gtggcatggagaaggaggcagt

SEQ ID NO: 7661098 - DNA, 22 bp, Homo sapiens
gtggcatgaaagcatctgtgat

SEQ ID NO: 7661099 - DNA, 22 bp, Homo sapiens
gtggcatctcagaggccaagaa

SEQ ID NO: 7661100 - DNA, 22 bp, Homo sapiens
gtggcatctcagaggccaagaa

SEQ ID NO: 7661101 - DNA, 22 bp, Homo sapiens
gtggcatgatgtcggcttagtg

SEQ ID NO: 7661102 - DNA, 22 bp, Homo sapiens
gtggcatgacagtgaatgggca

SEQ ID NO: 7661103 - DNA, 22 bp, Homo sapiens
gtggccaatttccatctgtaag

SEQ ID NO: 7661104 - DNA, 22 bp, Homo sapiens
gtggccaataggagcagctatc

SEQ ID NO: 7661105 - DNA, 22 bp, Homo sapiens
gtggccaaggtgcagagcagct

SEQ ID NO: 7661106 - DNA, 22 bp, Homo sapiens
gtggccaaggtgcagagcagct

SEQ ID NO: 7661107 - DNA, 22 bp, Homo sapiens
gtggccaaggcagagaaagagc

SEQ ID NO: 7661108 - DNA, 22 bp, Homo sapiens
gtggccaagaggggactggata

SEQ ID NO: 7661109 - DNA, 22 bp, Homo sapiens
gtggccaagagataaaattgtg

SEQ ID NO: 7661110 - DNA, 22 bp, Homo sapiens
gtggccaaaaggaagaaggtta

SEQ ID NO: 7661111 - DNA, 22 bp, Homo sapiens
gtggcagttgctgtggcaataa

SEQ ID NO: 7661112 - DNA, 22 bp, Homo sapiens
gtggcagtgtggagggaggagt

SEQ ID NO: 7661113 - DNA, 22 bp, Homo sapiens
gtggcatcaagatttagattca

SEQ ID NO: 7661114 - DNA, 22 bp, Homo sapiens
gtggcatcagagctccctccag

SEQ ID NO: 7661115 - DNA, 22 bp, Homo sapiens
gtggcatcgtctgaggtggggt

SEQ ID NO: 7661116 - DNA, 22 bp, Homo sapiens
gtggcatcgtctgaggtggggt

SEQ ID NO: 7661117 - DNA, 22 bp, Homo sapiens
gtggcagtgtggagggaggagt

SEQ ID NO: 7661118 - DNA, 20 bp, Homo sapiens
gtggcagtggtggcagcagt

SEQ ID NO: 7661119 - DNA, 22 bp, Homo sapiens
gtggcagtgtgaggatcctgct

SEQ ID NO: 7661120 - DNA, 20 bp, Homo sapiens
gtggcagtggtggcagcagt

SEQ ID NO: 7661121 - DNA, 20 bp, Homo sapiens
gtggcagtggtggcagcagt

SEQ ID NO: 7661122 - DNA, 22 bp, Homo sapiens
gtggcagtggagacccgagcct

SEQ ID NO: 7661123 - DNA, 22 bp, Homo sapiens
gtggcagtgccgtttggttcag

SEQ ID NO: 7661124 - DNA, 22 bp, Homo sapiens
gtggcagtggagacccgagcct

SEQ ID NO: 7661125 - DNA, 22 bp, Homo sapiens
gtggcagggtgctcatcatgca

SEQ ID NO: 7661126 - DNA, 22 bp, Homo sapiens
gtggcagtgccagctccgacaa

SEQ ID NO: 7661127 - DNA, 22 bp, Homo sapiens
gtggcagggtgctcatcatgca

SEQ ID NO: 7661128 - DNA, 22 bp, Homo sapiens
gtggcagggtgctcatcatgca

SEQ ID NO: 7661129 - DNA, 22 bp, Homo sapiens
gtggcagggtgctcatcatgca

SEQ ID NO: 7661130 - DNA, 22 bp, Homo sapiens
gtggcagggtgctcatcatgca

SEQ ID NO: 7661131 - DNA, 22 bp, Homo sapiens
gtggcaggggtattccagctga

SEQ ID NO: 7661132 - DNA, 22 bp, Homo sapiens
gtggcagggtgctcatcatgca

SEQ ID NO: 7661133 - DNA, 22 bp, Homo sapiens
gtggcagggtgctcatcatgca

SEQ ID NO: 7661134 - DNA, 22 bp, Homo sapiens
gtggcaggggtattccagctga

SEQ ID NO: 7661135 - DNA, 22 bp, Homo sapiens
gtggcaggggtattccagctga

SEQ ID NO: 7661136 - DNA, 22 bp, Homo sapiens
gtggcaggggtattccagctga

SEQ ID NO: 7661137 - DNA, 22 bp, Homo sapiens
gtggcaggggcgggctgttccg

SEQ ID NO: 7661138 - DNA, 22 bp, Homo sapiens
gtggcaggggcgggctgttccg

SEQ ID NO: 7661139 - DNA, 22 bp, Homo sapiens
gtggcaggggtattccagctga

SEQ ID NO: 7661140 - DNA, 22 bp, Homo sapiens
gtggcaggggcgggctgttccg

SEQ ID NO: 7661141 - DNA, 22 bp, Homo sapiens
gtggcccagccctacagaggac

SEQ ID NO: 7661142 - DNA, 22 bp, Homo sapiens
gtggcccacacagacagcatct

SEQ ID NO: 7661143 - DNA, 22 bp, Homo sapiens
gtggcccacttacgtcatgtgt

SEQ ID NO: 7661144 - DNA, 22 bp, Homo sapiens
gtggcccagccctacagaggac

SEQ ID NO: 7661145 - DNA, 22 bp, Homo sapiens
gtggcccagccctacagaggac

SEQ ID NO: 7661146 - DNA, 22 bp, Homo sapiens
gtggcccacttacgtcatgtgt

SEQ ID NO: 7661147 - DNA, 22 bp, Homo sapiens
gtggcccacttacgtcatgtgt

SEQ ID NO: 7661148 - DNA, 22 bp, Homo sapiens
gtggcccacttacgtcatgtgt

SEQ ID NO: 7661149 - DNA, 22 bp, Homo sapiens
gtggcccacacagacagcatct

SEQ ID NO: 7661150 - DNA, 22 bp, Homo sapiens
gtggccaggccgactgccaggc

SEQ ID NO: 7661151 - DNA, 22 bp, Homo sapiens
gtggccaggccgactgccaggc

SEQ ID NO: 7661152 - DNA, 22 bp, Homo sapiens
gtggccaggccgactgccaggc

SEQ ID NO: 7661153 - DNA, 22 bp, Homo sapiens
gtggccaggccgactgccaggc

SEQ ID NO: 7661154 - DNA, 22 bp, Homo sapiens
gtggccaggccgactgccaggc

SEQ ID NO: 7661155 - DNA, 22 bp, Homo sapiens
gtggccaggccgactgccaggc

SEQ ID NO: 7661156 - DNA, 22 bp, Homo sapiens
gtggccaggagaccttgggcat

SEQ ID NO: 7661157 - DNA, 22 bp, Homo sapiens
gtggccaggagaccttgggcat

SEQ ID NO: 7661158 - DNA, 22 bp, Homo sapiens
gtggccaggagagggtgggaca

SEQ ID NO: 7661159 - DNA, 22 bp, Homo sapiens
gtggccaggagagggtgggaca

SEQ ID NO: 7661160 - DNA, 22 bp, Homo sapiens
gtggccaggagagggtgggaca

SEQ ID NO: 7661161 - DNA, 22 bp, Homo sapiens
gtggccaggagagggtgggaca

SEQ ID NO: 7661162 - DNA, 22 bp, Homo sapiens
gtggccaggagagggtgggaca

SEQ ID NO: 7661163 - DNA, 22 bp, Homo sapiens
gtggccaggagagggtgggaca

SEQ ID NO: 7661164 - DNA, 22 bp, Homo sapiens
gtggccaggccgactgccaggc

SEQ ID NO: 7661165 - DNA, 22 bp, Homo sapiens
gtggccaggagagggtgggaca

SEQ ID NO: 7661166 - DNA, 22 bp, Homo sapiens
gtggccagctgtcagcaccctt

SEQ ID NO: 7661167 - DNA, 22 bp, Homo sapiens
gtggccagctgtcagcaccctt

SEQ ID NO: 7661168 - DNA, 18 bp, Homo sapiens
gtggccagcctggtcttg

SEQ ID NO: 7661169 - DNA, 22 bp, Homo sapiens
gtggccaggacattgccaggca

SEQ ID NO: 7661170 - DNA, 22 bp, Homo sapiens
gtggccaggacattgccaggca

SEQ ID NO: 7661171 - DNA, 22 bp, Homo sapiens
gtggccaggacattgccaggca

SEQ ID NO: 7661172 - DNA, 22 bp, Homo sapiens
gtggccaggacattgccaggca

SEQ ID NO: 7661173 - DNA, 22 bp, Homo sapiens
gtggccaggacattgccaggca

SEQ ID NO: 7661174 - DNA, 22 bp, Homo sapiens
gtggccagctgtcagcaccctt

SEQ ID NO: 7661175 - DNA, 22 bp, Homo sapiens
gtggccaggacattgccaggca

SEQ ID NO: 7661176 - DNA, 22 bp, Homo sapiens
gtggccaggacattgccaggca

SEQ ID NO: 7661177 - DNA, 22 bp, Homo sapiens
gtggccaggacattgccaggca

SEQ ID NO: 7661178 - DNA, 22 bp, Homo sapiens
gtggccaggagaccttgggcat

SEQ ID NO: 7661179 - DNA, 22 bp, Homo sapiens
gtggccaggacattgccaggca

SEQ ID NO: 7661180 - DNA, 22 bp, Homo sapiens
gtggccaggagaccttgggcat

SEQ ID NO: 7661181 - DNA, 22 bp, Homo sapiens
gtggccaggagaccttgggcat

SEQ ID NO: 7661182 - DNA, 22 bp, Homo sapiens
gtggcccaggcaccctgatgac

SEQ ID NO: 7661183 - DNA, 22 bp, Homo sapiens
gtggcccaggcaccctgatgac

SEQ ID NO: 7661184 - DNA, 22 bp, Homo sapiens
gtggcccaggcaccctgatgac

SEQ ID NO: 7661185 - DNA, 22 bp, Homo sapiens
gtggcccaggcttggcgctggc

SEQ ID NO: 7661186 - DNA, 22 bp, Homo sapiens
gtggcccaggcttggcgctggc

SEQ ID NO: 7661187 - DNA, 22 bp, Homo sapiens
gtggcccaggctggagtgcagt

SEQ ID NO: 7661188 - DNA, 22 bp, Homo sapiens
gtggcccaggctggagtgcagt

SEQ ID NO: 7661189 - DNA, 22 bp, Homo sapiens
gtggcccatcacgtttcgcctt

SEQ ID NO: 7661190 - DNA, 22 bp, Homo sapiens
gtggcccaggttggagtgcagt

SEQ ID NO: 7661191 - DNA, 22 bp, Homo sapiens
gtggcccaggcttggcgctggc

SEQ ID NO: 7661192 - DNA, 22 bp, Homo sapiens
gtggccccagggccctgtctgg

SEQ ID NO: 7661193 - DNA, 22 bp, Homo sapiens
gtggccccagggccctgtctgg

SEQ ID NO: 7661194 - DNA, 22 bp, Homo sapiens
gtggcccacttacgtcatgtgt

SEQ ID NO: 7661195 - DNA, 22 bp, Homo sapiens
gtggccccagggccctgtctgg

SEQ ID NO: 7661196 - DNA, 22 bp, Homo sapiens
gtggcccaggttggagtgcagt

SEQ ID NO: 7661197 - DNA, 22 bp, Homo sapiens
gtggcccaggcttggcgctggc

SEQ ID NO: 7661198 - DNA, 22 bp, Homo sapiens
gtggcccaggcttggcgctggc

SEQ ID NO: 7661199 - DNA, 22 bp, Homo sapiens
gtggcccaggcttggcgctggc

SEQ ID NO: 7661200 - DNA, 22 bp, Homo sapiens
gtggcccaggcttggcgctggc

SEQ ID NO: 7661201 - DNA, 22 bp, Homo sapiens
gtggccctaacaccgtttctca

SEQ ID NO: 7661202 - DNA, 22 bp, Homo sapiens
gtggccctatttgaggacccca

SEQ ID NO: 7661203 - DNA, 22 bp, Homo sapiens
gtggccctaacaccgtttctca

SEQ ID NO: 7661204 - DNA, 22 bp, Homo sapiens
gtggccctcagcagttgccaag

SEQ ID NO: 7661205 - DNA, 22 bp, Homo sapiens
gtggccctatttgaggacccca

SEQ ID NO: 7661206 - DNA, 22 bp, Homo sapiens
gtggccctcagcagttgccaag

SEQ ID NO: 7661207 - DNA, 22 bp, Homo sapiens
gtggccctctgatagggtcagg

SEQ ID NO: 7661208 - DNA, 22 bp, Homo sapiens
gtggccctcagcagttgccaag

SEQ ID NO: 7661209 - DNA, 22 bp, Homo sapiens
gtggccctcagcagttgccaag

SEQ ID NO: 7661210 - DNA, 22 bp, Homo sapiens
gtggccctctgatagggtcagg

SEQ ID NO: 7661211 - DNA, 22 bp, Homo sapiens
gtggccctgagccctttgacag

SEQ ID NO: 7661212 - DNA, 22 bp, Homo sapiens
gtggccctggagttgtgacact

SEQ ID NO: 7661213 - DNA, 21 bp, Homo sapiens
gtggccctgccgcagtgtcca

SEQ ID NO: 7661214 - DNA, 21 bp, Homo sapiens
gtggccctgccgcagtgtcca

SEQ ID NO: 7661215 - DNA, 21 bp, Homo sapiens
gtggccctgccgcagtgtcca

SEQ ID NO: 7661216 - DNA, 21 bp, Homo sapiens
gtggccctgccgcagtgtcca

SEQ ID NO: 7661217 - DNA, 22 bp, Homo sapiens
gtggccctctgatagggtcagg

SEQ ID NO: 7661218 - DNA, 22 bp, Homo sapiens
gtggccctgagccctttgacag

SEQ ID NO: 7661219 - DNA, 22 bp, Homo sapiens
gtggccctctgatagggtcagg

SEQ ID NO: 7661220 - DNA, 22 bp, Homo sapiens
gtggccagcaagtgctgcctct

SEQ ID NO: 7661221 - DNA, 22 bp, Homo sapiens
gtggccagcaagtgctgcctct

SEQ ID NO: 7661222 - DNA, 22 bp, Homo sapiens
gtggccagcaagtgctgcctct

SEQ ID NO: 7661223 - DNA, 22 bp, Homo sapiens
gtggccagccagggtgctgatg

SEQ ID NO: 7661224 - DNA, 22 bp, Homo sapiens
gtggccagccagggtgctgatg

SEQ ID NO: 7661225 - DNA, 22 bp, Homo sapiens
gtggccagccagggtgctgatg

SEQ ID NO: 7661226 - DNA, 22 bp, Homo sapiens
gtggccagccagggtgctgatg

SEQ ID NO: 7661227 - DNA, 22 bp, Homo sapiens
gtggccagccagggtgctgatg

SEQ ID NO: 7661228 - DNA, 22 bp, Homo sapiens
gtggccagccagggtgctgatg

SEQ ID NO: 7661229 - DNA, 22 bp, Homo sapiens
gtggccagaggtcccatgtgtc

SEQ ID NO: 7661230 - DNA, 22 bp, Homo sapiens
gtggccagaggtcccatgtgtc

SEQ ID NO: 7661231 - DNA, 22 bp, Homo sapiens
gtggccagaggtcccatgtgtc

SEQ ID NO: 7661232 - DNA, 22 bp, Homo sapiens
gtggccagaggtcccatgtgtc

SEQ ID NO: 7661233 - DNA, 22 bp, Homo sapiens
gtggccagagtgtcattttatt

SEQ ID NO: 7661234 - DNA, 22 bp, Homo sapiens
gtggccagcaagtgctgcctct

SEQ ID NO: 7661235 - DNA, 22 bp, Homo sapiens
gtggccagcaagtgctgcctct

SEQ ID NO: 7661236 - DNA, 22 bp, Homo sapiens
gtggccagcaagtgctgcctct

SEQ ID NO: 7661237 - DNA, 22 bp, Homo sapiens
gtggccagcaagtgctgcctct

SEQ ID NO: 7661238 - DNA, 22 bp, Homo sapiens
gtggccagccccatggacagtt

SEQ ID NO: 7661239 - DNA, 22 bp, Homo sapiens
gtggccagccagggtgctgatg

SEQ ID NO: 7661240 - DNA, 22 bp, Homo sapiens
gtggccagccccatggacagtt

SEQ ID NO: 7661241 - DNA, 22 bp, Homo sapiens
gtggccagccccatggacagtt

SEQ ID NO: 7661242 - DNA, 22 bp, Homo sapiens
gtggccagccccatggacagtt

SEQ ID NO: 7661243 - DNA, 22 bp, Homo sapiens
gtggccagccagggtgctgatg

SEQ ID NO: 7661244 - DNA, 22 bp, Homo sapiens
gtggccagccagggtgctgatg

SEQ ID NO: 7661245 - DNA, 22 bp, Homo sapiens
gtggccagccccatggacagtt

SEQ ID NO: 7661246 - DNA, 22 bp, Homo sapiens
gtggccagccagggtgctgatg

SEQ ID NO: 7661247 - DNA, 18 bp, Homo sapiens
gtggccagcctggtcttg

SEQ ID NO: 7661248 - DNA, 18 bp, Homo sapiens
gtggccagcctggtcttg

SEQ ID NO: 7661249 - DNA, 18 bp, Homo sapiens
gtggccagcctggtcttg

SEQ ID NO: 7661250 - DNA, 18 bp, Homo sapiens
gtggccagcctggtcttg

SEQ ID NO: 7661251 - DNA, 18 bp, Homo sapiens
gtggccagcctggtcttg

SEQ ID NO: 7661252 - DNA, 22 bp, Homo sapiens
gtggccagccccatggacagtt

SEQ ID NO: 7661253 - DNA, 18 bp, Homo sapiens
gtggccagcctggtcttg

SEQ ID NO: 7661254 - DNA, 18 bp, Homo sapiens
gtggccagcctggtcttg

SEQ ID NO: 7661255 - DNA, 22 bp, Homo sapiens
gtggccagccccatggacagtt

SEQ ID NO: 7661256 - DNA, 22 bp, Homo sapiens
gtggccagccccatggacagtt

SEQ ID NO: 7661257 - DNA, 22 bp, Homo sapiens
gtggccagaaccaggagaatga

SEQ ID NO: 7661258 - DNA, 22 bp, Homo sapiens
gtggccagaaccaggagaatga

SEQ ID NO: 7661259 - DNA, 22 bp, Homo sapiens
gtggccaccctcggcacacaca

SEQ ID NO: 7661260 - DNA, 22 bp, Homo sapiens
gtggccaccctcggcacacaca

SEQ ID NO: 7661261 - DNA, 22 bp, Homo sapiens
gtggccaccctcggcacacaca

SEQ ID NO: 7661262 - DNA, 22 bp, Homo sapiens
gtggccaccctcggcacacaca

SEQ ID NO: 7661263 - DNA, 22 bp, Homo sapiens
gtggccagaaccaggagaatga

SEQ ID NO: 7661264 - DNA, 22 bp, Homo sapiens
gtggccagaaccaggagaatga

SEQ ID NO: 7661265 - DNA, 22 bp, Homo sapiens
gtggccagaaccaggagaatga

SEQ ID NO: 7661266 - DNA, 22 bp, Homo sapiens
gtggccagaagactgcaatgct

SEQ ID NO: 7661267 - DNA, 22 bp, Homo sapiens
gtggccagaagactgcaatgct

SEQ ID NO: 7661268 - DNA, 22 bp, Homo sapiens
gtggccagaaccaggagaatga

SEQ ID NO: 7661269 - DNA, 22 bp, Homo sapiens
gtggccagaagttaagtggtta

SEQ ID NO: 7661270 - DNA, 22 bp, Homo sapiens
gtggccagaagttaagtggtta

SEQ ID NO: 7661271 - DNA, 22 bp, Homo sapiens
gtggccagaagttaagtggtta

SEQ ID NO: 7661272 - DNA, 22 bp, Homo sapiens
gtggccagaagttaagtggtta

SEQ ID NO: 7661273 - DNA, 22 bp, Homo sapiens
gtggccagaagttaagtggtta

SEQ ID NO: 7661274 - DNA, 22 bp, Homo sapiens
gtggccagaagttaagtggtta

SEQ ID NO: 7661275 - DNA, 22 bp, Homo sapiens
gtggccagaagactgcaatgct

SEQ ID NO: 7661276 - DNA, 22 bp, Homo sapiens
gtggccagaagactgcaatgct

SEQ ID NO: 7661277 - DNA, 22 bp, Homo sapiens
gtggccagaagactgcaatgct

SEQ ID NO: 7661278 - DNA, 22 bp, Homo sapiens
gtggccagaagactgcaatgct

SEQ ID NO: 7661279 - DNA, 22 bp, Homo sapiens
gtggccagaggtcccatgtgtc

SEQ ID NO: 7661280 - DNA, 22 bp, Homo sapiens
gtggccagaggtcccatgtgtc

SEQ ID NO: 7661281 - DNA, 22 bp, Homo sapiens
gtggccagaggtcccatgtgtc

SEQ ID NO: 7661282 - DNA, 22 bp, Homo sapiens
gtggccagaggtcccatgtgtc

SEQ ID NO: 7661283 - DNA, 22 bp, Homo sapiens
gtggccagaggtcccatgtgtc

SEQ ID NO: 7661284 - DNA, 22 bp, Homo sapiens
gtggccagagattaaatagagt

SEQ ID NO: 7661285 - DNA, 22 bp, Homo sapiens
gtggccagaggatttgttcagt

SEQ ID NO: 7661286 - DNA, 22 bp, Homo sapiens
gtggccagaatcttgaggcctt

SEQ ID NO: 7661287 - DNA, 22 bp, Homo sapiens
gtggccagaatcttgaggcctt

SEQ ID NO: 7661288 - DNA, 22 bp, Homo sapiens
gtggccagaatcttgaggcctt

SEQ ID NO: 7661289 - DNA, 22 bp, Homo sapiens
gtggccagagattaaatagagt

SEQ ID NO: 7661290 - DNA, 22 bp, Homo sapiens
gtggccagagattaaatagagt

SEQ ID NO: 7661291 - DNA, 22 bp, Homo sapiens
gtggccagaatcttgaggcctt

SEQ ID NO: 7661292 - DNA, 22 bp, Homo sapiens
gtggccagaatcttgaggcctt

SEQ ID NO: 7661293 - DNA, 22 bp, Homo sapiens
gtggccagaatcttgaggcctt

SEQ ID NO: 7661294 - DNA, 22 bp, Homo sapiens
gtggccagaatcttgaggcctt

SEQ ID NO: 7661295 - DNA, 22 bp, Homo sapiens
gtggccagaatcttgaggcctt

SEQ ID NO: 7661296 - DNA, 22 bp, Homo sapiens
gtggccagaatcttgaggcctt

SEQ ID NO: 7661297 - DNA, 22 bp, Homo sapiens
gtgggagcatggtcccagtgcc

SEQ ID NO: 7661298 - DNA, 22 bp, Homo sapiens
gtgggagagaccccgcttaggg

SEQ ID NO: 7661299 - DNA, 22 bp, Homo sapiens
gtgggagcatggtcccagtgcc

SEQ ID NO: 7661300 - DNA, 22 bp, Homo sapiens
gtgggagagaccccgcttaggg

SEQ ID NO: 7661301 - DNA, 22 bp, Homo sapiens
gtgggagagaccccgcttaggg

SEQ ID NO: 7661302 - DNA, 22 bp, Homo sapiens
gtgggagaatggccttgcaaac

SEQ ID NO: 7661303 - DNA, 22 bp, Homo sapiens
gtgggagaagccctgttcgtag

SEQ ID NO: 7661304 - DNA, 22 bp, Homo sapiens
gtgggagaagatttggtcatct

SEQ ID NO: 7661305 - DNA, 22 bp, Homo sapiens
gtgggagaagatttggtcatct

SEQ ID NO: 7661306 - DNA, 22 bp, Homo sapiens
gtgggagccctcagggaggtgc

SEQ ID NO: 7661307 - DNA, 22 bp, Homo sapiens
gtgggagccctcagggaggtgc

SEQ ID NO: 7661308 - DNA, 22 bp, Homo sapiens
gtgggagccctcagggaggtgc

SEQ ID NO: 7661309 - DNA, 22 bp, Homo sapiens
gtgggagccctcagggaggtgc

SEQ ID NO: 7661310 - DNA, 22 bp, Homo sapiens
gtgggagccctcagggaggtgc

SEQ ID NO: 7661311 - DNA, 22 bp, Homo sapiens
gtgggagccctcagggaggtgc

SEQ ID NO: 7661312 - DNA, 22 bp, Homo sapiens
gtgggagaaattagctctagtt

SEQ ID NO: 7661313 - DNA, 22 bp, Homo sapiens
gtgggagaaattagctctagtt

SEQ ID NO: 7661314 - DNA, 22 bp, Homo sapiens
gtgggagaaattagctctagtt

SEQ ID NO: 7661315 - DNA, 22 bp, Homo sapiens
gtgggagaaattagctctagtt

SEQ ID NO: 7661316 - DNA, 22 bp, Homo sapiens
gtgggagaaattagctctagtt

SEQ ID NO: 7661317 - DNA, 22 bp, Homo sapiens
gtgggagaaattagctctagtt

SEQ ID NO: 7661318 - DNA, 22 bp, Homo sapiens
gtgggagaaattagctctagtt

SEQ ID NO: 7661319 - DNA, 22 bp, Homo sapiens
gtgggagaagatttggtcatct

SEQ ID NO: 7661320 - DNA, 22 bp, Homo sapiens
gtgggagaagatttggtcatct

SEQ ID NO: 7661321 - DNA, 22 bp, Homo sapiens
gtggcttcatcaactgtgctta

SEQ ID NO: 7661322 - DNA, 22 bp, Homo sapiens
gtggcttcatcaactgtgctta

SEQ ID NO: 7661323 - DNA, 22 bp, Homo sapiens
gtggcttcatgaacactgatga

SEQ ID NO: 7661324 - DNA, 22 bp, Homo sapiens
gtggcttccaagactaagtcac

SEQ ID NO: 7661325 - DNA, 22 bp, Homo sapiens
gtggcttccatgtgcatctgac

SEQ ID NO: 7661326 - DNA, 22 bp, Homo sapiens
gtgggagaaattagctctagtt

SEQ ID NO: 7661327 - DNA, 22 bp, Homo sapiens
gtgggagctgcggaggcctggg

SEQ ID NO: 7661328 - DNA, 22 bp, Homo sapiens
gtgggagctgcggaggcctggg

SEQ ID NO: 7661329 - DNA, 22 bp, Homo sapiens
gtgggagccctcagggaggtgc

SEQ ID NO: 7661330 - DNA, 22 bp, Homo sapiens
gtgggagccctcagggaggtgc

SEQ ID NO: 7661331 - DNA, 22 bp, Homo sapiens
gtgggagctgcggaggcctggg

SEQ ID NO: 7661332 - DNA, 22 bp, Homo sapiens
gtgggagctgcggaggcctggg

SEQ ID NO: 7661333 - DNA, 22 bp, Homo sapiens
gtgggagctgcggaggcctggg

SEQ ID NO: 7661334 - DNA, 22 bp, Homo sapiens
gtgggagctgcggaggcctggg

SEQ ID NO: 7661335 - DNA, 22 bp, Homo sapiens
gtgggagcttcatcaagcagtt

SEQ ID NO: 7661336 - DNA, 22 bp, Homo sapiens
gtgggagctttggcatcaggct

SEQ ID NO: 7661337 - DNA, 22 bp, Homo sapiens
gtgggagctttggcatcaggct

SEQ ID NO: 7661338 - DNA, 22 bp, Homo sapiens
gtgggagctgctacctccttcc

SEQ ID NO: 7661339 - DNA, 22 bp, Homo sapiens
gtgggagctgctacctccttcc

SEQ ID NO: 7661340 - DNA, 22 bp, Homo sapiens
gtgggagctgctacctccttcc

SEQ ID NO: 7661341 - DNA, 22 bp, Homo sapiens
gtgggagctgctacctccttcc

SEQ ID NO: 7661342 - DNA, 22 bp, Homo sapiens
gtgggagctgcggaggcctggg

SEQ ID NO: 7661343 - DNA, 22 bp, Homo sapiens
gtgggagctgcggaggcctggg

SEQ ID NO: 7661344 - DNA, 22 bp, Homo sapiens
gtgggagtttgaacttcatgtt

SEQ ID NO: 7661345 - DNA, 22 bp, Homo sapiens
gtgggatgcagtggtgagtggc

SEQ ID NO: 7661346 - DNA, 22 bp, Homo sapiens
gtgggatgcagtggtgagtggc

SEQ ID NO: 7661347 - DNA, 22 bp, Homo sapiens
gtgggatgcagtggtgagtggc

SEQ ID NO: 7661348 - DNA, 22 bp, Homo sapiens
gtgggatgcagtggtgagtggc

SEQ ID NO: 7661349 - DNA, 22 bp, Homo sapiens
gtgggatgcttaggatcttgcc

SEQ ID NO: 7661350 - DNA, 22 bp, Homo sapiens
gtgggcaaagggactagggcca

SEQ ID NO: 7661351 - DNA, 22 bp, Homo sapiens
gtgggcaaggtccctgccagct

SEQ ID NO: 7661352 - DNA, 22 bp, Homo sapiens
gtgggcaacgattaagaggcaa

SEQ ID NO: 7661353 - DNA, 22 bp, Homo sapiens
gtgggatggtaggtaggtaata

SEQ ID NO: 7661354 - DNA, 22 bp, Homo sapiens
gtgggatgcttaggatcttgcc

SEQ ID NO: 7661355 - DNA, 22 bp, Homo sapiens
gtgggagctttggcatcaggct

SEQ ID NO: 7661356 - DNA, 22 bp, Homo sapiens
gtgggagctttggcatcaggct

SEQ ID NO: 7661357 - DNA, 22 bp, Homo sapiens
gtgggagctttggcatcaggct

SEQ ID NO: 7661358 - DNA, 22 bp, Homo sapiens
gtgggagtggggaagcagagtg

SEQ ID NO: 7661359 - DNA, 22 bp, Homo sapiens
gtgggagtggggaagcagagtg

SEQ ID NO: 7661360 - DNA, 22 bp, Homo sapiens
gtgggagtggagctcagcatgt

SEQ ID NO: 7661361 - DNA, 22 bp, Homo sapiens
gtgggagtggagctcagcatgt

SEQ ID NO: 7661362 - DNA, 22 bp, Homo sapiens
gtgggagtggggaagcagagtg

SEQ ID NO: 7661363 - DNA, 22 bp, Homo sapiens
gtgggagtggggaagcagagtg

SEQ ID NO: 7661364 - DNA, 22 bp, Homo sapiens
gtggctgctacagagctggagg

SEQ ID NO: 7661365 - DNA, 22 bp, Homo sapiens
gtggctgctcgggctccggccc

SEQ ID NO: 7661366 - DNA, 22 bp, Homo sapiens
gtggctgctcgggctccggccc

SEQ ID NO: 7661367 - DNA, 22 bp, Homo sapiens
gtggctgctcgggctccggccc

SEQ ID NO: 7661368 - DNA, 22 bp, Homo sapiens
gtggctgctaagtctccttcct

SEQ ID NO: 7661369 - DNA, 22 bp, Homo sapiens
gtggctgctacagagctggagg

SEQ ID NO: 7661370 - DNA, 22 bp, Homo sapiens
gtggctgctacagagctggagg

SEQ ID NO: 7661371 - DNA, 22 bp, Homo sapiens
gtggctgctaagtctccttcct

SEQ ID NO: 7661372 - DNA, 19 bp, Homo sapiens
gtggctgccgatcgcggct

SEQ ID NO: 7661373 - DNA, 19 bp, Homo sapiens
gtggctgccgatcgcggct

SEQ ID NO: 7661374 - DNA, 19 bp, Homo sapiens
gtggctgccgatcgcggct

SEQ ID NO: 7661375 - DNA, 22 bp, Homo sapiens
gtggctgctaagtctccttcct

SEQ ID NO: 7661376 - DNA, 22 bp, Homo sapiens
gtggctgctaagtctccttcct

SEQ ID NO: 7661377 - DNA, 22 bp, Homo sapiens
gtggctgctcgggctccggccc

SEQ ID NO: 7661378 - DNA, 22 bp, Homo sapiens
gtggctgctggtactctgggaa

SEQ ID NO: 7661379 - DNA, 22 bp, Homo sapiens
gtggctgctggtactctgggaa

SEQ ID NO: 7661380 - DNA, 22 bp, Homo sapiens
gtggctgctggtactctgggaa

SEQ ID NO: 7661381 - DNA, 22 bp, Homo sapiens
gtggctgctgtcctctctggtt

SEQ ID NO: 7661382 - DNA, 22 bp, Homo sapiens
gtggctgctgtcctctctggtt

SEQ ID NO: 7661383 - DNA, 22 bp, Homo sapiens
gtggctgctgtcctctctggtt

SEQ ID NO: 7661384 - DNA, 22 bp, Homo sapiens
gtggctgcatcggggtgaccag

SEQ ID NO: 7661385 - DNA, 22 bp, Homo sapiens
gtggctgcatcggggtgaccag

SEQ ID NO: 7661386 - DNA, 22 bp, Homo sapiens
gtggctgcatcggggtgaccag

SEQ ID NO: 7661387 - DNA, 22 bp, Homo sapiens
gtggctgcagctctgaacggac

SEQ ID NO: 7661388 - DNA, 22 bp, Homo sapiens
gtggctgcagtagtgtagggtc

SEQ ID NO: 7661389 - DNA, 22 bp, Homo sapiens
gtggctgcagcccagcggcacg

SEQ ID NO: 7661390 - DNA, 22 bp, Homo sapiens
gtggctgcagcccagcggcacg

SEQ ID NO: 7661391 - DNA, 22 bp, Homo sapiens
gtggctgcagcggctgtggaga

SEQ ID NO: 7661392 - DNA, 22 bp, Homo sapiens
gtggctgcagcggctgtggaga

SEQ ID NO: 7661393 - DNA, 22 bp, Homo sapiens
gtggctgcagcggctgtggaga

SEQ ID NO: 7661394 - DNA, 22 bp, Homo sapiens
gtggctgcagcggctgtggaga

SEQ ID NO: 7661395 - DNA, 22 bp, Homo sapiens
gtggctgcagagggcacagcat

SEQ ID NO: 7661396 - DNA, 22 bp, Homo sapiens
gtggctgcagcccagcggcacg

SEQ ID NO: 7661397 - DNA, 22 bp, Homo sapiens
gtggctgcagcccagcggcacg

SEQ ID NO: 7661398 - DNA, 22 bp, Homo sapiens
gtggctgcagagggcacagcat

SEQ ID NO: 7661399 - DNA, 22 bp, Homo sapiens
gtggctgcagagggcacagcat

SEQ ID NO: 7661400 - DNA, 22 bp, Homo sapiens
gtggctgcagagggcacagcat

SEQ ID NO: 7661401 - DNA, 22 bp, Homo sapiens
gtggctgcagagggcacagcat

SEQ ID NO: 7661402 - DNA, 22 bp, Homo sapiens
gtggcttcaccccagttgtctc

SEQ ID NO: 7661403 - DNA, 22 bp, Homo sapiens
gtggcttcacatggcatttggc

SEQ ID NO: 7661404 - DNA, 22 bp, Homo sapiens
gtggcttcacatggcatttggc

SEQ ID NO: 7661405 - DNA, 22 bp, Homo sapiens
gtggcttcaccccagttgtctc

SEQ ID NO: 7661406 - DNA, 22 bp, Homo sapiens
gtggctggtttcctgcatgcaa

SEQ ID NO: 7661407 - DNA, 22 bp, Homo sapiens
gtggctggtttcctgcatgcaa

SEQ ID NO: 7661408 - DNA, 22 bp, Homo sapiens
gtggctgttcttgccccatgct

SEQ ID NO: 7661409 - DNA, 22 bp, Homo sapiens
gtggctgtatagccaagtcaga

SEQ ID NO: 7661410 - DNA, 22 bp, Homo sapiens
gtggctgtatagccaagtcaga

SEQ ID NO: 7661411 - DNA, 22 bp, Homo sapiens
gtggctggtttcctgcatgcaa

SEQ ID NO: 7661412 - DNA, 22 bp, Homo sapiens
gtggctggtttcctgcatgcaa

SEQ ID NO: 7661413 - DNA, 22 bp, Homo sapiens
gtggctgggctccgagcggctt

SEQ ID NO: 7661414 - DNA, 22 bp, Homo sapiens
gtggctggtttcctgcatgcaa

SEQ ID NO: 7661415 - DNA, 22 bp, Homo sapiens
gtggctggtttcctgcatgcaa

SEQ ID NO: 7661416 - DNA, 22 bp, Homo sapiens
gtggctggtttcctgcatgcaa

SEQ ID NO: 7661417 - DNA, 22 bp, Homo sapiens
gtggctggtttcctgcatgcaa

SEQ ID NO: 7661418 - DNA, 22 bp, Homo sapiens
gtggctggtttcctgcatgcaa

SEQ ID NO: 7661419 - DNA, 22 bp, Homo sapiens
gtggctggtttcctgcatgcaa

SEQ ID NO: 7661420 - DNA, 22 bp, Homo sapiens
gtggctggtttcctgcatgcaa

SEQ ID NO: 7661421 - DNA, 22 bp, Homo sapiens
gtggctgggctccgagcggctt

SEQ ID NO: 7661422 - DNA, 22 bp, Homo sapiens
gtggctgggctccgagcggctt

SEQ ID NO: 7661423 - DNA, 22 bp, Homo sapiens
gtggctgggctccgagcggctt

SEQ ID NO: 7661424 - DNA, 22 bp, Homo sapiens
gtggctggccctggaccctaag

SEQ ID NO: 7661425 - DNA, 22 bp, Homo sapiens
gtggctggccctggaccctaag

SEQ ID NO: 7661426 - DNA, 22 bp, Homo sapiens
gtggctgggctccgagcggctt

SEQ ID NO: 7661427 - DNA, 22 bp, Homo sapiens
gtggctgggctccgagcggctt

SEQ ID NO: 7661428 - DNA, 22 bp, Homo sapiens
gtggctgggctccgagcggctt

SEQ ID NO: 7661429 - DNA, 22 bp, Homo sapiens
gtggctgggctccgagcggctt

SEQ ID NO: 7661430 - DNA, 22 bp, Homo sapiens
gtggctggagtatgaggaaagg

SEQ ID NO: 7661431 - DNA, 22 bp, Homo sapiens
gtggctggagtatgaggaaagg

SEQ ID NO: 7661432 - DNA, 22 bp, Homo sapiens
gtggctggagtatgaggaaagg

SEQ ID NO: 7661433 - DNA, 22 bp, Homo sapiens
gtggctggccctggaccctaag

SEQ ID NO: 7661434 - DNA, 22 bp, Homo sapiens
gtggctggagtatgaggaaagg

SEQ ID NO: 7661435 - DNA, 22 bp, Homo sapiens
gtggctgctgtcctctctggtt

SEQ ID NO: 7661436 - DNA, 22 bp, Homo sapiens
gtggcctctgtgctcctgccta

SEQ ID NO: 7661437 - DNA, 20 bp, Homo sapiens
gtggcctctcacattctgag

SEQ ID NO: 7661438 - DNA, 19 bp, Homo sapiens
gtggcctcggagcgcgcgg

SEQ ID NO: 7661439 - DNA, 20 bp, Homo sapiens
gtggcctctcacattctgag

SEQ ID NO: 7661440 - DNA, 22 bp, Homo sapiens
gtggcctctgtgctcctgccta

SEQ ID NO: 7661441 - DNA, 22 bp, Homo sapiens
gtggcctctgttggctcctagg

SEQ ID NO: 7661442 - DNA, 22 bp, Homo sapiens
gtggcctctgttggctcctagg

SEQ ID NO: 7661443 - DNA, 22 bp, Homo sapiens
gtggcctctgttggctcctagg

SEQ ID NO: 7661444 - DNA, 22 bp, Homo sapiens
gtggcctagaggtgcaaggaac

SEQ ID NO: 7661445 - DNA, 22 bp, Homo sapiens
gtggccctttgttttgatacct

SEQ ID NO: 7661446 - DNA, 23 bp, Homo sapiens
gtggcctccccggaatgcctcgc

SEQ ID NO: 7661447 - DNA, 22 bp, Homo sapiens
gtggcctcctccgtccgcctct

SEQ ID NO: 7661448 - DNA, 22 bp, Homo sapiens
gtggcctcctccgtccgcctct

SEQ ID NO: 7661449 - DNA, 23 bp, Homo sapiens
gtggcctccccggaatgcctcgc

SEQ ID NO: 7661450 - DNA, 23 bp, Homo sapiens
gtggcctccccggaatgcctcgc

SEQ ID NO: 7661451 - DNA, 23 bp, Homo sapiens
gtggcctccccggaatgcctcgc

SEQ ID NO: 7661452 - DNA, 22 bp, Homo sapiens
gtggccctgtgaacagcgcagt

SEQ ID NO: 7661453 - DNA, 22 bp, Homo sapiens
gtggccctgtgaacagcgcagt

SEQ ID NO: 7661454 - DNA, 22 bp, Homo sapiens
gtggccctgtcccaggcctcct

SEQ ID NO: 7661455 - DNA, 21 bp, Homo sapiens
gtggccctggtgtggctgcac

SEQ ID NO: 7661456 - DNA, 22 bp, Homo sapiens
gtggccctgtcccaggcctcct

SEQ ID NO: 7661457 - DNA, 22 bp, Homo sapiens
gtggccctgtcccaggcctcct

SEQ ID NO: 7661458 - DNA, 21 bp, Homo sapiens
gtggccctggtgtggctgcac

SEQ ID NO: 7661459 - DNA, 22 bp, Homo sapiens
gtggccctggagttgtgacact

SEQ ID NO: 7661460 - DNA, 21 bp, Homo sapiens
gtggccctggtgtggctgcac

SEQ ID NO: 7661461 - DNA, 21 bp, Homo sapiens
gtggccctggtgtggctgcac

SEQ ID NO: 7661462 - DNA, 22 bp, Homo sapiens
gtggccctggagttgtgacact

SEQ ID NO: 7661463 - DNA, 21 bp, Homo sapiens
gtggccctggtgtggctgcac

SEQ ID NO: 7661464 - DNA, 21 bp, Homo sapiens
gtggccctggtgtggctgcac

SEQ ID NO: 7661465 - DNA, 22 bp, Homo sapiens
gtggcccttgaagcagcttcat

SEQ ID NO: 7661466 - DNA, 22 bp, Homo sapiens
gtggcccttgaagcagcttcat

SEQ ID NO: 7661467 - DNA, 22 bp, Homo sapiens
gtggcccttgaagcagcttcat

SEQ ID NO: 7661468 - DNA, 22 bp, Homo sapiens
gtggcccttggagttgtgacct

SEQ ID NO: 7661469 - DNA, 22 bp, Homo sapiens
gtggcccttggagttgtgacct

SEQ ID NO: 7661470 - DNA, 22 bp, Homo sapiens
gtggccctgtgaacagcgcagt

SEQ ID NO: 7661471 - DNA, 22 bp, Homo sapiens
gtggccctgtgaacagcgcagt

SEQ ID NO: 7661472 - DNA, 20 bp, Homo sapiens
gtggcccttaaagagggaag

SEQ ID NO: 7661473 - DNA, 22 bp, Homo sapiens
gtggcctggaaaggctggtctg

SEQ ID NO: 7661474 - DNA, 22 bp, Homo sapiens
gtggcctggaaaggctggtctg

SEQ ID NO: 7661475 - DNA, 22 bp, Homo sapiens
gtggcctggaaaggctggtctg

SEQ ID NO: 7661476 - DNA, 22 bp, Homo sapiens
gtggcctggaaaggctggtctg

SEQ ID NO: 7661477 - DNA, 22 bp, Homo sapiens
gtggcctggatagactccatct

SEQ ID NO: 7661478 - DNA, 22 bp, Homo sapiens
gtggcctggatagactccatct

SEQ ID NO: 7661479 - DNA, 22 bp, Homo sapiens
gtggcctggatagactccatct

SEQ ID NO: 7661480 - DNA, 22 bp, Homo sapiens
gtggcctggatagactccatct

SEQ ID NO: 7661481 - DNA, 22 bp, Homo sapiens
gtggcctggagtttgatgtagg

SEQ ID NO: 7661482 - DNA, 22 bp, Homo sapiens
gtggcctggaaaggctggtctg

SEQ ID NO: 7661483 - DNA, 22 bp, Homo sapiens
gtggcctgccgtgtggtatggg

SEQ ID NO: 7661484 - DNA, 19 bp, Homo sapiens
gtggcctgcgctgggtgcg

SEQ ID NO: 7661485 - DNA, 19 bp, Homo sapiens
gtggcctgcgctgggtgcg

SEQ ID NO: 7661486 - DNA, 19 bp, Homo sapiens
gtggcctgcgctgggtgcg

SEQ ID NO: 7661487 - DNA, 19 bp, Homo sapiens
gtggcctgcgctgggtgcg

SEQ ID NO: 7661488 - DNA, 22 bp, Homo sapiens
gtggcctgccagcagatggcgc

SEQ ID NO: 7661489 - DNA, 22 bp, Homo sapiens
gtggcctgccgtgtggtatggg

SEQ ID NO: 7661490 - DNA, 22 bp, Homo sapiens
gtggcctgccgtgtggtatggg

SEQ ID NO: 7661491 - DNA, 22 bp, Homo sapiens
gtggcctgccagcagatggcgc

SEQ ID NO: 7661492 - DNA, 22 bp, Homo sapiens
gtggcctgccgcaccccaatat

SEQ ID NO: 7661493 - DNA, 22 bp, Homo sapiens
gtggcctgccagcagatggcgc

SEQ ID NO: 7661494 - DNA, 22 bp, Homo sapiens
gtggcctgccagcagatggcgc

SEQ ID NO: 7661495 - DNA, 22 bp, Homo sapiens
gtggcctgcaggcaccttgggg

SEQ ID NO: 7661496 - DNA, 22 bp, Homo sapiens
gtggcctgcaggcaccttgggg

SEQ ID NO: 7661497 - DNA, 22 bp, Homo sapiens
gtggcctgatgccagccctgtg

SEQ ID NO: 7661498 - DNA, 22 bp, Homo sapiens
gtggcctgatgccagccctgtg

SEQ ID NO: 7661499 - DNA, 21 bp, Homo sapiens
gtggcctgattatgaatgggt

SEQ ID NO: 7661500 - DNA, 21 bp, Homo sapiens
gtggcctgattatgaatgggt

SEQ ID NO: 7661501 - DNA, 21 bp, Homo sapiens
gtggcctgattatgaatgggt

SEQ ID NO: 7661502 - DNA, 22 bp, Homo sapiens
gtggcctgagcttcagagttgg

SEQ ID NO: 7661503 - DNA, 22 bp, Homo sapiens
gtggcctctgttggctcctagg

SEQ ID NO: 7661504 - DNA, 22 bp, Homo sapiens
gtggcctgatgccagccctgtg

SEQ ID NO: 7661505 - DNA, 22 bp, Homo sapiens
gtggcctgatgccagccctgtg

SEQ ID NO: 7661506 - DNA, 22 bp, Homo sapiens
gtggctcagttaacttccatgt

SEQ ID NO: 7661507 - DNA, 22 bp, Homo sapiens
gtggctcagttaacttccatgt

SEQ ID NO: 7661508 - DNA, 22 bp, Homo sapiens
gtggctcagttaacttccatgt

SEQ ID NO: 7661509 - DNA, 22 bp, Homo sapiens
gtggctcagcggagctctgcac

SEQ ID NO: 7661510 - DNA, 22 bp, Homo sapiens
gtggctcagcggagctctgcac

SEQ ID NO: 7661511 - DNA, 22 bp, Homo sapiens
gtggctcagcggagctctgcac

SEQ ID NO: 7661512 - DNA, 22 bp, Homo sapiens
gtggctcatctttgggaagtaa

SEQ ID NO: 7661513 - DNA, 22 bp, Homo sapiens
gtggctcatctttgggaagtaa

SEQ ID NO: 7661514 - DNA, 22 bp, Homo sapiens
gtggctcagttaacttccatgt

SEQ ID NO: 7661515 - DNA, 19 bp, Homo sapiens
gtggctcatgtagtgggcc

SEQ ID NO: 7661516 - DNA, 19 bp, Homo sapiens
gtggctcatgtagtgggcc

SEQ ID NO: 7661517 - DNA, 22 bp, Homo sapiens
gtggctctaggtgagcatggag

SEQ ID NO: 7661518 - DNA, 22 bp, Homo sapiens
gtggctctaggtgagcatggag

SEQ ID NO: 7661519 - DNA, 22 bp, Homo sapiens
gtggctctaggtgagcatggag

SEQ ID NO: 7661520 - DNA, 22 bp, Homo sapiens
gtggctctaggtgagcatggag

SEQ ID NO: 7661521 - DNA, 22 bp, Homo sapiens
gtggctctaggtgagcatggag

SEQ ID NO: 7661522 - DNA, 22 bp, Homo sapiens
gtggctctaggtgagcatggag

SEQ ID NO: 7661523 - DNA, 19 bp, Homo sapiens
gtggctcatgtagtgggcc

SEQ ID NO: 7661524 - DNA, 22 bp, Homo sapiens
gtggctccttttcaggaggctg

SEQ ID NO: 7661525 - DNA, 22 bp, Homo sapiens
gtggctccgcaggctccattct

SEQ ID NO: 7661526 - DNA, 22 bp, Homo sapiens
gtggctccttttcaggaggctg

SEQ ID NO: 7661527 - DNA, 22 bp, Homo sapiens
gtggctccttttcaggaggctg

SEQ ID NO: 7661528 - DNA, 22 bp, Homo sapiens
gtggctccttttcaggaggctg

SEQ ID NO: 7661529 - DNA, 19 bp, Homo sapiens
gtggctcatgtagtgggcc

SEQ ID NO: 7661530 - DNA, 22 bp, Homo sapiens
gtggctccgcaggctccattct

SEQ ID NO: 7661531 - DNA, 22 bp, Homo sapiens
gtggctccgcaggctccattct

SEQ ID NO: 7661532 - DNA, 22 bp, Homo sapiens
gtggcctggcgagctggcgcgg

SEQ ID NO: 7661533 - DNA, 22 bp, Homo sapiens
gtggcctggcgagctggcgcgg

SEQ ID NO: 7661534 - DNA, 22 bp, Homo sapiens
gtggcctggcgagctggcgcgg

SEQ ID NO: 7661535 - DNA, 22 bp, Homo sapiens
gtggcctggcgagctggcgcgg

SEQ ID NO: 7661536 - DNA, 22 bp, Homo sapiens
gtggcctggatgagcttcgaca

SEQ ID NO: 7661537 - DNA, 22 bp, Homo sapiens
gtggcctggcgagctggcgcgg

SEQ ID NO: 7661538 - DNA, 22 bp, Homo sapiens
gtggcctggcgagctggcgcgg

SEQ ID NO: 7661539 - DNA, 22 bp, Homo sapiens
gtggcctggcgagctggcgcgg

SEQ ID NO: 7661540 - DNA, 22 bp, Homo sapiens
gtggcctggatgagcttcgaca

SEQ ID NO: 7661541 - DNA, 22 bp, Homo sapiens
gtggctcagcggagctctgcac

SEQ ID NO: 7661542 - DNA, 22 bp, Homo sapiens
gtggcctggggtttgttctgag

SEQ ID NO: 7661543 - DNA, 22 bp, Homo sapiens
gtggcctggggtttgttctgag

SEQ ID NO: 7661544 - DNA, 22 bp, Homo sapiens
gtggcctggcgagctggcgcgg

SEQ ID NO: 7661545 - DNA, 22 bp, Homo sapiens
gtggcctggctggcaccacctc

SEQ ID NO: 7661546 - DNA, 22 bp, Homo sapiens
gtggctgcagagggcacagcat

SEQ ID NO: 7661547 - DNA, 22 bp, Homo sapiens
gtggctgcagagccagcaagct

SEQ ID NO: 7661548 - DNA, 22 bp, Homo sapiens
gtggctgcagagccagcaagct

SEQ ID NO: 7661549 - DNA, 22 bp, Homo sapiens
gtggctgcagagccagcaagct

SEQ ID NO: 7661550 - DNA, 22 bp, Homo sapiens
gtggctgcagagccagcaagct

SEQ ID NO: 7661551 - DNA, 17 bp, Homo sapiens
gtggctgcacacacatg

SEQ ID NO: 7661552 - DNA, 17 bp, Homo sapiens
gtggctgcacacacatg

SEQ ID NO: 7661553 - DNA, 22 bp, Homo sapiens
gtggctgagtggtcgagtcaga

SEQ ID NO: 7661554 - DNA, 22 bp, Homo sapiens
gtggctgcagagccagcaagct

SEQ ID NO: 7661555 - DNA, 22 bp, Homo sapiens
gtggctgcagagccagcaagct

SEQ ID NO: 7661556 - DNA, 17 bp, Homo sapiens
gtggctgcacacacatg

SEQ ID NO: 7661557 - DNA, 22 bp, Homo sapiens
gtggctctttatgtgttattgg

SEQ ID NO: 7661558 - DNA, 22 bp, Homo sapiens
gtggctcttgcatggggtctct

SEQ ID NO: 7661559 - DNA, 22 bp, Homo sapiens
gtggctcttgcatggggtctct

SEQ ID NO: 7661560 - DNA, 22 bp, Homo sapiens
gtggctcttgcatggggtctct

SEQ ID NO: 7661561 - DNA, 22 bp, Homo sapiens
gtggctctttatgtgttattgg

SEQ ID NO: 7661562 - DNA, 22 bp, Homo sapiens
gtggctgagcagcagagagctg

SEQ ID NO: 7661563 - DNA, 22 bp, Homo sapiens
gtggctgagcagcagagagctg

SEQ ID NO: 7661564 - DNA, 22 bp, Homo sapiens
gtggctgacaaccactggagga

SEQ ID NO: 7661565 - DNA, 22 bp, Homo sapiens
gtggctgagcagcagagagctg

SEQ ID NO: 7661566 - DNA, 21 bp, Homo sapiens
gtggctctgccaggactgaaa

SEQ ID NO: 7661567 - DNA, 22 bp, Homo sapiens
gtggctctcgccagcctgcggg

SEQ ID NO: 7661568 - DNA, 21 bp, Homo sapiens
gtggctctgccaggactgaaa

SEQ ID NO: 7661569 - DNA, 21 bp, Homo sapiens
gtggctctgccaggactgaaa

SEQ ID NO: 7661570 - DNA, 22 bp, Homo sapiens
gtggctctggctttccaggcgg

SEQ ID NO: 7661571 - DNA, 21 bp, Homo sapiens
gtggctctgccaggactgaaa

SEQ ID NO: 7661572 - DNA, 22 bp, Homo sapiens
gtggctctgtaaaatgcctgca

SEQ ID NO: 7661573 - DNA, 22 bp, Homo sapiens
gtggctctggctttccaggcgg

SEQ ID NO: 7661574 - DNA, 22 bp, Homo sapiens
gtggctctggctttccaggcgg

SEQ ID NO: 7661575 - DNA, 22 bp, Homo sapiens
gtggctctgtaaaatgcctgca

SEQ ID NO: 7661576 - DNA, 22 bp, Homo sapiens
gtggctctgtaaaatgcctgca

SEQ ID NO: 7661577 - DNA, 22 bp, Homo sapiens
gtggctctgtaaaatgcctgca

SEQ ID NO: 7661578 - DNA, 22 bp, Homo sapiens
gtggctctcgccagcctgcggg

SEQ ID NO: 7661579 - DNA, 22 bp, Homo sapiens
gtggctctccattgacatggaa

SEQ ID NO: 7661580 - DNA, 22 bp, Homo sapiens
gtggctctccattgacatggaa

SEQ ID NO: 7661581 - DNA, 22 bp, Homo sapiens
gtggctctccattgacatggaa

SEQ ID NO: 7661582 - DNA, 22 bp, Homo sapiens
gtggctctccattgacatggaa

SEQ ID NO: 7661583 - DNA, 22 bp, Homo sapiens
gtggctcagttaacttccatgt

SEQ ID NO: 7661584 - DNA, 22 bp, Homo sapiens
gtggctctccattgacatggaa

SEQ ID NO: 7661585 - DNA, 22 bp, Homo sapiens
gtggctctctggtcccctgcca

SEQ ID NO: 7661586 - DNA, 22 bp, Homo sapiens
gtggctctcgccagcctgcggg

SEQ ID NO: 7661587 - DNA, 22 bp, Homo sapiens
gtggctctctggtcccctgcca

SEQ ID NO: 7661588 - DNA, 22 bp, Homo sapiens
gtggctctctggtcccctgcca

SEQ ID NO: 7661589 - DNA, 22 bp, Homo sapiens
gtggctctctggtcccctgcca

SEQ ID NO: 7661590 - DNA, 22 bp, Homo sapiens
gtgacatatgcacacctttatt

SEQ ID NO: 7661591 - DNA, 22 bp, Homo sapiens
gtgacagtggtcacttgtagtt

SEQ ID NO: 7661592 - DNA, 22 bp, Homo sapiens
gtgacatggtttgccgtccctg

SEQ ID NO: 7661593 - DNA, 22 bp, Homo sapiens
gtgacatggtttgccgtccctg

SEQ ID NO: 7661594 - DNA, 22 bp, Homo sapiens
gtgacagtgacagctagatagt

SEQ ID NO: 7661595 - DNA, 22 bp, Homo sapiens
gtgacagtgacagctagatagt

SEQ ID NO: 7661596 - DNA, 22 bp, Homo sapiens
gtgacagtcaaagacatgactt

SEQ ID NO: 7661597 - DNA, 22 bp, Homo sapiens
gtgacagtcaaagacatgactt

SEQ ID NO: 7661598 - DNA, 22 bp, Homo sapiens
gtgacagtcaaagacatgactt

SEQ ID NO: 7661599 - DNA, 22 bp, Homo sapiens
gtgacattgctaggaacagatt

SEQ ID NO: 7661600 - DNA, 22 bp, Homo sapiens
gtgacattcaggatatcaatgg

SEQ ID NO: 7661601 - DNA, 22 bp, Homo sapiens
gtgacattgctaggaacagatt

SEQ ID NO: 7661602 - DNA, 22 bp, Homo sapiens
gtgacattcaggatatcaatgg

SEQ ID NO: 7661603 - DNA, 22 bp, Homo sapiens
gtgacatccgctgacatcgcca

SEQ ID NO: 7661604 - DNA, 22 bp, Homo sapiens
gtgacatgttatggactggcta

SEQ ID NO: 7661605 - DNA, 22 bp, Homo sapiens
gtgacatttacgaatcttatcc

SEQ ID NO: 7661606 - DNA, 22 bp, Homo sapiens
gtgacatttacgaatcttatcc

SEQ ID NO: 7661607 - DNA, 22 bp, Homo sapiens
gtgacatttacgaatcttatcc

SEQ ID NO: 7661608 - DNA, 22 bp, Homo sapiens
gtgacatttcccatcagtatcc

SEQ ID NO: 7661609 - DNA, 22 bp, Homo sapiens
gtgacatttattagatgcttac

SEQ ID NO: 7661610 - DNA, 22 bp, Homo sapiens
gtgacattttttaagcccttgt

SEQ ID NO: 7661611 - DNA, 22 bp, Homo sapiens
gtgaccaatattatgctaatta

SEQ ID NO: 7661612 - DNA, 22 bp, Homo sapiens
gtgacatttttactgatgagag

SEQ ID NO: 7661613 - DNA, 22 bp, Homo sapiens
gtgacatttcgtgacgtgagaa

SEQ ID NO: 7661614 - DNA, 20 bp, Homo sapiens
gtgaccagaagacagtgggt

SEQ ID NO: 7661615 - DNA, 22 bp, Homo sapiens
gtgaccagaaaggcttccattt

SEQ ID NO: 7661616 - DNA, 22 bp, Homo sapiens
gtgaccacttcaaattctagat

SEQ ID NO: 7661617 - DNA, 20 bp, Homo sapiens
gtgaccagaagacagtgggt

SEQ ID NO: 7661618 - DNA, 20 bp, Homo sapiens
gtgaccagaagacagtgggt

SEQ ID NO: 7661619 - DNA, 20 bp, Homo sapiens
gtgaccagaagacagtgggt

SEQ ID NO: 7661620 - DNA, 22 bp, Homo sapiens
gtgaccagccagtgctgtctgt

SEQ ID NO: 7661621 - DNA, 22 bp, Homo sapiens
gtgaccagccagtgctgtctgt

SEQ ID NO: 7661622 - DNA, 22 bp, Homo sapiens
gtgaccagacagagtctagccc

SEQ ID NO: 7661623 - DNA, 22 bp, Homo sapiens
gtgaccagagcgggagattggg

SEQ ID NO: 7661624 - DNA, 20 bp, Homo sapiens
gtgaccagaagacagtgggt

SEQ ID NO: 7661625 - DNA, 22 bp, Homo sapiens
gtgaccagagcgggagattggg

SEQ ID NO: 7661626 - DNA, 22 bp, Homo sapiens
gtgaccagttggcaggggtggg

SEQ ID NO: 7661627 - DNA, 22 bp, Homo sapiens
gtgaccagtgatgctgaggagt

SEQ ID NO: 7661628 - DNA, 22 bp, Homo sapiens
gtgaccagtgatgctgaggagt

SEQ ID NO: 7661629 - DNA, 22 bp, Homo sapiens
gtgaccagtgatgctgaggagt

SEQ ID NO: 7661630 - DNA, 22 bp, Homo sapiens
gtgaccagccagtgctgtctgt

SEQ ID NO: 7661631 - DNA, 22 bp, Homo sapiens
gtgaccagcccatagagaggcg

SEQ ID NO: 7661632 - DNA, 22 bp, Homo sapiens
gtgaccagcccatagagaggcg

SEQ ID NO: 7661633 - DNA, 22 bp, Homo sapiens
gtgaccagcccatagagaggcg

SEQ ID NO: 7661634 - DNA, 22 bp, Homo sapiens
gtgaccagcccatagagaggcg

SEQ ID NO: 7661635 - DNA, 22 bp, Homo sapiens
gtgcctgctgcagctgagcagt

SEQ ID NO: 7661636 - DNA, 22 bp, Homo sapiens
gtgcctgctgcagctgagcagt

SEQ ID NO: 7661637 - DNA, 22 bp, Homo sapiens
gtgcctgctgcagctgagcagt

SEQ ID NO: 7661638 - DNA, 22 bp, Homo sapiens
gtgcctgctgcagctgagcagt

SEQ ID NO: 7661639 - DNA, 22 bp, Homo sapiens
gtgcctgctgcagagtcgctgt

SEQ ID NO: 7661640 - DNA, 22 bp, Homo sapiens
gtgcctgctgcagagtcgctgt

SEQ ID NO: 7661641 - DNA, 22 bp, Homo sapiens
gtgcctgctacctgacttgttt

SEQ ID NO: 7661642 - DNA, 22 bp, Homo sapiens
gtgcctgccccactcctcagca

SEQ ID NO: 7661643 - DNA, 22 bp, Homo sapiens
gtgcctgcagcaatccatggca

SEQ ID NO: 7661644 - DNA, 22 bp, Homo sapiens
gtgcctgccccactcctcagca

SEQ ID NO: 7661645 - DNA, 22 bp, Homo sapiens
gtgcctgccccactcctcagca

SEQ ID NO: 7661646 - DNA, 22 bp, Homo sapiens
gtgcctgcagcaatccatggca

SEQ ID NO: 7661647 - DNA, 22 bp, Homo sapiens
gtgcctgcagcaatccatggca

SEQ ID NO: 7661648 - DNA, 22 bp, Homo sapiens
gtgcctgcagcaatccatggca

SEQ ID NO: 7661649 - DNA, 22 bp, Homo sapiens
gtgcctgagccagctgcagctc

SEQ ID NO: 7661650 - DNA, 22 bp, Homo sapiens
gtgaccagttggcaggggtggg

SEQ ID NO: 7661651 - DNA, 22 bp, Homo sapiens
gtgcctgagccagctgcagctc

SEQ ID NO: 7661652 - DNA, 22 bp, Homo sapiens
gtgcctgagccagctgcagctc

SEQ ID NO: 7661653 - DNA, 22 bp, Homo sapiens
gtgcctggaatgcgcctcggcg

SEQ ID NO: 7661654 - DNA, 22 bp, Homo sapiens
gtgcctggaatgcgcctcggcg

SEQ ID NO: 7661655 - DNA, 22 bp, Homo sapiens
gtgcctggaatgcgcctcggcg

SEQ ID NO: 7661656 - DNA, 22 bp, Homo sapiens
gtgcctggaatgcgcctcggcg

SEQ ID NO: 7661657 - DNA, 22 bp, Homo sapiens
gtgcctggaatgcgcctcggcg

SEQ ID NO: 7661658 - DNA, 22 bp, Homo sapiens
gtgcctggaatgcgcctcggcg

SEQ ID NO: 7661659 - DNA, 22 bp, Homo sapiens
gtgcctggaccctctttccgga

SEQ ID NO: 7661660 - DNA, 22 bp, Homo sapiens
gtgcctggaccctctttccgga

SEQ ID NO: 7661661 - DNA, 22 bp, Homo sapiens
gtgcctggaactgggtaggctg

SEQ ID NO: 7661662 - DNA, 22 bp, Homo sapiens
gtgcctggaactgggtaggctg

SEQ ID NO: 7661663 - DNA, 22 bp, Homo sapiens
gtgcctggaactgggtaggctg

SEQ ID NO: 7661664 - DNA, 22 bp, Homo sapiens
gtgcctggaactgggtaggctg

SEQ ID NO: 7661665 - DNA, 22 bp, Homo sapiens
gtgcctggaactgggtaggctg

SEQ ID NO: 7661666 - DNA, 22 bp, Homo sapiens
gtgcctggaactgggtaggctg

SEQ ID NO: 7661667 - DNA, 22 bp, Homo sapiens
gtgacaaggaaagacagactgt

SEQ ID NO: 7661668 - DNA, 22 bp, Homo sapiens
gtgacaatattagctcaggggc

SEQ ID NO: 7661669 - DNA, 22 bp, Homo sapiens
gtgacaatattagctcaggggc

SEQ ID NO: 7661670 - DNA, 22 bp, Homo sapiens
gtgacacccgcatgccactgtg

SEQ ID NO: 7661671 - DNA, 22 bp, Homo sapiens
gtgacactggtttaggtatgta

SEQ ID NO: 7661672 - DNA, 22 bp, Homo sapiens
gtgacacccgcatgccactgtg

SEQ ID NO: 7661673 - DNA, 22 bp, Homo sapiens
gtgacagaaacagggctagaat

SEQ ID NO: 7661674 - DNA, 22 bp, Homo sapiens
gtgacagaaacagggctagaat

SEQ ID NO: 7661675 - DNA, 22 bp, Homo sapiens
gtgacagaaacagggctagaat

SEQ ID NO: 7661676 - DNA, 16 bp, Homo sapiens
gtgacagacaataggc

SEQ ID NO: 7661677 - DNA, 22 bp, Homo sapiens
gtgacagagattaatagcttgg

SEQ ID NO: 7661678 - DNA, 22 bp, Homo sapiens
gtgacaaaaacactgattattt

SEQ ID NO: 7661679 - DNA, 22 bp, Homo sapiens
gtgacaaaggtcaagcttttga

SEQ ID NO: 7661680 - DNA, 22 bp, Homo sapiens
gtgacaaatgcaaattgggctg

SEQ ID NO: 7661681 - DNA, 22 bp, Homo sapiens
gtgacaaaggtcaagcttttga

SEQ ID NO: 7661682 - DNA, 22 bp, Homo sapiens
gtgacaaatgcaaattgggctg

SEQ ID NO: 7661683 - DNA, 22 bp, Homo sapiens
gtgacaaatgcaaattgggctg

SEQ ID NO: 7661684 - DNA, 22 bp, Homo sapiens
gtgacaaggaaagacagactgt

SEQ ID NO: 7661685 - DNA, 20 bp, Homo sapiens
gtgaagggagtcaggtgtgc

SEQ ID NO: 7661686 - DNA, 20 bp, Homo sapiens
gtgaagggagtcaggtgtgc

SEQ ID NO: 7661687 - DNA, 20 bp, Homo sapiens
gtgaagggagtcaggtgtgc

SEQ ID NO: 7661688 - DNA, 22 bp, Homo sapiens
gtgacaaaaacactgattattt

SEQ ID NO: 7661689 - DNA, 22 bp, Homo sapiens
gtgacaaaaacactgattattt

SEQ ID NO: 7661690 - DNA, 20 bp, Homo sapiens
gtgaagggagtcaggtgtgc

SEQ ID NO: 7661691 - DNA, 22 bp, Homo sapiens
gtgaaggctacaagagatcaag

SEQ ID NO: 7661692 - DNA, 22 bp, Homo sapiens
gtgaaggctgtgtgaaagttct

SEQ ID NO: 7661693 - DNA, 22 bp, Homo sapiens
gtgaaggccagtagggtcctgg

SEQ ID NO: 7661694 - DNA, 22 bp, Homo sapiens
gtgaaggcagccatcgacagtt

SEQ ID NO: 7661695 - DNA, 22 bp, Homo sapiens
gtgaaggcagccatcgacagtt

SEQ ID NO: 7661696 - DNA, 22 bp, Homo sapiens
gtgaaggcagccatcgacagtt

SEQ ID NO: 7661697 - DNA, 22 bp, Homo sapiens
gtgaaggccgtccttggggact

SEQ ID NO: 7661698 - DNA, 20 bp, Homo sapiens
gtgaaggctaagcacagagg

SEQ ID NO: 7661699 - DNA, 22 bp, Homo sapiens
gtctggggtactttcatctgat

SEQ ID NO: 7661700 - DNA, 22 bp, Homo sapiens
gtctggggtactttcatctgat

SEQ ID NO: 7661701 - DNA, 22 bp, Homo sapiens
gtctggggtactttcatctgat

SEQ ID NO: 7661702 - DNA, 22 bp, Homo sapiens
gtgaaggattggagggcatctt

SEQ ID NO: 7661703 - DNA, 22 bp, Homo sapiens
gtctggggtactttcatctgat

SEQ ID NO: 7661704 - DNA, 22 bp, Homo sapiens
gtgaaggcaatgataagagtga

SEQ ID NO: 7661705 - DNA, 22 bp, Homo sapiens
gtgaaggcaatgataagagtga

SEQ ID NO: 7661706 - DNA, 22 bp, Homo sapiens
gtgacagattatagggagcgtt

SEQ ID NO: 7661707 - DNA, 22 bp, Homo sapiens
gtgacagattatagggagcgtt

SEQ ID NO: 7661708 - DNA, 22 bp, Homo sapiens
gtgacagagttttagatctcat

SEQ ID NO: 7661709 - DNA, 22 bp, Homo sapiens
gtgacagagttttagatctcat

SEQ ID NO: 7661710 - DNA, 22 bp, Homo sapiens
gtgacagattatagggagcgtt

SEQ ID NO: 7661711 - DNA, 22 bp, Homo sapiens
gtgacagattatagggagcgtt

SEQ ID NO: 7661712 - DNA, 22 bp, Homo sapiens
gtgacagatttgctgcgcatgg

SEQ ID NO: 7661713 - DNA, 22 bp, Homo sapiens
gtgacagatttgctgcgcatgg

SEQ ID NO: 7661714 - DNA, 22 bp, Homo sapiens
gtgacagagtgagaccctgtct

SEQ ID NO: 7661715 - DNA, 22 bp, Homo sapiens
gtgacagagctgggatttgaag

SEQ ID NO: 7661716 - DNA, 22 bp, Homo sapiens
gtgacagagctgggatttgaag

SEQ ID NO: 7661717 - DNA, 22 bp, Homo sapiens
gtgacagagctgggatttgaag

SEQ ID NO: 7661718 - DNA, 22 bp, Homo sapiens
gtgacagagttttagatctcat

SEQ ID NO: 7661719 - DNA, 22 bp, Homo sapiens
gtgacagagtgagaccttgtct

SEQ ID NO: 7661720 - DNA, 22 bp, Homo sapiens
gtgacaggcccagtgggatgca

SEQ ID NO: 7661721 - DNA, 22 bp, Homo sapiens
gtgacaggcccagtgggatgca

SEQ ID NO: 7661722 - DNA, 22 bp, Homo sapiens
gtgacaggcccagtgggatgca

SEQ ID NO: 7661723 - DNA, 22 bp, Homo sapiens
gtgacaggccactgcggctctg

SEQ ID NO: 7661724 - DNA, 22 bp, Homo sapiens
gtgacaggccactgcggctctg

SEQ ID NO: 7661725 - DNA, 22 bp, Homo sapiens
gtgacaggccactgcggctctg

SEQ ID NO: 7661726 - DNA, 22 bp, Homo sapiens
gtgacaggccactgcggctctg

SEQ ID NO: 7661727 - DNA, 22 bp, Homo sapiens
gtgacagggggcttggtttcta

SEQ ID NO: 7661728 - DNA, 22 bp, Homo sapiens
gtgacagggagtgatatagcag

SEQ ID NO: 7661729 - DNA, 22 bp, Homo sapiens
gtgacagggagtgatatagcag

SEQ ID NO: 7661730 - DNA, 22 bp, Homo sapiens
gtgacagggggcttggtttcta

SEQ ID NO: 7661731 - DNA, 22 bp, Homo sapiens
gtgacagggggcttggtttcta

SEQ ID NO: 7661732 - DNA, 22 bp, Homo sapiens
gtgacaggtatactcaccattg

SEQ ID NO: 7661733 - DNA, 22 bp, Homo sapiens
gtgacaggcccagtgggatgca

SEQ ID NO: 7661734 - DNA, 22 bp, Homo sapiens
gtgacaggcccagtgggatgca

SEQ ID NO: 7661735 - DNA, 22 bp, Homo sapiens
gtgacagctccttggttagatg

SEQ ID NO: 7661736 - DNA, 18 bp, Homo sapiens
gtgacagctgctagctca

SEQ ID NO: 7661737 - DNA, 22 bp, Homo sapiens
gtgacaggatagtcagctttgt

SEQ ID NO: 7661738 - DNA, 22 bp, Homo sapiens
gtgacaggatagtcagctttgt

SEQ ID NO: 7661739 - DNA, 22 bp, Homo sapiens
gtgacagcctcttgggaggttg

SEQ ID NO: 7661740 - DNA, 22 bp, Homo sapiens
gtgacagcattgcagggcctct

SEQ ID NO: 7661741 - DNA, 22 bp, Homo sapiens
gtgacagccttcagtgtctctg

SEQ ID NO: 7661742 - DNA, 22 bp, Homo sapiens
gtgacaggccactgcggctctg

SEQ ID NO: 7661743 - DNA, 22 bp, Homo sapiens
gtgacaggcatggggtcatgca

SEQ ID NO: 7661744 - DNA, 22 bp, Homo sapiens
gtgacagatttgctgcgcatgg

SEQ ID NO: 7661745 - DNA, 22 bp, Homo sapiens
gtgacaggcatggggtcatgca

SEQ ID NO: 7661746 - DNA, 22 bp, Homo sapiens
gtgacaggcatggggtcatgca

SEQ ID NO: 7661747 - DNA, 22 bp, Homo sapiens
gtgacaggcatggggtcatgca

SEQ ID NO: 7661748 - DNA, 22 bp, Homo sapiens
gtgacaggcatggggtcatgca

SEQ ID NO: 7661749 - DNA, 23 bp, Homo sapiens
gtgcgccaggacaacctgacgga

SEQ ID NO: 7661750 - DNA, 22 bp, Homo sapiens
gtgcgccagctcaaggggaggc

SEQ ID NO: 7661751 - DNA, 23 bp, Homo sapiens
gtgcgccaggacaacctgacgga

SEQ ID NO: 7661752 - DNA, 22 bp, Homo sapiens
gtgcgcttcttcctgagccagg

SEQ ID NO: 7661753 - DNA, 22 bp, Homo sapiens
gtgcgggcctgggggtttctct

SEQ ID NO: 7661754 - DNA, 22 bp, Homo sapiens
gtgcgcttcttcctgagccagg

SEQ ID NO: 7661755 - DNA, 21 bp, Homo sapiens
gtgcggatgccgtcattgtca

SEQ ID NO: 7661756 - DNA, 22 bp, Homo sapiens
gtgcggatcggtgtcctccaaa

SEQ ID NO: 7661757 - DNA, 22 bp, Homo sapiens
gtgcctttgagaagtttctctg

SEQ ID NO: 7661758 - DNA, 22 bp, Homo sapiens
gtgcctttgagaagtttctctg

SEQ ID NO: 7661759 - DNA, 22 bp, Homo sapiens
gtgcctttgagaagtttctctg

SEQ ID NO: 7661760 - DNA, 22 bp, Homo sapiens
gtgccttccccggtggtctgtt

SEQ ID NO: 7661761 - DNA, 22 bp, Homo sapiens
gtgccttccccggtggtctgtt

SEQ ID NO: 7661762 - DNA, 22 bp, Homo sapiens
gtgccttttcttcatagttact

SEQ ID NO: 7661763 - DNA, 22 bp, Homo sapiens
gtgcctttgtgtctaaaacagc

SEQ ID NO: 7661764 - DNA, 22 bp, Homo sapiens
gtgcgcaccctcccggcatccc

SEQ ID NO: 7661765 - DNA, 22 bp, Homo sapiens
gtgcgggggttcccagcagccg

SEQ ID NO: 7661766 - DNA, 22 bp, Homo sapiens
gtgcgggggttcccagcagccg

SEQ ID NO: 7661767 - DNA, 22 bp, Homo sapiens
gtgcgggggttcccagcagccg

SEQ ID NO: 7661768 - DNA, 22 bp, Homo sapiens
gtgcgggcctgggggtttctct

SEQ ID NO: 7661769 - DNA, 22 bp, Homo sapiens
gtgcgtcctgggggctgggtcg

SEQ ID NO: 7661770 - DNA, 22 bp, Homo sapiens
gtgcgtggttctagatcctgtc

SEQ ID NO: 7661771 - DNA, 22 bp, Homo sapiens
gtgcgtggttctagatcctgtc

SEQ ID NO: 7661772 - DNA, 22 bp, Homo sapiens
gtgcgtgaggcccctgagcgaa

SEQ ID NO: 7661773 - DNA, 22 bp, Homo sapiens
gtgctaataatgtgttaatttc

SEQ ID NO: 7661774 - DNA, 22 bp, Homo sapiens
gtgcgtgtgcctatcaataaag

SEQ ID NO: 7661775 - DNA, 22 bp, Homo sapiens
gtgctaattgaccatttgatat

SEQ ID NO: 7661776 - DNA, 22 bp, Homo sapiens
gtgctacagactgagtacactt

SEQ ID NO: 7661777 - DNA, 22 bp, Homo sapiens
gtgctacagactgagtacactt

SEQ ID NO: 7661778 - DNA, 20 bp, Homo sapiens
gtgcctggagaagaggctgt

SEQ ID NO: 7661779 - DNA, 20 bp, Homo sapiens
gtgcctggagaagaggctgt

SEQ ID NO: 7661780 - DNA, 20 bp, Homo sapiens
gtgcctggagaagaggctgt

SEQ ID NO: 7661781 - DNA, 20 bp, Homo sapiens
gtgcctggagaagaggctgt

SEQ ID NO: 7661782 - DNA, 20 bp, Homo sapiens
gtgcctggagaagaggctgt

SEQ ID NO: 7661783 - DNA, 20 bp, Homo sapiens
gtgcctggagaagaggctgt

SEQ ID NO: 7661784 - DNA, 20 bp, Homo sapiens
gtgcctggagaagaggctgt

SEQ ID NO: 7661785 - DNA, 22 bp, Homo sapiens
gtgcctggagctaatgtgtata

SEQ ID NO: 7661786 - DNA, 22 bp, Homo sapiens
gtgcctggagctaatgtgtata

SEQ ID NO: 7661787 - DNA, 20 bp, Homo sapiens
gtgcctggagaagaggctgt

SEQ ID NO: 7661788 - DNA, 22 bp, Homo sapiens
gtgcctggcacacagaaggcaa

SEQ ID NO: 7661789 - DNA, 22 bp, Homo sapiens
gtgcctggcacacagaaggcaa

SEQ ID NO: 7661790 - DNA, 22 bp, Homo sapiens
gtgcctggcacacagaaggcaa

SEQ ID NO: 7661791 - DNA, 22 bp, Homo sapiens
gtgcctggcacacagaaggcaa

SEQ ID NO: 7661792 - DNA, 22 bp, Homo sapiens
gtgcctggcatgcgccggtgct

SEQ ID NO: 7661793 - DNA, 22 bp, Homo sapiens
gtgcctggcatgcgccggtgct

SEQ ID NO: 7661794 - DNA, 22 bp, Homo sapiens
gtgcctggcagggtcagctgct

SEQ ID NO: 7661795 - DNA, 22 bp, Homo sapiens
gtgcctgtttcttttgaattca

SEQ ID NO: 7661796 - DNA, 22 bp, Homo sapiens
gtgcctgggacacagcagatac

SEQ ID NO: 7661797 - DNA, 22 bp, Homo sapiens
gtgcctggcatgcgccggtgct

SEQ ID NO: 7661798 - DNA, 22 bp, Homo sapiens
gtgcctggcatgcgccggtgct

SEQ ID NO: 7661799 - DNA, 22 bp, Homo sapiens
gtgcctggcagggtcagctgct

SEQ ID NO: 7661800 - DNA, 22 bp, Homo sapiens
gtgcctggcagggtcagctgct

SEQ ID NO: 7661801 - DNA, 22 bp, Homo sapiens
gtgcctggcagggtcagctgct

SEQ ID NO: 7661802 - DNA, 22 bp, Homo sapiens
gtgcctggcagggtcagctgct

SEQ ID NO: 7661803 - DNA, 22 bp, Homo sapiens
gtgcctggcacacagaaggcaa

SEQ ID NO: 7661804 - DNA, 22 bp, Homo sapiens
gtgcctggcagggtcagctgct

SEQ ID NO: 7661805 - DNA, 22 bp, Homo sapiens
gtgcctggcagggtcagctgct

SEQ ID NO: 7661806 - DNA, 22 bp, Homo sapiens
gtgcctggcagggtcagctgct

SEQ ID NO: 7661807 - DNA, 22 bp, Homo sapiens
gtgcctggcagggtcagctgct

SEQ ID NO: 7661808 - DNA, 22 bp, Homo sapiens
gtggaaaactgagaaaattgct

SEQ ID NO: 7661809 - DNA, 22 bp, Homo sapiens
gtgctaggattacaggcatggg

SEQ ID NO: 7661810 - DNA, 22 bp, Homo sapiens
gtggaaatagtttggttataga

SEQ ID NO: 7661811 - DNA, 22 bp, Homo sapiens
gtggaaatagtttggttataga

SEQ ID NO: 7661812 - DNA, 22 bp, Homo sapiens
gtggaaatgcccccaaatagtg

SEQ ID NO: 7661813 - DNA, 22 bp, Homo sapiens
gtggaaatgcccccaaatagtg

SEQ ID NO: 7661814 - DNA, 22 bp, Homo sapiens
gtggaaattttaggatcatctt

SEQ ID NO: 7661815 - DNA, 22 bp, Homo sapiens
gtgctaggattacaggcatggg

SEQ ID NO: 7661816 - DNA, 22 bp, Homo sapiens
gtgctttttataaggcagactg

SEQ ID NO: 7661817 - DNA, 22 bp, Homo sapiens
gtgctttttataaggcagactg

SEQ ID NO: 7661818 - DNA, 22 bp, Homo sapiens
gtgctactagtttcatttttca

SEQ ID NO: 7661819 - DNA, 22 bp, Homo sapiens
gtggaaaactgagaaaattgct

SEQ ID NO: 7661820 - DNA, 22 bp, Homo sapiens
gtggaaaactgagaaaattgct

SEQ ID NO: 7661821 - DNA, 22 bp, Homo sapiens
gtgctttttcaatcagaaggga

SEQ ID NO: 7661822 - DNA, 22 bp, Homo sapiens
gtgctttttcaatcagaaggga

SEQ ID NO: 7661823 - DNA, 22 bp, Homo sapiens
gtggaagaggcaagatagctct

SEQ ID NO: 7661824 - DNA, 22 bp, Homo sapiens
gtggaagaggcaagatagctct

SEQ ID NO: 7661825 - DNA, 22 bp, Homo sapiens
gtggaagaggcaagatagctct

SEQ ID NO: 7661826 - DNA, 22 bp, Homo sapiens
gtggaagcaaccctggcaggag

SEQ ID NO: 7661827 - DNA, 22 bp, Homo sapiens
gtggaagaggcaagatagctct

SEQ ID NO: 7661828 - DNA, 22 bp, Homo sapiens
gtggaagcaaccctggcaggag

SEQ ID NO: 7661829 - DNA, 22 bp, Homo sapiens
gtggaagcagtaaggcaagttt

SEQ ID NO: 7661830 - DNA, 22 bp, Homo sapiens
gtggaagcctactcttgtggtt

SEQ ID NO: 7661831 - DNA, 22 bp, Homo sapiens
gtggaagctgatgggagacagg

SEQ ID NO: 7661832 - DNA, 22 bp, Homo sapiens
gtggaaggaagagatggcccca

SEQ ID NO: 7661833 - DNA, 22 bp, Homo sapiens
gtggaaggaagagatggcccca

SEQ ID NO: 7661834 - DNA, 22 bp, Homo sapiens
gtggaacagcctgtgcaaacct

SEQ ID NO: 7661835 - DNA, 22 bp, Homo sapiens
gtggaacagggagcctggaatg

SEQ ID NO: 7661836 - DNA, 22 bp, Homo sapiens
gtggaacagcctgtgcaaacct

SEQ ID NO: 7661837 - DNA, 22 bp, Homo sapiens
gtggaacagaactgtttattga

SEQ ID NO: 7661838 - DNA, 16 bp, Homo sapiens
gtggaacacattttgg

SEQ ID NO: 7661839 - DNA, 22 bp, Homo sapiens
gtggaacaatatcgaagagagg

SEQ ID NO: 7661840 - DNA, 22 bp, Homo sapiens
gtggaacaatatcgaagagagg

SEQ ID NO: 7661841 - DNA, 22 bp, Homo sapiens
gtggaacagtattttaaaagct

SEQ ID NO: 7661842 - DNA, 22 bp, Homo sapiens
gtggaacatgtccatatacatt

SEQ ID NO: 7661843 - DNA, 22 bp, Homo sapiens
gtggaacatgtccatatacatt

SEQ ID NO: 7661844 - DNA, 22 bp, Homo sapiens
gtggaacagggagcctggaatg

SEQ ID NO: 7661845 - DNA, 22 bp, Homo sapiens
gtggaagaggcaagatagctct

SEQ ID NO: 7661846 - DNA, 22 bp, Homo sapiens
gtggaacattcaaagtggagag

SEQ ID NO: 7661847 - DNA, 22 bp, Homo sapiens
gtggaacattcaaagtggagag

SEQ ID NO: 7661848 - DNA, 22 bp, Homo sapiens
gtggaaggtgaaggagcagcga

SEQ ID NO: 7661849 - DNA, 22 bp, Homo sapiens
gtggaaggtgctagaacaagga

SEQ ID NO: 7661850 - DNA, 22 bp, Homo sapiens
gtggaaggtgctagaacaagga

SEQ ID NO: 7661851 - DNA, 22 bp, Homo sapiens
gtggaagtagatttgagaaggt

SEQ ID NO: 7661852 - DNA, 19 bp, Homo sapiens
gtggaatcggtgtttttta

SEQ ID NO: 7661853 - DNA, 22 bp, Homo sapiens
gtggaatgaatagatttgcatt

SEQ ID NO: 7661854 - DNA, 22 bp, Homo sapiens
gtggaaggtgctagaacaagga

SEQ ID NO: 7661855 - DNA, 22 bp, Homo sapiens
gtggaaggtgctagaacaagga

SEQ ID NO: 7661856 - DNA, 22 bp, Homo sapiens
gtggaaggtgctagaacaagga

SEQ ID NO: 7661857 - DNA, 20 bp, Homo sapiens
gtggaatgcactctgtgctg

SEQ ID NO: 7661858 - DNA, 20 bp, Homo sapiens
gtggaatgcactctgtgctg

SEQ ID NO: 7661859 - DNA, 20 bp, Homo sapiens
gtggaatgcactctgtgctg

SEQ ID NO: 7661860 - DNA, 22 bp, Homo sapiens
gtggaatggccatgggatcctt

SEQ ID NO: 7661861 - DNA, 22 bp, Homo sapiens
gtggaatggccatgggatcctt

SEQ ID NO: 7661862 - DNA, 22 bp, Homo sapiens
gtggaatgtccttgatcataag

SEQ ID NO: 7661863 - DNA, 22 bp, Homo sapiens
gtggaattatgcatttcttcac

SEQ ID NO: 7661864 - DNA, 22 bp, Homo sapiens
gtggaattatgcatttcttcac

SEQ ID NO: 7661865 - DNA, 22 bp, Homo sapiens
gtggaagggactgcctagagga

SEQ ID NO: 7661866 - DNA, 22 bp, Homo sapiens
gtggaaggaattaacagactag

SEQ ID NO: 7661867 - DNA, 22 bp, Homo sapiens
gtggaagggactgcctagagga

SEQ ID NO: 7661868 - DNA, 22 bp, Homo sapiens
gtggaagggactgcctagagga

SEQ ID NO: 7661869 - DNA, 22 bp, Homo sapiens
gtggaagggactgcctagagga

SEQ ID NO: 7661870 - DNA, 22 bp, Homo sapiens
gtggaaggaagagatggcccca

SEQ ID NO: 7661871 - DNA, 22 bp, Homo sapiens
gtggaaggaagagatggcccca

SEQ ID NO: 7661872 - DNA, 22 bp, Homo sapiens
gtggaaggaagagatggcccca

SEQ ID NO: 7661873 - DNA, 22 bp, Homo sapiens
gtggaaggaagagatggcccca

SEQ ID NO: 7661874 - DNA, 22 bp, Homo sapiens
gtggaaggaagagatggcccca

SEQ ID NO: 7661875 - DNA, 22 bp, Homo sapiens
gtggaaggaattaacagactag

SEQ ID NO: 7661876 - DNA, 22 bp, Homo sapiens
gtggaaggaattaacagactag

SEQ ID NO: 7661877 - DNA, 22 bp, Homo sapiens
gtggaaggaattaacagactag

SEQ ID NO: 7661878 - DNA, 22 bp, Homo sapiens
gtggaaggtgaaggagcagcga

SEQ ID NO: 7661879 - DNA, 22 bp, Homo sapiens
gtggaaggtgaaggagcagcga

SEQ ID NO: 7661880 - DNA, 22 bp, Homo sapiens
gtggaaggtgaaggagcagcga

SEQ ID NO: 7661881 - DNA, 22 bp, Homo sapiens
gtggaaggtgaaggagcagcga

SEQ ID NO: 7661882 - DNA, 22 bp, Homo sapiens
gtggaaggtgaaggagcagcga

SEQ ID NO: 7661883 - DNA, 22 bp, Homo sapiens
gtggaaggtgaaggagcagcga

SEQ ID NO: 7661884 - DNA, 22 bp, Homo sapiens
gtggaaggtgaaggagcagcga

SEQ ID NO: 7661885 - DNA, 22 bp, Homo sapiens
gtggaaggtgaaggagcagcga

SEQ ID NO: 7661886 - DNA, 22 bp, Homo sapiens
gtggaaggtaatgcagcttact

SEQ ID NO: 7661887 - DNA, 22 bp, Homo sapiens
gtggaagggtcacagcccctac

SEQ ID NO: 7661888 - DNA, 22 bp, Homo sapiens
gtggaagggtcacagcccctac

SEQ ID NO: 7661889 - DNA, 22 bp, Homo sapiens
gtggaagggtcacagcccctac

SEQ ID NO: 7661890 - DNA, 22 bp, Homo sapiens
gtggaagggtcacagcccctac

SEQ ID NO: 7661891 - DNA, 22 bp, Homo sapiens
gtggcagagttgctgactagaa

SEQ ID NO: 7661892 - DNA, 22 bp, Homo sapiens
gtggcagagtgcggttctgacc

SEQ ID NO: 7661893 - DNA, 22 bp, Homo sapiens
gtggcagagtgcggttctgacc

SEQ ID NO: 7661894 - DNA, 22 bp, Homo sapiens
gtggcagaggttcctcagtgtg

SEQ ID NO: 7661895 - DNA, 22 bp, Homo sapiens
gtggcagaggttcctcagtgtg

SEQ ID NO: 7661896 - DNA, 22 bp, Homo sapiens
gtggcagaggttcctcagtgtg

SEQ ID NO: 7661897 - DNA, 22 bp, Homo sapiens
gtggcagaggttcctcagtgtg

SEQ ID NO: 7661898 - DNA, 22 bp, Homo sapiens
gtggcagagtgcggttctgacc

SEQ ID NO: 7661899 - DNA, 22 bp, Homo sapiens
gtggcagcaaaatcctgcattc

SEQ ID NO: 7661900 - DNA, 22 bp, Homo sapiens
gtggcagattgctcaccatggt

SEQ ID NO: 7661901 - DNA, 22 bp, Homo sapiens
gtggcagcaaaatcctgcattc

SEQ ID NO: 7661902 - DNA, 22 bp, Homo sapiens
gtggcagcaaaatcctgcattc

SEQ ID NO: 7661903 - DNA, 22 bp, Homo sapiens
gtggcagattgctcaccatggt

SEQ ID NO: 7661904 - DNA, 22 bp, Homo sapiens
gtggcagattgctcaccatggt

SEQ ID NO: 7661905 - DNA, 22 bp, Homo sapiens
gtggcagattgctcaccatggt

SEQ ID NO: 7661906 - DNA, 22 bp, Homo sapiens
gtggcagattgctcaccatggt

SEQ ID NO: 7661907 - DNA, 22 bp, Homo sapiens
gtggcagagttgctgactagaa

SEQ ID NO: 7661908 - DNA, 22 bp, Homo sapiens
gtggcagagggtgagctggact

SEQ ID NO: 7661909 - DNA, 22 bp, Homo sapiens
gtggcagagggtgagctggact

SEQ ID NO: 7661910 - DNA, 22 bp, Homo sapiens
gtggcagagggtgagctggact

SEQ ID NO: 7661911 - DNA, 22 bp, Homo sapiens
gtggcagagggtgagctggact

SEQ ID NO: 7661912 - DNA, 22 bp, Homo sapiens
gtggcagaggctgtgaggatgc

SEQ ID NO: 7661913 - DNA, 22 bp, Homo sapiens
gtggcagagggtgagctggact

SEQ ID NO: 7661914 - DNA, 22 bp, Homo sapiens
gtggcagagggtgagctggact

SEQ ID NO: 7661915 - DNA, 22 bp, Homo sapiens
gtggcagaggctgtgaggatgc

SEQ ID NO: 7661916 - DNA, 22 bp, Homo sapiens
gtggcagaggctgtgaggatgc

SEQ ID NO: 7661917 - DNA, 22 bp, Homo sapiens
gtggcagaggctctgggaccag

SEQ ID NO: 7661918 - DNA, 22 bp, Homo sapiens
gtggcagaggctctgggaccag

SEQ ID NO: 7661919 - DNA, 22 bp, Homo sapiens
gtggcagaggctctgggaccag

SEQ ID NO: 7661920 - DNA, 22 bp, Homo sapiens
gtggcagaggctctgggaccag

SEQ ID NO: 7661921 - DNA, 22 bp, Homo sapiens
gtggcagagccgtgcaggtagg

SEQ ID NO: 7661922 - DNA, 22 bp, Homo sapiens
gtggcagaggctctgggaccag

SEQ ID NO: 7661923 - DNA, 22 bp, Homo sapiens
gtggcagagccttgcggctttg

SEQ ID NO: 7661924 - DNA, 22 bp, Homo sapiens
gtggcagagccttgcggctttg

SEQ ID NO: 7661925 - DNA, 19 bp, Homo sapiens
gtggcagcagatttggtgt

SEQ ID NO: 7661926 - DNA, 19 bp, Homo sapiens
gtggcagcagatttggtgt

SEQ ID NO: 7661927 - DNA, 19 bp, Homo sapiens
gtggcagcagatttggtgt

SEQ ID NO: 7661928 - DNA, 22 bp, Homo sapiens
gtggcagcagaggggtggtatg

SEQ ID NO: 7661929 - DNA, 22 bp, Homo sapiens
gtggcagcagaggggtggtatg

SEQ ID NO: 7661930 - DNA, 22 bp, Homo sapiens
gtggcagcaggtactcacgcac

SEQ ID NO: 7661931 - DNA, 22 bp, Homo sapiens
gtggcagcaggtactcacgcac

SEQ ID NO: 7661932 - DNA, 22 bp, Homo sapiens
gtggcagcatggcttttagctg

SEQ ID NO: 7661933 - DNA, 22 bp, Homo sapiens
gtggcagccatgagaatataac

SEQ ID NO: 7661934 - DNA, 22 bp, Homo sapiens
gtggcagccatgagaatataac

SEQ ID NO: 7661935 - DNA, 22 bp, Homo sapiens
gtggcagcaaaatcctgcattc

SEQ ID NO: 7661936 - DNA, 22 bp, Homo sapiens
gtggcagcaaaatcctgcattc

SEQ ID NO: 7661937 - DNA, 22 bp, Homo sapiens
gtggcagcaaatgcctggacta

SEQ ID NO: 7661938 - DNA, 22 bp, Homo sapiens
gtggcagcaaaatcctgcattc

SEQ ID NO: 7661939 - DNA, 22 bp, Homo sapiens
gtggcagcaaatgcctggacta

SEQ ID NO: 7661940 - DNA, 22 bp, Homo sapiens
gtggcagcaaatgcctggacta

SEQ ID NO: 7661941 - DNA, 22 bp, Homo sapiens
gtggcagcaaatgcctggacta

SEQ ID NO: 7661942 - DNA, 22 bp, Homo sapiens
gtggcagcagaggggtggtatg

SEQ ID NO: 7661943 - DNA, 22 bp, Homo sapiens
gtggcagcagaggggtggtatg

SEQ ID NO: 7661944 - DNA, 22 bp, Homo sapiens
gtggcagctcatgttgttttaa

SEQ ID NO: 7661945 - DNA, 22 bp, Homo sapiens
gtggcagctcatgttgttttaa

SEQ ID NO: 7661946 - DNA, 22 bp, Homo sapiens
gtggcagctctcttgatttccc

SEQ ID NO: 7661947 - DNA, 22 bp, Homo sapiens
gtggcagctacatttaatgcaa

SEQ ID NO: 7661948 - DNA, 22 bp, Homo sapiens
gtggcagcggtgtgcaaggagg

SEQ ID NO: 7661949 - DNA, 22 bp, Homo sapiens
gtggcagctacatttaatgcaa

SEQ ID NO: 7661950 - DNA, 22 bp, Homo sapiens
gtggcagcggtgtgcaaggagg

SEQ ID NO: 7661951 - DNA, 22 bp, Homo sapiens
gtggcagcggtgtgcaaggagg

SEQ ID NO: 7661952 - DNA, 22 bp, Homo sapiens
gtggcagcggcccaggccgtct

SEQ ID NO: 7661953 - DNA, 22 bp, Homo sapiens
gtggcagccgcaggccctgtgt

SEQ ID NO: 7661954 - DNA, 22 bp, Homo sapiens
gtggcagccgcaggccctgtgt

SEQ ID NO: 7661955 - DNA, 22 bp, Homo sapiens
gtggcagccgcaggccctgtgt

SEQ ID NO: 7661956 - DNA, 16 bp, Homo sapiens
gtggcagccccttctc

SEQ ID NO: 7661957 - DNA, 22 bp, Homo sapiens
gtggcagcggcccaggccgtct

SEQ ID NO: 7661958 - DNA, 22 bp, Homo sapiens
gtggcagcggcccaggccgtct

SEQ ID NO: 7661959 - DNA, 18 bp, Homo sapiens
gtggcagcctttggcttt

SEQ ID NO: 7661960 - DNA, 22 bp, Homo sapiens
gtggcaaggagcatgaaaagtc

SEQ ID NO: 7661961 - DNA, 22 bp, Homo sapiens
gtggcaaggagcatgaaaagtc

SEQ ID NO: 7661962 - DNA, 22 bp, Homo sapiens
gtggcaagatgactactcactg

SEQ ID NO: 7661963 - DNA, 22 bp, Homo sapiens
gtggcaagtgttccaagaggcg

SEQ ID NO: 7661964 - DNA, 22 bp, Homo sapiens
gtggcaagtgttccaagaggcg

SEQ ID NO: 7661965 - DNA, 22 bp, Homo sapiens
gtggcaagtgttccaagaggcg

SEQ ID NO: 7661966 - DNA, 22 bp, Homo sapiens
gtggcaaggagcatgaaaagtc

SEQ ID NO: 7661967 - DNA, 22 bp, Homo sapiens
gtggcaaggctggaatggaacc

SEQ ID NO: 7661968 - DNA, 22 bp, Homo sapiens
gtggcaaggctggaatggaacc

SEQ ID NO: 7661969 - DNA, 22 bp, Homo sapiens
gtggcaacaaaagagcctagtg

SEQ ID NO: 7661970 - DNA, 21 bp, Homo sapiens
gtggcaagagtaggcattcat

SEQ ID NO: 7661971 - DNA, 21 bp, Homo sapiens
gtggcaagagtaggcattcat

SEQ ID NO: 7661972 - DNA, 22 bp, Homo sapiens
gtggcaacaaaagagcctagtg

SEQ ID NO: 7661973 - DNA, 21 bp, Homo sapiens
gtggcaagagtaggcattcat

SEQ ID NO: 7661974 - DNA, 22 bp, Homo sapiens
gtggattacaagacagttgaga

SEQ ID NO: 7661975 - DNA, 23 bp, Homo sapiens
gtggattccacaggagctgcccc

SEQ ID NO: 7661976 - DNA, 22 bp, Homo sapiens
gtggatggctagttgagaaggg

SEQ ID NO: 7661977 - DNA, 22 bp, Homo sapiens
gtggatggctagttgagaaggg

SEQ ID NO: 7661978 - DNA, 22 bp, Homo sapiens
gtggatggctagttgagaaggg

SEQ ID NO: 7661979 - DNA, 22 bp, Homo sapiens
gtggatggctagttgagaaggg

SEQ ID NO: 7661980 - DNA, 22 bp, Homo sapiens
gtggatggctagttgagaaggg

SEQ ID NO: 7661981 - DNA, 22 bp, Homo sapiens
gtggatggctagttgagaaggg

SEQ ID NO: 7661982 - DNA, 22 bp, Homo sapiens
gtggatggtggtccagtatcat

SEQ ID NO: 7661983 - DNA, 22 bp, Homo sapiens
gtggattacaagacagttgaga

SEQ ID NO: 7661984 - DNA, 22 bp, Homo sapiens
gtggattacaagacagttgaga

SEQ ID NO: 7661985 - DNA, 22 bp, Homo sapiens
gtggattacaagacagttgaga

SEQ ID NO: 7661986 - DNA, 22 bp, Homo sapiens
gtggatggattttgaggaatgg

SEQ ID NO: 7661987 - DNA, 22 bp, Homo sapiens
gtggatggattgaggcagtggg

SEQ ID NO: 7661988 - DNA, 22 bp, Homo sapiens
gtggatggattgaggcagtggg

SEQ ID NO: 7661989 - DNA, 22 bp, Homo sapiens
gtggatggattgaggcagtggg

SEQ ID NO: 7661990 - DNA, 22 bp, Homo sapiens
gtggatggattgaggcagtggg

SEQ ID NO: 7661991 - DNA, 22 bp, Homo sapiens
gtggatggattgaggcagtggg

SEQ ID NO: 7661992 - DNA, 22 bp, Homo sapiens
gtggatggccctgcacacaggt

SEQ ID NO: 7661993 - DNA, 22 bp, Homo sapiens
gtggatggccctgcacacaggt

SEQ ID NO: 7661994 - DNA, 22 bp, Homo sapiens
gtggatggccctgcacacaggt

SEQ ID NO: 7661995 - DNA, 22 bp, Homo sapiens
gtggatggattttgaggaatgg

SEQ ID NO: 7661996 - DNA, 22 bp, Homo sapiens
gtggatggattttgaggaatgg

SEQ ID NO: 7661997 - DNA, 22 bp, Homo sapiens
gtggatggattttgaggaatgg

SEQ ID NO: 7661998 - DNA, 22 bp, Homo sapiens
gtggatggattgaggcagtggg

SEQ ID NO: 7661999 - DNA, 22 bp, Homo sapiens
gtggatggagctggaagccatt

SEQ ID NO: 7662000 - DNA, 22 bp, Homo sapiens
gtggatggattgaggcagtggg

SEQ ID NO: 7662001 - DNA, 22 bp, Homo sapiens
gtggatggattgaggcagtggg

SEQ ID NO: 7662002 - DNA, 22 bp, Homo sapiens
gtggatggattgaggcagtggg

SEQ ID NO: 7662003 - DNA, 22 bp, Homo sapiens
gtggatggagctggaagccatt

SEQ ID NO: 7662004 - DNA, 22 bp, Homo sapiens
gtggatggagcagtgacccagg

SEQ ID NO: 7662005 - DNA, 22 bp, Homo sapiens
gtggatggagctggaagccatt

SEQ ID NO: 7662006 - DNA, 22 bp, Homo sapiens
gtggatggagcagtgacccagg

SEQ ID NO: 7662007 - DNA, 22 bp, Homo sapiens
gtggatggagctggaagccatt

SEQ ID NO: 7662008 - DNA, 22 bp, Homo sapiens
gtggatggagctggaagccatt

SEQ ID NO: 7662009 - DNA, 22 bp, Homo sapiens
gtggatggagctggaagccatt

SEQ ID NO: 7662010 - DNA, 22 bp, Homo sapiens
gtggcacattggtagggtctgt

SEQ ID NO: 7662011 - DNA, 22 bp, Homo sapiens
gtggcagagccgtgcaggtagg

SEQ ID NO: 7662012 - DNA, 22 bp, Homo sapiens
gtggcagagccgtgcaggtagg

SEQ ID NO: 7662013 - DNA, 22 bp, Homo sapiens
gtggcagagccaggctttgaac

SEQ ID NO: 7662014 - DNA, 22 bp, Homo sapiens
gtggcagagccaggctttgaac

SEQ ID NO: 7662015 - DNA, 22 bp, Homo sapiens
gtggcacagtgggagagcccca

SEQ ID NO: 7662016 - DNA, 22 bp, Homo sapiens
gtggcacagtctgaaattttga

SEQ ID NO: 7662017 - DNA, 22 bp, Homo sapiens
gtggcacagtgggagagcccca

SEQ ID NO: 7662018 - DNA, 22 bp, Homo sapiens
gtggcacagtgggagagcccca

SEQ ID NO: 7662019 - DNA, 22 bp, Homo sapiens
gtggcacataggatcctgtggc

SEQ ID NO: 7662020 - DNA, 22 bp, Homo sapiens
gtggcacataggatcctgtggc

SEQ ID NO: 7662021 - DNA, 22 bp, Homo sapiens
gtggcacattggtagggtctgt

SEQ ID NO: 7662022 - DNA, 22 bp, Homo sapiens
gtggcacattggtagggtctgt

SEQ ID NO: 7662023 - DNA, 22 bp, Homo sapiens
gtggcacagagatggggcatga

SEQ ID NO: 7662024 - DNA, 22 bp, Homo sapiens
gtggcacagagatggggcatga

SEQ ID NO: 7662025 - DNA, 22 bp, Homo sapiens
gtggcacagagatggggcatga

SEQ ID NO: 7662026 - DNA, 22 bp, Homo sapiens
gtggcacagggttgttggtcat

SEQ ID NO: 7662027 - DNA, 22 bp, Homo sapiens
gtggcacagggtgtggcacaca

SEQ ID NO: 7662028 - DNA, 22 bp, Homo sapiens
gtggcacagggtgtggcacaca

SEQ ID NO: 7662029 - DNA, 22 bp, Homo sapiens
gtggcacagggtgtggcacaca

SEQ ID NO: 7662030 - DNA, 22 bp, Homo sapiens
gtggcacagggtgtggcacaca

SEQ ID NO: 7662031 - DNA, 22 bp, Homo sapiens
gtggcacagccaagcctcactc

SEQ ID NO: 7662032 - DNA, 22 bp, Homo sapiens
gtggcacagccaagcctcactc

SEQ ID NO: 7662033 - DNA, 22 bp, Homo sapiens
gtggcacaaggcttacacagca

SEQ ID NO: 7662034 - DNA, 22 bp, Homo sapiens
gtggcaagtgttccaagaggcg

SEQ ID NO: 7662035 - DNA, 22 bp, Homo sapiens
gtggcaaggctggaatggaacc

SEQ ID NO: 7662036 - DNA, 22 bp, Homo sapiens
gtggcacaaggcttacacagca

SEQ ID NO: 7662037 - DNA, 22 bp, Homo sapiens
gtggcacacaggagagagctca

SEQ ID NO: 7662038 - DNA, 22 bp, Homo sapiens
gtggcacacaggagagagctca

SEQ ID NO: 7662039 - DNA, 22 bp, Homo sapiens
gtggcacacaggagagagctca

SEQ ID NO: 7662040 - DNA, 22 bp, Homo sapiens
gtggcacacaggagagagctca

SEQ ID NO: 7662041 - DNA, 22 bp, Homo sapiens
gtggcacagaagtttagagaac

SEQ ID NO: 7662042 - DNA, 22 bp, Homo sapiens
gtggcacacaggagagagctca

SEQ ID NO: 7662043 - DNA, 22 bp, Homo sapiens
gtggcacacaggagagagctca

SEQ ID NO: 7662044 - DNA, 22 bp, Homo sapiens
gtggaggagaggcgccttgcgg

SEQ ID NO: 7662045 - DNA, 22 bp, Homo sapiens
gtggaggagaggcgccttgcgg

SEQ ID NO: 7662046 - DNA, 22 bp, Homo sapiens
gtggaggagaggcgccttgcgg

SEQ ID NO: 7662047 - DNA, 22 bp, Homo sapiens
gtggaggacaaaagaagccttt

SEQ ID NO: 7662048 - DNA, 22 bp, Homo sapiens
gtggaggacaaaagaagccttt

SEQ ID NO: 7662049 - DNA, 22 bp, Homo sapiens
gtggaggcagtgacacagtagc

SEQ ID NO: 7662050 - DNA, 22 bp, Homo sapiens
gtggaggcagtgacacagtagc

SEQ ID NO: 7662051 - DNA, 22 bp, Homo sapiens
gtggagggaatgaatcttctct

SEQ ID NO: 7662052 - DNA, 22 bp, Homo sapiens
gtggagggaatgaatcttctct

SEQ ID NO: 7662053 - DNA, 22 bp, Homo sapiens
gtggagggtgagctcatgtttg

SEQ ID NO: 7662054 - DNA, 22 bp, Homo sapiens
gtggagggtgagctcatgtttg

SEQ ID NO: 7662055 - DNA, 22 bp, Homo sapiens
gtggagggtgagctcatgtttg

SEQ ID NO: 7662056 - DNA, 22 bp, Homo sapiens
gtggagggaatgaatcttctct

SEQ ID NO: 7662057 - DNA, 22 bp, Homo sapiens
gtggagggaatgaatcttctct

SEQ ID NO: 7662058 - DNA, 22 bp, Homo sapiens
gtggagggaatgaatcttctct

SEQ ID NO: 7662059 - DNA, 22 bp, Homo sapiens
gtggagggaatgaatcttctct

SEQ ID NO: 7662060 - DNA, 22 bp, Homo sapiens
gtggagggaatgaatcttctct

SEQ ID NO: 7662061 - DNA, 22 bp, Homo sapiens
gtggagggaatgaatcttctct

SEQ ID NO: 7662062 - DNA, 22 bp, Homo sapiens
gtggagggaatgaatcttctct

SEQ ID NO: 7662063 - DNA, 22 bp, Homo sapiens
gtggagggaatgaatcttctct

SEQ ID NO: 7662064 - DNA, 22 bp, Homo sapiens
gtggagggtgattgccggctgt

SEQ ID NO: 7662065 - DNA, 22 bp, Homo sapiens
gtggagggtgattgccggctgt

SEQ ID NO: 7662066 - DNA, 22 bp, Homo sapiens
gtggagggtgattgccggctgt

SEQ ID NO: 7662067 - DNA, 22 bp, Homo sapiens
gtggagggtgattgccggctgt

SEQ ID NO: 7662068 - DNA, 22 bp, Homo sapiens
gtggagggtgattgccggctgt

SEQ ID NO: 7662069 - DNA, 22 bp, Homo sapiens
gtggagggtgattgccggctgt

SEQ ID NO: 7662070 - DNA, 22 bp, Homo sapiens
gtggagggtgattgccggctgt

SEQ ID NO: 7662071 - DNA, 22 bp, Homo sapiens
gtggagggtgattgccggctgt

SEQ ID NO: 7662072 - DNA, 22 bp, Homo sapiens
gtggagggtgattgccggctgt

SEQ ID NO: 7662073 - DNA, 18 bp, Homo sapiens
gtggagggttctcagaat

SEQ ID NO: 7662074 - DNA, 18 bp, Homo sapiens
gtggagggttctcagaat

SEQ ID NO: 7662075 - DNA, 18 bp, Homo sapiens
gtggagggttctcagaat

SEQ ID NO: 7662076 - DNA, 18 bp, Homo sapiens
gtggagggttctcagaat

SEQ ID NO: 7662077 - DNA, 18 bp, Homo sapiens
gtggagggttctcagaat

SEQ ID NO: 7662078 - DNA, 18 bp, Homo sapiens
gtggagggttctcagaat

SEQ ID NO: 7662079 - DNA, 18 bp, Homo sapiens
gtggagggttctcagaat

SEQ ID NO: 7662080 - DNA, 18 bp, Homo sapiens
gtggagggttctcagaat

SEQ ID NO: 7662081 - DNA, 22 bp, Homo sapiens
gtggagggtttgcaatgtgcag

SEQ ID NO: 7662082 - DNA, 22 bp, Homo sapiens
gtggagggtttgcaatgtgcag

SEQ ID NO: 7662083 - DNA, 22 bp, Homo sapiens
gtggagggtttgcaatgtgcag

SEQ ID NO: 7662084 - DNA, 22 bp, Homo sapiens
gtggagggtttgcaatgtgcag

SEQ ID NO: 7662085 - DNA, 22 bp, Homo sapiens
gtggagggtttgcaatgtgcag

SEQ ID NO: 7662086 - DNA, 22 bp, Homo sapiens
gtggagtggtgatggataggtt

SEQ ID NO: 7662087 - DNA, 22 bp, Homo sapiens
gtggagtggtgatggataggtt

SEQ ID NO: 7662088 - DNA, 22 bp, Homo sapiens
gtggagtggtgatggataggtt

SEQ ID NO: 7662089 - DNA, 22 bp, Homo sapiens
gtggagtggtgatggataggtt

SEQ ID NO: 7662090 - DNA, 22 bp, Homo sapiens
gtggagtggtgatggataggtt

SEQ ID NO: 7662091 - DNA, 22 bp, Homo sapiens
gtggatgagataactgtagaag

SEQ ID NO: 7662092 - DNA, 22 bp, Homo sapiens
gtggatctactgtatgggatag

SEQ ID NO: 7662093 - DNA, 22 bp, Homo sapiens
gtggatctactgtatgggatag

SEQ ID NO: 7662094 - DNA, 22 bp, Homo sapiens
gtggatggacatgggcaagagg

SEQ ID NO: 7662095 - DNA, 22 bp, Homo sapiens
gtggatggacatgggcaagagg

SEQ ID NO: 7662096 - DNA, 22 bp, Homo sapiens
gtggatggacatgggcaagagg

SEQ ID NO: 7662097 - DNA, 22 bp, Homo sapiens
gtggatggacatgggcaagagg

SEQ ID NO: 7662098 - DNA, 22 bp, Homo sapiens
gtggatgcttaggcagcctggg

SEQ ID NO: 7662099 - DNA, 22 bp, Homo sapiens
gtggatgcttaggcagcctggg

SEQ ID NO: 7662100 - DNA, 22 bp, Homo sapiens
gtggatgcttaggcagcctggg

SEQ ID NO: 7662101 - DNA, 22 bp, Homo sapiens
gtggatgattgactctgtagac

SEQ ID NO: 7662102 - DNA, 18 bp, Homo sapiens
gtggatgcattgggaggg

SEQ ID NO: 7662103 - DNA, 22 bp, Homo sapiens
gtggatgcttaggcagcctggg

SEQ ID NO: 7662104 - DNA, 20 bp, Homo sapiens
gtggatgatcagtgtagtgg

SEQ ID NO: 7662105 - DNA, 22 bp, Homo sapiens
gtggatgattgactctgtagac

SEQ ID NO: 7662106 - DNA, 22 bp, Homo sapiens
gtggatgatgagtgactacaga

SEQ ID NO: 7662107 - DNA, 20 bp, Homo sapiens
gtggatgatcagtgtagtgg

SEQ ID NO: 7662108 - DNA, 17 bp, Homo sapiens
gtggaggtgctctggta

SEQ ID NO: 7662109 - DNA, 17 bp, Homo sapiens
gtggaggtgctctggta

SEQ ID NO: 7662110 - DNA, 17 bp, Homo sapiens
gtggaggtgctctggta

SEQ ID NO: 7662111 - DNA, 22 bp, Homo sapiens
gtggagtgcaacggttggagtt

SEQ ID NO: 7662112 - DNA, 22 bp, Homo sapiens
gtggagtgcaacggttggagtt

SEQ ID NO: 7662113 - DNA, 22 bp, Homo sapiens
gtggagtggcctggccctgaga

SEQ ID NO: 7662114 - DNA, 22 bp, Homo sapiens
gtggagtggcctggccctgaga

SEQ ID NO: 7662115 - DNA, 22 bp, Homo sapiens
gtggagtggcctggccctgaga

SEQ ID NO: 7662116 - DNA, 22 bp, Homo sapiens
gtggagtggcctggccctgaga

SEQ ID NO: 7662117 - DNA, 22 bp, Homo sapiens
gtggagtggcctggccctgaga

SEQ ID NO: 7662118 - DNA, 22 bp, Homo sapiens
gtggagggtttgcaatgtgcag

SEQ ID NO: 7662119 - DNA, 22 bp, Homo sapiens
gtggaggtcccgggcaggagca

SEQ ID NO: 7662120 - DNA, 22 bp, Homo sapiens
gtggagggtttgcaatgtgcag

SEQ ID NO: 7662121 - DNA, 22 bp, Homo sapiens
gtggaggtcccgggcaggagca

SEQ ID NO: 7662122 - DNA, 22 bp, Homo sapiens
gtggaggtcccgggcaggagca

SEQ ID NO: 7662123 - DNA, 22 bp, Homo sapiens
gtggaggtcccgggcaggagca

SEQ ID NO: 7662124 - DNA, 22 bp, Homo sapiens
gtggagggtttgcaatgtgcag

SEQ ID NO: 7662125 - DNA, 22 bp, Homo sapiens
gtggaggtcccgggcaggagca

SEQ ID NO: 7662126 - DNA, 22 bp, Homo sapiens
gtggaggtcccgggcaggagca

SEQ ID NO: 7662127 - DNA, 22 bp, Homo sapiens
gtggaggacaaaagaagccttt

SEQ ID NO: 7662128 - DNA, 22 bp, Homo sapiens
gtggaggaaaagaagttgggtg

SEQ ID NO: 7662129 - DNA, 22 bp, Homo sapiens
gtggaggacaaaagaagccttt

SEQ ID NO: 7662130 - DNA, 22 bp, Homo sapiens
gtggaggacaaaagaagccttt

SEQ ID NO: 7662131 - DNA, 19 bp, Homo sapiens
gtggagctaagaaaaggaa

SEQ ID NO: 7662132 - DNA, 22 bp, Homo sapiens
gtggagctggacccaggcctct

SEQ ID NO: 7662133 - DNA, 22 bp, Homo sapiens
gtggagctggacccaggcctct

SEQ ID NO: 7662134 - DNA, 22 bp, Homo sapiens
gtggagccctggtagggacccc

SEQ ID NO: 7662135 - DNA, 22 bp, Homo sapiens
gtggagccctggtagggacccc

SEQ ID NO: 7662136 - DNA, 22 bp, Homo sapiens
gtggagctggcccaagaagctg

SEQ ID NO: 7662137 - DNA, 22 bp, Homo sapiens
gtggagctggcccaagaagctg

SEQ ID NO: 7662138 - DNA, 22 bp, Homo sapiens
gtggaggaaaagaagttgggtg

SEQ ID NO: 7662139 - DNA, 22 bp, Homo sapiens
gtggaggaaaagaagttgggtg

SEQ ID NO: 7662140 - DNA, 23 bp, Homo sapiens
gtggagagattagtaattcaccc

SEQ ID NO: 7662141 - DNA, 22 bp, Homo sapiens
gtggagagcaaataattggaat

SEQ ID NO: 7662142 - DNA, 22 bp, Homo sapiens
gtggagagcaaataattggaat

SEQ ID NO: 7662143 - DNA, 23 bp, Homo sapiens
gtggagagattagtaattcaccc

SEQ ID NO: 7662144 - DNA, 22 bp, Homo sapiens
gtggagagagtgacagcatctt

SEQ ID NO: 7662145 - DNA, 23 bp, Homo sapiens
gtggagagattagtaattcaccc

SEQ ID NO: 7662146 - DNA, 22 bp, Homo sapiens
gtggagagagtgacagcatctt

SEQ ID NO: 7662147 - DNA, 22 bp, Homo sapiens
gtggagagagtgacagcatctt

SEQ ID NO: 7662148 - DNA, 22 bp, Homo sapiens
gtggagagagataagcctggtc

SEQ ID NO: 7662149 - DNA, 22 bp, Homo sapiens
gtggagagagataagcctggtc

SEQ ID NO: 7662150 - DNA, 22 bp, Homo sapiens
gtggagagagataagcctggtc

SEQ ID NO: 7662151 - DNA, 22 bp, Homo sapiens
gtggagagagtgacagcatctt

SEQ ID NO: 7662152 - DNA, 22 bp, Homo sapiens
gtggagagagtgacagcatctt

SEQ ID NO: 7662153 - DNA, 22 bp, Homo sapiens
gtggagagagtgacagcatctt

SEQ ID NO: 7662154 - DNA, 22 bp, Homo sapiens
gtggagaggaacccagctctgt

SEQ ID NO: 7662155 - DNA, 22 bp, Homo sapiens
gtggagaggaacccagctctgt

SEQ ID NO: 7662156 - DNA, 22 bp, Homo sapiens
gtggagaggaacccagctctgt

SEQ ID NO: 7662157 - DNA, 22 bp, Homo sapiens
gtggagaggaacccagctctgt

SEQ ID NO: 7662158 - DNA, 22 bp, Homo sapiens
gtggagaggaacccagctctgt

SEQ ID NO: 7662159 - DNA, 22 bp, Homo sapiens
gtggagaggaacccagctctgt

SEQ ID NO: 7662160 - DNA, 22 bp, Homo sapiens
gtggagccctggtagggacccc

SEQ ID NO: 7662161 - DNA, 22 bp, Homo sapiens
gtggagagcaaataattggaat

SEQ ID NO: 7662162 - DNA, 22 bp, Homo sapiens
gtggagaggaacccagctctgt

SEQ ID NO: 7662163 - DNA, 22 bp, Homo sapiens
gtggagagcaaataattggaat

SEQ ID NO: 7662164 - DNA, 22 bp, Homo sapiens
gtggagaggaacccagctctgt

SEQ ID NO: 7662165 - DNA, 22 bp, Homo sapiens
gtggagacctcctaggatgtgt

SEQ ID NO: 7662166 - DNA, 22 bp, Homo sapiens
gtggacttgctgtcctggactt

SEQ ID NO: 7662167 - DNA, 22 bp, Homo sapiens
gtggacatgcatacatatgttt

SEQ ID NO: 7662168 - DNA, 22 bp, Homo sapiens
gtggacaggcaggctgtcgggg

SEQ ID NO: 7662169 - DNA, 22 bp, Homo sapiens
gtggacatgcatacatatgttt

SEQ ID NO: 7662170 - DNA, 22 bp, Homo sapiens
gtggaccaaggtggaagataaa

SEQ ID NO: 7662171 - DNA, 22 bp, Homo sapiens
gtggacaggcaggctgtcgggg

SEQ ID NO: 7662172 - DNA, 22 bp, Homo sapiens
gtggacatgcatacatatgttt

SEQ ID NO: 7662173 - DNA, 22 bp, Homo sapiens
gtggagagagataagcctggtc

SEQ ID NO: 7662174 - DNA, 22 bp, Homo sapiens
gtggagagagataagcctggtc

SEQ ID NO: 7662175 - DNA, 22 bp, Homo sapiens
gtggagagagataagcctggtc

SEQ ID NO: 7662176 - DNA, 17 bp, Homo sapiens
gtggagacagatgcctc

SEQ ID NO: 7662177 - DNA, 22 bp, Homo sapiens
gtggagacgggacagaagctaa

SEQ ID NO: 7662178 - DNA, 22 bp, Homo sapiens
gtggagagagataagcctggtc

SEQ ID NO: 7662179 - DNA, 22 bp, Homo sapiens
gtggagagagataagcctggtc

SEQ ID NO: 7662180 - DNA, 22 bp, Homo sapiens
gtggagagagataagcctggtc

SEQ ID NO: 7662181 - DNA, 22 bp, Homo sapiens
gtggagagagataagcctggtc

SEQ ID NO: 7662182 - DNA, 22 bp, Homo sapiens
gtggagagagataagcctggtc

SEQ ID NO: 7662183 - DNA, 22 bp, Homo sapiens
gtggacagagctagaaaatgtg

SEQ ID NO: 7662184 - DNA, 22 bp, Homo sapiens
gtggacagagataataaactga

SEQ ID NO: 7662185 - DNA, 22 bp, Homo sapiens
gtggacagagactaaatgttgt

SEQ ID NO: 7662186 - DNA, 22 bp, Homo sapiens
gtggacagagactaaatgttgt

SEQ ID NO: 7662187 - DNA, 22 bp, Homo sapiens
gtggacagagactaaatgttgt

SEQ ID NO: 7662188 - DNA, 22 bp, Homo sapiens
gtggacagacataatcctaatt

SEQ ID NO: 7662189 - DNA, 22 bp, Homo sapiens
gtggacagagactaaatgttgt

SEQ ID NO: 7662190 - DNA, 22 bp, Homo sapiens
gtggaatttttacctatgaatg

SEQ ID NO: 7662191 - DNA, 22 bp, Homo sapiens
gtggaattgctggataatatca

SEQ ID NO: 7662192 - DNA, 22 bp, Homo sapiens
gtggacacaggagagagaactg

SEQ ID NO: 7662193 - DNA, 22 bp, Homo sapiens
gtggacactggcagcagctcag

SEQ ID NO: 7662194 - DNA, 22 bp, Homo sapiens
gtggacagacataatcctaatt

SEQ ID NO: 7662195 - DNA, 22 bp, Homo sapiens
gtggacagcttctaggtgccag

SEQ ID NO: 7662196 - DNA, 22 bp, Homo sapiens
gtggacaggcaggctgtcgggg

SEQ ID NO: 7662197 - DNA, 22 bp, Homo sapiens
gtggacagcttctaggtgccag

SEQ ID NO: 7662198 - DNA, 22 bp, Homo sapiens
gtggacagcttctaggtgccag

SEQ ID NO: 7662199 - DNA, 22 bp, Homo sapiens
gtggacagcttctaggtgccag

SEQ ID NO: 7662200 - DNA, 22 bp, Homo sapiens
gtggacagcttctaggtgccag

SEQ ID NO: 7662201 - DNA, 22 bp, Homo sapiens
gtggacagagctagaaaatgtg

SEQ ID NO: 7662202 - DNA, 22 bp, Homo sapiens
gtggacagagataataaactga

SEQ ID NO: 7662203 - DNA, 22 bp, Homo sapiens
gtggacagcttctaggtgccag

SEQ ID NO: 7662204 - DNA, 22 bp, Homo sapiens
gtggacagcttctaggtgccag

SEQ ID NO: 7662205 - DNA, 22 bp, Homo sapiens
gtggacagcttctaggtgccag

SEQ ID NO: 7662206 - DNA, 22 bp, Homo sapiens
gtggacagcttctaggtgccag

SEQ ID NO: 7662207 - DNA, 22 bp, Homo sapiens
gtggacagcttctaggtgccag

SEQ ID NO: 7662208 - DNA, 22 bp, Homo sapiens
gtggacagcttctaggtgccag

SEQ ID NO: 7662209 - DNA, 22 bp, Homo sapiens
gttattttaacttctcagtaat

SEQ ID NO: 7662210 - DNA, 22 bp, Homo sapiens
gttattttaacttctcagtaat

SEQ ID NO: 7662211 - DNA, 22 bp, Homo sapiens
gttattttaacttctcagtaat

SEQ ID NO: 7662212 - DNA, 22 bp, Homo sapiens
gttattttaacttctcagtaat

SEQ ID NO: 7662213 - DNA, 22 bp, Homo sapiens
gtgtgtcctcagtagtggcatg

SEQ ID NO: 7662214 - DNA, 22 bp, Homo sapiens
gtgtgtcctcagtagtggcatg

SEQ ID NO: 7662215 - DNA, 22 bp, Homo sapiens
gtgtgtcctcagtagtggcatg

SEQ ID NO: 7662216 - DNA, 22 bp, Homo sapiens
gttattttaacttctcagtaat

SEQ ID NO: 7662217 - DNA, 22 bp, Homo sapiens
gttattttaacttctcagtaat

SEQ ID NO: 7662218 - DNA, 22 bp, Homo sapiens
gttattttaacttctcagtaat

SEQ ID NO: 7662219 - DNA, 22 bp, Homo sapiens
gttattttaacttctcagtaat

SEQ ID NO: 7662220 - DNA, 21 bp, Homo sapiens
gttattttaagtgagctttgc

SEQ ID NO: 7662221 - DNA, 21 bp, Homo sapiens
gttattttaagtgagctttgc

SEQ ID NO: 7662222 - DNA, 21 bp, Homo sapiens
gttattttaagtgagctttgc

SEQ ID NO: 7662223 - DNA, 21 bp, Homo sapiens
gttattttaagtgagctttgc

SEQ ID NO: 7662224 - DNA, 21 bp, Homo sapiens
gttattttaagtgagctttgc

SEQ ID NO: 7662225 - DNA, 21 bp, Homo sapiens
gttattttaagtgagctttgc

SEQ ID NO: 7662226 - DNA, 21 bp, Homo sapiens
gttattttaagtgagctttgc

SEQ ID NO: 7662227 - DNA, 21 bp, Homo sapiens
gttattttaagtgagctttgc

SEQ ID NO: 7662228 - DNA, 21 bp, Homo sapiens
gttattttaagtgagctttgc

SEQ ID NO: 7662229 - DNA, 21 bp, Homo sapiens
gttattttaagtgagctttgc

SEQ ID NO: 7662230 - DNA, 22 bp, Homo sapiens
gttattttaacttctcagtaat

SEQ ID NO: 7662231 - DNA, 22 bp, Homo sapiens
gtgtgtccaaggccacaatagc

SEQ ID NO: 7662232 - DNA, 22 bp, Homo sapiens
gtgtgtccaggcgggagtcaag

SEQ ID NO: 7662233 - DNA, 23 bp, Homo sapiens
gtgtgtccattcgcactcttagg

SEQ ID NO: 7662234 - DNA, 22 bp, Homo sapiens
gtgtgtccctcctctcctgagt

SEQ ID NO: 7662235 - DNA, 22 bp, Homo sapiens
gtgtgtccctacaacagcttca

SEQ ID NO: 7662236 - DNA, 22 bp, Homo sapiens
gtgtgtcccttggaacctcagc

SEQ ID NO: 7662237 - DNA, 22 bp, Homo sapiens
gttattttcattggctcagact

SEQ ID NO: 7662238 - DNA, 22 bp, Homo sapiens
gttattttcattggctcagact

SEQ ID NO: 7662239 - DNA, 22 bp, Homo sapiens
gttattttcattggctcagact

SEQ ID NO: 7662240 - DNA, 22 bp, Homo sapiens
gttattttcattggctcagact

SEQ ID NO: 7662241 - DNA, 22 bp, Homo sapiens
gttattttcattggctcagact

SEQ ID NO: 7662242 - DNA, 22 bp, Homo sapiens
gttattttcattggctcagact

SEQ ID NO: 7662243 - DNA, 22 bp, Homo sapiens
gttattttcattggctcagact

SEQ ID NO: 7662244 - DNA, 22 bp, Homo sapiens
gttattttcattggctcagact

SEQ ID NO: 7662245 - DNA, 22 bp, Homo sapiens
gttattttcattggctcagact

SEQ ID NO: 7662246 - DNA, 22 bp, Homo sapiens
gttattttcattggctcagact

SEQ ID NO: 7662247 - DNA, 22 bp, Homo sapiens
gttattttcattggctcagact

SEQ ID NO: 7662248 - DNA, 22 bp, Homo sapiens
gttcaaaattcaaatggtatac

SEQ ID NO: 7662249 - DNA, 22 bp, Homo sapiens
gttcaaaattcaaatggtatac

SEQ ID NO: 7662250 - DNA, 22 bp, Homo sapiens
gttcaaaattcaaatggtatac

SEQ ID NO: 7662251 - DNA, 22 bp, Homo sapiens
gttcaaaattcaaatggtatac

SEQ ID NO: 7662252 - DNA, 19 bp, Homo sapiens
gttcaaacactgattcagc

SEQ ID NO: 7662253 - DNA, 22 bp, Homo sapiens
gttcaaagctcctggtacagta

SEQ ID NO: 7662254 - DNA, 22 bp, Homo sapiens
gttattttatctctgagaggtt

SEQ ID NO: 7662255 - DNA, 22 bp, Homo sapiens
gttattttatctctgagaggtt

SEQ ID NO: 7662256 - DNA, 22 bp, Homo sapiens
gttattttatctctgagaggtt

SEQ ID NO: 7662257 - DNA, 22 bp, Homo sapiens
gttattttatctctgagaggtt

SEQ ID NO: 7662258 - DNA, 22 bp, Homo sapiens
gttattttatctctgagaggtt

SEQ ID NO: 7662259 - DNA, 22 bp, Homo sapiens
gttattttatctctgagaggtt

SEQ ID NO: 7662260 - DNA, 22 bp, Homo sapiens
gttattttatctctgagaggtt

SEQ ID NO: 7662261 - DNA, 22 bp, Homo sapiens
gttattttatctctgagaggtt

SEQ ID NO: 7662262 - DNA, 21 bp, Homo sapiens
gttattttaagtgagctttgc

SEQ ID NO: 7662263 - DNA, 22 bp, Homo sapiens
gttattttcattggctcagact

SEQ ID NO: 7662264 - DNA, 22 bp, Homo sapiens
gttattttcattggctcagact

SEQ ID NO: 7662265 - DNA, 22 bp, Homo sapiens
gttattttcattggctcagact

SEQ ID NO: 7662266 - DNA, 22 bp, Homo sapiens
gttattttatctctgagaggtt

SEQ ID NO: 7662267 - DNA, 22 bp, Homo sapiens
gttattttatctctgagaggtt

SEQ ID NO: 7662268 - DNA, 22 bp, Homo sapiens
gttattttatctctgagaggtt

SEQ ID NO: 7662269 - DNA, 22 bp, Homo sapiens
gttattttatctctgagaggtt

SEQ ID NO: 7662270 - DNA, 22 bp, Homo sapiens
gttcaagaccagcctggccaac

SEQ ID NO: 7662271 - DNA, 22 bp, Homo sapiens
gttcaagaccagcctggccaac

SEQ ID NO: 7662272 - DNA, 22 bp, Homo sapiens
gttcaagaccagcctggccaac

SEQ ID NO: 7662273 - DNA, 22 bp, Homo sapiens
gttcaaattttggctgtactgc

SEQ ID NO: 7662274 - DNA, 22 bp, Homo sapiens
gttcaaattttggctgtactgc

SEQ ID NO: 7662275 - DNA, 22 bp, Homo sapiens
gttcaaattttggctgtactgc

SEQ ID NO: 7662276 - DNA, 22 bp, Homo sapiens
gttcaaattttctaggtgggtg

SEQ ID NO: 7662277 - DNA, 22 bp, Homo sapiens
gttcaaattgagatggtataaa

SEQ ID NO: 7662278 - DNA, 22 bp, Homo sapiens
gttcaaattgattttggtaaag

SEQ ID NO: 7662279 - DNA, 22 bp, Homo sapiens
gttcaaattgattttggtaaag

SEQ ID NO: 7662280 - DNA, 22 bp, Homo sapiens
gttcaaattgattttggtaaag

SEQ ID NO: 7662281 - DNA, 22 bp, Homo sapiens
gttcaagaccagcctggccaac

SEQ ID NO: 7662282 - DNA, 22 bp, Homo sapiens
gttcaagaccagcctggccaac

SEQ ID NO: 7662283 - DNA, 22 bp, Homo sapiens
gttcaaatctcaggacttcaga

SEQ ID NO: 7662284 - DNA, 22 bp, Homo sapiens
gttcaaatctcaggacttcaga

SEQ ID NO: 7662285 - DNA, 21 bp, Homo sapiens
gttcaaatcctgacactacac

SEQ ID NO: 7662286 - DNA, 21 bp, Homo sapiens
gttcaaatcctgacactacac

SEQ ID NO: 7662287 - DNA, 21 bp, Homo sapiens
gttcaaatcctgacactacac

SEQ ID NO: 7662288 - DNA, 22 bp, Homo sapiens
gttcaaatggctgcagttacca

SEQ ID NO: 7662289 - DNA, 22 bp, Homo sapiens
gttcaaatctcaggacttcaga

SEQ ID NO: 7662290 - DNA, 22 bp, Homo sapiens
gttcaaatctcaggacttcaga

SEQ ID NO: 7662291 - DNA, 22 bp, Homo sapiens
gttcaaatggctgcagttacca

SEQ ID NO: 7662292 - DNA, 22 bp, Homo sapiens
gttcaaatggctgcagttacca

SEQ ID NO: 7662293 - DNA, 22 bp, Homo sapiens
gttcaaatggctgcagttacca

SEQ ID NO: 7662294 - DNA, 21 bp, Homo sapiens
gttcaaatgggtagattcaca

SEQ ID NO: 7662295 - DNA, 21 bp, Homo sapiens
gttcaaatgggtagattcaca

SEQ ID NO: 7662296 - DNA, 21 bp, Homo sapiens
gttcaaatgggtagattcaca

SEQ ID NO: 7662297 - DNA, 21 bp, Homo sapiens
gttcaaatgggtagattcaca

SEQ ID NO: 7662298 - DNA, 21 bp, Homo sapiens
gttcaaatgggtagattcaca

SEQ ID NO: 7662299 - DNA, 22 bp, Homo sapiens
gttcaaattgagatggtataaa

SEQ ID NO: 7662300 - DNA, 22 bp, Homo sapiens
gttcaaattgagatggtataaa

SEQ ID NO: 7662301 - DNA, 22 bp, Homo sapiens
gttcaaattgagatggtataaa

SEQ ID NO: 7662302 - DNA, 22 bp, Homo sapiens
gttcaaattctatgaaatatgt

SEQ ID NO: 7662303 - DNA, 22 bp, Homo sapiens
gttcaaattctatgaaatatgt

SEQ ID NO: 7662304 - DNA, 22 bp, Homo sapiens
gttcaaattctatgaaatatgt

SEQ ID NO: 7662305 - DNA, 22 bp, Homo sapiens
gttcaaattctatgaaatatgt

SEQ ID NO: 7662306 - DNA, 22 bp, Homo sapiens
gttctaataggagaaaagacag

SEQ ID NO: 7662307 - DNA, 22 bp, Homo sapiens
gttctaataggagaaaagacag

SEQ ID NO: 7662308 - DNA, 22 bp, Homo sapiens
gttcaagtctggggctgccagt

SEQ ID NO: 7662309 - DNA, 22 bp, Homo sapiens
gttctaagggcttgaaatgtat

SEQ ID NO: 7662310 - DNA, 22 bp, Homo sapiens
gttcaaggttttacagagtgta

SEQ ID NO: 7662311 - DNA, 22 bp, Homo sapiens
gttcaagtctggggctgccagt

SEQ ID NO: 7662312 - DNA, 22 bp, Homo sapiens
gttcaaggttttacagagtgta

SEQ ID NO: 7662313 - DNA, 18 bp, Homo sapiens
gttcaaggtcaagagaga

SEQ ID NO: 7662314 - DNA, 22 bp, Homo sapiens
gttcaaggttttacagagtgta

SEQ ID NO: 7662315 - DNA, 22 bp, Homo sapiens
gttcaaggttttacagagtgta

SEQ ID NO: 7662316 - DNA, 18 bp, Homo sapiens
gttcaaggtcaagagaga

SEQ ID NO: 7662317 - DNA, 22 bp, Homo sapiens
gttcaagggctgtgtatgtggt

SEQ ID NO: 7662318 - DNA, 18 bp, Homo sapiens
gttcaaggtcaagagaga

SEQ ID NO: 7662319 - DNA, 18 bp, Homo sapiens
gttcaaggtcaagagaga

SEQ ID NO: 7662320 - DNA, 18 bp, Homo sapiens
gttcaagccaacatcaag

SEQ ID NO: 7662321 - DNA, 22 bp, Homo sapiens
gttcaaggaagggaggaaagcc

SEQ ID NO: 7662322 - DNA, 22 bp, Homo sapiens
gttcaaggaagggaggaaagcc

SEQ ID NO: 7662323 - DNA, 22 bp, Homo sapiens
gttcaaggaagggaggaaagcc

SEQ ID NO: 7662324 - DNA, 22 bp, Homo sapiens
gttcaaggaagggaggaaagcc

SEQ ID NO: 7662325 - DNA, 22 bp, Homo sapiens
gttcaagaccagcctggccaac

SEQ ID NO: 7662326 - DNA, 22 bp, Homo sapiens
gttcaagaccagcctggccaac

SEQ ID NO: 7662327 - DNA, 22 bp, Homo sapiens
gttctattactccctgcttctt

SEQ ID NO: 7662328 - DNA, 22 bp, Homo sapiens
gttctattactccctgcttctt

SEQ ID NO: 7662329 - DNA, 22 bp, Homo sapiens
gttctaggtatagtaagaaatt

SEQ ID NO: 7662330 - DNA, 22 bp, Homo sapiens
gttctatgttgagatagctaat

SEQ ID NO: 7662331 - DNA, 22 bp, Homo sapiens
gttctagcctggggctccttgg

SEQ ID NO: 7662332 - DNA, 22 bp, Homo sapiens
gttctaggagccaagaatatag

SEQ ID NO: 7662333 - DNA, 22 bp, Homo sapiens
gttctaggagccaagaatatag

SEQ ID NO: 7662334 - DNA, 22 bp, Homo sapiens
gttctagatgactgagcagctg

SEQ ID NO: 7662335 - DNA, 22 bp, Homo sapiens
gttctagatgactgagcagctg

SEQ ID NO: 7662336 - DNA, 22 bp, Homo sapiens
gttctaggctaggggagtaaga

SEQ ID NO: 7662337 - DNA, 22 bp, Homo sapiens
gttctaggctaggggagtaaga

SEQ ID NO: 7662338 - DNA, 22 bp, Homo sapiens
gttctaggttagaaggacagat

SEQ ID NO: 7662339 - DNA, 22 bp, Homo sapiens
gttctacatgacactcaacatt

SEQ ID NO: 7662340 - DNA, 22 bp, Homo sapiens
gttctacatgacactcaacatt

SEQ ID NO: 7662341 - DNA, 22 bp, Homo sapiens
gttctacatgacactcaacatt

SEQ ID NO: 7662342 - DNA, 21 bp, Homo sapiens
gttctacagttttagaattcc

SEQ ID NO: 7662343 - DNA, 22 bp, Homo sapiens
gttctactttctgtgtctttga

SEQ ID NO: 7662344 - DNA, 22 bp, Homo sapiens
gttctactttctgtgtctttga

SEQ ID NO: 7662345 - DNA, 18 bp, Homo sapiens
gttctagaaattaggtac

SEQ ID NO: 7662346 - DNA, 22 bp, Homo sapiens
gttctacagttcctattactta

SEQ ID NO: 7662347 - DNA, 22 bp, Homo sapiens
gttctaatttggggctccttag

SEQ ID NO: 7662348 - DNA, 22 bp, Homo sapiens
gttctacagttcctattactta

SEQ ID NO: 7662349 - DNA, 22 bp, Homo sapiens
gttctacagttcctattactta

SEQ ID NO: 7662350 - DNA, 22 bp, Homo sapiens
gttctaatattttaaaagccaa

SEQ ID NO: 7662351 - DNA, 22 bp, Homo sapiens
gttctaatattttaaaagccaa

SEQ ID NO: 7662352 - DNA, 22 bp, Homo sapiens
gttctaatttggggctccttag

SEQ ID NO: 7662353 - DNA, 22 bp, Homo sapiens
gttctgaatgtgcctgtactct

SEQ ID NO: 7662354 - DNA, 22 bp, Homo sapiens
gttctctggagtccctgggccc

SEQ ID NO: 7662355 - DNA, 22 bp, Homo sapiens
gttctctgccggcacctacccg

SEQ ID NO: 7662356 - DNA, 22 bp, Homo sapiens
gttctgagtcctcctttgaagg

SEQ ID NO: 7662357 - DNA, 22 bp, Homo sapiens
gttctgagtcctcctttgaagg

SEQ ID NO: 7662358 - DNA, 22 bp, Homo sapiens
gttctgagtcctcctttgaagg

SEQ ID NO: 7662359 - DNA, 22 bp, Homo sapiens
gttctgagtcctcctttgaagg

SEQ ID NO: 7662360 - DNA, 22 bp, Homo sapiens
gttctgacttctctgcatctgc

SEQ ID NO: 7662361 - DNA, 22 bp, Homo sapiens
gttctgacttctctgcatctgc

SEQ ID NO: 7662362 - DNA, 22 bp, Homo sapiens
gttctctctgcttccaagatgg

SEQ ID NO: 7662363 - DNA, 22 bp, Homo sapiens
gttctctctcttgcctgggtgg

SEQ ID NO: 7662364 - DNA, 22 bp, Homo sapiens
gttctctctcttgcctgggtgg

SEQ ID NO: 7662365 - DNA, 22 bp, Homo sapiens
gttctctcagcgatagtgatgg

SEQ ID NO: 7662366 - DNA, 22 bp, Homo sapiens
gttctctcagcgatagtgatgg

SEQ ID NO: 7662367 - DNA, 22 bp, Homo sapiens
gttctccttgtggctgcagcag

SEQ ID NO: 7662368 - DNA, 22 bp, Homo sapiens
gttctccttgtggctgcagcag

SEQ ID NO: 7662369 - DNA, 22 bp, Homo sapiens
gttctccttgtggctgcagcag

SEQ ID NO: 7662370 - DNA, 22 bp, Homo sapiens
gttctccttgtggctgcagcag

SEQ ID NO: 7662371 - DNA, 22 bp, Homo sapiens
gttctcctggctcccaccctgc

SEQ ID NO: 7662372 - DNA, 22 bp, Homo sapiens
gttctccttgtggctgcagcag

SEQ ID NO: 7662373 - DNA, 22 bp, Homo sapiens
gttctcctcttgtcccaggctg

SEQ ID NO: 7662374 - DNA, 22 bp, Homo sapiens
gttctcctcttgtcccaggctg

SEQ ID NO: 7662375 - DNA, 22 bp, Homo sapiens
gttctcctggctcccaccctgc

SEQ ID NO: 7662376 - DNA, 22 bp, Homo sapiens
gttctcctcttgtcccaggctg

SEQ ID NO: 7662377 - DNA, 22 bp, Homo sapiens
gttctccttgtggctgcagcag

SEQ ID NO: 7662378 - DNA, 22 bp, Homo sapiens
gttctctcaaactttgtgtttg

SEQ ID NO: 7662379 - DNA, 22 bp, Homo sapiens
gttctctcaaactttgtgtttg

SEQ ID NO: 7662380 - DNA, 22 bp, Homo sapiens
gttctctcagcctttgttatta

SEQ ID NO: 7662381 - DNA, 22 bp, Homo sapiens
gttctctcagcctttgttatta

SEQ ID NO: 7662382 - DNA, 22 bp, Homo sapiens
gttctcagtgatctgtgattcg

SEQ ID NO: 7662383 - DNA, 22 bp, Homo sapiens
gttctcagtgatctgtgattcg

SEQ ID NO: 7662384 - DNA, 22 bp, Homo sapiens
gttctcagcgtgggaggcagag

SEQ ID NO: 7662385 - DNA, 21 bp, Homo sapiens
gttctattttgcaaacttctg

SEQ ID NO: 7662386 - DNA, 21 bp, Homo sapiens
gttctattttgcaaacttctg

SEQ ID NO: 7662387 - DNA, 20 bp, Homo sapiens
gttctcactgatctgcaggg

SEQ ID NO: 7662388 - DNA, 22 bp, Homo sapiens
gttctattcattgctccacgag

SEQ ID NO: 7662389 - DNA, 22 bp, Homo sapiens
gttctattccccttatctgtga

SEQ ID NO: 7662390 - DNA, 22 bp, Homo sapiens
gttctattccccttatctgtga

SEQ ID NO: 7662391 - DNA, 22 bp, Homo sapiens
gttctattctccagttacatat

SEQ ID NO: 7662392 - DNA, 22 bp, Homo sapiens
gttctatttcagtaagcaggca

SEQ ID NO: 7662393 - DNA, 22 bp, Homo sapiens
gttctatttcagtaagcaggca

SEQ ID NO: 7662394 - DNA, 22 bp, Homo sapiens
gttctattctccagttacatat

SEQ ID NO: 7662395 - DNA, 22 bp, Homo sapiens
gttctattctccagttacatat

SEQ ID NO: 7662396 - DNA, 22 bp, Homo sapiens
gttctcctcttagctgtgccac

SEQ ID NO: 7662397 - DNA, 22 bp, Homo sapiens
gttctcctcttagctgtgccac

SEQ ID NO: 7662398 - DNA, 22 bp, Homo sapiens
gttctcctcttagctgtgccac

SEQ ID NO: 7662399 - DNA, 22 bp, Homo sapiens
gttctccctgtcccctgagctt

SEQ ID NO: 7662400 - DNA, 22 bp, Homo sapiens
gttctccctgtcccctgagctt

SEQ ID NO: 7662401 - DNA, 22 bp, Homo sapiens
gttctccattcagcttcctgtg

SEQ ID NO: 7662402 - DNA, 22 bp, Homo sapiens
gttctccaggggctgttcatct

SEQ ID NO: 7662403 - DNA, 22 bp, Homo sapiens
gttctccactgcagagtctctc

SEQ ID NO: 7662404 - DNA, 22 bp, Homo sapiens
gttctccaggggctgttcatct

SEQ ID NO: 7662405 - DNA, 22 bp, Homo sapiens
gttctccaggggctgttcatct

SEQ ID NO: 7662406 - DNA, 22 bp, Homo sapiens
gttctcagtggggagcagggtt

SEQ ID NO: 7662407 - DNA, 22 bp, Homo sapiens
gttctcagttcaggaaggacat

SEQ ID NO: 7662408 - DNA, 22 bp, Homo sapiens
gttctcagttcaggaaggacat

SEQ ID NO: 7662409 - DNA, 22 bp, Homo sapiens
gttctcatagtggaaaataggt

SEQ ID NO: 7662410 - DNA, 22 bp, Homo sapiens
gttctcagtggggagcagggtt

SEQ ID NO: 7662411 - DNA, 22 bp, Homo sapiens
gttctcagtggggagcagggtt

SEQ ID NO: 7662412 - DNA, 22 bp, Homo sapiens
gttctccactgcagagtctctc

SEQ ID NO: 7662413 - DNA, 22 bp, Homo sapiens
gttctccactgcagagtctctc

SEQ ID NO: 7662414 - DNA, 22 bp, Homo sapiens
gttctccactgcagagtctctc

SEQ ID NO: 7662415 - DNA, 22 bp, Homo sapiens
gttctcatagtggaaaataggt

SEQ ID NO: 7662416 - DNA, 22 bp, Homo sapiens
gttctcatatggcagagagagt

SEQ ID NO: 7662417 - DNA, 22 bp, Homo sapiens
gttgtttataaaaatatctagc

SEQ ID NO: 7662418 - DNA, 22 bp, Homo sapiens
gttgtttataaaaatatctagc

SEQ ID NO: 7662419 - DNA, 22 bp, Homo sapiens
gttgtttgtaatgacaggagac

SEQ ID NO: 7662420 - DNA, 22 bp, Homo sapiens
gttgttttaaaatactccagaa

SEQ ID NO: 7662421 - DNA, 22 bp, Homo sapiens
gttgttttaaaatactccagaa

SEQ ID NO: 7662422 - DNA, 22 bp, Homo sapiens
gttgttttaaaatactccagaa

SEQ ID NO: 7662423 - DNA, 22 bp, Homo sapiens
gttgttcttctcatccagcttg

SEQ ID NO: 7662424 - DNA, 22 bp, Homo sapiens
gttgttcttctcatccagcttg

SEQ ID NO: 7662425 - DNA, 22 bp, Homo sapiens
gttgttctccctaacaattact

SEQ ID NO: 7662426 - DNA, 22 bp, Homo sapiens
gttgttctccctaacaattact

SEQ ID NO: 7662427 - DNA, 22 bp, Homo sapiens
gttgttctccctaacaattact

SEQ ID NO: 7662428 - DNA, 22 bp, Homo sapiens
gttgttttataattgattgcaa

SEQ ID NO: 7662429 - DNA, 22 bp, Homo sapiens
gttgttttataattgattgcaa

SEQ ID NO: 7662430 - DNA, 22 bp, Homo sapiens
gttgttttataggctcatgcct

SEQ ID NO: 7662431 - DNA, 22 bp, Homo sapiens
gttgttttataggctcatgcct

SEQ ID NO: 7662432 - DNA, 22 bp, Homo sapiens
gttgttttataggctcatgcct

SEQ ID NO: 7662433 - DNA, 22 bp, Homo sapiens
gttgttttataggctcatgcct

SEQ ID NO: 7662434 - DNA, 22 bp, Homo sapiens
gttgttttataattgattgcaa

SEQ ID NO: 7662435 - DNA, 22 bp, Homo sapiens
gttgttttcagcagtttatgac

SEQ ID NO: 7662436 - DNA, 22 bp, Homo sapiens
gttgttttcagcagtttatgac

SEQ ID NO: 7662437 - DNA, 22 bp, Homo sapiens
gttgttttcacaaacccatgat

SEQ ID NO: 7662438 - DNA, 22 bp, Homo sapiens
gttgttttcacaaacccatgat

SEQ ID NO: 7662439 - DNA, 22 bp, Homo sapiens
gttgttttcacaaacccatgat

SEQ ID NO: 7662440 - DNA, 22 bp, Homo sapiens
gttgttttattgtgagtcccat

SEQ ID NO: 7662441 - DNA, 22 bp, Homo sapiens
gttgttttattgtgagtcccat

SEQ ID NO: 7662442 - DNA, 22 bp, Homo sapiens
gttgtgaatagtgccgcaataa

SEQ ID NO: 7662443 - DNA, 22 bp, Homo sapiens
gttgtgaatagtgccgcaataa

SEQ ID NO: 7662444 - DNA, 21 bp, Homo sapiens
gttgtccagctggtttgggcc

SEQ ID NO: 7662445 - DNA, 21 bp, Homo sapiens
gttgtccagctggtttgggcc

SEQ ID NO: 7662446 - DNA, 22 bp, Homo sapiens
gttgtcctccacatggcctctc

SEQ ID NO: 7662447 - DNA, 22 bp, Homo sapiens
gttgtccttcttatttgtagtg

SEQ ID NO: 7662448 - DNA, 22 bp, Homo sapiens
gttgtccttcttatttgtagtg

SEQ ID NO: 7662449 - DNA, 22 bp, Homo sapiens
gttgtcttagtcagaaatatgc

SEQ ID NO: 7662450 - DNA, 22 bp, Homo sapiens
gttgtcttagtcagaaatatgc

SEQ ID NO: 7662451 - DNA, 21 bp, Homo sapiens
gttgtggttggggctgcagct

SEQ ID NO: 7662452 - DNA, 21 bp, Homo sapiens
gttgtggttggggctgcagct

SEQ ID NO: 7662453 - DNA, 22 bp, Homo sapiens
gttgtgaatagtgccgcaataa

SEQ ID NO: 7662454 - DNA, 22 bp, Homo sapiens
gttgtgaatagtgccgcaataa

SEQ ID NO: 7662455 - DNA, 22 bp, Homo sapiens
gttgtacaggactgcccagtgt

SEQ ID NO: 7662456 - DNA, 22 bp, Homo sapiens
gttgtacaggactgcccagtgt

SEQ ID NO: 7662457 - DNA, 22 bp, Homo sapiens
gttgtacaggactgcccagtgt

SEQ ID NO: 7662458 - DNA, 22 bp, Homo sapiens
gttgtacagcattccatatagg

SEQ ID NO: 7662459 - DNA, 22 bp, Homo sapiens
gttgtacagcattccatatagg

SEQ ID NO: 7662460 - DNA, 22 bp, Homo sapiens
gttgtacaggcagggaaactga

SEQ ID NO: 7662461 - DNA, 22 bp, Homo sapiens
gttgtacaggcagggaaactga

SEQ ID NO: 7662462 - DNA, 22 bp, Homo sapiens
gttgtacaggactgcccagtgt

SEQ ID NO: 7662463 - DNA, 22 bp, Homo sapiens
gttgtacaggcagggaaactga

SEQ ID NO: 7662464 - DNA, 22 bp, Homo sapiens
gttgtacaggcagggaaactga

SEQ ID NO: 7662465 - DNA, 22 bp, Homo sapiens
gttctgctcctgtggcaatcta

SEQ ID NO: 7662466 - DNA, 22 bp, Homo sapiens
gttctgcagacttggaaggtgg

SEQ ID NO: 7662467 - DNA, 22 bp, Homo sapiens
gttctgcagggatccagctggg

SEQ ID NO: 7662468 - DNA, 22 bp, Homo sapiens
gttctgagtcctcctttgaagg

SEQ ID NO: 7662469 - DNA, 22 bp, Homo sapiens
gttctgagtcctcctttgaagg

SEQ ID NO: 7662470 - DNA, 22 bp, Homo sapiens
gttctgagtcctcctttgaagg

SEQ ID NO: 7662471 - DNA, 22 bp, Homo sapiens
gttctgagtcctcctttgaagg

SEQ ID NO: 7662472 - DNA, 22 bp, Homo sapiens
gttctgagtcctcctttgaagg

SEQ ID NO: 7662473 - DNA, 22 bp, Homo sapiens
gttctgagtggcccaagccctg

SEQ ID NO: 7662474 - DNA, 22 bp, Homo sapiens
gttctgagtggcccaagccctg

SEQ ID NO: 7662475 - DNA, 22 bp, Homo sapiens
gttctgcacatcacacaggtgc

SEQ ID NO: 7662476 - DNA, 22 bp, Homo sapiens
gttctgcacatcacacaggtgc

SEQ ID NO: 7662477 - DNA, 22 bp, Homo sapiens
gttgtatttgcctgaatgcagt

SEQ ID NO: 7662478 - DNA, 22 bp, Homo sapiens
gttgtattcttcaatatcagag

SEQ ID NO: 7662479 - DNA, 22 bp, Homo sapiens
gttgtatttgcctgaatgcagt

SEQ ID NO: 7662480 - DNA, 22 bp, Homo sapiens
gttgtatttgcctgaatgcagt

SEQ ID NO: 7662481 - DNA, 22 bp, Homo sapiens
gttgtatttgcctgaatgcagt

SEQ ID NO: 7662482 - DNA, 22 bp, Homo sapiens
gttgtattcttcaatatcagag

SEQ ID NO: 7662483 - DNA, 22 bp, Homo sapiens
gttgtattcttcaatatcagag

SEQ ID NO: 7662484 - DNA, 22 bp, Homo sapiens
gttgtattcttcaatatcagag

SEQ ID NO: 7662485 - DNA, 22 bp, Homo sapiens
gttgtatatgtagagaatggtc

SEQ ID NO: 7662486 - DNA, 22 bp, Homo sapiens
gttgtataaggaatgttgttta

SEQ ID NO: 7662487 - DNA, 22 bp, Homo sapiens
gttgtatagagggcatgaatct

SEQ ID NO: 7662488 - DNA, 22 bp, Homo sapiens
gttgtatagagggcatgaatct

SEQ ID NO: 7662489 - DNA, 22 bp, Homo sapiens
gttgtactctgaccattcagac

SEQ ID NO: 7662490 - DNA, 22 bp, Homo sapiens
gttgtacatgttggggtacctt

SEQ ID NO: 7662491 - DNA, 22 bp, Homo sapiens
gttgtacattctatgggtttgg

SEQ ID NO: 7662492 - DNA, 22 bp, Homo sapiens
gttgtacattctatgggttttg

SEQ ID NO: 7662493 - DNA, 22 bp, Homo sapiens
gttgtacattctatgggttttg

SEQ ID NO: 7662494 - DNA, 22 bp, Homo sapiens
gttgtacattctatgggttttg

SEQ ID NO: 7662495 - DNA, 22 bp, Homo sapiens
gttgtacatgcgtctgcaagga

SEQ ID NO: 7662496 - DNA, 22 bp, Homo sapiens
gttgtacatgcgtctgcaagga

SEQ ID NO: 7662497 - DNA, 22 bp, Homo sapiens
gttgtacatgcgtctgcaagga

SEQ ID NO: 7662498 - DNA, 22 bp, Homo sapiens
gttgtacatgttggggtacctt

SEQ ID NO: 7662499 - DNA, 22 bp, Homo sapiens
gttgtacatgttggggtacctt

SEQ ID NO: 7662500 - DNA, 22 bp, Homo sapiens
gttgtacattctatgggtttgg

SEQ ID NO: 7662501 - DNA, 22 bp, Homo sapiens
gttgtacattctatgggtttgg

SEQ ID NO: 7662502 - DNA, 22 bp, Homo sapiens
gttgtacatatgaggataagtt

SEQ ID NO: 7662503 - DNA, 22 bp, Homo sapiens
gttgtacatatgaggataagtt

SEQ ID NO: 7662504 - DNA, 22 bp, Homo sapiens
gttgtacatatgaggataagtt

SEQ ID NO: 7662505 - DNA, 22 bp, Homo sapiens
gttgtacatatgaggataagtt

SEQ ID NO: 7662506 - DNA, 22 bp, Homo sapiens
gtgtcctgagtgaggcctggcc

SEQ ID NO: 7662507 - DNA, 22 bp, Homo sapiens
gtgtcctgagtgaggcctggcc

SEQ ID NO: 7662508 - DNA, 22 bp, Homo sapiens
gtgtcctgagtgaggcctggcc

SEQ ID NO: 7662509 - DNA, 22 bp, Homo sapiens
gtgtcctcttattgctcttggc

SEQ ID NO: 7662510 - DNA, 22 bp, Homo sapiens
gtgtcctgagtgaggcctggcc

SEQ ID NO: 7662511 - DNA, 22 bp, Homo sapiens
gtgtcctgatcaattgagctgg

SEQ ID NO: 7662512 - DNA, 22 bp, Homo sapiens
gtgtccccacccaaatctcatc

SEQ ID NO: 7662513 - DNA, 22 bp, Homo sapiens
gtgtcccaggcctctggaatta

SEQ ID NO: 7662514 - DNA, 22 bp, Homo sapiens
gtgtcccaggcctctggaatta

SEQ ID NO: 7662515 - DNA, 22 bp, Homo sapiens
gtgtcccaggagaggagacaat

SEQ ID NO: 7662516 - DNA, 22 bp, Homo sapiens
gtgtcccaggagaggagacaat

SEQ ID NO: 7662517 - DNA, 22 bp, Homo sapiens
gtgtcccagccccacaggcctg

SEQ ID NO: 7662518 - DNA, 22 bp, Homo sapiens
gtgtcctgcaggccaggaatgg

SEQ ID NO: 7662519 - DNA, 22 bp, Homo sapiens
gtgtcctgcaggccaggaatgg

SEQ ID NO: 7662520 - DNA, 22 bp, Homo sapiens
gtgtcctgcacagcaccttgca

SEQ ID NO: 7662521 - DNA, 22 bp, Homo sapiens
gtgtcctgccaccctgggcttt

SEQ ID NO: 7662522 - DNA, 22 bp, Homo sapiens
gtgtcctgccaccctgggcttt

SEQ ID NO: 7662523 - DNA, 22 bp, Homo sapiens
gtgtcctgcattggctctgccc

SEQ ID NO: 7662524 - DNA, 22 bp, Homo sapiens
gtgtcctgcattggctctgccc

SEQ ID NO: 7662525 - DNA, 22 bp, Homo sapiens
gtgtcctgcattggctctgccc

SEQ ID NO: 7662526 - DNA, 22 bp, Homo sapiens
gtgtcctgcattggctctgccc

SEQ ID NO: 7662527 - DNA, 22 bp, Homo sapiens
gtgtcctgggctggtagagctg

SEQ ID NO: 7662528 - DNA, 22 bp, Homo sapiens
gtgtcctgggcattaggcttag

SEQ ID NO: 7662529 - DNA, 22 bp, Homo sapiens
gtgtcctgggcattaggcttag

SEQ ID NO: 7662530 - DNA, 22 bp, Homo sapiens
gtgtcctggagcccccagttca

SEQ ID NO: 7662531 - DNA, 18 bp, Homo sapiens
gtgtcctggctgcggcgc

SEQ ID NO: 7662532 - DNA, 18 bp, Homo sapiens
gtgtcctggctgcggcgc

SEQ ID NO: 7662533 - DNA, 18 bp, Homo sapiens
gtgtcctggctgcggcgc

SEQ ID NO: 7662534 - DNA, 18 bp, Homo sapiens
gtgtcctggctgcggcgc

SEQ ID NO: 7662535 - DNA, 22 bp, Homo sapiens
gtgtccttcattggaatctctc

SEQ ID NO: 7662536 - DNA, 22 bp, Homo sapiens
gtgtccttatttctgtctctca

SEQ ID NO: 7662537 - DNA, 22 bp, Homo sapiens
gtgtcctttccgggcctggagg

SEQ ID NO: 7662538 - DNA, 18 bp, Homo sapiens
gtgtcctttgcaagaaac

SEQ ID NO: 7662539 - DNA, 18 bp, Homo sapiens
gtgtcctttgcaagaaac

SEQ ID NO: 7662540 - DNA, 22 bp, Homo sapiens
gtgtccttttatgtgactggtt

SEQ ID NO: 7662541 - DNA, 22 bp, Homo sapiens
gtgtccttaagtcggttctcct

SEQ ID NO: 7662542 - DNA, 22 bp, Homo sapiens
gtgtccttaagtcggttctcct

SEQ ID NO: 7662543 - DNA, 22 bp, Homo sapiens
gtgtccttataagaagagatgc

SEQ ID NO: 7662544 - DNA, 22 bp, Homo sapiens
gtgtccttataagaagagatgc

SEQ ID NO: 7662545 - DNA, 22 bp, Homo sapiens
gtgtccttatgcataccagagt

SEQ ID NO: 7662546 - DNA, 22 bp, Homo sapiens
gtgtccttatttctgtctctca

SEQ ID NO: 7662547 - DNA, 22 bp, Homo sapiens
gtgtcctggttccttgtggctg

SEQ ID NO: 7662548 - DNA, 22 bp, Homo sapiens
gtgtcctgtttccctgtctata

SEQ ID NO: 7662549 - DNA, 22 bp, Homo sapiens
gtgtcctgtttccctgtctata

SEQ ID NO: 7662550 - DNA, 22 bp, Homo sapiens
gtgtcctgtttccctgtctata

SEQ ID NO: 7662551 - DNA, 22 bp, Homo sapiens
gtgtcctgggggacttcaggtt

SEQ ID NO: 7662552 - DNA, 22 bp, Homo sapiens
gtgtcctgggggacttcaggtt

SEQ ID NO: 7662553 - DNA, 22 bp, Homo sapiens
gtgtcctgggctggtagagctg

SEQ ID NO: 7662554 - DNA, 22 bp, Homo sapiens
gtgtcctgggtctctgattctt

SEQ ID NO: 7662555 - DNA, 22 bp, Homo sapiens
gtgtcctgggggacttcaggtt

SEQ ID NO: 7662556 - DNA, 22 bp, Homo sapiens
gtgtcgtgcttgccatgggtac

SEQ ID NO: 7662557 - DNA, 22 bp, Homo sapiens
gtgtcgtgcttgccatgggtac

SEQ ID NO: 7662558 - DNA, 22 bp, Homo sapiens
gtgtccttttatgtgactggtt

SEQ ID NO: 7662559 - DNA, 22 bp, Homo sapiens
gtgtccttgcagtttgaagaaa

SEQ ID NO: 7662560 - DNA, 22 bp, Homo sapiens
gtgtccttttgagggtccacag

SEQ ID NO: 7662561 - DNA, 22 bp, Homo sapiens
gtgtccttttgagggtccacag

SEQ ID NO: 7662562 - DNA, 22 bp, Homo sapiens
gtgtctctaggacctggtacta

SEQ ID NO: 7662563 - DNA, 22 bp, Homo sapiens
gtgtctctaggacctggtacta

SEQ ID NO: 7662564 - DNA, 22 bp, Homo sapiens
gtgtgagccatgatgtgtccag

SEQ ID NO: 7662565 - DNA, 22 bp, Homo sapiens
gtgtgagccatgatgtgtccag

SEQ ID NO: 7662566 - DNA, 22 bp, Homo sapiens
gtgtctctatctatgcctgaag

SEQ ID NO: 7662567 - DNA, 22 bp, Homo sapiens
gtgtctcttagcctgctaatgc

SEQ ID NO: 7662568 - DNA, 22 bp, Homo sapiens
gtgtctcttcctttcaagtggg

SEQ ID NO: 7662569 - DNA, 22 bp, Homo sapiens
gtgtctcttcctttcaagtggg

SEQ ID NO: 7662570 - DNA, 22 bp, Homo sapiens
gtgtctcttttcagactcttca

SEQ ID NO: 7662571 - DNA, 22 bp, Homo sapiens
gtgtctgagtttggaaagtcca

SEQ ID NO: 7662572 - DNA, 22 bp, Homo sapiens
gtgtcagatgtccagggcagca

SEQ ID NO: 7662573 - DNA, 22 bp, Homo sapiens
gtgtcagaaacaggaaggggaa

SEQ ID NO: 7662574 - DNA, 22 bp, Homo sapiens
gtgtcagaaacaggaaggggaa

SEQ ID NO: 7662575 - DNA, 22 bp, Homo sapiens
gtgtcacatggtttactgcagc

SEQ ID NO: 7662576 - DNA, 22 bp, Homo sapiens
gtgtcactggaatactgtctgt

SEQ ID NO: 7662577 - DNA, 22 bp, Homo sapiens
gtgtcaggagccttccatgggc

SEQ ID NO: 7662578 - DNA, 19 bp, Homo sapiens
gtgtcaggatgtgcagggg

SEQ ID NO: 7662579 - DNA, 22 bp, Homo sapiens
gtgtcaggagaattagggcttt

SEQ ID NO: 7662580 - DNA, 22 bp, Homo sapiens
gtgtcaggggcagccaggaaat

SEQ ID NO: 7662581 - DNA, 19 bp, Homo sapiens
gtgtcaggatgtgcagggg

SEQ ID NO: 7662582 - DNA, 19 bp, Homo sapiens
gtgtcaggatgtgcagggg

SEQ ID NO: 7662583 - DNA, 22 bp, Homo sapiens
gtgtcaggcagtcagcatggag

SEQ ID NO: 7662584 - DNA, 22 bp, Homo sapiens
gtgtcaggcagtcagcatggag

SEQ ID NO: 7662585 - DNA, 22 bp, Homo sapiens
gtgtcaggcagtcagcatggag

SEQ ID NO: 7662586 - DNA, 21 bp, Homo sapiens
gtgtcatggttgactttggca

SEQ ID NO: 7662587 - DNA, 22 bp, Homo sapiens
gtgtcagtccagaggcagccac

SEQ ID NO: 7662588 - DNA, 22 bp, Homo sapiens
gtgtcagtccagaggcagccac

SEQ ID NO: 7662589 - DNA, 22 bp, Homo sapiens
gtgtcatgcacactcagtgttg

SEQ ID NO: 7662590 - DNA, 22 bp, Homo sapiens
gtgtcattaaccaccatgcaaa

SEQ ID NO: 7662591 - DNA, 23 bp, Homo sapiens
gtgtcattactgtaattattgtg

SEQ ID NO: 7662592 - DNA, 22 bp, Homo sapiens
gtgtccacggctgagaatgatt

SEQ ID NO: 7662593 - DNA, 22 bp, Homo sapiens
gtgtccagagaaactcacagct

SEQ ID NO: 7662594 - DNA, 22 bp, Homo sapiens
gtgtccactcgtggtctgtcag

SEQ ID NO: 7662595 - DNA, 22 bp, Homo sapiens
gtgtccactcgtggtctgtcag

SEQ ID NO: 7662596 - DNA, 22 bp, Homo sapiens
gtgtccactcgtggtctgtcag

SEQ ID NO: 7662597 - DNA, 22 bp, Homo sapiens
gtgtccactccatgcccatcct

SEQ ID NO: 7662598 - DNA, 22 bp, Homo sapiens
gtgtccacggctgagaatgatt

SEQ ID NO: 7662599 - DNA, 22 bp, Homo sapiens
gtgtccagttttttctctgctg

SEQ ID NO: 7662600 - DNA, 22 bp, Homo sapiens
gtgtccagttttttctctgctg

SEQ ID NO: 7662601 - DNA, 22 bp, Homo sapiens
gtgtccagttttttctctgctg

SEQ ID NO: 7662602 - DNA, 22 bp, Homo sapiens
gtgtccagttttttctctgctg

SEQ ID NO: 7662603 - DNA, 22 bp, Homo sapiens
gtgtccatcagcagccactgtg

SEQ ID NO: 7662604 - DNA, 22 bp, Homo sapiens
gtgtccatcagcagccactgtg

SEQ ID NO: 7662605 - DNA, 22 bp, Homo sapiens
gtgtccatctctgtatgctgct

SEQ ID NO: 7662606 - DNA, 22 bp, Homo sapiens
gtgtccatctctgtatgctgct

SEQ ID NO: 7662607 - DNA, 22 bp, Homo sapiens
gtgtccatctctgtatgctgct

SEQ ID NO: 7662608 - DNA, 19 bp, Homo sapiens
gtgtccatggagcatggag

SEQ ID NO: 7662609 - DNA, 19 bp, Homo sapiens
gtgtccatggagcatggag

SEQ ID NO: 7662610 - DNA, 19 bp, Homo sapiens
gtgtccatggagcatggag

SEQ ID NO: 7662611 - DNA, 22 bp, Homo sapiens
gtgtccatgttgttcagggtga

SEQ ID NO: 7662612 - DNA, 22 bp, Homo sapiens
gtgtccatgttgttcagggtga

SEQ ID NO: 7662613 - DNA, 22 bp, Homo sapiens
gtgtccattcactgcaacactt

SEQ ID NO: 7662614 - DNA, 22 bp, Homo sapiens
gtgtccatgttgttcagggtga

SEQ ID NO: 7662615 - DNA, 22 bp, Homo sapiens
gtgtccattcactgcaacactt

SEQ ID NO: 7662616 - DNA, 22 bp, Homo sapiens
gtgtcccaaagattagaaatca

SEQ ID NO: 7662617 - DNA, 22 bp, Homo sapiens
gtgtcccaatctacttttccct

SEQ ID NO: 7662618 - DNA, 22 bp, Homo sapiens
gtgtcccaatgttcaggacggc

SEQ ID NO: 7662619 - DNA, 22 bp, Homo sapiens
gtgtcccaatgttcaggacggc

SEQ ID NO: 7662620 - DNA, 22 bp, Homo sapiens
gtgtcccactctggaggtgaag

SEQ ID NO: 7662621 - DNA, 22 bp, Homo sapiens
gtgtcccactctggaggtgaag

SEQ ID NO: 7662622 - DNA, 22 bp, Homo sapiens
gtgtcccagcagcacattggct

SEQ ID NO: 7662623 - DNA, 22 bp, Homo sapiens
gtgtccagcctgcacagggtgc

SEQ ID NO: 7662624 - DNA, 22 bp, Homo sapiens
gtgtccagcgtggaatgagggt

SEQ ID NO: 7662625 - DNA, 22 bp, Homo sapiens
gtgtccagcctgcacagggtgc

SEQ ID NO: 7662626 - DNA, 22 bp, Homo sapiens
gtgtccagcctgcacagggtgc

SEQ ID NO: 7662627 - DNA, 22 bp, Homo sapiens
gtgtccagatgaggagacgatg

SEQ ID NO: 7662628 - DNA, 22 bp, Homo sapiens
gtgtccagatgaggagacgatg

SEQ ID NO: 7662629 - DNA, 22 bp, Homo sapiens
gtgtccagagaaactcacagct

SEQ ID NO: 7662630 - DNA, 22 bp, Homo sapiens
gtgtccagagaactgtgggagc

SEQ ID NO: 7662631 - DNA, 22 bp, Homo sapiens
gtgtccagagaactgtgggagc

SEQ ID NO: 7662632 - DNA, 22 bp, Homo sapiens
gtgtccagagaaactcacagct

SEQ ID NO: 7662633 - DNA, 22 bp, Homo sapiens
gtgtccagagccgggctgaatg

SEQ ID NO: 7662634 - DNA, 22 bp, Homo sapiens
gtgtccagagaactgtgggagc

SEQ ID NO: 7662635 - DNA, 22 bp, Homo sapiens
gtgtccagggccgtgttgtctt

SEQ ID NO: 7662636 - DNA, 17 bp, Homo sapiens
gtgtccaggccgatggc

SEQ ID NO: 7662637 - DNA, 22 bp, Homo sapiens
gtgtccagggctggaagtgagg

SEQ ID NO: 7662638 - DNA, 22 bp, Homo sapiens
gtgtccagggctggaagtgagg

SEQ ID NO: 7662639 - DNA, 22 bp, Homo sapiens
gtgtccagcgtggaatgagggt

SEQ ID NO: 7662640 - DNA, 17 bp, Homo sapiens
gtgtccaggccgatggc

SEQ ID NO: 7662641 - DNA, 17 bp, Homo sapiens
gtgtccaggccgatggc

SEQ ID NO: 7662642 - DNA, 22 bp, Homo sapiens
gtgtccagtcatagcccagggc

SEQ ID NO: 7662643 - DNA, 22 bp, Homo sapiens
gtgtccagtcatagcccagggc

SEQ ID NO: 7662644 - DNA, 22 bp, Homo sapiens
gtgtccagggggtatcccagct

SEQ ID NO: 7662645 - DNA, 22 bp, Homo sapiens
gtgtccagtcatagcccagggc

SEQ ID NO: 7662646 - DNA, 22 bp, Homo sapiens
gtgtccagggggtatcccagct

SEQ ID NO: 7662647 - DNA, 22 bp, Homo sapiens
gtgtccagggggtatcccagct

SEQ ID NO: 7662648 - DNA, 22 bp, Homo sapiens
gtgtggtcgaagttctcccgga

SEQ ID NO: 7662649 - DNA, 22 bp, Homo sapiens
gtgtggtcgaagttctcccgga

SEQ ID NO: 7662650 - DNA, 22 bp, Homo sapiens
gtgtggtgaggccccttaggct

SEQ ID NO: 7662651 - DNA, 22 bp, Homo sapiens
gtgtggtgaggccccttaggct

SEQ ID NO: 7662652 - DNA, 22 bp, Homo sapiens
gtgtgtaaacctccaatctggg

SEQ ID NO: 7662653 - DNA, 22 bp, Homo sapiens
gtgtggtggccctccttcaggc

SEQ ID NO: 7662654 - DNA, 22 bp, Homo sapiens
gtgtgtaagtctcctcttcccg

SEQ ID NO: 7662655 - DNA, 22 bp, Homo sapiens
gtgtgtatgtagaactatgtat

SEQ ID NO: 7662656 - DNA, 22 bp, Homo sapiens
gtgtgtcagagctcagagaagt

SEQ ID NO: 7662657 - DNA, 22 bp, Homo sapiens
gtgtgtatgtagaactatgtat

SEQ ID NO: 7662658 - DNA, 22 bp, Homo sapiens
gtgtgtatgtagaactatgtat

SEQ ID NO: 7662659 - DNA, 22 bp, Homo sapiens
gtgtgtcaggtactgtgctagg

SEQ ID NO: 7662660 - DNA, 22 bp, Homo sapiens
gtgtgtatttaaaggatagttg

SEQ ID NO: 7662661 - DNA, 22 bp, Homo sapiens
gtgtgtattattgcatacacat

SEQ ID NO: 7662662 - DNA, 22 bp, Homo sapiens
gtgtgtatttaaaggatagttg

SEQ ID NO: 7662663 - DNA, 22 bp, Homo sapiens
gtgtgtcagagctcagagaagt

SEQ ID NO: 7662664 - DNA, 22 bp, Homo sapiens
gtgtgtcagagctcagagaagt

SEQ ID NO: 7662665 - DNA, 22 bp, Homo sapiens
gtgtgggtgggacatcatcttt

SEQ ID NO: 7662666 - DNA, 22 bp, Homo sapiens
gtgtggggtcttctcttggcct

SEQ ID NO: 7662667 - DNA, 22 bp, Homo sapiens
gtgtggtcgaagttctcccgga

SEQ ID NO: 7662668 - DNA, 22 bp, Homo sapiens
gtgtggtcgaagttctcccgga

SEQ ID NO: 7662669 - DNA, 22 bp, Homo sapiens
gtgtggggtcttctcttggcct

SEQ ID NO: 7662670 - DNA, 22 bp, Homo sapiens
gtgtggggtcttctcttggcct

SEQ ID NO: 7662671 - DNA, 22 bp, Homo sapiens
gtgtggggtcttctcttggcct

SEQ ID NO: 7662672 - DNA, 22 bp, Homo sapiens
gtgtggggtcttctcttggcct

SEQ ID NO: 7662673 - DNA, 22 bp, Homo sapiens
gtgtgggggcagctctgatatg

SEQ ID NO: 7662674 - DNA, 22 bp, Homo sapiens
gtgtgggggcagctctgatatg

SEQ ID NO: 7662675 - DNA, 22 bp, Homo sapiens
gtgtggggctcagtgggaatgt

SEQ ID NO: 7662676 - DNA, 22 bp, Homo sapiens
gtgtggggctcagtgggaatgt

SEQ ID NO: 7662677 - DNA, 22 bp, Homo sapiens
gtgtggggctcagtgggaatgt

SEQ ID NO: 7662678 - DNA, 22 bp, Homo sapiens
gtgtggggaggagagagccctt

SEQ ID NO: 7662679 - DNA, 22 bp, Homo sapiens
gtgtggggaggagagagccctt

SEQ ID NO: 7662680 - DNA, 22 bp, Homo sapiens
gtgtggggaggagagagccctt

SEQ ID NO: 7662681 - DNA, 22 bp, Homo sapiens
gtgtggggccaggatcagggct

SEQ ID NO: 7662682 - DNA, 22 bp, Homo sapiens
gtgtggggccaggatcagggct

SEQ ID NO: 7662683 - DNA, 22 bp, Homo sapiens
gtgtggggctcagtgggaatgt

SEQ ID NO: 7662684 - DNA, 22 bp, Homo sapiens
gtgtggggctcagtgggaatgt

SEQ ID NO: 7662685 - DNA, 22 bp, Homo sapiens
gtgtggggccaggatcagggct

SEQ ID NO: 7662686 - DNA, 22 bp, Homo sapiens
gtgtggggccaggatcagggct

SEQ ID NO: 7662687 - DNA, 22 bp, Homo sapiens
gtgtgggctgcagaggcacagc

SEQ ID NO: 7662688 - DNA, 22 bp, Homo sapiens
gtgtggggagctgcagccacat

SEQ ID NO: 7662689 - DNA, 22 bp, Homo sapiens
gtgtggggagctgcagccacat

SEQ ID NO: 7662690 - DNA, 22 bp, Homo sapiens
gtgtggggagctgcagccacat

SEQ ID NO: 7662691 - DNA, 22 bp, Homo sapiens
gtgtggggagctgcagccacat

SEQ ID NO: 7662692 - DNA, 22 bp, Homo sapiens
gtgtggggaggagagagccctt

SEQ ID NO: 7662693 - DNA, 22 bp, Homo sapiens
gtgtggggaggagagagccctt

SEQ ID NO: 7662694 - DNA, 22 bp, Homo sapiens
gtgtgggctatgtgcgtgggca

SEQ ID NO: 7662695 - DNA, 18 bp, Homo sapiens
gtgtgggctcctccgagt

SEQ ID NO: 7662696 - DNA, 22 bp, Homo sapiens
gtgtgggctgcagaggcacagc

SEQ ID NO: 7662697 - DNA, 22 bp, Homo sapiens
gtgtgggctatgtgcgtgggca

SEQ ID NO: 7662698 - DNA, 22 bp, Homo sapiens
gtgtgggcagggccgtgctccc

SEQ ID NO: 7662699 - DNA, 22 bp, Homo sapiens
gtgtgggaggaaggtgaacaga

SEQ ID NO: 7662700 - DNA, 22 bp, Homo sapiens
gtgtgggcagggccgtgctccc

SEQ ID NO: 7662701 - DNA, 22 bp, Homo sapiens
gtgtgggaggaaggtgaacaga

SEQ ID NO: 7662702 - DNA, 22 bp, Homo sapiens
gtgtgggaggaaggtgaacaga

SEQ ID NO: 7662703 - DNA, 22 bp, Homo sapiens
gtgtgggacgggtgagtggcca

SEQ ID NO: 7662704 - DNA, 22 bp, Homo sapiens
gtgtgggacgggtgagtggcca

SEQ ID NO: 7662705 - DNA, 22 bp, Homo sapiens
gtgtgggaggaaggtgaacaga

SEQ ID NO: 7662706 - DNA, 22 bp, Homo sapiens
gtgtgggaggaaggtgaacaga

SEQ ID NO: 7662707 - DNA, 22 bp, Homo sapiens
gtgtgcagtctgctaggcaggg

SEQ ID NO: 7662708 - DNA, 22 bp, Homo sapiens
gtgtgcagtctgctaggcaggg

SEQ ID NO: 7662709 - DNA, 22 bp, Homo sapiens
gtgtgcagtgagcaaaagatct

SEQ ID NO: 7662710 - DNA, 22 bp, Homo sapiens
gtgtgcagtgagcaaaagatct

SEQ ID NO: 7662711 - DNA, 22 bp, Homo sapiens
gtgtgcagtgagcaaaagatct

SEQ ID NO: 7662712 - DNA, 22 bp, Homo sapiens
gtgtgcagggggccagcgcagc

SEQ ID NO: 7662713 - DNA, 22 bp, Homo sapiens
gtgtgcagggggccagcgcagc

SEQ ID NO: 7662714 - DNA, 22 bp, Homo sapiens
gtgtgcaggggcttggtggagc

SEQ ID NO: 7662715 - DNA, 22 bp, Homo sapiens
gtgtgcagggggccagcgcagc

SEQ ID NO: 7662716 - DNA, 22 bp, Homo sapiens
gtgtgcaggggcttggtggagc

SEQ ID NO: 7662717 - DNA, 22 bp, Homo sapiens
gtgtgcagggggccagcgcagc

SEQ ID NO: 7662718 - DNA, 22 bp, Homo sapiens
gtgtgcagggctgcctgtgccg

SEQ ID NO: 7662719 - DNA, 22 bp, Homo sapiens
gtgtgcaggggcttggtggagc

SEQ ID NO: 7662720 - DNA, 22 bp, Homo sapiens
gtgtgcaggggcttggtggagc

SEQ ID NO: 7662721 - DNA, 22 bp, Homo sapiens
gtgtgcaggtgtcagtgcagct

SEQ ID NO: 7662722 - DNA, 22 bp, Homo sapiens
gtgtgcaggtgtcagtgcagct

SEQ ID NO: 7662723 - DNA, 22 bp, Homo sapiens
gtgtgcaggtgtcagtgcagct

SEQ ID NO: 7662724 - DNA, 22 bp, Homo sapiens
gtgtgcagggggccagcgcagc

SEQ ID NO: 7662725 - DNA, 22 bp, Homo sapiens
gtgtgcaggtgtcagtgcagct

SEQ ID NO: 7662726 - DNA, 22 bp, Homo sapiens
gtgtgcagtagagaaagagcag

SEQ ID NO: 7662727 - DNA, 22 bp, Homo sapiens
gtgtgcaggtgtcagtgcagct

SEQ ID NO: 7662728 - DNA, 22 bp, Homo sapiens
gtgtgcaggccacaggccaggg

SEQ ID NO: 7662729 - DNA, 22 bp, Homo sapiens
gtgtgcaggccacaggccaggg

SEQ ID NO: 7662730 - DNA, 23 bp, Homo sapiens
gtgtgcaggattatttgcagaca

SEQ ID NO: 7662731 - DNA, 22 bp, Homo sapiens
gtgtgcaggccacaggccaggg

SEQ ID NO: 7662732 - DNA, 22 bp, Homo sapiens
gtgtgcagcagagacaggactc

SEQ ID NO: 7662733 - DNA, 22 bp, Homo sapiens
gtgtgcagcagagacaggactc

SEQ ID NO: 7662734 - DNA, 22 bp, Homo sapiens
gtgtgcaggcttgaggattagg

SEQ ID NO: 7662735 - DNA, 22 bp, Homo sapiens
gtgtgcagggctgcctgtgccg

SEQ ID NO: 7662736 - DNA, 22 bp, Homo sapiens
gtgtgcagggctgcctgtgccg

SEQ ID NO: 7662737 - DNA, 22 bp, Homo sapiens
gtgtgcagggctgcctgtgccg

SEQ ID NO: 7662738 - DNA, 22 bp, Homo sapiens
gtgtgcagggatgagtgcaggt

SEQ ID NO: 7662739 - DNA, 22 bp, Homo sapiens
gtgtgcagggatgagtgcaggt

SEQ ID NO: 7662740 - DNA, 22 bp, Homo sapiens
gtgtgcagggatgagtgcaggt

SEQ ID NO: 7662741 - DNA, 22 bp, Homo sapiens
gtgtgcagggatgagtgcaggt

SEQ ID NO: 7662742 - DNA, 22 bp, Homo sapiens
gtgtgcagggatgagtgcaggt

SEQ ID NO: 7662743 - DNA, 22 bp, Homo sapiens
gtgtgcaagggcatgtacattg

SEQ ID NO: 7662744 - DNA, 22 bp, Homo sapiens
gtgtgcaactttcattaatatt

SEQ ID NO: 7662745 - DNA, 21 bp, Homo sapiens
gtgtgagtagcatgtgtctca

SEQ ID NO: 7662746 - DNA, 22 bp, Homo sapiens
gtgtgagtgaaagtagtttgat

SEQ ID NO: 7662747 - DNA, 22 bp, Homo sapiens
gtgtgagtgaaagtagtttgat

SEQ ID NO: 7662748 - DNA, 22 bp, Homo sapiens
gtgtgcacagtatactagggtt

SEQ ID NO: 7662749 - DNA, 22 bp, Homo sapiens
gtgtgcacagtatactagggtt

SEQ ID NO: 7662750 - DNA, 22 bp, Homo sapiens
gtgtgcagaacagggagtgggt

SEQ ID NO: 7662751 - DNA, 22 bp, Homo sapiens
gtgtgcagaacagggagtgggt

SEQ ID NO: 7662752 - DNA, 22 bp, Homo sapiens
gtgtgcagaacagggagtgggt

SEQ ID NO: 7662753 - DNA, 22 bp, Homo sapiens
gtgtgagggacagagaaagggg

SEQ ID NO: 7662754 - DNA, 21 bp, Homo sapiens
gtgtgagtagcatgtgtctca

SEQ ID NO: 7662755 - DNA, 22 bp, Homo sapiens
gtgtgagggcaacacagcaaac

SEQ ID NO: 7662756 - DNA, 22 bp, Homo sapiens
gtgtgagggacagagaaagggg

SEQ ID NO: 7662757 - DNA, 22 bp, Homo sapiens
gtgtgagggacagagaaagggg

SEQ ID NO: 7662758 - DNA, 21 bp, Homo sapiens
gtgtgagtagcatgtgtctca

SEQ ID NO: 7662759 - DNA, 22 bp, Homo sapiens
gtgtgagtgaaagtagtttgat

SEQ ID NO: 7662760 - DNA, 21 bp, Homo sapiens
gtgtgagtagcatgtgtctca

SEQ ID NO: 7662761 - DNA, 22 bp, Homo sapiens
gtgtgcagaagacacaagacat

SEQ ID NO: 7662762 - DNA, 22 bp, Homo sapiens
gtgtgcagaggcaggaggtgct

SEQ ID NO: 7662763 - DNA, 22 bp, Homo sapiens
gtgtgcagaggcaggaggtgct

SEQ ID NO: 7662764 - DNA, 22 bp, Homo sapiens
gtgtgcagaacagggagtgggt

SEQ ID NO: 7662765 - DNA, 22 bp, Homo sapiens
gtgtgcagaacagggagtgggt

SEQ ID NO: 7662766 - DNA, 22 bp, Homo sapiens
gtgtgcagaacagggagtgggt

SEQ ID NO: 7662767 - DNA, 22 bp, Homo sapiens
gtgtgcagaagacacaagacat

SEQ ID NO: 7662768 - DNA, 22 bp, Homo sapiens
gtgtgcagcagagacaggactc

SEQ ID NO: 7662769 - DNA, 22 bp, Homo sapiens
gtgtgcagcagagacaggactc

SEQ ID NO: 7662770 - DNA, 22 bp, Homo sapiens
gtgtgcagcagagacaggactc

SEQ ID NO: 7662771 - DNA, 22 bp, Homo sapiens
gtgtgcagatgtgatgctgggc

SEQ ID NO: 7662772 - DNA, 22 bp, Homo sapiens
gtgtgcagatgtgatgctgggc

SEQ ID NO: 7662773 - DNA, 22 bp, Homo sapiens
gtgtgcagatgtgatgctgggc

SEQ ID NO: 7662774 - DNA, 22 bp, Homo sapiens
gtgtgcagaggcaggaggtgct

SEQ ID NO: 7662775 - DNA, 22 bp, Homo sapiens
gtgtgcagaggcaggaggtgct

SEQ ID NO: 7662776 - DNA, 22 bp, Homo sapiens
gtgggggtggaaaggcaagttg

SEQ ID NO: 7662777 - DNA, 22 bp, Homo sapiens
gtgggggtggaaaggcaagttg

SEQ ID NO: 7662778 - DNA, 22 bp, Homo sapiens
gtgggggtggaaaggcaagttg

SEQ ID NO: 7662779 - DNA, 22 bp, Homo sapiens
gtgggggtggaaaggcaagttg

SEQ ID NO: 7662780 - DNA, 22 bp, Homo sapiens
gtgggggtggaaaggcaagttg

SEQ ID NO: 7662781 - DNA, 22 bp, Homo sapiens
gtgggggtttcattaagacaat

SEQ ID NO: 7662782 - DNA, 22 bp, Homo sapiens
gtgggggtttcattaagacaat

SEQ ID NO: 7662783 - DNA, 22 bp, Homo sapiens
gtgggggtttcattaagacaat

SEQ ID NO: 7662784 - DNA, 22 bp, Homo sapiens
gtgggggtggaaaggcaagttg

SEQ ID NO: 7662785 - DNA, 22 bp, Homo sapiens
gtgggggtggaaaggcaagttg

SEQ ID NO: 7662786 - DNA, 22 bp, Homo sapiens
gtgggggtttcattaagacaat

SEQ ID NO: 7662787 - DNA, 22 bp, Homo sapiens
gtggggtagatctttctcagga

SEQ ID NO: 7662788 - DNA, 22 bp, Homo sapiens
gtggggtagatctttctcagga

SEQ ID NO: 7662789 - DNA, 22 bp, Homo sapiens
gtggggtagatctttctcagga

SEQ ID NO: 7662790 - DNA, 22 bp, Homo sapiens
gtggggtagatctttctcagga

SEQ ID NO: 7662791 - DNA, 22 bp, Homo sapiens
gtggggtagatctttctcagga

SEQ ID NO: 7662792 - DNA, 22 bp, Homo sapiens
gtggggtagatctttctcagga

SEQ ID NO: 7662793 - DNA, 22 bp, Homo sapiens
gtggggtagatctttctcagga

SEQ ID NO: 7662794 - DNA, 22 bp, Homo sapiens
gtgggggctggctcgtcctgtg

SEQ ID NO: 7662795 - DNA, 22 bp, Homo sapiens
gtgggggctggctcgtcctgtg

SEQ ID NO: 7662796 - DNA, 22 bp, Homo sapiens
gtgggggctggctcgtcctgtg

SEQ ID NO: 7662797 - DNA, 22 bp, Homo sapiens
gtgggggctggctcgtcctgtg

SEQ ID NO: 7662798 - DNA, 22 bp, Homo sapiens
gtgggggctggctcgtcctgtg

SEQ ID NO: 7662799 - DNA, 22 bp, Homo sapiens
gtgggggctggctcgtcctgtg

SEQ ID NO: 7662800 - DNA, 22 bp, Homo sapiens
gtggggggacgttggtcacttt

SEQ ID NO: 7662801 - DNA, 22 bp, Homo sapiens
gtggggggacgttggtcacttt

SEQ ID NO: 7662802 - DNA, 22 bp, Homo sapiens
gtggggggacgttggtcacttt

SEQ ID NO: 7662803 - DNA, 22 bp, Homo sapiens
gtggggggacgttggtcacttt

SEQ ID NO: 7662804 - DNA, 22 bp, Homo sapiens
gtggggggagctgcaagctgga

SEQ ID NO: 7662805 - DNA, 22 bp, Homo sapiens
gtggggggagctgcaagctgga

SEQ ID NO: 7662806 - DNA, 22 bp, Homo sapiens
gtggggggagctgcaagctgga

SEQ ID NO: 7662807 - DNA, 22 bp, Homo sapiens
gtggggggagctgcaagctgga

SEQ ID NO: 7662808 - DNA, 22 bp, Homo sapiens
gtggggggagctgcaagctgga

SEQ ID NO: 7662809 - DNA, 22 bp, Homo sapiens
gtggggggagctgcaagctgga

SEQ ID NO: 7662810 - DNA, 22 bp, Homo sapiens
gtggggggagctgcaagctgga

SEQ ID NO: 7662811 - DNA, 22 bp, Homo sapiens
gtggggggagctgcaagctgga

SEQ ID NO: 7662812 - DNA, 22 bp, Homo sapiens
gtggggggacgttggtcacttt

SEQ ID NO: 7662813 - DNA, 22 bp, Homo sapiens
gtggggggacgttggtcacttt

SEQ ID NO: 7662814 - DNA, 22 bp, Homo sapiens
gtggggggacgttggtcacttt

SEQ ID NO: 7662815 - DNA, 18 bp, Homo sapiens
gtggggtgttgtgaggat

SEQ ID NO: 7662816 - DNA, 18 bp, Homo sapiens
gtggggtgttgtgaggat

SEQ ID NO: 7662817 - DNA, 18 bp, Homo sapiens
gtggggtgttgtgaggat

SEQ ID NO: 7662818 - DNA, 18 bp, Homo sapiens
gtggggtgttgtgaggat

SEQ ID NO: 7662819 - DNA, 18 bp, Homo sapiens
gtggggtgttgtgaggat

SEQ ID NO: 7662820 - DNA, 18 bp, Homo sapiens
gtggggtgttgtgaggat

SEQ ID NO: 7662821 - DNA, 22 bp, Homo sapiens
gtggggtgtccagcagcgagct

SEQ ID NO: 7662822 - DNA, 18 bp, Homo sapiens
gtggggtgttgtgaggat

SEQ ID NO: 7662823 - DNA, 18 bp, Homo sapiens
gtggggtgttgtgaggat

SEQ ID NO: 7662824 - DNA, 22 bp, Homo sapiens
gtggggtgtccagcagcgagct

SEQ ID NO: 7662825 - DNA, 22 bp, Homo sapiens
gtggggtgtccagcagcgagct

SEQ ID NO: 7662826 - DNA, 22 bp, Homo sapiens
gtggggtgtccagcagcgagct

SEQ ID NO: 7662827 - DNA, 22 bp, Homo sapiens
gtggggtgtccagcagcgagct

SEQ ID NO: 7662828 - DNA, 22 bp, Homo sapiens
gtggggtgtccagcagcgagct

SEQ ID NO: 7662829 - DNA, 22 bp, Homo sapiens
gtggggtgggctgagttaggcc

SEQ ID NO: 7662830 - DNA, 22 bp, Homo sapiens
gtggggtgggctgagttaggcc

SEQ ID NO: 7662831 - DNA, 22 bp, Homo sapiens
gtggggtgtccagcagcgagct

SEQ ID NO: 7662832 - DNA, 22 bp, Homo sapiens
gtggggtgtccagcagcgagct

SEQ ID NO: 7662833 - DNA, 22 bp, Homo sapiens
gtggggtgggctgagttaggcc

SEQ ID NO: 7662834 - DNA, 22 bp, Homo sapiens
gtggggtgggctgagttaggcc

SEQ ID NO: 7662835 - DNA, 22 bp, Homo sapiens
gtggggtgggctgagttaggcc

SEQ ID NO: 7662836 - DNA, 22 bp, Homo sapiens
gtggggtgggctgagttaggcc

SEQ ID NO: 7662837 - DNA, 22 bp, Homo sapiens
gtggggtgggctgagttaggcc

SEQ ID NO: 7662838 - DNA, 22 bp, Homo sapiens
gtggggtctctctgtacctccc

SEQ ID NO: 7662839 - DNA, 22 bp, Homo sapiens
gtggggtagatctttctcagga

SEQ ID NO: 7662840 - DNA, 22 bp, Homo sapiens
gtggggtctctctgtacctccc

SEQ ID NO: 7662841 - DNA, 22 bp, Homo sapiens
gtggggtctctctgtacctccc

SEQ ID NO: 7662842 - DNA, 22 bp, Homo sapiens
gtggggtctgtcctcttctggg

SEQ ID NO: 7662843 - DNA, 22 bp, Homo sapiens
gtggggtgcagcagtactgtgt

SEQ ID NO: 7662844 - DNA, 22 bp, Homo sapiens
gtggggtgcagcagtactgtgt

SEQ ID NO: 7662845 - DNA, 22 bp, Homo sapiens
gtggggtctgtcctcttctggg

SEQ ID NO: 7662846 - DNA, 22 bp, Homo sapiens
gtggggtgcagcagtactgtgt

SEQ ID NO: 7662847 - DNA, 22 bp, Homo sapiens
gtggggtgcagcagtactgtgt

SEQ ID NO: 7662848 - DNA, 22 bp, Homo sapiens
gtggggtgcagcagtactgtgt

SEQ ID NO: 7662849 - DNA, 22 bp, Homo sapiens
gtgggtgcggggagccgaggcg

SEQ ID NO: 7662850 - DNA, 22 bp, Homo sapiens
gtgggtgcggggagccgaggcg

SEQ ID NO: 7662851 - DNA, 22 bp, Homo sapiens
gtgggtgatgtactggaggcca

SEQ ID NO: 7662852 - DNA, 22 bp, Homo sapiens
gtgggtgatgtactggaggcca

SEQ ID NO: 7662853 - DNA, 22 bp, Homo sapiens
gtgggtgcggggagccgaggcg

SEQ ID NO: 7662854 - DNA, 22 bp, Homo sapiens
gtgggtgctgtcaggcagggaa

SEQ ID NO: 7662855 - DNA, 22 bp, Homo sapiens
gtgggtgcggggagccgaggcg

SEQ ID NO: 7662856 - DNA, 22 bp, Homo sapiens
gtgggtggacggtgcttttgtt

SEQ ID NO: 7662857 - DNA, 18 bp, Homo sapiens
gtggggtgttgtgaggat

SEQ ID NO: 7662858 - DNA, 22 bp, Homo sapiens
gtgggtcagcaagccaggagta

SEQ ID NO: 7662859 - DNA, 22 bp, Homo sapiens
gtgggtcagcaagccaggagta

SEQ ID NO: 7662860 - DNA, 22 bp, Homo sapiens
gtgggtctggctttgagggtca

SEQ ID NO: 7662861 - DNA, 22 bp, Homo sapiens
gtgggtgatgtactggaggcca

SEQ ID NO: 7662862 - DNA, 22 bp, Homo sapiens
gtgggtgatgtactggaggcca

SEQ ID NO: 7662863 - DNA, 22 bp, Homo sapiens
gtgggtgatgtactggaggcca

SEQ ID NO: 7662864 - DNA, 22 bp, Homo sapiens
gtgggtgatgtactggaggcca

SEQ ID NO: 7662865 - DNA, 22 bp, Homo sapiens
gtgggtggagactgggtgcaag

SEQ ID NO: 7662866 - DNA, 22 bp, Homo sapiens
gtgggtggacggtgcttttgtt

SEQ ID NO: 7662867 - DNA, 22 bp, Homo sapiens
gtgggtggacggtgcttttgtt

SEQ ID NO: 7662868 - DNA, 22 bp, Homo sapiens
gtgggtggacggtgcttttgtt

SEQ ID NO: 7662869 - DNA, 22 bp, Homo sapiens
gtgggtggagactgggtgcaag

SEQ ID NO: 7662870 - DNA, 22 bp, Homo sapiens
gtgggtggagactgggtgcaag

SEQ ID NO: 7662871 - DNA, 22 bp, Homo sapiens
gtgggtggagactgggtgcaag

SEQ ID NO: 7662872 - DNA, 22 bp, Homo sapiens
gtgggtggagactgggtgcaag

SEQ ID NO: 7662873 - DNA, 22 bp, Homo sapiens
gtgggtgctgtcaggcagggaa

SEQ ID NO: 7662874 - DNA, 22 bp, Homo sapiens
gtgggtggagactgggtgcaag

SEQ ID NO: 7662875 - DNA, 22 bp, Homo sapiens
gtgggtggagactgggtgcaag

SEQ ID NO: 7662876 - DNA, 22 bp, Homo sapiens
gtgggtggagactgggtgcaag

SEQ ID NO: 7662877 - DNA, 22 bp, Homo sapiens
gtgggtggagactgggtgcaag

SEQ ID NO: 7662878 - DNA, 22 bp, Homo sapiens
gtgggtggagactgggtgcaag

SEQ ID NO: 7662879 - DNA, 22 bp, Homo sapiens
gtgggtggaggcgtcgagggca

SEQ ID NO: 7662880 - DNA, 22 bp, Homo sapiens
gtgggtggaggcgtcgagggca

SEQ ID NO: 7662881 - DNA, 22 bp, Homo sapiens
gtgggtggaggcgtcgagggca

SEQ ID NO: 7662882 - DNA, 22 bp, Homo sapiens
gtgggtggaggcgtcgagggca

SEQ ID NO: 7662883 - DNA, 22 bp, Homo sapiens
gtgggtggaggcgtcgagggca

SEQ ID NO: 7662884 - DNA, 22 bp, Homo sapiens
gtgggtggaggcgtcgagggca

SEQ ID NO: 7662885 - DNA, 22 bp, Homo sapiens
gtgggtggaggcgtcgagggca

SEQ ID NO: 7662886 - DNA, 22 bp, Homo sapiens
gtgggtggaggcgtcgagggca

SEQ ID NO: 7662887 - DNA, 22 bp, Homo sapiens
gtgggtggagactgggtgcaag

SEQ ID NO: 7662888 - DNA, 22 bp, Homo sapiens
gtgggtggagactgggtgcaag

SEQ ID NO: 7662889 - DNA, 22 bp, Homo sapiens
gtgggtggaggcgtcgagggca

SEQ ID NO: 7662890 - DNA, 22 bp, Homo sapiens
gtgggtggagactgggtgcaag

SEQ ID NO: 7662891 - DNA, 20 bp, Homo sapiens
gtggtcacacctgagtgggt

SEQ ID NO: 7662892 - DNA, 22 bp, Homo sapiens
gtggtcaccatgaatgtgggtt

SEQ ID NO: 7662893 - DNA, 22 bp, Homo sapiens
gtggtcagaaatctcagtggca

SEQ ID NO: 7662894 - DNA, 22 bp, Homo sapiens
gtggtcagaaatctcagtggca

SEQ ID NO: 7662895 - DNA, 22 bp, Homo sapiens
gtggtcagaatggagcccagga

SEQ ID NO: 7662896 - DNA, 22 bp, Homo sapiens
gtggtcagaaatctcagtggca

SEQ ID NO: 7662897 - DNA, 22 bp, Homo sapiens
gtggtcagaaatctcagtggca

SEQ ID NO: 7662898 - DNA, 22 bp, Homo sapiens
gtggtcagaaatctcagtggca

SEQ ID NO: 7662899 - DNA, 22 bp, Homo sapiens
gtgggtggaggcgtcgagggca

SEQ ID NO: 7662900 - DNA, 22 bp, Homo sapiens
gtggtatttatgacagtgcccg

SEQ ID NO: 7662901 - DNA, 22 bp, Homo sapiens
gtggtcaaagcatcagagacct

SEQ ID NO: 7662902 - DNA, 20 bp, Homo sapiens
gtggtattcagtaacagtga

SEQ ID NO: 7662903 - DNA, 20 bp, Homo sapiens
gtggtattcagtaacagtga

SEQ ID NO: 7662904 - DNA, 22 bp, Homo sapiens
gtggtcagaatggagcccagga

SEQ ID NO: 7662905 - DNA, 22 bp, Homo sapiens
gtggtcagaatggagcccagga

SEQ ID NO: 7662906 - DNA, 22 bp, Homo sapiens
gtggtcagaatggagcccagga

SEQ ID NO: 7662907 - DNA, 22 bp, Homo sapiens
gtggtcagaatggagcccagga

SEQ ID NO: 7662908 - DNA, 22 bp, Homo sapiens
gtggtcagagatgacagtgggt

SEQ ID NO: 7662909 - DNA, 22 bp, Homo sapiens
gtggtcagagatgacagtgggt

SEQ ID NO: 7662910 - DNA, 22 bp, Homo sapiens
gtggtcagagatgacagtgggt

SEQ ID NO: 7662911 - DNA, 22 bp, Homo sapiens
gtggtcagcagcagtgggagtg

SEQ ID NO: 7662912 - DNA, 22 bp, Homo sapiens
gtggtcagcagcagtgggagtg

SEQ ID NO: 7662913 - DNA, 22 bp, Homo sapiens
gtggtcagagatgacagtgggt

SEQ ID NO: 7662914 - DNA, 22 bp, Homo sapiens
gtggtcagagatgacagtgggt

SEQ ID NO: 7662915 - DNA, 22 bp, Homo sapiens
gtggtcagcagcagtgggagtg

SEQ ID NO: 7662916 - DNA, 22 bp, Homo sapiens
gtggtcagcagcagtgggagtg

SEQ ID NO: 7662917 - DNA, 22 bp, Homo sapiens
gtggtcagtggtacagtttgaa

SEQ ID NO: 7662918 - DNA, 22 bp, Homo sapiens
gtggtcaggttatcagatcata

SEQ ID NO: 7662919 - DNA, 22 bp, Homo sapiens
gtggtcatcacggaaggaagat

SEQ ID NO: 7662920 - DNA, 22 bp, Homo sapiens
gtggtcatcaactgagaatggt

SEQ ID NO: 7662921 - DNA, 22 bp, Homo sapiens
gtggtcaggttatcagatcata

SEQ ID NO: 7662922 - DNA, 22 bp, Homo sapiens
gtggtcaggggctgtggctatg

SEQ ID NO: 7662923 - DNA, 22 bp, Homo sapiens
gtggtcaggggctgtggctatg

SEQ ID NO: 7662924 - DNA, 22 bp, Homo sapiens
gtggtcaggggctgaggtgccc

SEQ ID NO: 7662925 - DNA, 22 bp, Homo sapiens
gtggtcagccccggtgagccct

SEQ ID NO: 7662926 - DNA, 22 bp, Homo sapiens
gtggtcagcagcagtgggagtg

SEQ ID NO: 7662927 - DNA, 22 bp, Homo sapiens
gtggtcagcagcagtgggagtg

SEQ ID NO: 7662928 - DNA, 22 bp, Homo sapiens
gtggtcaggcagtgggagagaa

SEQ ID NO: 7662929 - DNA, 22 bp, Homo sapiens
gtggtcaggcagtgggagagaa

SEQ ID NO: 7662930 - DNA, 22 bp, Homo sapiens
gtggtcaggcagtgggagagaa

SEQ ID NO: 7662931 - DNA, 22 bp, Homo sapiens
gtggtcaggcagtgggagagaa

SEQ ID NO: 7662932 - DNA, 22 bp, Homo sapiens
gtggtcagggagcagagccatg

SEQ ID NO: 7662933 - DNA, 22 bp, Homo sapiens
gtggtcagggagcagagccatg

SEQ ID NO: 7662934 - DNA, 22 bp, Homo sapiens
gtggtcaggcagtgggagagaa

SEQ ID NO: 7662935 - DNA, 22 bp, Homo sapiens
gtggtcaggcagtgggagagaa

SEQ ID NO: 7662936 - DNA, 22 bp, Homo sapiens
gtggtcaggggctgaggtgccc

SEQ ID NO: 7662937 - DNA, 22 bp, Homo sapiens
gtggtcaggggctgaggtgccc

SEQ ID NO: 7662938 - DNA, 22 bp, Homo sapiens
gtggtcaggggctgaggtgccc

SEQ ID NO: 7662939 - DNA, 22 bp, Homo sapiens
gtgtacacatacacatattgaa

SEQ ID NO: 7662940 - DNA, 22 bp, Homo sapiens
gtgtacacatacacatattgaa

SEQ ID NO: 7662941 - DNA, 22 bp, Homo sapiens
gtgtacacatcattcacatata

SEQ ID NO: 7662942 - DNA, 22 bp, Homo sapiens
gtgtacacatcattcacatata

SEQ ID NO: 7662943 - DNA, 22 bp, Homo sapiens
gtgtacacttccttcacacggt

SEQ ID NO: 7662944 - DNA, 22 bp, Homo sapiens
gtgtacacttccttcacacggt

SEQ ID NO: 7662945 - DNA, 22 bp, Homo sapiens
gtgtacaaaatgtctccatgga

SEQ ID NO: 7662946 - DNA, 22 bp, Homo sapiens
gtgtacacacatcgtttgtcat

SEQ ID NO: 7662947 - DNA, 22 bp, Homo sapiens
gtgtacacacatcgtttgtcat

SEQ ID NO: 7662948 - DNA, 22 bp, Homo sapiens
gtgtaattttgtggtcctgtac

SEQ ID NO: 7662949 - DNA, 22 bp, Homo sapiens
gtgtaatttctaggtaatttga

SEQ ID NO: 7662950 - DNA, 22 bp, Homo sapiens
gtgtaattgaaattgagaacca

SEQ ID NO: 7662951 - DNA, 22 bp, Homo sapiens
gtgtaagtggaatcatatagta

SEQ ID NO: 7662952 - DNA, 22 bp, Homo sapiens
gtgtaagtatctttgtatcttt

SEQ ID NO: 7662953 - DNA, 22 bp, Homo sapiens
gtgtaagtatctttgtatcttt

SEQ ID NO: 7662954 - DNA, 22 bp, Homo sapiens
gtgtaatgttgtcagcatcatc

SEQ ID NO: 7662955 - DNA, 22 bp, Homo sapiens
gtgtaattagtagtaaattcaa

SEQ ID NO: 7662956 - DNA, 22 bp, Homo sapiens
gtgtaattatataaagatctac

SEQ ID NO: 7662957 - DNA, 22 bp, Homo sapiens
gtgtaattatataaagatctac

SEQ ID NO: 7662958 - DNA, 22 bp, Homo sapiens
gtgtaattgaaattgagaacca

SEQ ID NO: 7662959 - DNA, 22 bp, Homo sapiens
gtgtaagtatctttgtatcttt

SEQ ID NO: 7662960 - DNA, 22 bp, Homo sapiens
gtgtaagtatctttgtatcttt

SEQ ID NO: 7662961 - DNA, 22 bp, Homo sapiens
gtgtaagtatctttgtatcttt

SEQ ID NO: 7662962 - DNA, 22 bp, Homo sapiens
gtgtaagtatctttgtatcttt

SEQ ID NO: 7662963 - DNA, 22 bp, Homo sapiens
gtgtaagtatctttgtatcttt

SEQ ID NO: 7662964 - DNA, 22 bp, Homo sapiens
gtgtcacatggtttactgcagc

SEQ ID NO: 7662965 - DNA, 22 bp, Homo sapiens
gtgtcacaggcccagctcttca

SEQ ID NO: 7662966 - DNA, 22 bp, Homo sapiens
gtgtcacaggcccagctcttca

SEQ ID NO: 7662967 - DNA, 22 bp, Homo sapiens
gtgtcactggaatactgtctgt

SEQ ID NO: 7662968 - DNA, 22 bp, Homo sapiens
gtgtcaatgaggtttatttttg

SEQ ID NO: 7662969 - DNA, 22 bp, Homo sapiens
gtgtcaatgaggtttatttttg

SEQ ID NO: 7662970 - DNA, 22 bp, Homo sapiens
gtgtcacaagagcccaggaaac

SEQ ID NO: 7662971 - DNA, 22 bp, Homo sapiens
gtgtcacaagagcccaggaaac

SEQ ID NO: 7662972 - DNA, 22 bp, Homo sapiens
gtgtcacaggcccagctcttca

SEQ ID NO: 7662973 - DNA, 22 bp, Homo sapiens
gtgtacaggatgactgtactta

SEQ ID NO: 7662974 - DNA, 22 bp, Homo sapiens
gtgtcaacagccgaagataaat

SEQ ID NO: 7662975 - DNA, 22 bp, Homo sapiens
gtgtacaggatgactgtactta

SEQ ID NO: 7662976 - DNA, 22 bp, Homo sapiens
gtgtacaggatgactgtactta

SEQ ID NO: 7662977 - DNA, 22 bp, Homo sapiens
gtgtcaataaatagcggtgtgg

SEQ ID NO: 7662978 - DNA, 22 bp, Homo sapiens
gtgtacagatatctcacgttct

SEQ ID NO: 7662979 - DNA, 19 bp, Homo sapiens
gtgtacagctcagtgaatt

SEQ ID NO: 7662980 - DNA, 19 bp, Homo sapiens
gtgtacagctcagtgaatt

SEQ ID NO: 7662981 - DNA, 22 bp, Homo sapiens
gtgtacagatatctcacgttct

SEQ ID NO: 7662982 - DNA, 22 bp, Homo sapiens
gtgtacagatatctcacgttct

SEQ ID NO: 7662983 - DNA, 22 bp, Homo sapiens
gtgtacacttgaactgacggtt

SEQ ID NO: 7662984 - DNA, 19 bp, Homo sapiens
gtgtacacttggccatggt

SEQ ID NO: 7662985 - DNA, 22 bp, Homo sapiens
gtggtttgttttattcctggaa

SEQ ID NO: 7662986 - DNA, 22 bp, Homo sapiens
gtggttttacaaagagaaagat

SEQ ID NO: 7662987 - DNA, 22 bp, Homo sapiens
gtggttttaatattcagtctag

SEQ ID NO: 7662988 - DNA, 22 bp, Homo sapiens
gtggttttattcgttcctctgt

SEQ ID NO: 7662989 - DNA, 22 bp, Homo sapiens
gtggttttctccaacccagaac

SEQ ID NO: 7662990 - DNA, 19 bp, Homo sapiens
gtggttttctgaggagtct

SEQ ID NO: 7662991 - DNA, 19 bp, Homo sapiens
gtggttttctgaggagtct

SEQ ID NO: 7662992 - DNA, 22 bp, Homo sapiens
gtgtaaaaacatactatttcta

SEQ ID NO: 7662993 - DNA, 22 bp, Homo sapiens
gtgtaaaaacatactatttcta

SEQ ID NO: 7662994 - DNA, 22 bp, Homo sapiens
gtgtaaaaacatactatttcta

SEQ ID NO: 7662995 - DNA, 22 bp, Homo sapiens
gtgtaaaaacatactatttcta

SEQ ID NO: 7662996 - DNA, 22 bp, Homo sapiens
gtggttttgccattacaagtaa

SEQ ID NO: 7662997 - DNA, 22 bp, Homo sapiens
gtggttttgctttatgagtgaa

SEQ ID NO: 7662998 - DNA, 22 bp, Homo sapiens
gtggttttgctttatgagtgaa

SEQ ID NO: 7662999 - DNA, 22 bp, Homo sapiens
gtggttttggaggccactgttt

SEQ ID NO: 7663000 - DNA, 22 bp, Homo sapiens
gtggtttttagatttctacagt

SEQ ID NO: 7663001 - DNA, 22 bp, Homo sapiens
gtgtaaatgccccattcattga

SEQ ID NO: 7663002 - DNA, 17 bp, Homo sapiens
gtgtaaatgctagaaac

SEQ ID NO: 7663003 - DNA, 22 bp, Homo sapiens
gtgtaaatttgtacttgtaaat

SEQ ID NO: 7663004 - DNA, 17 bp, Homo sapiens
gtgtaactatgagccat

SEQ ID NO: 7663005 - DNA, 22 bp, Homo sapiens
gtgtaaggtgaaatcaacaaat

SEQ ID NO: 7663006 - DNA, 22 bp, Homo sapiens
gtgtaacttgctggaaaaacta

SEQ ID NO: 7663007 - DNA, 22 bp, Homo sapiens
gtgtaacttttattcatgctct

SEQ ID NO: 7663008 - DNA, 22 bp, Homo sapiens
gtgtaaagatgccaggaatctt

SEQ ID NO: 7663009 - DNA, 22 bp, Homo sapiens
gtgtaaagatgccaggaatctt

SEQ ID NO: 7663010 - DNA, 22 bp, Homo sapiens
gtgtaaatcagcttgtgtaata

SEQ ID NO: 7663011 - DNA, 22 bp, Homo sapiens
gtgtaaatcagcttgtgtaata

SEQ ID NO: 7663012 - DNA, 22 bp, Homo sapiens
gtgtaaatcagcttgtgtaata

SEQ ID NO: 7663013 - DNA, 22 bp, Homo sapiens
gtgtaaacacccttactgtggc

SEQ ID NO: 7663014 - DNA, 22 bp, Homo sapiens
gtgtaaaaacatactatttcta

SEQ ID NO: 7663015 - DNA, 22 bp, Homo sapiens
gtgtaaaaacatactatttcta

SEQ ID NO: 7663016 - DNA, 22 bp, Homo sapiens
gtgtaaacaacagtggtttgaa

SEQ ID NO: 7663017 - DNA, 21 bp, Homo sapiens
gtggttctagagaaacagaat

SEQ ID NO: 7663018 - DNA, 21 bp, Homo sapiens
gtggttctagagaaacagaat

SEQ ID NO: 7663019 - DNA, 22 bp, Homo sapiens
gtggttccgaatatttatttct

SEQ ID NO: 7663020 - DNA, 23 bp, Homo sapiens
gtggttcttaaaggtccccagtc

SEQ ID NO: 7663021 - DNA, 22 bp, Homo sapiens
gtggtttgtgcatagctcctat

SEQ ID NO: 7663022 - DNA, 22 bp, Homo sapiens
gtggttgggatcatgggctatg

SEQ ID NO: 7663023 - DNA, 22 bp, Homo sapiens
gtggttgtatagttaaggttca

SEQ ID NO: 7663024 - DNA, 22 bp, Homo sapiens
gtggtgtggctggcagagttta

SEQ ID NO: 7663025 - DNA, 22 bp, Homo sapiens
gtggtgtgtgcttagggctagg

SEQ ID NO: 7663026 - DNA, 22 bp, Homo sapiens
gtggtgtgtgcttagggctagg

SEQ ID NO: 7663027 - DNA, 22 bp, Homo sapiens
gtggtgtttgagctgccaggga

SEQ ID NO: 7663028 - DNA, 22 bp, Homo sapiens
gtggtgtttgagctgccaggga

SEQ ID NO: 7663029 - DNA, 21 bp, Homo sapiens
gtggttattttcattagcatc

SEQ ID NO: 7663030 - DNA, 22 bp, Homo sapiens
gtggtgcaggaagcatctggct

SEQ ID NO: 7663031 - DNA, 22 bp, Homo sapiens
gtggtgagttcaggctggggtg

SEQ ID NO: 7663032 - DNA, 22 bp, Homo sapiens
gtggtgcaggccagcaggggcg

SEQ ID NO: 7663033 - DNA, 22 bp, Homo sapiens
gtggtgcaggccagcaggggcg

SEQ ID NO: 7663034 - DNA, 22 bp, Homo sapiens
gtggtgcaggccagcaggggcg

SEQ ID NO: 7663035 - DNA, 22 bp, Homo sapiens
gtggtgcaggaagcatctggct

SEQ ID NO: 7663036 - DNA, 22 bp, Homo sapiens
gtggtgcaggaagcatctggct

SEQ ID NO: 7663037 - DNA, 22 bp, Homo sapiens
gtggtgcaggccagcaggggcg

SEQ ID NO: 7663038 - DNA, 22 bp, Homo sapiens
gtggtgtggctggcagagttta

SEQ ID NO: 7663039 - DNA, 22 bp, Homo sapiens
gtggtgcatgcatgcatatgta

SEQ ID NO: 7663040 - DNA, 22 bp, Homo sapiens
gtggtgcatccttgagtaagct

SEQ ID NO: 7663041 - DNA, 22 bp, Homo sapiens
gtggtgcatccttgagtaagct

SEQ ID NO: 7663042 - DNA, 22 bp, Homo sapiens
gtggtgcatccttgagtaagct

SEQ ID NO: 7663043 - DNA, 22 bp, Homo sapiens
gtggtgcaggtgtcactgcaga

SEQ ID NO: 7663044 - DNA, 22 bp, Homo sapiens
gtggtgcaggtgtcactgcaga

SEQ ID NO: 7663045 - DNA, 22 bp, Homo sapiens
gtggtgagattgctggatcaaa

SEQ ID NO: 7663046 - DNA, 22 bp, Homo sapiens
gtggtgagagtaggtgtcctct

SEQ ID NO: 7663047 - DNA, 22 bp, Homo sapiens
gtggtgagattgctggatcaaa

SEQ ID NO: 7663048 - DNA, 22 bp, Homo sapiens
gtggtgagttcaggctggggtg

SEQ ID NO: 7663049 - DNA, 22 bp, Homo sapiens
gtggtgagttcaggctggggtg

SEQ ID NO: 7663050 - DNA, 22 bp, Homo sapiens
gtggtgagttcaggctggggtg

SEQ ID NO: 7663051 - DNA, 22 bp, Homo sapiens
gtggtgaagccccatctctgct

SEQ ID NO: 7663052 - DNA, 22 bp, Homo sapiens
gtggtgaagcattgagaagtca

SEQ ID NO: 7663053 - DNA, 18 bp, Homo sapiens
gtggtctttctgtcttct

SEQ ID NO: 7663054 - DNA, 18 bp, Homo sapiens
gtggtctttctgtcttct

SEQ ID NO: 7663055 - DNA, 22 bp, Homo sapiens
gtggtgaagcattgagaagtca

SEQ ID NO: 7663056 - DNA, 22 bp, Homo sapiens
gtggtcttactggagggactct

SEQ ID NO: 7663057 - DNA, 22 bp, Homo sapiens
gtggtctttaaatttgtgcctg

SEQ ID NO: 7663058 - DNA, 22 bp, Homo sapiens
gtggtctttaaatttgtgcctg

SEQ ID NO: 7663059 - DNA, 22 bp, Homo sapiens
gtggtctggggtcaggcctgag

SEQ ID NO: 7663060 - DNA, 22 bp, Homo sapiens
gtggtctggggtcaggcctgag

SEQ ID NO: 7663061 - DNA, 22 bp, Homo sapiens
gtggtctggggtcaggcctgag

SEQ ID NO: 7663062 - DNA, 22 bp, Homo sapiens
gtggtcctttagaggatgtaat

SEQ ID NO: 7663063 - DNA, 22 bp, Homo sapiens
gtggtcctggcaaccatggtga

SEQ ID NO: 7663064 - DNA, 22 bp, Homo sapiens
gtggtcctggcaaccatggtga

SEQ ID NO: 7663065 - DNA, 22 bp, Homo sapiens
gtggtcctggcaaccatggtga

SEQ ID NO: 7663066 - DNA, 22 bp, Homo sapiens
gtggtcctgtcctgacggcttc

SEQ ID NO: 7663067 - DNA, 22 bp, Homo sapiens
gtggtccttacaggaggcttac

SEQ ID NO: 7663068 - DNA, 22 bp, Homo sapiens
gtggtccatcatgcagagctcc

SEQ ID NO: 7663069 - DNA, 22 bp, Homo sapiens
gtggtccccagagctgtgtaca

SEQ ID NO: 7663070 - DNA, 22 bp, Homo sapiens
gtggtccatcatgcagagctcc

SEQ ID NO: 7663071 - DNA, 22 bp, Homo sapiens
gtggtccatcatgcagagctcc

SEQ ID NO: 7663072 - DNA, 22 bp, Homo sapiens
gtggtccagaagagcgcatatg

SEQ ID NO: 7663073 - DNA, 22 bp, Homo sapiens
gtggtccagcgtccacacattc

SEQ ID NO: 7663074 - DNA, 22 bp, Homo sapiens
gtggtccaaggagtttccagca

SEQ ID NO: 7663075 - DNA, 22 bp, Homo sapiens
gtggtcatttgtctgagctcca

SEQ ID NO: 7663076 - DNA, 22 bp, Homo sapiens
gtggtcattgcttgaaagatca

SEQ ID NO: 7663077 - DNA, 22 bp, Homo sapiens
gtggtcctgccagccaggtcca

SEQ ID NO: 7663078 - DNA, 22 bp, Homo sapiens
gtggtcctgcacccgcttggcc

SEQ ID NO: 7663079 - DNA, 22 bp, Homo sapiens
gtggtcctgcacccgcttggcc

SEQ ID NO: 7663080 - DNA, 22 bp, Homo sapiens
gtggtcctgccagccaggtcca

SEQ ID NO: 7663081 - DNA, 22 bp, Homo sapiens
gtggtcctgagtagctttagaa

SEQ ID NO: 7663082 - DNA, 22 bp, Homo sapiens
gtggtcctcttcttctgtttgg

SEQ ID NO: 7663083 - DNA, 22 bp, Homo sapiens
gtggtcctgagtagctttagaa

SEQ ID NO: 7663084 - DNA, 22 bp, Homo sapiens
gtggtcccttctggccctggtc

SEQ ID NO: 7663085 - DNA, 22 bp, Homo sapiens
gtggtccccagagctgtgtaca

SEQ ID NO: 7663086 - DNA, 22 bp, Homo sapiens
gtggtcccttctggccctggtc

SEQ ID NO: 7663087 - DNA, 22 bp, Homo sapiens
gtggtcctcataattcagtgag

SEQ ID NO: 7663088 - DNA, 22 bp, Homo sapiens
gtggtcctcataattcagtgag

SEQ ID NO: 7663089 - DNA, 22 bp, Homo sapiens
gtggtcctcttcttctgtttgg

SEQ ID NO: 7663090 - DNA, 22 bp, Homo sapiens
gtgggggcaggcagtgctagga

SEQ ID NO: 7663091 - DNA, 22 bp, Homo sapiens
gtgggggcaggcagtgctagga

SEQ ID NO: 7663092 - DNA, 22 bp, Homo sapiens
gtgggggcaggcagtgctagga

SEQ ID NO: 7663093 - DNA, 22 bp, Homo sapiens
gtgggggcaggcagtgctagga

SEQ ID NO: 7663094 - DNA, 22 bp, Homo sapiens
gtgggggcaggcagtgctagga

SEQ ID NO: 7663095 - DNA, 22 bp, Homo sapiens
gtgggggcaggcagtgctagga

SEQ ID NO: 7663096 - DNA, 22 bp, Homo sapiens
gtgggggcaggcagtgctagga

SEQ ID NO: 7663097 - DNA, 22 bp, Homo sapiens
gtgggggcaggcagtgctagga

SEQ ID NO: 7663098 - DNA, 22 bp, Homo sapiens
gtgggggcaggcagtgctagga

SEQ ID NO: 7663099 - DNA, 22 bp, Homo sapiens
gtgggggctggaaatcttgcca

SEQ ID NO: 7663100 - DNA, 22 bp, Homo sapiens
gtgggggcagtgggcttcgagc

SEQ ID NO: 7663101 - DNA, 22 bp, Homo sapiens
gtgggggcagtgggcttcgagc

SEQ ID NO: 7663102 - DNA, 22 bp, Homo sapiens
gtgggggcagtgggcttcgagc

SEQ ID NO: 7663103 - DNA, 22 bp, Homo sapiens
gtgggggctggaaatcttgcca

SEQ ID NO: 7663104 - DNA, 22 bp, Homo sapiens
gtgggggctggaaatcttgcca

SEQ ID NO: 7663105 - DNA, 22 bp, Homo sapiens
gtgggggctggaaatcttgcca

SEQ ID NO: 7663106 - DNA, 22 bp, Homo sapiens
gtgggggctggaaatcttgcca

SEQ ID NO: 7663107 - DNA, 22 bp, Homo sapiens
gtgggggctggaaatcttgcca

SEQ ID NO: 7663108 - DNA, 22 bp, Homo sapiens
gtgggggctggaaatcttgcca

SEQ ID NO: 7663109 - DNA, 22 bp, Homo sapiens
gtgggggacccaggtgctgtcc

SEQ ID NO: 7663110 - DNA, 22 bp, Homo sapiens
gtgggggacccaggtgctgtcc

SEQ ID NO: 7663111 - DNA, 22 bp, Homo sapiens
gtggggcttcctggggcaagtt

SEQ ID NO: 7663112 - DNA, 22 bp, Homo sapiens
gtggggcttcctggggcaagtt

SEQ ID NO: 7663113 - DNA, 22 bp, Homo sapiens
gtgggggacccaggtgctgtcc

SEQ ID NO: 7663114 - DNA, 22 bp, Homo sapiens
gtgggggacccaggtgctgtcc

SEQ ID NO: 7663115 - DNA, 22 bp, Homo sapiens
gtgggggacccaggtgctgtcc

SEQ ID NO: 7663116 - DNA, 22 bp, Homo sapiens
gtggggcttcctggggcaagtt

SEQ ID NO: 7663117 - DNA, 22 bp, Homo sapiens
gtggggcttcctggggcaagtt

SEQ ID NO: 7663118 - DNA, 22 bp, Homo sapiens
gtggggcttcctggggcaagtt

SEQ ID NO: 7663119 - DNA, 22 bp, Homo sapiens
gtggggcttcctggggcaagtt

SEQ ID NO: 7663120 - DNA, 22 bp, Homo sapiens
gtggggcttcctggggcaagtt

SEQ ID NO: 7663121 - DNA, 22 bp, Homo sapiens
gtggggcttcctggggcaagtt

SEQ ID NO: 7663122 - DNA, 22 bp, Homo sapiens
gtgggggatgctgagttggaaa

SEQ ID NO: 7663123 - DNA, 22 bp, Homo sapiens
gtgggggatgctgagttggaaa

SEQ ID NO: 7663124 - DNA, 22 bp, Homo sapiens
gtgggggatgctgagttggaaa

SEQ ID NO: 7663125 - DNA, 22 bp, Homo sapiens
gtgggggatgctgagttggaaa

SEQ ID NO: 7663126 - DNA, 22 bp, Homo sapiens
gtgggggatgctgagttggaaa

SEQ ID NO: 7663127 - DNA, 22 bp, Homo sapiens
gtgggggagatgcttaggtccg

SEQ ID NO: 7663128 - DNA, 22 bp, Homo sapiens
gtgggggacccaggtgctgtcc

SEQ ID NO: 7663129 - DNA, 22 bp, Homo sapiens
gtggggaggcctaagcaagttg

SEQ ID NO: 7663130 - DNA, 22 bp, Homo sapiens
gtggggaggcctaagcaagttg

SEQ ID NO: 7663131 - DNA, 22 bp, Homo sapiens
gtggggaggcattcttctccct

SEQ ID NO: 7663132 - DNA, 22 bp, Homo sapiens
gtggggaggcattcttctccct

SEQ ID NO: 7663133 - DNA, 22 bp, Homo sapiens
gtggggaggcattcttctccct

SEQ ID NO: 7663134 - DNA, 22 bp, Homo sapiens
gtggggaggcctaagcaagttg

SEQ ID NO: 7663135 - DNA, 22 bp, Homo sapiens
gtggggaggcattcttctccct

SEQ ID NO: 7663136 - DNA, 22 bp, Homo sapiens
gtggggaggcattcttctccct

SEQ ID NO: 7663137 - DNA, 22 bp, Homo sapiens
gtggggaggcattcttctccct

SEQ ID NO: 7663138 - DNA, 22 bp, Homo sapiens
gtggggaggcattcttctccct

SEQ ID NO: 7663139 - DNA, 22 bp, Homo sapiens
gtggggaggcctaagcaagttg

SEQ ID NO: 7663140 - DNA, 22 bp, Homo sapiens
gtggggaggcctaagcaagttg

SEQ ID NO: 7663141 - DNA, 22 bp, Homo sapiens
gtggggaggcctaagcaagttg

SEQ ID NO: 7663142 - DNA, 22 bp, Homo sapiens
gtggggctggaagatgggtact

SEQ ID NO: 7663143 - DNA, 22 bp, Homo sapiens
gtggggctggaagatgggtact

SEQ ID NO: 7663144 - DNA, 22 bp, Homo sapiens
gtggggaggcctaagcaagttg

SEQ ID NO: 7663145 - DNA, 22 bp, Homo sapiens
gtggggaggcctaagcaagttg

SEQ ID NO: 7663146 - DNA, 22 bp, Homo sapiens
gtggggaggcctaagcaagttg

SEQ ID NO: 7663147 - DNA, 22 bp, Homo sapiens
gtggggaggcctaagcaagttg

SEQ ID NO: 7663148 - DNA, 22 bp, Homo sapiens
gtggggaggcctaagcaagttg

SEQ ID NO: 7663149 - DNA, 22 bp, Homo sapiens
gtggggacgggatggctcactg

SEQ ID NO: 7663150 - DNA, 22 bp, Homo sapiens
gtggggaaaggagtggggctca

SEQ ID NO: 7663151 - DNA, 22 bp, Homo sapiens
gtggggaaaggagtggggctca

SEQ ID NO: 7663152 - DNA, 22 bp, Homo sapiens
gtggggaaaggagtggggctca

SEQ ID NO: 7663153 - DNA, 22 bp, Homo sapiens
gtggggaaaggagtggggctca

SEQ ID NO: 7663154 - DNA, 22 bp, Homo sapiens
gtggggaaaggagtggggctca

SEQ ID NO: 7663155 - DNA, 22 bp, Homo sapiens
gtggggaaaggagtggggctca

SEQ ID NO: 7663156 - DNA, 22 bp, Homo sapiens
gtggggagcagccttagcccct

SEQ ID NO: 7663157 - DNA, 22 bp, Homo sapiens
gtggggagcagccttagcccct

SEQ ID NO: 7663158 - DNA, 22 bp, Homo sapiens
gtggggagcagccttagcccct

SEQ ID NO: 7663159 - DNA, 22 bp, Homo sapiens
gtggggaggcattcttctccct

SEQ ID NO: 7663160 - DNA, 22 bp, Homo sapiens
gtggggagcagccttagcccct

SEQ ID NO: 7663161 - DNA, 22 bp, Homo sapiens
gtggggagcagccttagcccct

SEQ ID NO: 7663162 - DNA, 22 bp, Homo sapiens
gtggggagcagccttagcccct

SEQ ID NO: 7663163 - DNA, 22 bp, Homo sapiens
gtggggagcagccttagcccct

SEQ ID NO: 7663164 - DNA, 22 bp, Homo sapiens
gtggggagcagccttagcccct

SEQ ID NO: 7663165 - DNA, 22 bp, Homo sapiens
gtgggctggaccctcctgctcc

SEQ ID NO: 7663166 - DNA, 22 bp, Homo sapiens
gtgggctggaccctcctgctcc

SEQ ID NO: 7663167 - DNA, 22 bp, Homo sapiens
gtgggctggaccctcctgctcc

SEQ ID NO: 7663168 - DNA, 22 bp, Homo sapiens
gtgggctggaccctcctgctcc

SEQ ID NO: 7663169 - DNA, 22 bp, Homo sapiens
gtgggctgcttcctccttccac

SEQ ID NO: 7663170 - DNA, 22 bp, Homo sapiens
gtgggctggaccctcctgctcc

SEQ ID NO: 7663171 - DNA, 22 bp, Homo sapiens
gtgggctgcttcctccttccac

SEQ ID NO: 7663172 - DNA, 22 bp, Homo sapiens
gtgggctgcttcctccttccac

SEQ ID NO: 7663173 - DNA, 22 bp, Homo sapiens
gtgggctgcccttgaggtcagc

SEQ ID NO: 7663174 - DNA, 22 bp, Homo sapiens
gtgggctgcccttgaggtcagc

SEQ ID NO: 7663175 - DNA, 22 bp, Homo sapiens
gtgggctgcccttgaggtcagc

SEQ ID NO: 7663176 - DNA, 22 bp, Homo sapiens
gtgggctgcccttgaggtcagc

SEQ ID NO: 7663177 - DNA, 22 bp, Homo sapiens
gtgggctgcccttgaggtcagc

SEQ ID NO: 7663178 - DNA, 22 bp, Homo sapiens
gtgggctgcccttgaggtcagc

SEQ ID NO: 7663179 - DNA, 22 bp, Homo sapiens
gtgggctgcccttgaggtcagc

SEQ ID NO: 7663180 - DNA, 22 bp, Homo sapiens
gtgggctgcccttgaggtcagc

SEQ ID NO: 7663181 - DNA, 22 bp, Homo sapiens
gtgggctgcccttgaggtcagc

SEQ ID NO: 7663182 - DNA, 22 bp, Homo sapiens
gtgggctgcttcctccttccac

SEQ ID NO: 7663183 - DNA, 22 bp, Homo sapiens
gtgggctggatttgcttgcaga

SEQ ID NO: 7663184 - DNA, 22 bp, Homo sapiens
gtgggctggatttgcttgcaga

SEQ ID NO: 7663185 - DNA, 22 bp, Homo sapiens
gtgggctggatttgcttgcaga

SEQ ID NO: 7663186 - DNA, 22 bp, Homo sapiens
gtgggctggatttgcttgcaga

SEQ ID NO: 7663187 - DNA, 22 bp, Homo sapiens
gtgggctggagcaatgatttca

SEQ ID NO: 7663188 - DNA, 22 bp, Homo sapiens
gtgggctggagcaatgatttca

SEQ ID NO: 7663189 - DNA, 22 bp, Homo sapiens
gtgggctggaccctcctgctcc

SEQ ID NO: 7663190 - DNA, 22 bp, Homo sapiens
gtgggctggaccctcctgctcc

SEQ ID NO: 7663191 - DNA, 22 bp, Homo sapiens
gtgggctggaccctcctgctcc

SEQ ID NO: 7663192 - DNA, 22 bp, Homo sapiens
gtgggctggaccctcctgctcc

SEQ ID NO: 7663193 - DNA, 22 bp, Homo sapiens
gtgggctgttgttccctgttct

SEQ ID NO: 7663194 - DNA, 22 bp, Homo sapiens
gtgggctgttgttccctgttct

SEQ ID NO: 7663195 - DNA, 22 bp, Homo sapiens
gtgggctgttgttccctgttct

SEQ ID NO: 7663196 - DNA, 22 bp, Homo sapiens
gtgggcttgttttgatgagatc

SEQ ID NO: 7663197 - DNA, 22 bp, Homo sapiens
gtgggcttctgttagggaggct

SEQ ID NO: 7663198 - DNA, 22 bp, Homo sapiens
gtgggctgttgttccctgttct

SEQ ID NO: 7663199 - DNA, 22 bp, Homo sapiens
gtgggctttgctggatccttcc

SEQ ID NO: 7663200 - DNA, 22 bp, Homo sapiens
gtgggccttgcagggtgcaggg

SEQ ID NO: 7663201 - DNA, 22 bp, Homo sapiens
gtgggccttcaaccctgtctgg

SEQ ID NO: 7663202 - DNA, 22 bp, Homo sapiens
gtgggccttcaaccctgtctgg

SEQ ID NO: 7663203 - DNA, 22 bp, Homo sapiens
gtgggccttgcagggtgcaggg

SEQ ID NO: 7663204 - DNA, 22 bp, Homo sapiens
gtgggcctgatgctgccatgag

SEQ ID NO: 7663205 - DNA, 22 bp, Homo sapiens
gtgggccttgcagggtgcaggg

SEQ ID NO: 7663206 - DNA, 22 bp, Homo sapiens
gtgggcctcttgagggtggcta

SEQ ID NO: 7663207 - DNA, 22 bp, Homo sapiens
gtgggcctcttgagggtggcta

SEQ ID NO: 7663208 - DNA, 22 bp, Homo sapiens
gtgggcctgatgctgccatgag

SEQ ID NO: 7663209 - DNA, 22 bp, Homo sapiens
gtgggcctgatgctgccatgag

SEQ ID NO: 7663210 - DNA, 22 bp, Homo sapiens
gtgggcctgatgctgccatgag

SEQ ID NO: 7663211 - DNA, 22 bp, Homo sapiens
gtgggcctcttgagggtggcta

SEQ ID NO: 7663212 - DNA, 22 bp, Homo sapiens
gtgggcctcttgagggtggcta

SEQ ID NO: 7663213 - DNA, 22 bp, Homo sapiens
gtgggccaggcgtctaggccct

SEQ ID NO: 7663214 - DNA, 22 bp, Homo sapiens
gtgggccaggcgtctaggccct

SEQ ID NO: 7663215 - DNA, 22 bp, Homo sapiens
gtgggccaggcgtctaggccct

SEQ ID NO: 7663216 - DNA, 22 bp, Homo sapiens
gtgggccagttcctcacaggta

SEQ ID NO: 7663217 - DNA, 22 bp, Homo sapiens
gtgggcctcccctttacgagcc

SEQ ID NO: 7663218 - DNA, 22 bp, Homo sapiens
gtgggccagttcctcacaggta

SEQ ID NO: 7663219 - DNA, 22 bp, Homo sapiens
gtgggccagttcctcacaggta

SEQ ID NO: 7663220 - DNA, 22 bp, Homo sapiens
gtgggcctcccctttacgagcc

SEQ ID NO: 7663221 - DNA, 22 bp, Homo sapiens
gtgggctcaggcctctgtgggg

SEQ ID NO: 7663222 - DNA, 22 bp, Homo sapiens
gtgggctgaggggacaccaagg

SEQ ID NO: 7663223 - DNA, 22 bp, Homo sapiens
gtgggctcccctggcatgtcca

SEQ ID NO: 7663224 - DNA, 22 bp, Homo sapiens
gtgggctgaggggacaccaagg

SEQ ID NO: 7663225 - DNA, 22 bp, Homo sapiens
gtgggctgaggggacaccaagg

SEQ ID NO: 7663226 - DNA, 22 bp, Homo sapiens
gtgggctgcccttgaggtcagc

SEQ ID NO: 7663227 - DNA, 22 bp, Homo sapiens
gtgggctgaggggacaccaagg

SEQ ID NO: 7663228 - DNA, 22 bp, Homo sapiens
gtgggctgcatgtttactattc

SEQ ID NO: 7663229 - DNA, 22 bp, Homo sapiens
gtgggctgcatgtttactattc

SEQ ID NO: 7663230 - DNA, 22 bp, Homo sapiens
gtgggctgcccttgaggtcagc

SEQ ID NO: 7663231 - DNA, 22 bp, Homo sapiens
gtgggctcccctggcatgtcca

SEQ ID NO: 7663232 - DNA, 22 bp, Homo sapiens
gtgggctcaggcctctgtgggg

SEQ ID NO: 7663233 - DNA, 22 bp, Homo sapiens
gtgggcctttcaggcgatctgg

SEQ ID NO: 7663234 - DNA, 23 bp, Homo sapiens
gtgggcgcccaggagcgggacgg

SEQ ID NO: 7663235 - DNA, 22 bp, Homo sapiens
gtgggccttgcagggtgcaggg

SEQ ID NO: 7663236 - DNA, 22 bp, Homo sapiens
gtgggccttgcagggtgcaggg

SEQ ID NO: 7663237 - DNA, 22 bp, Homo sapiens
gtgggccttgcagggtgcaggg

SEQ ID NO: 7663238 - DNA, 22 bp, Homo sapiens
gtgggccttgcagggtgcaggg

SEQ ID NO: 7663239 - DNA, 22 bp, Homo sapiens
gtgggccttgcagggtgcaggg

SEQ ID NO: 7663240 - DNA, 22 bp, Homo sapiens
gtgggccttgcagggtgcaggg

SEQ ID NO: 7663241 - DNA, 22 bp, Homo sapiens
gtgggcagcctgtccggagacc

SEQ ID NO: 7663242 - DNA, 22 bp, Homo sapiens
gtgggcagcctcctttattttc

SEQ ID NO: 7663243 - DNA, 22 bp, Homo sapiens
gtgggcagcctcctttattttc

SEQ ID NO: 7663244 - DNA, 22 bp, Homo sapiens
gtgggcagccccttcaaggcca

SEQ ID NO: 7663245 - DNA, 22 bp, Homo sapiens
gtgggcagccccttcaaggcca

SEQ ID NO: 7663246 - DNA, 22 bp, Homo sapiens
gtgggcagccccttcaaggcca

SEQ ID NO: 7663247 - DNA, 22 bp, Homo sapiens
gtgggcagccccttcaaggcca

SEQ ID NO: 7663248 - DNA, 22 bp, Homo sapiens
gtgggcagccccttcaaggcca

SEQ ID NO: 7663249 - DNA, 22 bp, Homo sapiens
gtgggcaggaggccctgccctg

SEQ ID NO: 7663250 - DNA, 22 bp, Homo sapiens
gtgggcaggaggccctgccctg

SEQ ID NO: 7663251 - DNA, 22 bp, Homo sapiens
gtgggcaggaggccctgccctg

SEQ ID NO: 7663252 - DNA, 22 bp, Homo sapiens
gtgggcagcctgtccggagacc

SEQ ID NO: 7663253 - DNA, 22 bp, Homo sapiens
gtgggcagcctgtccggagacc

SEQ ID NO: 7663254 - DNA, 22 bp, Homo sapiens
gtgggcagcctgtccggagacc

SEQ ID NO: 7663255 - DNA, 22 bp, Homo sapiens
gtgggcagcctgtccggagacc

SEQ ID NO: 7663256 - DNA, 22 bp, Homo sapiens
gtgggcagcctgtccggagacc

SEQ ID NO: 7663257 - DNA, 22 bp, Homo sapiens
gtgggcagcctgtccggagacc

SEQ ID NO: 7663258 - DNA, 22 bp, Homo sapiens
gtgggcagcctgtccggagacc

SEQ ID NO: 7663259 - DNA, 22 bp, Homo sapiens
gtgggcagccccttcaaggcca

SEQ ID NO: 7663260 - DNA, 22 bp, Homo sapiens
gtgggcaggaggccctgccctg

SEQ ID NO: 7663261 - DNA, 22 bp, Homo sapiens
gtgggcagtggtttgcgcggtc

SEQ ID NO: 7663262 - DNA, 22 bp, Homo sapiens
gtgggcagtggtttgcgcggtc

SEQ ID NO: 7663263 - DNA, 22 bp, Homo sapiens
gtgggcagtggtttgcgcggtc

SEQ ID NO: 7663264 - DNA, 22 bp, Homo sapiens
gtgggcagtggtttgcgcggtc

SEQ ID NO: 7663265 - DNA, 22 bp, Homo sapiens
gtgggcagtggtttgcgcggtc

SEQ ID NO: 7663266 - DNA, 22 bp, Homo sapiens
gtgggcagtgtgtcagtatctt

SEQ ID NO: 7663267 - DNA, 22 bp, Homo sapiens
gtgggcagtggtttgcgcggtc

SEQ ID NO: 7663268 - DNA, 22 bp, Homo sapiens
gtgggcagtggtttgcgcggtc

SEQ ID NO: 7663269 - DNA, 22 bp, Homo sapiens
gtgggcagttcaattctgggag

SEQ ID NO: 7663270 - DNA, 22 bp, Homo sapiens
gtgggcagttcaattctgggag

SEQ ID NO: 7663271 - DNA, 22 bp, Homo sapiens
gtgggcagttcaattctgggag

SEQ ID NO: 7663272 - DNA, 22 bp, Homo sapiens
gtgggcagttcaattctgggag

SEQ ID NO: 7663273 - DNA, 22 bp, Homo sapiens
gtgggcagtgtgtcagtatctt

SEQ ID NO: 7663274 - DNA, 22 bp, Homo sapiens
gtgggcagttcaattctgggag

SEQ ID NO: 7663275 - DNA, 22 bp, Homo sapiens
gtgggcagtgtgtcagtatctt

SEQ ID NO: 7663276 - DNA, 22 bp, Homo sapiens
gtgggcagtgtgtcagtatctt

SEQ ID NO: 7663277 - DNA, 22 bp, Homo sapiens
gtgggcagtgtgtcagtatctt

SEQ ID NO: 7663278 - DNA, 22 bp, Homo sapiens
gtgggcagttggtgattctcgt

SEQ ID NO: 7663279 - DNA, 22 bp, Homo sapiens
gtgggcagttggtgattctcgt

SEQ ID NO: 7663280 - DNA, 22 bp, Homo sapiens
gtgggcagttggtgattctcgt

SEQ ID NO: 7663281 - DNA, 22 bp, Homo sapiens
gtgggcagttggtgattctcgt

SEQ ID NO: 7663282 - DNA, 22 bp, Homo sapiens
gtgggcatcaccagggcctcca

SEQ ID NO: 7663283 - DNA, 20 bp, Homo sapiens
gtgggcatcagtcacagtgt

SEQ ID NO: 7663284 - DNA, 20 bp, Homo sapiens
gtgggcatcagtcacagtgt

SEQ ID NO: 7663285 - DNA, 20 bp, Homo sapiens
gtgggcatcagtcacagtgt

SEQ ID NO: 7663286 - DNA, 22 bp, Homo sapiens
gtgggcatctccttggaagcca

SEQ ID NO: 7663287 - DNA, 22 bp, Homo sapiens
gtgggcatgggaatctcaatga

SEQ ID NO: 7663288 - DNA, 22 bp, Homo sapiens
gtgggcattggagggggtacag

SEQ ID NO: 7663289 - DNA, 22 bp, Homo sapiens
gtgggcattggagggggtacag

SEQ ID NO: 7663290 - DNA, 22 bp, Homo sapiens
gtgggcatgggaatctcaatga

SEQ ID NO: 7663291 - DNA, 22 bp, Homo sapiens
gtgggccacatcccagggctct

SEQ ID NO: 7663292 - DNA, 22 bp, Homo sapiens
gtgggccacatcccagggctct

SEQ ID NO: 7663293 - DNA, 22 bp, Homo sapiens
gtgggccacatcccagggctct

SEQ ID NO: 7663294 - DNA, 22 bp, Homo sapiens
gtgggccacatcccagggctct

SEQ ID NO: 7663295 - DNA, 22 bp, Homo sapiens
gtgggccacatcccagggctct

SEQ ID NO: 7663296 - DNA, 22 bp, Homo sapiens
gtgggccactgggaggcaaggg

SEQ ID NO: 7663297 - DNA, 22 bp, Homo sapiens
gtgggccactgggaggcaaggg

SEQ ID NO: 7663298 - DNA, 22 bp, Homo sapiens
gtgggccactgggaggcaaggg

SEQ ID NO: 7663299 - DNA, 22 bp, Homo sapiens
gtgggccactgggaggcaaggg

SEQ ID NO: 7663300 - DNA, 22 bp, Homo sapiens
gtgggccacatcccagggctct

SEQ ID NO: 7663301 - DNA, 22 bp, Homo sapiens
gtgggccaggacccgctgtccg

SEQ ID NO: 7663302 - DNA, 19 bp, Homo sapiens
gtgggccaggcagaaggct

SEQ ID NO: 7663303 - DNA, 22 bp, Homo sapiens
gtgggccagcttttctcctggg

SEQ ID NO: 7663304 - DNA, 22 bp, Homo sapiens
gtgggccaggacccgctgtccg

SEQ ID NO: 7663305 - DNA, 22 bp, Homo sapiens
gtgggccaggacccgctgtccg

SEQ ID NO: 7663306 - DNA, 22 bp, Homo sapiens
gtgggccagcttttctcctggg

SEQ ID NO: 7663307 - DNA, 22 bp, Homo sapiens
gtgggccagcttttctcctggg

SEQ ID NO: 7663308 - DNA, 22 bp, Homo sapiens
gtgggccagcattttgaagagt

SEQ ID NO: 7663309 - DNA, 22 bp, Homo sapiens
gtgggccagcttttctcctggg

SEQ ID NO: 7663310 - DNA, 22 bp, Homo sapiens
gtgggccactgggaggcaaggg

SEQ ID NO: 7663311 - DNA, 22 bp, Homo sapiens
gtgggccaggcgtctaggccct

SEQ ID NO: 7663312 - DNA, 22 bp, Homo sapiens
gtgggccaggcgtctaggccct

SEQ ID NO: 7663313 - DNA, 22 bp, Homo sapiens
gtgggccaggcgtctaggccct

SEQ ID NO: 7663314 - DNA, 22 bp, Homo sapiens
gtgggccaggccggagtgcaga

SEQ ID NO: 7663315 - DNA, 22 bp, Homo sapiens
gtgggccaggccggagtgcaga

SEQ ID NO: 7663316 - DNA, 19 bp, Homo sapiens
gtgggccaggcagaaggct

SEQ ID NO: 7663317 - DNA, 19 bp, Homo sapiens
gtgggccaggcagaaggct

SEQ ID NO: 7663318 - DNA, 19 bp, Homo sapiens
gtgggccaggcagaaggct

SEQ ID NO: 7663319 - DNA, 22 bp, Homo sapiens
gtgggccaggccggagtgcaga

SEQ ID NO: 7663320 - DNA, 22 bp, Homo sapiens
gtgggccaggccggagtgcaga

SEQ ID NO: 7663321 - DNA, 22 bp, Homo sapiens
gtgggcagaggagagaacatta

SEQ ID NO: 7663322 - DNA, 22 bp, Homo sapiens
gtgggcagaggagagaacatta

SEQ ID NO: 7663323 - DNA, 20 bp, Homo sapiens
gtgggcagagcaccacctgg

SEQ ID NO: 7663324 - DNA, 20 bp, Homo sapiens
gtgggcagagcaccacctgg

SEQ ID NO: 7663325 - DNA, 22 bp, Homo sapiens
gtgggcagagcaagggaactca

SEQ ID NO: 7663326 - DNA, 20 bp, Homo sapiens
gtgggcagagcaccacctgg

SEQ ID NO: 7663327 - DNA, 20 bp, Homo sapiens
gtgggcagagcaccacctgg

SEQ ID NO: 7663328 - DNA, 20 bp, Homo sapiens
gtgggcagagcaccacctgg

SEQ ID NO: 7663329 - DNA, 20 bp, Homo sapiens
gtgggcagagcaccacctgg

SEQ ID NO: 7663330 - DNA, 22 bp, Homo sapiens
gtgggcagagcaagggaactca

SEQ ID NO: 7663331 - DNA, 22 bp, Homo sapiens
gtgggcagagcaagggaactca

SEQ ID NO: 7663332 - DNA, 22 bp, Homo sapiens
gtgggcagagcaagggaactca

SEQ ID NO: 7663333 - DNA, 22 bp, Homo sapiens
gtgggcagagcaagggaactca

SEQ ID NO: 7663334 - DNA, 22 bp, Homo sapiens
gtgggcagacatgatagaagga

SEQ ID NO: 7663335 - DNA, 22 bp, Homo sapiens
gtgggcagagcaagggaactca

SEQ ID NO: 7663336 - DNA, 22 bp, Homo sapiens
gtgggcagagcaagggaactca

SEQ ID NO: 7663337 - DNA, 22 bp, Homo sapiens
gtgggcagagcaagggaactca

SEQ ID NO: 7663338 - DNA, 22 bp, Homo sapiens
gtgggcagagcaagggaactca

SEQ ID NO: 7663339 - DNA, 22 bp, Homo sapiens
gtgggcagacatgatagaagga

SEQ ID NO: 7663340 - DNA, 22 bp, Homo sapiens
gtgggcagacatgatagaagga

SEQ ID NO: 7663341 - DNA, 22 bp, Homo sapiens
gtgggcagacatgatagaagga

SEQ ID NO: 7663342 - DNA, 22 bp, Homo sapiens
gtgggcagacatgatagaagga

SEQ ID NO: 7663343 - DNA, 22 bp, Homo sapiens
gtgggcagacatgatagaagga

SEQ ID NO: 7663344 - DNA, 22 bp, Homo sapiens
gtgggcagacagtgctttgcag

SEQ ID NO: 7663345 - DNA, 22 bp, Homo sapiens
gtgggcagacagtgctttgcag

SEQ ID NO: 7663346 - DNA, 22 bp, Homo sapiens
gtgggcagacagtgctttgcag

SEQ ID NO: 7663347 - DNA, 22 bp, Homo sapiens
gtgggcagacagtgctttgcag

SEQ ID NO: 7663348 - DNA, 22 bp, Homo sapiens
gtgggcagaacatttgtaggct

SEQ ID NO: 7663349 - DNA, 22 bp, Homo sapiens
gtgggcagaacatttgtaggct

SEQ ID NO: 7663350 - DNA, 22 bp, Homo sapiens
gtgggcagaattgaatctttaa

SEQ ID NO: 7663351 - DNA, 22 bp, Homo sapiens
gtgggcagacagtgctttgcag

SEQ ID NO: 7663352 - DNA, 22 bp, Homo sapiens
gtgggcagaacatttgtaggct

SEQ ID NO: 7663353 - DNA, 22 bp, Homo sapiens
gtgggcaaggtccctgccagct

SEQ ID NO: 7663354 - DNA, 22 bp, Homo sapiens
gtgggcagaacatttgtaggct

SEQ ID NO: 7663355 - DNA, 22 bp, Homo sapiens
gtgggcagccccttcaaggcca

SEQ ID NO: 7663356 - DNA, 22 bp, Homo sapiens
gtgggcagccccttcaaggcca

SEQ ID NO: 7663357 - DNA, 20 bp, Homo sapiens
gtgggcagcaggcatactgg

SEQ ID NO: 7663358 - DNA, 20 bp, Homo sapiens
gtgggcagcaggcatactgg

SEQ ID NO: 7663359 - DNA, 20 bp, Homo sapiens
gtgggcagcaggcatactgg

SEQ ID NO: 7663360 - DNA, 20 bp, Homo sapiens
gtgggcagcaggcatactgg

SEQ ID NO: 7663361 - DNA, 20 bp, Homo sapiens
gtgggcagcaggcatactgg

SEQ ID NO: 7663362 - DNA, 22 bp, Homo sapiens
gtgggcagcaccagggaagtgt

SEQ ID NO: 7663363 - DNA, 22 bp, Homo sapiens
gtgggcagcaccagggaagtgt

SEQ ID NO: 7663364 - DNA, 22 bp, Homo sapiens
gtgggcagcaccagggaagtgt

SEQ ID NO: 7663365 - DNA, 22 bp, Homo sapiens
gtgggcagcaccagggaagtgt

SEQ ID NO: 7663366 - DNA, 22 bp, Homo sapiens
gtgggcagcaccagggaagtgt

SEQ ID NO: 7663367 - DNA, 22 bp, Homo sapiens
gtgggcagcaccagggaagtgt

SEQ ID NO: 7663368 - DNA, 20 bp, Homo sapiens
gtgggcagcaggcatactgg

SEQ ID NO: 7663369 - DNA, 22 bp, Homo sapiens
gtgggcagcaccagggaagtgt

SEQ ID NO: 7663370 - DNA, 22 bp, Homo sapiens
gtgggcagcaccagggaagtgt

SEQ ID NO: 7663371 - DNA, 22 bp, Homo sapiens
gtgggcagcaccagggaagtgt

SEQ ID NO: 7663372 - DNA, 20 bp, Homo sapiens
gtgggcagatgtgtgcatgg

SEQ ID NO: 7663373 - DNA, 20 bp, Homo sapiens
gtgggcagatgtgtgcatgg

SEQ ID NO: 7663374 - DNA, 20 bp, Homo sapiens
gtgggcagatgtgtgcatgg

SEQ ID NO: 7663375 - DNA, 20 bp, Homo sapiens
gtgggcagatgtgtgcatgg

SEQ ID NO: 7663376 - DNA, 22 bp, Homo sapiens
gtgggcagatacatttgatatg

SEQ ID NO: 7663377 - DNA, 22 bp, Homo sapiens
gtgggcagaggagagaacatta

SEQ ID NO: 7663378 - DNA, 22 bp, Homo sapiens
gtgggcagaggagagaacatta

SEQ ID NO: 7663379 - DNA, 22 bp, Homo sapiens
gtgggcagaggagagaacatta

SEQ ID NO: 7663380 - DNA, 22 bp, Homo sapiens
gtgggcagattatagatgatgc

SEQ ID NO: 7663381 - DNA, 22 bp, Homo sapiens
gtgggcagattatagatgatgc

SEQ ID NO: 7663382 - DNA, 22 bp, Homo sapiens
gtgggcagattatagatgatgc

SEQ ID NO: 7663383 - DNA, 22 bp, Homo sapiens
gtgggcagcaccagggaagtgt

SEQ ID NO: 7663384 - DNA, 22 bp, Homo sapiens
gtgggcagattatagatgatgc

SEQ ID NO: 7663385 - DNA, 22 bp, Homo sapiens
gtgggcagattatagatgatgc

SEQ ID NO: 7663386 - DNA, 22 bp, Homo sapiens
gtgggcagattatagatgatgc

SEQ ID NO: 7663387 - DNA, 22 bp, Homo sapiens
gtgggcagattatagatgatgc

SEQ ID NO: 7663388 - DNA, 22 bp, Homo sapiens
gtgggcagattaatttctcaat

SEQ ID NO: 7663389 - DNA, 22 bp, Homo sapiens
gtgggcagattaatttctcaat

SEQ ID NO: 7663390 - DNA, 22 bp, Homo sapiens
gtgggcagattaatttctcaat

SEQ ID NO: 7663391 - DNA, 22 bp, Homo sapiens
taagaaatttagttatagaatg

SEQ ID NO: 7663392 - DNA, 22 bp, Homo sapiens
taagaaatttagttatagaatg

SEQ ID NO: 7663393 - DNA, 20 bp, Homo sapiens
taagaacaagactaggaagc

SEQ ID NO: 7663394 - DNA, 20 bp, Homo sapiens
taagaacaagactaggaagc

SEQ ID NO: 7663395 - DNA, 20 bp, Homo sapiens
taagaacaagactaggaagc

SEQ ID NO: 7663396 - DNA, 22 bp, Homo sapiens
taagaaatttagttatagaatg

SEQ ID NO: 7663397 - DNA, 22 bp, Homo sapiens
taagaaatttagttatagaatg

SEQ ID NO: 7663398 - DNA, 22 bp, Homo sapiens
taagaaatttagttatagaatg

SEQ ID NO: 7663399 - DNA, 22 bp, Homo sapiens
taagaaatttagttatagaatg

SEQ ID NO: 7663400 - DNA, 22 bp, Homo sapiens
taagaaatttagttatagaatg

SEQ ID NO: 7663401 - DNA, 22 bp, Homo sapiens
taacagcagggttacaggcatt

SEQ ID NO: 7663402 - DNA, 22 bp, Homo sapiens
taacagcagggttacaggcatt

SEQ ID NO: 7663403 - DNA, 22 bp, Homo sapiens
taacagcagggttacaggcatt

SEQ ID NO: 7663404 - DNA, 21 bp, Homo sapiens
taacagcagggaaatacgtgc

SEQ ID NO: 7663405 - DNA, 22 bp, Homo sapiens
taacagcagggttacaggcatt

SEQ ID NO: 7663406 - DNA, 22 bp, Homo sapiens
taacagcagtcctcttctcatg

SEQ ID NO: 7663407 - DNA, 22 bp, Homo sapiens
taacagcagggttacaggcatt

SEQ ID NO: 7663408 - DNA, 22 bp, Homo sapiens
taagaaatttagttatagaatg

SEQ ID NO: 7663409 - DNA, 22 bp, Homo sapiens
taacagagtgaaaatcagcaca

SEQ ID NO: 7663410 - DNA, 22 bp, Homo sapiens
taacagagtgaaaatcagcaca

SEQ ID NO: 7663411 - DNA, 22 bp, Homo sapiens
taacagagttgtacagttacgt

SEQ ID NO: 7663412 - DNA, 22 bp, Homo sapiens
taacagcaaccacagtgctggt

SEQ ID NO: 7663413 - DNA, 22 bp, Homo sapiens
taacagcaaccacagtgctggt

SEQ ID NO: 7663414 - DNA, 22 bp, Homo sapiens
taacagcactggcaggcactgt

SEQ ID NO: 7663415 - DNA, 22 bp, Homo sapiens
taacagcactggcaggcactgt

SEQ ID NO: 7663416 - DNA, 22 bp, Homo sapiens
taacagcactggcaggcactgt

SEQ ID NO: 7663417 - DNA, 22 bp, Homo sapiens
taacagagatagaaatgtaaag

SEQ ID NO: 7663418 - DNA, 22 bp, Homo sapiens
taacagagatagaaatgtaaag

SEQ ID NO: 7663419 - DNA, 22 bp, Homo sapiens
taacagaggtagaattcaaggt

SEQ ID NO: 7663420 - DNA, 22 bp, Homo sapiens
taacagagtaacaggtatgtaa

SEQ ID NO: 7663421 - DNA, 22 bp, Homo sapiens
taacagagatagaaatgtaaag

SEQ ID NO: 7663422 - DNA, 22 bp, Homo sapiens
taacagaatttgctaaactccg

SEQ ID NO: 7663423 - DNA, 22 bp, Homo sapiens
taacagaatttgctaaactccg

SEQ ID NO: 7663424 - DNA, 22 bp, Homo sapiens
taacagaatttgctaaactccg

SEQ ID NO: 7663425 - DNA, 22 bp, Homo sapiens
taacagaatttgctaaactccg

SEQ ID NO: 7663426 - DNA, 22 bp, Homo sapiens
taacagaatttgctaaactccg

SEQ ID NO: 7663427 - DNA, 22 bp, Homo sapiens
taacagaatttgctaaactccg

SEQ ID NO: 7663428 - DNA, 22 bp, Homo sapiens
taacagaatttgctaaactccg

SEQ ID NO: 7663429 - DNA, 22 bp, Homo sapiens
taacactgtggtgttctttgtc

SEQ ID NO: 7663430 - DNA, 22 bp, Homo sapiens
taacactgtggtgttctttgtc

SEQ ID NO: 7663431 - DNA, 22 bp, Homo sapiens
taacactgtggtgttctttgtc

SEQ ID NO: 7663432 - DNA, 22 bp, Homo sapiens
taacactgtgtctgccatatcc

SEQ ID NO: 7663433 - DNA, 22 bp, Homo sapiens
taacagaatagcagaaacagaa

SEQ ID NO: 7663434 - DNA, 22 bp, Homo sapiens
taacagaatagcagaaacagaa

SEQ ID NO: 7663435 - DNA, 22 bp, Homo sapiens
taacagaatagcagaaacagaa

SEQ ID NO: 7663436 - DNA, 22 bp, Homo sapiens
taacagaatagcagaaacagaa

SEQ ID NO: 7663437 - DNA, 22 bp, Homo sapiens
taacagaatagcagaaacagaa

SEQ ID NO: 7663438 - DNA, 22 bp, Homo sapiens
taacagaatagcagaaacagaa

SEQ ID NO: 7663439 - DNA, 22 bp, Homo sapiens
taacagaatagcagaaacagaa

SEQ ID NO: 7663440 - DNA, 22 bp, Homo sapiens
taacagaatagcagaaacagaa

SEQ ID NO: 7663441 - DNA, 22 bp, Homo sapiens
taacagaatttgctaaactccg

SEQ ID NO: 7663442 - DNA, 22 bp, Homo sapiens
taacagaatttgctaaactccg

SEQ ID NO: 7663443 - DNA, 22 bp, Homo sapiens
taacagaatttgctaaactccg

SEQ ID NO: 7663444 - DNA, 22 bp, Homo sapiens
taacagaatcctgttattgcca

SEQ ID NO: 7663445 - DNA, 22 bp, Homo sapiens
taacagaatcctgttattgcca

SEQ ID NO: 7663446 - DNA, 22 bp, Homo sapiens
taacagaatcctgttattgcca

SEQ ID NO: 7663447 - DNA, 22 bp, Homo sapiens
taacagaatcctgttattgcca

SEQ ID NO: 7663448 - DNA, 22 bp, Homo sapiens
taacagaatcctgttattgcca

SEQ ID NO: 7663449 - DNA, 22 bp, Homo sapiens
taacagaatcctgttattgcca

SEQ ID NO: 7663450 - DNA, 22 bp, Homo sapiens
taacagaatcctgttattgcca

SEQ ID NO: 7663451 - DNA, 22 bp, Homo sapiens
taacactgtaaacctagatgtt

SEQ ID NO: 7663452 - DNA, 22 bp, Homo sapiens
taacactgtaaacctagatgtt

SEQ ID NO: 7663453 - DNA, 22 bp, Homo sapiens
taacactgtaaacctagatgtt

SEQ ID NO: 7663454 - DNA, 22 bp, Homo sapiens
taacactgtaaacctagatgtt

SEQ ID NO: 7663455 - DNA, 22 bp, Homo sapiens
taacactgtaaacctagatgtt

SEQ ID NO: 7663456 - DNA, 22 bp, Homo sapiens
taacactgtccaaagaattcca

SEQ ID NO: 7663457 - DNA, 22 bp, Homo sapiens
taacactgtccaaagaattcca

SEQ ID NO: 7663458 - DNA, 22 bp, Homo sapiens
taacactgtgcccagagtccca

SEQ ID NO: 7663459 - DNA, 22 bp, Homo sapiens
taacactgtccaaagaattcca

SEQ ID NO: 7663460 - DNA, 22 bp, Homo sapiens
taacactgtccaaagaattcca

SEQ ID NO: 7663461 - DNA, 22 bp, Homo sapiens
taacactgtccaaagaattcca

SEQ ID NO: 7663462 - DNA, 22 bp, Homo sapiens
taacactgtggtgttctttgtc

SEQ ID NO: 7663463 - DNA, 22 bp, Homo sapiens
taacactgtgcccagagtccca

SEQ ID NO: 7663464 - DNA, 22 bp, Homo sapiens
taacactgtgcccagagtccca

SEQ ID NO: 7663465 - DNA, 20 bp, Homo sapiens
taagaacaagactaggaagc

SEQ ID NO: 7663466 - DNA, 22 bp, Homo sapiens
taagaacaagatgttcctgttt

SEQ ID NO: 7663467 - DNA, 22 bp, Homo sapiens
taaatgagggctgacatgattg

SEQ ID NO: 7663468 - DNA, 22 bp, Homo sapiens
taaatgagggctgacatgattg

SEQ ID NO: 7663469 - DNA, 22 bp, Homo sapiens
taaatgagggctgacatgattg

SEQ ID NO: 7663470 - DNA, 22 bp, Homo sapiens
taaatgagggctgacatgattg

SEQ ID NO: 7663471 - DNA, 22 bp, Homo sapiens
taaatgagggctgacatgattg

SEQ ID NO: 7663472 - DNA, 22 bp, Homo sapiens
taaatgagtaatatagctgttt

SEQ ID NO: 7663473 - DNA, 22 bp, Homo sapiens
taaatgagtaatatagctgttt

SEQ ID NO: 7663474 - DNA, 22 bp, Homo sapiens
taaatgagtaatatagctgttt

SEQ ID NO: 7663475 - DNA, 22 bp, Homo sapiens
taaatgagtaatatagctgttt

SEQ ID NO: 7663476 - DNA, 22 bp, Homo sapiens
taacactgaaaatgatgcatgt

SEQ ID NO: 7663477 - DNA, 22 bp, Homo sapiens
taacactgaaaatgatgcatgt

SEQ ID NO: 7663478 - DNA, 22 bp, Homo sapiens
taacactatccagatatgataa

SEQ ID NO: 7663479 - DNA, 22 bp, Homo sapiens
taacactatccagatatgataa

SEQ ID NO: 7663480 - DNA, 22 bp, Homo sapiens
taacactaagaatctaaattta

SEQ ID NO: 7663481 - DNA, 22 bp, Homo sapiens
taacactaagaatctaaattta

SEQ ID NO: 7663482 - DNA, 22 bp, Homo sapiens
taaatgataataatgctagtgt

SEQ ID NO: 7663483 - DNA, 22 bp, Homo sapiens
taaatgataataatgctagtgt

SEQ ID NO: 7663484 - DNA, 22 bp, Homo sapiens
taaatgataataatgctagtgt

SEQ ID NO: 7663485 - DNA, 22 bp, Homo sapiens
taaatgaagaaatggagattgt

SEQ ID NO: 7663486 - DNA, 22 bp, Homo sapiens
taaatgaaagggtttaatttat

SEQ ID NO: 7663487 - DNA, 22 bp, Homo sapiens
taaatgaagaaatggagattgt

SEQ ID NO: 7663488 - DNA, 22 bp, Homo sapiens
taaatgaagctcatgggccaca

SEQ ID NO: 7663489 - DNA, 22 bp, Homo sapiens
taaatgaagctcatgggccaca

SEQ ID NO: 7663490 - DNA, 22 bp, Homo sapiens
taaatgaagctcatgggccaca

SEQ ID NO: 7663491 - DNA, 22 bp, Homo sapiens
taaatgacattcttaagtcttg

SEQ ID NO: 7663492 - DNA, 22 bp, Homo sapiens
taaatgacaacacctgcttttg

SEQ ID NO: 7663493 - DNA, 22 bp, Homo sapiens
taaatgaagctcatgggccaca

SEQ ID NO: 7663494 - DNA, 22 bp, Homo sapiens
taaatgacattcttaagtcttg

SEQ ID NO: 7663495 - DNA, 22 bp, Homo sapiens
taaatgacattcttaagtcttg

SEQ ID NO: 7663496 - DNA, 22 bp, Homo sapiens
taaatgagatgtacataactca

SEQ ID NO: 7663497 - DNA, 22 bp, Homo sapiens
taaatgagatgtacataactca

SEQ ID NO: 7663498 - DNA, 22 bp, Homo sapiens
taaatgagatgtacataactca

SEQ ID NO: 7663499 - DNA, 22 bp, Homo sapiens
taacactgaaaatgatgcatgt

SEQ ID NO: 7663500 - DNA, 22 bp, Homo sapiens
taacactgaaaatgatgcatgt

SEQ ID NO: 7663501 - DNA, 22 bp, Homo sapiens
taacactgatttgttctcaggg

SEQ ID NO: 7663502 - DNA, 22 bp, Homo sapiens
taacactgatttgttctcaggg

SEQ ID NO: 7663503 - DNA, 22 bp, Homo sapiens
taacactgatttgttctcaggg

SEQ ID NO: 7663504 - DNA, 22 bp, Homo sapiens
taacactgatttgttctcaggg

SEQ ID NO: 7663505 - DNA, 22 bp, Homo sapiens
taacactgatttgttctcaggg

SEQ ID NO: 7663506 - DNA, 22 bp, Homo sapiens
taacactgatttgttctcaggg

SEQ ID NO: 7663507 - DNA, 22 bp, Homo sapiens
taacactgccatgctggagtca

SEQ ID NO: 7663508 - DNA, 22 bp, Homo sapiens
taacactgccatgctggagtca

SEQ ID NO: 7663509 - DNA, 22 bp, Homo sapiens
taacactggagagttggttgtg

SEQ ID NO: 7663510 - DNA, 22 bp, Homo sapiens
taacactgcttcattttggaga

SEQ ID NO: 7663511 - DNA, 22 bp, Homo sapiens
taacactgcttcattttggaga

SEQ ID NO: 7663512 - DNA, 22 bp, Homo sapiens
taacactggtatttcatttagt

SEQ ID NO: 7663513 - DNA, 22 bp, Homo sapiens
taacactggtatttcatttagt

SEQ ID NO: 7663514 - DNA, 22 bp, Homo sapiens
taacactggtatttcatttagt

SEQ ID NO: 7663515 - DNA, 22 bp, Homo sapiens
taacactggtatttcatttagt

SEQ ID NO: 7663516 - DNA, 22 bp, Homo sapiens
taacactggttatccctgtgca

SEQ ID NO: 7663517 - DNA, 22 bp, Homo sapiens
taacactggttatccctgtgca

SEQ ID NO: 7663518 - DNA, 22 bp, Homo sapiens
taacactggttatccctgtgca

SEQ ID NO: 7663519 - DNA, 22 bp, Homo sapiens
taacactggagagttggttgtg

SEQ ID NO: 7663520 - DNA, 22 bp, Homo sapiens
taacactggagagttggttgtg

SEQ ID NO: 7663521 - DNA, 22 bp, Homo sapiens
taacactggcttttgctgaggc

SEQ ID NO: 7663522 - DNA, 22 bp, Homo sapiens
taacactggcttttgctgaggc

SEQ ID NO: 7663523 - DNA, 22 bp, Homo sapiens
taacactggcttttgctgaggc

SEQ ID NO: 7663524 - DNA, 22 bp, Homo sapiens
taacactggcttttgctgaggc

SEQ ID NO: 7663525 - DNA, 22 bp, Homo sapiens
taaatgaagaaatggagattgt

SEQ ID NO: 7663526 - DNA, 22 bp, Homo sapiens
taaatgaaagggtttaatttat

SEQ ID NO: 7663527 - DNA, 22 bp, Homo sapiens
taaatgaaagggtttaatttat

SEQ ID NO: 7663528 - DNA, 22 bp, Homo sapiens
taaatgaaagggtttaatttat

SEQ ID NO: 7663529 - DNA, 22 bp, Homo sapiens
taaatgaaagggtttaatttat

SEQ ID NO: 7663530 - DNA, 22 bp, Homo sapiens
taaatgaaagggtttaatttat

SEQ ID NO: 7663531 - DNA, 22 bp, Homo sapiens
taaatgaaagggtttaatttat

SEQ ID NO: 7663532 - DNA, 22 bp, Homo sapiens
taaatgaaagggtttaatttat

SEQ ID NO: 7663533 - DNA, 22 bp, Homo sapiens
taaatgaaagggtttaatttat

SEQ ID NO: 7663534 - DNA, 22 bp, Homo sapiens
taaatgaaagggtttaatttat

SEQ ID NO: 7663535 - DNA, 22 bp, Homo sapiens
taaatgaaagggtttaatttat

SEQ ID NO: 7663536 - DNA, 22 bp, Homo sapiens
taaatcttgtggcaatgcttct

SEQ ID NO: 7663537 - DNA, 22 bp, Homo sapiens
taaatcttgtggcaatgcttct

SEQ ID NO: 7663538 - DNA, 22 bp, Homo sapiens
taaatcttgtggcaatgcttct

SEQ ID NO: 7663539 - DNA, 22 bp, Homo sapiens
taaatcttctacatcatcataa

SEQ ID NO: 7663540 - DNA, 22 bp, Homo sapiens
taaatcttctacatcatcataa

SEQ ID NO: 7663541 - DNA, 22 bp, Homo sapiens
taaatcttgtggcaatgcttct

SEQ ID NO: 7663542 - DNA, 22 bp, Homo sapiens
taaatctttaggaagctcaaac

SEQ ID NO: 7663543 - DNA, 22 bp, Homo sapiens
taaatctttaggaagctcaaac

SEQ ID NO: 7663544 - DNA, 22 bp, Homo sapiens
taaatctttaggaagctcaaac

SEQ ID NO: 7663545 - DNA, 22 bp, Homo sapiens
taaatctcctgtttttcatcta

SEQ ID NO: 7663546 - DNA, 22 bp, Homo sapiens
taaatctcagggaatatattga

SEQ ID NO: 7663547 - DNA, 22 bp, Homo sapiens
taaatctcctgtttttcatcta

SEQ ID NO: 7663548 - DNA, 22 bp, Homo sapiens
taaatctcagggaatatattga

SEQ ID NO: 7663549 - DNA, 22 bp, Homo sapiens
taaatctcctgtttttcatcta

SEQ ID NO: 7663550 - DNA, 22 bp, Homo sapiens
taaatctcctgtttttcatcta

SEQ ID NO: 7663551 - DNA, 18 bp, Homo sapiens
taaatctctctttagtca

SEQ ID NO: 7663552 - DNA, 18 bp, Homo sapiens
taaatctctctttagtca

SEQ ID NO: 7663553 - DNA, 18 bp, Homo sapiens
taaatctctctttagtca

SEQ ID NO: 7663554 - DNA, 22 bp, Homo sapiens
taaatctctcagtggccagaga

SEQ ID NO: 7663555 - DNA, 22 bp, Homo sapiens
taaatctctgctcctcttgggt

SEQ ID NO: 7663556 - DNA, 18 bp, Homo sapiens
taaatctctctttagtca

SEQ ID NO: 7663557 - DNA, 21 bp, Homo sapiens
taaatctctgtattcttcagt

SEQ ID NO: 7663558 - DNA, 21 bp, Homo sapiens
taaatctctgtattcttcagt

SEQ ID NO: 7663559 - DNA, 21 bp, Homo sapiens
taaatctctgtattcttcagt

SEQ ID NO: 7663560 - DNA, 22 bp, Homo sapiens
taaatctctgctcctcttgggt

SEQ ID NO: 7663561 - DNA, 21 bp, Homo sapiens
taaatctctgtattcttcagt

SEQ ID NO: 7663562 - DNA, 22 bp, Homo sapiens
taaatctcagcctttctgctta

SEQ ID NO: 7663563 - DNA, 22 bp, Homo sapiens
taaatctcactgggtatattgg

SEQ ID NO: 7663564 - DNA, 22 bp, Homo sapiens
taaatctcagcctttctgctta

SEQ ID NO: 7663565 - DNA, 22 bp, Homo sapiens
taaatctcactgggtatattgg

SEQ ID NO: 7663566 - DNA, 22 bp, Homo sapiens
taaatctcactgggtatattgg

SEQ ID NO: 7663567 - DNA, 22 bp, Homo sapiens
taaatctcactgggtatattgg

SEQ ID NO: 7663568 - DNA, 22 bp, Homo sapiens
taaatctcagggaatatattga

SEQ ID NO: 7663569 - DNA, 22 bp, Homo sapiens
taaatctcagggaatatattga

SEQ ID NO: 7663570 - DNA, 22 bp, Homo sapiens
taaatctcagcctttctgctta

SEQ ID NO: 7663571 - DNA, 22 bp, Homo sapiens
taaatctcagcctttctgctta

SEQ ID NO: 7663572 - DNA, 22 bp, Homo sapiens
taaatctcaataaagtctgtgg

SEQ ID NO: 7663573 - DNA, 22 bp, Homo sapiens
taaatctcaataaagtctgtgg

SEQ ID NO: 7663574 - DNA, 22 bp, Homo sapiens
taaatctcaataaagtctgtgg

SEQ ID NO: 7663575 - DNA, 22 bp, Homo sapiens
taaatccttatcttctttgaat

SEQ ID NO: 7663576 - DNA, 22 bp, Homo sapiens
taaatccttatcttctttgaat

SEQ ID NO: 7663577 - DNA, 22 bp, Homo sapiens
taaatccttatcttctttgaat

SEQ ID NO: 7663578 - DNA, 22 bp, Homo sapiens
taaatccttatcttctttgaat

SEQ ID NO: 7663579 - DNA, 22 bp, Homo sapiens
taaatcactcctaataatcagt

SEQ ID NO: 7663580 - DNA, 22 bp, Homo sapiens
taaatcactgtactttattcct

SEQ ID NO: 7663581 - DNA, 22 bp, Homo sapiens
taaatcactgtactttattcct

SEQ ID NO: 7663582 - DNA, 22 bp, Homo sapiens
taaatcactcctaataatcagt

SEQ ID NO: 7663583 - DNA, 22 bp, Homo sapiens
taaatcactcttctctcaccac

SEQ ID NO: 7663584 - DNA, 22 bp, Homo sapiens
taaatcactcctaataatcagt

SEQ ID NO: 7663585 - DNA, 22 bp, Homo sapiens
taaatagaatctaaactgctca

SEQ ID NO: 7663586 - DNA, 22 bp, Homo sapiens
taaatacttttactccactgat

SEQ ID NO: 7663587 - DNA, 22 bp, Homo sapiens
taaatcacccatctcctaatct

SEQ ID NO: 7663588 - DNA, 22 bp, Homo sapiens
taaatagaatctaaactgctca

SEQ ID NO: 7663589 - DNA, 22 bp, Homo sapiens
taaatagaatctaaactgctca

SEQ ID NO: 7663590 - DNA, 22 bp, Homo sapiens
taaatcacccatctcctaatct

SEQ ID NO: 7663591 - DNA, 22 bp, Homo sapiens
taaatagaatctaaactgctca

SEQ ID NO: 7663592 - DNA, 22 bp, Homo sapiens
taaatcagggagtcatctgcga

SEQ ID NO: 7663593 - DNA, 22 bp, Homo sapiens
taaatcagggagtcatctgcga

SEQ ID NO: 7663594 - DNA, 22 bp, Homo sapiens
taaatcagggagtcatctgcga

SEQ ID NO: 7663595 - DNA, 22 bp, Homo sapiens
taaatcagggagtcatctgcga

SEQ ID NO: 7663596 - DNA, 22 bp, Homo sapiens
taaatcagtaaggcatattctc

SEQ ID NO: 7663597 - DNA, 22 bp, Homo sapiens
taaatcagtaaggcatattctc

SEQ ID NO: 7663598 - DNA, 22 bp, Homo sapiens
taaatcaggaaggaaacttgga

SEQ ID NO: 7663599 - DNA, 22 bp, Homo sapiens
taaatcagcttatgccttttga

SEQ ID NO: 7663600 - DNA, 22 bp, Homo sapiens
taaatcagcctttgctatttta

SEQ ID NO: 7663601 - DNA, 22 bp, Homo sapiens
taaatcagcctttgctatttta

SEQ ID NO: 7663602 - DNA, 22 bp, Homo sapiens
taaatcagcctttgctatttta

SEQ ID NO: 7663603 - DNA, 22 bp, Homo sapiens
taaatcagtttctcttattggt

SEQ ID NO: 7663604 - DNA, 22 bp, Homo sapiens
taaatcagtttctcttattggt

SEQ ID NO: 7663605 - DNA, 22 bp, Homo sapiens
taaatcagtagatatggtatag

SEQ ID NO: 7663606 - DNA, 22 bp, Homo sapiens
taaatcagtaaggcatattctc

SEQ ID NO: 7663607 - DNA, 22 bp, Homo sapiens
taaatccagcttctaatttaga

SEQ ID NO: 7663608 - DNA, 22 bp, Homo sapiens
taaatccagcttctaatttaga

SEQ ID NO: 7663609 - DNA, 22 bp, Homo sapiens
taaatccctacatctgtgtttt

SEQ ID NO: 7663610 - DNA, 22 bp, Homo sapiens
taaatccagcttctaatttaga

SEQ ID NO: 7663611 - DNA, 22 bp, Homo sapiens
taaatccagcttctaatttaga

SEQ ID NO: 7663612 - DNA, 22 bp, Homo sapiens
gtttaagaaaattcatgttgtt

SEQ ID NO: 7663613 - DNA, 22 bp, Homo sapiens
gtttaagagggtttcattccca

SEQ ID NO: 7663614 - DNA, 22 bp, Homo sapiens
gtttaagagggtttcattccca

SEQ ID NO: 7663615 - DNA, 22 bp, Homo sapiens
gtttaagtttcagaagctaaga

SEQ ID NO: 7663616 - DNA, 22 bp, Homo sapiens
gtttaagaaaattcatgttgtt

SEQ ID NO: 7663617 - DNA, 22 bp, Homo sapiens
gtttaagaaaattcatgttgtt

SEQ ID NO: 7663618 - DNA, 22 bp, Homo sapiens
gtttaacattgtaccaacacct

SEQ ID NO: 7663619 - DNA, 22 bp, Homo sapiens
gtttaataatgttgaattacta

SEQ ID NO: 7663620 - DNA, 22 bp, Homo sapiens
gtttaataatgttgaattacta

SEQ ID NO: 7663621 - DNA, 22 bp, Homo sapiens
gtttaataatgttgaattacta

SEQ ID NO: 7663622 - DNA, 22 bp, Homo sapiens
gtttaataatgttgaattacta

SEQ ID NO: 7663623 - DNA, 22 bp, Homo sapiens
gtttaataatgttgaattacta

SEQ ID NO: 7663624 - DNA, 22 bp, Homo sapiens
gtttaataatgttgaattacta

SEQ ID NO: 7663625 - DNA, 22 bp, Homo sapiens
gtttaataatgttgaattacta

SEQ ID NO: 7663626 - DNA, 22 bp, Homo sapiens
gtttaataatgttgaattacta

SEQ ID NO: 7663627 - DNA, 21 bp, Homo sapiens
gtttttcagccctgaggtgag

SEQ ID NO: 7663628 - DNA, 19 bp, Homo sapiens
gtttttcccagacgaggca

SEQ ID NO: 7663629 - DNA, 19 bp, Homo sapiens
gtttttcccagacgaggca

SEQ ID NO: 7663630 - DNA, 21 bp, Homo sapiens
gtttttcagccctgaggtgag

SEQ ID NO: 7663631 - DNA, 21 bp, Homo sapiens
gtttttcagccctgaggtgag

SEQ ID NO: 7663632 - DNA, 22 bp, Homo sapiens
gtttaattcccacacctgccct

SEQ ID NO: 7663633 - DNA, 22 bp, Homo sapiens
gtttaattcccacacctgccct

SEQ ID NO: 7663634 - DNA, 22 bp, Homo sapiens
gtttttccttgctgaggacccg

SEQ ID NO: 7663635 - DNA, 22 bp, Homo sapiens
gtttttcctgctgacttgggtc

SEQ ID NO: 7663636 - DNA, 22 bp, Homo sapiens
gtttttcctgctgacttgggtc

SEQ ID NO: 7663637 - DNA, 22 bp, Homo sapiens
gtttttcctgctgacttgggtc

SEQ ID NO: 7663638 - DNA, 19 bp, Homo sapiens
gtttttcccagacgaggca

SEQ ID NO: 7663639 - DNA, 19 bp, Homo sapiens
gtttttcccagacgaggca

SEQ ID NO: 7663640 - DNA, 22 bp, Homo sapiens
gtttttctaagtagcgatattt

SEQ ID NO: 7663641 - DNA, 22 bp, Homo sapiens
gtttttctaagtagcgatattt

SEQ ID NO: 7663642 - DNA, 22 bp, Homo sapiens
gtttttctaagtagcgatattt

SEQ ID NO: 7663643 - DNA, 22 bp, Homo sapiens
gtttttccttgctgaggacccg

SEQ ID NO: 7663644 - DNA, 22 bp, Homo sapiens
gtttttccttgctgaggacccg

SEQ ID NO: 7663645 - DNA, 22 bp, Homo sapiens
gtttttccttgctgaggacccg

SEQ ID NO: 7663646 - DNA, 22 bp, Homo sapiens
gtttttctagaaatctcctcct

SEQ ID NO: 7663647 - DNA, 22 bp, Homo sapiens
gtttttctagaaatctcctcct

SEQ ID NO: 7663648 - DNA, 22 bp, Homo sapiens
gtttttctagaaatctcctcct

SEQ ID NO: 7663649 - DNA, 22 bp, Homo sapiens
gtttttctagaaatctcctcct

SEQ ID NO: 7663650 - DNA, 22 bp, Homo sapiens
gtttttctagaaatctcctcct

SEQ ID NO: 7663651 - DNA, 22 bp, Homo sapiens
gtttttctagaaatctcctcct

SEQ ID NO: 7663652 - DNA, 22 bp, Homo sapiens
gtttttctaagtagcgatattt

SEQ ID NO: 7663653 - DNA, 22 bp, Homo sapiens
gtttaaataattaggggcctgt

SEQ ID NO: 7663654 - DNA, 22 bp, Homo sapiens
gtttaaagtcttggaaggagga

SEQ ID NO: 7663655 - DNA, 22 bp, Homo sapiens
gtttaaataattaggggcctgt

SEQ ID NO: 7663656 - DNA, 22 bp, Homo sapiens
gtttaaataattaggggcctgt

SEQ ID NO: 7663657 - DNA, 22 bp, Homo sapiens
gtttaacatctgtgaagctgct

SEQ ID NO: 7663658 - DNA, 22 bp, Homo sapiens
gtttaacattgtaccaacacct

SEQ ID NO: 7663659 - DNA, 22 bp, Homo sapiens
gtttaaataattaggggcctgt

SEQ ID NO: 7663660 - DNA, 22 bp, Homo sapiens
gtttaaataattaggggcctgt

SEQ ID NO: 7663661 - DNA, 22 bp, Homo sapiens
gtttaaataattaggggcctgt

SEQ ID NO: 7663662 - DNA, 22 bp, Homo sapiens
gtttaaataattaggggcctgt

SEQ ID NO: 7663663 - DNA, 22 bp, Homo sapiens
gtttaaataattaggggcctgt

SEQ ID NO: 7663664 - DNA, 22 bp, Homo sapiens
gtttaaagtagcttccttttgg

SEQ ID NO: 7663665 - DNA, 22 bp, Homo sapiens
gtttaaagtcttggaaggagga

SEQ ID NO: 7663666 - DNA, 22 bp, Homo sapiens
gttgtttttgttctctatagct

SEQ ID NO: 7663667 - DNA, 22 bp, Homo sapiens
gttgtttttgttctctatagct

SEQ ID NO: 7663668 - DNA, 22 bp, Homo sapiens
gttgttttcagcagtttatgac

SEQ ID NO: 7663669 - DNA, 22 bp, Homo sapiens
gttgttttgcaggatccttaca

SEQ ID NO: 7663670 - DNA, 22 bp, Homo sapiens
gttgttttgcaggatccttaca

SEQ ID NO: 7663671 - DNA, 22 bp, Homo sapiens
gttgttttgcaggatccttaca

SEQ ID NO: 7663672 - DNA, 22 bp, Homo sapiens
gttgttttgcaggatccttaca

SEQ ID NO: 7663673 - DNA, 22 bp, Homo sapiens
gttgttttgcaggatccttaca

SEQ ID NO: 7663674 - DNA, 22 bp, Homo sapiens
gttgttttgctgtctgtcttag

SEQ ID NO: 7663675 - DNA, 22 bp, Homo sapiens
gttgttttgctgtctgtcttag

SEQ ID NO: 7663676 - DNA, 22 bp, Homo sapiens
gttgttttgctgtctgtcttag

SEQ ID NO: 7663677 - DNA, 22 bp, Homo sapiens
gttgtttttgttctctatagct

SEQ ID NO: 7663678 - DNA, 22 bp, Homo sapiens
gttgtttttgttctctatagct

SEQ ID NO: 7663679 - DNA, 22 bp, Homo sapiens
gttgtttttgttctctatagct

SEQ ID NO: 7663680 - DNA, 22 bp, Homo sapiens
gttgtttttgaacggtggtggc

SEQ ID NO: 7663681 - DNA, 22 bp, Homo sapiens
gttgtttttgaacggtggtggc

SEQ ID NO: 7663682 - DNA, 22 bp, Homo sapiens
gttgttttgctgtctgtcttag

SEQ ID NO: 7663683 - DNA, 19 bp, Homo sapiens
gttgtttttcttattatgg

SEQ ID NO: 7663684 - DNA, 19 bp, Homo sapiens
gttgtttttcttattatgg

SEQ ID NO: 7663685 - DNA, 19 bp, Homo sapiens
gttgtttttcttattatgg

SEQ ID NO: 7663686 - DNA, 19 bp, Homo sapiens
gttgtttttcttattatgg

SEQ ID NO: 7663687 - DNA, 22 bp, Homo sapiens
gttttttgggtgtatatcttct

SEQ ID NO: 7663688 - DNA, 22 bp, Homo sapiens
gttttttgggtgtatatcttct

SEQ ID NO: 7663689 - DNA, 22 bp, Homo sapiens
taaaacacataaactctctatt

SEQ ID NO: 7663690 - DNA, 22 bp, Homo sapiens
taaaacacataaactctctatt

SEQ ID NO: 7663691 - DNA, 22 bp, Homo sapiens
gttttttgggtgtatatcttct

SEQ ID NO: 7663692 - DNA, 22 bp, Homo sapiens
gttttttgggtgtatatcttct

SEQ ID NO: 7663693 - DNA, 22 bp, Homo sapiens
gttttttgggtgtatatcttct

SEQ ID NO: 7663694 - DNA, 22 bp, Homo sapiens
gttttttcatgagtagttatct

SEQ ID NO: 7663695 - DNA, 22 bp, Homo sapiens
gttttttcatgagtagttatct

SEQ ID NO: 7663696 - DNA, 22 bp, Homo sapiens
taaaacacctgtagtgtctgcc

SEQ ID NO: 7663697 - DNA, 22 bp, Homo sapiens
taaaacacataaactctctatt

SEQ ID NO: 7663698 - DNA, 22 bp, Homo sapiens
taaaacacataaactctctatt

SEQ ID NO: 7663699 - DNA, 22 bp, Homo sapiens
taaaacacctgtagtgtctgcc

SEQ ID NO: 7663700 - DNA, 22 bp, Homo sapiens
taaaacacctgtagtgtctgcc

SEQ ID NO: 7663701 - DNA, 22 bp, Homo sapiens
taaaacacctgtagtgtctgcc

SEQ ID NO: 7663702 - DNA, 22 bp, Homo sapiens
taaaacactcagcacctagcaa

SEQ ID NO: 7663703 - DNA, 22 bp, Homo sapiens
taaaacactcagcacctagcaa

SEQ ID NO: 7663704 - DNA, 22 bp, Homo sapiens
gtttttctttgtgtgaagacaa

SEQ ID NO: 7663705 - DNA, 22 bp, Homo sapiens
gtttttctttgtgtgaagacaa

SEQ ID NO: 7663706 - DNA, 22 bp, Homo sapiens
gtttttctttgtgtgaagacaa

SEQ ID NO: 7663707 - DNA, 22 bp, Homo sapiens
gtttttctttgtgtgaagacaa

SEQ ID NO: 7663708 - DNA, 22 bp, Homo sapiens
gtttttctttgtgtgaagacaa

SEQ ID NO: 7663709 - DNA, 22 bp, Homo sapiens
gtttttctttgtgtgaagacaa

SEQ ID NO: 7663710 - DNA, 22 bp, Homo sapiens
gtttttctttgtgtgaagacaa

SEQ ID NO: 7663711 - DNA, 22 bp, Homo sapiens
gtttttctttgtgtgaagacaa

SEQ ID NO: 7663712 - DNA, 22 bp, Homo sapiens
gtttttctttgtgtgaagacaa

SEQ ID NO: 7663713 - DNA, 22 bp, Homo sapiens
gtttttgtccatggaggcaaac

SEQ ID NO: 7663714 - DNA, 22 bp, Homo sapiens
gtttttgtccatggaggcaaac

SEQ ID NO: 7663715 - DNA, 22 bp, Homo sapiens
gtttttgtccatggaggcaaac

SEQ ID NO: 7663716 - DNA, 22 bp, Homo sapiens
gtttttgtcgagttccttgacc

SEQ ID NO: 7663717 - DNA, 22 bp, Homo sapiens
gtttttgtcgagttccttgacc

SEQ ID NO: 7663718 - DNA, 22 bp, Homo sapiens
gttttttcatgagtagttatct

SEQ ID NO: 7663719 - DNA, 22 bp, Homo sapiens
gttttttcatgagtagttatct

SEQ ID NO: 7663720 - DNA, 22 bp, Homo sapiens
gttttttcatgagtagttatct

SEQ ID NO: 7663721 - DNA, 22 bp, Homo sapiens
gttttttcatgagtagttatct

SEQ ID NO: 7663722 - DNA, 22 bp, Homo sapiens
gttttttcatgagtagttatct

SEQ ID NO: 7663723 - DNA, 22 bp, Homo sapiens
gttttttcatgagtagttatct

SEQ ID NO: 7663724 - DNA, 22 bp, Homo sapiens
gttttttcatgagtagttatct

SEQ ID NO: 7663725 - DNA, 20 bp, Homo sapiens
gtttttctctcttgccacta

SEQ ID NO: 7663726 - DNA, 20 bp, Homo sapiens
gtttttctctcttgccacta

SEQ ID NO: 7663727 - DNA, 20 bp, Homo sapiens
gtttttctctcttgccacta

SEQ ID NO: 7663728 - DNA, 20 bp, Homo sapiens
gtttttctctcttgccacta

SEQ ID NO: 7663729 - DNA, 20 bp, Homo sapiens
gtttttctctcttgccacta

SEQ ID NO: 7663730 - DNA, 20 bp, Homo sapiens
gtttttctctcttgccacta

SEQ ID NO: 7663731 - DNA, 22 bp, Homo sapiens
gtttttctaggaccatgtgatt

SEQ ID NO: 7663732 - DNA, 22 bp, Homo sapiens
gtttttctaggaccatgtgatt

SEQ ID NO: 7663733 - DNA, 22 bp, Homo sapiens
gtttttctaggaccatgtgatt

SEQ ID NO: 7663734 - DNA, 22 bp, Homo sapiens
gtttttctaggaccatgtgatt

SEQ ID NO: 7663735 - DNA, 22 bp, Homo sapiens
gtttttctaggaccatgtgatt

SEQ ID NO: 7663736 - DNA, 22 bp, Homo sapiens
gtttttctaggaccatgtgatt

SEQ ID NO: 7663737 - DNA, 22 bp, Homo sapiens
gtttttctaggaccatgtgatt

SEQ ID NO: 7663738 - DNA, 22 bp, Homo sapiens
gtttttctaggaccatgtgatt

SEQ ID NO: 7663739 - DNA, 22 bp, Homo sapiens
gtttttctagactgggagtttg

SEQ ID NO: 7663740 - DNA, 22 bp, Homo sapiens
gtttttctagactgggagtttg

SEQ ID NO: 7663741 - DNA, 22 bp, Homo sapiens
gtttttctagactgggagtttg

SEQ ID NO: 7663742 - DNA, 22 bp, Homo sapiens
gtttttctagactgggagtttg

SEQ ID NO: 7663743 - DNA, 22 bp, Homo sapiens
gtttttctagactgggagtttg

SEQ ID NO: 7663744 - DNA, 22 bp, Homo sapiens
gtttttctagaaatctcctcct

SEQ ID NO: 7663745 - DNA, 22 bp, Homo sapiens
gtttttctagaaatctcctcct

SEQ ID NO: 7663746 - DNA, 20 bp, Homo sapiens
gtttttcttgggcgagctat

SEQ ID NO: 7663747 - DNA, 20 bp, Homo sapiens
gtttttcttgggcgagctat

SEQ ID NO: 7663748 - DNA, 20 bp, Homo sapiens
gtttttcttgggcgagctat

SEQ ID NO: 7663749 - DNA, 20 bp, Homo sapiens
gtttttcttgggcgagctat

SEQ ID NO: 7663750 - DNA, 20 bp, Homo sapiens
gtttttcttgggcgagctat

SEQ ID NO: 7663751 - DNA, 22 bp, Homo sapiens
gtttttctgtgagcggtaaagg

SEQ ID NO: 7663752 - DNA, 22 bp, Homo sapiens
gtttttctgtgagcggtaaagg

SEQ ID NO: 7663753 - DNA, 22 bp, Homo sapiens
gtttttctgtgagcggtaaagg

SEQ ID NO: 7663754 - DNA, 22 bp, Homo sapiens
gtttttctgtgagcggtaaagg

SEQ ID NO: 7663755 - DNA, 20 bp, Homo sapiens
gtttttctctcttgccacta

SEQ ID NO: 7663756 - DNA, 20 bp, Homo sapiens
gtttttctctcttgccacta

SEQ ID NO: 7663757 - DNA, 22 bp, Homo sapiens
gtttttctctgaaatagttgac

SEQ ID NO: 7663758 - DNA, 22 bp, Homo sapiens
gtttttctctgaaatagttgac

SEQ ID NO: 7663759 - DNA, 22 bp, Homo sapiens
gtttttctctgaaatagttgac

SEQ ID NO: 7663760 - DNA, 22 bp, Homo sapiens
gtttttctctgaaatagttgac

SEQ ID NO: 7663761 - DNA, 22 bp, Homo sapiens
gtttttctctgaaatagttgac

SEQ ID NO: 7663762 - DNA, 22 bp, Homo sapiens
taaaggcagttctgattaggtc

SEQ ID NO: 7663763 - DNA, 22 bp, Homo sapiens
taaaggcagttggagttgagga

SEQ ID NO: 7663764 - DNA, 22 bp, Homo sapiens
taaaggcagtaattcctgagtt

SEQ ID NO: 7663765 - DNA, 22 bp, Homo sapiens
taaaggcagcctaggaagtgtt

SEQ ID NO: 7663766 - DNA, 22 bp, Homo sapiens
taaaggcagccactgagctcaa

SEQ ID NO: 7663767 - DNA, 22 bp, Homo sapiens
taaaggcagcctaggaagtgtt

SEQ ID NO: 7663768 - DNA, 22 bp, Homo sapiens
taaaggcagtaattcctgagtt

SEQ ID NO: 7663769 - DNA, 22 bp, Homo sapiens
taaaggcagtaattcctgagtt

SEQ ID NO: 7663770 - DNA, 22 bp, Homo sapiens
taaaggcagtaattcctgagtt

SEQ ID NO: 7663771 - DNA, 22 bp, Homo sapiens
taaaggcatgcaggtgaatgta

SEQ ID NO: 7663772 - DNA, 22 bp, Homo sapiens
taaaggcagttctgattaggtc

SEQ ID NO: 7663773 - DNA, 22 bp, Homo sapiens
taaaggcagttctgattaggtc

SEQ ID NO: 7663774 - DNA, 22 bp, Homo sapiens
taaaggccagggcctgagtgct

SEQ ID NO: 7663775 - DNA, 22 bp, Homo sapiens
taaaggccagggcctgagtgct

SEQ ID NO: 7663776 - DNA, 22 bp, Homo sapiens
taaaggcctagtaagttgagac

SEQ ID NO: 7663777 - DNA, 22 bp, Homo sapiens
taaaggctcagggaaccagatc

SEQ ID NO: 7663778 - DNA, 22 bp, Homo sapiens
taaaggctcagggaaccagatc

SEQ ID NO: 7663779 - DNA, 22 bp, Homo sapiens
taaaggctcactggcttggggt

SEQ ID NO: 7663780 - DNA, 22 bp, Homo sapiens
taaaggctcactggcttggggt

SEQ ID NO: 7663781 - DNA, 22 bp, Homo sapiens
taaaggctttattttccagtca

SEQ ID NO: 7663782 - DNA, 22 bp, Homo sapiens
taaaggctttattttccagtca

SEQ ID NO: 7663783 - DNA, 21 bp, Homo sapiens
taaaggctttagaatggcaaa

SEQ ID NO: 7663784 - DNA, 21 bp, Homo sapiens
taaaggctttagaatggcaaa

SEQ ID NO: 7663785 - DNA, 22 bp, Homo sapiens
taaaggcttctgcagggactga

SEQ ID NO: 7663786 - DNA, 22 bp, Homo sapiens
taaaggcttcggagtgcacact

SEQ ID NO: 7663787 - DNA, 22 bp, Homo sapiens
taaaggcttcggagtgcacact

SEQ ID NO: 7663788 - DNA, 20 bp, Homo sapiens
taaaggctgtgaggtggccc

SEQ ID NO: 7663789 - DNA, 20 bp, Homo sapiens
taaaggctgtgaggtggccc

SEQ ID NO: 7663790 - DNA, 22 bp, Homo sapiens
taaaggcttctgcagggactga

SEQ ID NO: 7663791 - DNA, 22 bp, Homo sapiens
taaaggcttctgcagggactga

SEQ ID NO: 7663792 - DNA, 22 bp, Homo sapiens
taaaggccatgatggaggatca

SEQ ID NO: 7663793 - DNA, 22 bp, Homo sapiens
taaaggctcgtattgttgtgtg

SEQ ID NO: 7663794 - DNA, 22 bp, Homo sapiens
taaaggctcgtattgttgtgtg

SEQ ID NO: 7663795 - DNA, 22 bp, Homo sapiens
taaatacttttactccactgat

SEQ ID NO: 7663796 - DNA, 22 bp, Homo sapiens
taaatacttttactccactgat

SEQ ID NO: 7663797 - DNA, 22 bp, Homo sapiens
taaatacttttactccactgat

SEQ ID NO: 7663798 - DNA, 22 bp, Homo sapiens
taaatacttttactccactgat

SEQ ID NO: 7663799 - DNA, 22 bp, Homo sapiens
taaatactttacaggatgtctc

SEQ ID NO: 7663800 - DNA, 22 bp, Homo sapiens
taaatactttacaggatgtctc

SEQ ID NO: 7663801 - DNA, 22 bp, Homo sapiens
taaatactttacaggatgtctc

SEQ ID NO: 7663802 - DNA, 22 bp, Homo sapiens
taaatactttacaggatgtctc

SEQ ID NO: 7663803 - DNA, 22 bp, Homo sapiens
taaaggcttttacaggagtgca

SEQ ID NO: 7663804 - DNA, 22 bp, Homo sapiens
taaaggcttttacaggagtgca

SEQ ID NO: 7663805 - DNA, 22 bp, Homo sapiens
taaaggcttttagtgatggtaa

SEQ ID NO: 7663806 - DNA, 22 bp, Homo sapiens
taaaggcaattcagcaagccac

SEQ ID NO: 7663807 - DNA, 22 bp, Homo sapiens
taaaggcacggagttgttatgg

SEQ ID NO: 7663808 - DNA, 22 bp, Homo sapiens
taaaggcaattcagcaagccac

SEQ ID NO: 7663809 - DNA, 22 bp, Homo sapiens
taaaggcaaatgtgtgtttgtg

SEQ ID NO: 7663810 - DNA, 22 bp, Homo sapiens
taaaggcaattcagcaagccac

SEQ ID NO: 7663811 - DNA, 22 bp, Homo sapiens
taaaggcacggagttgttatgg

SEQ ID NO: 7663812 - DNA, 22 bp, Homo sapiens
taaaggcaattcagcaagccac

SEQ ID NO: 7663813 - DNA, 22 bp, Homo sapiens
taaaggcactgcgtccctcaaa

SEQ ID NO: 7663814 - DNA, 22 bp, Homo sapiens
taaaggcactgcgtccctcaaa

SEQ ID NO: 7663815 - DNA, 22 bp, Homo sapiens
taaaggcagccactgagctcaa

SEQ ID NO: 7663816 - DNA, 22 bp, Homo sapiens
taaaggcagccactgagctcaa

SEQ ID NO: 7663817 - DNA, 22 bp, Homo sapiens
taaaggcagccactgagctcaa

SEQ ID NO: 7663818 - DNA, 22 bp, Homo sapiens
taaaggcaaatgtgtgtttgtg

SEQ ID NO: 7663819 - DNA, 22 bp, Homo sapiens
taaaggcaaactctccaaggat

SEQ ID NO: 7663820 - DNA, 22 bp, Homo sapiens
taaaggcaaactctccaaggat

SEQ ID NO: 7663821 - DNA, 22 bp, Homo sapiens
taaaggagtgtgatgaaaggga

SEQ ID NO: 7663822 - DNA, 22 bp, Homo sapiens
taaaggattttgtataatataa

SEQ ID NO: 7663823 - DNA, 22 bp, Homo sapiens
taaaggattttgtataatataa

SEQ ID NO: 7663824 - DNA, 22 bp, Homo sapiens
taaaggataactttcaagaatt

SEQ ID NO: 7663825 - DNA, 19 bp, Homo sapiens
taaaggaagaggaagggaa

SEQ ID NO: 7663826 - DNA, 19 bp, Homo sapiens
taaaggaagaggaagggaa

SEQ ID NO: 7663827 - DNA, 22 bp, Homo sapiens
taaaggaagaattctctgtgat

SEQ ID NO: 7663828 - DNA, 18 bp, Homo sapiens
taaaggaagtgggagagg

SEQ ID NO: 7663829 - DNA, 19 bp, Homo sapiens
taaaggaagaggaagggaa

SEQ ID NO: 7663830 - DNA, 18 bp, Homo sapiens
taaaggaagtgggagagg

SEQ ID NO: 7663831 - DNA, 18 bp, Homo sapiens
taaaggaagtgggagagg

SEQ ID NO: 7663832 - DNA, 22 bp, Homo sapiens
taaaggaagaattctctgtgat

SEQ ID NO: 7663833 - DNA, 22 bp, Homo sapiens
taaaggaagaattctctgtgat

SEQ ID NO: 7663834 - DNA, 22 bp, Homo sapiens
taaaggaagaattctctgtgat

SEQ ID NO: 7663835 - DNA, 22 bp, Homo sapiens
taaaggaagaattctctgtgat

SEQ ID NO: 7663836 - DNA, 19 bp, Homo sapiens
taaaggaagaagggaggat

SEQ ID NO: 7663837 - DNA, 19 bp, Homo sapiens
taaaggaagaagggaggat

SEQ ID NO: 7663838 - DNA, 19 bp, Homo sapiens
taaaggaagaagggaggat

SEQ ID NO: 7663839 - DNA, 22 bp, Homo sapiens
taaaggaatcagttttagagat

SEQ ID NO: 7663840 - DNA, 22 bp, Homo sapiens
taaaggaatcagttttagagat

SEQ ID NO: 7663841 - DNA, 18 bp, Homo sapiens
taaaggaagtgggagagg

SEQ ID NO: 7663842 - DNA, 22 bp, Homo sapiens
taaaggaatcagttttagagat

SEQ ID NO: 7663843 - DNA, 22 bp, Homo sapiens
taaaggaatcagttttagagat

SEQ ID NO: 7663844 - DNA, 22 bp, Homo sapiens
taaaggaatcagttttagagat

SEQ ID NO: 7663845 - DNA, 22 bp, Homo sapiens
taaaggaggagttaatgagact

SEQ ID NO: 7663846 - DNA, 22 bp, Homo sapiens
taaaggaggagttaatgagact

SEQ ID NO: 7663847 - DNA, 22 bp, Homo sapiens
taaaggaacagaggactcattt

SEQ ID NO: 7663848 - DNA, 22 bp, Homo sapiens
taaaggaacagaggactcattt

SEQ ID NO: 7663849 - DNA, 22 bp, Homo sapiens
taaagcttgtattgcaatattt

SEQ ID NO: 7663850 - DNA, 22 bp, Homo sapiens
taaagcttgtattgcaatattt

SEQ ID NO: 7663851 - DNA, 22 bp, Homo sapiens
taaagcttgtattgcaatattt

SEQ ID NO: 7663852 - DNA, 22 bp, Homo sapiens
taaaggaacagaggactcattt

SEQ ID NO: 7663853 - DNA, 22 bp, Homo sapiens
taaaggaactgctgctatggaa

SEQ ID NO: 7663854 - DNA, 22 bp, Homo sapiens
taaaggaactgctgctatggaa

SEQ ID NO: 7663855 - DNA, 22 bp, Homo sapiens
taaaggaactgctgctatggaa

SEQ ID NO: 7663856 - DNA, 22 bp, Homo sapiens
taaagctctgggtttctagatc

SEQ ID NO: 7663857 - DNA, 22 bp, Homo sapiens
taaaggaactgctgctatggaa

SEQ ID NO: 7663858 - DNA, 22 bp, Homo sapiens
taaagctgcaggctcagaaaac

SEQ ID NO: 7663859 - DNA, 22 bp, Homo sapiens
taaagctgcaggctcagaaaac

SEQ ID NO: 7663860 - DNA, 22 bp, Homo sapiens
taaagctgaaatgattatgaca

SEQ ID NO: 7663861 - DNA, 21 bp, Homo sapiens
taaagctcgttcaggaaagtc

SEQ ID NO: 7663862 - DNA, 22 bp, Homo sapiens
taaagctgaaatgattatgaca

SEQ ID NO: 7663863 - DNA, 22 bp, Homo sapiens
taaagctctgggtttctagatc

SEQ ID NO: 7663864 - DNA, 22 bp, Homo sapiens
taaagctctagtgttttggata

SEQ ID NO: 7663865 - DNA, 22 bp, Homo sapiens
taaagctgttcagtgcagaaag

SEQ ID NO: 7663866 - DNA, 22 bp, Homo sapiens
taaagctgttcagtgcagaaag

SEQ ID NO: 7663867 - DNA, 22 bp, Homo sapiens
taaagctgcaggctcagaaaac

SEQ ID NO: 7663868 - DNA, 22 bp, Homo sapiens
taaagctgttagagtagtaaga

SEQ ID NO: 7663869 - DNA, 22 bp, Homo sapiens
taaagctgttagagtagtaaga

SEQ ID NO: 7663870 - DNA, 22 bp, Homo sapiens
taaagctagaattgttccagca

SEQ ID NO: 7663871 - DNA, 22 bp, Homo sapiens
taaagctagaaggtgctgtaca

SEQ ID NO: 7663872 - DNA, 22 bp, Homo sapiens
taaagctattatagttatgttt

SEQ ID NO: 7663873 - DNA, 21 bp, Homo sapiens
taaagctcgttcaggaaagtc

SEQ ID NO: 7663874 - DNA, 22 bp, Homo sapiens
taaagctctagtgttttggata

SEQ ID NO: 7663875 - DNA, 22 bp, Homo sapiens
taaagcagtctgtgtatgtgaa

SEQ ID NO: 7663876 - DNA, 22 bp, Homo sapiens
taaagcagtctgtgtatgtgaa

SEQ ID NO: 7663877 - DNA, 22 bp, Homo sapiens
taaagcagtatgatggaaggat

SEQ ID NO: 7663878 - DNA, 22 bp, Homo sapiens
taaagcagtatgatggaaggat

SEQ ID NO: 7663879 - DNA, 22 bp, Homo sapiens
taaagcaggtgctcagtgacca

SEQ ID NO: 7663880 - DNA, 21 bp, Homo sapiens
taaagctagaaccttagcttt

SEQ ID NO: 7663881 - DNA, 21 bp, Homo sapiens
taaagctagaaccttagcttt

SEQ ID NO: 7663882 - DNA, 21 bp, Homo sapiens
taaagctagaaccttagcttt

SEQ ID NO: 7663883 - DNA, 22 bp, Homo sapiens
taaagctagaaggtgctgtaca

SEQ ID NO: 7663884 - DNA, 22 bp, Homo sapiens
taaaactagaccgtgagtctaa

SEQ ID NO: 7663885 - DNA, 22 bp, Homo sapiens
taaaactagaccgtgagtctaa

SEQ ID NO: 7663886 - DNA, 22 bp, Homo sapiens
taaaactagtggttgggactaa

SEQ ID NO: 7663887 - DNA, 22 bp, Homo sapiens
taaaactagaccgtgagtctaa

SEQ ID NO: 7663888 - DNA, 22 bp, Homo sapiens
taaaactagaccgtgagtctaa

SEQ ID NO: 7663889 - DNA, 22 bp, Homo sapiens
taaaactagaccgtgagtctaa

SEQ ID NO: 7663890 - DNA, 22 bp, Homo sapiens
taaaactgaatacatactgagg

SEQ ID NO: 7663891 - DNA, 22 bp, Homo sapiens
taaaactagtggttgggactaa

SEQ ID NO: 7663892 - DNA, 22 bp, Homo sapiens
taaaactagtggttgggactaa

SEQ ID NO: 7663893 - DNA, 22 bp, Homo sapiens
taaagcaggccacatatgtgat

SEQ ID NO: 7663894 - DNA, 22 bp, Homo sapiens
taaagcaggtgctcagtgacca

SEQ ID NO: 7663895 - DNA, 22 bp, Homo sapiens
taaagcaggtgctcagtgacca

SEQ ID NO: 7663896 - DNA, 22 bp, Homo sapiens
taaagcaggccacatatgtgat

SEQ ID NO: 7663897 - DNA, 22 bp, Homo sapiens
taaagcaggcatctctctcctc

SEQ ID NO: 7663898 - DNA, 22 bp, Homo sapiens
taaagcagcgtgggtggggcag

SEQ ID NO: 7663899 - DNA, 22 bp, Homo sapiens
taaagcagcgtgggtggggcag

SEQ ID NO: 7663900 - DNA, 22 bp, Homo sapiens
taaagcaggcatctctctcctc

SEQ ID NO: 7663901 - DNA, 22 bp, Homo sapiens
taaaacagcagggcagagaagt

SEQ ID NO: 7663902 - DNA, 22 bp, Homo sapiens
taaaaccaggtcttgggattta

SEQ ID NO: 7663903 - DNA, 22 bp, Homo sapiens
taaaaccataaggctggaagga

SEQ ID NO: 7663904 - DNA, 22 bp, Homo sapiens
taaaaccataaggctggaagga

SEQ ID NO: 7663905 - DNA, 22 bp, Homo sapiens
taaaacagcagggcagagaagt

SEQ ID NO: 7663906 - DNA, 22 bp, Homo sapiens
taaaacagcagggcagagaagt

SEQ ID NO: 7663907 - DNA, 22 bp, Homo sapiens
taaaacagcagggcagagaagt

SEQ ID NO: 7663908 - DNA, 22 bp, Homo sapiens
taaaacagcagggcagagaagt

SEQ ID NO: 7663909 - DNA, 22 bp, Homo sapiens
taaaacagcagggcagagaagt

SEQ ID NO: 7663910 - DNA, 22 bp, Homo sapiens
taaaacagcagggcagagaagt

SEQ ID NO: 7663911 - DNA, 22 bp, Homo sapiens
taaaaccattcctgctttcatg

SEQ ID NO: 7663912 - DNA, 22 bp, Homo sapiens
taaaaccattcctgctttcatg

SEQ ID NO: 7663913 - DNA, 22 bp, Homo sapiens
taaaaccataaggctggaagga

SEQ ID NO: 7663914 - DNA, 22 bp, Homo sapiens
taaaaccataaggctggaagga

SEQ ID NO: 7663915 - DNA, 22 bp, Homo sapiens
taaaaccataaggctggaagga

SEQ ID NO: 7663916 - DNA, 22 bp, Homo sapiens
taaaaccattcctgctttcatg

SEQ ID NO: 7663917 - DNA, 19 bp, Homo sapiens
taaaacgtgcatggcagca

SEQ ID NO: 7663918 - DNA, 22 bp, Homo sapiens
ggaggtatttgtcaatctgttt

SEQ ID NO: 7663919 - DNA, 20 bp, Homo sapiens
ggaggtcaaatgatgagaag

SEQ ID NO: 7663920 - DNA, 20 bp, Homo sapiens
ggaggtcaaatgatgagaag

SEQ ID NO: 7663921 - DNA, 20 bp, Homo sapiens
ggaggtcaaatgatgagaag

SEQ ID NO: 7663922 - DNA, 20 bp, Homo sapiens
ggaggtcaaatgatgagaag

SEQ ID NO: 7663923 - DNA, 20 bp, Homo sapiens
ggaggtcaaatgatgagaag

SEQ ID NO: 7663924 - DNA, 22 bp, Homo sapiens
ggaggtcaaatggagggctggg

SEQ ID NO: 7663925 - DNA, 22 bp, Homo sapiens
ggaggtcaaatggagggctggg

SEQ ID NO: 7663926 - DNA, 22 bp, Homo sapiens
ggaggtcaaatggagggctggg

SEQ ID NO: 7663927 - DNA, 20 bp, Homo sapiens
ggaggtcaaatgatgagaag

SEQ ID NO: 7663928 - DNA, 22 bp, Homo sapiens
ggaggtcaaatggagggctggg

SEQ ID NO: 7663929 - DNA, 22 bp, Homo sapiens
ggagggttagcaaaggcacaga

SEQ ID NO: 7663930 - DNA, 22 bp, Homo sapiens
ggagggtgggtcattcttacat

SEQ ID NO: 7663931 - DNA, 22 bp, Homo sapiens
ggagggttagcaaaggcacaga

SEQ ID NO: 7663932 - DNA, 22 bp, Homo sapiens
ggagggttagcaaaggcacaga

SEQ ID NO: 7663933 - DNA, 22 bp, Homo sapiens
ggagggttgggacaccagggtc

SEQ ID NO: 7663934 - DNA, 22 bp, Homo sapiens
ggaggtaaagtaactcgcccag

SEQ ID NO: 7663935 - DNA, 22 bp, Homo sapiens
ggaggtaacacaggcactgtgc

SEQ ID NO: 7663936 - DNA, 22 bp, Homo sapiens
ggaggtagtctgagtcataggc

SEQ ID NO: 7663937 - DNA, 22 bp, Homo sapiens
ggaggtagtctgagtcataggc

SEQ ID NO: 7663938 - DNA, 22 bp, Homo sapiens
ggaggtagtctgagtcataggc

SEQ ID NO: 7663939 - DNA, 22 bp, Homo sapiens
ggaggtagtctgagtcataggc

SEQ ID NO: 7663940 - DNA, 22 bp, Homo sapiens
ggaggtagcctcaaaagcagct

SEQ ID NO: 7663941 - DNA, 22 bp, Homo sapiens
ggaggtaagaggccctgggcca

SEQ ID NO: 7663942 - DNA, 22 bp, Homo sapiens
ggaggtaagaggccctgggccg

SEQ ID NO: 7663943 - DNA, 22 bp, Homo sapiens
ggaggtagcctcaaaagcagct

SEQ ID NO: 7663944 - DNA, 22 bp, Homo sapiens
ggaggtagcctcaaaagcagct

SEQ ID NO: 7663945 - DNA, 22 bp, Homo sapiens
ggagggtgggtcattcttacat

SEQ ID NO: 7663946 - DNA, 22 bp, Homo sapiens
ggagggtggcagcgtcctgggc

SEQ ID NO: 7663947 - DNA, 22 bp, Homo sapiens
ggagggtggcagcgtcctgggc

SEQ ID NO: 7663948 - DNA, 22 bp, Homo sapiens
ggagggtggcagcgtcctgggc

SEQ ID NO: 7663949 - DNA, 22 bp, Homo sapiens
ggagggtggcagcgtcctgggc

SEQ ID NO: 7663950 - DNA, 22 bp, Homo sapiens
ggagggtggcagcgtcctgggc

SEQ ID NO: 7663951 - DNA, 22 bp, Homo sapiens
ggagggtggcagcgtcctgggc

SEQ ID NO: 7663952 - DNA, 22 bp, Homo sapiens
ggagggtggcagcgtcctgggc

SEQ ID NO: 7663953 - DNA, 22 bp, Homo sapiens
ggagggtggcagcgtcctgggc

SEQ ID NO: 7663954 - DNA, 22 bp, Homo sapiens
ggagggtggcagcgtcctgggc

SEQ ID NO: 7663955 - DNA, 22 bp, Homo sapiens
ggagggtggcagcgtcctgggc

SEQ ID NO: 7663956 - DNA, 22 bp, Homo sapiens
ggagggtggcagcgtcctgggc

SEQ ID NO: 7663957 - DNA, 22 bp, Homo sapiens
ggagggtggcagcgtcctgggc

SEQ ID NO: 7663958 - DNA, 22 bp, Homo sapiens
ggagggtggcagcgtcctgggc

SEQ ID NO: 7663959 - DNA, 22 bp, Homo sapiens
ggagggtggcagcgtcctgggc

SEQ ID NO: 7663960 - DNA, 20 bp, Homo sapiens
ggagggtggaagaaagcaag

SEQ ID NO: 7663961 - DNA, 20 bp, Homo sapiens
ggagggtggaagaaagcaag

SEQ ID NO: 7663962 - DNA, 22 bp, Homo sapiens
ggaggtcccaggcctggcagca

SEQ ID NO: 7663963 - DNA, 22 bp, Homo sapiens
ggaggtcccaggcctggcagca

SEQ ID NO: 7663964 - DNA, 22 bp, Homo sapiens
ggaggtcccaggcctggcagca

SEQ ID NO: 7663965 - DNA, 22 bp, Homo sapiens
ggaggtcccaggcctggcagca

SEQ ID NO: 7663966 - DNA, 22 bp, Homo sapiens
ggaggtggaggttgcagtgagc

SEQ ID NO: 7663967 - DNA, 22 bp, Homo sapiens
ggaggtcatagctgtgcaggta

SEQ ID NO: 7663968 - DNA, 22 bp, Homo sapiens
ggaggtcatagctgtgcaggta

SEQ ID NO: 7663969 - DNA, 22 bp, Homo sapiens
ggaggtccatgtgaatgtggcc

SEQ ID NO: 7663970 - DNA, 22 bp, Homo sapiens
ggaggtccatgtgaatgtggcc

SEQ ID NO: 7663971 - DNA, 22 bp, Homo sapiens
ggaggtcatagctgtgcaggta

SEQ ID NO: 7663972 - DNA, 22 bp, Homo sapiens
ggaggtcacgactgggatgcct

SEQ ID NO: 7663973 - DNA, 22 bp, Homo sapiens
ggaggtcaaatggagggctggg

SEQ ID NO: 7663974 - DNA, 22 bp, Homo sapiens
ggaggtcaaatggagggctggg

SEQ ID NO: 7663975 - DNA, 22 bp, Homo sapiens
ggaggtcacaaggtgagtaaag

SEQ ID NO: 7663976 - DNA, 22 bp, Homo sapiens
ggaggtcacaaggtgagtaaag

SEQ ID NO: 7663977 - DNA, 23 bp, Homo sapiens
ggaggtcagtgcctgagggtgag

SEQ ID NO: 7663978 - DNA, 23 bp, Homo sapiens
ggaggtcagtgcctgagggtgag

SEQ ID NO: 7663979 - DNA, 22 bp, Homo sapiens
ggaggtcatagctgtgcaggta

SEQ ID NO: 7663980 - DNA, 22 bp, Homo sapiens
ggaggtggcagagggacattct

SEQ ID NO: 7663981 - DNA, 22 bp, Homo sapiens
ggaggtggcagagggacattct

SEQ ID NO: 7663982 - DNA, 22 bp, Homo sapiens
ggaggtggcagagggacattct

SEQ ID NO: 7663983 - DNA, 22 bp, Homo sapiens
ggaggtggcagagggacattct

SEQ ID NO: 7663984 - DNA, 22 bp, Homo sapiens
ggaggtggcagagggacattct

SEQ ID NO: 7663985 - DNA, 22 bp, Homo sapiens
ggaggtggcagagggacattct

SEQ ID NO: 7663986 - DNA, 22 bp, Homo sapiens
ggaggtggcagagggacattct

SEQ ID NO: 7663987 - DNA, 22 bp, Homo sapiens
ggaggtggcagagggacattct

SEQ ID NO: 7663988 - DNA, 22 bp, Homo sapiens
ggaggtggcagagggacattct

SEQ ID NO: 7663989 - DNA, 22 bp, Homo sapiens
ggaggtggaggttgcagtgagc

SEQ ID NO: 7663990 - DNA, 22 bp, Homo sapiens
ggaggtggaggttgcagtgagc

SEQ ID NO: 7663991 - DNA, 22 bp, Homo sapiens
ggaggtggaggttgcagtgagc

SEQ ID NO: 7663992 - DNA, 22 bp, Homo sapiens
ggaggtggaggttgcagtgagc

SEQ ID NO: 7663993 - DNA, 22 bp, Homo sapiens
ggaggtggaggttgcagtgagc

SEQ ID NO: 7663994 - DNA, 22 bp, Homo sapiens
ggaggtggaggttgcagtgagc

SEQ ID NO: 7663995 - DNA, 22 bp, Homo sapiens
ggaggtggaggttgcagtgagc

SEQ ID NO: 7663996 - DNA, 22 bp, Homo sapiens
ggaggtcatagctgtgcaggta

SEQ ID NO: 7663997 - DNA, 22 bp, Homo sapiens
ggaggtgggctaaggactctct

SEQ ID NO: 7663998 - DNA, 22 bp, Homo sapiens
ggaggtgggctaaggactctct

SEQ ID NO: 7663999 - DNA, 22 bp, Homo sapiens
ggaggtgggctaaggactctct

SEQ ID NO: 7664000 - DNA, 22 bp, Homo sapiens
ggaggtgggctaaggactctct

SEQ ID NO: 7664001 - DNA, 22 bp, Homo sapiens
ggaggtgggctaaggactctct

SEQ ID NO: 7664002 - DNA, 22 bp, Homo sapiens
ggaggtgggctaaggactctct

SEQ ID NO: 7664003 - DNA, 22 bp, Homo sapiens
ggaggtgggctaaggactctct

SEQ ID NO: 7664004 - DNA, 22 bp, Homo sapiens
ggaggtgggctaaggactctct

SEQ ID NO: 7664005 - DNA, 22 bp, Homo sapiens
ggaggtgggctaaggactctct

SEQ ID NO: 7664006 - DNA, 22 bp, Homo sapiens
ggaggtgggctaaggactctct

SEQ ID NO: 7664007 - DNA, 22 bp, Homo sapiens
ggaggtggtggcagtgacaatt

SEQ ID NO: 7664008 - DNA, 22 bp, Homo sapiens
ggaggtggtggcagtgacaatt

SEQ ID NO: 7664009 - DNA, 16 bp, Homo sapiens
ggaggtgggtaaggtg

SEQ ID NO: 7664010 - DNA, 22 bp, Homo sapiens
ggaggtggtggcagtgacaatt

SEQ ID NO: 7664011 - DNA, 22 bp, Homo sapiens
ggaggtggtggcagtgacaatt

SEQ ID NO: 7664012 - DNA, 16 bp, Homo sapiens
ggaggtgggtaaggtg

SEQ ID NO: 7664013 - DNA, 16 bp, Homo sapiens
ggaggtgggtaaggtg

SEQ ID NO: 7664014 - DNA, 22 bp, Homo sapiens
ggaggtgggctaaggactctct

SEQ ID NO: 7664015 - DNA, 22 bp, Homo sapiens
ggaggtgggctaaggactctct

SEQ ID NO: 7664016 - DNA, 22 bp, Homo sapiens
ggaggtgggctaaggactctct

SEQ ID NO: 7664017 - DNA, 22 bp, Homo sapiens
ggagtaggagtagaactcatca

SEQ ID NO: 7664018 - DNA, 22 bp, Homo sapiens
ggagtaggccccgggagagagt

SEQ ID NO: 7664019 - DNA, 22 bp, Homo sapiens
ggagtaggccccgggagagagt

SEQ ID NO: 7664020 - DNA, 22 bp, Homo sapiens
ggagtagctgcattccgagcac

SEQ ID NO: 7664021 - DNA, 22 bp, Homo sapiens
ggagtagctgcattccgagcac

SEQ ID NO: 7664022 - DNA, 22 bp, Homo sapiens
ggagtagctgcattccgagcac

SEQ ID NO: 7664023 - DNA, 22 bp, Homo sapiens
ggagtagctgcattccgagcac

SEQ ID NO: 7664024 - DNA, 22 bp, Homo sapiens
ggagtagctgcattccgagcac

SEQ ID NO: 7664025 - DNA, 22 bp, Homo sapiens
ggagtaaggctcagaggaaatg

SEQ ID NO: 7664026 - DNA, 22 bp, Homo sapiens
ggaggttctctctttgcagagc

SEQ ID NO: 7664027 - DNA, 22 bp, Homo sapiens
ggaggttctgatttgtcacaac

SEQ ID NO: 7664028 - DNA, 22 bp, Homo sapiens
ggaggttctgatttgtcacaac

SEQ ID NO: 7664029 - DNA, 22 bp, Homo sapiens
ggagtaaggctcagaggaaatg

SEQ ID NO: 7664030 - DNA, 22 bp, Homo sapiens
ggaggtggtggcagtgacaatt

SEQ ID NO: 7664031 - DNA, 22 bp, Homo sapiens
ggaggtggtggcagtgacaatt

SEQ ID NO: 7664032 - DNA, 22 bp, Homo sapiens
ggaggtggtggcagtgacaatt

SEQ ID NO: 7664033 - DNA, 22 bp, Homo sapiens
ggaggtggtggcagtgacaatt

SEQ ID NO: 7664034 - DNA, 22 bp, Homo sapiens
ggaggtggtttgatttctatat

SEQ ID NO: 7664035 - DNA, 22 bp, Homo sapiens
ggaggtggtttgatttctatat

SEQ ID NO: 7664036 - DNA, 22 bp, Homo sapiens
ggaggtggtttgatttctatat

SEQ ID NO: 7664037 - DNA, 22 bp, Homo sapiens
ggaggtggtttgatttctatat

SEQ ID NO: 7664038 - DNA, 22 bp, Homo sapiens
ggaggtgtcttgagattatcat

SEQ ID NO: 7664039 - DNA, 22 bp, Homo sapiens
ggaggttctctctttgcagagc

SEQ ID NO: 7664040 - DNA, 22 bp, Homo sapiens
ggaggtgggagcctccagtggt

SEQ ID NO: 7664041 - DNA, 22 bp, Homo sapiens
ggaggtgggagtttagttcttg

SEQ ID NO: 7664042 - DNA, 22 bp, Homo sapiens
ggaggtgggagtttagttcttg

SEQ ID NO: 7664043 - DNA, 22 bp, Homo sapiens
ggaggtgggagtttagttcttg

SEQ ID NO: 7664044 - DNA, 22 bp, Homo sapiens
ggaggtgggagcctccagtggt

SEQ ID NO: 7664045 - DNA, 22 bp, Homo sapiens
ggaggtgggagcctccagtggt

SEQ ID NO: 7664046 - DNA, 22 bp, Homo sapiens
ggaggtgggagcctccagtggt

SEQ ID NO: 7664047 - DNA, 22 bp, Homo sapiens
ggaggtgggagcctccagtggt

SEQ ID NO: 7664048 - DNA, 22 bp, Homo sapiens
ggaggtgggagcctccagtggt

SEQ ID NO: 7664049 - DNA, 22 bp, Homo sapiens
ggaggtgggagcctccagtggt

SEQ ID NO: 7664050 - DNA, 22 bp, Homo sapiens
ggaggtgggattaggacctaaa

SEQ ID NO: 7664051 - DNA, 22 bp, Homo sapiens
ggaggtgggattaggacctaaa

SEQ ID NO: 7664052 - DNA, 22 bp, Homo sapiens
ggaggtgggattaggacctaaa

SEQ ID NO: 7664053 - DNA, 22 bp, Homo sapiens
ggaggtgggattaggacctaaa

SEQ ID NO: 7664054 - DNA, 22 bp, Homo sapiens
ggaggtgggattaggacctaaa

SEQ ID NO: 7664055 - DNA, 22 bp, Homo sapiens
ggaggtgggattaggacctaaa

SEQ ID NO: 7664056 - DNA, 22 bp, Homo sapiens
ggaggtgggattaggacctaaa

SEQ ID NO: 7664057 - DNA, 22 bp, Homo sapiens
ggaggtgggattaggacctaaa

SEQ ID NO: 7664058 - DNA, 22 bp, Homo sapiens
ggaggtgggattaggacctaaa

SEQ ID NO: 7664059 - DNA, 22 bp, Homo sapiens
ggaggtgggattaggacctaaa

SEQ ID NO: 7664060 - DNA, 22 bp, Homo sapiens
ggaggtggcctgaaaatgtggc

SEQ ID NO: 7664061 - DNA, 22 bp, Homo sapiens
ggaggtggcctgaaaatgtggc

SEQ ID NO: 7664062 - DNA, 22 bp, Homo sapiens
ggaggtggcctgaaaatgtggc

SEQ ID NO: 7664063 - DNA, 22 bp, Homo sapiens
ggaggtggcctgaaaatgtggc

SEQ ID NO: 7664064 - DNA, 22 bp, Homo sapiens
ggaggtggcctgaaaatgtggc

SEQ ID NO: 7664065 - DNA, 22 bp, Homo sapiens
ggaggtggcctgaaaatgtggc

SEQ ID NO: 7664066 - DNA, 22 bp, Homo sapiens
ggaggtggcagggaacataatt

SEQ ID NO: 7664067 - DNA, 22 bp, Homo sapiens
ggaggtggcagggaacataatt

SEQ ID NO: 7664068 - DNA, 22 bp, Homo sapiens
ggaggtggcagagggacattct

SEQ ID NO: 7664069 - DNA, 22 bp, Homo sapiens
ggaggtggcctgaaaatgtggc

SEQ ID NO: 7664070 - DNA, 22 bp, Homo sapiens
ggaggtggcagggaacataatt

SEQ ID NO: 7664071 - DNA, 22 bp, Homo sapiens
ggaggtgggagacataggcggc

SEQ ID NO: 7664072 - DNA, 22 bp, Homo sapiens
ggaggtgggagcctccagtggt

SEQ ID NO: 7664073 - DNA, 22 bp, Homo sapiens
ggaggtgggagcctccagtggt

SEQ ID NO: 7664074 - DNA, 22 bp, Homo sapiens
ggaggtgggagcctccagtggt

SEQ ID NO: 7664075 - DNA, 22 bp, Homo sapiens
ggaggtgggagcctccagtggt

SEQ ID NO: 7664076 - DNA, 22 bp, Homo sapiens
ggaggtgggagcctccagtggt

SEQ ID NO: 7664077 - DNA, 22 bp, Homo sapiens
ggaggtgggagacataggcggc

SEQ ID NO: 7664078 - DNA, 22 bp, Homo sapiens
ggaggtgggagacataggcggc

SEQ ID NO: 7664079 - DNA, 22 bp, Homo sapiens
ggaggtgggagacataggcggc

SEQ ID NO: 7664080 - DNA, 22 bp, Homo sapiens
ggaggtgggagacataggcggc

SEQ ID NO: 7664081 - DNA, 22 bp, Homo sapiens
ggaggtgggagacataggcggc

SEQ ID NO: 7664082 - DNA, 22 bp, Homo sapiens
ggaggtgggagacataggcggc

SEQ ID NO: 7664083 - DNA, 22 bp, Homo sapiens
ggagggggaattcagccccagc

SEQ ID NO: 7664084 - DNA, 22 bp, Homo sapiens
ggagggggaagaagctaaagac

SEQ ID NO: 7664085 - DNA, 22 bp, Homo sapiens
ggagggggaagaagctaaagac

SEQ ID NO: 7664086 - DNA, 22 bp, Homo sapiens
ggagggggaagaagctaaagac

SEQ ID NO: 7664087 - DNA, 22 bp, Homo sapiens
ggagggggaagaagctaaagac

SEQ ID NO: 7664088 - DNA, 22 bp, Homo sapiens
ggagggggaagaagctaaagac

SEQ ID NO: 7664089 - DNA, 22 bp, Homo sapiens
ggagggggaagaagctaaagac

SEQ ID NO: 7664090 - DNA, 22 bp, Homo sapiens
ggagggggaagaagctaaagac

SEQ ID NO: 7664091 - DNA, 22 bp, Homo sapiens
ggagggggaattcagccccagc

SEQ ID NO: 7664092 - DNA, 22 bp, Homo sapiens
ggagggggaattcagccccagc

SEQ ID NO: 7664093 - DNA, 22 bp, Homo sapiens
ggagggggaattcagccccagc

SEQ ID NO: 7664094 - DNA, 22 bp, Homo sapiens
ggagggggaattcagccccagc

SEQ ID NO: 7664095 - DNA, 22 bp, Homo sapiens
ggagggggaattcagccccagc

SEQ ID NO: 7664096 - DNA, 22 bp, Homo sapiens
ggagggggaattcagccccagc

SEQ ID NO: 7664097 - DNA, 22 bp, Homo sapiens
ggagggggaattcagccccagc

SEQ ID NO: 7664098 - DNA, 22 bp, Homo sapiens
ggagggggaattcagccccagc

SEQ ID NO: 7664099 - DNA, 22 bp, Homo sapiens
ggagggggaattcagccccagc

SEQ ID NO: 7664100 - DNA, 22 bp, Homo sapiens
ggagggggaattcagccccagc

SEQ ID NO: 7664101 - DNA, 22 bp, Homo sapiens
ggagggggaattcagccccagc

SEQ ID NO: 7664102 - DNA, 22 bp, Homo sapiens
ggagggggaaactttggctgcc

SEQ ID NO: 7664103 - DNA, 22 bp, Homo sapiens
ggagggggaaactttggctgcc

SEQ ID NO: 7664104 - DNA, 22 bp, Homo sapiens
ggagggggaaactttggctgcc

SEQ ID NO: 7664105 - DNA, 22 bp, Homo sapiens
ggagggggaaactttggctgcc

SEQ ID NO: 7664106 - DNA, 22 bp, Homo sapiens
ggagggggaaactttggctgcc

SEQ ID NO: 7664107 - DNA, 22 bp, Homo sapiens
ggagggggaaactttggctgcc

SEQ ID NO: 7664108 - DNA, 22 bp, Homo sapiens
ggagggggaaactttggctgcc

SEQ ID NO: 7664109 - DNA, 22 bp, Homo sapiens
ggagggggaaactttggctgcc

SEQ ID NO: 7664110 - DNA, 22 bp, Homo sapiens
ggagggggaaactttggctgcc

SEQ ID NO: 7664111 - DNA, 22 bp, Homo sapiens
ggaggggctgagcaactttcag

SEQ ID NO: 7664112 - DNA, 22 bp, Homo sapiens
ggaggggctcctgttcgccccc

SEQ ID NO: 7664113 - DNA, 22 bp, Homo sapiens
ggaggggctcctgttcgccccc

SEQ ID NO: 7664114 - DNA, 22 bp, Homo sapiens
ggaggggctcctgttcgccccc

SEQ ID NO: 7664115 - DNA, 22 bp, Homo sapiens
ggaggggctcctgttcgccccc

SEQ ID NO: 7664116 - DNA, 22 bp, Homo sapiens
ggaggggagtctcccaaagccg

SEQ ID NO: 7664117 - DNA, 22 bp, Homo sapiens
ggaggggaggattaatgacaaa

SEQ ID NO: 7664118 - DNA, 22 bp, Homo sapiens
ggaggggaggattaatgacaaa

SEQ ID NO: 7664119 - DNA, 22 bp, Homo sapiens
ggaggggaggattaatgacaaa

SEQ ID NO: 7664120 - DNA, 22 bp, Homo sapiens
ggaggggaggattaatgacaaa

SEQ ID NO: 7664121 - DNA, 22 bp, Homo sapiens
ggaggggaggattaatgacaaa

SEQ ID NO: 7664122 - DNA, 22 bp, Homo sapiens
ggaggggaggattaatgacaaa

SEQ ID NO: 7664123 - DNA, 22 bp, Homo sapiens
ggaggggagatgtttgggctca

SEQ ID NO: 7664124 - DNA, 22 bp, Homo sapiens
ggaggggaggattaatgacaaa

SEQ ID NO: 7664125 - DNA, 22 bp, Homo sapiens
ggaggggaggattaatgacaaa

SEQ ID NO: 7664126 - DNA, 22 bp, Homo sapiens
ggaggggaggattaatgacaaa

SEQ ID NO: 7664127 - DNA, 22 bp, Homo sapiens
ggaggggagatgtttgggctca

SEQ ID NO: 7664128 - DNA, 22 bp, Homo sapiens
ggaggggagatgtttgggctca

SEQ ID NO: 7664129 - DNA, 22 bp, Homo sapiens
ggaggggagatgtttgggctca

SEQ ID NO: 7664130 - DNA, 22 bp, Homo sapiens
ggaggggagatgtttgggctca

SEQ ID NO: 7664131 - DNA, 22 bp, Homo sapiens
ggaggggagatgtttgggctca

SEQ ID NO: 7664132 - DNA, 22 bp, Homo sapiens
ggaggggagatgtttgggctca

SEQ ID NO: 7664133 - DNA, 22 bp, Homo sapiens
ggaggggagatgtttgggctca

SEQ ID NO: 7664134 - DNA, 22 bp, Homo sapiens
ggaggggagatgtttgggctca

SEQ ID NO: 7664135 - DNA, 22 bp, Homo sapiens
ggaggggagatgtttgggctca

SEQ ID NO: 7664136 - DNA, 22 bp, Homo sapiens
ggaggggaggtccagctgatct

SEQ ID NO: 7664137 - DNA, 22 bp, Homo sapiens
ggaggggaggtccagctgatct

SEQ ID NO: 7664138 - DNA, 22 bp, Homo sapiens
ggaggggaggtccagctgatct

SEQ ID NO: 7664139 - DNA, 22 bp, Homo sapiens
ggaggggaggattaatgacaaa

SEQ ID NO: 7664140 - DNA, 22 bp, Homo sapiens
ggaggggaggtccagctgatct

SEQ ID NO: 7664141 - DNA, 22 bp, Homo sapiens
ggaggggaggtccagctgatct

SEQ ID NO: 7664142 - DNA, 22 bp, Homo sapiens
ggaggggaggtccagctgatct

SEQ ID NO: 7664143 - DNA, 22 bp, Homo sapiens
ggaggggaggtccagctgatct

SEQ ID NO: 7664144 - DNA, 22 bp, Homo sapiens
ggaggggaggtccagctgatct

SEQ ID NO: 7664145 - DNA, 22 bp, Homo sapiens
ggaggggaggtccagctgatct

SEQ ID NO: 7664146 - DNA, 22 bp, Homo sapiens
ggaggggagtctcccaaagccg

SEQ ID NO: 7664147 - DNA, 22 bp, Homo sapiens
ggaggggagtctcccaaagccg

SEQ ID NO: 7664148 - DNA, 22 bp, Homo sapiens
ggaggggagtctcccaaagccg

SEQ ID NO: 7664149 - DNA, 22 bp, Homo sapiens
ggaggggaggtccagctgatct

SEQ ID NO: 7664150 - DNA, 22 bp, Homo sapiens
ggaggggaggtccagctgatct

SEQ ID NO: 7664151 - DNA, 22 bp, Homo sapiens
ggaggggaggtccagctgatct

SEQ ID NO: 7664152 - DNA, 22 bp, Homo sapiens
ggaggggagtctcccaaagccg

SEQ ID NO: 7664153 - DNA, 22 bp, Homo sapiens
ggaggggagtctcccaaagccg

SEQ ID NO: 7664154 - DNA, 22 bp, Homo sapiens
ggaggggagtctcccaaagccg

SEQ ID NO: 7664155 - DNA, 22 bp, Homo sapiens
ggaggggagtctcccaaagccg

SEQ ID NO: 7664156 - DNA, 22 bp, Homo sapiens
ggaggggagtctcccaaagccg

SEQ ID NO: 7664157 - DNA, 22 bp, Homo sapiens
ggaggggagtctcccaaagccg

SEQ ID NO: 7664158 - DNA, 22 bp, Homo sapiens
ggaggggagtctcccaaagccg

SEQ ID NO: 7664159 - DNA, 22 bp, Homo sapiens
ggagggggactgacactgattt

SEQ ID NO: 7664160 - DNA, 22 bp, Homo sapiens
ggagggggactgacactgattt

SEQ ID NO: 7664161 - DNA, 22 bp, Homo sapiens
ggagggggactgacactgattt

SEQ ID NO: 7664162 - DNA, 22 bp, Homo sapiens
ggagggggactgacactgattt

SEQ ID NO: 7664163 - DNA, 22 bp, Homo sapiens
ggagggggactgacactgattt

SEQ ID NO: 7664164 - DNA, 22 bp, Homo sapiens
ggagggggactgacactgattt

SEQ ID NO: 7664165 - DNA, 22 bp, Homo sapiens
ggagggggactgacactgattt

SEQ ID NO: 7664166 - DNA, 22 bp, Homo sapiens
ggagggggactgacactgattt

SEQ ID NO: 7664167 - DNA, 22 bp, Homo sapiens
ggaggggtctctagcgaggaga

SEQ ID NO: 7664168 - DNA, 22 bp, Homo sapiens
ggaggggtctctagcgaggaga

SEQ ID NO: 7664169 - DNA, 22 bp, Homo sapiens
ggaggggtctctagcgaggaga

SEQ ID NO: 7664170 - DNA, 22 bp, Homo sapiens
ggaggggtctctagcgaggaga

SEQ ID NO: 7664171 - DNA, 22 bp, Homo sapiens
ggaggggtctctagcgaggaga

SEQ ID NO: 7664172 - DNA, 22 bp, Homo sapiens
ggaggggtctctagcgaggaga

SEQ ID NO: 7664173 - DNA, 22 bp, Homo sapiens
ggaggggtctctagcgaggaga

SEQ ID NO: 7664174 - DNA, 22 bp, Homo sapiens
ggaggggtctctagcgaggaga

SEQ ID NO: 7664175 - DNA, 22 bp, Homo sapiens
ggaggggtctctagcgaggaga

SEQ ID NO: 7664176 - DNA, 22 bp, Homo sapiens
ggaggggtctctagcgaggaga

SEQ ID NO: 7664177 - DNA, 22 bp, Homo sapiens
ggaggggtgagaatggctgcct

SEQ ID NO: 7664178 - DNA, 22 bp, Homo sapiens
ggaggggtgagaatggctgcct

SEQ ID NO: 7664179 - DNA, 22 bp, Homo sapiens
ggaggggtgagaatggctgcct

SEQ ID NO: 7664180 - DNA, 22 bp, Homo sapiens
ggaggggtgagaatggctgcct

SEQ ID NO: 7664181 - DNA, 22 bp, Homo sapiens
ggaggggtgagaatggctgcct

SEQ ID NO: 7664182 - DNA, 22 bp, Homo sapiens
ggaggggtgagaatggctgcct

SEQ ID NO: 7664183 - DNA, 22 bp, Homo sapiens
ggaggggtgagaatggctgcct

SEQ ID NO: 7664184 - DNA, 22 bp, Homo sapiens
ggaggggtgagaatggctgcct

SEQ ID NO: 7664185 - DNA, 22 bp, Homo sapiens
ggaggggtgagaatggctgcct

SEQ ID NO: 7664186 - DNA, 22 bp, Homo sapiens
ggaggggtgagaatggctgcct

SEQ ID NO: 7664187 - DNA, 22 bp, Homo sapiens
ggaggggtgctcagctgtcacg

SEQ ID NO: 7664188 - DNA, 22 bp, Homo sapiens
ggaggggtggaaggagtgcctg

SEQ ID NO: 7664189 - DNA, 22 bp, Homo sapiens
ggaggggtggaaggagtgcctg

SEQ ID NO: 7664190 - DNA, 22 bp, Homo sapiens
ggaggggtggaaggagtgcctg

SEQ ID NO: 7664191 - DNA, 22 bp, Homo sapiens
ggaggggtgctcagctgtcacg

SEQ ID NO: 7664192 - DNA, 22 bp, Homo sapiens
ggaggggtgctcagctgtcacg

SEQ ID NO: 7664193 - DNA, 22 bp, Homo sapiens
ggaggggtgctcagctgtcacg

SEQ ID NO: 7664194 - DNA, 22 bp, Homo sapiens
ggaggggtgctcagctgtcacg

SEQ ID NO: 7664195 - DNA, 22 bp, Homo sapiens
ggagggtgcttaagttgtgttt

SEQ ID NO: 7664196 - DNA, 22 bp, Homo sapiens
ggagggtgcttaagttgtgttt

SEQ ID NO: 7664197 - DNA, 22 bp, Homo sapiens
ggagggtgcttaagttgtgttt

SEQ ID NO: 7664198 - DNA, 22 bp, Homo sapiens
ggagggtgcttaagttgtgttt

SEQ ID NO: 7664199 - DNA, 22 bp, Homo sapiens
ggagggtgcttaagttgtgttt

SEQ ID NO: 7664200 - DNA, 22 bp, Homo sapiens
ggagggtgcattttaccctgtg

SEQ ID NO: 7664201 - DNA, 22 bp, Homo sapiens
ggagggtgcattttaccctgtg

SEQ ID NO: 7664202 - DNA, 22 bp, Homo sapiens
ggagggtgcattttaccctgtg

SEQ ID NO: 7664203 - DNA, 22 bp, Homo sapiens
ggagggtgcagaccctttgcaa

SEQ ID NO: 7664204 - DNA, 22 bp, Homo sapiens
ggagggtgcattttaccctgtg

SEQ ID NO: 7664205 - DNA, 22 bp, Homo sapiens
ggagggtgcagaccctttgcaa

SEQ ID NO: 7664206 - DNA, 22 bp, Homo sapiens
ggagggtctaagggagaactga

SEQ ID NO: 7664207 - DNA, 22 bp, Homo sapiens
ggagggtgcagaccctttgcaa

SEQ ID NO: 7664208 - DNA, 22 bp, Homo sapiens
ggagggtgcagaccctttgcaa

SEQ ID NO: 7664209 - DNA, 22 bp, Homo sapiens
ggagggtccatcttgtgaaaag

SEQ ID NO: 7664210 - DNA, 22 bp, Homo sapiens
ggagggtccatcttgtgaaaag

SEQ ID NO: 7664211 - DNA, 22 bp, Homo sapiens
ggagggtccccagcagcatgaa

SEQ ID NO: 7664212 - DNA, 22 bp, Homo sapiens
ggagggtctaagggagaactga

SEQ ID NO: 7664213 - DNA, 22 bp, Homo sapiens
ggagggtccccagcagcatgaa

SEQ ID NO: 7664214 - DNA, 22 bp, Homo sapiens
ggagggtctaagggagaactga

SEQ ID NO: 7664215 - DNA, 22 bp, Homo sapiens
ggagggtctaagggagaactga

SEQ ID NO: 7664216 - DNA, 22 bp, Homo sapiens
ggagggtccactgtgaggcaga

SEQ ID NO: 7664217 - DNA, 22 bp, Homo sapiens
ggagggtccactgtgaggcaga

SEQ ID NO: 7664218 - DNA, 22 bp, Homo sapiens
ggagggtccactgtgaggcaga

SEQ ID NO: 7664219 - DNA, 22 bp, Homo sapiens
ggagggtccactgtgaggcaga

SEQ ID NO: 7664220 - DNA, 22 bp, Homo sapiens
ggagggtccactgtgaggcaga

SEQ ID NO: 7664221 - DNA, 22 bp, Homo sapiens
ggaggggtggtcgcgaagagca

SEQ ID NO: 7664222 - DNA, 22 bp, Homo sapiens
ggaggggtggtcgcgaagagca

SEQ ID NO: 7664223 - DNA, 22 bp, Homo sapiens
ggaggggtggtcgcgaagagca

SEQ ID NO: 7664224 - DNA, 22 bp, Homo sapiens
ggagggtccactgtgaggcaga

SEQ ID NO: 7664225 - DNA, 22 bp, Homo sapiens
ggaggggtggtcgcgaagagca

SEQ ID NO: 7664226 - DNA, 22 bp, Homo sapiens
ggaggggtggtcacctggcagg

SEQ ID NO: 7664227 - DNA, 22 bp, Homo sapiens
ggaggggtggtcacctggcagg

SEQ ID NO: 7664228 - DNA, 22 bp, Homo sapiens
ggaggggtggtcacctggcagg

SEQ ID NO: 7664229 - DNA, 22 bp, Homo sapiens
ggaggggtggtcacctggcagg

SEQ ID NO: 7664230 - DNA, 22 bp, Homo sapiens
ggaggggtggaaggagtgcctg

SEQ ID NO: 7664231 - DNA, 22 bp, Homo sapiens
ggaggggtggaaggagtgcctg

SEQ ID NO: 7664232 - DNA, 22 bp, Homo sapiens
ggaggggtggaaggagtgcctg

SEQ ID NO: 7664233 - DNA, 22 bp, Homo sapiens
ggaggggtggaaggagtgcctg

SEQ ID NO: 7664234 - DNA, 22 bp, Homo sapiens
ggaggcctagccagctccagtt

SEQ ID NO: 7664235 - DNA, 22 bp, Homo sapiens
ggaggcctagccagctccagtt

SEQ ID NO: 7664236 - DNA, 22 bp, Homo sapiens
ggaggcctagccagctccagtt

SEQ ID NO: 7664237 - DNA, 22 bp, Homo sapiens
ggaggcctagaaaagtggttct

SEQ ID NO: 7664238 - DNA, 22 bp, Homo sapiens
ggaggcctagaaaagtggttct

SEQ ID NO: 7664239 - DNA, 22 bp, Homo sapiens
ggaggcctagaaaagtggttct

SEQ ID NO: 7664240 - DNA, 22 bp, Homo sapiens
ggaggcctaaggtacagtttgc

SEQ ID NO: 7664241 - DNA, 22 bp, Homo sapiens
ggaggcccagagaggtgaagtg

SEQ ID NO: 7664242 - DNA, 22 bp, Homo sapiens
ggaggcccagaaggaagcccag

SEQ ID NO: 7664243 - DNA, 22 bp, Homo sapiens
ggaggcccagaaggaagcccag

SEQ ID NO: 7664244 - DNA, 22 bp, Homo sapiens
ggaggcccagaaggaagcccag

SEQ ID NO: 7664245 - DNA, 22 bp, Homo sapiens
ggaggccatgggcagaatcttt

SEQ ID NO: 7664246 - DNA, 22 bp, Homo sapiens
ggaggccatgggcagaatcttt

SEQ ID NO: 7664247 - DNA, 22 bp, Homo sapiens
ggaggccatgggcagaatcttt

SEQ ID NO: 7664248 - DNA, 22 bp, Homo sapiens
ggaggccatgggcagaatcttt

SEQ ID NO: 7664249 - DNA, 22 bp, Homo sapiens
ggaggcccagagaggtgaagtg

SEQ ID NO: 7664250 - DNA, 22 bp, Homo sapiens
ggaggcccagagaggtgaagtg

SEQ ID NO: 7664251 - DNA, 22 bp, Homo sapiens
ggaggcccagaaggaagcccag

SEQ ID NO: 7664252 - DNA, 22 bp, Homo sapiens
ggaggcctcctgggggaggttc

SEQ ID NO: 7664253 - DNA, 22 bp, Homo sapiens
ggaggcctcctgggggaggttc

SEQ ID NO: 7664254 - DNA, 22 bp, Homo sapiens
ggaggcctcctgggggaggttc

SEQ ID NO: 7664255 - DNA, 22 bp, Homo sapiens
ggaggcctcagtaccttgcttt

SEQ ID NO: 7664256 - DNA, 22 bp, Homo sapiens
ggaggcctcatcttgccccgtg

SEQ ID NO: 7664257 - DNA, 22 bp, Homo sapiens
ggaggcctcagtaccttgcttt

SEQ ID NO: 7664258 - DNA, 22 bp, Homo sapiens
ggaggcggaggttgcagtgagc

SEQ ID NO: 7664259 - DNA, 22 bp, Homo sapiens
ggaggcggaggttgcagtgagc

SEQ ID NO: 7664260 - DNA, 22 bp, Homo sapiens
ggaggcggaggttgcagtgagc

SEQ ID NO: 7664261 - DNA, 22 bp, Homo sapiens
ggaggcggaggttgcagtgagc

SEQ ID NO: 7664262 - DNA, 22 bp, Homo sapiens
ggaggccttgaggccaggagct

SEQ ID NO: 7664263 - DNA, 19 bp, Homo sapiens
ggaggcctgggtatttgcc

SEQ ID NO: 7664264 - DNA, 22 bp, Homo sapiens
ggaggcctggacttcctgatgg

SEQ ID NO: 7664265 - DNA, 22 bp, Homo sapiens
ggaggctccatgagctcctgca

SEQ ID NO: 7664266 - DNA, 22 bp, Homo sapiens
ggaggctcccacgcagctcaca

SEQ ID NO: 7664267 - DNA, 22 bp, Homo sapiens
ggaggctccatgagctcctgca

SEQ ID NO: 7664268 - DNA, 22 bp, Homo sapiens
ggaggctccatgagctcctgca

SEQ ID NO: 7664269 - DNA, 22 bp, Homo sapiens
ggaggctccatgagctcctgca

SEQ ID NO: 7664270 - DNA, 22 bp, Homo sapiens
ggaggctccactgctcttcctg

SEQ ID NO: 7664271 - DNA, 22 bp, Homo sapiens
ggaggctcagtgaggaaatgga

SEQ ID NO: 7664272 - DNA, 22 bp, Homo sapiens
ggaggctccatgagctcctgca

SEQ ID NO: 7664273 - DNA, 22 bp, Homo sapiens
ggaggctccatgagctcctgca

SEQ ID NO: 7664274 - DNA, 22 bp, Homo sapiens
ggaggctcagactccatcctca

SEQ ID NO: 7664275 - DNA, 23 bp, Homo sapiens
ggaggctcaagtatcacgggcag

SEQ ID NO: 7664276 - DNA, 23 bp, Homo sapiens
ggaggctcaagtatcacgggcag

SEQ ID NO: 7664277 - DNA, 23 bp, Homo sapiens
ggaggctcaagtatcacgggcag

SEQ ID NO: 7664278 - DNA, 22 bp, Homo sapiens
ggaggctcagtgaggaaatgga

SEQ ID NO: 7664279 - DNA, 22 bp, Homo sapiens
ggaggctcagtgaggaaatgga

SEQ ID NO: 7664280 - DNA, 22 bp, Homo sapiens
ggaggcggaggttgcagtgagt

SEQ ID NO: 7664281 - DNA, 22 bp, Homo sapiens
ggaggcggggaaggcatcccat

SEQ ID NO: 7664282 - DNA, 22 bp, Homo sapiens
ggaggcggggaaggcatcccat

SEQ ID NO: 7664283 - DNA, 22 bp, Homo sapiens
ggaggcggggaaggcatcccat

SEQ ID NO: 7664284 - DNA, 22 bp, Homo sapiens
ggaggcggggaaggcatcccat

SEQ ID NO: 7664285 - DNA, 22 bp, Homo sapiens
ggaggcggaggttgcagtgagt

SEQ ID NO: 7664286 - DNA, 22 bp, Homo sapiens
ggaggcggaggttgcagtgagt

SEQ ID NO: 7664287 - DNA, 22 bp, Homo sapiens
ggaggcggaggttgcagtgagt

SEQ ID NO: 7664288 - DNA, 22 bp, Homo sapiens
ggaggcggaggttgcagtgagc

SEQ ID NO: 7664289 - DNA, 22 bp, Homo sapiens
ggaggcggaggttgcagtgagc

SEQ ID NO: 7664290 - DNA, 22 bp, Homo sapiens
ggaggcggaggttgcagtgagc

SEQ ID NO: 7664291 - DNA, 22 bp, Homo sapiens
ggaggcggaggttgcagtgagc

SEQ ID NO: 7664292 - DNA, 22 bp, Homo sapiens
ggaggcggaggttgcagtgagt

SEQ ID NO: 7664293 - DNA, 22 bp, Homo sapiens
ggaggcggaggttgcagtgagt

SEQ ID NO: 7664294 - DNA, 22 bp, Homo sapiens
ggaggcggaggttgcagtgagt

SEQ ID NO: 7664295 - DNA, 22 bp, Homo sapiens
ggaggcggaggttgcagtgagt

SEQ ID NO: 7664296 - DNA, 22 bp, Homo sapiens
ggaggcggaggttgcagtgagt

SEQ ID NO: 7664297 - DNA, 22 bp, Homo sapiens
ggaggctgagaggtcgcagtgg

SEQ ID NO: 7664298 - DNA, 22 bp, Homo sapiens
ggaggctgagaggtcgcagtgg

SEQ ID NO: 7664299 - DNA, 22 bp, Homo sapiens
ggaggctgagaagtccaagatc

SEQ ID NO: 7664300 - DNA, 22 bp, Homo sapiens
ggaggctgagaagtccaagatc

SEQ ID NO: 7664301 - DNA, 22 bp, Homo sapiens
ggaggctgagaagtccaagatc

SEQ ID NO: 7664302 - DNA, 22 bp, Homo sapiens
ggaggctgagaagtccaagatc

SEQ ID NO: 7664303 - DNA, 22 bp, Homo sapiens
ggaggctgagaagtccaagatc

SEQ ID NO: 7664304 - DNA, 22 bp, Homo sapiens
ggaggctgagaagtccaagatc

SEQ ID NO: 7664305 - DNA, 22 bp, Homo sapiens
ggaggctcttgagaggggagta

SEQ ID NO: 7664306 - DNA, 22 bp, Homo sapiens
ggaggctgagaagtccaagatc

SEQ ID NO: 7664307 - DNA, 22 bp, Homo sapiens
ggaggctgagaagtccaagatc

SEQ ID NO: 7664308 - DNA, 22 bp, Homo sapiens
ggaggctcttgagaggggagta

SEQ ID NO: 7664309 - DNA, 22 bp, Homo sapiens
ggaggctcttgagaggggagta

SEQ ID NO: 7664310 - DNA, 22 bp, Homo sapiens
ggaggctcttgagaggggagta

SEQ ID NO: 7664311 - DNA, 22 bp, Homo sapiens
ggaggctctgcttatgaaaggc

SEQ ID NO: 7664312 - DNA, 22 bp, Homo sapiens
ggaggctctgctccgtgtgttc

SEQ ID NO: 7664313 - DNA, 22 bp, Homo sapiens
ggaggctctcctggccttgtct

SEQ ID NO: 7664314 - DNA, 22 bp, Homo sapiens
ggaggctctaaactttccttgg

SEQ ID NO: 7664315 - DNA, 22 bp, Homo sapiens
ggaggctctcctggccttgtct

SEQ ID NO: 7664316 - DNA, 22 bp, Homo sapiens
ggaggctcgctggtcgcacagc

SEQ ID NO: 7664317 - DNA, 22 bp, Homo sapiens
ggaggctcgctggtcgcacagc

SEQ ID NO: 7664318 - DNA, 22 bp, Homo sapiens
ggaggctcctaagctgacttga

SEQ ID NO: 7664319 - DNA, 22 bp, Homo sapiens
ggaggctcccacgcagctcaca

SEQ ID NO: 7664320 - DNA, 22 bp, Homo sapiens
ggaggctcccacgcagctcaca

SEQ ID NO: 7664321 - DNA, 22 bp, Homo sapiens
ggaggcttcctggctcttgatt

SEQ ID NO: 7664322 - DNA, 22 bp, Homo sapiens
ggaggcttcctggctcttgatt

SEQ ID NO: 7664323 - DNA, 19 bp, Homo sapiens
ggaggcttcttggggtcgg

SEQ ID NO: 7664324 - DNA, 19 bp, Homo sapiens
ggaggcttcttggggtcgg

SEQ ID NO: 7664325 - DNA, 19 bp, Homo sapiens
ggaggcttcttggggtcgg

SEQ ID NO: 7664326 - DNA, 22 bp, Homo sapiens
ggaggctgctgcctcacgtggg

SEQ ID NO: 7664327 - DNA, 22 bp, Homo sapiens
ggaggctgctgcctcacgtggg

SEQ ID NO: 7664328 - DNA, 22 bp, Homo sapiens
ggaggctgctgcctcacgtggg

SEQ ID NO: 7664329 - DNA, 22 bp, Homo sapiens
ggaggctgctgcctcacgtggg

SEQ ID NO: 7664330 - DNA, 22 bp, Homo sapiens
ggaggctgctgcctcacgtggg

SEQ ID NO: 7664331 - DNA, 22 bp, Homo sapiens
ggaggctgctgcctcacgtggg

SEQ ID NO: 7664332 - DNA, 22 bp, Homo sapiens
ggaggctgctgcctcacgtggg

SEQ ID NO: 7664333 - DNA, 22 bp, Homo sapiens
ggaggctgaggcccctcacagg

SEQ ID NO: 7664334 - DNA, 22 bp, Homo sapiens
ggaggctgaggcccctcacagg

SEQ ID NO: 7664335 - DNA, 22 bp, Homo sapiens
ggaggctgaggcccctcacagg

SEQ ID NO: 7664336 - DNA, 22 bp, Homo sapiens
ggaggctgaggcccctcacagg

SEQ ID NO: 7664337 - DNA, 22 bp, Homo sapiens
ggaggctgaggcccctcacagg

SEQ ID NO: 7664338 - DNA, 22 bp, Homo sapiens
ggaggctgaggcaggcggatca

SEQ ID NO: 7664339 - DNA, 22 bp, Homo sapiens
ggaggctgaggcaggcggatca

SEQ ID NO: 7664340 - DNA, 22 bp, Homo sapiens
ggaggctgaggcaggcggatca

SEQ ID NO: 7664341 - DNA, 22 bp, Homo sapiens
ggaggctgaggcaggcggatca

SEQ ID NO: 7664342 - DNA, 22 bp, Homo sapiens
ggaggctgaggcccctcacagg

SEQ ID NO: 7664343 - DNA, 22 bp, Homo sapiens
ggaggctgaggcccctcacagg

SEQ ID NO: 7664344 - DNA, 22 bp, Homo sapiens
ggaggctgaggcccctcacagg

SEQ ID NO: 7664345 - DNA, 22 bp, Homo sapiens
ggaggctgaggcccctcacagg

SEQ ID NO: 7664346 - DNA, 22 bp, Homo sapiens
ggaggctgaggcaggcggatca

SEQ ID NO: 7664347 - DNA, 22 bp, Homo sapiens
ggaggctgaggcaggcggatca

SEQ ID NO: 7664348 - DNA, 22 bp, Homo sapiens
ggaggctgaggcaggcggatca

SEQ ID NO: 7664349 - DNA, 22 bp, Homo sapiens
ggaggctgaggcaggcggatca

SEQ ID NO: 7664350 - DNA, 22 bp, Homo sapiens
ggaggctgaggcaggcggatca

SEQ ID NO: 7664351 - DNA, 22 bp, Homo sapiens
ggaggctgaggcaggcggatca

SEQ ID NO: 7664352 - DNA, 22 bp, Homo sapiens
ggaggctgagaggtcgcagtgg

SEQ ID NO: 7664353 - DNA, 22 bp, Homo sapiens
ggaggctgaggcaggcggatca

SEQ ID NO: 7664354 - DNA, 22 bp, Homo sapiens
ggaggctgagaggtcgcagtgg

SEQ ID NO: 7664355 - DNA, 22 bp, Homo sapiens
ggagggagagtgaccctaccaa

SEQ ID NO: 7664356 - DNA, 22 bp, Homo sapiens
ggagggagagtgaccctaccaa

SEQ ID NO: 7664357 - DNA, 22 bp, Homo sapiens
ggagggagagtgaccctaccaa

SEQ ID NO: 7664358 - DNA, 22 bp, Homo sapiens
ggagggagagtgaccctaccaa

SEQ ID NO: 7664359 - DNA, 22 bp, Homo sapiens
ggagggagagtgaccctaccaa

SEQ ID NO: 7664360 - DNA, 22 bp, Homo sapiens
ggagggagagtgaccctaccaa

SEQ ID NO: 7664361 - DNA, 22 bp, Homo sapiens
ggagggagagtgaccctaccaa

SEQ ID NO: 7664362 - DNA, 22 bp, Homo sapiens
ggagggagagtgaccctaccaa

SEQ ID NO: 7664363 - DNA, 22 bp, Homo sapiens
ggagggagagtgaccctaccaa

SEQ ID NO: 7664364 - DNA, 22 bp, Homo sapiens
ggagggacccactgcggtgacc

SEQ ID NO: 7664365 - DNA, 22 bp, Homo sapiens
ggagggacccactgcggtgacc

SEQ ID NO: 7664366 - DNA, 22 bp, Homo sapiens
ggagggacccactgcggtgacc

SEQ ID NO: 7664367 - DNA, 22 bp, Homo sapiens
ggagggagagtgaccctaccaa

SEQ ID NO: 7664368 - DNA, 22 bp, Homo sapiens
ggagggagcagagaacccaacc

SEQ ID NO: 7664369 - DNA, 22 bp, Homo sapiens
ggagggagcagagaacccaacc

SEQ ID NO: 7664370 - DNA, 22 bp, Homo sapiens
ggagggagagtgaccctaccaa

SEQ ID NO: 7664371 - DNA, 22 bp, Homo sapiens
ggagggagagtgaccctaccaa

SEQ ID NO: 7664372 - DNA, 22 bp, Homo sapiens
ggagggagagtgaccctaccaa

SEQ ID NO: 7664373 - DNA, 22 bp, Homo sapiens
ggagggcagagtcccctgctga

SEQ ID NO: 7664374 - DNA, 22 bp, Homo sapiens
ggagggcagagtcccctgctga

SEQ ID NO: 7664375 - DNA, 22 bp, Homo sapiens
ggagggcacaggaccagaaatc

SEQ ID NO: 7664376 - DNA, 22 bp, Homo sapiens
ggagggacccactctagaggtg

SEQ ID NO: 7664377 - DNA, 22 bp, Homo sapiens
ggagggacccactctagaggtg

SEQ ID NO: 7664378 - DNA, 22 bp, Homo sapiens
ggagggacccactctagaggtg

SEQ ID NO: 7664379 - DNA, 22 bp, Homo sapiens
ggagggacccactctagaggtg

SEQ ID NO: 7664380 - DNA, 22 bp, Homo sapiens
ggagggaatgtctagcattctt

SEQ ID NO: 7664381 - DNA, 22 bp, Homo sapiens
ggagggaatgtctagcattctt

SEQ ID NO: 7664382 - DNA, 22 bp, Homo sapiens
ggagggaaccttggctggattg

SEQ ID NO: 7664383 - DNA, 22 bp, Homo sapiens
ggagggaagtgagttctcagct

SEQ ID NO: 7664384 - DNA, 22 bp, Homo sapiens
ggagggaagtgagttctcagct

SEQ ID NO: 7664385 - DNA, 22 bp, Homo sapiens
ggagggaagtgagttctcagct

SEQ ID NO: 7664386 - DNA, 22 bp, Homo sapiens
ggagggaagtgagttctcagct

SEQ ID NO: 7664387 - DNA, 22 bp, Homo sapiens
ggagggaatgtctagcattctt

SEQ ID NO: 7664388 - DNA, 22 bp, Homo sapiens
ggagggaatgtctagcattctt

SEQ ID NO: 7664389 - DNA, 22 bp, Homo sapiens
ggagggaatgtctagcattctt

SEQ ID NO: 7664390 - DNA, 22 bp, Homo sapiens
ggagggaatgtctagcattctt

SEQ ID NO: 7664391 - DNA, 22 bp, Homo sapiens
ggagggaaccttggctggattg

SEQ ID NO: 7664392 - DNA, 22 bp, Homo sapiens
ggagggaaccttggctggattg

SEQ ID NO: 7664393 - DNA, 22 bp, Homo sapiens
ggaggcttgatgatcttggata

SEQ ID NO: 7664394 - DNA, 22 bp, Homo sapiens
ggaggcttgatgatcttggata

SEQ ID NO: 7664395 - DNA, 22 bp, Homo sapiens
ggaggcttgatgatcttggata

SEQ ID NO: 7664396 - DNA, 22 bp, Homo sapiens
ggagggaaccttggctggattg

SEQ ID NO: 7664397 - DNA, 22 bp, Homo sapiens
ggagggaaccttggctggattg

SEQ ID NO: 7664398 - DNA, 21 bp, Homo sapiens
ggagggcagcccagactggct

SEQ ID NO: 7664399 - DNA, 21 bp, Homo sapiens
ggagggcagcccagactggct

SEQ ID NO: 7664400 - DNA, 21 bp, Homo sapiens
ggagggcagcccagactggct

SEQ ID NO: 7664401 - DNA, 21 bp, Homo sapiens
ggagggcagcccagactggct

SEQ ID NO: 7664402 - DNA, 21 bp, Homo sapiens
ggagggcagcccagactggct

SEQ ID NO: 7664403 - DNA, 21 bp, Homo sapiens
ggagggcagcccagactggct

SEQ ID NO: 7664404 - DNA, 21 bp, Homo sapiens
ggagggcagcccagactggct

SEQ ID NO: 7664405 - DNA, 20 bp, Homo sapiens
ggagggcagctgagagttgg

SEQ ID NO: 7664406 - DNA, 20 bp, Homo sapiens
ggagggcagctgagagttgg

SEQ ID NO: 7664407 - DNA, 20 bp, Homo sapiens
ggagggcagctgagagttgg

SEQ ID NO: 7664408 - DNA, 20 bp, Homo sapiens
ggagggcagctgagagttgg

SEQ ID NO: 7664409 - DNA, 20 bp, Homo sapiens
ggagggcagctgagagttgg

SEQ ID NO: 7664410 - DNA, 20 bp, Homo sapiens
ggagggcagctgagagttgg

SEQ ID NO: 7664411 - DNA, 22 bp, Homo sapiens
ggagggcatcaatcaggcctgg

SEQ ID NO: 7664412 - DNA, 20 bp, Homo sapiens
ggagggcagctgagagttgg

SEQ ID NO: 7664413 - DNA, 22 bp, Homo sapiens
ggagggcatcaatcaggcctgg

SEQ ID NO: 7664414 - DNA, 22 bp, Homo sapiens
ggagggcatcaatcaggcctgg

SEQ ID NO: 7664415 - DNA, 22 bp, Homo sapiens
ggagggcatcaatcaggcctgg

SEQ ID NO: 7664416 - DNA, 22 bp, Homo sapiens
ggagggccctgggtgcagctct

SEQ ID NO: 7664417 - DNA, 22 bp, Homo sapiens
ggagggcccctccagtgggcag

SEQ ID NO: 7664418 - DNA, 22 bp, Homo sapiens
ggagggcccctccagtgggcag

SEQ ID NO: 7664419 - DNA, 22 bp, Homo sapiens
ggagggcccctccagtgggcag

SEQ ID NO: 7664420 - DNA, 22 bp, Homo sapiens
ggagggcccctccagtgggcag

SEQ ID NO: 7664421 - DNA, 22 bp, Homo sapiens
ggagggcccctccagtgggcag

SEQ ID NO: 7664422 - DNA, 22 bp, Homo sapiens
ggagggcccctccagtgggcag

SEQ ID NO: 7664423 - DNA, 22 bp, Homo sapiens
ggagggcatcaatcaggcctgg

SEQ ID NO: 7664424 - DNA, 22 bp, Homo sapiens
ggagggcatcaatcaggcctgg

SEQ ID NO: 7664425 - DNA, 22 bp, Homo sapiens
ggagggccatcttgggtgtgat

SEQ ID NO: 7664426 - DNA, 22 bp, Homo sapiens
ggagggccatcttgggtgtgat

SEQ ID NO: 7664427 - DNA, 22 bp, Homo sapiens
ggagggcccctccagtgggcag

SEQ ID NO: 7664428 - DNA, 22 bp, Homo sapiens
ggagggccatcttgggtgtgat

SEQ ID NO: 7664429 - DNA, 22 bp, Homo sapiens
ggagggccatcttgggtgtgat

SEQ ID NO: 7664430 - DNA, 22 bp, Homo sapiens
ggagggccatcttgggtgtgat

SEQ ID NO: 7664431 - DNA, 22 bp, Homo sapiens
ggagggctccctgggagtggat

SEQ ID NO: 7664432 - DNA, 22 bp, Homo sapiens
ggagggctccctgggagtggat

SEQ ID NO: 7664433 - DNA, 22 bp, Homo sapiens
ggagggctccctgggagtggat

SEQ ID NO: 7664434 - DNA, 22 bp, Homo sapiens
ggagggctccctgggagtggat

SEQ ID NO: 7664435 - DNA, 22 bp, Homo sapiens
ggagggctccctgggagtggat

SEQ ID NO: 7664436 - DNA, 22 bp, Homo sapiens
ggagggctccctgggagtggat

SEQ ID NO: 7664437 - DNA, 22 bp, Homo sapiens
ggagggctccctgggagtggat

SEQ ID NO: 7664438 - DNA, 22 bp, Homo sapiens
ggagggctcaattgactcctga

SEQ ID NO: 7664439 - DNA, 22 bp, Homo sapiens
ggagggctcaattgactcctga

SEQ ID NO: 7664440 - DNA, 22 bp, Homo sapiens
ggagggctccctgggagtggat

SEQ ID NO: 7664441 - DNA, 22 bp, Homo sapiens
ggagggcgacagggcgaccgcg

SEQ ID NO: 7664442 - DNA, 22 bp, Homo sapiens
ggagggctcaattgactcctga

SEQ ID NO: 7664443 - DNA, 22 bp, Homo sapiens
ggagggctcaattgactcctga

SEQ ID NO: 7664444 - DNA, 22 bp, Homo sapiens
ggagggctcaattgactcctga

SEQ ID NO: 7664445 - DNA, 22 bp, Homo sapiens
ggagggctccctgggagtggat

SEQ ID NO: 7664446 - DNA, 22 bp, Homo sapiens
ggagggctcaattgactcctga

SEQ ID NO: 7664447 - DNA, 22 bp, Homo sapiens
ggagggccctgggtgcagctct

SEQ ID NO: 7664448 - DNA, 22 bp, Homo sapiens
ggagggctcaattgactcctga

SEQ ID NO: 7664449 - DNA, 22 bp, Homo sapiens
ggagggccctgggtgcagctct

SEQ ID NO: 7664450 - DNA, 22 bp, Homo sapiens
ggagggccctgggtgcagctct

SEQ ID NO: 7664451 - DNA, 22 bp, Homo sapiens
ggagggccctgggtgcagctct

SEQ ID NO: 7664452 - DNA, 22 bp, Homo sapiens
ggagggctgagactggggtctg

SEQ ID NO: 7664453 - DNA, 22 bp, Homo sapiens
ggagggctgagactggggtctg

SEQ ID NO: 7664454 - DNA, 22 bp, Homo sapiens
ggagggctgagactggggtctg

SEQ ID NO: 7664455 - DNA, 22 bp, Homo sapiens
ggagggctgagactggggtctg

SEQ ID NO: 7664456 - DNA, 22 bp, Homo sapiens
ggagggctcgtcatccaccact

SEQ ID NO: 7664457 - DNA, 22 bp, Homo sapiens
ggagggctcgtcatccaccact

SEQ ID NO: 7664458 - DNA, 22 bp, Homo sapiens
ggagggctcgtcatccaccact

SEQ ID NO: 7664459 - DNA, 22 bp, Homo sapiens
ggagggctcgtcatccaccact

SEQ ID NO: 7664460 - DNA, 22 bp, Homo sapiens
ggagggctcgtcatccaccact

SEQ ID NO: 7664461 - DNA, 22 bp, Homo sapiens
ggagggctgagactggggtctg

SEQ ID NO: 7664462 - DNA, 22 bp, Homo sapiens
ggagggctgagactggggtctg

SEQ ID NO: 7664463 - DNA, 22 bp, Homo sapiens
ggagggctgagactggggtctg

SEQ ID NO: 7664464 - DNA, 22 bp, Homo sapiens
ggagggctgagactggggtctg

SEQ ID NO: 7664465 - DNA, 22 bp, Homo sapiens
ggagggctgccacccgctcacg

SEQ ID NO: 7664466 - DNA, 22 bp, Homo sapiens
ggagggctgccacccgctcacg

SEQ ID NO: 7664467 - DNA, 22 bp, Homo sapiens
ggagggctgccaggtggagcgg

SEQ ID NO: 7664468 - DNA, 22 bp, Homo sapiens
ggaggggaactaatcccgtgac

SEQ ID NO: 7664469 - DNA, 18 bp, Homo sapiens
ggagggctttggggactg

SEQ ID NO: 7664470 - DNA, 18 bp, Homo sapiens
ggagggctttggggactg

SEQ ID NO: 7664471 - DNA, 18 bp, Homo sapiens
ggagggctttggggactg

SEQ ID NO: 7664472 - DNA, 22 bp, Homo sapiens
ggaggggaactaatcccgtgac

SEQ ID NO: 7664473 - DNA, 22 bp, Homo sapiens
ggaggggaactaatcccgtgac

SEQ ID NO: 7664474 - DNA, 22 bp, Homo sapiens
ggaggggaactaatcccgtgac

SEQ ID NO: 7664475 - DNA, 22 bp, Homo sapiens
ggaggggaactaatcccgtgac

SEQ ID NO: 7664476 - DNA, 22 bp, Homo sapiens
ggaggggaactaatcccgtgac

SEQ ID NO: 7664477 - DNA, 22 bp, Homo sapiens
ggaggggaactaatcccgtgac

SEQ ID NO: 7664478 - DNA, 22 bp, Homo sapiens
ggaggggaactaatcccgtgac

SEQ ID NO: 7664479 - DNA, 22 bp, Homo sapiens
ggagggctgtagaggagacctg

SEQ ID NO: 7664480 - DNA, 23 bp, Homo sapiens
ggagggcttcatcagacccccag

SEQ ID NO: 7664481 - DNA, 23 bp, Homo sapiens
ggagggcttcatcagacccccag

SEQ ID NO: 7664482 - DNA, 23 bp, Homo sapiens
ggagggcttcatcagacccccag

SEQ ID NO: 7664483 - DNA, 18 bp, Homo sapiens
ggagggctttggggactg

SEQ ID NO: 7664484 - DNA, 18 bp, Homo sapiens
ggagggctttggggactg

SEQ ID NO: 7664485 - DNA, 18 bp, Homo sapiens
ggagggctttggggactg

SEQ ID NO: 7664486 - DNA, 23 bp, Homo sapiens
ggagggcttcatcagacccccag

SEQ ID NO: 7664487 - DNA, 22 bp, Homo sapiens
ggagggctgccaggtggagcgg

SEQ ID NO: 7664488 - DNA, 22 bp, Homo sapiens
ggagggctgccaggtggagcgg

SEQ ID NO: 7664489 - DNA, 22 bp, Homo sapiens
ggagggctgccaggtggagcgg

SEQ ID NO: 7664490 - DNA, 22 bp, Homo sapiens
ggagggctgtagaggagacctg

SEQ ID NO: 7664491 - DNA, 22 bp, Homo sapiens
ggagggctgtagaggagacctg

SEQ ID NO: 7664492 - DNA, 22 bp, Homo sapiens
ggagggctgtagaggagacctg

SEQ ID NO: 7664493 - DNA, 22 bp, Homo sapiens
ggagggctgccaggtggagcgg

SEQ ID NO: 7664494 - DNA, 22 bp, Homo sapiens
ggagggctgccaggtggagcgg

SEQ ID NO: 7664495 - DNA, 22 bp, Homo sapiens
ggagggctgccaggtggagcgg

SEQ ID NO: 7664496 - DNA, 22 bp, Homo sapiens
ggagggctgccaggtggagcgg

SEQ ID NO: 7664497 - DNA, 22 bp, Homo sapiens
ggagggctgccaggtggagcgg

SEQ ID NO: 7664498 - DNA, 22 bp, Homo sapiens
ggagggctgccaggtggagcgg

SEQ ID NO: 7664499 - DNA, 22 bp, Homo sapiens
ggagggctgccaggtggagcgg

SEQ ID NO: 7664500 - DNA, 22 bp, Homo sapiens
ggagggctgccacccgctcacg

SEQ ID NO: 7664501 - DNA, 22 bp, Homo sapiens
ggagggctgccaggtggagcgg

SEQ ID NO: 7664502 - DNA, 22 bp, Homo sapiens
ggagggctgccaggtggagcgg

SEQ ID NO: 7664503 - DNA, 22 bp, Homo sapiens
ggcacagcacagtggacccagg

SEQ ID NO: 7664504 - DNA, 22 bp, Homo sapiens
ggcacagcacagtggacccagg

SEQ ID NO: 7664505 - DNA, 22 bp, Homo sapiens
ggcacagcacagtggacccagg

SEQ ID NO: 7664506 - DNA, 22 bp, Homo sapiens
ggcacagcacagtggacccagg

SEQ ID NO: 7664507 - DNA, 22 bp, Homo sapiens
ggcacagcacagtggacccagg

SEQ ID NO: 7664508 - DNA, 22 bp, Homo sapiens
ggcacagcacagtggacccagg

SEQ ID NO: 7664509 - DNA, 22 bp, Homo sapiens
ggcacagcacagtggacccagg

SEQ ID NO: 7664510 - DNA, 22 bp, Homo sapiens
ggcacagcacagagcacatgta

SEQ ID NO: 7664511 - DNA, 22 bp, Homo sapiens
ggcacagcacagagcacatgta

SEQ ID NO: 7664512 - DNA, 22 bp, Homo sapiens
ggcacagcacagagcacatgta

SEQ ID NO: 7664513 - DNA, 22 bp, Homo sapiens
ggcacagcaagaagggaaatga

SEQ ID NO: 7664514 - DNA, 23 bp, Homo sapiens
ggcacagatgctgagcatgtgca

SEQ ID NO: 7664515 - DNA, 22 bp, Homo sapiens
ggcacagcacagagcacatgta

SEQ ID NO: 7664516 - DNA, 22 bp, Homo sapiens
ggcacagcaagaagggaaatga

SEQ ID NO: 7664517 - DNA, 22 bp, Homo sapiens
ggcacagcacagagcacatgta

SEQ ID NO: 7664518 - DNA, 22 bp, Homo sapiens
ggcacagcaagaagggaaatga

SEQ ID NO: 7664519 - DNA, 22 bp, Homo sapiens
ggcacagcacagagcacatgta

SEQ ID NO: 7664520 - DNA, 22 bp, Homo sapiens
ggcacagcacagagcacatgta

SEQ ID NO: 7664521 - DNA, 22 bp, Homo sapiens
ggcacagcacagagcacatgta

SEQ ID NO: 7664522 - DNA, 22 bp, Homo sapiens
ggcacagcacagagcacatgta

SEQ ID NO: 7664523 - DNA, 22 bp, Homo sapiens
ggcacagcactgtaggcctggg

SEQ ID NO: 7664524 - DNA, 22 bp, Homo sapiens
ggcagaatggaaagatatcata

SEQ ID NO: 7664525 - DNA, 22 bp, Homo sapiens
ggcagaatggaaagatatcata

SEQ ID NO: 7664526 - DNA, 19 bp, Homo sapiens
ggcagaattttatgagctg

SEQ ID NO: 7664527 - DNA, 19 bp, Homo sapiens
ggcagaattttatgagctg

SEQ ID NO: 7664528 - DNA, 22 bp, Homo sapiens
ggcagaatttgccattcaagct

SEQ ID NO: 7664529 - DNA, 22 bp, Homo sapiens
ggcagaatttgccattcaagct

SEQ ID NO: 7664530 - DNA, 20 bp, Homo sapiens
ggcagaatgtgagcagctgc

SEQ ID NO: 7664531 - DNA, 20 bp, Homo sapiens
ggcagaatgtgagcagctgc

SEQ ID NO: 7664532 - DNA, 22 bp, Homo sapiens
ggcagaatgggctattataatg

SEQ ID NO: 7664533 - DNA, 22 bp, Homo sapiens
ggcagaatgggctattataatg

SEQ ID NO: 7664534 - DNA, 22 bp, Homo sapiens
ggcagacaatctgtctgttagg

SEQ ID NO: 7664535 - DNA, 22 bp, Homo sapiens
ggcagacaatctgtctgttagg

SEQ ID NO: 7664536 - DNA, 22 bp, Homo sapiens
ggcagacacaaaaacataaggt

SEQ ID NO: 7664537 - DNA, 22 bp, Homo sapiens
ggcagacacaaaaacataaggt

SEQ ID NO: 7664538 - DNA, 22 bp, Homo sapiens
ggcagacacaaaaacataaggt

SEQ ID NO: 7664539 - DNA, 22 bp, Homo sapiens
ggcagacacaaaaacataaggt

SEQ ID NO: 7664540 - DNA, 22 bp, Homo sapiens
ggcacagcaccttttcacattg

SEQ ID NO: 7664541 - DNA, 22 bp, Homo sapiens
ggcacagcaccttttcacattg

SEQ ID NO: 7664542 - DNA, 22 bp, Homo sapiens
ggcacagcactgtaggcctggg

SEQ ID NO: 7664543 - DNA, 22 bp, Homo sapiens
ggcacagcactgtaggcctggg

SEQ ID NO: 7664544 - DNA, 22 bp, Homo sapiens
ggcacagcactgtaggcctggg

SEQ ID NO: 7664545 - DNA, 22 bp, Homo sapiens
ggcacagcaccttttcacattg

SEQ ID NO: 7664546 - DNA, 22 bp, Homo sapiens
ggcacagcactgtaggcctggg

SEQ ID NO: 7664547 - DNA, 22 bp, Homo sapiens
ggcacagcactgtaggcctggg

SEQ ID NO: 7664548 - DNA, 22 bp, Homo sapiens
ggcacagcactgtaggcctggg

SEQ ID NO: 7664549 - DNA, 22 bp, Homo sapiens
ggcacagcactgtaggcctggg

SEQ ID NO: 7664550 - DNA, 22 bp, Homo sapiens
ggcacagcactgtaggcctggg

SEQ ID NO: 7664551 - DNA, 22 bp, Homo sapiens
ggcacagagctccagccttggc

SEQ ID NO: 7664552 - DNA, 22 bp, Homo sapiens
ggcacagagctttgtcccagtt

SEQ ID NO: 7664553 - DNA, 22 bp, Homo sapiens
ggcacagagctttgtcccagtt

SEQ ID NO: 7664554 - DNA, 22 bp, Homo sapiens
ggcacagagctccagccttggc

SEQ ID NO: 7664555 - DNA, 22 bp, Homo sapiens
ggcacagagctccagccttggc

SEQ ID NO: 7664556 - DNA, 22 bp, Homo sapiens
ggcacagagctccagccttggc

SEQ ID NO: 7664557 - DNA, 22 bp, Homo sapiens
ggcacagagcccagcttcctag

SEQ ID NO: 7664558 - DNA, 22 bp, Homo sapiens
ggcacagagctttgtcccagtt

SEQ ID NO: 7664559 - DNA, 22 bp, Homo sapiens
ggcacagagctttgtcccagtt

SEQ ID NO: 7664560 - DNA, 22 bp, Homo sapiens
ggcacagaggttgcctccagat

SEQ ID NO: 7664561 - DNA, 22 bp, Homo sapiens
ggcacagaggttgcctccagat

SEQ ID NO: 7664562 - DNA, 22 bp, Homo sapiens
ggcacagaggttgcctccagat

SEQ ID NO: 7664563 - DNA, 22 bp, Homo sapiens
ggcacagaggttgcctccagat

SEQ ID NO: 7664564 - DNA, 22 bp, Homo sapiens
ggcacagagttggcagagctgc

SEQ ID NO: 7664565 - DNA, 22 bp, Homo sapiens
ggcacagagttggcagagctgc

SEQ ID NO: 7664566 - DNA, 22 bp, Homo sapiens
ggcacagagttggcagagctgc

SEQ ID NO: 7664567 - DNA, 22 bp, Homo sapiens
ggcacagaggttgcctccagat

SEQ ID NO: 7664568 - DNA, 22 bp, Homo sapiens
ggcacagagttggcagagctgc

SEQ ID NO: 7664569 - DNA, 22 bp, Homo sapiens
ggcacagagttggcagagctgc

SEQ ID NO: 7664570 - DNA, 22 bp, Homo sapiens
ggcacagagttggcagagctgc

SEQ ID NO: 7664571 - DNA, 22 bp, Homo sapiens
ggcacagagttggcagagctgc

SEQ ID NO: 7664572 - DNA, 22 bp, Homo sapiens
ggcacagagttggcagagctgc

SEQ ID NO: 7664573 - DNA, 22 bp, Homo sapiens
ggcacagagttggcagagctgc

SEQ ID NO: 7664574 - DNA, 22 bp, Homo sapiens
ggcacagagttggcagagctgc

SEQ ID NO: 7664575 - DNA, 22 bp, Homo sapiens
ggcacagagttggcagagctgc

SEQ ID NO: 7664576 - DNA, 22 bp, Homo sapiens
ggcacagatagatcaagtgtct

SEQ ID NO: 7664577 - DNA, 22 bp, Homo sapiens
ggcacagatagatcaagtgtct

SEQ ID NO: 7664578 - DNA, 22 bp, Homo sapiens
ggcacagatagatcaagtgtct

SEQ ID NO: 7664579 - DNA, 23 bp, Homo sapiens
ggcacagatgctgagcatgtgca

SEQ ID NO: 7664580 - DNA, 23 bp, Homo sapiens
ggcacagatgctgagcatgtgca

SEQ ID NO: 7664581 - DNA, 22 bp, Homo sapiens
ggcacagatagatcaagtgtct

SEQ ID NO: 7664582 - DNA, 23 bp, Homo sapiens
ggcacagatgctgagcatgtgca

SEQ ID NO: 7664583 - DNA, 23 bp, Homo sapiens
ggcacagatgctgagcatgtgca

SEQ ID NO: 7664584 - DNA, 23 bp, Homo sapiens
ggcacagatgctgagcatgtgca

SEQ ID NO: 7664585 - DNA, 23 bp, Homo sapiens
ggcacagatgctgagcatgtgca

SEQ ID NO: 7664586 - DNA, 23 bp, Homo sapiens
ggcacagatgctgagcatgtgca

SEQ ID NO: 7664587 - DNA, 22 bp, Homo sapiens
ggcagacctctccagccccaca

SEQ ID NO: 7664588 - DNA, 22 bp, Homo sapiens
ggcagacctctccagccccaca

SEQ ID NO: 7664589 - DNA, 22 bp, Homo sapiens
ggcagacctctccagccccaca

SEQ ID NO: 7664590 - DNA, 22 bp, Homo sapiens
ggcagacctctccagccccaca

SEQ ID NO: 7664591 - DNA, 22 bp, Homo sapiens
ggcagacactcaaaagctggga

SEQ ID NO: 7664592 - DNA, 22 bp, Homo sapiens
ggcagacctctccagccccaca

SEQ ID NO: 7664593 - DNA, 22 bp, Homo sapiens
ggcagacctctccagccccaca

SEQ ID NO: 7664594 - DNA, 22 bp, Homo sapiens
ggcagacacctttatgtctaat

SEQ ID NO: 7664595 - DNA, 22 bp, Homo sapiens
ggcagacactcaaaagctggga

SEQ ID NO: 7664596 - DNA, 22 bp, Homo sapiens
ggcagacacctttatgtctaat

SEQ ID NO: 7664597 - DNA, 22 bp, Homo sapiens
ggcagacacctttatgtctaat

SEQ ID NO: 7664598 - DNA, 19 bp, Homo sapiens
ggcagacacagttgacatg

SEQ ID NO: 7664599 - DNA, 19 bp, Homo sapiens
ggcagacacagttgacatg

SEQ ID NO: 7664600 - DNA, 22 bp, Homo sapiens
ggcagacacaaaaacataaggt

SEQ ID NO: 7664601 - DNA, 22 bp, Homo sapiens
ggcagacacaaaaacataaggt

SEQ ID NO: 7664602 - DNA, 22 bp, Homo sapiens
ggcagagaatctggctgtttac

SEQ ID NO: 7664603 - DNA, 21 bp, Homo sapiens
ggcagagaagctggaagttgg

SEQ ID NO: 7664604 - DNA, 21 bp, Homo sapiens
ggcagagaagctggaagttgg

SEQ ID NO: 7664605 - DNA, 22 bp, Homo sapiens
ggcagagaatctggctgtttac

SEQ ID NO: 7664606 - DNA, 22 bp, Homo sapiens
ggcagagaatctggctgtttac

SEQ ID NO: 7664607 - DNA, 21 bp, Homo sapiens
ggcagagaagctggaagttgg

SEQ ID NO: 7664608 - DNA, 21 bp, Homo sapiens
ggcagagaagctggaagttgg

SEQ ID NO: 7664609 - DNA, 21 bp, Homo sapiens
ggcagagaagctggaagttgg

SEQ ID NO: 7664610 - DNA, 21 bp, Homo sapiens
ggcagagaagctggaagttgg

SEQ ID NO: 7664611 - DNA, 21 bp, Homo sapiens
ggcagagaagctggaagttgg

SEQ ID NO: 7664612 - DNA, 20 bp, Homo sapiens
ggcagacctgctgagagccc

SEQ ID NO: 7664613 - DNA, 18 bp, Homo sapiens
ggcagacgcgaggggcgg

SEQ ID NO: 7664614 - DNA, 20 bp, Homo sapiens
ggcagacctgctgagagccc

SEQ ID NO: 7664615 - DNA, 22 bp, Homo sapiens
ggcagactttttctctgaaggg

SEQ ID NO: 7664616 - DNA, 18 bp, Homo sapiens
ggcagacgcgaggggcgg

SEQ ID NO: 7664617 - DNA, 22 bp, Homo sapiens
ggcagactgtaataggagaatt

SEQ ID NO: 7664618 - DNA, 22 bp, Homo sapiens
ggcagagagttctccacctctc

SEQ ID NO: 7664619 - DNA, 23 bp, Homo sapiens
ggcagagagcatggctggggccc

SEQ ID NO: 7664620 - DNA, 23 bp, Homo sapiens
ggcagagagcatggctggggccc

SEQ ID NO: 7664621 - DNA, 23 bp, Homo sapiens
ggcagagagcatggctggggccc

SEQ ID NO: 7664622 - DNA, 23 bp, Homo sapiens
ggcagagagcatggctggggccc

SEQ ID NO: 7664623 - DNA, 22 bp, Homo sapiens
ggcagagactgggttggcagag

SEQ ID NO: 7664624 - DNA, 23 bp, Homo sapiens
ggcagagagcatggctggggccc

SEQ ID NO: 7664625 - DNA, 23 bp, Homo sapiens
ggcagagagcatggctggggccc

SEQ ID NO: 7664626 - DNA, 23 bp, Homo sapiens
ggcagagagcatggctggggccc

SEQ ID NO: 7664627 - DNA, 23 bp, Homo sapiens
ggcagagagcatggctggggccc

SEQ ID NO: 7664628 - DNA, 22 bp, Homo sapiens
ggcagagcttgttccttctgtt

SEQ ID NO: 7664629 - DNA, 22 bp, Homo sapiens
ggcagagcttgttccttctgtt

SEQ ID NO: 7664630 - DNA, 22 bp, Homo sapiens
ggcagagcttgttccttctgtt

SEQ ID NO: 7664631 - DNA, 22 bp, Homo sapiens
ggcagaggaagctggaagtggg

SEQ ID NO: 7664632 - DNA, 22 bp, Homo sapiens
ggcagaggaagctggaagtggg

SEQ ID NO: 7664633 - DNA, 22 bp, Homo sapiens
ggcagaggaagctggaagtggg

SEQ ID NO: 7664634 - DNA, 22 bp, Homo sapiens
ggcagagactgggttggcagag

SEQ ID NO: 7664635 - DNA, 22 bp, Homo sapiens
ggcagagactgggttggcagag

SEQ ID NO: 7664636 - DNA, 22 bp, Homo sapiens
ggcagagactgggttggcagag

SEQ ID NO: 7664637 - DNA, 22 bp, Homo sapiens
ggcagagactgggttggcagag

SEQ ID NO: 7664638 - DNA, 22 bp, Homo sapiens
ggcagagactgggttggcagag

SEQ ID NO: 7664639 - DNA, 23 bp, Homo sapiens
ggcagagagcatggctggggccc

SEQ ID NO: 7664640 - DNA, 23 bp, Homo sapiens
ggcagagagcatggctggggccc

SEQ ID NO: 7664641 - DNA, 23 bp, Homo sapiens
ggcagagagcatggctggggccc

SEQ ID NO: 7664642 - DNA, 22 bp, Homo sapiens
ggcagagaatctggctgtttac

SEQ ID NO: 7664643 - DNA, 22 bp, Homo sapiens
ggcagagacaccgaatgactct

SEQ ID NO: 7664644 - DNA, 22 bp, Homo sapiens
ggcagagacaccgaatgactct

SEQ ID NO: 7664645 - DNA, 22 bp, Homo sapiens
ggcagagacaccgaatgactct

SEQ ID NO: 7664646 - DNA, 22 bp, Homo sapiens
ggcagagacaccgaatgactct

SEQ ID NO: 7664647 - DNA, 22 bp, Homo sapiens
ggcagagactgggttggcagag

SEQ ID NO: 7664648 - DNA, 22 bp, Homo sapiens
ggcagagacaccgaatgactct

SEQ ID NO: 7664649 - DNA, 22 bp, Homo sapiens
ggcagagacaccgaatgactct

SEQ ID NO: 7664650 - DNA, 22 bp, Homo sapiens
ggcagagacaccgaatgactct

SEQ ID NO: 7664651 - DNA, 22 bp, Homo sapiens
ggcagagactgggttggcagag

SEQ ID NO: 7664652 - DNA, 22 bp, Homo sapiens
ggcagagactgggttggcagag

SEQ ID NO: 7664653 - DNA, 22 bp, Homo sapiens
ggagtggcactctgaggcgggg

SEQ ID NO: 7664654 - DNA, 22 bp, Homo sapiens
ggagtgctttgaagccttcatt

SEQ ID NO: 7664655 - DNA, 22 bp, Homo sapiens
ggagtgctttgaagccttcatt

SEQ ID NO: 7664656 - DNA, 22 bp, Homo sapiens
ggagtaggccccgggagagagt

SEQ ID NO: 7664657 - DNA, 22 bp, Homo sapiens
ggagtgctgggccgctgccaac

SEQ ID NO: 7664658 - DNA, 22 bp, Homo sapiens
ggagtggcactctgaggcgggg

SEQ ID NO: 7664659 - DNA, 22 bp, Homo sapiens
ggagtggcactctgaggcgggg

SEQ ID NO: 7664660 - DNA, 22 bp, Homo sapiens
ggagtggcactctgaggcgggg

SEQ ID NO: 7664661 - DNA, 22 bp, Homo sapiens
ggagtggcactctgaggcgggg

SEQ ID NO: 7664662 - DNA, 22 bp, Homo sapiens
ggagtggcactctgaggcgggg

SEQ ID NO: 7664663 - DNA, 22 bp, Homo sapiens
ggagtggcagagagggtatact

SEQ ID NO: 7664664 - DNA, 22 bp, Homo sapiens
ggagtggcactctgaggcgggg

SEQ ID NO: 7664665 - DNA, 22 bp, Homo sapiens
ggagtggcagcgaggatcagat

SEQ ID NO: 7664666 - DNA, 22 bp, Homo sapiens
ggagtggcagcgaggatcagat

SEQ ID NO: 7664667 - DNA, 22 bp, Homo sapiens
ggagtggcagcgaggatcagat

SEQ ID NO: 7664668 - DNA, 22 bp, Homo sapiens
ggagtggcagcgaggatcagat

SEQ ID NO: 7664669 - DNA, 22 bp, Homo sapiens
ggagtggcagctaggctgtcag

SEQ ID NO: 7664670 - DNA, 22 bp, Homo sapiens
ggagtggcagctaggctgtcag

SEQ ID NO: 7664671 - DNA, 22 bp, Homo sapiens
ggagtggcagctaggctgtcag

SEQ ID NO: 7664672 - DNA, 22 bp, Homo sapiens
ggagtggcagcgaggatcagat

SEQ ID NO: 7664673 - DNA, 22 bp, Homo sapiens
ggagtggcagcgaggatcagat

SEQ ID NO: 7664674 - DNA, 22 bp, Homo sapiens
ggagtggcagcgaggatcagat

SEQ ID NO: 7664675 - DNA, 22 bp, Homo sapiens
ggagtggcagagagggtatact

SEQ ID NO: 7664676 - DNA, 22 bp, Homo sapiens
ggagtggcagcgaggatcagat

SEQ ID NO: 7664677 - DNA, 22 bp, Homo sapiens
ggagtggcagcgaggatcagat

SEQ ID NO: 7664678 - DNA, 22 bp, Homo sapiens
ggagtggcagctaggctgtcag

SEQ ID NO: 7664679 - DNA, 22 bp, Homo sapiens
ggagtggcaggccacagtgctg

SEQ ID NO: 7664680 - DNA, 22 bp, Homo sapiens
ggagtggcaggccacagtgctg

SEQ ID NO: 7664681 - DNA, 22 bp, Homo sapiens
ggagtggcaggccacagtgctg

SEQ ID NO: 7664682 - DNA, 22 bp, Homo sapiens
ggagtggcagctaggctgtcag

SEQ ID NO: 7664683 - DNA, 22 bp, Homo sapiens
ggagtggccacgactgggagat

SEQ ID NO: 7664684 - DNA, 22 bp, Homo sapiens
ggagtggccacgactgggagat

SEQ ID NO: 7664685 - DNA, 22 bp, Homo sapiens
ggagtggccacgactgggagat

SEQ ID NO: 7664686 - DNA, 22 bp, Homo sapiens
ggagtggccacgactgggagat

SEQ ID NO: 7664687 - DNA, 22 bp, Homo sapiens
ggagtggcctctcctgtgcagg

SEQ ID NO: 7664688 - DNA, 22 bp, Homo sapiens
ggagtggctatttgtgctggtt

SEQ ID NO: 7664689 - DNA, 22 bp, Homo sapiens
ggagtggcctctcctgtgcagg

SEQ ID NO: 7664690 - DNA, 22 bp, Homo sapiens
ggagtggctatttgtgctggtt

SEQ ID NO: 7664691 - DNA, 22 bp, Homo sapiens
ggagtggcctctcctgtgcagg

SEQ ID NO: 7664692 - DNA, 22 bp, Homo sapiens
ggagtggcctctcctgtgcagg

SEQ ID NO: 7664693 - DNA, 22 bp, Homo sapiens
ggagtggcctctcctgtgcagg

SEQ ID NO: 7664694 - DNA, 22 bp, Homo sapiens
ggagtggcctctcctgtgcagg

SEQ ID NO: 7664695 - DNA, 22 bp, Homo sapiens
ggagtggcctctcctgtgcagg

SEQ ID NO: 7664696 - DNA, 22 bp, Homo sapiens
ggagtggcctctcctgtgcagg

SEQ ID NO: 7664697 - DNA, 19 bp, Homo sapiens
ggagtgggtagttagtggt

SEQ ID NO: 7664698 - DNA, 19 bp, Homo sapiens
ggagtgggtagttagtggt

SEQ ID NO: 7664699 - DNA, 19 bp, Homo sapiens
ggagtgggtagttagtggt

SEQ ID NO: 7664700 - DNA, 19 bp, Homo sapiens
ggagtgggtagttagtggt

SEQ ID NO: 7664701 - DNA, 19 bp, Homo sapiens
ggagtgggtagttagtggt

SEQ ID NO: 7664702 - DNA, 19 bp, Homo sapiens
ggagtgggtagttagtggt

SEQ ID NO: 7664703 - DNA, 22 bp, Homo sapiens
ggagtggtggtcaggccatggc

SEQ ID NO: 7664704 - DNA, 22 bp, Homo sapiens
ggagtggtggtcaggccatggc

SEQ ID NO: 7664705 - DNA, 22 bp, Homo sapiens
ggagtggtggtcaggccatggc

SEQ ID NO: 7664706 - DNA, 22 bp, Homo sapiens
ggagtgggcagcactgccctgt

SEQ ID NO: 7664707 - DNA, 22 bp, Homo sapiens
ggagtgggcagcactgccctgt

SEQ ID NO: 7664708 - DNA, 22 bp, Homo sapiens
ggagtgggcagcactgccctgt

SEQ ID NO: 7664709 - DNA, 22 bp, Homo sapiens
ggagtgggcagcactgccctgt

SEQ ID NO: 7664710 - DNA, 22 bp, Homo sapiens
ggagtgggcagcactgccctgt

SEQ ID NO: 7664711 - DNA, 22 bp, Homo sapiens
ggagtgggcagcactgccctgt

SEQ ID NO: 7664712 - DNA, 22 bp, Homo sapiens
ggagtgggcagcactgccctgt

SEQ ID NO: 7664713 - DNA, 22 bp, Homo sapiens
ggagtgggcagcactgccctgt

SEQ ID NO: 7664714 - DNA, 22 bp, Homo sapiens
ggagtgggcagcactgccctgt

SEQ ID NO: 7664715 - DNA, 22 bp, Homo sapiens
ggagtggctgtttctgccccca

SEQ ID NO: 7664716 - DNA, 22 bp, Homo sapiens
ggagtggctatttgtgctggtt

SEQ ID NO: 7664717 - DNA, 22 bp, Homo sapiens
ggagtggctgtttctgccccca

SEQ ID NO: 7664718 - DNA, 22 bp, Homo sapiens
ggagtgggaacaatgacatggt

SEQ ID NO: 7664719 - DNA, 22 bp, Homo sapiens
ggagtgggaacaatgacatggt

SEQ ID NO: 7664720 - DNA, 22 bp, Homo sapiens
ggagtgggaacaatgacatggt

SEQ ID NO: 7664721 - DNA, 22 bp, Homo sapiens
ggagtggctgtttctgccccca

SEQ ID NO: 7664722 - DNA, 22 bp, Homo sapiens
ggagtgggaacaatgacatggt

SEQ ID NO: 7664723 - DNA, 22 bp, Homo sapiens
ggagtgggaacaatgacatggt

SEQ ID NO: 7664724 - DNA, 22 bp, Homo sapiens
ggagtgggaacaatgacatggt

SEQ ID NO: 7664725 - DNA, 22 bp, Homo sapiens
ggagtgggaacaatgacatggt

SEQ ID NO: 7664726 - DNA, 22 bp, Homo sapiens
ggagtgggaacaatgacatggt

SEQ ID NO: 7664727 - DNA, 22 bp, Homo sapiens
ggagtgggaacaatgacatggt

SEQ ID NO: 7664728 - DNA, 22 bp, Homo sapiens
ggagtgggaacaatgacatggt

SEQ ID NO: 7664729 - DNA, 22 bp, Homo sapiens
ggagtgggaacaatgacatggt

SEQ ID NO: 7664730 - DNA, 22 bp, Homo sapiens
ggagtgggaacaatgacatggt

SEQ ID NO: 7664731 - DNA, 22 bp, Homo sapiens
ggagttgattttggatatatta

SEQ ID NO: 7664732 - DNA, 22 bp, Homo sapiens
ggagttgatcagagtaggaggt

SEQ ID NO: 7664733 - DNA, 17 bp, Homo sapiens
ggagttctgcagtcagg

SEQ ID NO: 7664734 - DNA, 22 bp, Homo sapiens
ggagttcaggaaaggagccaga

SEQ ID NO: 7664735 - DNA, 22 bp, Homo sapiens
ggagttcaggaatgaaaatgtt

SEQ ID NO: 7664736 - DNA, 22 bp, Homo sapiens
ggagttcaggaatgaaaatgtt

SEQ ID NO: 7664737 - DNA, 22 bp, Homo sapiens
ggagttcaggaatgaaaatgtt

SEQ ID NO: 7664738 - DNA, 22 bp, Homo sapiens
ggagttccagaccagactggcc

SEQ ID NO: 7664739 - DNA, 22 bp, Homo sapiens
ggagttccagaccagactggcc

SEQ ID NO: 7664740 - DNA, 22 bp, Homo sapiens
ggagttgattttggatatatta

SEQ ID NO: 7664741 - DNA, 22 bp, Homo sapiens
ggcaaggcctgcagctcagtgt

SEQ ID NO: 7664742 - DNA, 22 bp, Homo sapiens
ggcaaggcctgcagctcagtgt

SEQ ID NO: 7664743 - DNA, 22 bp, Homo sapiens
ggcaaggcctgcagctcagtgt

SEQ ID NO: 7664744 - DNA, 22 bp, Homo sapiens
ggagttgattttggatatatta

SEQ ID NO: 7664745 - DNA, 22 bp, Homo sapiens
ggcaaggcctgcagctcagtgt

SEQ ID NO: 7664746 - DNA, 22 bp, Homo sapiens
ggcaaggccaggcctccaagac

SEQ ID NO: 7664747 - DNA, 22 bp, Homo sapiens
ggcaaggccaggcctccaagac

SEQ ID NO: 7664748 - DNA, 22 bp, Homo sapiens
ggagtggtgtcactgagaggaa

SEQ ID NO: 7664749 - DNA, 22 bp, Homo sapiens
ggagtggtgtcactgagaggaa

SEQ ID NO: 7664750 - DNA, 22 bp, Homo sapiens
ggagtggtgtcactgagaggaa

SEQ ID NO: 7664751 - DNA, 22 bp, Homo sapiens
ggagtggtgtcactgagaggaa

SEQ ID NO: 7664752 - DNA, 22 bp, Homo sapiens
ggagtgtcccgattttccaggt

SEQ ID NO: 7664753 - DNA, 23 bp, Homo sapiens
ggagtgtgaagacctgatatagc

SEQ ID NO: 7664754 - DNA, 22 bp, Homo sapiens
ggagtgtggagaggacatgggt

SEQ ID NO: 7664755 - DNA, 22 bp, Homo sapiens
ggagtgtggagaggacatgggt

SEQ ID NO: 7664756 - DNA, 22 bp, Homo sapiens
ggagtgtggagaggacatgggt

SEQ ID NO: 7664757 - DNA, 22 bp, Homo sapiens
ggagtgtgggatggagctcagg

SEQ ID NO: 7664758 - DNA, 22 bp, Homo sapiens
ggagtgtgggatggagctcagg

SEQ ID NO: 7664759 - DNA, 22 bp, Homo sapiens
ggagtgtgggatggagctcagg

SEQ ID NO: 7664760 - DNA, 22 bp, Homo sapiens
ggagttcactgtgcaggctctg

SEQ ID NO: 7664761 - DNA, 22 bp, Homo sapiens
ggagttcacgatgttggccagg

SEQ ID NO: 7664762 - DNA, 22 bp, Homo sapiens
ggagttcactgtgcaggctctg

SEQ ID NO: 7664763 - DNA, 22 bp, Homo sapiens
ggagttatttgcaggaggggca

SEQ ID NO: 7664764 - DNA, 22 bp, Homo sapiens
ggagttcaaatcttttggatct

SEQ ID NO: 7664765 - DNA, 22 bp, Homo sapiens
ggagttcaccaaggttatgcag

SEQ ID NO: 7664766 - DNA, 22 bp, Homo sapiens
ggcacacagatggagcactagc

SEQ ID NO: 7664767 - DNA, 22 bp, Homo sapiens
ggcacacagcttggcaggagat

SEQ ID NO: 7664768 - DNA, 22 bp, Homo sapiens
ggcacacagcttggcaggagat

SEQ ID NO: 7664769 - DNA, 22 bp, Homo sapiens
ggcacacagcggaatttgctct

SEQ ID NO: 7664770 - DNA, 22 bp, Homo sapiens
ggcacacagcttggcaggagat

SEQ ID NO: 7664771 - DNA, 22 bp, Homo sapiens
ggcaagggacggccgtgagaca

SEQ ID NO: 7664772 - DNA, 22 bp, Homo sapiens
ggcacacagatggagcactagc

SEQ ID NO: 7664773 - DNA, 22 bp, Homo sapiens
ggcacacagatggagcactagc

SEQ ID NO: 7664774 - DNA, 22 bp, Homo sapiens
ggcaagggacggccgtgagaca

SEQ ID NO: 7664775 - DNA, 22 bp, Homo sapiens
ggcacacaaaggcagcatttga

SEQ ID NO: 7664776 - DNA, 22 bp, Homo sapiens
ggcaagggacggccgtgagaca

SEQ ID NO: 7664777 - DNA, 22 bp, Homo sapiens
ggcaagggacggccgtgagaca

SEQ ID NO: 7664778 - DNA, 22 bp, Homo sapiens
ggcaagggacggccgtgagaca

SEQ ID NO: 7664779 - DNA, 22 bp, Homo sapiens
ggcaagggacggccgtgagaca

SEQ ID NO: 7664780 - DNA, 22 bp, Homo sapiens
ggcaaggccttgcccagcattc

SEQ ID NO: 7664781 - DNA, 22 bp, Homo sapiens
ggcaagggacggccgtgagaca

SEQ ID NO: 7664782 - DNA, 22 bp, Homo sapiens
ggcaagggacggccgtgagaca

SEQ ID NO: 7664783 - DNA, 22 bp, Homo sapiens
ggcaaggccttgcccagcattc

SEQ ID NO: 7664784 - DNA, 22 bp, Homo sapiens
ggcaaggcctgcagctcagtgt

SEQ ID NO: 7664785 - DNA, 22 bp, Homo sapiens
ggcaaggccttgcccagcattc

SEQ ID NO: 7664786 - DNA, 22 bp, Homo sapiens
ggcacactcacttctgccctga

SEQ ID NO: 7664787 - DNA, 22 bp, Homo sapiens
ggcacagagaggccctggaagg

SEQ ID NO: 7664788 - DNA, 22 bp, Homo sapiens
ggcacagacttttgcttgcgtt

SEQ ID NO: 7664789 - DNA, 22 bp, Homo sapiens
ggcacagagcaggccactaatc

SEQ ID NO: 7664790 - DNA, 22 bp, Homo sapiens
ggcacagagaggccctggaagg

SEQ ID NO: 7664791 - DNA, 22 bp, Homo sapiens
ggcacagagcccagcttcctag

SEQ ID NO: 7664792 - DNA, 22 bp, Homo sapiens
ggcacagagcaggccactaatc

SEQ ID NO: 7664793 - DNA, 22 bp, Homo sapiens
ggcacacagcttggcaggagat

SEQ ID NO: 7664794 - DNA, 22 bp, Homo sapiens
ggcacacagcttggcaggagat

SEQ ID NO: 7664795 - DNA, 22 bp, Homo sapiens
ggcacacatagatctgcactgg

SEQ ID NO: 7664796 - DNA, 22 bp, Homo sapiens
ggcacacatagatctgcactgg

SEQ ID NO: 7664797 - DNA, 22 bp, Homo sapiens
ggcacacatagatctgcactgg

SEQ ID NO: 7664798 - DNA, 22 bp, Homo sapiens
ggcacacatagatctgcactgg

SEQ ID NO: 7664799 - DNA, 22 bp, Homo sapiens
ggcacacatggtggttggtgaa

SEQ ID NO: 7664800 - DNA, 22 bp, Homo sapiens
ggcacacatggtggttggtgaa

SEQ ID NO: 7664801 - DNA, 22 bp, Homo sapiens
ggcaggctcagcagccaaggag

SEQ ID NO: 7664802 - DNA, 22 bp, Homo sapiens
ggcaggctcagcagccaaggag

SEQ ID NO: 7664803 - DNA, 22 bp, Homo sapiens
ggcaggctcagcagccaaggag

SEQ ID NO: 7664804 - DNA, 22 bp, Homo sapiens
ggcaggctccaagcatcctatg

SEQ ID NO: 7664805 - DNA, 22 bp, Homo sapiens
ggcaggctccaagcatcctatg

SEQ ID NO: 7664806 - DNA, 22 bp, Homo sapiens
ggcaggctccaagcatcctatg

SEQ ID NO: 7664807 - DNA, 22 bp, Homo sapiens
ggcaggctcagcagccaaggag

SEQ ID NO: 7664808 - DNA, 22 bp, Homo sapiens
ggcaggctccaagcatcctatg

SEQ ID NO: 7664809 - DNA, 22 bp, Homo sapiens
ggcaggctccaagcatcctatg

SEQ ID NO: 7664810 - DNA, 22 bp, Homo sapiens
ggcaggctccagagccctctcc

SEQ ID NO: 7664811 - DNA, 22 bp, Homo sapiens
ggcaggctccagagccctctcc

SEQ ID NO: 7664812 - DNA, 22 bp, Homo sapiens
ggcaggctccgtgttccattcc

SEQ ID NO: 7664813 - DNA, 22 bp, Homo sapiens
ggcaggctccgtgttccattcc

SEQ ID NO: 7664814 - DNA, 22 bp, Homo sapiens
ggcaggctccagagccctctcc

SEQ ID NO: 7664815 - DNA, 22 bp, Homo sapiens
ggcaggctccagagccctctcc

SEQ ID NO: 7664816 - DNA, 22 bp, Homo sapiens
ggcaggctccagagccctctcc

SEQ ID NO: 7664817 - DNA, 22 bp, Homo sapiens
ggcaggctcttggccttatgag

SEQ ID NO: 7664818 - DNA, 22 bp, Homo sapiens
ggcaggctcttggccttatgag

SEQ ID NO: 7664819 - DNA, 22 bp, Homo sapiens
ggcaggctcttggccttatgag

SEQ ID NO: 7664820 - DNA, 18 bp, Homo sapiens
ggcaggctctctgggtca

SEQ ID NO: 7664821 - DNA, 18 bp, Homo sapiens
ggcaggctctctgggtca

SEQ ID NO: 7664822 - DNA, 18 bp, Homo sapiens
ggcaggctctctgggtca

SEQ ID NO: 7664823 - DNA, 18 bp, Homo sapiens
ggcaggctctctgggtca

SEQ ID NO: 7664824 - DNA, 22 bp, Homo sapiens
ggcaggctccagagccctctcc

SEQ ID NO: 7664825 - DNA, 18 bp, Homo sapiens
ggcaggctctctgggtca

SEQ ID NO: 7664826 - DNA, 18 bp, Homo sapiens
ggcaggctctctgggtca

SEQ ID NO: 7664827 - DNA, 18 bp, Homo sapiens
ggcaggctctctgggtca

SEQ ID NO: 7664828 - DNA, 22 bp, Homo sapiens
ggcaggctgcttgggtcatgtc

SEQ ID NO: 7664829 - DNA, 22 bp, Homo sapiens
ggcaggctgcttgggtcatgtc

SEQ ID NO: 7664830 - DNA, 22 bp, Homo sapiens
ggcaggctgcttgggtcatgtc

SEQ ID NO: 7664831 - DNA, 22 bp, Homo sapiens
ggcaggctgcttgggtcatgtc

SEQ ID NO: 7664832 - DNA, 22 bp, Homo sapiens
ggcaggctgcttgggtcatgtc

SEQ ID NO: 7664833 - DNA, 22 bp, Homo sapiens
ggcaggctgcttgggtcatgtc

SEQ ID NO: 7664834 - DNA, 22 bp, Homo sapiens
ggcaggctcttggccttatgag

SEQ ID NO: 7664835 - DNA, 22 bp, Homo sapiens
ggcaggctgcttgggtcatgtc

SEQ ID NO: 7664836 - DNA, 22 bp, Homo sapiens
ggcaggctgcttgggtcatgtc

SEQ ID NO: 7664837 - DNA, 22 bp, Homo sapiens
ggcaggctgcttgggtcatgtc

SEQ ID NO: 7664838 - DNA, 22 bp, Homo sapiens
ggcaggctgcttgggtcatgtc

SEQ ID NO: 7664839 - DNA, 22 bp, Homo sapiens
ggcaggcgtggtggcctcagaa

SEQ ID NO: 7664840 - DNA, 22 bp, Homo sapiens
ggcaggctagcactgatgtcct

SEQ ID NO: 7664841 - DNA, 22 bp, Homo sapiens
ggcaggctagcactgatgtcct

SEQ ID NO: 7664842 - DNA, 22 bp, Homo sapiens
ggcaggctagcactgatgtcct

SEQ ID NO: 7664843 - DNA, 22 bp, Homo sapiens
ggcaggctagcactgatgtcct

SEQ ID NO: 7664844 - DNA, 22 bp, Homo sapiens
ggcaggctcagcagccaaggag

SEQ ID NO: 7664845 - DNA, 22 bp, Homo sapiens
ggcaggctcagcagccaaggag

SEQ ID NO: 7664846 - DNA, 22 bp, Homo sapiens
ggcaggctcagcagccaaggag

SEQ ID NO: 7664847 - DNA, 22 bp, Homo sapiens
ggcaggctagcactgatgtcct

SEQ ID NO: 7664848 - DNA, 22 bp, Homo sapiens
ggcaggctagcactgatgtcct

SEQ ID NO: 7664849 - DNA, 22 bp, Homo sapiens
ggcaggcctgagaggcagggct

SEQ ID NO: 7664850 - DNA, 22 bp, Homo sapiens
ggcaggcgtggtggcctcagaa

SEQ ID NO: 7664851 - DNA, 22 bp, Homo sapiens
ggcaggcgtggtggcctcagaa

SEQ ID NO: 7664852 - DNA, 22 bp, Homo sapiens
ggcaggcgtggtggcctcagaa

SEQ ID NO: 7664853 - DNA, 22 bp, Homo sapiens
ggcaggcgtggtggcctcagaa

SEQ ID NO: 7664854 - DNA, 22 bp, Homo sapiens
ggcaggcgtggtggcctcagaa

SEQ ID NO: 7664855 - DNA, 22 bp, Homo sapiens
ggcaggcagcctccatccacag

SEQ ID NO: 7664856 - DNA, 22 bp, Homo sapiens
ggcaggcagatggctgcaccaa

SEQ ID NO: 7664857 - DNA, 22 bp, Homo sapiens
ggcaggcagcctccatccacag

SEQ ID NO: 7664858 - DNA, 22 bp, Homo sapiens
ggcaggcaggagcgtgcttggg

SEQ ID NO: 7664859 - DNA, 22 bp, Homo sapiens
ggcaggcaggagcgtgcttggg

SEQ ID NO: 7664860 - DNA, 22 bp, Homo sapiens
ggcaggcatggggtctgccatt

SEQ ID NO: 7664861 - DNA, 22 bp, Homo sapiens
ggcaggcaggagcgtgcttggg

SEQ ID NO: 7664862 - DNA, 22 bp, Homo sapiens
ggcaggcattagagattcccag

SEQ ID NO: 7664863 - DNA, 22 bp, Homo sapiens
ggcaggcattagagattcccag

SEQ ID NO: 7664864 - DNA, 22 bp, Homo sapiens
ggcaggcattagagattcccag

SEQ ID NO: 7664865 - DNA, 22 bp, Homo sapiens
ggcaggcattgcaacatgtaca

SEQ ID NO: 7664866 - DNA, 22 bp, Homo sapiens
ggcaggcattgcaacatgtaca

SEQ ID NO: 7664867 - DNA, 22 bp, Homo sapiens
ggcaggcctgagaggcagggct

SEQ ID NO: 7664868 - DNA, 22 bp, Homo sapiens
ggcaggcctgagaggcagggct

SEQ ID NO: 7664869 - DNA, 22 bp, Homo sapiens
ggcaggcctgagaggcagggct

SEQ ID NO: 7664870 - DNA, 22 bp, Homo sapiens
ggcaggcctgagaggcagggct

SEQ ID NO: 7664871 - DNA, 22 bp, Homo sapiens
ggcaggcattgcaacatgtaca

SEQ ID NO: 7664872 - DNA, 22 bp, Homo sapiens
ggcaggcattgcaacatgtaca

SEQ ID NO: 7664873 - DNA, 22 bp, Homo sapiens
ggcaggcattgcaacatgtaca

SEQ ID NO: 7664874 - DNA, 22 bp, Homo sapiens
ggcaggctgcttgggtcatgtc

SEQ ID NO: 7664875 - DNA, 22 bp, Homo sapiens
ggcaggctgcttgggtcatgtc

SEQ ID NO: 7664876 - DNA, 22 bp, Homo sapiens
ggcaggctgcttgggtcatgtc

SEQ ID NO: 7664877 - DNA, 19 bp, Homo sapiens
ggcaggctggatagagagg

SEQ ID NO: 7664878 - DNA, 22 bp, Homo sapiens
ggcaggctggctttgttccagg

SEQ ID NO: 7664879 - DNA, 19 bp, Homo sapiens
ggcaggctggatagagagg

SEQ ID NO: 7664880 - DNA, 19 bp, Homo sapiens
ggcaggctggatagagagg

SEQ ID NO: 7664881 - DNA, 19 bp, Homo sapiens
ggcaggctggatagagagg

SEQ ID NO: 7664882 - DNA, 22 bp, Homo sapiens
ggcaggctgggagtcatcagag

SEQ ID NO: 7664883 - DNA, 22 bp, Homo sapiens
ggcaggctgggagtcatcagag

SEQ ID NO: 7664884 - DNA, 22 bp, Homo sapiens
ggcaggctgggagtcatcagag

SEQ ID NO: 7664885 - DNA, 22 bp, Homo sapiens
ggcaggctgggagtcatcagag

SEQ ID NO: 7664886 - DNA, 22 bp, Homo sapiens
ggcaggctggctttgttccagg

SEQ ID NO: 7664887 - DNA, 22 bp, Homo sapiens
ggcaggctgggagtcatcagag

SEQ ID NO: 7664888 - DNA, 22 bp, Homo sapiens
ggcaggctgggagtcatcagag

SEQ ID NO: 7664889 - DNA, 22 bp, Homo sapiens
ggcaggctgggagtcatcagag

SEQ ID NO: 7664890 - DNA, 22 bp, Homo sapiens
ggcaggtgagttcattatctgc

SEQ ID NO: 7664891 - DNA, 22 bp, Homo sapiens
ggcaggtgaggcatgtgcctgg

SEQ ID NO: 7664892 - DNA, 22 bp, Homo sapiens
ggcaggtgaggcatgtgcctgg

SEQ ID NO: 7664893 - DNA, 22 bp, Homo sapiens
ggcaggtgaggcatgtgcctgg

SEQ ID NO: 7664894 - DNA, 22 bp, Homo sapiens
ggcaggctgggtgtcatggagt

SEQ ID NO: 7664895 - DNA, 22 bp, Homo sapiens
ggcaggctgggtgtcatggagt

SEQ ID NO: 7664896 - DNA, 22 bp, Homo sapiens
ggcaggtgaggcatgtgcctgg

SEQ ID NO: 7664897 - DNA, 22 bp, Homo sapiens
ggcaggctgggagtcatcagag

SEQ ID NO: 7664898 - DNA, 22 bp, Homo sapiens
ggcaggctgggagtcatcagag

SEQ ID NO: 7664899 - DNA, 22 bp, Homo sapiens
ggcaggctgggtgtcatggagt

SEQ ID NO: 7664900 - DNA, 22 bp, Homo sapiens
ggcaggctgggtgtcatggagt

SEQ ID NO: 7664901 - DNA, 22 bp, Homo sapiens
ggcaggctggctttgttccagg

SEQ ID NO: 7664902 - DNA, 22 bp, Homo sapiens
ggcaggctgggtgtcatggagt

SEQ ID NO: 7664903 - DNA, 22 bp, Homo sapiens
ggcaggtgctaagagaggtaaa

SEQ ID NO: 7664904 - DNA, 22 bp, Homo sapiens
ggcaggtgctaagagaggtaaa

SEQ ID NO: 7664905 - DNA, 22 bp, Homo sapiens
ggcaggtgctaagagaggtaaa

SEQ ID NO: 7664906 - DNA, 22 bp, Homo sapiens
ggcaggtgctaagagaggtaaa

SEQ ID NO: 7664907 - DNA, 22 bp, Homo sapiens
ggcaggtgctaagagaggtaaa

SEQ ID NO: 7664908 - DNA, 22 bp, Homo sapiens
ggcaggtgctaagagaggtaaa

SEQ ID NO: 7664909 - DNA, 22 bp, Homo sapiens
ggcaggtgctaagagaggtaaa

SEQ ID NO: 7664910 - DNA, 20 bp, Homo sapiens
ggcaggtgctcgcttggtct

SEQ ID NO: 7664911 - DNA, 20 bp, Homo sapiens
ggcaggtgctcgcttggtct

SEQ ID NO: 7664912 - DNA, 22 bp, Homo sapiens
ggcaggtgctctgtgggcctgg

SEQ ID NO: 7664913 - DNA, 20 bp, Homo sapiens
ggcaggtgctcgcttggtct

SEQ ID NO: 7664914 - DNA, 20 bp, Homo sapiens
ggcaggtgctcgcttggtct

SEQ ID NO: 7664915 - DNA, 20 bp, Homo sapiens
ggcaggtgctcgcttggtct

SEQ ID NO: 7664916 - DNA, 17 bp, Homo sapiens
ggcaggtgcggggccgc

SEQ ID NO: 7664917 - DNA, 17 bp, Homo sapiens
ggcaggtgcggggccgc

SEQ ID NO: 7664918 - DNA, 17 bp, Homo sapiens
ggcaggtgcggggccgc

SEQ ID NO: 7664919 - DNA, 17 bp, Homo sapiens
ggcaggtgcggggccgc

SEQ ID NO: 7664920 - DNA, 17 bp, Homo sapiens
ggcaggtgcggggccgc

SEQ ID NO: 7664921 - DNA, 22 bp, Homo sapiens
ggcaggtgcgcatgttgcatta

SEQ ID NO: 7664922 - DNA, 22 bp, Homo sapiens
ggcaggtgcgcatgttgcatta

SEQ ID NO: 7664923 - DNA, 22 bp, Homo sapiens
ggcaggtgcgcatgttgcatta

SEQ ID NO: 7664924 - DNA, 22 bp, Homo sapiens
ggcaggtgcgcatgttgcatta

SEQ ID NO: 7664925 - DNA, 22 bp, Homo sapiens
ggcaggtgcgcatgttgcatta

SEQ ID NO: 7664926 - DNA, 17 bp, Homo sapiens
ggcaggtgcggggccgc

SEQ ID NO: 7664927 - DNA, 17 bp, Homo sapiens
ggcaggtgcggggccgc

SEQ ID NO: 7664928 - DNA, 17 bp, Homo sapiens
ggcaggtgcggggccgc

SEQ ID NO: 7664929 - DNA, 22 bp, Homo sapiens
ggcaggtgctaagagaggtaaa

SEQ ID NO: 7664930 - DNA, 17 bp, Homo sapiens
ggcaggtgcggggccgc

SEQ ID NO: 7664931 - DNA, 22 bp, Homo sapiens
ggcaggtgctaagagaggtaaa

SEQ ID NO: 7664932 - DNA, 22 bp, Homo sapiens
ggcaggtgctaagagaggtaaa

SEQ ID NO: 7664933 - DNA, 19 bp, Homo sapiens
ggcagctggacgctgttca

SEQ ID NO: 7664934 - DNA, 19 bp, Homo sapiens
ggcagctggacgctgttca

SEQ ID NO: 7664935 - DNA, 19 bp, Homo sapiens
ggcagctggacgctgttca

SEQ ID NO: 7664936 - DNA, 19 bp, Homo sapiens
ggcagctggacgctgttca

SEQ ID NO: 7664937 - DNA, 22 bp, Homo sapiens
ggcagctggcctcctcgcccac

SEQ ID NO: 7664938 - DNA, 22 bp, Homo sapiens
ggcagctggcctcctcgcccac

SEQ ID NO: 7664939 - DNA, 22 bp, Homo sapiens
ggcagctgctgcattacgttgt

SEQ ID NO: 7664940 - DNA, 22 bp, Homo sapiens
ggcagctgctgcattacgttgt

SEQ ID NO: 7664941 - DNA, 19 bp, Homo sapiens
ggcagctggacgctgttca

SEQ ID NO: 7664942 - DNA, 22 bp, Homo sapiens
ggcagctgctgcattacgttgt

SEQ ID NO: 7664943 - DNA, 22 bp, Homo sapiens
ggcagctggcctcctcgcccac

SEQ ID NO: 7664944 - DNA, 22 bp, Homo sapiens
ggcagctggcctcctcgcccac

SEQ ID NO: 7664945 - DNA, 22 bp, Homo sapiens
ggcagctggcctcctcgcccac

SEQ ID NO: 7664946 - DNA, 22 bp, Homo sapiens
ggcagctggcctcctcgcccac

SEQ ID NO: 7664947 - DNA, 23 bp, Homo sapiens
ggcagctgggcagcactcatggg

SEQ ID NO: 7664948 - DNA, 23 bp, Homo sapiens
ggcagctgggcagcactcatggg

SEQ ID NO: 7664949 - DNA, 23 bp, Homo sapiens
ggcagctgggcagcactcatggg

SEQ ID NO: 7664950 - DNA, 23 bp, Homo sapiens
ggcagctgggcagcactcatggg

SEQ ID NO: 7664951 - DNA, 23 bp, Homo sapiens
ggcagctgggcagcactcatggg

SEQ ID NO: 7664952 - DNA, 22 bp, Homo sapiens
ggcagctgcacgttgtcccgtc

SEQ ID NO: 7664953 - DNA, 22 bp, Homo sapiens
ggcagctgcaaatctgctctgt

SEQ ID NO: 7664954 - DNA, 22 bp, Homo sapiens
ggcagctgcacgttgtcccgtc

SEQ ID NO: 7664955 - DNA, 22 bp, Homo sapiens
ggcagctctgtgtctgggaagc

SEQ ID NO: 7664956 - DNA, 17 bp, Homo sapiens
ggcagctgccacttttt

SEQ ID NO: 7664957 - DNA, 22 bp, Homo sapiens
ggcagctgcacgttgtcccgtc

SEQ ID NO: 7664958 - DNA, 17 bp, Homo sapiens
ggcagctgccacttttt

SEQ ID NO: 7664959 - DNA, 22 bp, Homo sapiens
ggcagctgcacgttgtcccgtc

SEQ ID NO: 7664960 - DNA, 22 bp, Homo sapiens
ggcagctctgctaattgagcct

SEQ ID NO: 7664961 - DNA, 22 bp, Homo sapiens
ggcagctctgctaattgagcct

SEQ ID NO: 7664962 - DNA, 22 bp, Homo sapiens
ggcagctctgctaattgagcct

SEQ ID NO: 7664963 - DNA, 22 bp, Homo sapiens
ggcagctctgctaattgagcct

SEQ ID NO: 7664964 - DNA, 22 bp, Homo sapiens
ggcagctctgctccttggctcc

SEQ ID NO: 7664965 - DNA, 22 bp, Homo sapiens
ggcagctctgctccacatgagt

SEQ ID NO: 7664966 - DNA, 22 bp, Homo sapiens
ggcagctctgctccacatgagt

SEQ ID NO: 7664967 - DNA, 22 bp, Homo sapiens
ggcagctctgctccacatgagt

SEQ ID NO: 7664968 - DNA, 22 bp, Homo sapiens
ggcagctctgctccttggctcc

SEQ ID NO: 7664969 - DNA, 22 bp, Homo sapiens
ggcagaggaagctggaagtggg

SEQ ID NO: 7664970 - DNA, 22 bp, Homo sapiens
ggcagaggaagctggaagtggg

SEQ ID NO: 7664971 - DNA, 22 bp, Homo sapiens
ggcagaggaagctggaagtggg

SEQ ID NO: 7664972 - DNA, 22 bp, Homo sapiens
ggcagaggaagctggaagtggg

SEQ ID NO: 7664973 - DNA, 22 bp, Homo sapiens
ggcagaggaagctggaagtggg

SEQ ID NO: 7664974 - DNA, 22 bp, Homo sapiens
ggcagaggaagctggaagtggg

SEQ ID NO: 7664975 - DNA, 20 bp, Homo sapiens
ggcagctctagtcgaggccc

SEQ ID NO: 7664976 - DNA, 20 bp, Homo sapiens
ggcagctctagtcgaggccc

SEQ ID NO: 7664977 - DNA, 22 bp, Homo sapiens
ggcagaggaagctggaagtggg

SEQ ID NO: 7664978 - DNA, 22 bp, Homo sapiens
ggcagaggaagctggaagtggg

SEQ ID NO: 7664979 - DNA, 22 bp, Homo sapiens
ggcagctcgtcaggctgcggcg

SEQ ID NO: 7664980 - DNA, 22 bp, Homo sapiens
ggcagctcgtcaggctgcggcg

SEQ ID NO: 7664981 - DNA, 22 bp, Homo sapiens
ggcagctctgatgatgctctgg

SEQ ID NO: 7664982 - DNA, 22 bp, Homo sapiens
ggcagctctgatgatgctctgg

SEQ ID NO: 7664983 - DNA, 23 bp, Homo sapiens
ggcagctctcatctgatgactga

SEQ ID NO: 7664984 - DNA, 22 bp, Homo sapiens
ggcagaggaagctggaagtggg

SEQ ID NO: 7664985 - DNA, 22 bp, Homo sapiens
ggcagaggaagctggaagtggg

SEQ ID NO: 7664986 - DNA, 22 bp, Homo sapiens
ggcagaggaagctggaagtggg

SEQ ID NO: 7664987 - DNA, 22 bp, Homo sapiens
ggcagaggaagctggaagtggg

SEQ ID NO: 7664988 - DNA, 22 bp, Homo sapiens
ggcagaggaagctggaagtggg

SEQ ID NO: 7664989 - DNA, 22 bp, Homo sapiens
ggcagaggaagctggaagtggg

SEQ ID NO: 7664990 - DNA, 22 bp, Homo sapiens
ggcagaggaagctggaagtggg

SEQ ID NO: 7664991 - DNA, 22 bp, Homo sapiens
ggcagaggaagctggaagtggg

SEQ ID NO: 7664992 - DNA, 22 bp, Homo sapiens
ggcagaggaagctggaagtggg

SEQ ID NO: 7664993 - DNA, 22 bp, Homo sapiens
ggcagaggaagctggaagtggg

SEQ ID NO: 7664994 - DNA, 22 bp, Homo sapiens
ggcagaggaagctggaagtggg

SEQ ID NO: 7664995 - DNA, 22 bp, Homo sapiens
ggcagaggaagctggaagtggg

SEQ ID NO: 7664996 - DNA, 22 bp, Homo sapiens
ggcagaggaagctggaagtggg

SEQ ID NO: 7664997 - DNA, 22 bp, Homo sapiens
ggcagaggaagctggaagtggg

SEQ ID NO: 7664998 - DNA, 22 bp, Homo sapiens
ggcagaggaagctggaagtggg

SEQ ID NO: 7664999 - DNA, 22 bp, Homo sapiens
ggcagaggaagctggaagtggg

SEQ ID NO: 7665000 - DNA, 22 bp, Homo sapiens
ggcagaggaagctggaagtggg

SEQ ID NO: 7665001 - DNA, 22 bp, Homo sapiens
ggcagaggaagctggaagtggg

SEQ ID NO: 7665002 - DNA, 22 bp, Homo sapiens
ggcaggcagatggctgcaccaa

SEQ ID NO: 7665003 - DNA, 22 bp, Homo sapiens
ggcagctgtgaagtgcctcaca

SEQ ID NO: 7665004 - DNA, 22 bp, Homo sapiens
ggcaggcagatggctgcaccaa

SEQ ID NO: 7665005 - DNA, 22 bp, Homo sapiens
ggcagctgtgaagtgcctcaca

SEQ ID NO: 7665006 - DNA, 22 bp, Homo sapiens
ggcagctgtgaagtgcctcaca

SEQ ID NO: 7665007 - DNA, 22 bp, Homo sapiens
ggcagctgtgaagtgcctcaca

SEQ ID NO: 7665008 - DNA, 22 bp, Homo sapiens
ggcagctgtgaagtgcctcaca

SEQ ID NO: 7665009 - DNA, 22 bp, Homo sapiens
ggcagctgtctctgagttagca

SEQ ID NO: 7665010 - DNA, 22 bp, Homo sapiens
ggcagctgtctctgagttagca

SEQ ID NO: 7665011 - DNA, 22 bp, Homo sapiens
ggcagctgtctctgagttagca

SEQ ID NO: 7665012 - DNA, 22 bp, Homo sapiens
ggcagctgtctctgagttagca

SEQ ID NO: 7665013 - DNA, 22 bp, Homo sapiens
ggcagctgtctctgagttagca

SEQ ID NO: 7665014 - DNA, 22 bp, Homo sapiens
ggcagctgtctctgagttagca

SEQ ID NO: 7665015 - DNA, 22 bp, Homo sapiens
ggcagctgtgaagtgcctcaca

SEQ ID NO: 7665016 - DNA, 22 bp, Homo sapiens
ggcagctgtgaagtgcctcaca

SEQ ID NO: 7665017 - DNA, 22 bp, Homo sapiens
ggcagctgtgaagtgcctcaca

SEQ ID NO: 7665018 - DNA, 22 bp, Homo sapiens
ggcagctgtgaagtgcctcaca

SEQ ID NO: 7665019 - DNA, 22 bp, Homo sapiens
ggcagctgtgaagtgcctcaca

SEQ ID NO: 7665020 - DNA, 22 bp, Homo sapiens
ggcagctgtgaagtgcctcaca

SEQ ID NO: 7665021 - DNA, 22 bp, Homo sapiens
ggcagctgtctcattcacacct

SEQ ID NO: 7665022 - DNA, 22 bp, Homo sapiens
ggcagctgtctcattcacacct

SEQ ID NO: 7665023 - DNA, 22 bp, Homo sapiens
ggcagctgtctcattcacacct

SEQ ID NO: 7665024 - DNA, 22 bp, Homo sapiens
ggcagctgtctcattcacacct

SEQ ID NO: 7665025 - DNA, 22 bp, Homo sapiens
ggcagctgtaagatgagtgaat

SEQ ID NO: 7665026 - DNA, 22 bp, Homo sapiens
ggcagctgtaagatgagtgaat

SEQ ID NO: 7665027 - DNA, 22 bp, Homo sapiens
ggcagctgtaagatgagtgaat

SEQ ID NO: 7665028 - DNA, 22 bp, Homo sapiens
ggcagctgtctcattcacacct

SEQ ID NO: 7665029 - DNA, 22 bp, Homo sapiens
ggcagctgtctcattcacacct

SEQ ID NO: 7665030 - DNA, 22 bp, Homo sapiens
ggcagctggttctttccattaa

SEQ ID NO: 7665031 - DNA, 22 bp, Homo sapiens
ggcagctggttctttccattaa

SEQ ID NO: 7665032 - DNA, 22 bp, Homo sapiens
ggcagctggttctttccattaa

SEQ ID NO: 7665033 - DNA, 22 bp, Homo sapiens
ggcagctggttctttccattaa

SEQ ID NO: 7665034 - DNA, 22 bp, Homo sapiens
ggcagctgggttggccagaaac

SEQ ID NO: 7665035 - DNA, 22 bp, Homo sapiens
ggcagctgtaagatgagtgaat

SEQ ID NO: 7665036 - DNA, 22 bp, Homo sapiens
ggcagctgtaagatgagtgaat

SEQ ID NO: 7665037 - DNA, 22 bp, Homo sapiens
ggcagctgtaagatgagtgaat

SEQ ID NO: 7665038 - DNA, 22 bp, Homo sapiens
ggcagctgtaagatgagtgaat

SEQ ID NO: 7665039 - DNA, 22 bp, Homo sapiens
ggcagctgtaagatgagtgaat

SEQ ID NO: 7665040 - DNA, 22 bp, Homo sapiens
ggcagctgtaagatgagtgaat

SEQ ID NO: 7665041 - DNA, 22 bp, Homo sapiens
ggcagctgggttggccagaaac

SEQ ID NO: 7665042 - DNA, 22 bp, Homo sapiens
ggcagctgggttggccagaaac

SEQ ID NO: 7665043 - DNA, 22 bp, Homo sapiens
ggcagctgggttggccagaaac

SEQ ID NO: 7665044 - DNA, 22 bp, Homo sapiens
ggcagctgggttggccagaaac

SEQ ID NO: 7665045 - DNA, 22 bp, Homo sapiens
ggcagctgggttggccagaaac

SEQ ID NO: 7665046 - DNA, 22 bp, Homo sapiens
ggcagctggttctttccattaa

SEQ ID NO: 7665047 - DNA, 22 bp, Homo sapiens
ggcagctgggttggccagaaac

SEQ ID NO: 7665048 - DNA, 22 bp, Homo sapiens
ggcagctgggtgcctaataatg

SEQ ID NO: 7665049 - DNA, 22 bp, Homo sapiens
ggcagctgggtgcctaataatg

SEQ ID NO: 7665050 - DNA, 22 bp, Homo sapiens
ggcagctgggtcacaccgatct

SEQ ID NO: 7665051 - DNA, 22 bp, Homo sapiens
ggcagctgggtcacaccgatct

SEQ ID NO: 7665052 - DNA, 22 bp, Homo sapiens
ggcagctgggttggccagaaac

SEQ ID NO: 7665053 - DNA, 22 bp, Homo sapiens
ggcagctgggtgcctaataatg

SEQ ID NO: 7665054 - DNA, 23 bp, Homo sapiens
ggcagctgggcagcactcatggg

SEQ ID NO: 7665055 - DNA, 23 bp, Homo sapiens
ggcagctgggcagcactcatggg

SEQ ID NO: 7665056 - DNA, 23 bp, Homo sapiens
ggcagctgggcagcactcatggg

SEQ ID NO: 7665057 - DNA, 23 bp, Homo sapiens
ggcagctgggcagcactcatggg

SEQ ID NO: 7665058 - DNA, 23 bp, Homo sapiens
ggcagctgggcagcactcatggg

SEQ ID NO: 7665059 - DNA, 23 bp, Homo sapiens
ggcagctgggcagcactcatggg

SEQ ID NO: 7665060 - DNA, 22 bp, Homo sapiens
ggcagctggggcagtgccctgt

SEQ ID NO: 7665061 - DNA, 23 bp, Homo sapiens
ggcagctgggcagcactcatggg

SEQ ID NO: 7665062 - DNA, 22 bp, Homo sapiens
ggcagctggggcagtgccctgt

SEQ ID NO: 7665063 - DNA, 22 bp, Homo sapiens
ggcagctggggcagtgccctgt

SEQ ID NO: 7665064 - DNA, 22 bp, Homo sapiens
ggcagctggggcagtgccctgt

SEQ ID NO: 7665065 - DNA, 22 bp, Homo sapiens
ggcagctggggcagtgccctgt

SEQ ID NO: 7665066 - DNA, 22 bp, Homo sapiens
ggcagctggggcagtgccctgt

SEQ ID NO: 7665067 - DNA, 22 bp, Homo sapiens
ggcagctggggcagtgccctgt

SEQ ID NO: 7665068 - DNA, 22 bp, Homo sapiens
ggcagctggggcagtgccctgt

SEQ ID NO: 7665069 - DNA, 22 bp, Homo sapiens
ggcagctggggcagtgccctgt

SEQ ID NO: 7665070 - DNA, 22 bp, Homo sapiens
ggcagctgggtcacaccgatct

SEQ ID NO: 7665071 - DNA, 22 bp, Homo sapiens
ggcagctgggtcacaccgatct

SEQ ID NO: 7665072 - DNA, 22 bp, Homo sapiens
ggcagctgggtcacaccgatct

SEQ ID NO: 7665073 - DNA, 22 bp, Homo sapiens
ggcagctggggcagtgccctgt

SEQ ID NO: 7665074 - DNA, 22 bp, Homo sapiens
ggaggaaatccttagtaaggca

SEQ ID NO: 7665075 - DNA, 22 bp, Homo sapiens
ggaggaaatccttagtaaggca

SEQ ID NO: 7665076 - DNA, 22 bp, Homo sapiens
ggaggaaatgaaaggagggttt

SEQ ID NO: 7665077 - DNA, 22 bp, Homo sapiens
ggaggaaatgaaaggagggttt

SEQ ID NO: 7665078 - DNA, 22 bp, Homo sapiens
ggaggaaatgaaaggagggttt

SEQ ID NO: 7665079 - DNA, 22 bp, Homo sapiens
ggaggaaatgaaaggagggttt

SEQ ID NO: 7665080 - DNA, 22 bp, Homo sapiens
ggaggaaatgaaaggagggttt

SEQ ID NO: 7665081 - DNA, 22 bp, Homo sapiens
ggaggaagaggttgttctctca

SEQ ID NO: 7665082 - DNA, 22 bp, Homo sapiens
ggaggaaatgaaaggagggttt

SEQ ID NO: 7665083 - DNA, 22 bp, Homo sapiens
ggaggaagaggttgttctctca

SEQ ID NO: 7665084 - DNA, 22 bp, Homo sapiens
ggaggaagaggttgttctctca

SEQ ID NO: 7665085 - DNA, 22 bp, Homo sapiens
ggaggaagcacacggcttgtat

SEQ ID NO: 7665086 - DNA, 22 bp, Homo sapiens
ggaggaagcacacggcttgtat

SEQ ID NO: 7665087 - DNA, 22 bp, Homo sapiens
ggaggaagcacacggcttgtat

SEQ ID NO: 7665088 - DNA, 22 bp, Homo sapiens
ggaggaagcacacggcttgtat

SEQ ID NO: 7665089 - DNA, 22 bp, Homo sapiens
ggaggaagcacacggcttgtat

SEQ ID NO: 7665090 - DNA, 22 bp, Homo sapiens
ggaggaagcacacggcttgtat

SEQ ID NO: 7665091 - DNA, 22 bp, Homo sapiens
ggaggaagaggttgttctctca

SEQ ID NO: 7665092 - DNA, 22 bp, Homo sapiens
ggaggaagaggttgttctctca

SEQ ID NO: 7665093 - DNA, 22 bp, Homo sapiens
ggaggaagcacacggcttgtat

SEQ ID NO: 7665094 - DNA, 22 bp, Homo sapiens
ggaggaagcacacggcttgtat

SEQ ID NO: 7665095 - DNA, 22 bp, Homo sapiens
ggaggaagcacacggcttgtat

SEQ ID NO: 7665096 - DNA, 22 bp, Homo sapiens
ggaggaagggtagcataatgta

SEQ ID NO: 7665097 - DNA, 22 bp, Homo sapiens
ggaggaagggtagcataatgta

SEQ ID NO: 7665098 - DNA, 22 bp, Homo sapiens
ggaggaagggtagcataatgta

SEQ ID NO: 7665099 - DNA, 22 bp, Homo sapiens
ggaggaagggtagcataatgta

SEQ ID NO: 7665100 - DNA, 22 bp, Homo sapiens
ggaggaagggtagcataatgta

SEQ ID NO: 7665101 - DNA, 22 bp, Homo sapiens
ggaggaagtgcagttctactac

SEQ ID NO: 7665102 - DNA, 22 bp, Homo sapiens
ggaggaagggtagcataatgta

SEQ ID NO: 7665103 - DNA, 22 bp, Homo sapiens
ggaggaagggcccaggctttat

SEQ ID NO: 7665104 - DNA, 22 bp, Homo sapiens
ggaggaagggcccaggctttat

SEQ ID NO: 7665105 - DNA, 22 bp, Homo sapiens
ggaggaagggcccaggctttat

SEQ ID NO: 7665106 - DNA, 22 bp, Homo sapiens
ggaggaagggcccaggctttat

SEQ ID NO: 7665107 - DNA, 22 bp, Homo sapiens
ggaggaagggcccaggctttat

SEQ ID NO: 7665108 - DNA, 22 bp, Homo sapiens
ggaggaagggcccaggctttat

SEQ ID NO: 7665109 - DNA, 22 bp, Homo sapiens
ggaggaagggcccaggctttat

SEQ ID NO: 7665110 - DNA, 22 bp, Homo sapiens
ggaggaagggcccaggctttat

SEQ ID NO: 7665111 - DNA, 22 bp, Homo sapiens
ggaggaagggcccaggctttat

SEQ ID NO: 7665112 - DNA, 22 bp, Homo sapiens
ggaggaagccctcggtgcccca

SEQ ID NO: 7665113 - DNA, 22 bp, Homo sapiens
ggaggaagccctcggtgcccca

SEQ ID NO: 7665114 - DNA, 22 bp, Homo sapiens
ggaggaagccctcggtgcccca

SEQ ID NO: 7665115 - DNA, 22 bp, Homo sapiens
ggaggaagcacacggcttgtat

SEQ ID NO: 7665116 - DNA, 22 bp, Homo sapiens
ggaggaagcacacggcttgtat

SEQ ID NO: 7665117 - DNA, 22 bp, Homo sapiens
ggaggaagccctcggtgcccca

SEQ ID NO: 7665118 - DNA, 22 bp, Homo sapiens
ggaggaagccctcggtgcccca

SEQ ID NO: 7665119 - DNA, 22 bp, Homo sapiens
ggaggaagccctcggtgcccca

SEQ ID NO: 7665120 - DNA, 16 bp, Homo sapiens
ggaggaaggcatagtg

SEQ ID NO: 7665121 - DNA, 16 bp, Homo sapiens
ggaggaaggcatagtg

SEQ ID NO: 7665122 - DNA, 22 bp, Homo sapiens
ggaggaagccctcggtgcccca

SEQ ID NO: 7665123 - DNA, 16 bp, Homo sapiens
ggaggaaggcatagtg

SEQ ID NO: 7665124 - DNA, 22 bp, Homo sapiens
ggaggaagggcccaggctttat

SEQ ID NO: 7665125 - DNA, 16 bp, Homo sapiens
ggaggaaggcatagtg

SEQ ID NO: 7665126 - DNA, 22 bp, Homo sapiens
ggaggaagccctcggtgcccca

SEQ ID NO: 7665127 - DNA, 22 bp, Homo sapiens
ggaggaagccctcggtgcccca

SEQ ID NO: 7665128 - DNA, 22 bp, Homo sapiens
ggaggaagccctcggtgcccca

SEQ ID NO: 7665129 - DNA, 22 bp, Homo sapiens
ggaggacaggggctgcagcaca

SEQ ID NO: 7665130 - DNA, 22 bp, Homo sapiens
ggaggacaggggctgcagcaca

SEQ ID NO: 7665131 - DNA, 22 bp, Homo sapiens
ggaggacaggggctgcagcaca

SEQ ID NO: 7665132 - DNA, 22 bp, Homo sapiens
ggaggacaggggctgcagcaca

SEQ ID NO: 7665133 - DNA, 22 bp, Homo sapiens
ggaggacaggggctgcagcaca

SEQ ID NO: 7665134 - DNA, 22 bp, Homo sapiens
ggaggacaggggctgcagcaca

SEQ ID NO: 7665135 - DNA, 22 bp, Homo sapiens
ggaggacactggctctgccttc

SEQ ID NO: 7665136 - DNA, 22 bp, Homo sapiens
ggaggacactggctctgccttc

SEQ ID NO: 7665137 - DNA, 22 bp, Homo sapiens
ggaggacactggctctgccttc

SEQ ID NO: 7665138 - DNA, 22 bp, Homo sapiens
ggaggacactggctctgccttc

SEQ ID NO: 7665139 - DNA, 22 bp, Homo sapiens
ggaggacactggctctgccttc

SEQ ID NO: 7665140 - DNA, 22 bp, Homo sapiens
ggaggaagtgcagttctactac

SEQ ID NO: 7665141 - DNA, 22 bp, Homo sapiens
ggaggaagggtagcataatgta

SEQ ID NO: 7665142 - DNA, 22 bp, Homo sapiens
ggaggaagtgcagttctactac

SEQ ID NO: 7665143 - DNA, 22 bp, Homo sapiens
ggaggaagtgcagttctactac

SEQ ID NO: 7665144 - DNA, 22 bp, Homo sapiens
ggaggaagtgcagttctactac

SEQ ID NO: 7665145 - DNA, 22 bp, Homo sapiens
ggaggaagtgcagttctactac

SEQ ID NO: 7665146 - DNA, 22 bp, Homo sapiens
ggaggagctgctgtgggggccc

SEQ ID NO: 7665147 - DNA, 22 bp, Homo sapiens
ggaggagctgctgtgggggccc

SEQ ID NO: 7665148 - DNA, 22 bp, Homo sapiens
ggaggagctgctgtgggggccc

SEQ ID NO: 7665149 - DNA, 22 bp, Homo sapiens
ggaggagcccactcaaagggga

SEQ ID NO: 7665150 - DNA, 22 bp, Homo sapiens
ggaggagcccactcaaagggga

SEQ ID NO: 7665151 - DNA, 22 bp, Homo sapiens
ggaggagcccactcaaagggga

SEQ ID NO: 7665152 - DNA, 22 bp, Homo sapiens
ggaggagcccactcaaagggga

SEQ ID NO: 7665153 - DNA, 22 bp, Homo sapiens
ggaggagcccactcaaagggga

SEQ ID NO: 7665154 - DNA, 22 bp, Homo sapiens
ggaggagcatgagagggtagtg

SEQ ID NO: 7665155 - DNA, 22 bp, Homo sapiens
ggaggactcaggtctggccatg

SEQ ID NO: 7665156 - DNA, 22 bp, Homo sapiens
ggaggagcatgagagggtagtg

SEQ ID NO: 7665157 - DNA, 22 bp, Homo sapiens
ggaggagcatgagagggtagtg

SEQ ID NO: 7665158 - DNA, 22 bp, Homo sapiens
ggaggagcatgagagggtagtg

SEQ ID NO: 7665159 - DNA, 22 bp, Homo sapiens
ggaggagcatgagagggtagtg

SEQ ID NO: 7665160 - DNA, 22 bp, Homo sapiens
ggaggagcatgagagggtagtg

SEQ ID NO: 7665161 - DNA, 22 bp, Homo sapiens
ggaggagcatgagagggtagtg

SEQ ID NO: 7665162 - DNA, 22 bp, Homo sapiens
ggagctgcaagtgttgagagct

SEQ ID NO: 7665163 - DNA, 22 bp, Homo sapiens
ggagctgcaagtgttgagagct

SEQ ID NO: 7665164 - DNA, 22 bp, Homo sapiens
ggagctgcaagtgttgagagct

SEQ ID NO: 7665165 - DNA, 22 bp, Homo sapiens
ggagctgcacgctctgaagcct

SEQ ID NO: 7665166 - DNA, 22 bp, Homo sapiens
ggaggaaatccttagtaaggca

SEQ ID NO: 7665167 - DNA, 22 bp, Homo sapiens
ggaggaaatccttagtaaggca

SEQ ID NO: 7665168 - DNA, 22 bp, Homo sapiens
ggaggaaatccttagtaaggca

SEQ ID NO: 7665169 - DNA, 22 bp, Homo sapiens
ggaggaaaggctccctccctct

SEQ ID NO: 7665170 - DNA, 22 bp, Homo sapiens
ggagctgcacgctctgaagcct

SEQ ID NO: 7665171 - DNA, 22 bp, Homo sapiens
ggagctgcacgctctgaagcct

SEQ ID NO: 7665172 - DNA, 21 bp, Homo sapiens
ggaggaaaaaggaatgacttg

SEQ ID NO: 7665173 - DNA, 22 bp, Homo sapiens
ggaggaaaggctccctccctct

SEQ ID NO: 7665174 - DNA, 22 bp, Homo sapiens
ggaggaaaggctccctccctct

SEQ ID NO: 7665175 - DNA, 22 bp, Homo sapiens
ggaggaaaggctccctccctct

SEQ ID NO: 7665176 - DNA, 22 bp, Homo sapiens
ggagctgaggacactacatttt

SEQ ID NO: 7665177 - DNA, 22 bp, Homo sapiens
ggagctgaggctgaggcctcac

SEQ ID NO: 7665178 - DNA, 22 bp, Homo sapiens
ggagctgagagtagtccctttt

SEQ ID NO: 7665179 - DNA, 22 bp, Homo sapiens
ggagctgagagtagtccctttt

SEQ ID NO: 7665180 - DNA, 22 bp, Homo sapiens
ggagctgagcagcgatggcgga

SEQ ID NO: 7665181 - DNA, 22 bp, Homo sapiens
ggagctgaggaatagctttgat

SEQ ID NO: 7665182 - DNA, 22 bp, Homo sapiens
ggagctgaggaatagctttgat

SEQ ID NO: 7665183 - DNA, 22 bp, Homo sapiens
ggagctgaggaatagctttgat

SEQ ID NO: 7665184 - DNA, 22 bp, Homo sapiens
ggagctgagttcttcagccggg

SEQ ID NO: 7665185 - DNA, 22 bp, Homo sapiens
ggagctgagtgggtttattgat

SEQ ID NO: 7665186 - DNA, 22 bp, Homo sapiens
ggagctgaggtaacagtgagtg

SEQ ID NO: 7665187 - DNA, 22 bp, Homo sapiens
ggagctgaggtaacagtgagtg

SEQ ID NO: 7665188 - DNA, 22 bp, Homo sapiens
ggagctgaggtaacagtgagtg

SEQ ID NO: 7665189 - DNA, 22 bp, Homo sapiens
ggagctgagacccagtggctga

SEQ ID NO: 7665190 - DNA, 22 bp, Homo sapiens
ggagctgagacccagtggctga

SEQ ID NO: 7665191 - DNA, 22 bp, Homo sapiens
ggagctgagacccagtggctga

SEQ ID NO: 7665192 - DNA, 22 bp, Homo sapiens
ggagctgagacccagtggctga

SEQ ID NO: 7665193 - DNA, 22 bp, Homo sapiens
ggagctgaaccccatcgtgctg

SEQ ID NO: 7665194 - DNA, 22 bp, Homo sapiens
ggagctgaaggggtgggctcag

SEQ ID NO: 7665195 - DNA, 22 bp, Homo sapiens
ggagctgaaggggtgggctcag

SEQ ID NO: 7665196 - DNA, 22 bp, Homo sapiens
ggagctcttccagcttgttgct

SEQ ID NO: 7665197 - DNA, 22 bp, Homo sapiens
ggagctctgtgtctctcctgcc

SEQ ID NO: 7665198 - DNA, 22 bp, Homo sapiens
ggagctctgaggatgcattggt

SEQ ID NO: 7665199 - DNA, 22 bp, Homo sapiens
ggagctcaggcccagcaaggcc

SEQ ID NO: 7665200 - DNA, 22 bp, Homo sapiens
ggagctcaggcccagcaaggcc

SEQ ID NO: 7665201 - DNA, 22 bp, Homo sapiens
ggagctcaggcccagcaaggcc

SEQ ID NO: 7665202 - DNA, 22 bp, Homo sapiens
ggagctcagtggggggactgtg

SEQ ID NO: 7665203 - DNA, 22 bp, Homo sapiens
ggagctcagtggggggactgtg

SEQ ID NO: 7665204 - DNA, 22 bp, Homo sapiens
ggagctcaccttggagtctctg

SEQ ID NO: 7665205 - DNA, 22 bp, Homo sapiens
ggagctcaccttggagtctctg

SEQ ID NO: 7665206 - DNA, 22 bp, Homo sapiens
ggagctcagaagtgagtgagtt

SEQ ID NO: 7665207 - DNA, 22 bp, Homo sapiens
ggagctcagaagtgagtgagtt

SEQ ID NO: 7665208 - DNA, 22 bp, Homo sapiens
ggagctcagaagtgagtgagtt

SEQ ID NO: 7665209 - DNA, 22 bp, Homo sapiens
ggagctcaggcccagcaaggcc

SEQ ID NO: 7665210 - DNA, 22 bp, Homo sapiens
ggagctcctggcagtgacagag

SEQ ID NO: 7665211 - DNA, 22 bp, Homo sapiens
ggagctcctggcagtgacagag

SEQ ID NO: 7665212 - DNA, 22 bp, Homo sapiens
ggagctcctggcagtgacagag

SEQ ID NO: 7665213 - DNA, 22 bp, Homo sapiens
ggagctctcctgatgtgaagat

SEQ ID NO: 7665214 - DNA, 16 bp, Homo sapiens
ggagctcctcgacttt

SEQ ID NO: 7665215 - DNA, 22 bp, Homo sapiens
ggagctcctggcagtgacagag

SEQ ID NO: 7665216 - DNA, 17 bp, Homo sapiens
ggagctccagctactgc

SEQ ID NO: 7665217 - DNA, 22 bp, Homo sapiens
ggagctcataacaaggtagcca

SEQ ID NO: 7665218 - DNA, 22 bp, Homo sapiens
ggagctcataacaaggtagcca

SEQ ID NO: 7665219 - DNA, 22 bp, Homo sapiens
ggaggaggcggcagaagttcct

SEQ ID NO: 7665220 - DNA, 22 bp, Homo sapiens
ggaggaggcggcagaagttcct

SEQ ID NO: 7665221 - DNA, 22 bp, Homo sapiens
ggaggaggcggcagaagttcct

SEQ ID NO: 7665222 - DNA, 22 bp, Homo sapiens
ggaggaggcaagtaccagatgc

SEQ ID NO: 7665223 - DNA, 22 bp, Homo sapiens
ggaggaggcaagtaccagatgc

SEQ ID NO: 7665224 - DNA, 22 bp, Homo sapiens
ggaggaggcaagtaccagatgc

SEQ ID NO: 7665225 - DNA, 22 bp, Homo sapiens
ggaggaggcaagtaccagatgc

SEQ ID NO: 7665226 - DNA, 22 bp, Homo sapiens
ggaggaggcaagtaccagatgc

SEQ ID NO: 7665227 - DNA, 22 bp, Homo sapiens
ggaggaggcaagtaccagatgc

SEQ ID NO: 7665228 - DNA, 22 bp, Homo sapiens
ggaggaggcaagtaccagatgc

SEQ ID NO: 7665229 - DNA, 22 bp, Homo sapiens
ggaggaggcaagtaccagatgc

SEQ ID NO: 7665230 - DNA, 22 bp, Homo sapiens
ggaggaggcaagtaccagatgc

SEQ ID NO: 7665231 - DNA, 22 bp, Homo sapiens
ggaggaggcaagtaccagatgc

SEQ ID NO: 7665232 - DNA, 22 bp, Homo sapiens
ggaggagctgctgtgggggccc

SEQ ID NO: 7665233 - DNA, 22 bp, Homo sapiens
ggaggagctgctgtgggggccc

SEQ ID NO: 7665234 - DNA, 22 bp, Homo sapiens
ggaggaggcaagtaccagatgc

SEQ ID NO: 7665235 - DNA, 22 bp, Homo sapiens
ggaggagctgctgtgggggccc

SEQ ID NO: 7665236 - DNA, 22 bp, Homo sapiens
ggaggagctgctgtgggggccc

SEQ ID NO: 7665237 - DNA, 22 bp, Homo sapiens
ggaggcagaatagagtgtgggt

SEQ ID NO: 7665238 - DNA, 22 bp, Homo sapiens
ggaggcagaatagagtgtgggt

SEQ ID NO: 7665239 - DNA, 22 bp, Homo sapiens
ggaggcagaatagagtgtgggt

SEQ ID NO: 7665240 - DNA, 22 bp, Homo sapiens
ggaggcagaatagagtgtgggt

SEQ ID NO: 7665241 - DNA, 22 bp, Homo sapiens
ggaggcagaatagagtgtgggt

SEQ ID NO: 7665242 - DNA, 22 bp, Homo sapiens
ggaggcagaatagagtgtgggt

SEQ ID NO: 7665243 - DNA, 22 bp, Homo sapiens
ggaggcagaatagagtgtgggt

SEQ ID NO: 7665244 - DNA, 22 bp, Homo sapiens
ggaggcagaatagagtgtgggt

SEQ ID NO: 7665245 - DNA, 22 bp, Homo sapiens
ggaggaggcggcagaagttcct

SEQ ID NO: 7665246 - DNA, 22 bp, Homo sapiens
ggaggcagaatagagtgtgggt

SEQ ID NO: 7665247 - DNA, 22 bp, Homo sapiens
ggaggcagaatagagtgtgggt

SEQ ID NO: 7665248 - DNA, 22 bp, Homo sapiens
ggaggcagaatagagtgtgggt

SEQ ID NO: 7665249 - DNA, 22 bp, Homo sapiens
ggaggcagaatagagtgtgggt

SEQ ID NO: 7665250 - DNA, 22 bp, Homo sapiens
ggaggccaaggcgggcggatca

SEQ ID NO: 7665251 - DNA, 22 bp, Homo sapiens
ggaggcagaatagagtgtgggt

SEQ ID NO: 7665252 - DNA, 22 bp, Homo sapiens
ggaggcagaatagagtgtgggt

SEQ ID NO: 7665253 - DNA, 22 bp, Homo sapiens
ggaggcagaatagagtgtgggt

SEQ ID NO: 7665254 - DNA, 22 bp, Homo sapiens
ggaggcagaatagagtgtgggt

SEQ ID NO: 7665255 - DNA, 22 bp, Homo sapiens
ggaggcagaatagagtgtgggt

SEQ ID NO: 7665256 - DNA, 22 bp, Homo sapiens
ggaggccaaggtgggcggatca

SEQ ID NO: 7665257 - DNA, 22 bp, Homo sapiens
ggaggccaaggcgggcggatca

SEQ ID NO: 7665258 - DNA, 22 bp, Homo sapiens
ggaggccaaggtgggcggatca

SEQ ID NO: 7665259 - DNA, 22 bp, Homo sapiens
ggaggccaaggtgggcggatca

SEQ ID NO: 7665260 - DNA, 22 bp, Homo sapiens
ggaggccaaggtgggcggatca

SEQ ID NO: 7665261 - DNA, 22 bp, Homo sapiens
ggaggccaagtcactgacctgg

SEQ ID NO: 7665262 - DNA, 22 bp, Homo sapiens
ggaggccaagtcactgacctgg

SEQ ID NO: 7665263 - DNA, 22 bp, Homo sapiens
ggaggccaagtcactgacctgg

SEQ ID NO: 7665264 - DNA, 22 bp, Homo sapiens
ggaggccaattttctaactgca

SEQ ID NO: 7665265 - DNA, 22 bp, Homo sapiens
ggaggccaagtcactgacctgg

SEQ ID NO: 7665266 - DNA, 22 bp, Homo sapiens
ggaggccaccatggagtcactt

SEQ ID NO: 7665267 - DNA, 22 bp, Homo sapiens
ggaggccaccatggagtcactt

SEQ ID NO: 7665268 - DNA, 22 bp, Homo sapiens
ggaggccaccatggagtcactt

SEQ ID NO: 7665269 - DNA, 22 bp, Homo sapiens
ggaggccaccatggagtcactt

SEQ ID NO: 7665270 - DNA, 22 bp, Homo sapiens
ggaggccacctgacctgctgtt

SEQ ID NO: 7665271 - DNA, 22 bp, Homo sapiens
ggaggccaattttctaactgca

SEQ ID NO: 7665272 - DNA, 22 bp, Homo sapiens
ggaggccaattttctaactgca

SEQ ID NO: 7665273 - DNA, 22 bp, Homo sapiens
ggaggccaattttctaactgca

SEQ ID NO: 7665274 - DNA, 22 bp, Homo sapiens
ggaggccaattttctaactgca

SEQ ID NO: 7665275 - DNA, 22 bp, Homo sapiens
ggaggccagaatctgtgttgga

SEQ ID NO: 7665276 - DNA, 22 bp, Homo sapiens
ggaggccagaatctgtgttgga

SEQ ID NO: 7665277 - DNA, 22 bp, Homo sapiens
ggaggccagaatctgtgttgga

SEQ ID NO: 7665278 - DNA, 22 bp, Homo sapiens
ggaggccacggtttagcaccga

SEQ ID NO: 7665279 - DNA, 22 bp, Homo sapiens
ggaggccacggtttagcaccga

SEQ ID NO: 7665280 - DNA, 22 bp, Homo sapiens
ggaggccagcctgaggctgagg

SEQ ID NO: 7665281 - DNA, 22 bp, Homo sapiens
ggaggccagcctgaggctgagg

SEQ ID NO: 7665282 - DNA, 22 bp, Homo sapiens
ggaggccagcctgaggctgagg

SEQ ID NO: 7665283 - DNA, 22 bp, Homo sapiens
ggaggccagcctgaggctgagg

SEQ ID NO: 7665284 - DNA, 22 bp, Homo sapiens
ggaggccacctgacctgctgtt

SEQ ID NO: 7665285 - DNA, 22 bp, Homo sapiens
ggaggccacctgacctgctgtt

SEQ ID NO: 7665286 - DNA, 22 bp, Homo sapiens
ggaggccacggtttagcaccga

SEQ ID NO: 7665287 - DNA, 22 bp, Homo sapiens
ggaggccacggtttagcaccga

SEQ ID NO: 7665288 - DNA, 22 bp, Homo sapiens
ggaggccacggtttagcaccga

SEQ ID NO: 7665289 - DNA, 22 bp, Homo sapiens
ggaggccacctgacctgctgtt

SEQ ID NO: 7665290 - DNA, 22 bp, Homo sapiens
ggaggccacctgacctgctgtt

SEQ ID NO: 7665291 - DNA, 22 bp, Homo sapiens
ggaggccatagtttgggagtca

SEQ ID NO: 7665292 - DNA, 22 bp, Homo sapiens
ggaggccatagtttgggagtca

SEQ ID NO: 7665293 - DNA, 22 bp, Homo sapiens
ggaggccatagtttgggagtca

SEQ ID NO: 7665294 - DNA, 22 bp, Homo sapiens
ggaggccatagtttgggagtca

SEQ ID NO: 7665295 - DNA, 22 bp, Homo sapiens
ggaggccagtcctggccgggct

SEQ ID NO: 7665296 - DNA, 22 bp, Homo sapiens
ggaggccagtcctggccgggct

SEQ ID NO: 7665297 - DNA, 22 bp, Homo sapiens
ggaggccagtcctggccgggct

SEQ ID NO: 7665298 - DNA, 22 bp, Homo sapiens
ggaggccagtcctggccgggct

SEQ ID NO: 7665299 - DNA, 22 bp, Homo sapiens
ggaggccatcagggagggcatt

SEQ ID NO: 7665300 - DNA, 22 bp, Homo sapiens
ggaggccatcagggagggcatt

SEQ ID NO: 7665301 - DNA, 22 bp, Homo sapiens
ggaggccatcagggagggcatt

SEQ ID NO: 7665302 - DNA, 22 bp, Homo sapiens
ggaggccatcagggagggcatt

SEQ ID NO: 7665303 - DNA, 22 bp, Homo sapiens
ggaggccatcagggagggcatt

SEQ ID NO: 7665304 - DNA, 22 bp, Homo sapiens
ggaggccatcagggagggcatt

SEQ ID NO: 7665305 - DNA, 22 bp, Homo sapiens
ggaggccatcagggagggcatt

SEQ ID NO: 7665306 - DNA, 22 bp, Homo sapiens
ggaggccatcagggagggcatt

SEQ ID NO: 7665307 - DNA, 22 bp, Homo sapiens
ggaggccatctggctggaggct

SEQ ID NO: 7665308 - DNA, 22 bp, Homo sapiens
ggaggccatctggctggaggct

SEQ ID NO: 7665309 - DNA, 22 bp, Homo sapiens
ggaggccatctggctggaggct

SEQ ID NO: 7665310 - DNA, 22 bp, Homo sapiens
ggaggccatcagggagggcatt

SEQ ID NO: 7665311 - DNA, 22 bp, Homo sapiens
ggaggccatcagggagggcatt

SEQ ID NO: 7665312 - DNA, 22 bp, Homo sapiens
ggaggccatcagggagggcatt

SEQ ID NO: 7665313 - DNA, 22 bp, Homo sapiens
ggaggccatctggctggaggct

SEQ ID NO: 7665314 - DNA, 22 bp, Homo sapiens
ggaggccatcagggagggcatt

SEQ ID NO: 7665315 - DNA, 22 bp, Homo sapiens
ggaggccatcagggagggcatt

SEQ ID NO: 7665316 - DNA, 22 bp, Homo sapiens
ggaggccatgaggctctaggtg

SEQ ID NO: 7665317 - DNA, 22 bp, Homo sapiens
ggaggccatgaggctctaggtg

SEQ ID NO: 7665318 - DNA, 22 bp, Homo sapiens
ggaggccatgaggctctaggtg

SEQ ID NO: 7665319 - DNA, 22 bp, Homo sapiens
ggaggccatgaggctctaggtg

SEQ ID NO: 7665320 - DNA, 22 bp, Homo sapiens
ggaggccatctggctggaggct

SEQ ID NO: 7665321 - DNA, 22 bp, Homo sapiens
ggaggccatctggctggaggct

SEQ ID NO: 7665322 - DNA, 22 bp, Homo sapiens
ggaggccatgaggctctaggtg

SEQ ID NO: 7665323 - DNA, 22 bp, Homo sapiens
ggaggccatctggctggaggct

SEQ ID NO: 7665324 - DNA, 22 bp, Homo sapiens
ggaggccatctggctggaggct

SEQ ID NO: 7665325 - DNA, 22 bp, Homo sapiens
ggaggccagggtgggtggatcg

SEQ ID NO: 7665326 - DNA, 22 bp, Homo sapiens
ggaggccagggacccagtcagc

SEQ ID NO: 7665327 - DNA, 22 bp, Homo sapiens
ggaggccagggacccagtcagc

SEQ ID NO: 7665328 - DNA, 22 bp, Homo sapiens
ggaggccagggacccagtcagc

SEQ ID NO: 7665329 - DNA, 22 bp, Homo sapiens
ggaggccagggacccagtcagc

SEQ ID NO: 7665330 - DNA, 15 bp, Homo sapiens
ggaggccaggctgtg

SEQ ID NO: 7665331 - DNA, 22 bp, Homo sapiens
ggaggccaggatgggaactcaa

SEQ ID NO: 7665332 - DNA, 15 bp, Homo sapiens
ggaggccaggctgtg

SEQ ID NO: 7665333 - DNA, 22 bp, Homo sapiens
ggaggccagggacccagtcagc

SEQ ID NO: 7665334 - DNA, 22 bp, Homo sapiens
ggaggccagggacccagtcagc

SEQ ID NO: 7665335 - DNA, 22 bp, Homo sapiens
ggaggccagggacccagtcagc

SEQ ID NO: 7665336 - DNA, 22 bp, Homo sapiens
ggaggccagggacccagtcagc

SEQ ID NO: 7665337 - DNA, 22 bp, Homo sapiens
ggaggccaggtgggagtcatct

SEQ ID NO: 7665338 - DNA, 22 bp, Homo sapiens
ggaggccaggtgggagtcatct

SEQ ID NO: 7665339 - DNA, 22 bp, Homo sapiens
ggaggccagtcctggccgggct

SEQ ID NO: 7665340 - DNA, 22 bp, Homo sapiens
ggaggccaggtgggagtcatct

SEQ ID NO: 7665341 - DNA, 22 bp, Homo sapiens
ggaggccaggtgggagtcatct

SEQ ID NO: 7665342 - DNA, 22 bp, Homo sapiens
ggaggccaggtgggagtcatct

SEQ ID NO: 7665343 - DNA, 22 bp, Homo sapiens
ggaggccaggtgggagtcatct

SEQ ID NO: 7665344 - DNA, 22 bp, Homo sapiens
ggaggccagggtgggtggatcg

SEQ ID NO: 7665345 - DNA, 22 bp, Homo sapiens
ggaggccagggtgggtggatcg

SEQ ID NO: 7665346 - DNA, 22 bp, Homo sapiens
ggaggccaggaagagccgccct

SEQ ID NO: 7665347 - DNA, 22 bp, Homo sapiens
ggaggccaggaagagccgccct

SEQ ID NO: 7665348 - DNA, 22 bp, Homo sapiens
ggaggccaggaaggctcggaga

SEQ ID NO: 7665349 - DNA, 22 bp, Homo sapiens
ggaggccaggaaggctcggaga

SEQ ID NO: 7665350 - DNA, 22 bp, Homo sapiens
ggaggccaggaaggctcggaga

SEQ ID NO: 7665351 - DNA, 22 bp, Homo sapiens
ggaggccaggatgggaactcaa

SEQ ID NO: 7665352 - DNA, 22 bp, Homo sapiens
ggaggccaggatgggaactcaa

SEQ ID NO: 7665353 - DNA, 22 bp, Homo sapiens
ggaggccaggaaggctcggaga

SEQ ID NO: 7665354 - DNA, 22 bp, Homo sapiens
ggaggccaggaaggctcggaga

SEQ ID NO: 7665355 - DNA, 22 bp, Homo sapiens
ggaggccaggaaggctcggaga

SEQ ID NO: 7665356 - DNA, 22 bp, Homo sapiens
ggaggccagcctgaggctgagg

SEQ ID NO: 7665357 - DNA, 22 bp, Homo sapiens
ggaggccagcctgaggctgagg

SEQ ID NO: 7665358 - DNA, 22 bp, Homo sapiens
ggaggccagcctgaggctgagg

SEQ ID NO: 7665359 - DNA, 22 bp, Homo sapiens
ggaggccagcctgaggctgagg

SEQ ID NO: 7665360 - DNA, 22 bp, Homo sapiens
ggaggccagcctgaggctgagg

SEQ ID NO: 7665361 - DNA, 22 bp, Homo sapiens
ggaggccagcctgaggctgagg

SEQ ID NO: 7665362 - DNA, 22 bp, Homo sapiens
ggaggccagcctgaggctgagg

SEQ ID NO: 7665363 - DNA, 22 bp, Homo sapiens
ggaggccaggaagagccgccct

SEQ ID NO: 7665364 - DNA, 22 bp, Homo sapiens
ggaggccagcctgaggctgagg

SEQ ID NO: 7665365 - DNA, 22 bp, Homo sapiens
ggaggccaggaagagccgccct

SEQ ID NO: 7665366 - DNA, 22 bp, Homo sapiens
ggaggccaggaagagccgccct

SEQ ID NO: 7665367 - DNA, 22 bp, Homo sapiens
ggagaaggaagaaagctactat

SEQ ID NO: 7665368 - DNA, 22 bp, Homo sapiens
ggagaaggaagaaagctactat

SEQ ID NO: 7665369 - DNA, 22 bp, Homo sapiens
ggagaaggaagaaagctactat

SEQ ID NO: 7665370 - DNA, 22 bp, Homo sapiens
ggagaaggaagaaagctactat

SEQ ID NO: 7665371 - DNA, 22 bp, Homo sapiens
ggagaaggaagaaagctactat

SEQ ID NO: 7665372 - DNA, 22 bp, Homo sapiens
ggagaaggaagaaagctactat

SEQ ID NO: 7665373 - DNA, 22 bp, Homo sapiens
ggagaaggaagaaagctactat

SEQ ID NO: 7665374 - DNA, 22 bp, Homo sapiens
ggagaaggaatattggagtagg

SEQ ID NO: 7665375 - DNA, 22 bp, Homo sapiens
ggagaaggaatattggagtagg

SEQ ID NO: 7665376 - DNA, 22 bp, Homo sapiens
ggagaaggaagaaagctactat

SEQ ID NO: 7665377 - DNA, 22 bp, Homo sapiens
ggagaaggaatattggagtagg

SEQ ID NO: 7665378 - DNA, 22 bp, Homo sapiens
ggagaaggaatattggagtagg

SEQ ID NO: 7665379 - DNA, 22 bp, Homo sapiens
ggagaaggaatattggagtagg

SEQ ID NO: 7665380 - DNA, 22 bp, Homo sapiens
ggagaaggaatattggagtagg

SEQ ID NO: 7665381 - DNA, 22 bp, Homo sapiens
ggagaaggaatattggagtagg

SEQ ID NO: 7665382 - DNA, 22 bp, Homo sapiens
ggagaaggaatattggagtagg

SEQ ID NO: 7665383 - DNA, 22 bp, Homo sapiens
ggagaaggaatattggagtagg

SEQ ID NO: 7665384 - DNA, 22 bp, Homo sapiens
ggagaaggaatattggagtagg

SEQ ID NO: 7665385 - DNA, 22 bp, Homo sapiens
ggagaaggaatattggagtagg

SEQ ID NO: 7665386 - DNA, 22 bp, Homo sapiens
ggagaaggaatattggagtagg

SEQ ID NO: 7665387 - DNA, 22 bp, Homo sapiens
ggagaaggaatattggagtagg

SEQ ID NO: 7665388 - DNA, 21 bp, Homo sapiens
ggagaaggacaatgttgagta

SEQ ID NO: 7665389 - DNA, 21 bp, Homo sapiens
ggagaaggacaatgttgagta

SEQ ID NO: 7665390 - DNA, 21 bp, Homo sapiens
ggagaaggacaatgttgagta

SEQ ID NO: 7665391 - DNA, 21 bp, Homo sapiens
ggagaaggacaatgttgagta

SEQ ID NO: 7665392 - DNA, 21 bp, Homo sapiens
ggagaaggacaatgttgagta

SEQ ID NO: 7665393 - DNA, 22 bp, Homo sapiens
ggagaaggcacacccacctctg

SEQ ID NO: 7665394 - DNA, 22 bp, Homo sapiens
ggagaaggcacacccacctctg

SEQ ID NO: 7665395 - DNA, 22 bp, Homo sapiens
ggagaaggcacacccacctctg

SEQ ID NO: 7665396 - DNA, 22 bp, Homo sapiens
ggagaaggtggctcagcaaagg

SEQ ID NO: 7665397 - DNA, 22 bp, Homo sapiens
ggagaaggtggctcagcaaagg

SEQ ID NO: 7665398 - DNA, 21 bp, Homo sapiens
ggagaaggacaatgttgagta

SEQ ID NO: 7665399 - DNA, 21 bp, Homo sapiens
ggagaaggacaatgttgagta

SEQ ID NO: 7665400 - DNA, 21 bp, Homo sapiens
ggagaaggacaatgttgagta

SEQ ID NO: 7665401 - DNA, 21 bp, Homo sapiens
ggagaaggacaatgttgagta

SEQ ID NO: 7665402 - DNA, 21 bp, Homo sapiens
ggagaaggacaatgttgagta

SEQ ID NO: 7665403 - DNA, 21 bp, Homo sapiens
ggagaaggacaatgttgagta

SEQ ID NO: 7665404 - DNA, 17 bp, Homo sapiens
ggagacagggtctttaa

SEQ ID NO: 7665405 - DNA, 17 bp, Homo sapiens
ggagacagggtctttaa

SEQ ID NO: 7665406 - DNA, 17 bp, Homo sapiens
ggagacagggtctttaa

SEQ ID NO: 7665407 - DNA, 17 bp, Homo sapiens
ggagacagggtctttaa

SEQ ID NO: 7665408 - DNA, 22 bp, Homo sapiens
ggagacagggttgaaccacgca

SEQ ID NO: 7665409 - DNA, 17 bp, Homo sapiens
ggagacagggtctttaa

SEQ ID NO: 7665410 - DNA, 22 bp, Homo sapiens
ggagaggcttggcccagcctgg

SEQ ID NO: 7665411 - DNA, 22 bp, Homo sapiens
ggagacagggttgaaccacgca

SEQ ID NO: 7665412 - DNA, 22 bp, Homo sapiens
ggagaggcttggcccagcctgg

SEQ ID NO: 7665413 - DNA, 17 bp, Homo sapiens
ggagacagggtctttaa

SEQ ID NO: 7665414 - DNA, 17 bp, Homo sapiens
ggagacagggtctttaa

SEQ ID NO: 7665415 - DNA, 22 bp, Homo sapiens
ggagacagcaggaagaaatatc

SEQ ID NO: 7665416 - DNA, 22 bp, Homo sapiens
ggagacagcaggaagaaatatc

SEQ ID NO: 7665417 - DNA, 22 bp, Homo sapiens
ggagacagcaggaagaaatatc

SEQ ID NO: 7665418 - DNA, 22 bp, Homo sapiens
ggagacagcaggaagaaatatc

SEQ ID NO: 7665419 - DNA, 22 bp, Homo sapiens
ggagacagcaggaagaaatatc

SEQ ID NO: 7665420 - DNA, 22 bp, Homo sapiens
ggagacactggaaagtattaca

SEQ ID NO: 7665421 - DNA, 22 bp, Homo sapiens
ggagacactggaaagtattaca

SEQ ID NO: 7665422 - DNA, 22 bp, Homo sapiens
ggagacacgggtgctgaggacc

SEQ ID NO: 7665423 - DNA, 22 bp, Homo sapiens
ggagaatgatatatagctcagt

SEQ ID NO: 7665424 - DNA, 22 bp, Homo sapiens
ggagaatgatatatagctcagt

SEQ ID NO: 7665425 - DNA, 22 bp, Homo sapiens
ggagaatgatatatagctcagt

SEQ ID NO: 7665426 - DNA, 22 bp, Homo sapiens
ggagaaggtggctcagcaaagg

SEQ ID NO: 7665427 - DNA, 22 bp, Homo sapiens
ggagaaggtggctcagcaaagg

SEQ ID NO: 7665428 - DNA, 22 bp, Homo sapiens
ggagaaggtggctcagcaaagg

SEQ ID NO: 7665429 - DNA, 22 bp, Homo sapiens
ggagaaggtggctcagcaaagg

SEQ ID NO: 7665430 - DNA, 22 bp, Homo sapiens
ggagaaggtggctcagcaaagg

SEQ ID NO: 7665431 - DNA, 22 bp, Homo sapiens
ggagacaacaatcatgtgtgaa

SEQ ID NO: 7665432 - DNA, 22 bp, Homo sapiens
ggagacaacaatcatgtgtgaa

SEQ ID NO: 7665433 - DNA, 23 bp, Homo sapiens
ggagacaaggtaccacgttaaca

SEQ ID NO: 7665434 - DNA, 22 bp, Homo sapiens
ggagacaacaatcatgtgtgaa

SEQ ID NO: 7665435 - DNA, 22 bp, Homo sapiens
ggagaattctttattagctttt

SEQ ID NO: 7665436 - DNA, 22 bp, Homo sapiens
ggagaatgattctttgctcact

SEQ ID NO: 7665437 - DNA, 22 bp, Homo sapiens
ggagaatgattctttgctcact

SEQ ID NO: 7665438 - DNA, 22 bp, Homo sapiens
ggagacaatggaggccaaaaga

SEQ ID NO: 7665439 - DNA, 23 bp, Homo sapiens
ggagacaaggtaccacgttaaca

SEQ ID NO: 7665440 - DNA, 22 bp, Homo sapiens
ggagacaatggaggccaaaaga

SEQ ID NO: 7665441 - DNA, 22 bp, Homo sapiens
ggagacacccacattgctgggt

SEQ ID NO: 7665442 - DNA, 22 bp, Homo sapiens
ggagacacatatacagaaagag

SEQ ID NO: 7665443 - DNA, 22 bp, Homo sapiens
ggaagtttattgagttcaagta

SEQ ID NO: 7665444 - DNA, 22 bp, Homo sapiens
ggaagtttcaggaatctgcatt

SEQ ID NO: 7665445 - DNA, 22 bp, Homo sapiens
ggaagtttctggtgaggacgag

SEQ ID NO: 7665446 - DNA, 22 bp, Homo sapiens
ggaagtgtttgtgcagatggcc

SEQ ID NO: 7665447 - DNA, 22 bp, Homo sapiens
ggaagttcagttgctagtttca

SEQ ID NO: 7665448 - DNA, 22 bp, Homo sapiens
ggaagttcagttgctagtttca

SEQ ID NO: 7665449 - DNA, 22 bp, Homo sapiens
ggaagttgtatgatcggggaat

SEQ ID NO: 7665450 - DNA, 22 bp, Homo sapiens
ggaagtgtttgtgcagatggcc

SEQ ID NO: 7665451 - DNA, 22 bp, Homo sapiens
ggaagtgtttccttgggcagca

SEQ ID NO: 7665452 - DNA, 22 bp, Homo sapiens
ggaagtgtttccttgggcagca

SEQ ID NO: 7665453 - DNA, 22 bp, Homo sapiens
ggaagtgtttccttgggcagca

SEQ ID NO: 7665454 - DNA, 22 bp, Homo sapiens
ggaagtgtttccttgggcagca

SEQ ID NO: 7665455 - DNA, 22 bp, Homo sapiens
ggaagtgtgcaatattgggctg

SEQ ID NO: 7665456 - DNA, 22 bp, Homo sapiens
ggaagtgaggaaatattttgtt

SEQ ID NO: 7665457 - DNA, 22 bp, Homo sapiens
ggaagtggtagagccatgagtg

SEQ ID NO: 7665458 - DNA, 22 bp, Homo sapiens
ggaagtggtagagccatgagtg

SEQ ID NO: 7665459 - DNA, 22 bp, Homo sapiens
ggaagtggtagagccatgagtg

SEQ ID NO: 7665460 - DNA, 22 bp, Homo sapiens
ggaagtgtagtccgaagttgcg

SEQ ID NO: 7665461 - DNA, 22 bp, Homo sapiens
ggaagtggtagagccatgagtg

SEQ ID NO: 7665462 - DNA, 22 bp, Homo sapiens
ggaagtggtagagccatgagtg

SEQ ID NO: 7665463 - DNA, 22 bp, Homo sapiens
ggaaggtttttctcctggtggg

SEQ ID NO: 7665464 - DNA, 18 bp, Homo sapiens
ggaaggtgctggagtgca

SEQ ID NO: 7665465 - DNA, 18 bp, Homo sapiens
ggaaggtgctggagtgca

SEQ ID NO: 7665466 - DNA, 18 bp, Homo sapiens
ggaaggtgctggagtgca

SEQ ID NO: 7665467 - DNA, 18 bp, Homo sapiens
ggaaggtgctggagtgca

SEQ ID NO: 7665468 - DNA, 18 bp, Homo sapiens
ggaaggtgctggagtgca

SEQ ID NO: 7665469 - DNA, 18 bp, Homo sapiens
ggaaggtgctggagtgca

SEQ ID NO: 7665470 - DNA, 18 bp, Homo sapiens
ggaaggtgctggagtgca

SEQ ID NO: 7665471 - DNA, 18 bp, Homo sapiens
ggaagtaggaagaggaag

SEQ ID NO: 7665472 - DNA, 23 bp, Homo sapiens
ggaagtcagcggagaggtggctg

SEQ ID NO: 7665473 - DNA, 22 bp, Homo sapiens
ggaagtaatgtcttaagattct

SEQ ID NO: 7665474 - DNA, 22 bp, Homo sapiens
ggaagtagaagtaatgaaatca

SEQ ID NO: 7665475 - DNA, 22 bp, Homo sapiens
ggaagtagaagtaatgaaatca

SEQ ID NO: 7665476 - DNA, 22 bp, Homo sapiens
ggaagtagaagtaatgaaatca

SEQ ID NO: 7665477 - DNA, 18 bp, Homo sapiens
ggaagtaggaagaggaag

SEQ ID NO: 7665478 - DNA, 18 bp, Homo sapiens
ggaagtaggaagaggaag

SEQ ID NO: 7665479 - DNA, 22 bp, Homo sapiens
ggaataaagaatctggttcccc

SEQ ID NO: 7665480 - DNA, 22 bp, Homo sapiens
ggaagtttgtatactggcctct

SEQ ID NO: 7665481 - DNA, 22 bp, Homo sapiens
ggaataaaaattgtttactgta

SEQ ID NO: 7665482 - DNA, 22 bp, Homo sapiens
ggaataaaaattgtttactgta

SEQ ID NO: 7665483 - DNA, 22 bp, Homo sapiens
ggaagtttgagcatctgtttcc

SEQ ID NO: 7665484 - DNA, 22 bp, Homo sapiens
ggaagtttgagcatctgtttcc

SEQ ID NO: 7665485 - DNA, 22 bp, Homo sapiens
ggaagtttgagcatctgtttcc

SEQ ID NO: 7665486 - DNA, 22 bp, Homo sapiens
ggaagtttgggagctggtaatc

SEQ ID NO: 7665487 - DNA, 18 bp, Homo sapiens
ggaagtttgggtcccctg

SEQ ID NO: 7665488 - DNA, 22 bp, Homo sapiens
ggaagtttgtagatgtttctta

SEQ ID NO: 7665489 - DNA, 22 bp, Homo sapiens
ggaagtttgtagatgtttctta

SEQ ID NO: 7665490 - DNA, 22 bp, Homo sapiens
ggaagtttgggagctggtaatc

SEQ ID NO: 7665491 - DNA, 22 bp, Homo sapiens
ggaataggatttacctctgtaa

SEQ ID NO: 7665492 - DNA, 22 bp, Homo sapiens
ggaatagtagttggggaatggc

SEQ ID NO: 7665493 - DNA, 22 bp, Homo sapiens
ggaatagggagagaatcgtttg

SEQ ID NO: 7665494 - DNA, 22 bp, Homo sapiens
ggaatatagccagtaacagtca

SEQ ID NO: 7665495 - DNA, 22 bp, Homo sapiens
ggaatagtttatgtagctgaat

SEQ ID NO: 7665496 - DNA, 22 bp, Homo sapiens
ggaatacaaatctttgttctct

SEQ ID NO: 7665497 - DNA, 22 bp, Homo sapiens
ggaatactaaaggaagcaattg

SEQ ID NO: 7665498 - DNA, 22 bp, Homo sapiens
ggaatactaaaggaagcaattg

SEQ ID NO: 7665499 - DNA, 22 bp, Homo sapiens
ggaatactatgacacacaggtg

SEQ ID NO: 7665500 - DNA, 22 bp, Homo sapiens
ggaatactttgttgtcttccaa

SEQ ID NO: 7665501 - DNA, 22 bp, Homo sapiens
ggaatcagaattactgaatgga

SEQ ID NO: 7665502 - DNA, 22 bp, Homo sapiens
ggaatagtttatgtagctgaat

SEQ ID NO: 7665503 - DNA, 22 bp, Homo sapiens
ggaatcagaattactgaatgga

SEQ ID NO: 7665504 - DNA, 22 bp, Homo sapiens
ggaatcagaattactgaatgga

SEQ ID NO: 7665505 - DNA, 22 bp, Homo sapiens
ggagaagcaggtgctttgggtc

SEQ ID NO: 7665506 - DNA, 22 bp, Homo sapiens
ggaatatagccagtaacagtca

SEQ ID NO: 7665507 - DNA, 22 bp, Homo sapiens
ggaatatagccagtaacagtca

SEQ ID NO: 7665508 - DNA, 19 bp, Homo sapiens
ggagaagcatctagaaata

SEQ ID NO: 7665509 - DNA, 19 bp, Homo sapiens
ggagaagcatctagaaata

SEQ ID NO: 7665510 - DNA, 22 bp, Homo sapiens
ggagaagcaggtgctttgggtc

SEQ ID NO: 7665511 - DNA, 22 bp, Homo sapiens
ggagaagcaggtgctttgggtc

SEQ ID NO: 7665512 - DNA, 22 bp, Homo sapiens
ggagaagcaggtgctttgggtc

SEQ ID NO: 7665513 - DNA, 19 bp, Homo sapiens
ggagaagcatctagaaata

SEQ ID NO: 7665514 - DNA, 22 bp, Homo sapiens
ggagaagccacacattgggtgt

SEQ ID NO: 7665515 - DNA, 19 bp, Homo sapiens
ggagaagcccaggaatcct

SEQ ID NO: 7665516 - DNA, 19 bp, Homo sapiens
ggagaagcccaggaatcct

SEQ ID NO: 7665517 - DNA, 19 bp, Homo sapiens
ggagaagcccaggaatcct

SEQ ID NO: 7665518 - DNA, 19 bp, Homo sapiens
ggagaagcccaggaatcct

SEQ ID NO: 7665519 - DNA, 22 bp, Homo sapiens
ggagaagccacacattgggtgt

SEQ ID NO: 7665520 - DNA, 22 bp, Homo sapiens
ggagaagccaggtgataagcaa

SEQ ID NO: 7665521 - DNA, 22 bp, Homo sapiens
ggagaagccaggtgataagcaa

SEQ ID NO: 7665522 - DNA, 22 bp, Homo sapiens
ggagaagccaggtgataagcaa

SEQ ID NO: 7665523 - DNA, 22 bp, Homo sapiens
ggagaaggaagaaagctactat

SEQ ID NO: 7665524 - DNA, 22 bp, Homo sapiens
ggagaaggaagaaagctactat

SEQ ID NO: 7665525 - DNA, 22 bp, Homo sapiens
ggagaaggaagaaagctactat

SEQ ID NO: 7665526 - DNA, 22 bp, Homo sapiens
ggagagggtaggggtcctgccc

SEQ ID NO: 7665527 - DNA, 22 bp, Homo sapiens
ggagagggtaggggtcctgccc

SEQ ID NO: 7665528 - DNA, 22 bp, Homo sapiens
ggagagggtaggggtcctgccc

SEQ ID NO: 7665529 - DNA, 23 bp, Homo sapiens
ggagaggggtgtgggcatcttta

SEQ ID NO: 7665530 - DNA, 23 bp, Homo sapiens
ggagaggggtgtgggcatcttta

SEQ ID NO: 7665531 - DNA, 23 bp, Homo sapiens
ggagaggggtgtgggcatcttta

SEQ ID NO: 7665532 - DNA, 23 bp, Homo sapiens
ggagaggggtgtgggcatcttta

SEQ ID NO: 7665533 - DNA, 23 bp, Homo sapiens
ggagaggggtgtgggcatcttta

SEQ ID NO: 7665534 - DNA, 23 bp, Homo sapiens
ggagaggggtgtgggcatcttta

SEQ ID NO: 7665535 - DNA, 23 bp, Homo sapiens
ggagaggggtgtgggcatcttta

SEQ ID NO: 7665536 - DNA, 23 bp, Homo sapiens
ggagaggggtgtgggcatcttta

SEQ ID NO: 7665537 - DNA, 22 bp, Homo sapiens
ggagagggggctccctgcttgg

SEQ ID NO: 7665538 - DNA, 22 bp, Homo sapiens
ggagagggggctccctgcttgg

SEQ ID NO: 7665539 - DNA, 22 bp, Homo sapiens
ggagagggggctccctgcttgg

SEQ ID NO: 7665540 - DNA, 22 bp, Homo sapiens
ggagagggggctccctgcttgg

SEQ ID NO: 7665541 - DNA, 22 bp, Homo sapiens
ggagagggggctccctgcttgg

SEQ ID NO: 7665542 - DNA, 22 bp, Homo sapiens
ggagagggggctccctgcttgg

SEQ ID NO: 7665543 - DNA, 22 bp, Homo sapiens
ggagaggggcaagtttatctag

SEQ ID NO: 7665544 - DNA, 22 bp, Homo sapiens
ggagaggggaacttgttgcttg

SEQ ID NO: 7665545 - DNA, 22 bp, Homo sapiens
ggagaggggcaagtttatctag

SEQ ID NO: 7665546 - DNA, 22 bp, Homo sapiens
ggagaggggaacttgttgcttg

SEQ ID NO: 7665547 - DNA, 22 bp, Homo sapiens
ggagaggggaacttgttgcttg

SEQ ID NO: 7665548 - DNA, 22 bp, Homo sapiens
ggagaggggaacttgttgcttg

SEQ ID NO: 7665549 - DNA, 22 bp, Homo sapiens
ggagaggggaacttgttgcttg

SEQ ID NO: 7665550 - DNA, 22 bp, Homo sapiens
ggagaggcttggcccagcctgg

SEQ ID NO: 7665551 - DNA, 22 bp, Homo sapiens
ggagaggcttggcccagcctgg

SEQ ID NO: 7665552 - DNA, 22 bp, Homo sapiens
ggagaggcttggcccagcctgg

SEQ ID NO: 7665553 - DNA, 22 bp, Homo sapiens
ggagagggtgtggaaagttatc

SEQ ID NO: 7665554 - DNA, 22 bp, Homo sapiens
ggagagggtgtggaaagttatc

SEQ ID NO: 7665555 - DNA, 22 bp, Homo sapiens
ggagagggtaggggtcctgccc

SEQ ID NO: 7665556 - DNA, 22 bp, Homo sapiens
ggagagggtgtggaaagttatc

SEQ ID NO: 7665557 - DNA, 22 bp, Homo sapiens
ggagagggtgtggaaagttatc

SEQ ID NO: 7665558 - DNA, 22 bp, Homo sapiens
ggagagggtgtggaaagttatc

SEQ ID NO: 7665559 - DNA, 22 bp, Homo sapiens
ggagaggtgaatggctgctcta

SEQ ID NO: 7665560 - DNA, 22 bp, Homo sapiens
ggagagggtaggggtcctgccc

SEQ ID NO: 7665561 - DNA, 22 bp, Homo sapiens
ggagagggtaggggtcctgccc

SEQ ID NO: 7665562 - DNA, 22 bp, Homo sapiens
ggagagggtaggggtcctgccc

SEQ ID NO: 7665563 - DNA, 22 bp, Homo sapiens
ggagagggtaggggtcctgccc

SEQ ID NO: 7665564 - DNA, 22 bp, Homo sapiens
ggagagggtaggggtcctgccc

SEQ ID NO: 7665565 - DNA, 22 bp, Homo sapiens
ggagagggtaggggtcctgccc

SEQ ID NO: 7665566 - DNA, 22 bp, Homo sapiens
ggagagggtaggggtcctgccc

SEQ ID NO: 7665567 - DNA, 22 bp, Homo sapiens
ggagagggtaggggtcctgccc

SEQ ID NO: 7665568 - DNA, 22 bp, Homo sapiens
ggagagggtaggggtcctgccc

SEQ ID NO: 7665569 - DNA, 22 bp, Homo sapiens
ggagagggtaggggtcctgccc

SEQ ID NO: 7665570 - DNA, 22 bp, Homo sapiens
ggagaggtgtattcagtgggtc

SEQ ID NO: 7665571 - DNA, 22 bp, Homo sapiens
ggagaggtgtattcagtgggtc

SEQ ID NO: 7665572 - DNA, 17 bp, Homo sapiens
ggagatctggcagaggg

SEQ ID NO: 7665573 - DNA, 22 bp, Homo sapiens
ggagaggtgcaggtcagtggca

SEQ ID NO: 7665574 - DNA, 22 bp, Homo sapiens
ggagaggtgcaggtcagtggca

SEQ ID NO: 7665575 - DNA, 22 bp, Homo sapiens
ggagaggtgtattcagtgggtc

SEQ ID NO: 7665576 - DNA, 22 bp, Homo sapiens
ggagaggtgtattcagtgggtc

SEQ ID NO: 7665577 - DNA, 22 bp, Homo sapiens
ggagaggtgcaggtcagtggca

SEQ ID NO: 7665578 - DNA, 22 bp, Homo sapiens
ggagaggtgcaggtcagtggca

SEQ ID NO: 7665579 - DNA, 22 bp, Homo sapiens
ggagaggtgagaggtacaagtt

SEQ ID NO: 7665580 - DNA, 22 bp, Homo sapiens
ggagaggtgagaggtacaagtt

SEQ ID NO: 7665581 - DNA, 22 bp, Homo sapiens
ggagaggtgagaggtacaagtt

SEQ ID NO: 7665582 - DNA, 22 bp, Homo sapiens
ggagcctgtgcccaagcccaga

SEQ ID NO: 7665583 - DNA, 22 bp, Homo sapiens
ggagcctgtgcccaagcccaga

SEQ ID NO: 7665584 - DNA, 22 bp, Homo sapiens
ggagcctgtgcccaagcccaga

SEQ ID NO: 7665585 - DNA, 22 bp, Homo sapiens
ggagcctggttactagagcctg

SEQ ID NO: 7665586 - DNA, 22 bp, Homo sapiens
ggagcctggttactagagcctg

SEQ ID NO: 7665587 - DNA, 22 bp, Homo sapiens
ggagcctggttactagagcctg

SEQ ID NO: 7665588 - DNA, 22 bp, Homo sapiens
ggagcctggttactagagcctg

SEQ ID NO: 7665589 - DNA, 22 bp, Homo sapiens
ggagcctggtcaggttggctcc

SEQ ID NO: 7665590 - DNA, 22 bp, Homo sapiens
ggagcctggtcaggttggctcc

SEQ ID NO: 7665591 - DNA, 23 bp, Homo sapiens
ggagatgcttaagagtggttgag

SEQ ID NO: 7665592 - DNA, 22 bp, Homo sapiens
ggagatgctttccagtggggat

SEQ ID NO: 7665593 - DNA, 22 bp, Homo sapiens
ggagatgctttccagtggggat

SEQ ID NO: 7665594 - DNA, 22 bp, Homo sapiens
ggagatgctttccagtggggat

SEQ ID NO: 7665595 - DNA, 22 bp, Homo sapiens
ggagatgctttccagtggggat

SEQ ID NO: 7665596 - DNA, 22 bp, Homo sapiens
ggagatgacacaatttatttat

SEQ ID NO: 7665597 - DNA, 22 bp, Homo sapiens
ggagatgacacaatttatttat

SEQ ID NO: 7665598 - DNA, 20 bp, Homo sapiens
ggagatgcagcccaggtgcc

SEQ ID NO: 7665599 - DNA, 20 bp, Homo sapiens
ggagatgcagcccaggtgcc

SEQ ID NO: 7665600 - DNA, 20 bp, Homo sapiens
ggagatgcagcccaggtgcc

SEQ ID NO: 7665601 - DNA, 22 bp, Homo sapiens
ggagatgccagaattgcaaatt

SEQ ID NO: 7665602 - DNA, 20 bp, Homo sapiens
ggagatgcctctcagtccat

SEQ ID NO: 7665603 - DNA, 22 bp, Homo sapiens
ggagatgccttgtttcaggaac

SEQ ID NO: 7665604 - DNA, 23 bp, Homo sapiens
ggagatgcttaagagtggttgag

SEQ ID NO: 7665605 - DNA, 22 bp, Homo sapiens
ggagatgctatgtagtttggtt

SEQ ID NO: 7665606 - DNA, 22 bp, Homo sapiens
ggagatgctatgtagtttggtt

SEQ ID NO: 7665607 - DNA, 22 bp, Homo sapiens
ggagatgcgactcgcggggctg

SEQ ID NO: 7665608 - DNA, 22 bp, Homo sapiens
ggagatgctatgtagtttggtt

SEQ ID NO: 7665609 - DNA, 22 bp, Homo sapiens
ggagctagcctgtctctgttta

SEQ ID NO: 7665610 - DNA, 22 bp, Homo sapiens
ggagctaggcaaagctcacgga

SEQ ID NO: 7665611 - DNA, 22 bp, Homo sapiens
ggagcgtgcactccaggccctt

SEQ ID NO: 7665612 - DNA, 22 bp, Homo sapiens
ggagcgtgcactccaggccctt

SEQ ID NO: 7665613 - DNA, 22 bp, Homo sapiens
ggagcgtgcactccaggccctt

SEQ ID NO: 7665614 - DNA, 22 bp, Homo sapiens
ggagcggcagatggagtgggag

SEQ ID NO: 7665615 - DNA, 22 bp, Homo sapiens
ggagcgtgcagcatgagctcat

SEQ ID NO: 7665616 - DNA, 20 bp, Homo sapiens
ggagctagagctgaaagact

SEQ ID NO: 7665617 - DNA, 20 bp, Homo sapiens
ggagctagagctgaaagact

SEQ ID NO: 7665618 - DNA, 22 bp, Homo sapiens
ggagcgagcccgatagcgctgg

SEQ ID NO: 7665619 - DNA, 22 bp, Homo sapiens
ggagcggagggagggccactgt

SEQ ID NO: 7665620 - DNA, 22 bp, Homo sapiens
ggagcgagcccgatagcgctgg

SEQ ID NO: 7665621 - DNA, 22 bp, Homo sapiens
ggagccttgggcgctctcccat

SEQ ID NO: 7665622 - DNA, 22 bp, Homo sapiens
ggagcggagggagggccactgt

SEQ ID NO: 7665623 - DNA, 22 bp, Homo sapiens
ggagcggcagatggagtgggag

SEQ ID NO: 7665624 - DNA, 22 bp, Homo sapiens
ggagcggcagatggagtgggag

SEQ ID NO: 7665625 - DNA, 22 bp, Homo sapiens
ggagcggtcagctggccacacg

SEQ ID NO: 7665626 - DNA, 22 bp, Homo sapiens
ggagcggtcagctggccacacg

SEQ ID NO: 7665627 - DNA, 22 bp, Homo sapiens
ggagcctgtggccgtcacgact

SEQ ID NO: 7665628 - DNA, 22 bp, Homo sapiens
ggagcctgtggccgtcacgact

SEQ ID NO: 7665629 - DNA, 22 bp, Homo sapiens
ggagcctgtgcccaagcccaga

SEQ ID NO: 7665630 - DNA, 22 bp, Homo sapiens
ggagcctgtggccgtcacgact

SEQ ID NO: 7665631 - DNA, 22 bp, Homo sapiens
ggagcctgtggccgtcacgact

SEQ ID NO: 7665632 - DNA, 22 bp, Homo sapiens
ggagcctgtgggatgagatgtg

SEQ ID NO: 7665633 - DNA, 22 bp, Homo sapiens
ggagcctgtgggatgagatgtg

SEQ ID NO: 7665634 - DNA, 22 bp, Homo sapiens
ggagcctgtgggatgagatgtg

SEQ ID NO: 7665635 - DNA, 22 bp, Homo sapiens
ggagcctgtgggatgagatgtg

SEQ ID NO: 7665636 - DNA, 22 bp, Homo sapiens
ggagcctgttagttgagtgctc

SEQ ID NO: 7665637 - DNA, 22 bp, Homo sapiens
ggagcctgttagttgagtgctc

SEQ ID NO: 7665638 - DNA, 22 bp, Homo sapiens
ggagcctgttagttgagtgctc

SEQ ID NO: 7665639 - DNA, 22 bp, Homo sapiens
ggagcctgtgggatgagatgtg

SEQ ID NO: 7665640 - DNA, 22 bp, Homo sapiens
ggaaagaggatagtgggtaggt

SEQ ID NO: 7665641 - DNA, 22 bp, Homo sapiens
ggaaagagggacccagcttggt

SEQ ID NO: 7665642 - DNA, 22 bp, Homo sapiens
ggaaagagggacccagcttggt

SEQ ID NO: 7665643 - DNA, 22 bp, Homo sapiens
ggaaagaggatagtgggtaggt

SEQ ID NO: 7665644 - DNA, 22 bp, Homo sapiens
ggaaagaggatagtgggtaggt

SEQ ID NO: 7665645 - DNA, 22 bp, Homo sapiens
ggaaagagggacccagcttggt

SEQ ID NO: 7665646 - DNA, 22 bp, Homo sapiens
ggaaagagttttggtatatttg

SEQ ID NO: 7665647 - DNA, 22 bp, Homo sapiens
ggaaagagggacccagcttggt

SEQ ID NO: 7665648 - DNA, 22 bp, Homo sapiens
ggaaagagttttggtatatttg

SEQ ID NO: 7665649 - DNA, 22 bp, Homo sapiens
ggaaagatttgtcacatgaatg

SEQ ID NO: 7665650 - DNA, 22 bp, Homo sapiens
ggaaagagctaaaagggtgaga

SEQ ID NO: 7665651 - DNA, 22 bp, Homo sapiens
ggaaagagctaaaagggtgaga

SEQ ID NO: 7665652 - DNA, 22 bp, Homo sapiens
ggaaagagcccagcagtgcttg

SEQ ID NO: 7665653 - DNA, 22 bp, Homo sapiens
ggaaagagcccagcagtgcttg

SEQ ID NO: 7665654 - DNA, 22 bp, Homo sapiens
ggaaagagctaaaagggtgaga

SEQ ID NO: 7665655 - DNA, 22 bp, Homo sapiens
ggaaagagctaaaagggtgaga

SEQ ID NO: 7665656 - DNA, 22 bp, Homo sapiens
ggaaagaggatagtgggtaggt

SEQ ID NO: 7665657 - DNA, 22 bp, Homo sapiens
ggaaagaggatagtgggtaggt

SEQ ID NO: 7665658 - DNA, 22 bp, Homo sapiens
ggaaagagctaaaagggtgaga

SEQ ID NO: 7665659 - DNA, 22 bp, Homo sapiens
ggaaagagctaaaagggtgaga

SEQ ID NO: 7665660 - DNA, 22 bp, Homo sapiens
ggaaagagctaaaagggtgaga

SEQ ID NO: 7665661 - DNA, 22 bp, Homo sapiens
ggaaagccaggtgctctggtgt

SEQ ID NO: 7665662 - DNA, 22 bp, Homo sapiens
ggaaagcatccaggtgccccca

SEQ ID NO: 7665663 - DNA, 22 bp, Homo sapiens
ggaaagccaggtgctctggtgt

SEQ ID NO: 7665664 - DNA, 22 bp, Homo sapiens
ggaaagatttgtcacatgaatg

SEQ ID NO: 7665665 - DNA, 22 bp, Homo sapiens
ggaaagctactggtgtcctctg

SEQ ID NO: 7665666 - DNA, 22 bp, Homo sapiens
ggaactattgctctagcaatag

SEQ ID NO: 7665667 - DNA, 19 bp, Homo sapiens
ggaactcacttagagaaac

SEQ ID NO: 7665668 - DNA, 22 bp, Homo sapiens
ggaaagctcagatcttgttgga

SEQ ID NO: 7665669 - DNA, 19 bp, Homo sapiens
ggaaccttggagcttcggc

SEQ ID NO: 7665670 - DNA, 22 bp, Homo sapiens
ggaacctttctccaggttgtag

SEQ ID NO: 7665671 - DNA, 22 bp, Homo sapiens
ggaacctttgtgaagggagagg

SEQ ID NO: 7665672 - DNA, 22 bp, Homo sapiens
ggaacctttgtgctccactggg

SEQ ID NO: 7665673 - DNA, 22 bp, Homo sapiens
ggaactgaatgtctcggtataa

SEQ ID NO: 7665674 - DNA, 22 bp, Homo sapiens
ggaactgaatgtctcggtataa

SEQ ID NO: 7665675 - DNA, 22 bp, Homo sapiens
ggaactgaatgtctcggtataa

SEQ ID NO: 7665676 - DNA, 22 bp, Homo sapiens
ggaactgaatgtctcggtataa

SEQ ID NO: 7665677 - DNA, 22 bp, Homo sapiens
ggaactcctgctccaagcagct

SEQ ID NO: 7665678 - DNA, 22 bp, Homo sapiens
ggaactcagacgatcctatgtt

SEQ ID NO: 7665679 - DNA, 22 bp, Homo sapiens
ggaactcagtatcagactccag

SEQ ID NO: 7665680 - DNA, 22 bp, Homo sapiens
ggaactcctgctccaagcagct

SEQ ID NO: 7665681 - DNA, 22 bp, Homo sapiens
ggaactcctgctccaagcagct

SEQ ID NO: 7665682 - DNA, 22 bp, Homo sapiens
ggaactcctgctccaagcagct

SEQ ID NO: 7665683 - DNA, 21 bp, Homo sapiens
ggaaagaaggcaaggctcagg

SEQ ID NO: 7665684 - DNA, 21 bp, Homo sapiens
ggaaagaaggcaaggctcagg

SEQ ID NO: 7665685 - DNA, 21 bp, Homo sapiens
ggaaagaaggcaaggctcagg

SEQ ID NO: 7665686 - DNA, 21 bp, Homo sapiens
ggaaagaaggcaaggctcagg

SEQ ID NO: 7665687 - DNA, 22 bp, Homo sapiens
ggaaagaatagagactttatca

SEQ ID NO: 7665688 - DNA, 22 bp, Homo sapiens
ggaaagaatagagactttatca

SEQ ID NO: 7665689 - DNA, 22 bp, Homo sapiens
ggaaagaatagagactttatca

SEQ ID NO: 7665690 - DNA, 22 bp, Homo sapiens
ggaaagaaccctggatggctgg

SEQ ID NO: 7665691 - DNA, 22 bp, Homo sapiens
ggaaagaaccctggatggctgg

SEQ ID NO: 7665692 - DNA, 22 bp, Homo sapiens
ggaaagaaccctggatggctgg

SEQ ID NO: 7665693 - DNA, 22 bp, Homo sapiens
ggaaagaaagtgtgaacaactt

SEQ ID NO: 7665694 - DNA, 22 bp, Homo sapiens
ggaaagaaagtgtgaacaactt

SEQ ID NO: 7665695 - DNA, 22 bp, Homo sapiens
ggaaagaaccctggatggctgg

SEQ ID NO: 7665696 - DNA, 21 bp, Homo sapiens
ggaaagaaggcaaggctcagg

SEQ ID NO: 7665697 - DNA, 22 bp, Homo sapiens
ggaaagaaccctggatggctgg

SEQ ID NO: 7665698 - DNA, 22 bp, Homo sapiens
ggaaagagaagttgggaggaat

SEQ ID NO: 7665699 - DNA, 23 bp, Homo sapiens
ggaaagagaggagttgtgcatag

SEQ ID NO: 7665700 - DNA, 23 bp, Homo sapiens
ggaaagagaggagttgtgcatag

SEQ ID NO: 7665701 - DNA, 22 bp, Homo sapiens
ggaaagagcccagcagtgcttg

SEQ ID NO: 7665702 - DNA, 23 bp, Homo sapiens
ggaaagagaggagttgtgcatag

SEQ ID NO: 7665703 - DNA, 22 bp, Homo sapiens
ggaaagagcccagcagtgcttg

SEQ ID NO: 7665704 - DNA, 22 bp, Homo sapiens
ggaaagagcccagcagtgcttg

SEQ ID NO: 7665705 - DNA, 22 bp, Homo sapiens
ggaaagagcccagcagtgcttg

SEQ ID NO: 7665706 - DNA, 22 bp, Homo sapiens
ggaaagagcccagcagtgcttg

SEQ ID NO: 7665707 - DNA, 22 bp, Homo sapiens
ggaaagaatcaagtgatcctgt

SEQ ID NO: 7665708 - DNA, 22 bp, Homo sapiens
ggaaagaatcaagtgatcctgt

SEQ ID NO: 7665709 - DNA, 22 bp, Homo sapiens
ggaaagaatcaagtgatcctgt

SEQ ID NO: 7665710 - DNA, 22 bp, Homo sapiens
ggaaagagaagttgggaggaat

SEQ ID NO: 7665711 - DNA, 22 bp, Homo sapiens
ggaaagagaagttgggaggaat

SEQ ID NO: 7665712 - DNA, 22 bp, Homo sapiens
ggaaagagaagttgggaggaat

SEQ ID NO: 7665713 - DNA, 22 bp, Homo sapiens
ggaaagagaagttgggaggaat

SEQ ID NO: 7665714 - DNA, 22 bp, Homo sapiens
ggaaagagaagttgggaggaat

SEQ ID NO: 7665715 - DNA, 22 bp, Homo sapiens
ggaaagagaagttgggaggaat

SEQ ID NO: 7665716 - DNA, 22 bp, Homo sapiens
ggaaagacctgagataggaata

SEQ ID NO: 7665717 - DNA, 20 bp, Homo sapiens
ggaaacatttttatttccat

SEQ ID NO: 7665718 - DNA, 22 bp, Homo sapiens
ggaaacattccaagagttgaaa

SEQ ID NO: 7665719 - DNA, 22 bp, Homo sapiens
ggaaacatattctgatgtgcat

SEQ ID NO: 7665720 - DNA, 22 bp, Homo sapiens
ggaaacattccaagagttgaaa

SEQ ID NO: 7665721 - DNA, 22 bp, Homo sapiens
ggaaacatgcctgctggacagt

SEQ ID NO: 7665722 - DNA, 19 bp, Homo sapiens
ggaaacaggggccagagga

SEQ ID NO: 7665723 - DNA, 19 bp, Homo sapiens
ggaaacaggggccagagga

SEQ ID NO: 7665724 - DNA, 19 bp, Homo sapiens
ggaaacaggggccagagga

SEQ ID NO: 7665725 - DNA, 19 bp, Homo sapiens
ggaaacaggggccagagga

SEQ ID NO: 7665726 - DNA, 22 bp, Homo sapiens
ggaaacagctctttggggctgt

SEQ ID NO: 7665727 - DNA, 22 bp, Homo sapiens
ggaaacagagggcacctgagcc

SEQ ID NO: 7665728 - DNA, 22 bp, Homo sapiens
ggaaacagagggcacctgagcc

SEQ ID NO: 7665729 - DNA, 22 bp, Homo sapiens
ggaaacagagggcacctgagcc

SEQ ID NO: 7665730 - DNA, 22 bp, Homo sapiens
ggaaacagcaaattatggcaat

SEQ ID NO: 7665731 - DNA, 22 bp, Homo sapiens
ggaaaccattcccgactctcct

SEQ ID NO: 7665732 - DNA, 22 bp, Homo sapiens
ggaaaccattcccgactctcct

SEQ ID NO: 7665733 - DNA, 22 bp, Homo sapiens
ggaaaccattcccgactctcct

SEQ ID NO: 7665734 - DNA, 22 bp, Homo sapiens
ggaaaccttaattattacacca

SEQ ID NO: 7665735 - DNA, 21 bp, Homo sapiens
ggaaaccttccaagcagagac

SEQ ID NO: 7665736 - DNA, 22 bp, Homo sapiens
ggaaactgagtgacactccctc

SEQ ID NO: 7665737 - DNA, 22 bp, Homo sapiens
ggaaactgagtgacactccctc

SEQ ID NO: 7665738 - DNA, 18 bp, Homo sapiens
ggaaaccttggactcgcc

SEQ ID NO: 7665739 - DNA, 22 bp, Homo sapiens
ggaaactaaatcaagctggctt

SEQ ID NO: 7665740 - DNA, 22 bp, Homo sapiens
ggaaactaaatcaagctggctt

SEQ ID NO: 7665741 - DNA, 22 bp, Homo sapiens
ggaaagaaagtgtgaacaactt

SEQ ID NO: 7665742 - DNA, 22 bp, Homo sapiens
ggaaagaaagtgtgaacaactt

SEQ ID NO: 7665743 - DNA, 22 bp, Homo sapiens
ggaaagaaagtgtgaacaactt

SEQ ID NO: 7665744 - DNA, 22 bp, Homo sapiens
ggaaactgtagtttgctgacat

SEQ ID NO: 7665745 - DNA, 22 bp, Homo sapiens
ggaaactgcttacactagaggg

SEQ ID NO: 7665746 - DNA, 22 bp, Homo sapiens
ggaaactgcttacactagaggg

SEQ ID NO: 7665747 - DNA, 22 bp, Homo sapiens
ggaaactgcttacactagaggg

SEQ ID NO: 7665748 - DNA, 22 bp, Homo sapiens
ggaaaacaagagaatgatgttt

SEQ ID NO: 7665749 - DNA, 22 bp, Homo sapiens
ggaaaacaagagaatgatgttt

SEQ ID NO: 7665750 - DNA, 22 bp, Homo sapiens
ggaaaacaagagaatgatgttt

SEQ ID NO: 7665751 - DNA, 22 bp, Homo sapiens
ggaaaacaagagaatgatgttt

SEQ ID NO: 7665752 - DNA, 20 bp, Homo sapiens
ggaaaaatgcatgctcaaga

SEQ ID NO: 7665753 - DNA, 20 bp, Homo sapiens
ggaaaaatgcatgctcaaga

SEQ ID NO: 7665754 - DNA, 20 bp, Homo sapiens
ggaaaaatgcatgctcaaga

SEQ ID NO: 7665755 - DNA, 20 bp, Homo sapiens
ggaaaaatgcatgctcaaga

SEQ ID NO: 7665756 - DNA, 20 bp, Homo sapiens
ggaaaaatgcatgctcaaga

SEQ ID NO: 7665757 - DNA, 22 bp, Homo sapiens
gcttctggtgaggcctcaggaa

SEQ ID NO: 7665758 - DNA, 22 bp, Homo sapiens
ggaaaactgaggctctcagcag

SEQ ID NO: 7665759 - DNA, 22 bp, Homo sapiens
ggaaaactgaggctctcagcag

SEQ ID NO: 7665760 - DNA, 22 bp, Homo sapiens
ggaaacacatgatcagacatct

SEQ ID NO: 7665761 - DNA, 22 bp, Homo sapiens
ggaaaacaagagaatgatgttt

SEQ ID NO: 7665762 - DNA, 22 bp, Homo sapiens
ggaaaacagcgattggtatcat

SEQ ID NO: 7665763 - DNA, 22 bp, Homo sapiens
ggaaaacagcgattggtatcat

SEQ ID NO: 7665764 - DNA, 22 bp, Homo sapiens
ggaaaacagcgattggtatcat

SEQ ID NO: 7665765 - DNA, 22 bp, Homo sapiens
gcttctggagtcttcagaggaa

SEQ ID NO: 7665766 - DNA, 22 bp, Homo sapiens
gcttctgggcacctgaacagga

SEQ ID NO: 7665767 - DNA, 22 bp, Homo sapiens
gcttctggggttctggcatgct

SEQ ID NO: 7665768 - DNA, 22 bp, Homo sapiens
gcttctggggttctggcatgct

SEQ ID NO: 7665769 - DNA, 22 bp, Homo sapiens
gcttctggggttctggcatgct

SEQ ID NO: 7665770 - DNA, 22 bp, Homo sapiens
gcttctggggttctggcatgct

SEQ ID NO: 7665771 - DNA, 22 bp, Homo sapiens
gcttctggagtcttcagaggaa

SEQ ID NO: 7665772 - DNA, 22 bp, Homo sapiens
gcttctggaggagctgggctga

SEQ ID NO: 7665773 - DNA, 22 bp, Homo sapiens
gcttctggaggagctgggctga

SEQ ID NO: 7665774 - DNA, 22 bp, Homo sapiens
gcttctggaggagctgggctga

SEQ ID NO: 7665775 - DNA, 17 bp, Homo sapiens
gcttctggagcttctgt

SEQ ID NO: 7665776 - DNA, 17 bp, Homo sapiens
gcttctggagcttctgt

SEQ ID NO: 7665777 - DNA, 22 bp, Homo sapiens
gcttctggaagctgcttctgcc

SEQ ID NO: 7665778 - DNA, 22 bp, Homo sapiens
gcttctggaagctgcttctgcc

SEQ ID NO: 7665779 - DNA, 22 bp, Homo sapiens
gcttctggaagctgcttctgcc

SEQ ID NO: 7665780 - DNA, 22 bp, Homo sapiens
ggaagaaagtagaaaaccgtgg

SEQ ID NO: 7665781 - DNA, 22 bp, Homo sapiens
ggaagaaagtagaaaaccgtgg

SEQ ID NO: 7665782 - DNA, 22 bp, Homo sapiens
ggaagaaagtagaaaaccgtgg

SEQ ID NO: 7665783 - DNA, 22 bp, Homo sapiens
ggaagaaaggtggacaacaggt

SEQ ID NO: 7665784 - DNA, 22 bp, Homo sapiens
ggaagaaaggtggacaacaggt

SEQ ID NO: 7665785 - DNA, 22 bp, Homo sapiens
ggaagaaagtagaaaaccgtgg

SEQ ID NO: 7665786 - DNA, 22 bp, Homo sapiens
ggaagaaatctggttaagagat

SEQ ID NO: 7665787 - DNA, 22 bp, Homo sapiens
ggaagaaatctggttaagagat

SEQ ID NO: 7665788 - DNA, 22 bp, Homo sapiens
ggaagaaatctggttaagagat

SEQ ID NO: 7665789 - DNA, 22 bp, Homo sapiens
ggaagaaatctggttaagagat

SEQ ID NO: 7665790 - DNA, 22 bp, Homo sapiens
ggaagaaaggtggacaacaggt

SEQ ID NO: 7665791 - DNA, 22 bp, Homo sapiens
ggaagaaaggtggacaacaggt

SEQ ID NO: 7665792 - DNA, 22 bp, Homo sapiens
ggaagaaaggtggacaacaggt

SEQ ID NO: 7665793 - DNA, 22 bp, Homo sapiens
ggaagaaaggtggacaacaggt

SEQ ID NO: 7665794 - DNA, 22 bp, Homo sapiens
ggaagaaaggtggacaacaggt

SEQ ID NO: 7665795 - DNA, 22 bp, Homo sapiens
ggaagaaaggtggacaacaggt

SEQ ID NO: 7665796 - DNA, 22 bp, Homo sapiens
ggaagaaaggtggacaacaggt

SEQ ID NO: 7665797 - DNA, 22 bp, Homo sapiens
ggaagaaaggtggacaacaggt

SEQ ID NO: 7665798 - DNA, 22 bp, Homo sapiens
ggaagaaaggtggacaacaggt

SEQ ID NO: 7665799 - DNA, 22 bp, Homo sapiens
ggaagaaaggtggacaacaggt

SEQ ID NO: 7665800 - DNA, 22 bp, Homo sapiens
ggaagaaaggtggacaacaggt

SEQ ID NO: 7665801 - DNA, 22 bp, Homo sapiens
ggaagaaaggtggacaacaggt

SEQ ID NO: 7665802 - DNA, 22 bp, Homo sapiens
ggaagaaaggtggacaacaggt

SEQ ID NO: 7665803 - DNA, 22 bp, Homo sapiens
ggaagaaaggtggacaacaggt

SEQ ID NO: 7665804 - DNA, 22 bp, Homo sapiens
ggaagaaagacatttattttga

SEQ ID NO: 7665805 - DNA, 22 bp, Homo sapiens
ggaagaaaatgggcaacaggtg

SEQ ID NO: 7665806 - DNA, 22 bp, Homo sapiens
ggaagaaaatgggcaacaggtg

SEQ ID NO: 7665807 - DNA, 22 bp, Homo sapiens
ggaagaaaatgggcaacaggtg

SEQ ID NO: 7665808 - DNA, 22 bp, Homo sapiens
ggaagaaaatgggcaacaggtg

SEQ ID NO: 7665809 - DNA, 22 bp, Homo sapiens
ggaagaaaatgggcaacaggtg

SEQ ID NO: 7665810 - DNA, 22 bp, Homo sapiens
ggaagaaaatgggcaacaggtg

SEQ ID NO: 7665811 - DNA, 22 bp, Homo sapiens
ggaagaaaatgggcaacaggtg

SEQ ID NO: 7665812 - DNA, 22 bp, Homo sapiens
ggaagaaaatgggcaacaggtg

SEQ ID NO: 7665813 - DNA, 22 bp, Homo sapiens
ggaagaaagcacacaaacttga

SEQ ID NO: 7665814 - DNA, 22 bp, Homo sapiens
ggaagaaagcacacaaacttga

SEQ ID NO: 7665815 - DNA, 22 bp, Homo sapiens
ggaagaaagcacacaaacttga

SEQ ID NO: 7665816 - DNA, 22 bp, Homo sapiens
ggaagaaagcacacaaacttga

SEQ ID NO: 7665817 - DNA, 22 bp, Homo sapiens
ggaagaaagacatttattttga

SEQ ID NO: 7665818 - DNA, 22 bp, Homo sapiens
ggaagaaagacatttattttga

SEQ ID NO: 7665819 - DNA, 22 bp, Homo sapiens
ggaagaaagacatttattttga

SEQ ID NO: 7665820 - DNA, 17 bp, Homo sapiens
ggaagaaaaggatcatc

SEQ ID NO: 7665821 - DNA, 17 bp, Homo sapiens
ggaagaaaaggatcatc

SEQ ID NO: 7665822 - DNA, 17 bp, Homo sapiens
ggaagaaaaggatcatc

SEQ ID NO: 7665823 - DNA, 17 bp, Homo sapiens
ggaagaaaaggatcatc

SEQ ID NO: 7665824 - DNA, 17 bp, Homo sapiens
ggaagaaaaggatcatc

SEQ ID NO: 7665825 - DNA, 17 bp, Homo sapiens
ggaagaaaaggatcatc

SEQ ID NO: 7665826 - DNA, 17 bp, Homo sapiens
ggaagaaaaggatcatc

SEQ ID NO: 7665827 - DNA, 17 bp, Homo sapiens
ggaagaaaaggatcatc

SEQ ID NO: 7665828 - DNA, 17 bp, Homo sapiens
ggaagaaaaggatcatc

SEQ ID NO: 7665829 - DNA, 17 bp, Homo sapiens
ggaagaaaaggatcatc

SEQ ID NO: 7665830 - DNA, 17 bp, Homo sapiens
ggaagaaaaggatcatc

SEQ ID NO: 7665831 - DNA, 18 bp, Homo sapiens
ggaagaaaaggaactcag

SEQ ID NO: 7665832 - DNA, 18 bp, Homo sapiens
ggaagaaaaggaactcag

SEQ ID NO: 7665833 - DNA, 18 bp, Homo sapiens
ggaagaaaaggaactcag

SEQ ID NO: 7665834 - DNA, 18 bp, Homo sapiens
ggaagaaaaggaactcag

SEQ ID NO: 7665835 - DNA, 18 bp, Homo sapiens
ggaagaaaaggaactcag

SEQ ID NO: 7665836 - DNA, 18 bp, Homo sapiens
ggaagaaaaggaactcag

SEQ ID NO: 7665837 - DNA, 18 bp, Homo sapiens
ggaagaaaaggaactcag

SEQ ID NO: 7665838 - DNA, 22 bp, Homo sapiens
ggaagaaaagcttccagcgcct

SEQ ID NO: 7665839 - DNA, 22 bp, Homo sapiens
ggaagaaaagcttccagcgcct

SEQ ID NO: 7665840 - DNA, 22 bp, Homo sapiens
ggaagaaaagcttccagcgcct

SEQ ID NO: 7665841 - DNA, 22 bp, Homo sapiens
ggaactgattaagtcatgagaa

SEQ ID NO: 7665842 - DNA, 22 bp, Homo sapiens
ggaactggagaatgccctcttt

SEQ ID NO: 7665843 - DNA, 22 bp, Homo sapiens
ggaactggagaatgccctcttt

SEQ ID NO: 7665844 - DNA, 22 bp, Homo sapiens
ggaactgattaagtcatgagaa

SEQ ID NO: 7665845 - DNA, 22 bp, Homo sapiens
ggaactgagcaatggcatgaaa

SEQ ID NO: 7665846 - DNA, 22 bp, Homo sapiens
ggaactgagaagcagctatgcc

SEQ ID NO: 7665847 - DNA, 22 bp, Homo sapiens
ggaactgagaagcagctatgcc

SEQ ID NO: 7665848 - DNA, 22 bp, Homo sapiens
ggaactgaatgtctcggtataa

SEQ ID NO: 7665849 - DNA, 22 bp, Homo sapiens
ggaactttaggatcctggctca

SEQ ID NO: 7665850 - DNA, 22 bp, Homo sapiens
ggaactgggttagggtctcttc

SEQ ID NO: 7665851 - DNA, 22 bp, Homo sapiens
ggaacttaataagttttgtaat

SEQ ID NO: 7665852 - DNA, 22 bp, Homo sapiens
ggaacttatactgccagattct

SEQ ID NO: 7665853 - DNA, 22 bp, Homo sapiens
ggaacttatactgccagattct

SEQ ID NO: 7665854 - DNA, 22 bp, Homo sapiens
ggaactggagaatgccctcttt

SEQ ID NO: 7665855 - DNA, 22 bp, Homo sapiens
ggaactgggttagggtctcttc

SEQ ID NO: 7665856 - DNA, 22 bp, Homo sapiens
ggaaggtgctccctggacagag

SEQ ID NO: 7665857 - DNA, 22 bp, Homo sapiens
ggaaggtgctccctggacagag

SEQ ID NO: 7665858 - DNA, 22 bp, Homo sapiens
ggaaggtgctccctggacagag

SEQ ID NO: 7665859 - DNA, 22 bp, Homo sapiens
ggaaggtgctccctggacagag

SEQ ID NO: 7665860 - DNA, 22 bp, Homo sapiens
ggaaggtgctccctggacagag

SEQ ID NO: 7665861 - DNA, 22 bp, Homo sapiens
ggaaggtgctccctggacagag

SEQ ID NO: 7665862 - DNA, 18 bp, Homo sapiens
ggaaggtgatgtgaaaag

SEQ ID NO: 7665863 - DNA, 18 bp, Homo sapiens
ggaaggtgatgtgaaaag

SEQ ID NO: 7665864 - DNA, 18 bp, Homo sapiens
ggaaggtgatgtgaaaag

SEQ ID NO: 7665865 - DNA, 18 bp, Homo sapiens
ggaaggtgatgtgaaaag

SEQ ID NO: 7665866 - DNA, 22 bp, Homo sapiens
ggaaggtgctccctggacagag

SEQ ID NO: 7665867 - DNA, 22 bp, Homo sapiens
ggaaggtgctccctggacagag

SEQ ID NO: 7665868 - DNA, 22 bp, Homo sapiens
ggaaggtgctccctggacagag

SEQ ID NO: 7665869 - DNA, 22 bp, Homo sapiens
ggaaggtgctccctggacagag

SEQ ID NO: 7665870 - DNA, 22 bp, Homo sapiens
ggaaggtgctccctggacagag

SEQ ID NO: 7665871 - DNA, 19 bp, Homo sapiens
ggaaggtgacagtggtgaa

SEQ ID NO: 7665872 - DNA, 19 bp, Homo sapiens
ggaaggtgacagtggtgaa

SEQ ID NO: 7665873 - DNA, 19 bp, Homo sapiens
ggaaggtgacagtggtgaa

SEQ ID NO: 7665874 - DNA, 19 bp, Homo sapiens
ggaaggtgacagtggtgaa

SEQ ID NO: 7665875 - DNA, 19 bp, Homo sapiens
ggaaggtgacagtggtgaa

SEQ ID NO: 7665876 - DNA, 19 bp, Homo sapiens
ggaaggtgacagtggtgaa

SEQ ID NO: 7665877 - DNA, 22 bp, Homo sapiens
ggaaggtcgagctgcatctggc

SEQ ID NO: 7665878 - DNA, 22 bp, Homo sapiens
ggaaggtcgagctgcatctggc

SEQ ID NO: 7665879 - DNA, 22 bp, Homo sapiens
ggaaggtgaggtaaggtcttgt

SEQ ID NO: 7665880 - DNA, 22 bp, Homo sapiens
ggaaggtgaggtaaggtcttgt

SEQ ID NO: 7665881 - DNA, 19 bp, Homo sapiens
ggaaggtgacagtggtgaa

SEQ ID NO: 7665882 - DNA, 19 bp, Homo sapiens
ggaaggtgacagtggtgaa

SEQ ID NO: 7665883 - DNA, 19 bp, Homo sapiens
ggaaggtgacagtggtgaa

SEQ ID NO: 7665884 - DNA, 22 bp, Homo sapiens
ggaagggtttggaaagccgaga

SEQ ID NO: 7665885 - DNA, 22 bp, Homo sapiens
ggaagggtttggaaagccgaga

SEQ ID NO: 7665886 - DNA, 22 bp, Homo sapiens
ggaagggtttaagcaggagagt

SEQ ID NO: 7665887 - DNA, 22 bp, Homo sapiens
ggaaggggttaggggtccctga

SEQ ID NO: 7665888 - DNA, 22 bp, Homo sapiens
ggaagggtttaagcaggagagt

SEQ ID NO: 7665889 - DNA, 22 bp, Homo sapiens
ggaaggggttaggggtccctga

SEQ ID NO: 7665890 - DNA, 22 bp, Homo sapiens
ggaaggggtgtcgcccatggat

SEQ ID NO: 7665891 - DNA, 22 bp, Homo sapiens
ggaaggggttaggggtccctga

SEQ ID NO: 7665892 - DNA, 22 bp, Homo sapiens
ggaaggggttaggggtccctga

SEQ ID NO: 7665893 - DNA, 22 bp, Homo sapiens
ggaaggggttaggggtccctga

SEQ ID NO: 7665894 - DNA, 22 bp, Homo sapiens
ggaaggggttaggggtccctga

SEQ ID NO: 7665895 - DNA, 22 bp, Homo sapiens
ggaaggggttaggggtccctga

SEQ ID NO: 7665896 - DNA, 22 bp, Homo sapiens
ggaaggggtgtcgcccatggat

SEQ ID NO: 7665897 - DNA, 22 bp, Homo sapiens
ggaaggggtgtcgcccatggat

SEQ ID NO: 7665898 - DNA, 22 bp, Homo sapiens
ggaaggggtgtcgcccatggat

SEQ ID NO: 7665899 - DNA, 22 bp, Homo sapiens
ggaaggggtgtcgcccatggat

SEQ ID NO: 7665900 - DNA, 22 bp, Homo sapiens
ggaaggggtgtcgcccatggat

SEQ ID NO: 7665901 - DNA, 22 bp, Homo sapiens
ggaaggggtgggtgagcctcag

SEQ ID NO: 7665902 - DNA, 22 bp, Homo sapiens
ggaaggggtgggtgagcctcag

SEQ ID NO: 7665903 - DNA, 22 bp, Homo sapiens
ggaaggggtgggtgagcctcag

SEQ ID NO: 7665904 - DNA, 22 bp, Homo sapiens
ggaaggggtgggtgagcctcag

SEQ ID NO: 7665905 - DNA, 22 bp, Homo sapiens
ggaaggggtgggtgagcctcag

SEQ ID NO: 7665906 - DNA, 22 bp, Homo sapiens
ggaaggggtgggtgagcctcag

SEQ ID NO: 7665907 - DNA, 21 bp, Homo sapiens
ggaaggggtcctcccaacagt

SEQ ID NO: 7665908 - DNA, 22 bp, Homo sapiens
ggaaggggtgggtgagcctcag

SEQ ID NO: 7665909 - DNA, 22 bp, Homo sapiens
ggaaggggtgggtgagcctcag

SEQ ID NO: 7665910 - DNA, 22 bp, Homo sapiens
ggaaggggtgggtgagcctcag

SEQ ID NO: 7665911 - DNA, 22 bp, Homo sapiens
ggaaggggtcacctcctgatga

SEQ ID NO: 7665912 - DNA, 22 bp, Homo sapiens
ggaagggcaataaaatctcagg

SEQ ID NO: 7665913 - DNA, 21 bp, Homo sapiens
ggaaggggtcctcccaacagt

SEQ ID NO: 7665914 - DNA, 21 bp, Homo sapiens
ggaaggggtcctcccaacagt

SEQ ID NO: 7665915 - DNA, 21 bp, Homo sapiens
ggaaggggtcctcccaacagt

SEQ ID NO: 7665916 - DNA, 22 bp, Homo sapiens
ggaagggcaaaagagatgaact

SEQ ID NO: 7665917 - DNA, 22 bp, Homo sapiens
ggaagggcaaaagagatgaact

SEQ ID NO: 7665918 - DNA, 22 bp, Homo sapiens
ggaagggcaaaagagatgaact

SEQ ID NO: 7665919 - DNA, 22 bp, Homo sapiens
ggaagggcaaaagagatgaact

SEQ ID NO: 7665920 - DNA, 22 bp, Homo sapiens
ggaagggcaaaagagatgaact

SEQ ID NO: 7665921 - DNA, 22 bp, Homo sapiens
ggaagggcaaaagagatgaact

SEQ ID NO: 7665922 - DNA, 22 bp, Homo sapiens
ggaagaaatctggttaagagat

SEQ ID NO: 7665923 - DNA, 22 bp, Homo sapiens
ggaagaaatctggttaagagat

SEQ ID NO: 7665924 - DNA, 22 bp, Homo sapiens
ggaagaaatctggttaagagat

SEQ ID NO: 7665925 - DNA, 22 bp, Homo sapiens
ggaagaaatctggttaagagat

SEQ ID NO: 7665926 - DNA, 22 bp, Homo sapiens
ggaagaaatctggttaagagat

SEQ ID NO: 7665927 - DNA, 22 bp, Homo sapiens
ggaagaaatgctcttctatgcg

SEQ ID NO: 7665928 - DNA, 22 bp, Homo sapiens
ggaagaaatctggttaagagat

SEQ ID NO: 7665929 - DNA, 22 bp, Homo sapiens
ggaagaaatgctcttctatgcg

SEQ ID NO: 7665930 - DNA, 22 bp, Homo sapiens
ggaagaaatgctcttctatgcg

SEQ ID NO: 7665931 - DNA, 22 bp, Homo sapiens
ggaagaaatgctcttctatgcg

SEQ ID NO: 7665932 - DNA, 22 bp, Homo sapiens
ggaagggagtagttggaatgca

SEQ ID NO: 7665933 - DNA, 22 bp, Homo sapiens
ggaagggagtagttggaatgca

SEQ ID NO: 7665934 - DNA, 22 bp, Homo sapiens
ggaagaaatgctcttctatgcg

SEQ ID NO: 7665935 - DNA, 22 bp, Homo sapiens
ggaagaaatgctcttctatgcg

SEQ ID NO: 7665936 - DNA, 22 bp, Homo sapiens
ggaagaaatgctcttctatgcg

SEQ ID NO: 7665937 - DNA, 22 bp, Homo sapiens
ggaagaaatgctcttctatgcg

SEQ ID NO: 7665938 - DNA, 22 bp, Homo sapiens
ggaagggagtagttggaatgca

SEQ ID NO: 7665939 - DNA, 22 bp, Homo sapiens
ggaagggagtagttggaatgca

SEQ ID NO: 7665940 - DNA, 22 bp, Homo sapiens
ggaagggagtagttggaatgca

SEQ ID NO: 7665941 - DNA, 22 bp, Homo sapiens
ggaagggagtagttggaatgca

SEQ ID NO: 7665942 - DNA, 22 bp, Homo sapiens
ggaagggagtagttggaatgca

SEQ ID NO: 7665943 - DNA, 22 bp, Homo sapiens
gcttacaaacaacagaaattaa

SEQ ID NO: 7665944 - DNA, 22 bp, Homo sapiens
gcttacaagatcgtgctccagt

SEQ ID NO: 7665945 - DNA, 22 bp, Homo sapiens
gcttaattctggctcagtttcc

SEQ ID NO: 7665946 - DNA, 22 bp, Homo sapiens
gcttacaaacaacagaaattaa

SEQ ID NO: 7665947 - DNA, 22 bp, Homo sapiens
gcttaattctggctcagtttcc

SEQ ID NO: 7665948 - DNA, 22 bp, Homo sapiens
gcttaattctggctcagtttcc

SEQ ID NO: 7665949 - DNA, 22 bp, Homo sapiens
gcttaattctggctcagtttcc

SEQ ID NO: 7665950 - DNA, 22 bp, Homo sapiens
gctgggctggaaggccaaggca

SEQ ID NO: 7665951 - DNA, 22 bp, Homo sapiens
gctgggctggaaggccaaggca

SEQ ID NO: 7665952 - DNA, 22 bp, Homo sapiens
gctgggctggaaggccaaggca

SEQ ID NO: 7665953 - DNA, 22 bp, Homo sapiens
gcttaaggaattggagagtctg

SEQ ID NO: 7665954 - DNA, 22 bp, Homo sapiens
gcttaattctggctcagtttcc

SEQ ID NO: 7665955 - DNA, 22 bp, Homo sapiens
gcttaattctggctcagtttcc

SEQ ID NO: 7665956 - DNA, 22 bp, Homo sapiens
gctgggctggaaggccaaggca

SEQ ID NO: 7665957 - DNA, 22 bp, Homo sapiens
gctgggctgcgtcggggaagcc

SEQ ID NO: 7665958 - DNA, 22 bp, Homo sapiens
gctgggctgcccaacctctgac

SEQ ID NO: 7665959 - DNA, 22 bp, Homo sapiens
gctgggctgcccaacctctgac

SEQ ID NO: 7665960 - DNA, 22 bp, Homo sapiens
gctgggctgcccaacctctgac

SEQ ID NO: 7665961 - DNA, 22 bp, Homo sapiens
gctgggctgagctagacttggc

SEQ ID NO: 7665962 - DNA, 22 bp, Homo sapiens
gctgggctgagctagacttggc

SEQ ID NO: 7665963 - DNA, 22 bp, Homo sapiens
gctgggctgagctagacttggc

SEQ ID NO: 7665964 - DNA, 22 bp, Homo sapiens
gctgggctgcccaacctctgac

SEQ ID NO: 7665965 - DNA, 22 bp, Homo sapiens
gctgggctgcccaacctctgac

SEQ ID NO: 7665966 - DNA, 22 bp, Homo sapiens
gctgggctgcgtcggggaagcc

SEQ ID NO: 7665967 - DNA, 22 bp, Homo sapiens
gctgggctgcgtcggggaagcc

SEQ ID NO: 7665968 - DNA, 22 bp, Homo sapiens
gctgggctgcgtcggggaagcc

SEQ ID NO: 7665969 - DNA, 22 bp, Homo sapiens
gctgggctgcgtcggggaagcc

SEQ ID NO: 7665970 - DNA, 22 bp, Homo sapiens
gctgggctgcgtcggggaagcc

SEQ ID NO: 7665971 - DNA, 22 bp, Homo sapiens
gcttagaagtacacatgccttt

SEQ ID NO: 7665972 - DNA, 22 bp, Homo sapiens
gcttagaagttcctataaaatg

SEQ ID NO: 7665973 - DNA, 22 bp, Homo sapiens
gcttagcctggactggtgagca

SEQ ID NO: 7665974 - DNA, 22 bp, Homo sapiens
gcttacagataatgaggagact

SEQ ID NO: 7665975 - DNA, 22 bp, Homo sapiens
gcttacaggtgaggcagcaaga

SEQ ID NO: 7665976 - DNA, 22 bp, Homo sapiens
gcttacaatcatttcagtttag

SEQ ID NO: 7665977 - DNA, 22 bp, Homo sapiens
gcttagaaagtgattgatacat

SEQ ID NO: 7665978 - DNA, 22 bp, Homo sapiens
gcttacaggtgaggcagcaaga

SEQ ID NO: 7665979 - DNA, 22 bp, Homo sapiens
gcttatgatgtttacataaaag

SEQ ID NO: 7665980 - DNA, 16 bp, Homo sapiens
gcttagtgagagcaac

SEQ ID NO: 7665981 - DNA, 22 bp, Homo sapiens
gcttagtggtgtgcaaaggggt

SEQ ID NO: 7665982 - DNA, 22 bp, Homo sapiens
gcttagtgtaggacctggaata

SEQ ID NO: 7665983 - DNA, 22 bp, Homo sapiens
gcttagtttaggacaattttct

SEQ ID NO: 7665984 - DNA, 22 bp, Homo sapiens
gcttattttcaccttctctcag

SEQ ID NO: 7665985 - DNA, 22 bp, Homo sapiens
gcttattttatcctattcacta

SEQ ID NO: 7665986 - DNA, 22 bp, Homo sapiens
gcttagtgaaacaacctttggc

SEQ ID NO: 7665987 - DNA, 22 bp, Homo sapiens
gcttagtcaattataaataggc

SEQ ID NO: 7665988 - DNA, 22 bp, Homo sapiens
gcttagtcctagtgtactaaat

SEQ ID NO: 7665989 - DNA, 22 bp, Homo sapiens
gcttagtcaattataaataggc

SEQ ID NO: 7665990 - DNA, 22 bp, Homo sapiens
gcttagtccccaagagagacca

SEQ ID NO: 7665991 - DNA, 22 bp, Homo sapiens
gcttagtcaattataaataggc

SEQ ID NO: 7665992 - DNA, 22 bp, Homo sapiens
gcttaggaaaatggtggagttg

SEQ ID NO: 7665993 - DNA, 22 bp, Homo sapiens
gctgggctgagctagacttggc

SEQ ID NO: 7665994 - DNA, 22 bp, Homo sapiens
gctgggctgagctagacttggc

SEQ ID NO: 7665995 - DNA, 22 bp, Homo sapiens
gctgggctgagctagacttggc

SEQ ID NO: 7665996 - DNA, 22 bp, Homo sapiens
gctgggctctttacccctgtac

SEQ ID NO: 7665997 - DNA, 22 bp, Homo sapiens
gctgggctctttacccctgtac

SEQ ID NO: 7665998 - DNA, 22 bp, Homo sapiens
gctgggctgagaagttaagcaa

SEQ ID NO: 7665999 - DNA, 22 bp, Homo sapiens
gctgggctgagaagttaagcaa

SEQ ID NO: 7666000 - DNA, 22 bp, Homo sapiens
gctgggctgagaagttaagcaa

SEQ ID NO: 7666001 - DNA, 22 bp, Homo sapiens
gctgggctgagaagttaagcaa

SEQ ID NO: 7666002 - DNA, 22 bp, Homo sapiens
gctgggctctttacccctgtac

SEQ ID NO: 7666003 - DNA, 22 bp, Homo sapiens
gctgggctctttacccctgtac

SEQ ID NO: 7666004 - DNA, 22 bp, Homo sapiens
gctgggctctttacccctgtac

SEQ ID NO: 7666005 - DNA, 22 bp, Homo sapiens
gctgggctcttatcacctgtac

SEQ ID NO: 7666006 - DNA, 22 bp, Homo sapiens
gctgggctcttatcacctgtac

SEQ ID NO: 7666007 - DNA, 22 bp, Homo sapiens
gctgggctcttatcacctgtac

SEQ ID NO: 7666008 - DNA, 22 bp, Homo sapiens
gctgggctctgtcatgccttcc

SEQ ID NO: 7666009 - DNA, 22 bp, Homo sapiens
gctgggctcgttcccacacgcg

SEQ ID NO: 7666010 - DNA, 22 bp, Homo sapiens
gctgggctcgttcccacacgcg

SEQ ID NO: 7666011 - DNA, 22 bp, Homo sapiens
gctgggctctgtcatgccttcc

SEQ ID NO: 7666012 - DNA, 22 bp, Homo sapiens
gctgggctctgtcatgccttcc

SEQ ID NO: 7666013 - DNA, 22 bp, Homo sapiens
gctgggctctgtcatgccttcc

SEQ ID NO: 7666014 - DNA, 21 bp, Homo sapiens
gctgggctccagtctgccgct

SEQ ID NO: 7666015 - DNA, 21 bp, Homo sapiens
gctgggctccagtctgccgct

SEQ ID NO: 7666016 - DNA, 22 bp, Homo sapiens
gctgggctcgttcccacacgcg

SEQ ID NO: 7666017 - DNA, 22 bp, Homo sapiens
gctgggctcgttcccacacgcg

SEQ ID NO: 7666018 - DNA, 21 bp, Homo sapiens
gctgggctccagtctgccgct

SEQ ID NO: 7666019 - DNA, 21 bp, Homo sapiens
gctgggctccagtctgccgct

SEQ ID NO: 7666020 - DNA, 21 bp, Homo sapiens
gctgggctccagtctgccgct

SEQ ID NO: 7666021 - DNA, 22 bp, Homo sapiens
gctgggccagagcagcagcact

SEQ ID NO: 7666022 - DNA, 22 bp, Homo sapiens
gctgggccagagcagcagcact

SEQ ID NO: 7666023 - DNA, 22 bp, Homo sapiens
gctgggccagagcagcagcact

SEQ ID NO: 7666024 - DNA, 22 bp, Homo sapiens
gctgggccagactttcaatgtc

SEQ ID NO: 7666025 - DNA, 22 bp, Homo sapiens
gctgggccagactttcaatgtc

SEQ ID NO: 7666026 - DNA, 22 bp, Homo sapiens
gctgggccagactttcaatgtc

SEQ ID NO: 7666027 - DNA, 22 bp, Homo sapiens
gctgggccagactttcaatgtc

SEQ ID NO: 7666028 - DNA, 22 bp, Homo sapiens
gctgggccagactttcaatgtc

SEQ ID NO: 7666029 - DNA, 22 bp, Homo sapiens
gctgggccagactttcaatgtc

SEQ ID NO: 7666030 - DNA, 22 bp, Homo sapiens
gctgggcatgtgaccaacagaa

SEQ ID NO: 7666031 - DNA, 22 bp, Homo sapiens
gctgggcatgtgaccaacagaa

SEQ ID NO: 7666032 - DNA, 22 bp, Homo sapiens
gctgggcatgtgaccaacagaa

SEQ ID NO: 7666033 - DNA, 22 bp, Homo sapiens
gctgggcatgtgaccaacagaa

SEQ ID NO: 7666034 - DNA, 22 bp, Homo sapiens
gctgggctcagacctagtgaac

SEQ ID NO: 7666035 - DNA, 22 bp, Homo sapiens
gctgggctcagacctagtgaac

SEQ ID NO: 7666036 - DNA, 22 bp, Homo sapiens
gctgggccagagcagcagcact

SEQ ID NO: 7666037 - DNA, 22 bp, Homo sapiens
gctgggctcatttgtgtgtctg

SEQ ID NO: 7666038 - DNA, 22 bp, Homo sapiens
gctgggctccaccctcaactgt

SEQ ID NO: 7666039 - DNA, 22 bp, Homo sapiens
gctgggctccaccctcaactgt

SEQ ID NO: 7666040 - DNA, 22 bp, Homo sapiens
gctgggctccaccctcaactgt

SEQ ID NO: 7666041 - DNA, 22 bp, Homo sapiens
gctgggctcatttgtgtgtctg

SEQ ID NO: 7666042 - DNA, 22 bp, Homo sapiens
gctgggctcatttgtgtgtctg

SEQ ID NO: 7666043 - DNA, 22 bp, Homo sapiens
gctgggctcatttgtgtgtctg

SEQ ID NO: 7666044 - DNA, 22 bp, Homo sapiens
gctgggctcatttgtgtgtctg

SEQ ID NO: 7666045 - DNA, 22 bp, Homo sapiens
gctgggctcatttgtgtgtctg

SEQ ID NO: 7666046 - DNA, 22 bp, Homo sapiens
gctgggctccaggccagggtga

SEQ ID NO: 7666047 - DNA, 22 bp, Homo sapiens
gctgggctccaggccagggtga

SEQ ID NO: 7666048 - DNA, 22 bp, Homo sapiens
gctgggctccaggccagggtga

SEQ ID NO: 7666049 - DNA, 22 bp, Homo sapiens
gctgggctccaggccagggtga

SEQ ID NO: 7666050 - DNA, 22 bp, Homo sapiens
gctgggctccaggccagggtga

SEQ ID NO: 7666051 - DNA, 22 bp, Homo sapiens
gctgggctccaccctcaactgt

SEQ ID NO: 7666052 - DNA, 22 bp, Homo sapiens
gctgggctccaccctcaactgt

SEQ ID NO: 7666053 - DNA, 22 bp, Homo sapiens
gctgggctccaggccagggtga

SEQ ID NO: 7666054 - DNA, 22 bp, Homo sapiens
gctgggctccaggccagggtga

SEQ ID NO: 7666055 - DNA, 22 bp, Homo sapiens
gcttcagattcctcttctgtaa

SEQ ID NO: 7666056 - DNA, 22 bp, Homo sapiens
gcttcagattcttttcatgtct

SEQ ID NO: 7666057 - DNA, 22 bp, Homo sapiens
gcttcagattcttttcatgtct

SEQ ID NO: 7666058 - DNA, 22 bp, Homo sapiens
gcttcagattcttttcatgtct

SEQ ID NO: 7666059 - DNA, 22 bp, Homo sapiens
gcttcagatttatgtatcattg

SEQ ID NO: 7666060 - DNA, 21 bp, Homo sapiens
gcttcagcaaggcttgctggt

SEQ ID NO: 7666061 - DNA, 22 bp, Homo sapiens
gcttcagaagttgggctctgac

SEQ ID NO: 7666062 - DNA, 22 bp, Homo sapiens
gcttcagacctgaaaggaaaaa

SEQ ID NO: 7666063 - DNA, 22 bp, Homo sapiens
gcttcagactggagcagaggaa

SEQ ID NO: 7666064 - DNA, 22 bp, Homo sapiens
gcttcagactggagcagaggaa

SEQ ID NO: 7666065 - DNA, 22 bp, Homo sapiens
gcttcagactggagcagaggaa

SEQ ID NO: 7666066 - DNA, 22 bp, Homo sapiens
gcttcagactggagcagaggaa

SEQ ID NO: 7666067 - DNA, 22 bp, Homo sapiens
gcttcagactgtgcttctgttg

SEQ ID NO: 7666068 - DNA, 22 bp, Homo sapiens
gcttcagactgtgcttctgttg

SEQ ID NO: 7666069 - DNA, 22 bp, Homo sapiens
gcttcagagatttcactagttt

SEQ ID NO: 7666070 - DNA, 22 bp, Homo sapiens
gcttcagattcctcttctgtaa

SEQ ID NO: 7666071 - DNA, 22 bp, Homo sapiens
gcttcaaattaaggtgaatccc

SEQ ID NO: 7666072 - DNA, 22 bp, Homo sapiens
gcttcaagctgttcagaactat

SEQ ID NO: 7666073 - DNA, 22 bp, Homo sapiens
gcttcaagctgttcagaactat

SEQ ID NO: 7666074 - DNA, 22 bp, Homo sapiens
gcttcaaggccaagacacctta

SEQ ID NO: 7666075 - DNA, 22 bp, Homo sapiens
gcttcaaggccaagacacctta

SEQ ID NO: 7666076 - DNA, 22 bp, Homo sapiens
gcttcacaacttcttaattctt

SEQ ID NO: 7666077 - DNA, 22 bp, Homo sapiens
gcttcacactaaaaatgttaaa

SEQ ID NO: 7666078 - DNA, 22 bp, Homo sapiens
gcttattttcaccttctctcag

SEQ ID NO: 7666079 - DNA, 22 bp, Homo sapiens
gcttattttcaccttctctcag

SEQ ID NO: 7666080 - DNA, 20 bp, Homo sapiens
gcttcagaacctgggtgctg

SEQ ID NO: 7666081 - DNA, 20 bp, Homo sapiens
gcttcagaacctgggtgctg

SEQ ID NO: 7666082 - DNA, 22 bp, Homo sapiens
gcttcagaaatgaacactgtct

SEQ ID NO: 7666083 - DNA, 20 bp, Homo sapiens
gcttcagaacctgggtgctg

SEQ ID NO: 7666084 - DNA, 22 bp, Homo sapiens
gcttcagaagttgggctctgac

SEQ ID NO: 7666085 - DNA, 22 bp, Homo sapiens
gcttcagaagttgggctctgac

SEQ ID NO: 7666086 - DNA, 22 bp, Homo sapiens
gcttcagaagttgggctctgac

SEQ ID NO: 7666087 - DNA, 22 bp, Homo sapiens
gcttcacagaatcaatagttgg

SEQ ID NO: 7666088 - DNA, 22 bp, Homo sapiens
gcttcctggagggagagagctg

SEQ ID NO: 7666089 - DNA, 22 bp, Homo sapiens
gcttcctggagggagagagctg

SEQ ID NO: 7666090 - DNA, 22 bp, Homo sapiens
gcttcctggagggagagagctg

SEQ ID NO: 7666091 - DNA, 22 bp, Homo sapiens
gcttcatttgagaacctctgtg

SEQ ID NO: 7666092 - DNA, 22 bp, Homo sapiens
gcttcctggaacaactgttgct

SEQ ID NO: 7666093 - DNA, 22 bp, Homo sapiens
gcttcatttctctctgtagacc

SEQ ID NO: 7666094 - DNA, 22 bp, Homo sapiens
gcttcattactgacagtctgtg

SEQ ID NO: 7666095 - DNA, 22 bp, Homo sapiens
gcttcatttctctctgtagacc

SEQ ID NO: 7666096 - DNA, 22 bp, Homo sapiens
gcttcatttctctctgtagacc

SEQ ID NO: 7666097 - DNA, 22 bp, Homo sapiens
gcttcatttgagaacctctgtg

SEQ ID NO: 7666098 - DNA, 22 bp, Homo sapiens
gcttcctgggacaggctatgtg

SEQ ID NO: 7666099 - DNA, 22 bp, Homo sapiens
gcttcctgggacaggctatgtg

SEQ ID NO: 7666100 - DNA, 22 bp, Homo sapiens
gcttcctgggacaggctatgtg

SEQ ID NO: 7666101 - DNA, 22 bp, Homo sapiens
gcttcctgggacaggctatgtg

SEQ ID NO: 7666102 - DNA, 22 bp, Homo sapiens
gcttcctggagggagagagctg

SEQ ID NO: 7666103 - DNA, 22 bp, Homo sapiens
gcttcctggagggagagagctg

SEQ ID NO: 7666104 - DNA, 22 bp, Homo sapiens
gcttcctggagggagagagctg

SEQ ID NO: 7666105 - DNA, 22 bp, Homo sapiens
gcttcctggagggagagagctg

SEQ ID NO: 7666106 - DNA, 22 bp, Homo sapiens
gcttcctggagggagagagctg

SEQ ID NO: 7666107 - DNA, 22 bp, Homo sapiens
gcttcagggttatgcaagagtg

SEQ ID NO: 7666108 - DNA, 22 bp, Homo sapiens
gcttcaggctgaattcctccta

SEQ ID NO: 7666109 - DNA, 20 bp, Homo sapiens
gcttcagtttcctcactggt

SEQ ID NO: 7666110 - DNA, 22 bp, Homo sapiens
gcttcagcctcacactgatatc

SEQ ID NO: 7666111 - DNA, 22 bp, Homo sapiens
gcttcagcccatcccagtacat

SEQ ID NO: 7666112 - DNA, 22 bp, Homo sapiens
gcttcattaatagaattagtat

SEQ ID NO: 7666113 - DNA, 22 bp, Homo sapiens
gcttcattaactcagagttttg

SEQ ID NO: 7666114 - DNA, 22 bp, Homo sapiens
gcttcattactgacagtctgtg

SEQ ID NO: 7666115 - DNA, 18 bp, Homo sapiens
gcttcatggaagggttgt

SEQ ID NO: 7666116 - DNA, 22 bp, Homo sapiens
gcttcatgggtgtgcaacctgt

SEQ ID NO: 7666117 - DNA, 22 bp, Homo sapiens
gcttcatgaaaatcactggtca

SEQ ID NO: 7666118 - DNA, 22 bp, Homo sapiens
gcttcatgcttgctccaaagct

SEQ ID NO: 7666119 - DNA, 22 bp, Homo sapiens
gcttcatgccaggaggtttaag

SEQ ID NO: 7666120 - DNA, 22 bp, Homo sapiens
gcttcatacaatggtatatgca

SEQ ID NO: 7666121 - DNA, 22 bp, Homo sapiens
gcttcatacaatggtatatgca

SEQ ID NO: 7666122 - DNA, 22 bp, Homo sapiens
gcttcatagcattcattgcctg

SEQ ID NO: 7666123 - DNA, 22 bp, Homo sapiens
gcttccttctaccacatcatgc

SEQ ID NO: 7666124 - DNA, 22 bp, Homo sapiens
gcttccttgggaaaattagatg

SEQ ID NO: 7666125 - DNA, 22 bp, Homo sapiens
gcttccttggtcctggtctaag

SEQ ID NO: 7666126 - DNA, 22 bp, Homo sapiens
gcttccttggtcctggtctaag

SEQ ID NO: 7666127 - DNA, 22 bp, Homo sapiens
gcttccttggtcctggtctaag

SEQ ID NO: 7666128 - DNA, 22 bp, Homo sapiens
gcttcggggtccaagcgcgtgt

SEQ ID NO: 7666129 - DNA, 22 bp, Homo sapiens
gcttccttccttacattggtgg

SEQ ID NO: 7666130 - DNA, 22 bp, Homo sapiens
gcttccttattgttgccatagt

SEQ ID NO: 7666131 - DNA, 22 bp, Homo sapiens
gcttccttattgttgccatagt

SEQ ID NO: 7666132 - DNA, 17 bp, Homo sapiens
gcttcctgtgctgggga

SEQ ID NO: 7666133 - DNA, 22 bp, Homo sapiens
gcttcctgtaggcaggtccaag

SEQ ID NO: 7666134 - DNA, 22 bp, Homo sapiens
gcttcctgtaggcaggtccaag

SEQ ID NO: 7666135 - DNA, 22 bp, Homo sapiens
gcttcctgtaggcaggtccaag

SEQ ID NO: 7666136 - DNA, 22 bp, Homo sapiens
gcttcctgtaggcaggtccaag

SEQ ID NO: 7666137 - DNA, 22 bp, Homo sapiens
gcttcctgtatcctcctgtacc

SEQ ID NO: 7666138 - DNA, 22 bp, Homo sapiens
gcttcctgtatcctcctgtacc

SEQ ID NO: 7666139 - DNA, 22 bp, Homo sapiens
gcttcctgtccaggccccacat

SEQ ID NO: 7666140 - DNA, 22 bp, Homo sapiens
gcttcctgtatcctcctgtacc

SEQ ID NO: 7666141 - DNA, 22 bp, Homo sapiens
gcttcctgtccctcagccatga

SEQ ID NO: 7666142 - DNA, 22 bp, Homo sapiens
gcttcctgtccctcagccatga

SEQ ID NO: 7666143 - DNA, 22 bp, Homo sapiens
gcttcctgtccctcagccatga

SEQ ID NO: 7666144 - DNA, 17 bp, Homo sapiens
gcttcctgtgctgggga

SEQ ID NO: 7666145 - DNA, 22 bp, Homo sapiens
gcttctatcctaccatgtcttg

SEQ ID NO: 7666146 - DNA, 22 bp, Homo sapiens
gcttctatccctccactgcact

SEQ ID NO: 7666147 - DNA, 22 bp, Homo sapiens
gcttctcaattctcaccctcca

SEQ ID NO: 7666148 - DNA, 22 bp, Homo sapiens
gcttctatcctaccatgtcttg

SEQ ID NO: 7666149 - DNA, 20 bp, Homo sapiens
gcttctcagggcttctctga

SEQ ID NO: 7666150 - DNA, 22 bp, Homo sapiens
gcttctgatgtcagacttctgg

SEQ ID NO: 7666151 - DNA, 22 bp, Homo sapiens
gcttctaattcactttgggaag

SEQ ID NO: 7666152 - DNA, 22 bp, Homo sapiens
gcttctagggaaggcagtcaca

SEQ ID NO: 7666153 - DNA, 22 bp, Homo sapiens
gcttctaattttttacagaata

SEQ ID NO: 7666154 - DNA, 22 bp, Homo sapiens
gcttctacccacgagatgcaaa

SEQ ID NO: 7666155 - DNA, 22 bp, Homo sapiens
gcttctaacctgcttcctgtag

SEQ ID NO: 7666156 - DNA, 22 bp, Homo sapiens
gcttcggggtccaagcgcgtgt

SEQ ID NO: 7666157 - DNA, 22 bp, Homo sapiens
gcttcgttgattttattataaa

SEQ ID NO: 7666158 - DNA, 22 bp, Homo sapiens
gcttctaacctgcttcctgtag

SEQ ID NO: 7666159 - DNA, 22 bp, Homo sapiens
gcttctggaagcatatgcaaga

SEQ ID NO: 7666160 - DNA, 22 bp, Homo sapiens
gcttctgccttgcactttgtca

SEQ ID NO: 7666161 - DNA, 22 bp, Homo sapiens
gcttctgcgcacgcttcttccc

SEQ ID NO: 7666162 - DNA, 23 bp, Homo sapiens
gcttctgccatttgctagctgtg

SEQ ID NO: 7666163 - DNA, 23 bp, Homo sapiens
gcttctgccatttgctagctgtg

SEQ ID NO: 7666164 - DNA, 22 bp, Homo sapiens
gcttctgcagccaaagaagccg

SEQ ID NO: 7666165 - DNA, 22 bp, Homo sapiens
gggaccaggtgggtgcattccg

SEQ ID NO: 7666166 - DNA, 22 bp, Homo sapiens
gggaccaggtgggtgcattccg

SEQ ID NO: 7666167 - DNA, 22 bp, Homo sapiens
gggaccaggtcagggctctgac

SEQ ID NO: 7666168 - DNA, 22 bp, Homo sapiens
gggaccaggtcagggctctgac

SEQ ID NO: 7666169 - DNA, 22 bp, Homo sapiens
gggaccaggtcagggctctgac

SEQ ID NO: 7666170 - DNA, 22 bp, Homo sapiens
gggaccagtgtctgtgagaaaa

SEQ ID NO: 7666171 - DNA, 22 bp, Homo sapiens
gggaccagtgtctgtgagaaaa

SEQ ID NO: 7666172 - DNA, 22 bp, Homo sapiens
gggaccagtgtctgtgagaaaa

SEQ ID NO: 7666173 - DNA, 22 bp, Homo sapiens
gggaccagtgtctgtgagaaaa

SEQ ID NO: 7666174 - DNA, 22 bp, Homo sapiens
gggaccagtgtctgtgagaaaa

SEQ ID NO: 7666175 - DNA, 22 bp, Homo sapiens
gggaccctcaacatctgcttct

SEQ ID NO: 7666176 - DNA, 22 bp, Homo sapiens
gggaccctgggaggctggcgca

SEQ ID NO: 7666177 - DNA, 22 bp, Homo sapiens
gggacccaggtaatcctgtgct

SEQ ID NO: 7666178 - DNA, 22 bp, Homo sapiens
gggaccataactaggcatgatg

SEQ ID NO: 7666179 - DNA, 22 bp, Homo sapiens
gggacccacgaaaggctttgga

SEQ ID NO: 7666180 - DNA, 22 bp, Homo sapiens
gggacctgaggccctgctccac

SEQ ID NO: 7666181 - DNA, 22 bp, Homo sapiens
gggacctgaggccctgctccac

SEQ ID NO: 7666182 - DNA, 22 bp, Homo sapiens
gggacctgaggaggggtttcag

SEQ ID NO: 7666183 - DNA, 19 bp, Homo sapiens
gggacctgactaattggca

SEQ ID NO: 7666184 - DNA, 19 bp, Homo sapiens
gggacctgactaattggca

SEQ ID NO: 7666185 - DNA, 22 bp, Homo sapiens
gggaccctgggaggctggcgca

SEQ ID NO: 7666186 - DNA, 22 bp, Homo sapiens
gggacctgcgccactcactgtc

SEQ ID NO: 7666187 - DNA, 22 bp, Homo sapiens
gggacctgcgccactcactgtc

SEQ ID NO: 7666188 - DNA, 22 bp, Homo sapiens
gggacctgcgccactcactgtc

SEQ ID NO: 7666189 - DNA, 22 bp, Homo sapiens
gggacctggacatgtgtgtgct

SEQ ID NO: 7666190 - DNA, 22 bp, Homo sapiens
gggacctgaggccctgctccac

SEQ ID NO: 7666191 - DNA, 22 bp, Homo sapiens
gggacctgaggccctgctccac

SEQ ID NO: 7666192 - DNA, 22 bp, Homo sapiens
gggacctgccaaggccacccag

SEQ ID NO: 7666193 - DNA, 22 bp, Homo sapiens
gggacctgccattgctcacagg

SEQ ID NO: 7666194 - DNA, 22 bp, Homo sapiens
gggacctgccattgctcacagg

SEQ ID NO: 7666195 - DNA, 22 bp, Homo sapiens
gggacgacaggctctgtggtag

SEQ ID NO: 7666196 - DNA, 22 bp, Homo sapiens
gggacctggtctagcactgagc

SEQ ID NO: 7666197 - DNA, 22 bp, Homo sapiens
gggacctggtctagcactgagc

SEQ ID NO: 7666198 - DNA, 22 bp, Homo sapiens
gggacctggtctagcactgagc

SEQ ID NO: 7666199 - DNA, 23 bp, Homo sapiens
gggacctggtaggaggtgattgg

SEQ ID NO: 7666200 - DNA, 22 bp, Homo sapiens
gggacctgggccagaggacagt

SEQ ID NO: 7666201 - DNA, 22 bp, Homo sapiens
gggacctgggccagaggacagt

SEQ ID NO: 7666202 - DNA, 22 bp, Homo sapiens
gggacctggcgagggtcacaca

SEQ ID NO: 7666203 - DNA, 22 bp, Homo sapiens
gggacctggcgagggtcacaca

SEQ ID NO: 7666204 - DNA, 22 bp, Homo sapiens
gggacctgggccagaggacagt

SEQ ID NO: 7666205 - DNA, 22 bp, Homo sapiens
gggacctggggactccttgttc

SEQ ID NO: 7666206 - DNA, 22 bp, Homo sapiens
gggacctggggactccttgttc

SEQ ID NO: 7666207 - DNA, 22 bp, Homo sapiens
gggacctggggactccttgttc

SEQ ID NO: 7666208 - DNA, 22 bp, Homo sapiens
gggactccaaaactgtacccaa

SEQ ID NO: 7666209 - DNA, 22 bp, Homo sapiens
gggactccagggccactgggcc

SEQ ID NO: 7666210 - DNA, 22 bp, Homo sapiens
gggactccagggccactgggcc

SEQ ID NO: 7666211 - DNA, 17 bp, Homo sapiens
gggactcaagatggggt

SEQ ID NO: 7666212 - DNA, 22 bp, Homo sapiens
gggactccataagcacatggat

SEQ ID NO: 7666213 - DNA, 22 bp, Homo sapiens
gggactccataagcacatggat

SEQ ID NO: 7666214 - DNA, 17 bp, Homo sapiens
gggactcaagatggggt

SEQ ID NO: 7666215 - DNA, 22 bp, Homo sapiens
gggacgtgagtgaagaaggtct

SEQ ID NO: 7666216 - DNA, 22 bp, Homo sapiens
gggacgggcagtccaaggggtc

SEQ ID NO: 7666217 - DNA, 22 bp, Homo sapiens
gggagaaggagctagttcttga

SEQ ID NO: 7666218 - DNA, 22 bp, Homo sapiens
gggagaagaatgtgtcaattgt

SEQ ID NO: 7666219 - DNA, 22 bp, Homo sapiens
gggagaagaatgtgtcaattgt

SEQ ID NO: 7666220 - DNA, 22 bp, Homo sapiens
gggagaactgggtggagcatct

SEQ ID NO: 7666221 - DNA, 22 bp, Homo sapiens
gggagaaatgtctggcctgctg

SEQ ID NO: 7666222 - DNA, 22 bp, Homo sapiens
gggagaaatgtctggcctgctg

SEQ ID NO: 7666223 - DNA, 22 bp, Homo sapiens
gggactccataagcacatggat

SEQ ID NO: 7666224 - DNA, 22 bp, Homo sapiens
gggagaaatgtctggcctgctg

SEQ ID NO: 7666225 - DNA, 22 bp, Homo sapiens
gggagaaatgtctggcctgctg

SEQ ID NO: 7666226 - DNA, 22 bp, Homo sapiens
gggagaaatgtctggcctgctg

SEQ ID NO: 7666227 - DNA, 22 bp, Homo sapiens
gggacgagccccaggctggagg

SEQ ID NO: 7666228 - DNA, 22 bp, Homo sapiens
gggacgagatcttggcagtgtg

SEQ ID NO: 7666229 - DNA, 22 bp, Homo sapiens
gggacgagatcttggcagtgtg

SEQ ID NO: 7666230 - DNA, 22 bp, Homo sapiens
gggacgacaggctctgtggtag

SEQ ID NO: 7666231 - DNA, 22 bp, Homo sapiens
gggacgagatcttggcagtgtg

SEQ ID NO: 7666232 - DNA, 22 bp, Homo sapiens
gggacgagatcttggcagtgtg

SEQ ID NO: 7666233 - DNA, 22 bp, Homo sapiens
gggacgagatcttggcagtgtg

SEQ ID NO: 7666234 - DNA, 22 bp, Homo sapiens
gggacgagatcttggcagtgtg

SEQ ID NO: 7666235 - DNA, 22 bp, Homo sapiens
gggacgagatcttggcagtgtg

SEQ ID NO: 7666236 - DNA, 22 bp, Homo sapiens
gggacgacaggctctgtggtag

SEQ ID NO: 7666237 - DNA, 22 bp, Homo sapiens
gggacgacaggctctgtggtag

SEQ ID NO: 7666238 - DNA, 22 bp, Homo sapiens
gggacgacaggctctgtggtag

SEQ ID NO: 7666239 - DNA, 22 bp, Homo sapiens
gggacgggcacggagggccctc

SEQ ID NO: 7666240 - DNA, 22 bp, Homo sapiens
gggacgggcacggagggccctc

SEQ ID NO: 7666241 - DNA, 22 bp, Homo sapiens
gggacgggcacggagggccctc

SEQ ID NO: 7666242 - DNA, 22 bp, Homo sapiens
gggacgggcacggagggccctc

SEQ ID NO: 7666243 - DNA, 22 bp, Homo sapiens
gggacgggcagtccaaggggtc

SEQ ID NO: 7666244 - DNA, 22 bp, Homo sapiens
gggacgggcagtccaaggggtc

SEQ ID NO: 7666245 - DNA, 22 bp, Homo sapiens
gggacgggcagtccaaggggtc

SEQ ID NO: 7666246 - DNA, 22 bp, Homo sapiens
gggacgagccccaggctggagg

SEQ ID NO: 7666247 - DNA, 22 bp, Homo sapiens
gggacgggcacggagggccctc

SEQ ID NO: 7666248 - DNA, 22 bp, Homo sapiens
gggacgagccccaggctggagg

SEQ ID NO: 7666249 - DNA, 22 bp, Homo sapiens
gggacgagccccaggctggagg

SEQ ID NO: 7666250 - DNA, 22 bp, Homo sapiens
gggacgggcacggagggccctc

SEQ ID NO: 7666251 - DNA, 18 bp, Homo sapiens
gggaggccccagcaggag

SEQ ID NO: 7666252 - DNA, 18 bp, Homo sapiens
gggaggccccagcaggag

SEQ ID NO: 7666253 - DNA, 18 bp, Homo sapiens
gggaggccccagcaggag

SEQ ID NO: 7666254 - DNA, 20 bp, Homo sapiens
gggaggccccagagtccagg

SEQ ID NO: 7666255 - DNA, 18 bp, Homo sapiens
gggaggccccagcaggag

SEQ ID NO: 7666256 - DNA, 18 bp, Homo sapiens
gggaggccccagcaggag

SEQ ID NO: 7666257 - DNA, 18 bp, Homo sapiens
gggaggccccagcaggag

SEQ ID NO: 7666258 - DNA, 20 bp, Homo sapiens
gggaggcgagggctgagcag

SEQ ID NO: 7666259 - DNA, 20 bp, Homo sapiens
gggaggcgagggctgagcag

SEQ ID NO: 7666260 - DNA, 20 bp, Homo sapiens
gggaggcgagggctgagcag

SEQ ID NO: 7666261 - DNA, 17 bp, Homo sapiens
gggaggccttggtttcc

SEQ ID NO: 7666262 - DNA, 20 bp, Homo sapiens
gggaggcgagggctgagcag

SEQ ID NO: 7666263 - DNA, 22 bp, Homo sapiens
gggaggcgccgagggtagctaa

SEQ ID NO: 7666264 - DNA, 17 bp, Homo sapiens
gggaggccttggtttcc

SEQ ID NO: 7666265 - DNA, 20 bp, Homo sapiens
gggaggcgagggctgagcag

SEQ ID NO: 7666266 - DNA, 22 bp, Homo sapiens
gggaggcgccgagggtagctaa

SEQ ID NO: 7666267 - DNA, 22 bp, Homo sapiens
gggaggcgccgagggtagctaa

SEQ ID NO: 7666268 - DNA, 22 bp, Homo sapiens
gggaggcgccgagggtagctaa

SEQ ID NO: 7666269 - DNA, 22 bp, Homo sapiens
gggaggcgccgagggtagctaa

SEQ ID NO: 7666270 - DNA, 22 bp, Homo sapiens
gggaggctcagtggtgtcctct

SEQ ID NO: 7666271 - DNA, 22 bp, Homo sapiens
gggaggctcagtggtgtcctct

SEQ ID NO: 7666272 - DNA, 22 bp, Homo sapiens
gggaggctcagtggtgtcctct

SEQ ID NO: 7666273 - DNA, 22 bp, Homo sapiens
gggaggctctgctcagcccccg

SEQ ID NO: 7666274 - DNA, 22 bp, Homo sapiens
gggaggctctgctcagcccccg

SEQ ID NO: 7666275 - DNA, 22 bp, Homo sapiens
gggaggctctgctcagcccccg

SEQ ID NO: 7666276 - DNA, 22 bp, Homo sapiens
gggaggctgccatccttcagga

SEQ ID NO: 7666277 - DNA, 22 bp, Homo sapiens
gggaggctgccatccttcagga

SEQ ID NO: 7666278 - DNA, 22 bp, Homo sapiens
gggaggctctgctcagcccccg

SEQ ID NO: 7666279 - DNA, 22 bp, Homo sapiens
gggaggctgccatccttcagga

SEQ ID NO: 7666280 - DNA, 22 bp, Homo sapiens
gggaggctgccatccttcagga

SEQ ID NO: 7666281 - DNA, 22 bp, Homo sapiens
gggaggctggctctggccacag

SEQ ID NO: 7666282 - DNA, 22 bp, Homo sapiens
gggaggctgccatccttcagga

SEQ ID NO: 7666283 - DNA, 22 bp, Homo sapiens
gggaggctgccatccttcagga

SEQ ID NO: 7666284 - DNA, 22 bp, Homo sapiens
gggaggctgccatccttcagga

SEQ ID NO: 7666285 - DNA, 22 bp, Homo sapiens
gggagaaggaggactgtgctgt

SEQ ID NO: 7666286 - DNA, 22 bp, Homo sapiens
gggagaaggaggactgtgctgt

SEQ ID NO: 7666287 - DNA, 22 bp, Homo sapiens
gggagaaggaggactgtgctgt

SEQ ID NO: 7666288 - DNA, 20 bp, Homo sapiens
gggagaagggctgatgagag

SEQ ID NO: 7666289 - DNA, 20 bp, Homo sapiens
gggagaagggctgatgagag

SEQ ID NO: 7666290 - DNA, 20 bp, Homo sapiens
gggagaagggctgatgagag

SEQ ID NO: 7666291 - DNA, 20 bp, Homo sapiens
gggagaagggctgatgagag

SEQ ID NO: 7666292 - DNA, 20 bp, Homo sapiens
gggagaagggctgatgagag

SEQ ID NO: 7666293 - DNA, 20 bp, Homo sapiens
gggagaagggctgatgagag

SEQ ID NO: 7666294 - DNA, 20 bp, Homo sapiens
gggagaagggctgatgagag

SEQ ID NO: 7666295 - DNA, 20 bp, Homo sapiens
gggagaagggctgatgagag

SEQ ID NO: 7666296 - DNA, 22 bp, Homo sapiens
gggagaaggagctagttcttga

SEQ ID NO: 7666297 - DNA, 22 bp, Homo sapiens
gggagaaggagctagttcttga

SEQ ID NO: 7666298 - DNA, 22 bp, Homo sapiens
gggagaaggagctagttcttga

SEQ ID NO: 7666299 - DNA, 22 bp, Homo sapiens
gggagaaggaggactgtgctgt

SEQ ID NO: 7666300 - DNA, 22 bp, Homo sapiens
gggagaaggaggactgtgctgt

SEQ ID NO: 7666301 - DNA, 22 bp, Homo sapiens
gggagaaggaggactgtgctgt

SEQ ID NO: 7666302 - DNA, 22 bp, Homo sapiens
gggagaaggaggactgtgctgt

SEQ ID NO: 7666303 - DNA, 22 bp, Homo sapiens
gggaggagcttggagattcact

SEQ ID NO: 7666304 - DNA, 20 bp, Homo sapiens
gggagaagggctgatgagag

SEQ ID NO: 7666305 - DNA, 22 bp, Homo sapiens
gggaggaggaatgttttgtgta

SEQ ID NO: 7666306 - DNA, 22 bp, Homo sapiens
gggaggaggaatgttttgtgta

SEQ ID NO: 7666307 - DNA, 22 bp, Homo sapiens
gggaggaggaatgttttgtgta

SEQ ID NO: 7666308 - DNA, 22 bp, Homo sapiens
gggaggagcttggagattcact

SEQ ID NO: 7666309 - DNA, 22 bp, Homo sapiens
gggaggagggtgctggctaaac

SEQ ID NO: 7666310 - DNA, 22 bp, Homo sapiens
gggaggagggtgctggctaaac

SEQ ID NO: 7666311 - DNA, 22 bp, Homo sapiens
gggaggagggtgctggctaaac

SEQ ID NO: 7666312 - DNA, 22 bp, Homo sapiens
gggaggagggtgctggctaaac

SEQ ID NO: 7666313 - DNA, 22 bp, Homo sapiens
gggaggagggtgctggctaaac

SEQ ID NO: 7666314 - DNA, 22 bp, Homo sapiens
gggaggagggtgctggctaaac

SEQ ID NO: 7666315 - DNA, 22 bp, Homo sapiens
gggaggagggtgctggctaaac

SEQ ID NO: 7666316 - DNA, 22 bp, Homo sapiens
gggaggagggtgctggctaaac

SEQ ID NO: 7666317 - DNA, 20 bp, Homo sapiens
gggaggccccagagtccagg

SEQ ID NO: 7666318 - DNA, 20 bp, Homo sapiens
gggaggccccagagtccagg

SEQ ID NO: 7666319 - DNA, 22 bp, Homo sapiens
gggcagaggggcgcttccctct

SEQ ID NO: 7666320 - DNA, 22 bp, Homo sapiens
gggcagaggggcgcttccctct

SEQ ID NO: 7666321 - DNA, 22 bp, Homo sapiens
gggcagaggggcgcttccctct

SEQ ID NO: 7666322 - DNA, 22 bp, Homo sapiens
gggcagaggggcgcttccctct

SEQ ID NO: 7666323 - DNA, 22 bp, Homo sapiens
gggcagaggggcgcttccctct

SEQ ID NO: 7666324 - DNA, 22 bp, Homo sapiens
gggcagaggggcgcttccctct

SEQ ID NO: 7666325 - DNA, 22 bp, Homo sapiens
gggcagaggggcgcttccctct

SEQ ID NO: 7666326 - DNA, 22 bp, Homo sapiens
gggatggggagctggaaagggg

SEQ ID NO: 7666327 - DNA, 22 bp, Homo sapiens
gggatggggagctggaaagggg

SEQ ID NO: 7666328 - DNA, 22 bp, Homo sapiens
gggatggggagctggaaagggg

SEQ ID NO: 7666329 - DNA, 22 bp, Homo sapiens
gggcagaggggcgcttccctct

SEQ ID NO: 7666330 - DNA, 22 bp, Homo sapiens
gggatggggagctggaaagggg

SEQ ID NO: 7666331 - DNA, 22 bp, Homo sapiens
gggatggggagctggaaagggg

SEQ ID NO: 7666332 - DNA, 19 bp, Homo sapiens
gggatgggccctcaccctc

SEQ ID NO: 7666333 - DNA, 22 bp, Homo sapiens
gggatggggagctggaaagggg

SEQ ID NO: 7666334 - DNA, 22 bp, Homo sapiens
gggatggggagctggaaagggg

SEQ ID NO: 7666335 - DNA, 22 bp, Homo sapiens
gggatgggagagcatttagaga

SEQ ID NO: 7666336 - DNA, 22 bp, Homo sapiens
gggatgggagagcatttagaga

SEQ ID NO: 7666337 - DNA, 22 bp, Homo sapiens
gggatgggagagcatttagaga

SEQ ID NO: 7666338 - DNA, 19 bp, Homo sapiens
gggatgggccctcaccctc

SEQ ID NO: 7666339 - DNA, 19 bp, Homo sapiens
gggatgggccctcaccctc

SEQ ID NO: 7666340 - DNA, 19 bp, Homo sapiens
gggatgggccctcaccctc

SEQ ID NO: 7666341 - DNA, 22 bp, Homo sapiens
gggatggggagctggaaagggg

SEQ ID NO: 7666342 - DNA, 22 bp, Homo sapiens
gggatggggagctggaaagggg

SEQ ID NO: 7666343 - DNA, 22 bp, Homo sapiens
gggatggggagctggaaagggg

SEQ ID NO: 7666344 - DNA, 22 bp, Homo sapiens
gggatggggagctggaaagggg

SEQ ID NO: 7666345 - DNA, 22 bp, Homo sapiens
gggatggggagctggaaagggg

SEQ ID NO: 7666346 - DNA, 22 bp, Homo sapiens
gggatggggagctggaaagggg

SEQ ID NO: 7666347 - DNA, 22 bp, Homo sapiens
gggatggggagctggaaagggg

SEQ ID NO: 7666348 - DNA, 22 bp, Homo sapiens
gggatggggagctggaaagggg

SEQ ID NO: 7666349 - DNA, 22 bp, Homo sapiens
gggatggggagctggaaagggg

SEQ ID NO: 7666350 - DNA, 22 bp, Homo sapiens
gggatggggagctggaaagggg

SEQ ID NO: 7666351 - DNA, 22 bp, Homo sapiens
gggatggggagctggaaagggg

SEQ ID NO: 7666352 - DNA, 22 bp, Homo sapiens
gggatggatcttggctgaggct

SEQ ID NO: 7666353 - DNA, 22 bp, Homo sapiens
gggatggcctagactagcttgg

SEQ ID NO: 7666354 - DNA, 22 bp, Homo sapiens
gggatggatcttggctgaggct

SEQ ID NO: 7666355 - DNA, 22 bp, Homo sapiens
gggatggatcttggctgaggct

SEQ ID NO: 7666356 - DNA, 22 bp, Homo sapiens
gggatggatcttggctgaggct

SEQ ID NO: 7666357 - DNA, 22 bp, Homo sapiens
gggatggctcaaaggagtcagg

SEQ ID NO: 7666358 - DNA, 22 bp, Homo sapiens
gggatggctcaaaggagtcagg

SEQ ID NO: 7666359 - DNA, 22 bp, Homo sapiens
gggatggctcaaaggagtcagg

SEQ ID NO: 7666360 - DNA, 22 bp, Homo sapiens
gggatggctcaaaggagtcagg

SEQ ID NO: 7666361 - DNA, 22 bp, Homo sapiens
gggatggctcaaaggagtcagg

SEQ ID NO: 7666362 - DNA, 22 bp, Homo sapiens
gggatggctttgtggctgactc

SEQ ID NO: 7666363 - DNA, 22 bp, Homo sapiens
gggatggctttgtggctgactc

SEQ ID NO: 7666364 - DNA, 22 bp, Homo sapiens
gggatggctttgtggctgactc

SEQ ID NO: 7666365 - DNA, 22 bp, Homo sapiens
gggatggctgcctgcatcagga

SEQ ID NO: 7666366 - DNA, 22 bp, Homo sapiens
gggatggctttgtggctgactc

SEQ ID NO: 7666367 - DNA, 22 bp, Homo sapiens
gggatggctgcctgcatcagga

SEQ ID NO: 7666368 - DNA, 22 bp, Homo sapiens
gggatggctcaaaggagtcagg

SEQ ID NO: 7666369 - DNA, 22 bp, Homo sapiens
gggatggctcaaaggagtcagg

SEQ ID NO: 7666370 - DNA, 22 bp, Homo sapiens
gggatggctcaaaggagtcagg

SEQ ID NO: 7666371 - DNA, 22 bp, Homo sapiens
gggatggctgcctgcatcagga

SEQ ID NO: 7666372 - DNA, 22 bp, Homo sapiens
gggatggctcaaaggagtcagg

SEQ ID NO: 7666373 - DNA, 22 bp, Homo sapiens
gggatggctgcctgcatcagga

SEQ ID NO: 7666374 - DNA, 22 bp, Homo sapiens
gggatggagggtagagcaagtg

SEQ ID NO: 7666375 - DNA, 22 bp, Homo sapiens
gggatggagggtagagcaagtg

SEQ ID NO: 7666376 - DNA, 22 bp, Homo sapiens
gggatggatcttggctgaggct

SEQ ID NO: 7666377 - DNA, 22 bp, Homo sapiens
gggatggagggtagagcaagtg

SEQ ID NO: 7666378 - DNA, 22 bp, Homo sapiens
gggatggagggtagagcaagtg

SEQ ID NO: 7666379 - DNA, 22 bp, Homo sapiens
gggatggatcttggctgaggct

SEQ ID NO: 7666380 - DNA, 22 bp, Homo sapiens
gggatggatcttggctgaggct

SEQ ID NO: 7666381 - DNA, 22 bp, Homo sapiens
gggatggatcttggctgaggct

SEQ ID NO: 7666382 - DNA, 22 bp, Homo sapiens
gggatggatcttggctgaggct

SEQ ID NO: 7666383 - DNA, 22 bp, Homo sapiens
gggatggatcttggctgaggct

SEQ ID NO: 7666384 - DNA, 22 bp, Homo sapiens
gggatggatcttggctgaggct

SEQ ID NO: 7666385 - DNA, 22 bp, Homo sapiens
gggatggagggtagagcaagtg

SEQ ID NO: 7666386 - DNA, 22 bp, Homo sapiens
gggatggagggtagagcaagtg

SEQ ID NO: 7666387 - DNA, 22 bp, Homo sapiens
gggatggacttggggactccag

SEQ ID NO: 7666388 - DNA, 22 bp, Homo sapiens
gggatggactgacggtagcgcg

SEQ ID NO: 7666389 - DNA, 22 bp, Homo sapiens
gggatggacttggggactccag

SEQ ID NO: 7666390 - DNA, 22 bp, Homo sapiens
gggatggactgacggtagcgcg

SEQ ID NO: 7666391 - DNA, 22 bp, Homo sapiens
gggatggactgacggtagcgcg

SEQ ID NO: 7666392 - DNA, 22 bp, Homo sapiens
gggatggactgacggtagcgcg

SEQ ID NO: 7666393 - DNA, 22 bp, Homo sapiens
gggagggaaagcttgatctgtc

SEQ ID NO: 7666394 - DNA, 22 bp, Homo sapiens
gggagggaaagcttgatctgtc

SEQ ID NO: 7666395 - DNA, 22 bp, Homo sapiens
gggagggaaagcttgatctgtc

SEQ ID NO: 7666396 - DNA, 22 bp, Homo sapiens
gggagggaaagcttgatctgtc

SEQ ID NO: 7666397 - DNA, 22 bp, Homo sapiens
gggagggaaagcttgatctgtc

SEQ ID NO: 7666398 - DNA, 22 bp, Homo sapiens
gggagggaaagcttgatctgtc

SEQ ID NO: 7666399 - DNA, 22 bp, Homo sapiens
gggagggaaagcttgatctgtc

SEQ ID NO: 7666400 - DNA, 22 bp, Homo sapiens
gggagggaaagcttgatctgtc

SEQ ID NO: 7666401 - DNA, 22 bp, Homo sapiens
gggagggaaagcttgatctgtc

SEQ ID NO: 7666402 - DNA, 22 bp, Homo sapiens
gggaggcttgagccatactgcc

SEQ ID NO: 7666403 - DNA, 22 bp, Homo sapiens
gggaggctggctctggccacag

SEQ ID NO: 7666404 - DNA, 22 bp, Homo sapiens
gggaggcttgagccatactgcc

SEQ ID NO: 7666405 - DNA, 22 bp, Homo sapiens
gggaggcttgagccatactgcc

SEQ ID NO: 7666406 - DNA, 22 bp, Homo sapiens
gggaggctggctctggccacag

SEQ ID NO: 7666407 - DNA, 22 bp, Homo sapiens
gggaggctggctctggccacag

SEQ ID NO: 7666408 - DNA, 22 bp, Homo sapiens
gggaggctggctctggccacag

SEQ ID NO: 7666409 - DNA, 22 bp, Homo sapiens
gggagggaaggtacctgtgtga

SEQ ID NO: 7666410 - DNA, 22 bp, Homo sapiens
gggagggaaggtacctgtgtga

SEQ ID NO: 7666411 - DNA, 22 bp, Homo sapiens
gggagggaaggaggcgccgtgt

SEQ ID NO: 7666412 - DNA, 22 bp, Homo sapiens
gggagggaaggtacctgtgtga

SEQ ID NO: 7666413 - DNA, 22 bp, Homo sapiens
gggagggaaggtacctgtgtga

SEQ ID NO: 7666414 - DNA, 22 bp, Homo sapiens
gggagggaaggtacctgtgtga

SEQ ID NO: 7666415 - DNA, 22 bp, Homo sapiens
gggagggaaggtacctgtgtga

SEQ ID NO: 7666416 - DNA, 22 bp, Homo sapiens
gggagggaaggtacctgtgtga

SEQ ID NO: 7666417 - DNA, 22 bp, Homo sapiens
gggagggaaggtacctgtgtga

SEQ ID NO: 7666418 - DNA, 22 bp, Homo sapiens
gggagggaaggtacctgtgtga

SEQ ID NO: 7666419 - DNA, 22 bp, Homo sapiens
gggagggaaggaggcgccgtgt

SEQ ID NO: 7666420 - DNA, 22 bp, Homo sapiens
gggagggaaggaggcgccgtgt

SEQ ID NO: 7666421 - DNA, 22 bp, Homo sapiens
gggagggaaggaccttatgaat

SEQ ID NO: 7666422 - DNA, 22 bp, Homo sapiens
gggagggaaggaggcgccgtgt

SEQ ID NO: 7666423 - DNA, 22 bp, Homo sapiens
gggagggaaggaccttatgaat

SEQ ID NO: 7666424 - DNA, 22 bp, Homo sapiens
gggagggaaggaccttatgaat

SEQ ID NO: 7666425 - DNA, 22 bp, Homo sapiens
gggagggaaggaccttatgaat

SEQ ID NO: 7666426 - DNA, 22 bp, Homo sapiens
gggagggaaggaccttatgaat

SEQ ID NO: 7666427 - DNA, 22 bp, Homo sapiens
gggagggacacaaagagttccc

SEQ ID NO: 7666428 - DNA, 22 bp, Homo sapiens
gggatcgctcagtgtgtgaaga

SEQ ID NO: 7666429 - DNA, 22 bp, Homo sapiens
gggatcgggcttgaggggccct

SEQ ID NO: 7666430 - DNA, 22 bp, Homo sapiens
gggatccatccgtgcagcagag

SEQ ID NO: 7666431 - DNA, 22 bp, Homo sapiens
gggatcgtcatggaaagtgcta

SEQ ID NO: 7666432 - DNA, 22 bp, Homo sapiens
gggatctgacttgctggtgggt

SEQ ID NO: 7666433 - DNA, 22 bp, Homo sapiens
gggatgaggatcaatcagggag

SEQ ID NO: 7666434 - DNA, 20 bp, Homo sapiens
gggatgagagtcctagctct

SEQ ID NO: 7666435 - DNA, 22 bp, Homo sapiens
gggatctgagtaggcagaagct

SEQ ID NO: 7666436 - DNA, 22 bp, Homo sapiens
gggatgcagactacagggctta

SEQ ID NO: 7666437 - DNA, 22 bp, Homo sapiens
gggatgcagactacagggctta

SEQ ID NO: 7666438 - DNA, 19 bp, Homo sapiens
gggatgcactctgaccact

SEQ ID NO: 7666439 - DNA, 19 bp, Homo sapiens
gggatgcactctgaccact

SEQ ID NO: 7666440 - DNA, 22 bp, Homo sapiens
gggatgatggaaaagtctgtta

SEQ ID NO: 7666441 - DNA, 22 bp, Homo sapiens
gggatgataatgccagagttaa

SEQ ID NO: 7666442 - DNA, 22 bp, Homo sapiens
gggatgataatgccagagttaa

SEQ ID NO: 7666443 - DNA, 22 bp, Homo sapiens
gggatgaggatcaatcagggag

SEQ ID NO: 7666444 - DNA, 22 bp, Homo sapiens
gggatgaggatcaatcagggag

SEQ ID NO: 7666445 - DNA, 22 bp, Homo sapiens
gggatgaggatcaatcagggag

SEQ ID NO: 7666446 - DNA, 22 bp, Homo sapiens
gggatggactgacggtagcgcg

SEQ ID NO: 7666447 - DNA, 22 bp, Homo sapiens
gggatgctggtgcctgtggcac

SEQ ID NO: 7666448 - DNA, 22 bp, Homo sapiens
gggatgctggtgcctgtggcac

SEQ ID NO: 7666449 - DNA, 22 bp, Homo sapiens
gggatgctggtgcctgtggcac

SEQ ID NO: 7666450 - DNA, 22 bp, Homo sapiens
gggatggactgacggtagcgcg

SEQ ID NO: 7666451 - DNA, 22 bp, Homo sapiens
gggatggactgacggtagcgcg

SEQ ID NO: 7666452 - DNA, 22 bp, Homo sapiens
gggatgcagtcagagcccctgt

SEQ ID NO: 7666453 - DNA, 22 bp, Homo sapiens
gggatgcagtcagagcccctgt

SEQ ID NO: 7666454 - DNA, 22 bp, Homo sapiens
gggatgcagtcagagcccctgt

SEQ ID NO: 7666455 - DNA, 18 bp, Homo sapiens
gggcagcacagcagcctc

SEQ ID NO: 7666456 - DNA, 18 bp, Homo sapiens
gggcagcacagcagcctc

SEQ ID NO: 7666457 - DNA, 18 bp, Homo sapiens
gggcagcacagcagcctc

SEQ ID NO: 7666458 - DNA, 18 bp, Homo sapiens
gggcagcacagcagcctc

SEQ ID NO: 7666459 - DNA, 18 bp, Homo sapiens
gggcagcacagcagcctc

SEQ ID NO: 7666460 - DNA, 22 bp, Homo sapiens
gggcagcacagacagtgaaggc

SEQ ID NO: 7666461 - DNA, 20 bp, Homo sapiens
gggcagcaagacatttgaca

SEQ ID NO: 7666462 - DNA, 18 bp, Homo sapiens
gggcagcacagcagcctc

SEQ ID NO: 7666463 - DNA, 22 bp, Homo sapiens
gggcagcacagacagtgaaggc

SEQ ID NO: 7666464 - DNA, 22 bp, Homo sapiens
gggcagcacagacagtgaaggc

SEQ ID NO: 7666465 - DNA, 22 bp, Homo sapiens
gggcagcaaatctgagtctggt

SEQ ID NO: 7666466 - DNA, 22 bp, Homo sapiens
gggcagcaaatctgagtctggt

SEQ ID NO: 7666467 - DNA, 22 bp, Homo sapiens
gggcagcaaatctgagtctggt

SEQ ID NO: 7666468 - DNA, 22 bp, Homo sapiens
gggcagcaaatctgagtctggt

SEQ ID NO: 7666469 - DNA, 22 bp, Homo sapiens
gggcagcaaatctgagtctggt

SEQ ID NO: 7666470 - DNA, 22 bp, Homo sapiens
gggcagcaaatctgagtctggt

SEQ ID NO: 7666471 - DNA, 22 bp, Homo sapiens
gggcagcaaatctgagtctggt

SEQ ID NO: 7666472 - DNA, 22 bp, Homo sapiens
gggcagcaaatctgagtctggt

SEQ ID NO: 7666473 - DNA, 22 bp, Homo sapiens
gggcagcacagacagtgaaggc

SEQ ID NO: 7666474 - DNA, 22 bp, Homo sapiens
gggcagcacagacagtgaaggc

SEQ ID NO: 7666475 - DNA, 20 bp, Homo sapiens
gggcagcaagacatttgaca

SEQ ID NO: 7666476 - DNA, 20 bp, Homo sapiens
gggcagcaagacatttgaca

SEQ ID NO: 7666477 - DNA, 22 bp, Homo sapiens
gggcagaggttcaacttcaaca

SEQ ID NO: 7666478 - DNA, 22 bp, Homo sapiens
gggcagaggttcaacttcaaca

SEQ ID NO: 7666479 - DNA, 22 bp, Homo sapiens
gggcagaggttcaacttcaaca

SEQ ID NO: 7666480 - DNA, 22 bp, Homo sapiens
gggcagatcacctgaggtcagg

SEQ ID NO: 7666481 - DNA, 22 bp, Homo sapiens
gggcagatgtctggacacctca

SEQ ID NO: 7666482 - DNA, 18 bp, Homo sapiens
gggcagatgtcccaagat

SEQ ID NO: 7666483 - DNA, 18 bp, Homo sapiens
gggcagatgtcccaagat

SEQ ID NO: 7666484 - DNA, 20 bp, Homo sapiens
gggcagatgtttttatgttg

SEQ ID NO: 7666485 - DNA, 22 bp, Homo sapiens
gggcagatgtctggacacctca

SEQ ID NO: 7666486 - DNA, 22 bp, Homo sapiens
gggcagcaaatctgagtctggt

SEQ ID NO: 7666487 - DNA, 22 bp, Homo sapiens
gggcagatggggcacaggctga

SEQ ID NO: 7666488 - DNA, 22 bp, Homo sapiens
gggcagatcacctgaggtcagg

SEQ ID NO: 7666489 - DNA, 22 bp, Homo sapiens
gggcagatggggcacaggctga

SEQ ID NO: 7666490 - DNA, 22 bp, Homo sapiens
gggcagcagaattggacagaaa

SEQ ID NO: 7666491 - DNA, 22 bp, Homo sapiens
gggcagcagaattggacagaaa

SEQ ID NO: 7666492 - DNA, 22 bp, Homo sapiens
gggcagcagaattggacagaaa

SEQ ID NO: 7666493 - DNA, 22 bp, Homo sapiens
gggcagcagaattggacagaaa

SEQ ID NO: 7666494 - DNA, 22 bp, Homo sapiens
gggcagcagaattggacagaaa

SEQ ID NO: 7666495 - DNA, 22 bp, Homo sapiens
gggcagcagagccctgccgagt

SEQ ID NO: 7666496 - DNA, 22 bp, Homo sapiens
gggcagcagaattggacagaaa

SEQ ID NO: 7666497 - DNA, 22 bp, Homo sapiens
gggcagcagagccctgccgagt

SEQ ID NO: 7666498 - DNA, 22 bp, Homo sapiens
gggcagcagagccctgccgagt

SEQ ID NO: 7666499 - DNA, 20 bp, Homo sapiens
gggcagcctcgggagtgggt

SEQ ID NO: 7666500 - DNA, 20 bp, Homo sapiens
gggcagcctcgggagtgggt

SEQ ID NO: 7666501 - DNA, 20 bp, Homo sapiens
gggcagcctcgggagtgggt

SEQ ID NO: 7666502 - DNA, 20 bp, Homo sapiens
gggcagcctcgggagtgggt

SEQ ID NO: 7666503 - DNA, 20 bp, Homo sapiens
gggcagcctcgggagtgggt

SEQ ID NO: 7666504 - DNA, 22 bp, Homo sapiens
gggcagccgcgtgacctgccag

SEQ ID NO: 7666505 - DNA, 22 bp, Homo sapiens
gggcagccccagcgcgttggct

SEQ ID NO: 7666506 - DNA, 22 bp, Homo sapiens
gggcagcccagaactgctgcag

SEQ ID NO: 7666507 - DNA, 22 bp, Homo sapiens
gggcagccccagcgcgttggct

SEQ ID NO: 7666508 - DNA, 22 bp, Homo sapiens
gggcagccccagcgcgttggct

SEQ ID NO: 7666509 - DNA, 22 bp, Homo sapiens
gggcagccgcgtgacctgccag

SEQ ID NO: 7666510 - DNA, 21 bp, Homo sapiens
gggcagcacgtcattcctgtg

SEQ ID NO: 7666511 - DNA, 21 bp, Homo sapiens
gggcagcacgtcattcctgtg

SEQ ID NO: 7666512 - DNA, 18 bp, Homo sapiens
gggcagcacagcagcctc

SEQ ID NO: 7666513 - DNA, 18 bp, Homo sapiens
gggcagcacagcagcctc

SEQ ID NO: 7666514 - DNA, 22 bp, Homo sapiens
gggcagcacgtttcaggaggat

SEQ ID NO: 7666515 - DNA, 22 bp, Homo sapiens
gggcagcacgtttcaggaggat

SEQ ID NO: 7666516 - DNA, 22 bp, Homo sapiens
gggcagcacgtttcaggaggat

SEQ ID NO: 7666517 - DNA, 22 bp, Homo sapiens
gggcagcacgtttcaggaggat

SEQ ID NO: 7666518 - DNA, 22 bp, Homo sapiens
gggcagcacgtttcaggaggat

SEQ ID NO: 7666519 - DNA, 22 bp, Homo sapiens
gggcagcacgtttcaggaggat

SEQ ID NO: 7666520 - DNA, 22 bp, Homo sapiens
gggcagcacgtttcaggaggat

SEQ ID NO: 7666521 - DNA, 22 bp, Homo sapiens
gggcagcacgtttcaggaggat

SEQ ID NO: 7666522 - DNA, 22 bp, Homo sapiens
gggcagcacgtttcaggaggat

SEQ ID NO: 7666523 - DNA, 22 bp, Homo sapiens
gggcagcagaattggacagaaa

SEQ ID NO: 7666524 - DNA, 22 bp, Homo sapiens
gggcagcagaattggacagaaa

SEQ ID NO: 7666525 - DNA, 22 bp, Homo sapiens
gggcagcactcatacctatatt

SEQ ID NO: 7666526 - DNA, 22 bp, Homo sapiens
gggcagcacgtttcaggaggat

SEQ ID NO: 7666527 - DNA, 22 bp, Homo sapiens
gggcagcacgtttcaggaggat

SEQ ID NO: 7666528 - DNA, 22 bp, Homo sapiens
gggccaggtcggtgaatggtca

SEQ ID NO: 7666529 - DNA, 22 bp, Homo sapiens
gggccaggtcggtgaatggtca

SEQ ID NO: 7666530 - DNA, 22 bp, Homo sapiens
gggccaggtcggtgaatggtca

SEQ ID NO: 7666531 - DNA, 22 bp, Homo sapiens
gggccaggtatcgtctttagta

SEQ ID NO: 7666532 - DNA, 22 bp, Homo sapiens
gggccaggtatcgtctttagta

SEQ ID NO: 7666533 - DNA, 22 bp, Homo sapiens
gggccaggagtggagatatggg

SEQ ID NO: 7666534 - DNA, 22 bp, Homo sapiens
gggccaggagtggagatatggg

SEQ ID NO: 7666535 - DNA, 22 bp, Homo sapiens
gggccaggagtggagatatggg

SEQ ID NO: 7666536 - DNA, 22 bp, Homo sapiens
gggccacattgaagggtgggta

SEQ ID NO: 7666537 - DNA, 22 bp, Homo sapiens
gggccacaggccttgcccgcag

SEQ ID NO: 7666538 - DNA, 22 bp, Homo sapiens
gggccacaggccttgcccgcag

SEQ ID NO: 7666539 - DNA, 22 bp, Homo sapiens
gggccacattgaagggtgggta

SEQ ID NO: 7666540 - DNA, 22 bp, Homo sapiens
gggccacaggccttgcccgcag

SEQ ID NO: 7666541 - DNA, 22 bp, Homo sapiens
gggccacaggagaggctgtcag

SEQ ID NO: 7666542 - DNA, 22 bp, Homo sapiens
gggccacaggccttgcccgcag

SEQ ID NO: 7666543 - DNA, 22 bp, Homo sapiens
gggccaggtggaccccagcctc

SEQ ID NO: 7666544 - DNA, 22 bp, Homo sapiens
gggccaggtggaccccagcctc

SEQ ID NO: 7666545 - DNA, 22 bp, Homo sapiens
gggccaggtggaccccagcctc

SEQ ID NO: 7666546 - DNA, 22 bp, Homo sapiens
gggccaggtggaccccagcctc

SEQ ID NO: 7666547 - DNA, 22 bp, Homo sapiens
gggccaggtcggtgaatggtca

SEQ ID NO: 7666548 - DNA, 22 bp, Homo sapiens
gggccaggtcggtgaatggtca

SEQ ID NO: 7666549 - DNA, 22 bp, Homo sapiens
gggccaggtcggtgaatggtca

SEQ ID NO: 7666550 - DNA, 22 bp, Homo sapiens
gggccaggtggaccccagcctc

SEQ ID NO: 7666551 - DNA, 22 bp, Homo sapiens
gggccagtagcacctgtgtgga

SEQ ID NO: 7666552 - DNA, 22 bp, Homo sapiens
gggccagtagcacctgtgtgga

SEQ ID NO: 7666553 - DNA, 22 bp, Homo sapiens
gggcagctctcacagcagccaa

SEQ ID NO: 7666554 - DNA, 22 bp, Homo sapiens
gggcagctctcacagcagccaa

SEQ ID NO: 7666555 - DNA, 21 bp, Homo sapiens
gggccacaccttctgcagacc

SEQ ID NO: 7666556 - DNA, 22 bp, Homo sapiens
gggcagctctcacagcagccaa

SEQ ID NO: 7666557 - DNA, 22 bp, Homo sapiens
gggcagctctcacagcagccaa

SEQ ID NO: 7666558 - DNA, 21 bp, Homo sapiens
gggccacaccttctgcagacc

SEQ ID NO: 7666559 - DNA, 21 bp, Homo sapiens
gggccacaccttctgcagacc

SEQ ID NO: 7666560 - DNA, 22 bp, Homo sapiens
gggccacaggagaggctgtcag

SEQ ID NO: 7666561 - DNA, 21 bp, Homo sapiens
gggccacaccttctgcagacc

SEQ ID NO: 7666562 - DNA, 22 bp, Homo sapiens
gggccacaggagaggctgtcag

SEQ ID NO: 7666563 - DNA, 22 bp, Homo sapiens
gggccacaggagaggctgtcag

SEQ ID NO: 7666564 - DNA, 22 bp, Homo sapiens
gggccacaggagaggctgtcag

SEQ ID NO: 7666565 - DNA, 22 bp, Homo sapiens
gggcagctcctgtggaatccac

SEQ ID NO: 7666566 - DNA, 22 bp, Homo sapiens
gggcagctcctgtggaatccac

SEQ ID NO: 7666567 - DNA, 22 bp, Homo sapiens
gggcagctcctgtggaatccac

SEQ ID NO: 7666568 - DNA, 22 bp, Homo sapiens
gggcagctcctgtggaatccac

SEQ ID NO: 7666569 - DNA, 22 bp, Homo sapiens
gggcagctcctgtggaatccac

SEQ ID NO: 7666570 - DNA, 22 bp, Homo sapiens
gggcagctcctgtggaatccac

SEQ ID NO: 7666571 - DNA, 22 bp, Homo sapiens
gggcagctcggaagtgggaaag

SEQ ID NO: 7666572 - DNA, 22 bp, Homo sapiens
gggcagctcggaagtgggaaag

SEQ ID NO: 7666573 - DNA, 22 bp, Homo sapiens
gggcagctcggaagtgggaaag

SEQ ID NO: 7666574 - DNA, 22 bp, Homo sapiens
gggcagctcggaagtgggaaag

SEQ ID NO: 7666575 - DNA, 22 bp, Homo sapiens
gggcagctcggaagtgggaaag

SEQ ID NO: 7666576 - DNA, 22 bp, Homo sapiens
gggcagctagccctctagccca

SEQ ID NO: 7666577 - DNA, 22 bp, Homo sapiens
gggcagctagccctctagccca

SEQ ID NO: 7666578 - DNA, 22 bp, Homo sapiens
gggcagctagccctctagccca

SEQ ID NO: 7666579 - DNA, 22 bp, Homo sapiens
gggcagctcagccaccatgcag

SEQ ID NO: 7666580 - DNA, 22 bp, Homo sapiens
gggcagctcagccaccatgcag

SEQ ID NO: 7666581 - DNA, 20 bp, Homo sapiens
gggcagctcccctcattctg

SEQ ID NO: 7666582 - DNA, 20 bp, Homo sapiens
gggcagctcccctcattctg

SEQ ID NO: 7666583 - DNA, 20 bp, Homo sapiens
gggcagctcccctcattctg

SEQ ID NO: 7666584 - DNA, 20 bp, Homo sapiens
gggcagctcccctcattctg

SEQ ID NO: 7666585 - DNA, 20 bp, Homo sapiens
gggcagctcccctcattctg

SEQ ID NO: 7666586 - DNA, 22 bp, Homo sapiens
gggcagctcagccaccatgcag

SEQ ID NO: 7666587 - DNA, 22 bp, Homo sapiens
gggcagcctgctttctgatcca

SEQ ID NO: 7666588 - DNA, 22 bp, Homo sapiens
gggcagcctcggtgcctgctgc

SEQ ID NO: 7666589 - DNA, 22 bp, Homo sapiens
gggcagctagccctctagccca

SEQ ID NO: 7666590 - DNA, 22 bp, Homo sapiens
gggcagctagccctctagccca

SEQ ID NO: 7666591 - DNA, 22 bp, Homo sapiens
gggcagcctgctttctgatcca

SEQ ID NO: 7666592 - DNA, 22 bp, Homo sapiens
gggcagcctcggtgcctgctgc

SEQ ID NO: 7666593 - DNA, 22 bp, Homo sapiens
gggcagcctcggtgcctgctgc

SEQ ID NO: 7666594 - DNA, 22 bp, Homo sapiens
gggcagcctcggtgcctgctgc

SEQ ID NO: 7666595 - DNA, 23 bp, Homo sapiens
gggcccagcacaggacctggcag

SEQ ID NO: 7666596 - DNA, 23 bp, Homo sapiens
gggcccagcacaggacctggcag

SEQ ID NO: 7666597 - DNA, 23 bp, Homo sapiens
gggcccagcacaggacctggcag

SEQ ID NO: 7666598 - DNA, 22 bp, Homo sapiens
gggcccactggctgtctgaccc

SEQ ID NO: 7666599 - DNA, 22 bp, Homo sapiens
gggcccactggctgtctgaccc

SEQ ID NO: 7666600 - DNA, 23 bp, Homo sapiens
gggcccagcacaggacctggcag

SEQ ID NO: 7666601 - DNA, 23 bp, Homo sapiens
gggcccagcacaggacctggcag

SEQ ID NO: 7666602 - DNA, 23 bp, Homo sapiens
gggcccagcacaggacctggcag

SEQ ID NO: 7666603 - DNA, 23 bp, Homo sapiens
gggcccagcacaggacctggcag

SEQ ID NO: 7666604 - DNA, 22 bp, Homo sapiens
gggcccagcactggctgggatc

SEQ ID NO: 7666605 - DNA, 22 bp, Homo sapiens
gggcccagcactggctgggatc

SEQ ID NO: 7666606 - DNA, 22 bp, Homo sapiens
gggcccagcactggctgggatc

SEQ ID NO: 7666607 - DNA, 22 bp, Homo sapiens
gggcccagcactggctgggatc

SEQ ID NO: 7666608 - DNA, 22 bp, Homo sapiens
gggcccagcactggctgggatc

SEQ ID NO: 7666609 - DNA, 22 bp, Homo sapiens
gggcccagcactggctgggatc

SEQ ID NO: 7666610 - DNA, 22 bp, Homo sapiens
gggcccagcactggctgggatc

SEQ ID NO: 7666611 - DNA, 22 bp, Homo sapiens
gggcccagcactggctgggatc

SEQ ID NO: 7666612 - DNA, 22 bp, Homo sapiens
gggcccagcactggctgggatc

SEQ ID NO: 7666613 - DNA, 22 bp, Homo sapiens
gggcccagcactggctgggatc

SEQ ID NO: 7666614 - DNA, 22 bp, Homo sapiens
gggcccagcactggctgggatc

SEQ ID NO: 7666615 - DNA, 22 bp, Homo sapiens
gggccagttctccgcctctttt

SEQ ID NO: 7666616 - DNA, 22 bp, Homo sapiens
gggccagtctgactctgctggt

SEQ ID NO: 7666617 - DNA, 22 bp, Homo sapiens
gggccagtgaacaatgagggaa

SEQ ID NO: 7666618 - DNA, 22 bp, Homo sapiens
gggccagtgagtcgggagagct

SEQ ID NO: 7666619 - DNA, 22 bp, Homo sapiens
gggccagtgagtcgggagagct

SEQ ID NO: 7666620 - DNA, 22 bp, Homo sapiens
gggccagtgggacctgggtctc

SEQ ID NO: 7666621 - DNA, 22 bp, Homo sapiens
gggccagtgagtcgggagagct

SEQ ID NO: 7666622 - DNA, 22 bp, Homo sapiens
gggccagtgagtcgggagagct

SEQ ID NO: 7666623 - DNA, 22 bp, Homo sapiens
gggccagtgagtcgggagagct

SEQ ID NO: 7666624 - DNA, 22 bp, Homo sapiens
gggccatgagaggttcatcaac

SEQ ID NO: 7666625 - DNA, 22 bp, Homo sapiens
gggccatgagaggttcatcaac

SEQ ID NO: 7666626 - DNA, 22 bp, Homo sapiens
gggccatgagaggttcatcaac

SEQ ID NO: 7666627 - DNA, 22 bp, Homo sapiens
gggccatgagaggttcatcaac

SEQ ID NO: 7666628 - DNA, 22 bp, Homo sapiens
gggccatgagaggttcatcaac

SEQ ID NO: 7666629 - DNA, 22 bp, Homo sapiens
gggcccagccctctgctcactg

SEQ ID NO: 7666630 - DNA, 22 bp, Homo sapiens
gggcccagcgtggttccatctg

SEQ ID NO: 7666631 - DNA, 22 bp, Homo sapiens
gggcccagcgtggttccatctg

SEQ ID NO: 7666632 - DNA, 22 bp, Homo sapiens
gggcccagccctctgctcactg

SEQ ID NO: 7666633 - DNA, 22 bp, Homo sapiens
gggcccagccctctgctcactg

SEQ ID NO: 7666634 - DNA, 22 bp, Homo sapiens
gggcccagccctctgctcactg

SEQ ID NO: 7666635 - DNA, 22 bp, Homo sapiens
gggcccagccctctgctcactg

SEQ ID NO: 7666636 - DNA, 22 bp, Homo sapiens
gggcccagccctctgctcactg

SEQ ID NO: 7666637 - DNA, 22 bp, Homo sapiens
gggcccagccctctgctcactg

SEQ ID NO: 7666638 - DNA, 22 bp, Homo sapiens
gggcccagccctctgctcactg

SEQ ID NO: 7666639 - DNA, 19 bp, Homo sapiens
gggcccagcatggagggtt

SEQ ID NO: 7666640 - DNA, 22 bp, Homo sapiens
gggcccagccctctgctcactg

SEQ ID NO: 7666641 - DNA, 19 bp, Homo sapiens
gggcccagcatggagggtt

SEQ ID NO: 7666642 - DNA, 19 bp, Homo sapiens
gggcccagcatggagggtt

SEQ ID NO: 7666643 - DNA, 19 bp, Homo sapiens
gggcccagcatggagggtt

SEQ ID NO: 7666644 - DNA, 19 bp, Homo sapiens
gggcccagcatggagggtt

SEQ ID NO: 7666645 - DNA, 19 bp, Homo sapiens
gggcccagcatggagggtt

SEQ ID NO: 7666646 - DNA, 19 bp, Homo sapiens
gggcccagcatggagggtt

SEQ ID NO: 7666647 - DNA, 19 bp, Homo sapiens
gggcccagcatggagggtt

SEQ ID NO: 7666648 - DNA, 19 bp, Homo sapiens
gggcccagcatggagggtt

SEQ ID NO: 7666649 - DNA, 22 bp, Homo sapiens
gggcccagcactggctgggatc

SEQ ID NO: 7666650 - DNA, 19 bp, Homo sapiens
gggcccagcatggagggtt

SEQ ID NO: 7666651 - DNA, 22 bp, Homo sapiens
gggcccagcgtggttccatctg

SEQ ID NO: 7666652 - DNA, 22 bp, Homo sapiens
gggcccagcgtggttccatctg

SEQ ID NO: 7666653 - DNA, 22 bp, Homo sapiens
gggcccaggcctccttccttcc

SEQ ID NO: 7666654 - DNA, 22 bp, Homo sapiens
gggcccagcgtggttccatctg

SEQ ID NO: 7666655 - DNA, 22 bp, Homo sapiens
gggcccaggcctccttccttcc

SEQ ID NO: 7666656 - DNA, 22 bp, Homo sapiens
gggcctgtctcactccctggtt

SEQ ID NO: 7666657 - DNA, 22 bp, Homo sapiens
gggcctgtgtgttcaggagcct

SEQ ID NO: 7666658 - DNA, 22 bp, Homo sapiens
gggcctgtgtgttcaggagcct

SEQ ID NO: 7666659 - DNA, 22 bp, Homo sapiens
gggcctgttctgattggcagat

SEQ ID NO: 7666660 - DNA, 22 bp, Homo sapiens
gggcggatcatttgaggtcagg

SEQ ID NO: 7666661 - DNA, 22 bp, Homo sapiens
gggcggatcacctgaggtcagg

SEQ ID NO: 7666662 - DNA, 22 bp, Homo sapiens
gggcggatcatttgaggtcagg

SEQ ID NO: 7666663 - DNA, 22 bp, Homo sapiens
gggcggatcatttgaggtcagg

SEQ ID NO: 7666664 - DNA, 22 bp, Homo sapiens
gggcggatcatttgaggtcagg

SEQ ID NO: 7666665 - DNA, 22 bp, Homo sapiens
gggcggatcatttgaggtcagg

SEQ ID NO: 7666666 - DNA, 22 bp, Homo sapiens
gggcggatcatttgaggtcagg

SEQ ID NO: 7666667 - DNA, 22 bp, Homo sapiens
gggcggatcacctgaggtcagg

SEQ ID NO: 7666668 - DNA, 22 bp, Homo sapiens
gggcggatcacctgaggtcagg

SEQ ID NO: 7666669 - DNA, 22 bp, Homo sapiens
gggcggatcacctgaggtcagg

SEQ ID NO: 7666670 - DNA, 22 bp, Homo sapiens
gggcggatcacctgaggtcagg

SEQ ID NO: 7666671 - DNA, 22 bp, Homo sapiens
gggcggatcacctgaggtcagg

SEQ ID NO: 7666672 - DNA, 22 bp, Homo sapiens
gggcctgttctgattggcagat

SEQ ID NO: 7666673 - DNA, 19 bp, Homo sapiens
gggcggagcctgacctggg

SEQ ID NO: 7666674 - DNA, 19 bp, Homo sapiens
gggcggagcctgacctggg

SEQ ID NO: 7666675 - DNA, 19 bp, Homo sapiens
gggcggagcctgacctggg

SEQ ID NO: 7666676 - DNA, 22 bp, Homo sapiens
gggcggatcacctgaggtcagg

SEQ ID NO: 7666677 - DNA, 22 bp, Homo sapiens
gggcggatcacctgaggtcagg

SEQ ID NO: 7666678 - DNA, 22 bp, Homo sapiens
gggcggatcacctgaggtcagg

SEQ ID NO: 7666679 - DNA, 22 bp, Homo sapiens
gggcggatcacctgaggtcagg

SEQ ID NO: 7666680 - DNA, 22 bp, Homo sapiens
gggcggatcacctgaggtcagg

SEQ ID NO: 7666681 - DNA, 22 bp, Homo sapiens
gggcggggggagctggaatgaa

SEQ ID NO: 7666682 - DNA, 22 bp, Homo sapiens
gggcggggggagctggaatgaa

SEQ ID NO: 7666683 - DNA, 22 bp, Homo sapiens
gggcggggggagctggaatgaa

SEQ ID NO: 7666684 - DNA, 22 bp, Homo sapiens
gggcggggggagctggaatgaa

SEQ ID NO: 7666685 - DNA, 22 bp, Homo sapiens
gggcggggcttccgtcctccac

SEQ ID NO: 7666686 - DNA, 22 bp, Homo sapiens
gggcggggcttccgtcctccac

SEQ ID NO: 7666687 - DNA, 22 bp, Homo sapiens
gggcggggcttccgtcctccac

SEQ ID NO: 7666688 - DNA, 22 bp, Homo sapiens
gggcggggggagctggaatgaa

SEQ ID NO: 7666689 - DNA, 22 bp, Homo sapiens
gggcggggggagctggaatgaa

SEQ ID NO: 7666690 - DNA, 22 bp, Homo sapiens
gggcggggggagctggaatgaa

SEQ ID NO: 7666691 - DNA, 22 bp, Homo sapiens
gggcggggggagctggaatgaa

SEQ ID NO: 7666692 - DNA, 22 bp, Homo sapiens
gggcggggggagctggaatgaa

SEQ ID NO: 7666693 - DNA, 22 bp, Homo sapiens
gggcggatcatttgaggtcagg

SEQ ID NO: 7666694 - DNA, 22 bp, Homo sapiens
gggcggatcatttgaggtcagg

SEQ ID NO: 7666695 - DNA, 22 bp, Homo sapiens
gggcggatcatttgaggtcagg

SEQ ID NO: 7666696 - DNA, 22 bp, Homo sapiens
gggcggatcatttgaggtcagg

SEQ ID NO: 7666697 - DNA, 22 bp, Homo sapiens
gggcggcgtcggcgaggccatc

SEQ ID NO: 7666698 - DNA, 22 bp, Homo sapiens
gggcggcgtcggcgaggccatc

SEQ ID NO: 7666699 - DNA, 22 bp, Homo sapiens
gggcggatcatttgaggtcagg

SEQ ID NO: 7666700 - DNA, 22 bp, Homo sapiens
gggcggggcttccgtcctccac

SEQ ID NO: 7666701 - DNA, 22 bp, Homo sapiens
gggctactgagctggaactggg

SEQ ID NO: 7666702 - DNA, 22 bp, Homo sapiens
gggctactgagctggaactggg

SEQ ID NO: 7666703 - DNA, 22 bp, Homo sapiens
gggctactgagctggaactggg

SEQ ID NO: 7666704 - DNA, 22 bp, Homo sapiens
gggctagaaattctgcagtgga

SEQ ID NO: 7666705 - DNA, 22 bp, Homo sapiens
gggctagaaattctgcagtgga

SEQ ID NO: 7666706 - DNA, 22 bp, Homo sapiens
gggctagaaattctgcagtgga

SEQ ID NO: 7666707 - DNA, 22 bp, Homo sapiens
gggctagaagttagctagagaa

SEQ ID NO: 7666708 - DNA, 22 bp, Homo sapiens
gggctagaagttagctagagaa

SEQ ID NO: 7666709 - DNA, 22 bp, Homo sapiens
gggctagaagttagctagagaa

SEQ ID NO: 7666710 - DNA, 22 bp, Homo sapiens
gggctagaagttagctagagaa

SEQ ID NO: 7666711 - DNA, 22 bp, Homo sapiens
gggctagaaattctgcagtgga

SEQ ID NO: 7666712 - DNA, 22 bp, Homo sapiens
gggctagaagttagctagagaa

SEQ ID NO: 7666713 - DNA, 22 bp, Homo sapiens
gggctagaatccgcgtctcttg

SEQ ID NO: 7666714 - DNA, 22 bp, Homo sapiens
gggctagaagttagctagagaa

SEQ ID NO: 7666715 - DNA, 22 bp, Homo sapiens
gggcgtggatggtcagtgcagg

SEQ ID NO: 7666716 - DNA, 22 bp, Homo sapiens
gggctaaatgcagaaatgcaga

SEQ ID NO: 7666717 - DNA, 21 bp, Homo sapiens
gggctaagagtgaccaggcag

SEQ ID NO: 7666718 - DNA, 21 bp, Homo sapiens
gggctaagagtgaccaggcag

SEQ ID NO: 7666719 - DNA, 22 bp, Homo sapiens
gggctaagtgaagattgctcca

SEQ ID NO: 7666720 - DNA, 22 bp, Homo sapiens
gggctaagtgaagattgctcca

SEQ ID NO: 7666721 - DNA, 22 bp, Homo sapiens
gggctaagcagagtgggaacag

SEQ ID NO: 7666722 - DNA, 22 bp, Homo sapiens
gggctaagcagagtgggaacag

SEQ ID NO: 7666723 - DNA, 22 bp, Homo sapiens
gggctaagctcgcccagggcca

SEQ ID NO: 7666724 - DNA, 22 bp, Homo sapiens
gggctaagctcgcccagggcca

SEQ ID NO: 7666725 - DNA, 22 bp, Homo sapiens
gggctactgagctggaactggg

SEQ ID NO: 7666726 - DNA, 22 bp, Homo sapiens
gggctactgagctggaactggg

SEQ ID NO: 7666727 - DNA, 22 bp, Homo sapiens
gggctacattgtgagagaagtt

SEQ ID NO: 7666728 - DNA, 22 bp, Homo sapiens
gggctacattgtgagagaagtt

SEQ ID NO: 7666729 - DNA, 22 bp, Homo sapiens
gggctacagacatgctctaagc

SEQ ID NO: 7666730 - DNA, 22 bp, Homo sapiens
gggctaagtggatcagtcagga

SEQ ID NO: 7666731 - DNA, 22 bp, Homo sapiens
gggctaagtggatcagtcagga

SEQ ID NO: 7666732 - DNA, 22 bp, Homo sapiens
gggctaagtggatcagtcagga

SEQ ID NO: 7666733 - DNA, 22 bp, Homo sapiens
gggcgtgaccatctgggagctc

SEQ ID NO: 7666734 - DNA, 22 bp, Homo sapiens
gggcgtggatggtcagtgcagg

SEQ ID NO: 7666735 - DNA, 22 bp, Homo sapiens
gggcgtggatggtcagtgcagg

SEQ ID NO: 7666736 - DNA, 22 bp, Homo sapiens
gggcgtggatggtcagtgcagg

SEQ ID NO: 7666737 - DNA, 22 bp, Homo sapiens
gggcgtggatggtcagtgcagg

SEQ ID NO: 7666738 - DNA, 22 bp, Homo sapiens
gggcgtcctggaccctcccctg

SEQ ID NO: 7666739 - DNA, 22 bp, Homo sapiens
gggcgtggatggtcagtgcagg

SEQ ID NO: 7666740 - DNA, 22 bp, Homo sapiens
gggcgtggatggtcagtgcagg

SEQ ID NO: 7666741 - DNA, 22 bp, Homo sapiens
gggcggggggagctggaatgaa

SEQ ID NO: 7666742 - DNA, 22 bp, Homo sapiens
gggcggggtggctcatgcctgt

SEQ ID NO: 7666743 - DNA, 22 bp, Homo sapiens
gggcggggtggctcatgcctgt

SEQ ID NO: 7666744 - DNA, 22 bp, Homo sapiens
gggcggggggagctggaatgaa

SEQ ID NO: 7666745 - DNA, 22 bp, Homo sapiens
gggcggggggagctggaatgaa

SEQ ID NO: 7666746 - DNA, 22 bp, Homo sapiens
gggcggtgcctgtctccgaagc

SEQ ID NO: 7666747 - DNA, 22 bp, Homo sapiens
gggcggggtggctcatgcctgt

SEQ ID NO: 7666748 - DNA, 22 bp, Homo sapiens
gggcggggtggctcatgcctgt

SEQ ID NO: 7666749 - DNA, 22 bp, Homo sapiens
gggcggggtggctcatgcctgt

SEQ ID NO: 7666750 - DNA, 22 bp, Homo sapiens
gggcggggtggctcatgcctgt

SEQ ID NO: 7666751 - DNA, 22 bp, Homo sapiens
gggggctcctcccagctgccag

SEQ ID NO: 7666752 - DNA, 22 bp, Homo sapiens
gggggctcctcccagctgccag

SEQ ID NO: 7666753 - DNA, 22 bp, Homo sapiens
gggggctccaggcgagaatgtg

SEQ ID NO: 7666754 - DNA, 19 bp, Homo sapiens
ggggagaactagagacagc

SEQ ID NO: 7666755 - DNA, 22 bp, Homo sapiens
gggggctgaggctgttctgagg

SEQ ID NO: 7666756 - DNA, 22 bp, Homo sapiens
gggggctgaggctgttctgagg

SEQ ID NO: 7666757 - DNA, 22 bp, Homo sapiens
gggggctgaggctgttctgagg

SEQ ID NO: 7666758 - DNA, 22 bp, Homo sapiens
gggggctcctcccagctgccag

SEQ ID NO: 7666759 - DNA, 19 bp, Homo sapiens
ggggagaactagagacagc

SEQ ID NO: 7666760 - DNA, 22 bp, Homo sapiens
ggggactgccttccacagacac

SEQ ID NO: 7666761 - DNA, 19 bp, Homo sapiens
ggggagaactagagacagc

SEQ ID NO: 7666762 - DNA, 19 bp, Homo sapiens
ggggagaactagagacagc

SEQ ID NO: 7666763 - DNA, 22 bp, Homo sapiens
gggggctagagagatgaaatat

SEQ ID NO: 7666764 - DNA, 22 bp, Homo sapiens
ggggactgaggcactgaaggtg

SEQ ID NO: 7666765 - DNA, 22 bp, Homo sapiens
ggggactgaggcactgaaggtg

SEQ ID NO: 7666766 - DNA, 22 bp, Homo sapiens
ggggactgaggcactgaaggtg

SEQ ID NO: 7666767 - DNA, 22 bp, Homo sapiens
ggggactgccttccacagacac

SEQ ID NO: 7666768 - DNA, 22 bp, Homo sapiens
ggggacctaggctctgtctctt

SEQ ID NO: 7666769 - DNA, 22 bp, Homo sapiens
ggggacctgggcttcaagggtt

SEQ ID NO: 7666770 - DNA, 22 bp, Homo sapiens
ggggaccctcaggactgcgtct

SEQ ID NO: 7666771 - DNA, 22 bp, Homo sapiens
ggggaccctcaggactgcgtct

SEQ ID NO: 7666772 - DNA, 22 bp, Homo sapiens
ggggaccctcaggactgcgtct

SEQ ID NO: 7666773 - DNA, 22 bp, Homo sapiens
ggggaccctcaggactgcgtct

SEQ ID NO: 7666774 - DNA, 22 bp, Homo sapiens
ggggactctgcttctgggatca

SEQ ID NO: 7666775 - DNA, 22 bp, Homo sapiens
ggggactgaggcactgaaggtg

SEQ ID NO: 7666776 - DNA, 22 bp, Homo sapiens
ggggactgaggcactgaaggtg

SEQ ID NO: 7666777 - DNA, 22 bp, Homo sapiens
ggggactctgcttctgggatca

SEQ ID NO: 7666778 - DNA, 22 bp, Homo sapiens
ggggactgaggcactgaaggtg

SEQ ID NO: 7666779 - DNA, 22 bp, Homo sapiens
ggggactgaggcactgaaggtg

SEQ ID NO: 7666780 - DNA, 22 bp, Homo sapiens
ggggacgcagaaagagtggcag

SEQ ID NO: 7666781 - DNA, 22 bp, Homo sapiens
ggggacgggacttagcatgagt

SEQ ID NO: 7666782 - DNA, 22 bp, Homo sapiens
ggggacgcagaaagagtggcag

SEQ ID NO: 7666783 - DNA, 22 bp, Homo sapiens
ggggacgggacttagcatgagt

SEQ ID NO: 7666784 - DNA, 23 bp, Homo sapiens
gggggctggttgactctctgcag

SEQ ID NO: 7666785 - DNA, 22 bp, Homo sapiens
gggggctggactttcccacaca

SEQ ID NO: 7666786 - DNA, 22 bp, Homo sapiens
gggggctggactttcccacaca

SEQ ID NO: 7666787 - DNA, 22 bp, Homo sapiens
gggggctggactttcccacaca

SEQ ID NO: 7666788 - DNA, 23 bp, Homo sapiens
gggggctggttgactctctgcag

SEQ ID NO: 7666789 - DNA, 23 bp, Homo sapiens
gggggctggttgactctctgcag

SEQ ID NO: 7666790 - DNA, 23 bp, Homo sapiens
gggggctggttgactctctgcag

SEQ ID NO: 7666791 - DNA, 23 bp, Homo sapiens
gggggctggttgactctctgcag

SEQ ID NO: 7666792 - DNA, 23 bp, Homo sapiens
gggggctggttgactctctgcag

SEQ ID NO: 7666793 - DNA, 22 bp, Homo sapiens
gggggctgtcctgtgcattgta

SEQ ID NO: 7666794 - DNA, 23 bp, Homo sapiens
gggggctggttgactctctgcag

SEQ ID NO: 7666795 - DNA, 22 bp, Homo sapiens
gggggctgtcctgtgcattgta

SEQ ID NO: 7666796 - DNA, 22 bp, Homo sapiens
gggggctgtcctgtgcattgta

SEQ ID NO: 7666797 - DNA, 22 bp, Homo sapiens
gggggctgtcctgtgcattgta

SEQ ID NO: 7666798 - DNA, 22 bp, Homo sapiens
gggggctgtcctgtgcattgta

SEQ ID NO: 7666799 - DNA, 22 bp, Homo sapiens
gggggctggaatatccatcaac

SEQ ID NO: 7666800 - DNA, 22 bp, Homo sapiens
gggggctggaatatccatcaac

SEQ ID NO: 7666801 - DNA, 22 bp, Homo sapiens
gggggctggaatatccatcaac

SEQ ID NO: 7666802 - DNA, 16 bp, Homo sapiens
gggggctgcaagcttc

SEQ ID NO: 7666803 - DNA, 16 bp, Homo sapiens
gggggctgcaagcttc

SEQ ID NO: 7666804 - DNA, 22 bp, Homo sapiens
gggggctgatcatttactgggc

SEQ ID NO: 7666805 - DNA, 22 bp, Homo sapiens
gggggctgaggctgttctgagg

SEQ ID NO: 7666806 - DNA, 22 bp, Homo sapiens
gggggctgaggctgttctgagg

SEQ ID NO: 7666807 - DNA, 22 bp, Homo sapiens
gggggctgaggctgttctgagg

SEQ ID NO: 7666808 - DNA, 22 bp, Homo sapiens
gggggctgatcatttactgggc

SEQ ID NO: 7666809 - DNA, 22 bp, Homo sapiens
gggggctgatcatttactgggc

SEQ ID NO: 7666810 - DNA, 22 bp, Homo sapiens
gggggctgatcatttactgggc

SEQ ID NO: 7666811 - DNA, 22 bp, Homo sapiens
gggggctgatcatttactgggc

SEQ ID NO: 7666812 - DNA, 22 bp, Homo sapiens
gggggctggactttcccacaca

SEQ ID NO: 7666813 - DNA, 22 bp, Homo sapiens
gggggctggactttcccacaca

SEQ ID NO: 7666814 - DNA, 22 bp, Homo sapiens
gggggctggactttcccacaca

SEQ ID NO: 7666815 - DNA, 22 bp, Homo sapiens
gggggctggaatatccatcaac

SEQ ID NO: 7666816 - DNA, 22 bp, Homo sapiens
gggggctggaatatccatcaac

SEQ ID NO: 7666817 - DNA, 22 bp, Homo sapiens
gggggctggaatatccatcaac

SEQ ID NO: 7666818 - DNA, 22 bp, Homo sapiens
gggggctggaatatccatcaac

SEQ ID NO: 7666819 - DNA, 22 bp, Homo sapiens
gggggtaggcagacaaggacat

SEQ ID NO: 7666820 - DNA, 22 bp, Homo sapiens
gggggtcccaagctgggctgct

SEQ ID NO: 7666821 - DNA, 22 bp, Homo sapiens
gggggtcccaagctgggctgct

SEQ ID NO: 7666822 - DNA, 22 bp, Homo sapiens
gggggtgacgatggcagctggt

SEQ ID NO: 7666823 - DNA, 22 bp, Homo sapiens
gggggtgacgatggcagctggt

SEQ ID NO: 7666824 - DNA, 22 bp, Homo sapiens
gggggtgacgatggcagctggt

SEQ ID NO: 7666825 - DNA, 22 bp, Homo sapiens
gggggtgacgatggcagctggt

SEQ ID NO: 7666826 - DNA, 22 bp, Homo sapiens
gggggtaggcagacaaggacat

SEQ ID NO: 7666827 - DNA, 22 bp, Homo sapiens
gggggtaggcagacaaggacat

SEQ ID NO: 7666828 - DNA, 22 bp, Homo sapiens
ggggggtgctgatcagtggagc

SEQ ID NO: 7666829 - DNA, 22 bp, Homo sapiens
ggggggtgctgatcagtggagc

SEQ ID NO: 7666830 - DNA, 22 bp, Homo sapiens
ggggggtgctgatcagtggagc

SEQ ID NO: 7666831 - DNA, 22 bp, Homo sapiens
ggggggtgctgatcagtggagc

SEQ ID NO: 7666832 - DNA, 22 bp, Homo sapiens
ggggggtgctgatcagtggagc

SEQ ID NO: 7666833 - DNA, 22 bp, Homo sapiens
ggggggtgctgatcagtggagc

SEQ ID NO: 7666834 - DNA, 22 bp, Homo sapiens
ggggggtgctgatcagtggagc

SEQ ID NO: 7666835 - DNA, 22 bp, Homo sapiens
ggggggtgacaagtagaggttg

SEQ ID NO: 7666836 - DNA, 22 bp, Homo sapiens
ggggggcagctgtcctggccat

SEQ ID NO: 7666837 - DNA, 22 bp, Homo sapiens
ggggggcagctgtcctggccat

SEQ ID NO: 7666838 - DNA, 22 bp, Homo sapiens
ggggggcagctgtcctggccat

SEQ ID NO: 7666839 - DNA, 22 bp, Homo sapiens
ggggggcagctgtcctggccat

SEQ ID NO: 7666840 - DNA, 22 bp, Homo sapiens
ggggggcagctgtcctggccat

SEQ ID NO: 7666841 - DNA, 22 bp, Homo sapiens
ggggggctgttctggacaggaa

SEQ ID NO: 7666842 - DNA, 22 bp, Homo sapiens
ggggggcgccatggtctcttgg

SEQ ID NO: 7666843 - DNA, 22 bp, Homo sapiens
ggggggctgttctggacaggaa

SEQ ID NO: 7666844 - DNA, 22 bp, Homo sapiens
ggggggctgttctggacaggaa

SEQ ID NO: 7666845 - DNA, 22 bp, Homo sapiens
ggggggctgttctggacaggaa

SEQ ID NO: 7666846 - DNA, 22 bp, Homo sapiens
ggggggtgacaagtagaggttg

SEQ ID NO: 7666847 - DNA, 22 bp, Homo sapiens
ggggggtgacaagtagaggttg

SEQ ID NO: 7666848 - DNA, 22 bp, Homo sapiens
ggggggtgacaagtagaggttg

SEQ ID NO: 7666849 - DNA, 22 bp, Homo sapiens
ggggggtgacaagtagaggttg

SEQ ID NO: 7666850 - DNA, 22 bp, Homo sapiens
ggggggtgacaagtagaggttg

SEQ ID NO: 7666851 - DNA, 22 bp, Homo sapiens
gggggggtcttcagacctcaga

SEQ ID NO: 7666852 - DNA, 22 bp, Homo sapiens
gggggggtcttcagacctcaga

SEQ ID NO: 7666853 - DNA, 20 bp, Homo sapiens
ggggggcttcagggcctgtg

SEQ ID NO: 7666854 - DNA, 20 bp, Homo sapiens
ggggggcttcagggcctgtg

SEQ ID NO: 7666855 - DNA, 20 bp, Homo sapiens
ggggggcttcagggcctgtg

SEQ ID NO: 7666856 - DNA, 20 bp, Homo sapiens
ggggggcttcagggcctgtg

SEQ ID NO: 7666857 - DNA, 20 bp, Homo sapiens
ggggggcttcagggcctgtg

SEQ ID NO: 7666858 - DNA, 20 bp, Homo sapiens
ggggggcttcagggcctgtg

SEQ ID NO: 7666859 - DNA, 22 bp, Homo sapiens
ggggtactggctggagccccac

SEQ ID NO: 7666860 - DNA, 22 bp, Homo sapiens
gggggtttctgggctgagcaga

SEQ ID NO: 7666861 - DNA, 22 bp, Homo sapiens
ggggtactggctggagccccac

SEQ ID NO: 7666862 - DNA, 22 bp, Homo sapiens
gggggtggttctaagtcctata

SEQ ID NO: 7666863 - DNA, 22 bp, Homo sapiens
gggggtggttctaagtcctata

SEQ ID NO: 7666864 - DNA, 22 bp, Homo sapiens
gggggtggttctaagtcctata

SEQ ID NO: 7666865 - DNA, 22 bp, Homo sapiens
gggggtggttctaagtcctata

SEQ ID NO: 7666866 - DNA, 22 bp, Homo sapiens
gggggtggttctaagtcctata

SEQ ID NO: 7666867 - DNA, 22 bp, Homo sapiens
gggggtggttctaagtcctata

SEQ ID NO: 7666868 - DNA, 22 bp, Homo sapiens
gggggtggttctaagtcctata

SEQ ID NO: 7666869 - DNA, 16 bp, Homo sapiens
gggggtgagagagagt

SEQ ID NO: 7666870 - DNA, 22 bp, Homo sapiens
gggggtgagcctgccaggccca

SEQ ID NO: 7666871 - DNA, 22 bp, Homo sapiens
gggggtgagcctgccaggccca

SEQ ID NO: 7666872 - DNA, 22 bp, Homo sapiens
gggggtgagcctgccaggccca

SEQ ID NO: 7666873 - DNA, 22 bp, Homo sapiens
gggggtgacgatggcagctggt

SEQ ID NO: 7666874 - DNA, 22 bp, Homo sapiens
gggggtgacgatggcagctggt

SEQ ID NO: 7666875 - DNA, 22 bp, Homo sapiens
gggggtgaggacaggagcactg

SEQ ID NO: 7666876 - DNA, 22 bp, Homo sapiens
gggggtgaggacaggagcactg

SEQ ID NO: 7666877 - DNA, 22 bp, Homo sapiens
gggggtggttctaagtcctata

SEQ ID NO: 7666878 - DNA, 22 bp, Homo sapiens
gggtccaggcgtggcccagatg

SEQ ID NO: 7666879 - DNA, 22 bp, Homo sapiens
gggtccaggcgtggcccagatg

SEQ ID NO: 7666880 - DNA, 22 bp, Homo sapiens
gggtccagggccagtggctgag

SEQ ID NO: 7666881 - DNA, 22 bp, Homo sapiens
gggtccagggccagtggctgag

SEQ ID NO: 7666882 - DNA, 22 bp, Homo sapiens
gggtccaggcgtggcccagatg

SEQ ID NO: 7666883 - DNA, 22 bp, Homo sapiens
gggtccagggccagtggctgag

SEQ ID NO: 7666884 - DNA, 22 bp, Homo sapiens
gggtccagggccagtggctgag

SEQ ID NO: 7666885 - DNA, 22 bp, Homo sapiens
gggtccagctacatcagggtgg

SEQ ID NO: 7666886 - DNA, 22 bp, Homo sapiens
gggtccagctacatcagggtgg

SEQ ID NO: 7666887 - DNA, 20 bp, Homo sapiens
gggtccaggactctgaattt

SEQ ID NO: 7666888 - DNA, 22 bp, Homo sapiens
gggtccagctacatcagggtgg

SEQ ID NO: 7666889 - DNA, 20 bp, Homo sapiens
gggtccaggactctgaattt

SEQ ID NO: 7666890 - DNA, 22 bp, Homo sapiens
gggtccaggcactatgctaagt

SEQ ID NO: 7666891 - DNA, 22 bp, Homo sapiens
ggggtaggcaggtgatctgatc

SEQ ID NO: 7666892 - DNA, 22 bp, Homo sapiens
ggggtaggaagagaaaatagtg

SEQ ID NO: 7666893 - DNA, 22 bp, Homo sapiens
ggggtaggcaggtgatctgatc

SEQ ID NO: 7666894 - DNA, 22 bp, Homo sapiens
ggggtaggcaggtgatctgatc

SEQ ID NO: 7666895 - DNA, 22 bp, Homo sapiens
ggggtaggaagagaaaatagtg

SEQ ID NO: 7666896 - DNA, 22 bp, Homo sapiens
ggggtaggcaggtgatctgatc

SEQ ID NO: 7666897 - DNA, 22 bp, Homo sapiens
ggggtaggcaggtgatctgatc

SEQ ID NO: 7666898 - DNA, 22 bp, Homo sapiens
gggtgggcccagcccagagaag

SEQ ID NO: 7666899 - DNA, 22 bp, Homo sapiens
gggtgggcccagcccagagaag

SEQ ID NO: 7666900 - DNA, 22 bp, Homo sapiens
gggtgggcccagcccagagaag

SEQ ID NO: 7666901 - DNA, 22 bp, Homo sapiens
gggtgggcccagcccagagaag

SEQ ID NO: 7666902 - DNA, 22 bp, Homo sapiens
gggtgggccactgagcagcgtg

SEQ ID NO: 7666903 - DNA, 22 bp, Homo sapiens
gggtgggccactgagcagcgtg

SEQ ID NO: 7666904 - DNA, 22 bp, Homo sapiens
gggtgggccactgagcagcgtg

SEQ ID NO: 7666905 - DNA, 22 bp, Homo sapiens
gggtgggccactgagcagcgtg

SEQ ID NO: 7666906 - DNA, 22 bp, Homo sapiens
gggtgggccactgagcagcgtg

SEQ ID NO: 7666907 - DNA, 22 bp, Homo sapiens
gggtgggcctgtctggccatgt

SEQ ID NO: 7666908 - DNA, 22 bp, Homo sapiens
gggtgggcctgtctggccatgt

SEQ ID NO: 7666909 - DNA, 22 bp, Homo sapiens
gggtgggcccagcccagagaag

SEQ ID NO: 7666910 - DNA, 22 bp, Homo sapiens
gggtgggcccagcccagagaag

SEQ ID NO: 7666911 - DNA, 22 bp, Homo sapiens
gggtgggccccaggtatctgta

SEQ ID NO: 7666912 - DNA, 23 bp, Homo sapiens
gggtgggccaaattaggtagcct

SEQ ID NO: 7666913 - DNA, 23 bp, Homo sapiens
gggtgggccaaattaggtagcct

SEQ ID NO: 7666914 - DNA, 23 bp, Homo sapiens
gggtgggccaaattaggtagcct

SEQ ID NO: 7666915 - DNA, 23 bp, Homo sapiens
gggtgggccaaattaggtagcct

SEQ ID NO: 7666916 - DNA, 23 bp, Homo sapiens
gggtgggccaaattaggtagcct

SEQ ID NO: 7666917 - DNA, 22 bp, Homo sapiens
gggtgggccactgagcagcgtg

SEQ ID NO: 7666918 - DNA, 23 bp, Homo sapiens
gggtgggccaaattaggtagcct

SEQ ID NO: 7666919 - DNA, 17 bp, Homo sapiens
gggtgggcactgctggc

SEQ ID NO: 7666920 - DNA, 17 bp, Homo sapiens
gggtgggcactgctggc

SEQ ID NO: 7666921 - DNA, 17 bp, Homo sapiens
gggtgggcactgctggc

SEQ ID NO: 7666922 - DNA, 22 bp, Homo sapiens
gggtgggatggcaggagccgct

SEQ ID NO: 7666923 - DNA, 22 bp, Homo sapiens
gggtgggatggcaggagccgct

SEQ ID NO: 7666924 - DNA, 22 bp, Homo sapiens
gggtgggatggcaggagccgct

SEQ ID NO: 7666925 - DNA, 22 bp, Homo sapiens
gggtgggatggcaggagccgct

SEQ ID NO: 7666926 - DNA, 22 bp, Homo sapiens
gggtgggatggcaggagccgct

SEQ ID NO: 7666927 - DNA, 22 bp, Homo sapiens
gggtgggatggcaggagccgct

SEQ ID NO: 7666928 - DNA, 19 bp, Homo sapiens
gggtgaggaagagcgttgc

SEQ ID NO: 7666929 - DNA, 19 bp, Homo sapiens
gggtgaggaagagcgttgc

SEQ ID NO: 7666930 - DNA, 19 bp, Homo sapiens
gggtgaggaagagcgttgc

SEQ ID NO: 7666931 - DNA, 19 bp, Homo sapiens
gggtgaggaagagcgttgc

SEQ ID NO: 7666932 - DNA, 22 bp, Homo sapiens
gggtgaggagctgccagtcatg

SEQ ID NO: 7666933 - DNA, 20 bp, Homo sapiens
gggtgagatgtaggagaggg

SEQ ID NO: 7666934 - DNA, 22 bp, Homo sapiens
gggtgaggagctgccagtcatg

SEQ ID NO: 7666935 - DNA, 22 bp, Homo sapiens
gggtgaggagctgccagtcatg

SEQ ID NO: 7666936 - DNA, 22 bp, Homo sapiens
gggtgaggagctgccagtcatg

SEQ ID NO: 7666937 - DNA, 22 bp, Homo sapiens
gggtgaggagctgccagtcatg

SEQ ID NO: 7666938 - DNA, 22 bp, Homo sapiens
gggtgaggagctgccagtcatg

SEQ ID NO: 7666939 - DNA, 22 bp, Homo sapiens
gggtgaggagctgccagtcatg

SEQ ID NO: 7666940 - DNA, 22 bp, Homo sapiens
gggtgaggagctgccagtcatg

SEQ ID NO: 7666941 - DNA, 22 bp, Homo sapiens
gggtgaggagctgccagtcatg

SEQ ID NO: 7666942 - DNA, 22 bp, Homo sapiens
gggtggctgagaacaggacccc

SEQ ID NO: 7666943 - DNA, 22 bp, Homo sapiens
gggtggctgagaacaggacccc

SEQ ID NO: 7666944 - DNA, 22 bp, Homo sapiens
gggtgaggagctgccagtcatg

SEQ ID NO: 7666945 - DNA, 22 bp, Homo sapiens
gggtgaggagctgccagtcatg

SEQ ID NO: 7666946 - DNA, 22 bp, Homo sapiens
gggtgggaacaggatgccagga

SEQ ID NO: 7666947 - DNA, 22 bp, Homo sapiens
gggtgggaacaggatgccagga

SEQ ID NO: 7666948 - DNA, 22 bp, Homo sapiens
gggtgggaacaggatgccagga

SEQ ID NO: 7666949 - DNA, 22 bp, Homo sapiens
gggtgggaacaggatgccagga

SEQ ID NO: 7666950 - DNA, 22 bp, Homo sapiens
gggtgggaacaggatgccagga

SEQ ID NO: 7666951 - DNA, 22 bp, Homo sapiens
gggtggctgagaacaggacccc

SEQ ID NO: 7666952 - DNA, 22 bp, Homo sapiens
gggtgggaacaggatgccagga

SEQ ID NO: 7666953 - DNA, 22 bp, Homo sapiens
gggtgggaacaggatgccagga

SEQ ID NO: 7666954 - DNA, 22 bp, Homo sapiens
gggtgggaacaggatgccagga

SEQ ID NO: 7666955 - DNA, 22 bp, Homo sapiens
gggtgggaacaggatgccagga

SEQ ID NO: 7666956 - DNA, 22 bp, Homo sapiens
gggtgggatggcaggagccgct

SEQ ID NO: 7666957 - DNA, 22 bp, Homo sapiens
gggtgggatgccgctgtctcca

SEQ ID NO: 7666958 - DNA, 22 bp, Homo sapiens
gggtgggatgccgctgtctcca

SEQ ID NO: 7666959 - DNA, 22 bp, Homo sapiens
gggtgggaaggctaagggattg

SEQ ID NO: 7666960 - DNA, 22 bp, Homo sapiens
gggtgggaacaggatgccagga

SEQ ID NO: 7666961 - DNA, 22 bp, Homo sapiens
gggtgggaaggctaagggattg

SEQ ID NO: 7666962 - DNA, 22 bp, Homo sapiens
gggtgggaaggctaagggattg

SEQ ID NO: 7666963 - DNA, 22 bp, Homo sapiens
gggtgggatgccgctgtctcca

SEQ ID NO: 7666964 - DNA, 22 bp, Homo sapiens
gggtgggatgccgctgtctcca

SEQ ID NO: 7666965 - DNA, 22 bp, Homo sapiens
gggtgggatgccgctgtctcca

SEQ ID NO: 7666966 - DNA, 22 bp, Homo sapiens
gggtgacattaggaagatagac

SEQ ID NO: 7666967 - DNA, 22 bp, Homo sapiens
gggtgacatagtgatggggcat

SEQ ID NO: 7666968 - DNA, 22 bp, Homo sapiens
gggtgacatttcccaatgagcc

SEQ ID NO: 7666969 - DNA, 22 bp, Homo sapiens
gggtgaagctcctgcaggggcc

SEQ ID NO: 7666970 - DNA, 22 bp, Homo sapiens
gggtgaagctcctgcaggggcc

SEQ ID NO: 7666971 - DNA, 22 bp, Homo sapiens
gggtgaagctcctgcaggggcc

SEQ ID NO: 7666972 - DNA, 22 bp, Homo sapiens
gggtgaagctcctgcaggggcc

SEQ ID NO: 7666973 - DNA, 22 bp, Homo sapiens
gggtgacatagtgatggggcat

SEQ ID NO: 7666974 - DNA, 22 bp, Homo sapiens
gggtgacatagtgatggggcat

SEQ ID NO: 7666975 - DNA, 22 bp, Homo sapiens
gggtgacagcagctaatgacag

SEQ ID NO: 7666976 - DNA, 20 bp, Homo sapiens
gggtgagatgtaggagaggg

SEQ ID NO: 7666977 - DNA, 20 bp, Homo sapiens
gggtgagatgtaggagaggg

SEQ ID NO: 7666978 - DNA, 20 bp, Homo sapiens
gggtgagatgtaggagaggg

SEQ ID NO: 7666979 - DNA, 20 bp, Homo sapiens
gggtgagatgtaggagaggg

SEQ ID NO: 7666980 - DNA, 22 bp, Homo sapiens
gggtgagagtcaggcagagatt

SEQ ID NO: 7666981 - DNA, 22 bp, Homo sapiens
gggtgagagtcaggcagagatt

SEQ ID NO: 7666982 - DNA, 20 bp, Homo sapiens
gggtgagatgtaggagaggg

SEQ ID NO: 7666983 - DNA, 22 bp, Homo sapiens
gggtgagagtcaggcagagatt

SEQ ID NO: 7666984 - DNA, 22 bp, Homo sapiens
gggtgagacagaaagagcaaaa

SEQ ID NO: 7666985 - DNA, 22 bp, Homo sapiens
gggtgagacagaaagagcaaaa

SEQ ID NO: 7666986 - DNA, 22 bp, Homo sapiens
gggtctggcatgctgagatgga

SEQ ID NO: 7666987 - DNA, 22 bp, Homo sapiens
gggtctggcatgctgagatgga

SEQ ID NO: 7666988 - DNA, 22 bp, Homo sapiens
gggtctggcatgctgagatgga

SEQ ID NO: 7666989 - DNA, 22 bp, Homo sapiens
gggtctggcatgctgagatgga

SEQ ID NO: 7666990 - DNA, 22 bp, Homo sapiens
gggtctggcatgctgagatgga

SEQ ID NO: 7666991 - DNA, 22 bp, Homo sapiens
gggtctggcatgctgagatgga

SEQ ID NO: 7666992 - DNA, 22 bp, Homo sapiens
gggtgaagctcctgcaggggcc

SEQ ID NO: 7666993 - DNA, 22 bp, Homo sapiens
gggtcttggctctggaaatgct

SEQ ID NO: 7666994 - DNA, 22 bp, Homo sapiens
gggtcttggctctggaaatgct

SEQ ID NO: 7666995 - DNA, 22 bp, Homo sapiens
gggtcttcatttattctacact

SEQ ID NO: 7666996 - DNA, 22 bp, Homo sapiens
gggtcttcgccgccgccataac

SEQ ID NO: 7666997 - DNA, 22 bp, Homo sapiens
gggtcttctgatataggtccag

SEQ ID NO: 7666998 - DNA, 22 bp, Homo sapiens
gggtctgggcaggcgcttcctc

SEQ ID NO: 7666999 - DNA, 22 bp, Homo sapiens
gggtctggcatgctgagatgga

SEQ ID NO: 7667000 - DNA, 22 bp, Homo sapiens
gggtctgggcaggcgcttcctc

SEQ ID NO: 7667001 - DNA, 22 bp, Homo sapiens
gggtctggagggcagcccttct

SEQ ID NO: 7667002 - DNA, 22 bp, Homo sapiens
gggtctggagatccgggtgaag

SEQ ID NO: 7667003 - DNA, 22 bp, Homo sapiens
gggtctggagatccgggtgaag

SEQ ID NO: 7667004 - DNA, 22 bp, Homo sapiens
gggtctggagatccgggtgaag

SEQ ID NO: 7667005 - DNA, 22 bp, Homo sapiens
gggtctggagatccgggtgaag

SEQ ID NO: 7667006 - DNA, 22 bp, Homo sapiens
gggtctggacggctgcaggaag

SEQ ID NO: 7667007 - DNA, 22 bp, Homo sapiens
gggtctggagatccgggtgaag

SEQ ID NO: 7667008 - DNA, 22 bp, Homo sapiens
gggtctggacggctgcaggaag

SEQ ID NO: 7667009 - DNA, 22 bp, Homo sapiens
gggtctgctccacctgcagccc

SEQ ID NO: 7667010 - DNA, 22 bp, Homo sapiens
gggtctgctccacctgcagccc

SEQ ID NO: 7667011 - DNA, 22 bp, Homo sapiens
gggtctgagctgaggggaaatc

SEQ ID NO: 7667012 - DNA, 22 bp, Homo sapiens
gggtctgagctgaggggaaatc

SEQ ID NO: 7667013 - DNA, 22 bp, Homo sapiens
gggtctggacggctgcaggaag

SEQ ID NO: 7667014 - DNA, 22 bp, Homo sapiens
gggtctggacggctgcaggaag

SEQ ID NO: 7667015 - DNA, 22 bp, Homo sapiens
gggtctggacggctgcaggaag

SEQ ID NO: 7667016 - DNA, 22 bp, Homo sapiens
gggtctcctaatggaggatgac

SEQ ID NO: 7667017 - DNA, 22 bp, Homo sapiens
gggtctcctgagagaagatgct

SEQ ID NO: 7667018 - DNA, 22 bp, Homo sapiens
gggtctcctgagagaagatgct

SEQ ID NO: 7667019 - DNA, 22 bp, Homo sapiens
gggtctctcagaaggctgcaat

SEQ ID NO: 7667020 - DNA, 22 bp, Homo sapiens
gggtctctcctccccagctgtg

SEQ ID NO: 7667021 - DNA, 22 bp, Homo sapiens
gggtctctcctccccagctgtg

SEQ ID NO: 7667022 - DNA, 22 bp, Homo sapiens
gggtctctcctccccagctgtg

SEQ ID NO: 7667023 - DNA, 22 bp, Homo sapiens
gggtctctgagcttccaagata

SEQ ID NO: 7667024 - DNA, 22 bp, Homo sapiens
ggggaagggagtccaagtgtta

SEQ ID NO: 7667025 - DNA, 20 bp, Homo sapiens
ggggaagtcactgcagtcag

SEQ ID NO: 7667026 - DNA, 20 bp, Homo sapiens
ggggaagtcactgcagtcag

SEQ ID NO: 7667027 - DNA, 23 bp, Homo sapiens
ggggaagtggcagtgagtgaggc

SEQ ID NO: 7667028 - DNA, 20 bp, Homo sapiens
ggggaagtcactgcagtcag

SEQ ID NO: 7667029 - DNA, 23 bp, Homo sapiens
ggggaagtggcagtgagtgaggc

SEQ ID NO: 7667030 - DNA, 23 bp, Homo sapiens
ggggaagtggcagtgagtgaggc

SEQ ID NO: 7667031 - DNA, 22 bp, Homo sapiens
ggggaatgagtgcccagaaagc

SEQ ID NO: 7667032 - DNA, 23 bp, Homo sapiens
ggggaagtggcagtgagtgaggc

SEQ ID NO: 7667033 - DNA, 23 bp, Homo sapiens
ggggaagtggcagtgagtgaggc

SEQ ID NO: 7667034 - DNA, 23 bp, Homo sapiens
ggggacagagggcagcccgcatc

SEQ ID NO: 7667035 - DNA, 23 bp, Homo sapiens
ggggacagagggcagcccgcatc

SEQ ID NO: 7667036 - DNA, 23 bp, Homo sapiens
ggggacagagggcagcccgcatc

SEQ ID NO: 7667037 - DNA, 23 bp, Homo sapiens
ggggacagagggcagcccgcatc

SEQ ID NO: 7667038 - DNA, 23 bp, Homo sapiens
ggggacagagggcagcccgcatc

SEQ ID NO: 7667039 - DNA, 23 bp, Homo sapiens
ggggacagagggcagcccgcatc

SEQ ID NO: 7667040 - DNA, 23 bp, Homo sapiens
ggggacagagggcagcccgcatc

SEQ ID NO: 7667041 - DNA, 23 bp, Homo sapiens
ggggacagagggcagcccgcatc

SEQ ID NO: 7667042 - DNA, 23 bp, Homo sapiens
ggggacagagggcagcccgcatc

SEQ ID NO: 7667043 - DNA, 23 bp, Homo sapiens
ggggacagagggcagcccgcatc

SEQ ID NO: 7667044 - DNA, 23 bp, Homo sapiens
ggggacagagggcagcccgcatc

SEQ ID NO: 7667045 - DNA, 22 bp, Homo sapiens
ggggaatgagtgcccagaaagc

SEQ ID NO: 7667046 - DNA, 22 bp, Homo sapiens
ggggaagggagtccaagtgtta

SEQ ID NO: 7667047 - DNA, 22 bp, Homo sapiens
ggggaagggagtccaagtgtta

SEQ ID NO: 7667048 - DNA, 16 bp, Homo sapiens
ggggaaggcaagaggg

SEQ ID NO: 7667049 - DNA, 22 bp, Homo sapiens
ggggaagggagtccaagtgtta

SEQ ID NO: 7667050 - DNA, 22 bp, Homo sapiens
ggggaagggagtccaagtgtta

SEQ ID NO: 7667051 - DNA, 22 bp, Homo sapiens
ggggaagggagtccaagtgtta

SEQ ID NO: 7667052 - DNA, 16 bp, Homo sapiens
ggggaaggcaagaggg

SEQ ID NO: 7667053 - DNA, 22 bp, Homo sapiens
ggggaagggagtccaagtgtta

SEQ ID NO: 7667054 - DNA, 22 bp, Homo sapiens
ggggaagggagtccaagtgtta

SEQ ID NO: 7667055 - DNA, 22 bp, Homo sapiens
ggggaagggagtccaagtgtta

SEQ ID NO: 7667056 - DNA, 22 bp, Homo sapiens
ggggaaggattgagttgaccca

SEQ ID NO: 7667057 - DNA, 22 bp, Homo sapiens
ggggaaggattgagttgaccca

SEQ ID NO: 7667058 - DNA, 22 bp, Homo sapiens
ggggaaggattgagttgaccca

SEQ ID NO: 7667059 - DNA, 22 bp, Homo sapiens
ggggaaggattgagttgaccca

SEQ ID NO: 7667060 - DNA, 16 bp, Homo sapiens
ggggaaggcaagaggg

SEQ ID NO: 7667061 - DNA, 16 bp, Homo sapiens
ggggaaggcaagaggg

SEQ ID NO: 7667062 - DNA, 16 bp, Homo sapiens
ggggaaggcaagaggg

SEQ ID NO: 7667063 - DNA, 16 bp, Homo sapiens
ggggaaggcaagaggg

SEQ ID NO: 7667064 - DNA, 16 bp, Homo sapiens
ggggaaggcaagaggg

SEQ ID NO: 7667065 - DNA, 16 bp, Homo sapiens
ggggaaggcaagaggg

SEQ ID NO: 7667066 - DNA, 22 bp, Homo sapiens
ggggacagttaaagaccaagac

SEQ ID NO: 7667067 - DNA, 22 bp, Homo sapiens
ggggacagttaaagaccaagac

SEQ ID NO: 7667068 - DNA, 22 bp, Homo sapiens
ggggacagtcgatctagtgatt

SEQ ID NO: 7667069 - DNA, 22 bp, Homo sapiens
ggggacagtcgatctagtgatt

SEQ ID NO: 7667070 - DNA, 22 bp, Homo sapiens
ggggacagtcgatctagtgatt

SEQ ID NO: 7667071 - DNA, 22 bp, Homo sapiens
ggggacagttaaagaccaagac

SEQ ID NO: 7667072 - DNA, 22 bp, Homo sapiens
ggggacagttaaagaccaagac

SEQ ID NO: 7667073 - DNA, 22 bp, Homo sapiens
ggggacagttaaagaccaagac

SEQ ID NO: 7667074 - DNA, 22 bp, Homo sapiens
ggggacagttaaagaccaagac

SEQ ID NO: 7667075 - DNA, 22 bp, Homo sapiens
ggggacagtcgatctagtgatt

SEQ ID NO: 7667076 - DNA, 22 bp, Homo sapiens
ggggacagtcgatctagtgatt

SEQ ID NO: 7667077 - DNA, 22 bp, Homo sapiens
ggggacagtcgatctagtgatt

SEQ ID NO: 7667078 - DNA, 22 bp, Homo sapiens
ggggacagtcgatctagtgatt

SEQ ID NO: 7667079 - DNA, 22 bp, Homo sapiens
ggggacagtcgatctagtgatt

SEQ ID NO: 7667080 - DNA, 22 bp, Homo sapiens
ggggacagtcgatctagtgatt

SEQ ID NO: 7667081 - DNA, 22 bp, Homo sapiens
ggggacagtcgatctagtgatt

SEQ ID NO: 7667082 - DNA, 22 bp, Homo sapiens
ggggacagtcgatctagtgatt

SEQ ID NO: 7667083 - DNA, 22 bp, Homo sapiens
ggggacagtcgatctagtgatt

SEQ ID NO: 7667084 - DNA, 22 bp, Homo sapiens
ggggacagtcgatctagtgatt

SEQ ID NO: 7667085 - DNA, 22 bp, Homo sapiens
ggggacagttaaagaccaagac

SEQ ID NO: 7667086 - DNA, 22 bp, Homo sapiens
ggggacagttaaagaccaagac

SEQ ID NO: 7667087 - DNA, 22 bp, Homo sapiens
ggggacagttaaagaccaagac

SEQ ID NO: 7667088 - DNA, 23 bp, Homo sapiens
ggggacagttcccactggggtct

SEQ ID NO: 7667089 - DNA, 23 bp, Homo sapiens
ggggacagttcccactggggtct

SEQ ID NO: 7667090 - DNA, 23 bp, Homo sapiens
ggggacagttcccactggggtct

SEQ ID NO: 7667091 - DNA, 23 bp, Homo sapiens
ggggacagttcccactggggtct

SEQ ID NO: 7667092 - DNA, 23 bp, Homo sapiens
ggggacagttcccactggggtct

SEQ ID NO: 7667093 - DNA, 23 bp, Homo sapiens
ggggacagttcccactggggtct

SEQ ID NO: 7667094 - DNA, 23 bp, Homo sapiens
ggggacagttcccactggggtct

SEQ ID NO: 7667095 - DNA, 23 bp, Homo sapiens
ggggacagttcccactggggtct

SEQ ID NO: 7667096 - DNA, 23 bp, Homo sapiens
ggggacagttcccactggggtct

SEQ ID NO: 7667097 - DNA, 23 bp, Homo sapiens
ggggacagttcccactggggtct

SEQ ID NO: 7667098 - DNA, 22 bp, Homo sapiens
ggggaccctcaggactgcgtct

SEQ ID NO: 7667099 - DNA, 22 bp, Homo sapiens
ggggaccctcaggactgcgtct

SEQ ID NO: 7667100 - DNA, 22 bp, Homo sapiens
ggggaccctcaggactgcgtct

SEQ ID NO: 7667101 - DNA, 22 bp, Homo sapiens
ggggaccctcaggactgcgtct

SEQ ID NO: 7667102 - DNA, 22 bp, Homo sapiens
gggctggagacaagtgagccgc

SEQ ID NO: 7667103 - DNA, 22 bp, Homo sapiens
gggctggagacaagtgagccgc

SEQ ID NO: 7667104 - DNA, 22 bp, Homo sapiens
gggctggagacaagtgagccgc

SEQ ID NO: 7667105 - DNA, 22 bp, Homo sapiens
gggctggagacaagtgagccgc

SEQ ID NO: 7667106 - DNA, 16 bp, Homo sapiens
gggctggagatacagt

SEQ ID NO: 7667107 - DNA, 16 bp, Homo sapiens
gggctggagatacagt

SEQ ID NO: 7667108 - DNA, 22 bp, Homo sapiens
gggctggagagtcccacgtggg

SEQ ID NO: 7667109 - DNA, 22 bp, Homo sapiens
gggctggagagtcccacgtggg

SEQ ID NO: 7667110 - DNA, 22 bp, Homo sapiens
gggctggagagtcccacgtggg

SEQ ID NO: 7667111 - DNA, 22 bp, Homo sapiens
gggctggagacaagtgagccgc

SEQ ID NO: 7667112 - DNA, 21 bp, Homo sapiens
gggctggacatggtggctcat

SEQ ID NO: 7667113 - DNA, 21 bp, Homo sapiens
gggctggacatggtggctcat

SEQ ID NO: 7667114 - DNA, 21 bp, Homo sapiens
gggctggacatggtggctcat

SEQ ID NO: 7667115 - DNA, 22 bp, Homo sapiens
gggctggaccgcgacccctgag

SEQ ID NO: 7667116 - DNA, 22 bp, Homo sapiens
gggctggaccgcgacccctgag

SEQ ID NO: 7667117 - DNA, 22 bp, Homo sapiens
gggctggaccgcgacccctgag

SEQ ID NO: 7667118 - DNA, 22 bp, Homo sapiens
gggctggactgcattgcctcgc

SEQ ID NO: 7667119 - DNA, 22 bp, Homo sapiens
gggctggactgcattgcctcgc

SEQ ID NO: 7667120 - DNA, 22 bp, Homo sapiens
gggctggaccgctcgcctccct

SEQ ID NO: 7667121 - DNA, 22 bp, Homo sapiens
gggctggactgcattgcctcgc

SEQ ID NO: 7667122 - DNA, 22 bp, Homo sapiens
gggctggaccgctcgcctccct

SEQ ID NO: 7667123 - DNA, 22 bp, Homo sapiens
gggctggaccgcgacccctgag

SEQ ID NO: 7667124 - DNA, 22 bp, Homo sapiens
gggctggagcctggcggtggtt

SEQ ID NO: 7667125 - DNA, 22 bp, Homo sapiens
gggctggagcctggcggtggtt

SEQ ID NO: 7667126 - DNA, 22 bp, Homo sapiens
gggctggagccagctgtggctg

SEQ ID NO: 7667127 - DNA, 22 bp, Homo sapiens
gggctggagcctggcggtggtt

SEQ ID NO: 7667128 - DNA, 22 bp, Homo sapiens
gggctggagcctggcggtggtt

SEQ ID NO: 7667129 - DNA, 22 bp, Homo sapiens
gggctggagcctggcggtggtt

SEQ ID NO: 7667130 - DNA, 22 bp, Homo sapiens
gggctggagcctggcggtggtt

SEQ ID NO: 7667131 - DNA, 22 bp, Homo sapiens
gggctggagcctggcggtggtt

SEQ ID NO: 7667132 - DNA, 22 bp, Homo sapiens
gggctggatctcctgcaggcag

SEQ ID NO: 7667133 - DNA, 22 bp, Homo sapiens
gggctggatctcctgcaggcag

SEQ ID NO: 7667134 - DNA, 22 bp, Homo sapiens
gggctggatctcctgcaggcag

SEQ ID NO: 7667135 - DNA, 22 bp, Homo sapiens
gggctggagccagctgtggctg

SEQ ID NO: 7667136 - DNA, 22 bp, Homo sapiens
gggctggagccagctgtggctg

SEQ ID NO: 7667137 - DNA, 22 bp, Homo sapiens
gggctggagccagctgtggctg

SEQ ID NO: 7667138 - DNA, 22 bp, Homo sapiens
gggctggagccagctgtggctg

SEQ ID NO: 7667139 - DNA, 22 bp, Homo sapiens
gggctggagccagctgtggctg

SEQ ID NO: 7667140 - DNA, 22 bp, Homo sapiens
gggctggagccagctgtggctg

SEQ ID NO: 7667141 - DNA, 22 bp, Homo sapiens
gggctggagccagctgtggctg

SEQ ID NO: 7667142 - DNA, 22 bp, Homo sapiens
gggctggagatgcttatggaga

SEQ ID NO: 7667143 - DNA, 22 bp, Homo sapiens
gggctggagatgcttatggaga

SEQ ID NO: 7667144 - DNA, 22 bp, Homo sapiens
gggctggatctcctgcaggcag

SEQ ID NO: 7667145 - DNA, 22 bp, Homo sapiens
gggctggatctcctgcaggcag

SEQ ID NO: 7667146 - DNA, 17 bp, Homo sapiens
gggctggatggccatgg

SEQ ID NO: 7667147 - DNA, 17 bp, Homo sapiens
gggctggatggccatgg

SEQ ID NO: 7667148 - DNA, 17 bp, Homo sapiens
gggctggatggccatgg

SEQ ID NO: 7667149 - DNA, 17 bp, Homo sapiens
gggctggatggccatgg

SEQ ID NO: 7667150 - DNA, 22 bp, Homo sapiens
gggctggatgggagccttggcc

SEQ ID NO: 7667151 - DNA, 17 bp, Homo sapiens
gggctggatggccatgg

SEQ ID NO: 7667152 - DNA, 22 bp, Homo sapiens
gggctggatgggagccttggcc

SEQ ID NO: 7667153 - DNA, 22 bp, Homo sapiens
gggctggatgggagccttggcc

SEQ ID NO: 7667154 - DNA, 22 bp, Homo sapiens
gggctggatgggagccttggcc

SEQ ID NO: 7667155 - DNA, 22 bp, Homo sapiens
gggctggattactgaactgagt

SEQ ID NO: 7667156 - DNA, 22 bp, Homo sapiens
gggctggatgtttgatgacgaa

SEQ ID NO: 7667157 - DNA, 22 bp, Homo sapiens
gggctggattactgaactgagt

SEQ ID NO: 7667158 - DNA, 22 bp, Homo sapiens
gggctggatgtttgatgacgaa

SEQ ID NO: 7667159 - DNA, 22 bp, Homo sapiens
gggctggatgtttgatgacgaa

SEQ ID NO: 7667160 - DNA, 22 bp, Homo sapiens
gggctggatgtttgatgacgaa

SEQ ID NO: 7667161 - DNA, 22 bp, Homo sapiens
gggctggatgggagccttggcc

SEQ ID NO: 7667162 - DNA, 22 bp, Homo sapiens
gggctggatgggagccttggcc

SEQ ID NO: 7667163 - DNA, 22 bp, Homo sapiens
gggctggatgggagccttggcc

SEQ ID NO: 7667164 - DNA, 22 bp, Homo sapiens
gggctggatgtttgatgacgaa

SEQ ID NO: 7667165 - DNA, 22 bp, Homo sapiens
gggctggcaggacctgggctga

SEQ ID NO: 7667166 - DNA, 22 bp, Homo sapiens
gggctggcaggacctgggctga

SEQ ID NO: 7667167 - DNA, 22 bp, Homo sapiens
gggctggcaggacctgggctga

SEQ ID NO: 7667168 - DNA, 22 bp, Homo sapiens
gggctggcatcagttgccgaga

SEQ ID NO: 7667169 - DNA, 22 bp, Homo sapiens
gggctggcatcagttgccgaga

SEQ ID NO: 7667170 - DNA, 22 bp, Homo sapiens
gggctggcatcggttgctgaga

SEQ ID NO: 7667171 - DNA, 22 bp, Homo sapiens
ggggaaggattgagttgaccca

SEQ ID NO: 7667172 - DNA, 22 bp, Homo sapiens
gggctggcatcagttgccgaga

SEQ ID NO: 7667173 - DNA, 22 bp, Homo sapiens
gggctggcaggacctgggctga

SEQ ID NO: 7667174 - DNA, 22 bp, Homo sapiens
gggctggcaggacctgggctga

SEQ ID NO: 7667175 - DNA, 22 bp, Homo sapiens
gggctggcaggacctgggctga

SEQ ID NO: 7667176 - DNA, 22 bp, Homo sapiens
gggctggcaggacctgggctga

SEQ ID NO: 7667177 - DNA, 22 bp, Homo sapiens
gggctggcaggacctgggctga

SEQ ID NO: 7667178 - DNA, 22 bp, Homo sapiens
gggctggcaggacctgggctga

SEQ ID NO: 7667179 - DNA, 22 bp, Homo sapiens
gggctggcaggacctgggctga

SEQ ID NO: 7667180 - DNA, 22 bp, Homo sapiens
gggctctgtggatgtgagagct

SEQ ID NO: 7667181 - DNA, 22 bp, Homo sapiens
gggctctgtggatgtgagagct

SEQ ID NO: 7667182 - DNA, 22 bp, Homo sapiens
gggctctgtggcttccttctta

SEQ ID NO: 7667183 - DNA, 22 bp, Homo sapiens
gggctctgtggcttccttctta

SEQ ID NO: 7667184 - DNA, 22 bp, Homo sapiens
gggctctgtgcaccccagcacc

SEQ ID NO: 7667185 - DNA, 22 bp, Homo sapiens
gggctctgtgcaccccagcacc

SEQ ID NO: 7667186 - DNA, 22 bp, Homo sapiens
gggctctgtggatgtgagagct

SEQ ID NO: 7667187 - DNA, 22 bp, Homo sapiens
gggctctgtggatgtgagagct

SEQ ID NO: 7667188 - DNA, 22 bp, Homo sapiens
gggctctgtggatgtgagagct

SEQ ID NO: 7667189 - DNA, 22 bp, Homo sapiens
gggctctgtggatgtgagagct

SEQ ID NO: 7667190 - DNA, 22 bp, Homo sapiens
gggctctgtccattccttcata

SEQ ID NO: 7667191 - DNA, 22 bp, Homo sapiens
gggctctgtgcaccccagcacc

SEQ ID NO: 7667192 - DNA, 22 bp, Homo sapiens
gggctctgtgcaccccagcacc

SEQ ID NO: 7667193 - DNA, 22 bp, Homo sapiens
gggctctgtgcaccccagcacc

SEQ ID NO: 7667194 - DNA, 22 bp, Homo sapiens
gggctctgtccattccttcata

SEQ ID NO: 7667195 - DNA, 22 bp, Homo sapiens
gggctctgtccattccttcata

SEQ ID NO: 7667196 - DNA, 22 bp, Homo sapiens
gggctctgtgcaccccagcacc

SEQ ID NO: 7667197 - DNA, 22 bp, Homo sapiens
gggctctgtgcaccccagcacc

SEQ ID NO: 7667198 - DNA, 22 bp, Homo sapiens
gggctctgtgcaccccagcacc

SEQ ID NO: 7667199 - DNA, 22 bp, Homo sapiens
gggctctgtgcaccccagcacc

SEQ ID NO: 7667200 - DNA, 22 bp, Homo sapiens
gggctctgtgcaccccagcacc

SEQ ID NO: 7667201 - DNA, 22 bp, Homo sapiens
gggctctggtcctgaactgaag

SEQ ID NO: 7667202 - DNA, 22 bp, Homo sapiens
gggctctggtcctgaactgaag

SEQ ID NO: 7667203 - DNA, 22 bp, Homo sapiens
gggctctggtcctgaactgaag

SEQ ID NO: 7667204 - DNA, 22 bp, Homo sapiens
gggctctggtcctgaactgaag

SEQ ID NO: 7667205 - DNA, 22 bp, Homo sapiens
gggctctggtacttcctggctc

SEQ ID NO: 7667206 - DNA, 22 bp, Homo sapiens
gggctctggtacttcctggctc

SEQ ID NO: 7667207 - DNA, 22 bp, Homo sapiens
gggctctggtacttcctggctc

SEQ ID NO: 7667208 - DNA, 22 bp, Homo sapiens
gggctctgtccattccttcata

SEQ ID NO: 7667209 - DNA, 22 bp, Homo sapiens
gggctctgtccattccttcata

SEQ ID NO: 7667210 - DNA, 22 bp, Homo sapiens
gggctctgtccattccttcata

SEQ ID NO: 7667211 - DNA, 20 bp, Homo sapiens
gggctctgtaaggttgaaag

SEQ ID NO: 7667212 - DNA, 22 bp, Homo sapiens
gggctctggtgccttcacagaa

SEQ ID NO: 7667213 - DNA, 22 bp, Homo sapiens
gggctctggtcctgaactgaag

SEQ ID NO: 7667214 - DNA, 22 bp, Homo sapiens
gggctctggtgccttcacagaa

SEQ ID NO: 7667215 - DNA, 22 bp, Homo sapiens
gggctctggtgccttcacagaa

SEQ ID NO: 7667216 - DNA, 22 bp, Homo sapiens
gggctctggtgctattgacgaa

SEQ ID NO: 7667217 - DNA, 22 bp, Homo sapiens
gggctctgggtcgtgtctccat

SEQ ID NO: 7667218 - DNA, 22 bp, Homo sapiens
gggctctggtacttcctggctc

SEQ ID NO: 7667219 - DNA, 22 bp, Homo sapiens
gggctctggtacttcctggctc

SEQ ID NO: 7667220 - DNA, 22 bp, Homo sapiens
gggctctggtacttcctggctc

SEQ ID NO: 7667221 - DNA, 22 bp, Homo sapiens
gggctctggtacttcctggctc

SEQ ID NO: 7667222 - DNA, 22 bp, Homo sapiens
gggctctgggtcgtgtctccat

SEQ ID NO: 7667223 - DNA, 22 bp, Homo sapiens
gggctctgggtcgtgtctccat

SEQ ID NO: 7667224 - DNA, 22 bp, Homo sapiens
gggctagggcctgctatggttt

SEQ ID NO: 7667225 - DNA, 22 bp, Homo sapiens
gggctaggcttggccagcactg

SEQ ID NO: 7667226 - DNA, 22 bp, Homo sapiens
gggctaggcttggccagcactg

SEQ ID NO: 7667227 - DNA, 20 bp, Homo sapiens
gggctaggtagccatttggc

SEQ ID NO: 7667228 - DNA, 20 bp, Homo sapiens
gggctaggtagccatttggc

SEQ ID NO: 7667229 - DNA, 22 bp, Homo sapiens
gggctagcagattctacctaat

SEQ ID NO: 7667230 - DNA, 22 bp, Homo sapiens
gggctagaagttagctagagaa

SEQ ID NO: 7667231 - DNA, 22 bp, Homo sapiens
gggctagcctcttccctgctcc

SEQ ID NO: 7667232 - DNA, 22 bp, Homo sapiens
gggctagcctcttccctgctcc

SEQ ID NO: 7667233 - DNA, 22 bp, Homo sapiens
gggctagcctcttccctgctcc

SEQ ID NO: 7667234 - DNA, 20 bp, Homo sapiens
gggctagaccagggcagagg

SEQ ID NO: 7667235 - DNA, 22 bp, Homo sapiens
gggctagaatccgcgtctcttg

SEQ ID NO: 7667236 - DNA, 20 bp, Homo sapiens
gggctagaccagggcagagg

SEQ ID NO: 7667237 - DNA, 22 bp, Homo sapiens
gggctagcctcttccctgctcc

SEQ ID NO: 7667238 - DNA, 20 bp, Homo sapiens
gggctagaccagggcagagg

SEQ ID NO: 7667239 - DNA, 22 bp, Homo sapiens
gggctagcctcttccctgctcc

SEQ ID NO: 7667240 - DNA, 22 bp, Homo sapiens
gggctagcctcttccctgctcc

SEQ ID NO: 7667241 - DNA, 22 bp, Homo sapiens
gggctagcctcttccctgctcc

SEQ ID NO: 7667242 - DNA, 22 bp, Homo sapiens
gggctaggcttggccagcactg

SEQ ID NO: 7667243 - DNA, 22 bp, Homo sapiens
gggctaggcttggccagcactg

SEQ ID NO: 7667244 - DNA, 18 bp, Homo sapiens
gggctaggcaaggaccac

SEQ ID NO: 7667245 - DNA, 18 bp, Homo sapiens
gggctaggcaaggaccac

SEQ ID NO: 7667246 - DNA, 18 bp, Homo sapiens
gggctaggcaaggaccac

SEQ ID NO: 7667247 - DNA, 18 bp, Homo sapiens
gggctaggcaaggaccac

SEQ ID NO: 7667248 - DNA, 21 bp, Homo sapiens
gggctggacatggtggctcat

SEQ ID NO: 7667249 - DNA, 21 bp, Homo sapiens
gggctggacatggtggctcat

SEQ ID NO: 7667250 - DNA, 21 bp, Homo sapiens
gggctggacatggtggctcat

SEQ ID NO: 7667251 - DNA, 22 bp, Homo sapiens
gggctggacatctaaggtagct

SEQ ID NO: 7667252 - DNA, 22 bp, Homo sapiens
gggctggacatctaaggtagct

SEQ ID NO: 7667253 - DNA, 22 bp, Homo sapiens
gggctggaagacaggaaatgct

SEQ ID NO: 7667254 - DNA, 22 bp, Homo sapiens
gggctggacatctaaggtagct

SEQ ID NO: 7667255 - DNA, 22 bp, Homo sapiens
gggctggaagtgcattgatgct

SEQ ID NO: 7667256 - DNA, 22 bp, Homo sapiens
gggctggaagtgcattgatgct

SEQ ID NO: 7667257 - DNA, 22 bp, Homo sapiens
gggctggaagtgcattgatgct

SEQ ID NO: 7667258 - DNA, 22 bp, Homo sapiens
gggctgcttttttcttagcaga

SEQ ID NO: 7667259 - DNA, 22 bp, Homo sapiens
gggctgcttttaagggtctcag

SEQ ID NO: 7667260 - DNA, 22 bp, Homo sapiens
gggctgcttttttcttagcaga

SEQ ID NO: 7667261 - DNA, 22 bp, Homo sapiens
gggctggaaaaacaacatacaa

SEQ ID NO: 7667262 - DNA, 22 bp, Homo sapiens
gggctggaaaaacaacatacaa

SEQ ID NO: 7667263 - DNA, 22 bp, Homo sapiens
gggctggaagacaggaaatgct

SEQ ID NO: 7667264 - DNA, 22 bp, Homo sapiens
gggctggaagacaggaaatgct

SEQ ID NO: 7667265 - DNA, 22 bp, Homo sapiens
gggctggaagacaggaaatgct

SEQ ID NO: 7667266 - DNA, 22 bp, Homo sapiens
gggctggaaaaacaacatacaa

SEQ ID NO: 7667267 - DNA, 22 bp, Homo sapiens
gggctggaaaaacaacatacaa

SEQ ID NO: 7667268 - DNA, 22 bp, Homo sapiens
gggctgcttttaagggtctcag

SEQ ID NO: 7667269 - DNA, 22 bp, Homo sapiens
gggctgcttttttcttagcaga

SEQ ID NO: 7667270 - DNA, 22 bp, Homo sapiens
gggctgcttttaagggtctcag

SEQ ID NO: 7667271 - DNA, 22 bp, Homo sapiens
gggctgcttttaagggtctcag

SEQ ID NO: 7667272 - DNA, 22 bp, Homo sapiens
gggctgcttggaggaggcgctc

SEQ ID NO: 7667273 - DNA, 22 bp, Homo sapiens
gggctgcttggaggaggcgctc

SEQ ID NO: 7667274 - DNA, 22 bp, Homo sapiens
gggctgcttggaggaggcgctc

SEQ ID NO: 7667275 - DNA, 22 bp, Homo sapiens
gggctgcttggaggaggcgctc

SEQ ID NO: 7667276 - DNA, 22 bp, Homo sapiens
gggctgcttcctggggaatgct

SEQ ID NO: 7667277 - DNA, 22 bp, Homo sapiens
gggctgcttcctggggaatgct

SEQ ID NO: 7667278 - DNA, 22 bp, Homo sapiens
gggctgcttgctggagacagac

SEQ ID NO: 7667279 - DNA, 22 bp, Homo sapiens
gggctgcttgctggagacagac

SEQ ID NO: 7667280 - DNA, 22 bp, Homo sapiens
gggctgcttgctggagacagac

SEQ ID NO: 7667281 - DNA, 22 bp, Homo sapiens
gggctgcttgctggagacagac

SEQ ID NO: 7667282 - DNA, 22 bp, Homo sapiens
gggctgcttgctggagacagac

SEQ ID NO: 7667283 - DNA, 22 bp, Homo sapiens
gggctgcttatactgatgataa

SEQ ID NO: 7667284 - DNA, 22 bp, Homo sapiens
gggctgagacgatggggtcttc

SEQ ID NO: 7667285 - DNA, 22 bp, Homo sapiens
gggctgagacgatggggtcttc

SEQ ID NO: 7667286 - DNA, 22 bp, Homo sapiens
gggctgagacgatggggtcttc

SEQ ID NO: 7667287 - DNA, 22 bp, Homo sapiens
gggctgagacgatggggtcttc

SEQ ID NO: 7667288 - DNA, 22 bp, Homo sapiens
gggctgagagctggaatctgag

SEQ ID NO: 7667289 - DNA, 22 bp, Homo sapiens
gggctgagacgatggggtcttc

SEQ ID NO: 7667290 - DNA, 22 bp, Homo sapiens
gggctgagacgatggggtcttc

SEQ ID NO: 7667291 - DNA, 22 bp, Homo sapiens
gggctgagacgatggggtcttc

SEQ ID NO: 7667292 - DNA, 22 bp, Homo sapiens
gggctgagacgatggggtcttc

SEQ ID NO: 7667293 - DNA, 22 bp, Homo sapiens
gggctgagaattcagctttcct

SEQ ID NO: 7667294 - DNA, 22 bp, Homo sapiens
gggctgagacgatggggtcttc

SEQ ID NO: 7667295 - DNA, 22 bp, Homo sapiens
gggctgagaattcagctttcct

SEQ ID NO: 7667296 - DNA, 22 bp, Homo sapiens
gggctgagaattcagctttcct

SEQ ID NO: 7667297 - DNA, 22 bp, Homo sapiens
gggctgagaattcagctttcct

SEQ ID NO: 7667298 - DNA, 22 bp, Homo sapiens
gggctgagaattcagctttcct

SEQ ID NO: 7667299 - DNA, 22 bp, Homo sapiens
gggctctgtggcttccttctta

SEQ ID NO: 7667300 - DNA, 22 bp, Homo sapiens
gggctctgtggttgtgctttgt

SEQ ID NO: 7667301 - DNA, 22 bp, Homo sapiens
gggctctgtggttgtgctttgt

SEQ ID NO: 7667302 - DNA, 22 bp, Homo sapiens
gggctctgtgttctagctctcg

SEQ ID NO: 7667303 - DNA, 22 bp, Homo sapiens
gggctctgtgttctagctctcg

SEQ ID NO: 7667304 - DNA, 22 bp, Homo sapiens
gggctctgtgttctagctctcg

SEQ ID NO: 7667305 - DNA, 22 bp, Homo sapiens
gggctctgtgttctagctctcg

SEQ ID NO: 7667306 - DNA, 22 bp, Homo sapiens
gggctgagaagttgatcccaag

SEQ ID NO: 7667307 - DNA, 22 bp, Homo sapiens
gggctgagaagttgatcccaag

SEQ ID NO: 7667308 - DNA, 22 bp, Homo sapiens
gggctgagaattcagctttcct

SEQ ID NO: 7667309 - DNA, 22 bp, Homo sapiens
gggctgagaattcagctttcct

SEQ ID NO: 7667310 - DNA, 22 bp, Homo sapiens
gggctgagaagttgatcccaag

SEQ ID NO: 7667311 - DNA, 22 bp, Homo sapiens
ggcaggtgctctgtgggcctgg

SEQ ID NO: 7667312 - DNA, 22 bp, Homo sapiens
ggcaggtgctctgtgggcctgg

SEQ ID NO: 7667313 - DNA, 22 bp, Homo sapiens
ggcaggtgctctgtgggcctgg

SEQ ID NO: 7667314 - DNA, 22 bp, Homo sapiens
ggcaggtgctctgtgggcctgg

SEQ ID NO: 7667315 - DNA, 22 bp, Homo sapiens
ggcaggtgctctgtgggcctgg

SEQ ID NO: 7667316 - DNA, 22 bp, Homo sapiens
ggcaggtgctctgtgggcctgg

SEQ ID NO: 7667317 - DNA, 22 bp, Homo sapiens
ggcaggtgctctgtgggcctgg

SEQ ID NO: 7667318 - DNA, 22 bp, Homo sapiens
ggcaggtgctgggagcatctca

SEQ ID NO: 7667319 - DNA, 22 bp, Homo sapiens
ggcaggtgctgggagcatctca

SEQ ID NO: 7667320 - DNA, 22 bp, Homo sapiens
ggcaggtgctgggagcatctca

SEQ ID NO: 7667321 - DNA, 22 bp, Homo sapiens
ggcaggtgctgggagcatctca

SEQ ID NO: 7667322 - DNA, 22 bp, Homo sapiens
ggcaggtgctgggagcatctca

SEQ ID NO: 7667323 - DNA, 22 bp, Homo sapiens
ggcaggtgcttgtcgaaggcct

SEQ ID NO: 7667324 - DNA, 22 bp, Homo sapiens
ggcaggtgcttgtcgaaggcct

SEQ ID NO: 7667325 - DNA, 22 bp, Homo sapiens
ggcaggtgcttgtcgaaggcct

SEQ ID NO: 7667326 - DNA, 20 bp, Homo sapiens
ggcaggtgctgtcccctcct

SEQ ID NO: 7667327 - DNA, 22 bp, Homo sapiens
ggcaggtggaaggtctccattc

SEQ ID NO: 7667328 - DNA, 22 bp, Homo sapiens
ggcaggtggaaggtctccattc

SEQ ID NO: 7667329 - DNA, 22 bp, Homo sapiens
ggcaggtggaagttggcagagc

SEQ ID NO: 7667330 - DNA, 22 bp, Homo sapiens
ggccacctctgccctactgagt

SEQ ID NO: 7667331 - DNA, 22 bp, Homo sapiens
ggcaggtggaagttggcagagc

SEQ ID NO: 7667332 - DNA, 22 bp, Homo sapiens
ggccagaagttggaaaagagcc

SEQ ID NO: 7667333 - DNA, 22 bp, Homo sapiens
ggccagaagttggaaaagagcc

SEQ ID NO: 7667334 - DNA, 22 bp, Homo sapiens
ggccagaagttggaaaagagcc

SEQ ID NO: 7667335 - DNA, 22 bp, Homo sapiens
ggccagaagttggaaaagagcc

SEQ ID NO: 7667336 - DNA, 22 bp, Homo sapiens
ggccagaagttggaaaagagcc

SEQ ID NO: 7667337 - DNA, 22 bp, Homo sapiens
ggccagacatatcgctcccaaa

SEQ ID NO: 7667338 - DNA, 22 bp, Homo sapiens
ggccagagaagtcagacccttg

SEQ ID NO: 7667339 - DNA, 22 bp, Homo sapiens
ggccagagaagtcagacccttg

SEQ ID NO: 7667340 - DNA, 22 bp, Homo sapiens
ggccagactgagtgaggtcaag

SEQ ID NO: 7667341 - DNA, 22 bp, Homo sapiens
ggccagactgagtgaggtcaag

SEQ ID NO: 7667342 - DNA, 22 bp, Homo sapiens
ggccagagaatatgccttacgt

SEQ ID NO: 7667343 - DNA, 22 bp, Homo sapiens
ggccagagaagtcagacccttg

SEQ ID NO: 7667344 - DNA, 22 bp, Homo sapiens
ggccagagaatatgccttacgt

SEQ ID NO: 7667345 - DNA, 22 bp, Homo sapiens
ggccagagaagtcagacccttg

SEQ ID NO: 7667346 - DNA, 22 bp, Homo sapiens
ggccagagaagtcagacccttg

SEQ ID NO: 7667347 - DNA, 22 bp, Homo sapiens
ggccagagaagtcagacccttg

SEQ ID NO: 7667348 - DNA, 22 bp, Homo sapiens
ggccagagaagtcagacccttg

SEQ ID NO: 7667349 - DNA, 22 bp, Homo sapiens
ggccagagaagtcagacccttg

SEQ ID NO: 7667350 - DNA, 22 bp, Homo sapiens
ggccagaagttggaaaagagcc

SEQ ID NO: 7667351 - DNA, 22 bp, Homo sapiens
ggccagaagctggggcatagga

SEQ ID NO: 7667352 - DNA, 22 bp, Homo sapiens
ggccagaagttggaaaagagcc

SEQ ID NO: 7667353 - DNA, 22 bp, Homo sapiens
ggccagaagctggggcatagga

SEQ ID NO: 7667354 - DNA, 22 bp, Homo sapiens
ggccaccttcctgtggtctctg

SEQ ID NO: 7667355 - DNA, 22 bp, Homo sapiens
ggccaccttaagttaaggatat

SEQ ID NO: 7667356 - DNA, 22 bp, Homo sapiens
ggccagaaagttaagctgtggc

SEQ ID NO: 7667357 - DNA, 22 bp, Homo sapiens
ggccaccttaagttaaggatat

SEQ ID NO: 7667358 - DNA, 22 bp, Homo sapiens
ggccacctgggttcgactgggc

SEQ ID NO: 7667359 - DNA, 22 bp, Homo sapiens
ggccacctgggttcgactgggc

SEQ ID NO: 7667360 - DNA, 22 bp, Homo sapiens
ggccaccttccagttgcctgca

SEQ ID NO: 7667361 - DNA, 22 bp, Homo sapiens
ggccaccttccagttgcctgca

SEQ ID NO: 7667362 - DNA, 22 bp, Homo sapiens
ggccaccttccagttgcctgca

SEQ ID NO: 7667363 - DNA, 22 bp, Homo sapiens
ggccaccttcctgtggtctctg

SEQ ID NO: 7667364 - DNA, 22 bp, Homo sapiens
ggccaccttcctgtggtctctg

SEQ ID NO: 7667365 - DNA, 20 bp, Homo sapiens
ggccacctgcttcagacccc

SEQ ID NO: 7667366 - DNA, 20 bp, Homo sapiens
ggccacctgcttcagacccc

SEQ ID NO: 7667367 - DNA, 22 bp, Homo sapiens
ggccacctctgccctactgagt

SEQ ID NO: 7667368 - DNA, 22 bp, Homo sapiens
ggccacctggctgtgggggcag

SEQ ID NO: 7667369 - DNA, 22 bp, Homo sapiens
ggccacctgggttcgactgggc

SEQ ID NO: 7667370 - DNA, 22 bp, Homo sapiens
ggccacctggctgtgggggcag

SEQ ID NO: 7667371 - DNA, 22 bp, Homo sapiens
ggccacctgggatctcatcctg

SEQ ID NO: 7667372 - DNA, 22 bp, Homo sapiens
ggccacctgggatctcatcctg

SEQ ID NO: 7667373 - DNA, 22 bp, Homo sapiens
ggccacctgggatctcatcctg

SEQ ID NO: 7667374 - DNA, 22 bp, Homo sapiens
ggccagagggagggcacaaatc

SEQ ID NO: 7667375 - DNA, 22 bp, Homo sapiens
ggccagagggagggcacaaatc

SEQ ID NO: 7667376 - DNA, 18 bp, Homo sapiens
ggccagagggagggtccc

SEQ ID NO: 7667377 - DNA, 18 bp, Homo sapiens
ggccagagggagggtccc

SEQ ID NO: 7667378 - DNA, 18 bp, Homo sapiens
ggccagagggagggtccc

SEQ ID NO: 7667379 - DNA, 18 bp, Homo sapiens
ggccagagggagggtccc

SEQ ID NO: 7667380 - DNA, 17 bp, Homo sapiens
ggccagaggcggggctg

SEQ ID NO: 7667381 - DNA, 17 bp, Homo sapiens
ggccagaggcggggctg

SEQ ID NO: 7667382 - DNA, 17 bp, Homo sapiens
ggccagaggcggggctg

SEQ ID NO: 7667383 - DNA, 17 bp, Homo sapiens
ggccagaggcggggctg

SEQ ID NO: 7667384 - DNA, 17 bp, Homo sapiens
ggccagaggcggggctg

SEQ ID NO: 7667385 - DNA, 17 bp, Homo sapiens
ggccagaggcggggctg

SEQ ID NO: 7667386 - DNA, 18 bp, Homo sapiens
ggccagagggagggtccc

SEQ ID NO: 7667387 - DNA, 18 bp, Homo sapiens
ggccagagggagggtccc

SEQ ID NO: 7667388 - DNA, 22 bp, Homo sapiens
ggccagaggtggtacatagctt

SEQ ID NO: 7667389 - DNA, 22 bp, Homo sapiens
ggccagaggtggtacatagctt

SEQ ID NO: 7667390 - DNA, 18 bp, Homo sapiens
ggccagagggagggtccc

SEQ ID NO: 7667391 - DNA, 18 bp, Homo sapiens
ggccagagggagggtccc

SEQ ID NO: 7667392 - DNA, 22 bp, Homo sapiens
ggccagagggagggcacaaatc

SEQ ID NO: 7667393 - DNA, 18 bp, Homo sapiens
ggccagagggagggtccc

SEQ ID NO: 7667394 - DNA, 18 bp, Homo sapiens
ggccagagggagggtccc

SEQ ID NO: 7667395 - DNA, 22 bp, Homo sapiens
ggccatgggaagaggtggagag

SEQ ID NO: 7667396 - DNA, 22 bp, Homo sapiens
ggccatgggaagaggtggagag

SEQ ID NO: 7667397 - DNA, 22 bp, Homo sapiens
ggccatgggaagaggtggagag

SEQ ID NO: 7667398 - DNA, 22 bp, Homo sapiens
ggccatgggaagaggtggagag

SEQ ID NO: 7667399 - DNA, 22 bp, Homo sapiens
ggccatgggaagaggtggagag

SEQ ID NO: 7667400 - DNA, 22 bp, Homo sapiens
ggccatgggaagaggtggagag

SEQ ID NO: 7667401 - DNA, 22 bp, Homo sapiens
ggccagaggtggtacatagctt

SEQ ID NO: 7667402 - DNA, 22 bp, Homo sapiens
ggccagaggtgtcctcagttct

SEQ ID NO: 7667403 - DNA, 22 bp, Homo sapiens
ggccagagagcagccaggattc

SEQ ID NO: 7667404 - DNA, 22 bp, Homo sapiens
ggccagagagcagccaggattc

SEQ ID NO: 7667405 - DNA, 22 bp, Homo sapiens
ggccagagagcagccaggattc

SEQ ID NO: 7667406 - DNA, 22 bp, Homo sapiens
ggccagagagcagccaggattc

SEQ ID NO: 7667407 - DNA, 22 bp, Homo sapiens
ggccagagagcagccaggattc

SEQ ID NO: 7667408 - DNA, 22 bp, Homo sapiens
ggccagagagcagccaggattc

SEQ ID NO: 7667409 - DNA, 22 bp, Homo sapiens
ggccagagctgacctatcaatg

SEQ ID NO: 7667410 - DNA, 22 bp, Homo sapiens
ggccagagctgacctatcaatg

SEQ ID NO: 7667411 - DNA, 22 bp, Homo sapiens
ggccagagctgacctatcaatg

SEQ ID NO: 7667412 - DNA, 22 bp, Homo sapiens
ggccagagctcaaacagtcgca

SEQ ID NO: 7667413 - DNA, 22 bp, Homo sapiens
ggccagagctcaaacagtcgca

SEQ ID NO: 7667414 - DNA, 22 bp, Homo sapiens
ggccagagctcaaacagtcgca

SEQ ID NO: 7667415 - DNA, 22 bp, Homo sapiens
ggccagagctcaaacagtcgca

SEQ ID NO: 7667416 - DNA, 22 bp, Homo sapiens
ggccagagagccgctgttagga

SEQ ID NO: 7667417 - DNA, 22 bp, Homo sapiens
ggccagagagccgctgttagga

SEQ ID NO: 7667418 - DNA, 22 bp, Homo sapiens
ggccagagagcagccaggattc

SEQ ID NO: 7667419 - DNA, 22 bp, Homo sapiens
ggccagagagccgctgttagga

SEQ ID NO: 7667420 - DNA, 22 bp, Homo sapiens
ggccagaggccatcctcctgct

SEQ ID NO: 7667421 - DNA, 22 bp, Homo sapiens
ggccagaggccatcctcctgct

SEQ ID NO: 7667422 - DNA, 22 bp, Homo sapiens
ggccagaggccatcctcctgct

SEQ ID NO: 7667423 - DNA, 22 bp, Homo sapiens
ggccagaggccatcctcctgct

SEQ ID NO: 7667424 - DNA, 22 bp, Homo sapiens
ggccagaggccacagctgtgtc

SEQ ID NO: 7667425 - DNA, 22 bp, Homo sapiens
ggccagaggccacagctgtgtc

SEQ ID NO: 7667426 - DNA, 22 bp, Homo sapiens
ggccagaggccacagctgtgtc

SEQ ID NO: 7667427 - DNA, 22 bp, Homo sapiens
ggccagaggccacagctgtgtc

SEQ ID NO: 7667428 - DNA, 22 bp, Homo sapiens
ggccagaggacctctcatagcc

SEQ ID NO: 7667429 - DNA, 22 bp, Homo sapiens
ggccagaggacctctcatagcc

SEQ ID NO: 7667430 - DNA, 22 bp, Homo sapiens
ggccagaggacctctcatagcc

SEQ ID NO: 7667431 - DNA, 22 bp, Homo sapiens
ggccagaggacctctcatagcc

SEQ ID NO: 7667432 - DNA, 22 bp, Homo sapiens
ggccagaggacctctcatagcc

SEQ ID NO: 7667433 - DNA, 22 bp, Homo sapiens
ggccagaggccacagctgtgtc

SEQ ID NO: 7667434 - DNA, 22 bp, Homo sapiens
ggccagaggccacagctgtgtc

SEQ ID NO: 7667435 - DNA, 22 bp, Homo sapiens
ggccagaggccacagctgtgtc

SEQ ID NO: 7667436 - DNA, 22 bp, Homo sapiens
ggccagaggccacagctgtgtc

SEQ ID NO: 7667437 - DNA, 22 bp, Homo sapiens
ggccccagttcactcctggccg

SEQ ID NO: 7667438 - DNA, 22 bp, Homo sapiens
ggccccagttcactcctggccg

SEQ ID NO: 7667439 - DNA, 22 bp, Homo sapiens
ggccccaggtagaagatataga

SEQ ID NO: 7667440 - DNA, 22 bp, Homo sapiens
ggccccaggtctgaacacgctg

SEQ ID NO: 7667441 - DNA, 22 bp, Homo sapiens
ggccccaggtctgaacacgctg

SEQ ID NO: 7667442 - DNA, 22 bp, Homo sapiens
ggccccaggtctgaacacgctg

SEQ ID NO: 7667443 - DNA, 22 bp, Homo sapiens
ggccccagttcactcctggccg

SEQ ID NO: 7667444 - DNA, 22 bp, Homo sapiens
ggccccagttcactcctggccg

SEQ ID NO: 7667445 - DNA, 22 bp, Homo sapiens
ggccccagcagaccctcctctg

SEQ ID NO: 7667446 - DNA, 21 bp, Homo sapiens
ggccccgcagacccagcacgt

SEQ ID NO: 7667447 - DNA, 21 bp, Homo sapiens
ggccccgcagacccagcacgt

SEQ ID NO: 7667448 - DNA, 17 bp, Homo sapiens
ggccccggagcctgaca

SEQ ID NO: 7667449 - DNA, 17 bp, Homo sapiens
ggccccggagcctgaca

SEQ ID NO: 7667450 - DNA, 22 bp, Homo sapiens
ggcccctaacatctctcaccaa

SEQ ID NO: 7667451 - DNA, 22 bp, Homo sapiens
ggcccccagggtgggtgtagac

SEQ ID NO: 7667452 - DNA, 22 bp, Homo sapiens
ggcccccagggtgggtgtagac

SEQ ID NO: 7667453 - DNA, 22 bp, Homo sapiens
ggccccagttcactcctggccg

SEQ ID NO: 7667454 - DNA, 22 bp, Homo sapiens
ggccccagttcactcctggccg

SEQ ID NO: 7667455 - DNA, 22 bp, Homo sapiens
ggccccagttcactcctggccg

SEQ ID NO: 7667456 - DNA, 22 bp, Homo sapiens
ggcccctggcaccaggctgatt

SEQ ID NO: 7667457 - DNA, 22 bp, Homo sapiens
ggcccctgcggactgcctagag

SEQ ID NO: 7667458 - DNA, 19 bp, Homo sapiens
ggcccctctcacaggagtt

SEQ ID NO: 7667459 - DNA, 22 bp, Homo sapiens
ggcccctgcggactgcctagag

SEQ ID NO: 7667460 - DNA, 22 bp, Homo sapiens
ggcccctcttgtggcacatacg

SEQ ID NO: 7667461 - DNA, 22 bp, Homo sapiens
ggcccctcttgtggcacatacg

SEQ ID NO: 7667462 - DNA, 22 bp, Homo sapiens
ggcccctcttgtggcacatacg

SEQ ID NO: 7667463 - DNA, 22 bp, Homo sapiens
ggcccctgcggactgcctagag

SEQ ID NO: 7667464 - DNA, 22 bp, Homo sapiens
ggcccctgcggactgcctagag

SEQ ID NO: 7667465 - DNA, 19 bp, Homo sapiens
ggcccctctcacaggagtt

SEQ ID NO: 7667466 - DNA, 19 bp, Homo sapiens
ggcccctctcacaggagtt

SEQ ID NO: 7667467 - DNA, 19 bp, Homo sapiens
ggcccctctcacaggagtt

SEQ ID NO: 7667468 - DNA, 19 bp, Homo sapiens
ggcccctctcacaggagtt

SEQ ID NO: 7667469 - DNA, 22 bp, Homo sapiens
ggcccctcttgtggcacatacg

SEQ ID NO: 7667470 - DNA, 22 bp, Homo sapiens
ggcccctcttgtggcacatacg

SEQ ID NO: 7667471 - DNA, 22 bp, Homo sapiens
ggcccctcagcatctgagtcag

SEQ ID NO: 7667472 - DNA, 17 bp, Homo sapiens
ggcccctatctcccttc

SEQ ID NO: 7667473 - DNA, 22 bp, Homo sapiens
ggcccctcagcatctgagtcag

SEQ ID NO: 7667474 - DNA, 22 bp, Homo sapiens
ggcccctcagcatctgagtcag

SEQ ID NO: 7667475 - DNA, 22 bp, Homo sapiens
ggcccctcagcatctgagtcag

SEQ ID NO: 7667476 - DNA, 22 bp, Homo sapiens
ggcccctcagcatctgagtcag

SEQ ID NO: 7667477 - DNA, 22 bp, Homo sapiens
ggcccagcgaggccacctacag

SEQ ID NO: 7667478 - DNA, 22 bp, Homo sapiens
ggcccagcgaggccacctacag

SEQ ID NO: 7667479 - DNA, 22 bp, Homo sapiens
ggccccacgggggagtcctagt

SEQ ID NO: 7667480 - DNA, 22 bp, Homo sapiens
ggccccacgggggagtcctagt

SEQ ID NO: 7667481 - DNA, 22 bp, Homo sapiens
ggccccacgggggagtcctagt

SEQ ID NO: 7667482 - DNA, 22 bp, Homo sapiens
ggccccagattctgggctgggt

SEQ ID NO: 7667483 - DNA, 22 bp, Homo sapiens
ggccccagattctgggctgggt

SEQ ID NO: 7667484 - DNA, 22 bp, Homo sapiens
ggccccagattctgggctgggt

SEQ ID NO: 7667485 - DNA, 22 bp, Homo sapiens
ggccccagcagaccctcctctg

SEQ ID NO: 7667486 - DNA, 22 bp, Homo sapiens
ggccccagcagaccctcctctg

SEQ ID NO: 7667487 - DNA, 22 bp, Homo sapiens
ggccccagcagaccctcctctg

SEQ ID NO: 7667488 - DNA, 22 bp, Homo sapiens
ggccccagattctgggctgggt

SEQ ID NO: 7667489 - DNA, 22 bp, Homo sapiens
ggccccagattctgggctgggt

SEQ ID NO: 7667490 - DNA, 22 bp, Homo sapiens
ggcccagccttggggtttcttt

SEQ ID NO: 7667491 - DNA, 22 bp, Homo sapiens
ggcccagccttggggtttcttt

SEQ ID NO: 7667492 - DNA, 22 bp, Homo sapiens
ggcccagcgaggccacctacag

SEQ ID NO: 7667493 - DNA, 22 bp, Homo sapiens
ggcccagcgaggccacctacag

SEQ ID NO: 7667494 - DNA, 22 bp, Homo sapiens
ggcccagcctggcaacaatgac

SEQ ID NO: 7667495 - DNA, 22 bp, Homo sapiens
ggcccagcctggcaacaatgac

SEQ ID NO: 7667496 - DNA, 22 bp, Homo sapiens
ggcccagccttggggtttcttt

SEQ ID NO: 7667497 - DNA, 22 bp, Homo sapiens
ggcccagcctggcaacaatgac

SEQ ID NO: 7667498 - DNA, 22 bp, Homo sapiens
ggcccagcctcagacatgccct

SEQ ID NO: 7667499 - DNA, 22 bp, Homo sapiens
ggcccagcctcagacatgccct

SEQ ID NO: 7667500 - DNA, 22 bp, Homo sapiens
ggcccagcctcagacatgccct

SEQ ID NO: 7667501 - DNA, 22 bp, Homo sapiens
ggcccagcctcagacatgccct

SEQ ID NO: 7667502 - DNA, 22 bp, Homo sapiens
ggcccagcctggcaacaatgac

SEQ ID NO: 7667503 - DNA, 22 bp, Homo sapiens
ggcccagcctcagacatgccct

SEQ ID NO: 7667504 - DNA, 22 bp, Homo sapiens
ggcccagcctcagacatgccct

SEQ ID NO: 7667505 - DNA, 22 bp, Homo sapiens
ggcccagcctcagacatgccct

SEQ ID NO: 7667506 - DNA, 17 bp, Homo sapiens
ggccatggtgcaaggtt

SEQ ID NO: 7667507 - DNA, 22 bp, Homo sapiens
ggccatggtgaggtcttctcag

SEQ ID NO: 7667508 - DNA, 17 bp, Homo sapiens
ggccatggtgcaaggtt

SEQ ID NO: 7667509 - DNA, 17 bp, Homo sapiens
ggccatggtgcaaggtt

SEQ ID NO: 7667510 - DNA, 22 bp, Homo sapiens
ggccatggtggtttgagcacct

SEQ ID NO: 7667511 - DNA, 22 bp, Homo sapiens
ggccatggttggggaagacatg

SEQ ID NO: 7667512 - DNA, 22 bp, Homo sapiens
ggccatggttggggaagacatg

SEQ ID NO: 7667513 - DNA, 22 bp, Homo sapiens
ggccatggtggtttgagcacct

SEQ ID NO: 7667514 - DNA, 22 bp, Homo sapiens
ggccatggtggtttgagcacct

SEQ ID NO: 7667515 - DNA, 22 bp, Homo sapiens
ggccatggtggtttgagcacct

SEQ ID NO: 7667516 - DNA, 22 bp, Homo sapiens
ggccatggtggtttgagcacct

SEQ ID NO: 7667517 - DNA, 22 bp, Homo sapiens
ggccatggtggtttgagcacct

SEQ ID NO: 7667518 - DNA, 22 bp, Homo sapiens
ggccatggtggtttgagcacct

SEQ ID NO: 7667519 - DNA, 22 bp, Homo sapiens
ggccattattttttatcagtgt

SEQ ID NO: 7667520 - DNA, 22 bp, Homo sapiens
ggccattgcaacgtcaggagga

SEQ ID NO: 7667521 - DNA, 22 bp, Homo sapiens
ggccatggttggggaagacatg

SEQ ID NO: 7667522 - DNA, 22 bp, Homo sapiens
ggcccaaaccaagtacctcaaa

SEQ ID NO: 7667523 - DNA, 20 bp, Homo sapiens
ggccatgggttgcctgaggt

SEQ ID NO: 7667524 - DNA, 20 bp, Homo sapiens
ggccatgggttgcctgaggt

SEQ ID NO: 7667525 - DNA, 20 bp, Homo sapiens
ggccatgggttgcctgaggt

SEQ ID NO: 7667526 - DNA, 20 bp, Homo sapiens
ggccatgggttgcctgaggt

SEQ ID NO: 7667527 - DNA, 20 bp, Homo sapiens
ggccatgggttgcctgaggt

SEQ ID NO: 7667528 - DNA, 22 bp, Homo sapiens
ggccatggggacagagggtgaa

SEQ ID NO: 7667529 - DNA, 22 bp, Homo sapiens
ggccatggggacagagggtgaa

SEQ ID NO: 7667530 - DNA, 20 bp, Homo sapiens
ggccatgggttgcctgaggt

SEQ ID NO: 7667531 - DNA, 22 bp, Homo sapiens
ggccatggggacagagggtgaa

SEQ ID NO: 7667532 - DNA, 22 bp, Homo sapiens
ggccatggtcatgggtgagctt

SEQ ID NO: 7667533 - DNA, 22 bp, Homo sapiens
ggccatggtgaggtcttctcag

SEQ ID NO: 7667534 - DNA, 22 bp, Homo sapiens
ggccatggtcatgggtgagctt

SEQ ID NO: 7667535 - DNA, 22 bp, Homo sapiens
ggccatggtcatgggtgagctt

SEQ ID NO: 7667536 - DNA, 22 bp, Homo sapiens
ggccatggtcatgggtgagctt

SEQ ID NO: 7667537 - DNA, 22 bp, Homo sapiens
ggccatggtcatgggtgagctt

SEQ ID NO: 7667538 - DNA, 22 bp, Homo sapiens
ggccatggtcatgggtgagctt

SEQ ID NO: 7667539 - DNA, 22 bp, Homo sapiens
ggccatggtcatgggtgagctt

SEQ ID NO: 7667540 - DNA, 22 bp, Homo sapiens
ggcccacttgaaatggagctca

SEQ ID NO: 7667541 - DNA, 22 bp, Homo sapiens
ggcccagaagccagaagcctcc

SEQ ID NO: 7667542 - DNA, 22 bp, Homo sapiens
ggcccagaaaaaggcttagaat

SEQ ID NO: 7667543 - DNA, 22 bp, Homo sapiens
ggcccagaaaaaggcttagaat

SEQ ID NO: 7667544 - DNA, 22 bp, Homo sapiens
ggcccagaaaaaggcttagaat

SEQ ID NO: 7667545 - DNA, 22 bp, Homo sapiens
ggcccagaaaaaggcttagaat

SEQ ID NO: 7667546 - DNA, 22 bp, Homo sapiens
ggcccacactgacagctgagct

SEQ ID NO: 7667547 - DNA, 22 bp, Homo sapiens
ggcccacatggaagcatcgagg

SEQ ID NO: 7667548 - DNA, 20 bp, Homo sapiens
ggcccacatcctttgctatg

SEQ ID NO: 7667549 - DNA, 22 bp, Homo sapiens
ggcccacatggaagcatcgagg

SEQ ID NO: 7667550 - DNA, 22 bp, Homo sapiens
ggcccacatggaagcatcgagg

SEQ ID NO: 7667551 - DNA, 22 bp, Homo sapiens
ggcccacaccaggggccacagt

SEQ ID NO: 7667552 - DNA, 22 bp, Homo sapiens
ggcccacttgaaatggagctca

SEQ ID NO: 7667553 - DNA, 22 bp, Homo sapiens
ggcccagccggcgagtctcgcg

SEQ ID NO: 7667554 - DNA, 22 bp, Homo sapiens
ggcccagccggcgagtctcgcg

SEQ ID NO: 7667555 - DNA, 22 bp, Homo sapiens
ggcccagccggcgagtctcgcg

SEQ ID NO: 7667556 - DNA, 22 bp, Homo sapiens
ggcccagccggcgagtctcgcg

SEQ ID NO: 7667557 - DNA, 22 bp, Homo sapiens
ggcccagccggcgagtctcgcg

SEQ ID NO: 7667558 - DNA, 22 bp, Homo sapiens
ggcccagccggcgagtctcgcg

SEQ ID NO: 7667559 - DNA, 22 bp, Homo sapiens
ggcccagaagccagaagcctcc

SEQ ID NO: 7667560 - DNA, 22 bp, Homo sapiens
ggcccagcccgagtcagccttc

SEQ ID NO: 7667561 - DNA, 22 bp, Homo sapiens
ggcccagcccgagtcagccttc

SEQ ID NO: 7667562 - DNA, 22 bp, Homo sapiens
ggcccaaagggctctgtgggct

SEQ ID NO: 7667563 - DNA, 22 bp, Homo sapiens
ggcccaaaggagtcttggacca

SEQ ID NO: 7667564 - DNA, 22 bp, Homo sapiens
ggcccaaaccagctgggcagga

SEQ ID NO: 7667565 - DNA, 22 bp, Homo sapiens
ggcccaaaccagctgggcagga

SEQ ID NO: 7667566 - DNA, 22 bp, Homo sapiens
ggcccaaacgggtccagtgaaa

SEQ ID NO: 7667567 - DNA, 22 bp, Homo sapiens
ggcccaaacgggtccagtgaaa

SEQ ID NO: 7667568 - DNA, 22 bp, Homo sapiens
ggcccaaacgggtccagtgaaa

SEQ ID NO: 7667569 - DNA, 22 bp, Homo sapiens
ggcccaaaccagctgggcagga

SEQ ID NO: 7667570 - DNA, 22 bp, Homo sapiens
ggcccaaaccaagtacctcaaa

SEQ ID NO: 7667571 - DNA, 22 bp, Homo sapiens
ggcccaaaccaagtacctcaaa

SEQ ID NO: 7667572 - DNA, 22 bp, Homo sapiens
ggcccaaatctccacttgttgc

SEQ ID NO: 7667573 - DNA, 22 bp, Homo sapiens
ggcccaaggcccaggtcgagct

SEQ ID NO: 7667574 - DNA, 22 bp, Homo sapiens
ggcccaaaggagtcttggacca

SEQ ID NO: 7667575 - DNA, 22 bp, Homo sapiens
ggcccaaagggctctgtgggct

SEQ ID NO: 7667576 - DNA, 22 bp, Homo sapiens
ggcccaaggcccaggtcgagct

SEQ ID NO: 7667577 - DNA, 22 bp, Homo sapiens
ggcccaaggtgccaaggcctcc

SEQ ID NO: 7667578 - DNA, 22 bp, Homo sapiens
ggcccaaggtgccaaggcctcc

SEQ ID NO: 7667579 - DNA, 22 bp, Homo sapiens
ggcccaaatctccacttgttgc

SEQ ID NO: 7667580 - DNA, 19 bp, Homo sapiens
ggcccaagtactgagtgcc

SEQ ID NO: 7667581 - DNA, 19 bp, Homo sapiens
ggcccaagtactgagtgcc

SEQ ID NO: 7667582 - DNA, 22 bp, Homo sapiens
ggcccaaggtgccaaggcctcc

SEQ ID NO: 7667583 - DNA, 19 bp, Homo sapiens
ggcccaagtactgagtgcc

SEQ ID NO: 7667584 - DNA, 22 bp, Homo sapiens
ggcccacactgacagctgagct

SEQ ID NO: 7667585 - DNA, 22 bp, Homo sapiens
ggcccacactgacagctgagct

SEQ ID NO: 7667586 - DNA, 22 bp, Homo sapiens
ggcccacactgacagctgagct

SEQ ID NO: 7667587 - DNA, 22 bp, Homo sapiens
ggcccacactgacagctgagct

SEQ ID NO: 7667588 - DNA, 22 bp, Homo sapiens
ggcccacactgacagctgagct

SEQ ID NO: 7667589 - DNA, 22 bp, Homo sapiens
ggcccacactgacagctgagct

SEQ ID NO: 7667590 - DNA, 19 bp, Homo sapiens
ggctcagtggcaccatcct

SEQ ID NO: 7667591 - DNA, 19 bp, Homo sapiens
ggctcagtgacataggtgc

SEQ ID NO: 7667592 - DNA, 22 bp, Homo sapiens
ggctcagtgggaacaagctgag

SEQ ID NO: 7667593 - DNA, 19 bp, Homo sapiens
ggctcagtgacataggtgc

SEQ ID NO: 7667594 - DNA, 22 bp, Homo sapiens
ggctcagtgggaacaagctgag

SEQ ID NO: 7667595 - DNA, 22 bp, Homo sapiens
ggctcagtgtttgtggaacata

SEQ ID NO: 7667596 - DNA, 22 bp, Homo sapiens
ggctcataggctcagggctttg

SEQ ID NO: 7667597 - DNA, 22 bp, Homo sapiens
ggctcataaactcagttcagtt

SEQ ID NO: 7667598 - DNA, 22 bp, Homo sapiens
ggctcatatcccggccatcatt

SEQ ID NO: 7667599 - DNA, 22 bp, Homo sapiens
ggctcatatcccggccatcatt

SEQ ID NO: 7667600 - DNA, 22 bp, Homo sapiens
ggctcatatcccggccatcatt

SEQ ID NO: 7667601 - DNA, 22 bp, Homo sapiens
ggctcatatcccggccatcatt

SEQ ID NO: 7667602 - DNA, 22 bp, Homo sapiens
ggctccaaagggcagtgtgagg

SEQ ID NO: 7667603 - DNA, 22 bp, Homo sapiens
ggctccaaagggcagtgtgagg

SEQ ID NO: 7667604 - DNA, 22 bp, Homo sapiens
ggctcatgtatgaaagggtgtg

SEQ ID NO: 7667605 - DNA, 22 bp, Homo sapiens
ggctcatgtatgaaagggtgtg

SEQ ID NO: 7667606 - DNA, 22 bp, Homo sapiens
ggctcatcagaaatacctgaca

SEQ ID NO: 7667607 - DNA, 22 bp, Homo sapiens
ggctcatcagaaatacctgaca

SEQ ID NO: 7667608 - DNA, 18 bp, Homo sapiens
ggctcatctagcatcatt

SEQ ID NO: 7667609 - DNA, 18 bp, Homo sapiens
ggctcatctagcatcatt

SEQ ID NO: 7667610 - DNA, 20 bp, Homo sapiens
ggctcatcttgtctgctgac

SEQ ID NO: 7667611 - DNA, 22 bp, Homo sapiens
ggctcatgtatgaaagggtgtg

SEQ ID NO: 7667612 - DNA, 22 bp, Homo sapiens
ggctcaggcctgtaatcctagc

SEQ ID NO: 7667613 - DNA, 22 bp, Homo sapiens
ggctcaggtttaaagtgcttta

SEQ ID NO: 7667614 - DNA, 22 bp, Homo sapiens
ggctcaggccagaccacgactc

SEQ ID NO: 7667615 - DNA, 22 bp, Homo sapiens
ggctcaggccagaccacgactc

SEQ ID NO: 7667616 - DNA, 22 bp, Homo sapiens
ggctcaggtttccttcccagct

SEQ ID NO: 7667617 - DNA, 22 bp, Homo sapiens
ggctcaggtttaaagtgcttta

SEQ ID NO: 7667618 - DNA, 22 bp, Homo sapiens
ggctcaggtttaaagtgcttta

SEQ ID NO: 7667619 - DNA, 22 bp, Homo sapiens
ggctcaggtttaaagtgcttta

SEQ ID NO: 7667620 - DNA, 22 bp, Homo sapiens
ggctcagtaagtcaggttcatt

SEQ ID NO: 7667621 - DNA, 22 bp, Homo sapiens
ggctcagtaagtcaggttcatt

SEQ ID NO: 7667622 - DNA, 22 bp, Homo sapiens
ggctcagtaagtcaggttcatt

SEQ ID NO: 7667623 - DNA, 22 bp, Homo sapiens
ggctcaggtttccttcccagct

SEQ ID NO: 7667624 - DNA, 22 bp, Homo sapiens
ggctcaggtttccttcccagct

SEQ ID NO: 7667625 - DNA, 22 bp, Homo sapiens
ggctcaggtttccttcccagct

SEQ ID NO: 7667626 - DNA, 22 bp, Homo sapiens
ggctcaggtttccttcccagct

SEQ ID NO: 7667627 - DNA, 22 bp, Homo sapiens
ggctcaggtttccttcccagct

SEQ ID NO: 7667628 - DNA, 22 bp, Homo sapiens
ggctcaggtttccttcccagct

SEQ ID NO: 7667629 - DNA, 23 bp, Homo sapiens
ggctcctgcttcatgtcccacct

SEQ ID NO: 7667630 - DNA, 23 bp, Homo sapiens
ggctcctgcttcatgtcccacct

SEQ ID NO: 7667631 - DNA, 23 bp, Homo sapiens
ggctcctgcttcatgtcccacct

SEQ ID NO: 7667632 - DNA, 23 bp, Homo sapiens
ggctcctgcttcatgtcccacct

SEQ ID NO: 7667633 - DNA, 23 bp, Homo sapiens
ggctcctgcttcatgtcccacct

SEQ ID NO: 7667634 - DNA, 23 bp, Homo sapiens
ggctcctgcttcatgtcccacct

SEQ ID NO: 7667635 - DNA, 22 bp, Homo sapiens
ggctcctgcacctgtccctctg

SEQ ID NO: 7667636 - DNA, 22 bp, Homo sapiens
ggctcctgcacctgtccctctg

SEQ ID NO: 7667637 - DNA, 22 bp, Homo sapiens
ggctcctgcacctgtccctctg

SEQ ID NO: 7667638 - DNA, 22 bp, Homo sapiens
ggctcctggaaagccctcgctc

SEQ ID NO: 7667639 - DNA, 21 bp, Homo sapiens
ggctcctgctttgtgaggggc

SEQ ID NO: 7667640 - DNA, 21 bp, Homo sapiens
ggctcctgctttgtgaggggc

SEQ ID NO: 7667641 - DNA, 21 bp, Homo sapiens
ggctcctgctttgtgaggggc

SEQ ID NO: 7667642 - DNA, 21 bp, Homo sapiens
ggctcctgctttgtgaggggc

SEQ ID NO: 7667643 - DNA, 23 bp, Homo sapiens
ggctcctgcttcatgtcccacct

SEQ ID NO: 7667644 - DNA, 23 bp, Homo sapiens
ggctcctgcttcatgtcccacct

SEQ ID NO: 7667645 - DNA, 22 bp, Homo sapiens
ggctccaccctgcttccagaag

SEQ ID NO: 7667646 - DNA, 22 bp, Homo sapiens
ggctcctgatgctcagatttca

SEQ ID NO: 7667647 - DNA, 22 bp, Homo sapiens
ggctccaccctgcttccagaag

SEQ ID NO: 7667648 - DNA, 22 bp, Homo sapiens
ggctccaagtctcagagtgaag

SEQ ID NO: 7667649 - DNA, 22 bp, Homo sapiens
ggctccaacactaaatgtgttt

SEQ ID NO: 7667650 - DNA, 22 bp, Homo sapiens
ggctccaacactaaatgtgttt

SEQ ID NO: 7667651 - DNA, 22 bp, Homo sapiens
ggctccaacactaaatgtgttt

SEQ ID NO: 7667652 - DNA, 22 bp, Homo sapiens
ggctccaagtctcagagtgaag

SEQ ID NO: 7667653 - DNA, 22 bp, Homo sapiens
ggctccacaattacacactgga

SEQ ID NO: 7667654 - DNA, 22 bp, Homo sapiens
ggctccacaattacacactgga

SEQ ID NO: 7667655 - DNA, 22 bp, Homo sapiens
ggctccacaattacacactgga

SEQ ID NO: 7667656 - DNA, 22 bp, Homo sapiens
ggctcctgatttgagggggctg

SEQ ID NO: 7667657 - DNA, 22 bp, Homo sapiens
ggctcctgcacctgtccctctg

SEQ ID NO: 7667658 - DNA, 22 bp, Homo sapiens
ggctcctgcacctgtccctctg

SEQ ID NO: 7667659 - DNA, 22 bp, Homo sapiens
ggctcctgcacctgtccctctg

SEQ ID NO: 7667660 - DNA, 22 bp, Homo sapiens
ggctcctgcacctgtccctctg

SEQ ID NO: 7667661 - DNA, 22 bp, Homo sapiens
ggctcctgatttgagggggctg

SEQ ID NO: 7667662 - DNA, 22 bp, Homo sapiens
ggctcctgatttgagggggctg

SEQ ID NO: 7667663 - DNA, 22 bp, Homo sapiens
ggctcctgatttgagggggctg

SEQ ID NO: 7667664 - DNA, 22 bp, Homo sapiens
ggctcctgcacctgtccctctg

SEQ ID NO: 7667665 - DNA, 22 bp, Homo sapiens
ggctcagcttggtgcgcagaaa

SEQ ID NO: 7667666 - DNA, 22 bp, Homo sapiens
ggctcagcttggtgcgcagaaa

SEQ ID NO: 7667667 - DNA, 22 bp, Homo sapiens
ggctcaggacacagtggtttag

SEQ ID NO: 7667668 - DNA, 22 bp, Homo sapiens
ggctcagcttggtgcgcagaaa

SEQ ID NO: 7667669 - DNA, 22 bp, Homo sapiens
ggctcagcttggtgcgcagaaa

SEQ ID NO: 7667670 - DNA, 22 bp, Homo sapiens
ggctcaggacctgggattgcca

SEQ ID NO: 7667671 - DNA, 22 bp, Homo sapiens
ggctcaggacctgggattgcca

SEQ ID NO: 7667672 - DNA, 22 bp, Homo sapiens
ggctcaggacctgggattgcca

SEQ ID NO: 7667673 - DNA, 22 bp, Homo sapiens
ggctcaggacctgggattgcca

SEQ ID NO: 7667674 - DNA, 22 bp, Homo sapiens
ggctcaggacacagtggtttag

SEQ ID NO: 7667675 - DNA, 22 bp, Homo sapiens
ggctcaggactgcagcgtagag

SEQ ID NO: 7667676 - DNA, 22 bp, Homo sapiens
ggctcaggactgcagcgtagag

SEQ ID NO: 7667677 - DNA, 22 bp, Homo sapiens
ggctcaggactgcagcgtagag

SEQ ID NO: 7667678 - DNA, 22 bp, Homo sapiens
ggctcaggacctgggattgcca

SEQ ID NO: 7667679 - DNA, 22 bp, Homo sapiens
ggctcaggccagaccacgactc

SEQ ID NO: 7667680 - DNA, 22 bp, Homo sapiens
ggctcaggccagaccacgactc

SEQ ID NO: 7667681 - DNA, 22 bp, Homo sapiens
ggctcaggccagaccacgactc

SEQ ID NO: 7667682 - DNA, 22 bp, Homo sapiens
ggctcaggccagaccacgactc

SEQ ID NO: 7667683 - DNA, 22 bp, Homo sapiens
ggctcaggccagaccacgactc

SEQ ID NO: 7667684 - DNA, 22 bp, Homo sapiens
ggctcaggatgagccttctcat

SEQ ID NO: 7667685 - DNA, 22 bp, Homo sapiens
ggctcaggatgagccttctcat

SEQ ID NO: 7667686 - DNA, 22 bp, Homo sapiens
ggctcaggagaggggctaaaag

SEQ ID NO: 7667687 - DNA, 22 bp, Homo sapiens
ggctcaggatgagccttctcat

SEQ ID NO: 7667688 - DNA, 22 bp, Homo sapiens
ggctcaggatgagccttctcat

SEQ ID NO: 7667689 - DNA, 22 bp, Homo sapiens
ggctcaggatgagccttctcat

SEQ ID NO: 7667690 - DNA, 22 bp, Homo sapiens
ggctcaggatgagccttctcat

SEQ ID NO: 7667691 - DNA, 22 bp, Homo sapiens
ggctcaggagaggggctaaaag

SEQ ID NO: 7667692 - DNA, 22 bp, Homo sapiens
ggctcaggactgcagcgtagag

SEQ ID NO: 7667693 - DNA, 22 bp, Homo sapiens
ggctcaggactgcagcgtagag

SEQ ID NO: 7667694 - DNA, 22 bp, Homo sapiens
ggctcaggactgcagcgtagag

SEQ ID NO: 7667695 - DNA, 22 bp, Homo sapiens
ggctcaggactgcagcgtagag

SEQ ID NO: 7667696 - DNA, 22 bp, Homo sapiens
ggccttggcctagccctccagg

SEQ ID NO: 7667697 - DNA, 20 bp, Homo sapiens
ggccttggcctctttgcagc

SEQ ID NO: 7667698 - DNA, 20 bp, Homo sapiens
ggccttggcctctttgcagc

SEQ ID NO: 7667699 - DNA, 21 bp, Homo sapiens
ggccttggcgggggccgaatt

SEQ ID NO: 7667700 - DNA, 20 bp, Homo sapiens
ggccttggcctctttgcagc

SEQ ID NO: 7667701 - DNA, 22 bp, Homo sapiens
ggccttggatccaagctgcggc

SEQ ID NO: 7667702 - DNA, 22 bp, Homo sapiens
ggccttggatccaagctgcggc

SEQ ID NO: 7667703 - DNA, 22 bp, Homo sapiens
ggccttggagtcctccactgga

SEQ ID NO: 7667704 - DNA, 22 bp, Homo sapiens
ggccttggatccaagctgcggc

SEQ ID NO: 7667705 - DNA, 22 bp, Homo sapiens
ggccttggattttaccctaaag

SEQ ID NO: 7667706 - DNA, 22 bp, Homo sapiens
ggccttggattttaccctaaag

SEQ ID NO: 7667707 - DNA, 22 bp, Homo sapiens
ggccttggcctagccctccagg

SEQ ID NO: 7667708 - DNA, 22 bp, Homo sapiens
ggccttgggaggagggtcagaa

SEQ ID NO: 7667709 - DNA, 22 bp, Homo sapiens
ggccttgggaggagggtcagaa

SEQ ID NO: 7667710 - DNA, 22 bp, Homo sapiens
ggccttgggaggagggtcagaa

SEQ ID NO: 7667711 - DNA, 22 bp, Homo sapiens
ggccttggctcctgcagggagt

SEQ ID NO: 7667712 - DNA, 22 bp, Homo sapiens
ggccttggctcctgcagggagt

SEQ ID NO: 7667713 - DNA, 21 bp, Homo sapiens
ggccttggcgggggccgaatt

SEQ ID NO: 7667714 - DNA, 22 bp, Homo sapiens
ggccttggctcctgcagggagt

SEQ ID NO: 7667715 - DNA, 22 bp, Homo sapiens
ggccttggctcctgcagggagt

SEQ ID NO: 7667716 - DNA, 22 bp, Homo sapiens
ggctcagctggatggttctact

SEQ ID NO: 7667717 - DNA, 22 bp, Homo sapiens
ggctcagcttatctgggcaggc

SEQ ID NO: 7667718 - DNA, 22 bp, Homo sapiens
ggctcagcgcgctgggagggag

SEQ ID NO: 7667719 - DNA, 22 bp, Homo sapiens
ggctcagcttatctgggcaggc

SEQ ID NO: 7667720 - DNA, 22 bp, Homo sapiens
ggctcagccccgtaacacagca

SEQ ID NO: 7667721 - DNA, 22 bp, Homo sapiens
ggctcagccccgtaacacagca

SEQ ID NO: 7667722 - DNA, 18 bp, Homo sapiens
ggctcagcaggctctctc

SEQ ID NO: 7667723 - DNA, 18 bp, Homo sapiens
ggctcagcaggctctctc

SEQ ID NO: 7667724 - DNA, 22 bp, Homo sapiens
ggctcagcccccacgcttcttc

SEQ ID NO: 7667725 - DNA, 18 bp, Homo sapiens
ggctcagcaggctctctc

SEQ ID NO: 7667726 - DNA, 18 bp, Homo sapiens
ggctcagcaggctctctc

SEQ ID NO: 7667727 - DNA, 22 bp, Homo sapiens
ggccttgggatgtggctgcagc

SEQ ID NO: 7667728 - DNA, 18 bp, Homo sapiens
ggctcagcaggctctctc

SEQ ID NO: 7667729 - DNA, 22 bp, Homo sapiens
ggctcagcacagggctggcatc

SEQ ID NO: 7667730 - DNA, 21 bp, Homo sapiens
ggccttcccctgcagtctccg

SEQ ID NO: 7667731 - DNA, 22 bp, Homo sapiens
ggccttcctgctgctccgggcc

SEQ ID NO: 7667732 - DNA, 22 bp, Homo sapiens
ggccttcctgctgctccgggcc

SEQ ID NO: 7667733 - DNA, 21 bp, Homo sapiens
ggccttcccctgcagtctccg

SEQ ID NO: 7667734 - DNA, 22 bp, Homo sapiens
ggccttcctgctgctccgggcc

SEQ ID NO: 7667735 - DNA, 22 bp, Homo sapiens
ggccttcctggcggctcagggt

SEQ ID NO: 7667736 - DNA, 22 bp, Homo sapiens
ggccttcctggcggctcagggt

SEQ ID NO: 7667737 - DNA, 22 bp, Homo sapiens
ggccttcctgttgtgtccaccg

SEQ ID NO: 7667738 - DNA, 22 bp, Homo sapiens
ggccttcctggcggctcagggt

SEQ ID NO: 7667739 - DNA, 22 bp, Homo sapiens
ggccttcctgttgtgtccaccg

SEQ ID NO: 7667740 - DNA, 22 bp, Homo sapiens
ggccttccttcccagcctactg

SEQ ID NO: 7667741 - DNA, 22 bp, Homo sapiens
ggccttccttcccagcctactg

SEQ ID NO: 7667742 - DNA, 22 bp, Homo sapiens
ggccttccttcccagcctactg

SEQ ID NO: 7667743 - DNA, 22 bp, Homo sapiens
ggccttccttcccagcctactg

SEQ ID NO: 7667744 - DNA, 22 bp, Homo sapiens
ggccttccatctgcctctgttt

SEQ ID NO: 7667745 - DNA, 22 bp, Homo sapiens
ggccttccatctgcctctgttt

SEQ ID NO: 7667746 - DNA, 22 bp, Homo sapiens
ggccttccattgctcttttcta

SEQ ID NO: 7667747 - DNA, 21 bp, Homo sapiens
ggccttcccctgcagtctccg

SEQ ID NO: 7667748 - DNA, 21 bp, Homo sapiens
ggccttcccctgcagtctccg

SEQ ID NO: 7667749 - DNA, 21 bp, Homo sapiens
ggccttcccctgcagtctccg

SEQ ID NO: 7667750 - DNA, 22 bp, Homo sapiens
ggccttccatctgcctctgttt

SEQ ID NO: 7667751 - DNA, 22 bp, Homo sapiens
ggccttccatctgcctctgttt

SEQ ID NO: 7667752 - DNA, 22 bp, Homo sapiens
ggccttcacgtgacctggcgtg

SEQ ID NO: 7667753 - DNA, 22 bp, Homo sapiens
ggccttccagggaagacagggc

SEQ ID NO: 7667754 - DNA, 22 bp, Homo sapiens
ggccttccagggaagacagggc

SEQ ID NO: 7667755 - DNA, 22 bp, Homo sapiens
ggccttcacgtgacctggcgtg

SEQ ID NO: 7667756 - DNA, 22 bp, Homo sapiens
ggcctgttttatcagtttttaa

SEQ ID NO: 7667757 - DNA, 22 bp, Homo sapiens
ggccttagctgtctttcctttg

SEQ ID NO: 7667758 - DNA, 22 bp, Homo sapiens
ggccttaggctcaacaggcaga

SEQ ID NO: 7667759 - DNA, 20 bp, Homo sapiens
ggccttagggagggctgtaa

SEQ ID NO: 7667760 - DNA, 22 bp, Homo sapiens
ggccttgccaaggagcccttaa

SEQ ID NO: 7667761 - DNA, 22 bp, Homo sapiens
ggccttgccaaggagcccttaa

SEQ ID NO: 7667762 - DNA, 23 bp, Homo sapiens
ggccttgcagtaaaccaaatgac

SEQ ID NO: 7667763 - DNA, 23 bp, Homo sapiens
ggccttgcagtaaaccaaatgac

SEQ ID NO: 7667764 - DNA, 23 bp, Homo sapiens
ggccttgcagtaaaccaaatgac

SEQ ID NO: 7667765 - DNA, 22 bp, Homo sapiens
ggccttgcctcaatagctccac

SEQ ID NO: 7667766 - DNA, 22 bp, Homo sapiens
ggccttgcctcaatagctccac

SEQ ID NO: 7667767 - DNA, 22 bp, Homo sapiens
ggccttgcggaacgctcaggcg

SEQ ID NO: 7667768 - DNA, 22 bp, Homo sapiens
ggccttgcggaacgctcaggcg

SEQ ID NO: 7667769 - DNA, 22 bp, Homo sapiens
ggccttgcagccacagaacaca

SEQ ID NO: 7667770 - DNA, 22 bp, Homo sapiens
ggccttgcagccacagaacaca

SEQ ID NO: 7667771 - DNA, 22 bp, Homo sapiens
ggccttgagagccagtgcaggc

SEQ ID NO: 7667772 - DNA, 22 bp, Homo sapiens
ggccttctgcctttcagcaatg

SEQ ID NO: 7667773 - DNA, 22 bp, Homo sapiens
ggccttgatcctccagagcact

SEQ ID NO: 7667774 - DNA, 22 bp, Homo sapiens
ggccttgatcctccagagcact

SEQ ID NO: 7667775 - DNA, 22 bp, Homo sapiens
ggccttgctgcttccagaaggt

SEQ ID NO: 7667776 - DNA, 22 bp, Homo sapiens
ggccttgctgcttccagaaggt

SEQ ID NO: 7667777 - DNA, 20 bp, Homo sapiens
ggccttgcttctccggcttc

SEQ ID NO: 7667778 - DNA, 20 bp, Homo sapiens
ggccttgcttctccggcttc

SEQ ID NO: 7667779 - DNA, 20 bp, Homo sapiens
ggccttgcttctccggcttc

SEQ ID NO: 7667780 - DNA, 22 bp, Homo sapiens
ggccttgcttctgggcatggtt

SEQ ID NO: 7667781 - DNA, 22 bp, Homo sapiens
ggccttgcttctgggcatggtt

SEQ ID NO: 7667782 - DNA, 22 bp, Homo sapiens
ggccttggaaagatacccagct

SEQ ID NO: 7667783 - DNA, 22 bp, Homo sapiens
ggccttggaaagatacccagct

SEQ ID NO: 7667784 - DNA, 22 bp, Homo sapiens
ggccttgcttctgggcatggtt

SEQ ID NO: 7667785 - DNA, 22 bp, Homo sapiens
ggccttgcttgggttatatgcc

SEQ ID NO: 7667786 - DNA, 22 bp, Homo sapiens
ggccttgcttgggttatatgcc

SEQ ID NO: 7667787 - DNA, 22 bp, Homo sapiens
ggccttgcttgggttatatgcc

SEQ ID NO: 7667788 - DNA, 15 bp, Homo sapiens
ggccttgctatttcc

SEQ ID NO: 7667789 - DNA, 20 bp, Homo sapiens
ggccttgctctgtgaccccc

SEQ ID NO: 7667790 - DNA, 20 bp, Homo sapiens
ggccttgctctgtgaccccc

SEQ ID NO: 7667791 - DNA, 19 bp, Homo sapiens
ggccttgctctgtggcagc

SEQ ID NO: 7667792 - DNA, 19 bp, Homo sapiens
ggccttgctctgtggcagc

SEQ ID NO: 7667793 - DNA, 22 bp, Homo sapiens
ggccttgctgcttccagaaggt

SEQ ID NO: 7667794 - DNA, 19 bp, Homo sapiens
ggccttgctctgtggcagc

SEQ ID NO: 7667795 - DNA, 22 bp, Homo sapiens
ggccttggagtcctccactgga

SEQ ID NO: 7667796 - DNA, 22 bp, Homo sapiens
ggccttggagtcctccactgga

SEQ ID NO: 7667797 - DNA, 22 bp, Homo sapiens
ggccttggagtcctccactgga

SEQ ID NO: 7667798 - DNA, 22 bp, Homo sapiens
ggccttggagtcagccttgagc

SEQ ID NO: 7667799 - DNA, 22 bp, Homo sapiens
ggccttggagtcagccttgagc

SEQ ID NO: 7667800 - DNA, 22 bp, Homo sapiens
ggccttggagtcctccactgga

SEQ ID NO: 7667801 - DNA, 20 bp, Homo sapiens
ggccttggaatagcacagct

SEQ ID NO: 7667802 - DNA, 20 bp, Homo sapiens
ggccttggaatagcacagct

SEQ ID NO: 7667803 - DNA, 22 bp, Homo sapiens
ggccttggaaagatacccagct

SEQ ID NO: 7667804 - DNA, 22 bp, Homo sapiens
ggccctctgctcacttcctatt

SEQ ID NO: 7667805 - DNA, 22 bp, Homo sapiens
ggccctctgctcacttcctatt

SEQ ID NO: 7667806 - DNA, 22 bp, Homo sapiens
ggccctctgcctgtgctggcga

SEQ ID NO: 7667807 - DNA, 22 bp, Homo sapiens
ggccctctgcctgtgctggcga

SEQ ID NO: 7667808 - DNA, 22 bp, Homo sapiens
ggccctctgcctgtgctggcga

SEQ ID NO: 7667809 - DNA, 22 bp, Homo sapiens
ggccctctgatacagaagaatg

SEQ ID NO: 7667810 - DNA, 22 bp, Homo sapiens
ggccctctgatacagaagaatg

SEQ ID NO: 7667811 - DNA, 22 bp, Homo sapiens
ggccctctgatccaactggtat

SEQ ID NO: 7667812 - DNA, 22 bp, Homo sapiens
ggccctctgagtagctgcaaac

SEQ ID NO: 7667813 - DNA, 22 bp, Homo sapiens
ggccctctctacatgttagacg

SEQ ID NO: 7667814 - DNA, 22 bp, Homo sapiens
ggccctctccaactctgttcca

SEQ ID NO: 7667815 - DNA, 22 bp, Homo sapiens
ggcccctgtaaaatgtacatgt

SEQ ID NO: 7667816 - DNA, 22 bp, Homo sapiens
ggcccctgtaaaatgtacatgt

SEQ ID NO: 7667817 - DNA, 22 bp, Homo sapiens
ggcccctgcggactgcctagag

SEQ ID NO: 7667818 - DNA, 22 bp, Homo sapiens
ggccctcccggtgatgaagagc

SEQ ID NO: 7667819 - DNA, 22 bp, Homo sapiens
ggccctccctgagccaggtggg

SEQ ID NO: 7667820 - DNA, 22 bp, Homo sapiens
ggccctccctgagccaggtggg

SEQ ID NO: 7667821 - DNA, 22 bp, Homo sapiens
ggccctccctgagccaggtggg

SEQ ID NO: 7667822 - DNA, 22 bp, Homo sapiens
ggcccctgtaaaatgtacatgt

SEQ ID NO: 7667823 - DNA, 22 bp, Homo sapiens
ggccctgaagtgattgtgagtt

SEQ ID NO: 7667824 - DNA, 22 bp, Homo sapiens
ggccctgaagtgattgtgagtt

SEQ ID NO: 7667825 - DNA, 22 bp, Homo sapiens
ggccctgaagtgattgtgagtt

SEQ ID NO: 7667826 - DNA, 22 bp, Homo sapiens
ggccctcttttggtttggatgt

SEQ ID NO: 7667827 - DNA, 22 bp, Homo sapiens
ggccctcttttatccatcataa

SEQ ID NO: 7667828 - DNA, 22 bp, Homo sapiens
ggccctcttttatccatcataa

SEQ ID NO: 7667829 - DNA, 22 bp, Homo sapiens
ggccctcttgatatccagcggc

SEQ ID NO: 7667830 - DNA, 22 bp, Homo sapiens
ggccctctgtggctgccatgga

SEQ ID NO: 7667831 - DNA, 22 bp, Homo sapiens
ggccctctttagacagagtagg

SEQ ID NO: 7667832 - DNA, 22 bp, Homo sapiens
ggccctctttagacagagtagg

SEQ ID NO: 7667833 - DNA, 22 bp, Homo sapiens
ggccctcttttatccatcataa

SEQ ID NO: 7667834 - DNA, 22 bp, Homo sapiens
ggccctcttttatccatcataa

SEQ ID NO: 7667835 - DNA, 22 bp, Homo sapiens
ggccctctggtgagtatcacat

SEQ ID NO: 7667836 - DNA, 22 bp, Homo sapiens
ggccctctgtggctgccatgga

SEQ ID NO: 7667837 - DNA, 22 bp, Homo sapiens
ggccctctgtggctgccatgga

SEQ ID NO: 7667838 - DNA, 22 bp, Homo sapiens
ggccctctgtggctgccatgga

SEQ ID NO: 7667839 - DNA, 22 bp, Homo sapiens
ggccctctgctctgagatgaag

SEQ ID NO: 7667840 - DNA, 22 bp, Homo sapiens
ggccctctggcttccgcatggg

SEQ ID NO: 7667841 - DNA, 22 bp, Homo sapiens
ggccctctggcttccgcatggg

SEQ ID NO: 7667842 - DNA, 22 bp, Homo sapiens
ggccctgcaaggtacccaggcc

SEQ ID NO: 7667843 - DNA, 22 bp, Homo sapiens
ggccctgatacaagtaaggtct

SEQ ID NO: 7667844 - DNA, 22 bp, Homo sapiens
ggccctgcgattaggtggcagg

SEQ ID NO: 7667845 - DNA, 22 bp, Homo sapiens
ggccctgagctgaagtactgtg

SEQ ID NO: 7667846 - DNA, 22 bp, Homo sapiens
ggccctgcgattaggtggcagg

SEQ ID NO: 7667847 - DNA, 22 bp, Homo sapiens
ggccctgctcaggctgcgatga

SEQ ID NO: 7667848 - DNA, 22 bp, Homo sapiens
ggcctggctggttcagtaccct

SEQ ID NO: 7667849 - DNA, 22 bp, Homo sapiens
ggccctgcgattaggtggcagg

SEQ ID NO: 7667850 - DNA, 22 bp, Homo sapiens
ggccctgcgattaggtggcagg

SEQ ID NO: 7667851 - DNA, 22 bp, Homo sapiens
ggccctgatacaagtaaggtct

SEQ ID NO: 7667852 - DNA, 22 bp, Homo sapiens
ggccctgatctcctggattctt

SEQ ID NO: 7667853 - DNA, 22 bp, Homo sapiens
ggccctgcaaggtacccaggcc

SEQ ID NO: 7667854 - DNA, 22 bp, Homo sapiens
ggccctgcaaggtacccaggcc

SEQ ID NO: 7667855 - DNA, 22 bp, Homo sapiens
ggccctgagctgaagtactgtg

SEQ ID NO: 7667856 - DNA, 22 bp, Homo sapiens
ggccctgagctgaagtactgtg

SEQ ID NO: 7667857 - DNA, 22 bp, Homo sapiens
ggccctgagtctagctgctctt

SEQ ID NO: 7667858 - DNA, 22 bp, Homo sapiens
ggccctgaagtgattgtgagtt

SEQ ID NO: 7667859 - DNA, 22 bp, Homo sapiens
ggccctgagcacagctcctctc

SEQ ID NO: 7667860 - DNA, 22 bp, Homo sapiens
ggccctgagcacagctcctctc

SEQ ID NO: 7667861 - DNA, 22 bp, Homo sapiens
ggccctgagctgaagtactgtg

SEQ ID NO: 7667862 - DNA, 23 bp, Homo sapiens
ggcctgtgttttgtctgaagtac

SEQ ID NO: 7667863 - DNA, 22 bp, Homo sapiens
ggcctgggcctttgtgttttga

SEQ ID NO: 7667864 - DNA, 22 bp, Homo sapiens
ggcctgggcctttgtgttttga

SEQ ID NO: 7667865 - DNA, 22 bp, Homo sapiens
ggcctgggcctttgtgttttga

SEQ ID NO: 7667866 - DNA, 22 bp, Homo sapiens
ggcctgggcctttgtgttttga

SEQ ID NO: 7667867 - DNA, 22 bp, Homo sapiens
ggcctggctggttcagtaccct

SEQ ID NO: 7667868 - DNA, 22 bp, Homo sapiens
ggcctggctggttcagtaccct

SEQ ID NO: 7667869 - DNA, 22 bp, Homo sapiens
ggcctggctggttcagtaccct

SEQ ID NO: 7667870 - DNA, 22 bp, Homo sapiens
ggcctgggcccactgtcaagag

SEQ ID NO: 7667871 - DNA, 22 bp, Homo sapiens
ggcctgggcccactgtcaagag

SEQ ID NO: 7667872 - DNA, 22 bp, Homo sapiens
ggcctgggcccactgtcaagag

SEQ ID NO: 7667873 - DNA, 22 bp, Homo sapiens
ggcctgggcccactgtcaagag

SEQ ID NO: 7667874 - DNA, 22 bp, Homo sapiens
ggcctgggcccactgtcaagag

SEQ ID NO: 7667875 - DNA, 22 bp, Homo sapiens
ggcctgggcccactgtcaagag

SEQ ID NO: 7667876 - DNA, 22 bp, Homo sapiens
gggaaaggatcagtgggaggct

SEQ ID NO: 7667877 - DNA, 22 bp, Homo sapiens
ggctttgtggggtgaagtaaag

SEQ ID NO: 7667878 - DNA, 22 bp, Homo sapiens
ggctttggtagacacagattga

SEQ ID NO: 7667879 - DNA, 22 bp, Homo sapiens
ggctttggggtgtgcagagatg

SEQ ID NO: 7667880 - DNA, 22 bp, Homo sapiens
ggctttggggtgtgcagagatg

SEQ ID NO: 7667881 - DNA, 22 bp, Homo sapiens
ggctttggggtgtgcagagatg

SEQ ID NO: 7667882 - DNA, 22 bp, Homo sapiens
gggaaaggatttacagtttgat

SEQ ID NO: 7667883 - DNA, 22 bp, Homo sapiens
gggaaaggatttacagtttgat

SEQ ID NO: 7667884 - DNA, 22 bp, Homo sapiens
gggaaaggatcagtgggaggct

SEQ ID NO: 7667885 - DNA, 23 bp, Homo sapiens
gggaaatcaaaagatatttcttc

SEQ ID NO: 7667886 - DNA, 22 bp, Homo sapiens
gggaacagaggagggtgttgct

SEQ ID NO: 7667887 - DNA, 22 bp, Homo sapiens
gggaacagaggagggtgttgct

SEQ ID NO: 7667888 - DNA, 22 bp, Homo sapiens
gggaacagaggagggtgttgct

SEQ ID NO: 7667889 - DNA, 22 bp, Homo sapiens
gggaaattgtgtgagatctttg

SEQ ID NO: 7667890 - DNA, 22 bp, Homo sapiens
gggaaattgtcaacactctcaa

SEQ ID NO: 7667891 - DNA, 22 bp, Homo sapiens
gggaacacagacttgatgatga

SEQ ID NO: 7667892 - DNA, 22 bp, Homo sapiens
gggaaattttaggtttgtctcg

SEQ ID NO: 7667893 - DNA, 22 bp, Homo sapiens
gggaaattttaggtttgtctcg

SEQ ID NO: 7667894 - DNA, 22 bp, Homo sapiens
gggaaattgtaacaagtctgtt

SEQ ID NO: 7667895 - DNA, 19 bp, Homo sapiens
gggaaattcacttgcttcc

SEQ ID NO: 7667896 - DNA, 19 bp, Homo sapiens
gggaaattcacttgcttcc

SEQ ID NO: 7667897 - DNA, 21 bp, Homo sapiens
gggaaattaggattgctcatc

SEQ ID NO: 7667898 - DNA, 21 bp, Homo sapiens
gggaaattaggattgctcatc

SEQ ID NO: 7667899 - DNA, 22 bp, Homo sapiens
gggaaattaatgactggttgga

SEQ ID NO: 7667900 - DNA, 22 bp, Homo sapiens
gggaaatctcgtcctctattta

SEQ ID NO: 7667901 - DNA, 22 bp, Homo sapiens
gggaaatctcgtcctctattta

SEQ ID NO: 7667902 - DNA, 22 bp, Homo sapiens
gggaaatctcgtcctctattta

SEQ ID NO: 7667903 - DNA, 22 bp, Homo sapiens
gggaaatctcgtcctctattta

SEQ ID NO: 7667904 - DNA, 22 bp, Homo sapiens
ggcttcctccttcctgctgtca

SEQ ID NO: 7667905 - DNA, 22 bp, Homo sapiens
ggcttcctggagaaggtctgag

SEQ ID NO: 7667906 - DNA, 22 bp, Homo sapiens
ggcttcctggagaaggtctgag

SEQ ID NO: 7667907 - DNA, 22 bp, Homo sapiens
ggcttcctccttcctgctgtca

SEQ ID NO: 7667908 - DNA, 22 bp, Homo sapiens
ggcttcctaatactccctacac

SEQ ID NO: 7667909 - DNA, 22 bp, Homo sapiens
ggcttccctttccgagaggaga

SEQ ID NO: 7667910 - DNA, 22 bp, Homo sapiens
ggcttcctatcccatctgagtg

SEQ ID NO: 7667911 - DNA, 22 bp, Homo sapiens
ggcttcctaatactccctacac

SEQ ID NO: 7667912 - DNA, 22 bp, Homo sapiens
ggcttcctaatactccctacac

SEQ ID NO: 7667913 - DNA, 22 bp, Homo sapiens
ggcttcctggggcctcctgcaa

SEQ ID NO: 7667914 - DNA, 22 bp, Homo sapiens
ggcttcctttcactaccctcag

SEQ ID NO: 7667915 - DNA, 22 bp, Homo sapiens
ggcttcctggggcctcctgcaa

SEQ ID NO: 7667916 - DNA, 22 bp, Homo sapiens
ggcttcctggggcctcctgcaa

SEQ ID NO: 7667917 - DNA, 22 bp, Homo sapiens
ggcttctccaggtactgagcat

SEQ ID NO: 7667918 - DNA, 22 bp, Homo sapiens
ggctttgggattcagcatgaga

SEQ ID NO: 7667919 - DNA, 18 bp, Homo sapiens
ggctttggctcttaccgc

SEQ ID NO: 7667920 - DNA, 22 bp, Homo sapiens
ggctttgggattcagcatgaga

SEQ ID NO: 7667921 - DNA, 22 bp, Homo sapiens
ggctttggggtgtgcagagatg

SEQ ID NO: 7667922 - DNA, 22 bp, Homo sapiens
ggctttgggggtgtccaagaaa

SEQ ID NO: 7667923 - DNA, 22 bp, Homo sapiens
ggctttgggattcagcatgaga

SEQ ID NO: 7667924 - DNA, 22 bp, Homo sapiens
ggctttgggccctcaagtctcc

SEQ ID NO: 7667925 - DNA, 22 bp, Homo sapiens
ggcttctccaggtactgagcat

SEQ ID NO: 7667926 - DNA, 18 bp, Homo sapiens
ggcttctcactgacctca

SEQ ID NO: 7667927 - DNA, 22 bp, Homo sapiens
ggcttctcagcacactgtccac

SEQ ID NO: 7667928 - DNA, 22 bp, Homo sapiens
ggcttcctttcactaccctcag

SEQ ID NO: 7667929 - DNA, 22 bp, Homo sapiens
ggcttcctttcactaccctcag

SEQ ID NO: 7667930 - DNA, 19 bp, Homo sapiens
ggcttcgaggctggggaag

SEQ ID NO: 7667931 - DNA, 22 bp, Homo sapiens
ggcttcgcagctcggcagccgc

SEQ ID NO: 7667932 - DNA, 22 bp, Homo sapiens
gggaagagatttccacatcatt

SEQ ID NO: 7667933 - DNA, 22 bp, Homo sapiens
gggaagagatttccacatcatt

SEQ ID NO: 7667934 - DNA, 22 bp, Homo sapiens
gggaagagaggaggtggtttcg

SEQ ID NO: 7667935 - DNA, 22 bp, Homo sapiens
gggaagagatttccacatcatt

SEQ ID NO: 7667936 - DNA, 22 bp, Homo sapiens
gggaagagatttccacatcatt

SEQ ID NO: 7667937 - DNA, 22 bp, Homo sapiens
gggaagagatttccacatcatt

SEQ ID NO: 7667938 - DNA, 22 bp, Homo sapiens
gggaagagatttccacatcatt

SEQ ID NO: 7667939 - DNA, 22 bp, Homo sapiens
gggaagagatttccacatcatt

SEQ ID NO: 7667940 - DNA, 18 bp, Homo sapiens
gggaagaggatctggccc

SEQ ID NO: 7667941 - DNA, 18 bp, Homo sapiens
gggaagaggatctggccc

SEQ ID NO: 7667942 - DNA, 18 bp, Homo sapiens
gggaagaggatctggccc

SEQ ID NO: 7667943 - DNA, 22 bp, Homo sapiens
gggaagagatttccacatcatt

SEQ ID NO: 7667944 - DNA, 18 bp, Homo sapiens
gggaagaggatctggccc

SEQ ID NO: 7667945 - DNA, 18 bp, Homo sapiens
gggaagaggatctggccc

SEQ ID NO: 7667946 - DNA, 23 bp, Homo sapiens
gggaccaggcccttcctggtttg

SEQ ID NO: 7667947 - DNA, 18 bp, Homo sapiens
gggaagaggatctggccc

SEQ ID NO: 7667948 - DNA, 23 bp, Homo sapiens
gggaccaggcccttcctggtttg

SEQ ID NO: 7667949 - DNA, 18 bp, Homo sapiens
gggaagaggatctggccc

SEQ ID NO: 7667950 - DNA, 18 bp, Homo sapiens
gggaagaggatctggccc

SEQ ID NO: 7667951 - DNA, 22 bp, Homo sapiens
gggaccaggtcagggctctgac

SEQ ID NO: 7667952 - DNA, 22 bp, Homo sapiens
gggaccaggtcagggctctgac

SEQ ID NO: 7667953 - DNA, 22 bp, Homo sapiens
gggaccaggtcagggctctgac

SEQ ID NO: 7667954 - DNA, 22 bp, Homo sapiens
gggaccaggtcagggctctgac

SEQ ID NO: 7667955 - DNA, 23 bp, Homo sapiens
gggaccaggcccttcctggtttg

SEQ ID NO: 7667956 - DNA, 23 bp, Homo sapiens
gggaccaggcccttcctggtttg

SEQ ID NO: 7667957 - DNA, 22 bp, Homo sapiens
gggaagagaccgtaccctggcc

SEQ ID NO: 7667958 - DNA, 22 bp, Homo sapiens
gggaagacttagtcggttcaat

SEQ ID NO: 7667959 - DNA, 22 bp, Homo sapiens
gggaagacttagtcggttcaat

SEQ ID NO: 7667960 - DNA, 22 bp, Homo sapiens
gggaagagaccgtaccctggcc

SEQ ID NO: 7667961 - DNA, 22 bp, Homo sapiens
gggaagacttagtcggttcaat

SEQ ID NO: 7667962 - DNA, 22 bp, Homo sapiens
gggaagagaccgtaccctggcc

SEQ ID NO: 7667963 - DNA, 22 bp, Homo sapiens
gggaagaagacatggtgaaggc

SEQ ID NO: 7667964 - DNA, 22 bp, Homo sapiens
gggaagaagacatggtgaaggc

SEQ ID NO: 7667965 - DNA, 22 bp, Homo sapiens
gggaagaagacatggtgaaggc

SEQ ID NO: 7667966 - DNA, 21 bp, Homo sapiens
gggaagactgtcaggattcct

SEQ ID NO: 7667967 - DNA, 22 bp, Homo sapiens
gggaagaagacatggtgaaggc

SEQ ID NO: 7667968 - DNA, 21 bp, Homo sapiens
gggaagactgtcaggattcct

SEQ ID NO: 7667969 - DNA, 21 bp, Homo sapiens
gggaagactgtcaggattcct

SEQ ID NO: 7667970 - DNA, 22 bp, Homo sapiens
gggaagagaggaggtggtttcg

SEQ ID NO: 7667971 - DNA, 22 bp, Homo sapiens
gggaagagaccgtaccctggcc

SEQ ID NO: 7667972 - DNA, 22 bp, Homo sapiens
gggaagagaggaggtggtttcg

SEQ ID NO: 7667973 - DNA, 22 bp, Homo sapiens
gggaagagaggaggtggtttcg

SEQ ID NO: 7667974 - DNA, 22 bp, Homo sapiens
gggaagagaggaggtggtttcg

SEQ ID NO: 7667975 - DNA, 22 bp, Homo sapiens
gggaagagaggaggtggtttcg

SEQ ID NO: 7667976 - DNA, 22 bp, Homo sapiens
gggaagagaccgtaccctggcc

SEQ ID NO: 7667977 - DNA, 22 bp, Homo sapiens
gggaagagaccgtaccctggcc

SEQ ID NO: 7667978 - DNA, 22 bp, Homo sapiens
gggaagagaccgtaccctggcc

SEQ ID NO: 7667979 - DNA, 22 bp, Homo sapiens
gggaacagcttgggctctgcca

SEQ ID NO: 7667980 - DNA, 22 bp, Homo sapiens
gggaacagcttgggctctgcca

SEQ ID NO: 7667981 - DNA, 22 bp, Homo sapiens
gggaacagcttgggctctgcca

SEQ ID NO: 7667982 - DNA, 22 bp, Homo sapiens
gggaacagcttgggctctgcca

SEQ ID NO: 7667983 - DNA, 22 bp, Homo sapiens
gggaacagcctcaccagccctg

SEQ ID NO: 7667984 - DNA, 22 bp, Homo sapiens
gggaacagcctcaccagccctg

SEQ ID NO: 7667985 - DNA, 22 bp, Homo sapiens
gggaacagcatatctgaagggt

SEQ ID NO: 7667986 - DNA, 22 bp, Homo sapiens
gggaacagcatatctgaagggt

SEQ ID NO: 7667987 - DNA, 22 bp, Homo sapiens
gggaacagcatatctgaagggt

SEQ ID NO: 7667988 - DNA, 22 bp, Homo sapiens
gggaacagcatatctgaagggt

SEQ ID NO: 7667989 - DNA, 22 bp, Homo sapiens
gggaacagcatatctgaagggt

SEQ ID NO: 7667990 - DNA, 22 bp, Homo sapiens
gggaacagagtgccagactgac

SEQ ID NO: 7667991 - DNA, 22 bp, Homo sapiens
gggaacagaggagggtgttgct

SEQ ID NO: 7667992 - DNA, 22 bp, Homo sapiens
gggaacagagtgccagactgac

SEQ ID NO: 7667993 - DNA, 22 bp, Homo sapiens
gggaacagagtgccagactgac

SEQ ID NO: 7667994 - DNA, 22 bp, Homo sapiens
gggaacagagtgccagactgac

SEQ ID NO: 7667995 - DNA, 22 bp, Homo sapiens
gggaacagcatatctgaagggt

SEQ ID NO: 7667996 - DNA, 22 bp, Homo sapiens
gggaacagcatatctgaagggt

SEQ ID NO: 7667997 - DNA, 22 bp, Homo sapiens
gggaacagcatatctgaagggt

SEQ ID NO: 7667998 - DNA, 22 bp, Homo sapiens
gggaacagcatatctgaagggt

SEQ ID NO: 7667999 - DNA, 22 bp, Homo sapiens
gggaacagagtgccagactgac

SEQ ID NO: 7668000 - DNA, 22 bp, Homo sapiens
gggaacagagtgccagactgac

SEQ ID NO: 7668001 - DNA, 22 bp, Homo sapiens
gggaacagggcctgagctgggg

SEQ ID NO: 7668002 - DNA, 22 bp, Homo sapiens
gggaacagggcctgagctgggg

SEQ ID NO: 7668003 - DNA, 22 bp, Homo sapiens
gggaacagggcctgagctgggg

SEQ ID NO: 7668004 - DNA, 22 bp, Homo sapiens
gggaacagggcctgagctgggg

SEQ ID NO: 7668005 - DNA, 22 bp, Homo sapiens
gggaaccacccctctgccctga

SEQ ID NO: 7668006 - DNA, 22 bp, Homo sapiens
gggaaccagccgcttccgcctc

SEQ ID NO: 7668007 - DNA, 22 bp, Homo sapiens
gggaaccacccctctgccctga

SEQ ID NO: 7668008 - DNA, 22 bp, Homo sapiens
gggaaccacccctctgccctga

SEQ ID NO: 7668009 - DNA, 22 bp, Homo sapiens
gggaacagggcctgagctgggg

SEQ ID NO: 7668010 - DNA, 22 bp, Homo sapiens
gggaacagggcctgagctgggg

SEQ ID NO: 7668011 - DNA, 22 bp, Homo sapiens
gggaactgtttaacaggggttt

SEQ ID NO: 7668012 - DNA, 22 bp, Homo sapiens
gggaacttatgatatgacttta

SEQ ID NO: 7668013 - DNA, 22 bp, Homo sapiens
gggaagaagacatggtgaaggc

SEQ ID NO: 7668014 - DNA, 22 bp, Homo sapiens
gggaagaagacatggtgaaggc

SEQ ID NO: 7668015 - DNA, 22 bp, Homo sapiens
gggaacttgctaaaatacagac

SEQ ID NO: 7668016 - DNA, 22 bp, Homo sapiens
gggaactgtttaacaggggttt

SEQ ID NO: 7668017 - DNA, 22 bp, Homo sapiens
gggaactgtttaacaggggttt

SEQ ID NO: 7668018 - DNA, 22 bp, Homo sapiens
gggaacctgccccaggcctctg

SEQ ID NO: 7668019 - DNA, 22 bp, Homo sapiens
gggaacctgccccaggcctctg

SEQ ID NO: 7668020 - DNA, 22 bp, Homo sapiens
gggaactattttaagcacttga

SEQ ID NO: 7668021 - DNA, 22 bp, Homo sapiens
gggaactgtgtggtgctctgat

SEQ ID NO: 7668022 - DNA, 22 bp, Homo sapiens
gggaactattttaagcacttga

SEQ ID NO: 7668023 - DNA, 22 bp, Homo sapiens
ggcttccccacaaagcacacaa

SEQ ID NO: 7668024 - DNA, 22 bp, Homo sapiens
ggcttcccagtccctgctctca

SEQ ID NO: 7668025 - DNA, 22 bp, Homo sapiens
ggcttccccacagtcctgagct

SEQ ID NO: 7668026 - DNA, 22 bp, Homo sapiens
ggcttccccacaaagcacacaa

SEQ ID NO: 7668027 - DNA, 20 bp, Homo sapiens
ggcttccccgccatcttccg

SEQ ID NO: 7668028 - DNA, 20 bp, Homo sapiens
ggcttccccgccatcttccg

SEQ ID NO: 7668029 - DNA, 20 bp, Homo sapiens
ggcttccccgccatcttccg

SEQ ID NO: 7668030 - DNA, 22 bp, Homo sapiens
ggcttcccctccagtgctctgt

SEQ ID NO: 7668031 - DNA, 22 bp, Homo sapiens
ggcttcccctccagtgctctgt

SEQ ID NO: 7668032 - DNA, 22 bp, Homo sapiens
ggcttcccctccagtgctctgt

SEQ ID NO: 7668033 - DNA, 22 bp, Homo sapiens
ggcttcccctccagtgctctgt

SEQ ID NO: 7668034 - DNA, 22 bp, Homo sapiens
ggcttccctgcctcacttattc

SEQ ID NO: 7668035 - DNA, 22 bp, Homo sapiens
ggcttccctgtttgctgtgcct

SEQ ID NO: 7668036 - DNA, 22 bp, Homo sapiens
ggcttccctgtttgctgtgcct

SEQ ID NO: 7668037 - DNA, 22 bp, Homo sapiens
ggcttccctgtttgctgtgcct

SEQ ID NO: 7668038 - DNA, 22 bp, Homo sapiens
ggcttccctgtttgctgtgcct

SEQ ID NO: 7668039 - DNA, 22 bp, Homo sapiens
ggcttccctttccgagaggaga

SEQ ID NO: 7668040 - DNA, 22 bp, Homo sapiens
ggcttccctaaacctttccact

SEQ ID NO: 7668041 - DNA, 22 bp, Homo sapiens
ggcttccctaaacctttccact

SEQ ID NO: 7668042 - DNA, 22 bp, Homo sapiens
ggcttccctaaacctttccact

SEQ ID NO: 7668043 - DNA, 18 bp, Homo sapiens
ggcttccctactcacttc

SEQ ID NO: 7668044 - DNA, 18 bp, Homo sapiens
ggcttccctactcacttc

SEQ ID NO: 7668045 - DNA, 18 bp, Homo sapiens
ggcttccctactcacttc

SEQ ID NO: 7668046 - DNA, 22 bp, Homo sapiens
ggcttccctgcctcacttattc

SEQ ID NO: 7668047 - DNA, 22 bp, Homo sapiens
ggcttccctgcctcacttattc

SEQ ID NO: 7668048 - DNA, 22 bp, Homo sapiens
ggcttcccaggcggtccccaca

SEQ ID NO: 7668049 - DNA, 22 bp, Homo sapiens
ggcttcccaggcggtccccaca

SEQ ID NO: 7668050 - DNA, 22 bp, Homo sapiens
ggcttcccaggcggtccccaca

SEQ ID NO: 7668051 - DNA, 22 bp, Homo sapiens
ggcttcccagtccctgctctca

SEQ ID NO: 7668052 - DNA, 22 bp, Homo sapiens
ggcttcccagtccctgctctca

SEQ ID NO: 7668053 - DNA, 22 bp, Homo sapiens
ggcttcccagtccctgctctca

SEQ ID NO: 7668054 - DNA, 22 bp, Homo sapiens
ggcttcccagtccctgctctca

SEQ ID NO: 7668055 - DNA, 22 bp, Homo sapiens
ggcttcccaaggagccaggatg

SEQ ID NO: 7668056 - DNA, 22 bp, Homo sapiens
ggcttcccagcagagggcgcac

SEQ ID NO: 7668057 - DNA, 22 bp, Homo sapiens
ggcttccagctgggccttggag

SEQ ID NO: 7668058 - DNA, 22 bp, Homo sapiens
ggcttccagctgggccttggag

SEQ ID NO: 7668059 - DNA, 17 bp, Homo sapiens
ggcttccaggtggctct

SEQ ID NO: 7668060 - DNA, 17 bp, Homo sapiens
ggcttccaggtggctct

SEQ ID NO: 7668061 - DNA, 22 bp, Homo sapiens
ggcttccagtgatgcctctttg

SEQ ID NO: 7668062 - DNA, 22 bp, Homo sapiens
ggcttccagtgatgcctctttg

SEQ ID NO: 7668063 - DNA, 22 bp, Homo sapiens
ggcttccagtgatgcctctttg

SEQ ID NO: 7668064 - DNA, 22 bp, Homo sapiens
ggcttcccaaggagccaggatg

SEQ ID NO: 7668065 - DNA, 22 bp, Homo sapiens
ggcttcccaaggagccaggatg

SEQ ID NO: 7668066 - DNA, 19 bp, Homo sapiens
ggcttcagtttagcaggct

SEQ ID NO: 7668067 - DNA, 19 bp, Homo sapiens
ggcttcagtttagcaggct

SEQ ID NO: 7668068 - DNA, 19 bp, Homo sapiens
ggcttcagtttagcaggct

SEQ ID NO: 7668069 - DNA, 19 bp, Homo sapiens
ggcttcagtttagcaggct

SEQ ID NO: 7668070 - DNA, 22 bp, Homo sapiens
ggcttcatctcgttgacacctc

SEQ ID NO: 7668071 - DNA, 22 bp, Homo sapiens
ggcttcatggagttctacacca

SEQ ID NO: 7668072 - DNA, 22 bp, Homo sapiens
ggcttcatttctgtccttgatt

SEQ ID NO: 7668073 - DNA, 22 bp, Homo sapiens
ggcttcattttatcttatcatg

SEQ ID NO: 7668074 - DNA, 22 bp, Homo sapiens
ggcttccaaggtcctctccacc

SEQ ID NO: 7668075 - DNA, 22 bp, Homo sapiens
ggcttccaaggtcctctccacc

SEQ ID NO: 7668076 - DNA, 22 bp, Homo sapiens
ggcttccaaggtcctctccacc

SEQ ID NO: 7668077 - DNA, 22 bp, Homo sapiens
ggcttcagtgagctgagctcac

SEQ ID NO: 7668078 - DNA, 22 bp, Homo sapiens
ggcttcagtggccagagatgat

SEQ ID NO: 7668079 - DNA, 22 bp, Homo sapiens
ggcttcagtggccagagatgat

SEQ ID NO: 7668080 - DNA, 22 bp, Homo sapiens
ggcttcagtgagctgagctcac

SEQ ID NO: 7668081 - DNA, 22 bp, Homo sapiens
ggcttcagtgagctgagctcac

SEQ ID NO: 7668082 - DNA, 23 bp, Homo sapiens
ggcttcagtgagagtccctgctg

SEQ ID NO: 7668083 - DNA, 22 bp, Homo sapiens
ggcttcaggggtctgtctgcac

SEQ ID NO: 7668084 - DNA, 22 bp, Homo sapiens
ggcttcaggggtctgtctgcac

SEQ ID NO: 7668085 - DNA, 22 bp, Homo sapiens
ggcttcaggggtctgtctgcac

SEQ ID NO: 7668086 - DNA, 22 bp, Homo sapiens
ggcttcaggggtctgtctgcac

SEQ ID NO: 7668087 - DNA, 22 bp, Homo sapiens
ggcttcagtgactggtgccctc

SEQ ID NO: 7668088 - DNA, 22 bp, Homo sapiens
ggcttcagtgactggtgccctc

SEQ ID NO: 7668089 - DNA, 22 bp, Homo sapiens
ggcttcagtgactggtgccctc

SEQ ID NO: 7668090 - DNA, 23 bp, Homo sapiens
ggcttcagtgagagtccctgctg

SEQ ID NO: 7668091 - DNA, 23 bp, Homo sapiens
ggcttcagtgagagtccctgctg

SEQ ID NO: 7668092 - DNA, 23 bp, Homo sapiens
ggcttcagtgagagtccctgctg

SEQ ID NO: 7668093 - DNA, 23 bp, Homo sapiens
ggcttcagtgagagtccctgctg

SEQ ID NO: 7668094 - DNA, 22 bp, Homo sapiens
ggctgtgttccaagtgtcagga

SEQ ID NO: 7668095 - DNA, 22 bp, Homo sapiens
ggctgtgtggccgtgggctcta

SEQ ID NO: 7668096 - DNA, 21 bp, Homo sapiens
ggctgtgttcagggcatgcgg

SEQ ID NO: 7668097 - DNA, 22 bp, Homo sapiens
ggctgtgtggccgtgggctcta

SEQ ID NO: 7668098 - DNA, 22 bp, Homo sapiens
ggctgtgtcctgtatgattatt

SEQ ID NO: 7668099 - DNA, 19 bp, Homo sapiens
ggctgtggtggtgccttgc

SEQ ID NO: 7668100 - DNA, 22 bp, Homo sapiens
ggctgtgtccccacctgagcag

SEQ ID NO: 7668101 - DNA, 22 bp, Homo sapiens
ggctggctccacctaggtagct

SEQ ID NO: 7668102 - DNA, 22 bp, Homo sapiens
ggctggctccacctaggtagct

SEQ ID NO: 7668103 - DNA, 22 bp, Homo sapiens
ggctggctccacctaggtagct

SEQ ID NO: 7668104 - DNA, 22 bp, Homo sapiens
ggctggctcatgcaaagggtga

SEQ ID NO: 7668105 - DNA, 22 bp, Homo sapiens
ggctggctcttaccgacagcgt

SEQ ID NO: 7668106 - DNA, 22 bp, Homo sapiens
ggctggctccacctaggtagct

SEQ ID NO: 7668107 - DNA, 22 bp, Homo sapiens
ggctggctccacctaggtagct

SEQ ID NO: 7668108 - DNA, 22 bp, Homo sapiens
ggctggctccacctaggtagct

SEQ ID NO: 7668109 - DNA, 22 bp, Homo sapiens
ggctggctatctgtggttgcct

SEQ ID NO: 7668110 - DNA, 22 bp, Homo sapiens
ggctggctacattggaggaagg

SEQ ID NO: 7668111 - DNA, 22 bp, Homo sapiens
ggctggctatctgtggttgcct

SEQ ID NO: 7668112 - DNA, 22 bp, Homo sapiens
ggctggctacattggaggaagg

SEQ ID NO: 7668113 - DNA, 22 bp, Homo sapiens
ggctggctcagggcttgagaga

SEQ ID NO: 7668114 - DNA, 22 bp, Homo sapiens
ggctggctatctgtggttgcct

SEQ ID NO: 7668115 - DNA, 22 bp, Homo sapiens
ggctggctcagggcttgagaga

SEQ ID NO: 7668116 - DNA, 22 bp, Homo sapiens
ggctggctgataaagggttgag

SEQ ID NO: 7668117 - DNA, 22 bp, Homo sapiens
ggctggctgataaagggttgag

SEQ ID NO: 7668118 - DNA, 22 bp, Homo sapiens
ggctggctgataaagggttgag

SEQ ID NO: 7668119 - DNA, 22 bp, Homo sapiens
ggctggctgataaagggttgag

SEQ ID NO: 7668120 - DNA, 22 bp, Homo sapiens
ggctggctgataaagggttgag

SEQ ID NO: 7668121 - DNA, 22 bp, Homo sapiens
ggctggctcttaccgacagcgt

SEQ ID NO: 7668122 - DNA, 22 bp, Homo sapiens
ggctggctcttaccgacagcgt

SEQ ID NO: 7668123 - DNA, 22 bp, Homo sapiens
ggctggctcttaccgacagcgt

SEQ ID NO: 7668124 - DNA, 22 bp, Homo sapiens
ggctggctcttaccgacagcgt

SEQ ID NO: 7668125 - DNA, 22 bp, Homo sapiens
ggctggctgcatgccccctcct

SEQ ID NO: 7668126 - DNA, 22 bp, Homo sapiens
ggctggctggatgaatggatta

SEQ ID NO: 7668127 - DNA, 22 bp, Homo sapiens
ggctggctggatgaatggatta

SEQ ID NO: 7668128 - DNA, 22 bp, Homo sapiens
ggctggctggatgaatggatta

SEQ ID NO: 7668129 - DNA, 22 bp, Homo sapiens
ggctggctggatgaatggatta

SEQ ID NO: 7668130 - DNA, 22 bp, Homo sapiens
ggctggctgataaagggttgag

SEQ ID NO: 7668131 - DNA, 22 bp, Homo sapiens
ggctggctgataaagggttgag

SEQ ID NO: 7668132 - DNA, 22 bp, Homo sapiens
ggctggctgcatgccccctcct

SEQ ID NO: 7668133 - DNA, 22 bp, Homo sapiens
ggctggctgcatgccccctcct

SEQ ID NO: 7668134 - DNA, 22 bp, Homo sapiens
ggctggctgcatgccccctcct

SEQ ID NO: 7668135 - DNA, 22 bp, Homo sapiens
ggctggctggcttagcagagga

SEQ ID NO: 7668136 - DNA, 22 bp, Homo sapiens
ggctggctggcttagcagagga

SEQ ID NO: 7668137 - DNA, 22 bp, Homo sapiens
ggctggctggcttagcagagga

SEQ ID NO: 7668138 - DNA, 22 bp, Homo sapiens
ggctggctggcttagcagagga

SEQ ID NO: 7668139 - DNA, 22 bp, Homo sapiens
ggctggctggcttagcagagga

SEQ ID NO: 7668140 - DNA, 22 bp, Homo sapiens
ggctggctgtgccctgtactct

SEQ ID NO: 7668141 - DNA, 22 bp, Homo sapiens
ggctggctgtgccctgtactct

SEQ ID NO: 7668142 - DNA, 22 bp, Homo sapiens
ggctggctgtgccctgtactct

SEQ ID NO: 7668143 - DNA, 22 bp, Homo sapiens
ggctggctgtgccctgtactct

SEQ ID NO: 7668144 - DNA, 22 bp, Homo sapiens
ggctggctggctggtagacaag

SEQ ID NO: 7668145 - DNA, 22 bp, Homo sapiens
ggctggctggctggtagacaag

SEQ ID NO: 7668146 - DNA, 22 bp, Homo sapiens
ggctggctggctggtagacaag

SEQ ID NO: 7668147 - DNA, 22 bp, Homo sapiens
ggctggctggctggtagacaag

SEQ ID NO: 7668148 - DNA, 22 bp, Homo sapiens
ggctggctggcttagcagagga

SEQ ID NO: 7668149 - DNA, 22 bp, Homo sapiens
ggctggctggcttagcagagga

SEQ ID NO: 7668150 - DNA, 22 bp, Homo sapiens
ggctggctggctggtagacaag

SEQ ID NO: 7668151 - DNA, 22 bp, Homo sapiens
ggctggcttgccaagctcaggg

SEQ ID NO: 7668152 - DNA, 22 bp, Homo sapiens
ggctggcttgccaagctcaggg

SEQ ID NO: 7668153 - DNA, 22 bp, Homo sapiens
ggctggcttgccaagctcaggg

SEQ ID NO: 7668154 - DNA, 22 bp, Homo sapiens
ggctggcttgccaagctcaggg

SEQ ID NO: 7668155 - DNA, 22 bp, Homo sapiens
ggctggcttgccaagctcaggg

SEQ ID NO: 7668156 - DNA, 22 bp, Homo sapiens
ggctggcttgccaagctcaggg

SEQ ID NO: 7668157 - DNA, 22 bp, Homo sapiens
ggctggcttgccaagctcaggg

SEQ ID NO: 7668158 - DNA, 22 bp, Homo sapiens
ggctggctgtgccctgtactct

SEQ ID NO: 7668159 - DNA, 19 bp, Homo sapiens
ggctgtggtggtgccttgc

SEQ ID NO: 7668160 - DNA, 22 bp, Homo sapiens
ggctgtggtggcatccctgagc

SEQ ID NO: 7668161 - DNA, 22 bp, Homo sapiens
ggctgtggtggcatccctgagc

SEQ ID NO: 7668162 - DNA, 19 bp, Homo sapiens
ggctgtggtggtgccttgc

SEQ ID NO: 7668163 - DNA, 19 bp, Homo sapiens
ggctgtggtggtgccttgc

SEQ ID NO: 7668164 - DNA, 19 bp, Homo sapiens
ggctgtggtggtgccttgc

SEQ ID NO: 7668165 - DNA, 19 bp, Homo sapiens
ggctgtggtggtgccttgc

SEQ ID NO: 7668166 - DNA, 22 bp, Homo sapiens
ggctggcttgccaagctcaggg

SEQ ID NO: 7668167 - DNA, 22 bp, Homo sapiens
ggctggcttgccaagctcaggg

SEQ ID NO: 7668168 - DNA, 22 bp, Homo sapiens
ggctgtggtggcatccctgagc

SEQ ID NO: 7668169 - DNA, 22 bp, Homo sapiens
ggctgtggtggcatccctgagc

SEQ ID NO: 7668170 - DNA, 22 bp, Homo sapiens
ggctgtggtggcatccctgagc

SEQ ID NO: 7668171 - DNA, 22 bp, Homo sapiens
ggctgtggtggcatccctgagc

SEQ ID NO: 7668172 - DNA, 19 bp, Homo sapiens
ggctgcctggagcgagggc

SEQ ID NO: 7668173 - DNA, 19 bp, Homo sapiens
ggctgcctggagcgagggc

SEQ ID NO: 7668174 - DNA, 19 bp, Homo sapiens
ggctgcctggagcgagggc

SEQ ID NO: 7668175 - DNA, 19 bp, Homo sapiens
ggctgcctggagcgagggc

SEQ ID NO: 7668176 - DNA, 22 bp, Homo sapiens
ggctgcaggcagggtatccact

SEQ ID NO: 7668177 - DNA, 22 bp, Homo sapiens
ggctgcaggcagaggctgtctg

SEQ ID NO: 7668178 - DNA, 22 bp, Homo sapiens
ggctgcaggcagaggctgtctg

SEQ ID NO: 7668179 - DNA, 22 bp, Homo sapiens
ggctgcaggcagaggctgtctg

SEQ ID NO: 7668180 - DNA, 22 bp, Homo sapiens
ggctgcaggcagaggctgtctg

SEQ ID NO: 7668181 - DNA, 22 bp, Homo sapiens
ggctgcaggatgcccagccgtg

SEQ ID NO: 7668182 - DNA, 22 bp, Homo sapiens
ggctgcaggatgcccagccgtg

SEQ ID NO: 7668183 - DNA, 22 bp, Homo sapiens
ggctgcaggatgcccagccgtg

SEQ ID NO: 7668184 - DNA, 22 bp, Homo sapiens
ggctgcaggcagaggctgtctg

SEQ ID NO: 7668185 - DNA, 22 bp, Homo sapiens
ggctgcaggcagaggctgtctg

SEQ ID NO: 7668186 - DNA, 22 bp, Homo sapiens
ggctgcaggaacgacggagggg

SEQ ID NO: 7668187 - DNA, 20 bp, Homo sapiens
ggctgcaggactcattggct

SEQ ID NO: 7668188 - DNA, 20 bp, Homo sapiens
ggctgcaggactcattggct

SEQ ID NO: 7668189 - DNA, 22 bp, Homo sapiens
ggctgcaggaacgacggagggg

SEQ ID NO: 7668190 - DNA, 22 bp, Homo sapiens
ggctgcaggaacgacggagggg

SEQ ID NO: 7668191 - DNA, 22 bp, Homo sapiens
ggctgcaggaacgacggagggg

SEQ ID NO: 7668192 - DNA, 22 bp, Homo sapiens
ggctgcaggaacgacggagggg

SEQ ID NO: 7668193 - DNA, 22 bp, Homo sapiens
ggctgcaggaacgacggagggg

SEQ ID NO: 7668194 - DNA, 22 bp, Homo sapiens
ggctgcaggaacgacggagggg

SEQ ID NO: 7668195 - DNA, 20 bp, Homo sapiens
ggctgcaggactcattggct

SEQ ID NO: 7668196 - DNA, 20 bp, Homo sapiens
ggctgcaggactcattggct

SEQ ID NO: 7668197 - DNA, 20 bp, Homo sapiens
ggctgcaggactcattggct

SEQ ID NO: 7668198 - DNA, 22 bp, Homo sapiens
ggctgcaggatgcccagccgtg

SEQ ID NO: 7668199 - DNA, 22 bp, Homo sapiens
ggctgcaggatgcccagccgtg

SEQ ID NO: 7668200 - DNA, 22 bp, Homo sapiens
ggctgcaggatgcccagccgtg

SEQ ID NO: 7668201 - DNA, 22 bp, Homo sapiens
ggctgcaggatgcccagccgtg

SEQ ID NO: 7668202 - DNA, 22 bp, Homo sapiens
ggctgcaggatgcccagccgtg

SEQ ID NO: 7668203 - DNA, 22 bp, Homo sapiens
ggctgcaggatgcccagccgtg

SEQ ID NO: 7668204 - DNA, 22 bp, Homo sapiens
ggctgcctgtgcccaggcacac

SEQ ID NO: 7668205 - DNA, 22 bp, Homo sapiens
ggctgcctgtgcccaggcacac

SEQ ID NO: 7668206 - DNA, 22 bp, Homo sapiens
ggctgcctgtgcccaggcacac

SEQ ID NO: 7668207 - DNA, 22 bp, Homo sapiens
ggctgcctgtgcccaggcacac

SEQ ID NO: 7668208 - DNA, 22 bp, Homo sapiens
ggctgcctgtgcccaggcacac

SEQ ID NO: 7668209 - DNA, 22 bp, Homo sapiens
ggctgcctggtttagtgctgac

SEQ ID NO: 7668210 - DNA, 22 bp, Homo sapiens
ggctgcctggtttagtgctgac

SEQ ID NO: 7668211 - DNA, 22 bp, Homo sapiens
ggctgcctggtttagtgctgac

SEQ ID NO: 7668212 - DNA, 22 bp, Homo sapiens
ggctgcctggtttcttgtaagg

SEQ ID NO: 7668213 - DNA, 22 bp, Homo sapiens
ggctgcctggtttcttgtaagg

SEQ ID NO: 7668214 - DNA, 22 bp, Homo sapiens
ggctgcctgggagccctcctct

SEQ ID NO: 7668215 - DNA, 22 bp, Homo sapiens
ggctgcctgggagccctcctct

SEQ ID NO: 7668216 - DNA, 22 bp, Homo sapiens
ggctgcctgggagccctcctct

SEQ ID NO: 7668217 - DNA, 22 bp, Homo sapiens
ggctgcctgggagccctcctct

SEQ ID NO: 7668218 - DNA, 22 bp, Homo sapiens
ggctgcctggtttagtgctgac

SEQ ID NO: 7668219 - DNA, 22 bp, Homo sapiens
ggctgcctggtttagtgctgac

SEQ ID NO: 7668220 - DNA, 21 bp, Homo sapiens
ggctgcctgggaagaagaaga

SEQ ID NO: 7668221 - DNA, 21 bp, Homo sapiens
ggctgcctgggaagaagaaga

SEQ ID NO: 7668222 - DNA, 21 bp, Homo sapiens
ggctgcctgggaagaagaaga

SEQ ID NO: 7668223 - DNA, 22 bp, Homo sapiens
ggctgcctgggagccctcctct

SEQ ID NO: 7668224 - DNA, 22 bp, Homo sapiens
ggctgcctgggagccctcctct

SEQ ID NO: 7668225 - DNA, 22 bp, Homo sapiens
ggctgcctgggagccctcctct

SEQ ID NO: 7668226 - DNA, 22 bp, Homo sapiens
ggctgccttcatagaccatggg

SEQ ID NO: 7668227 - DNA, 22 bp, Homo sapiens
ggctgccttcatagaccatggg

SEQ ID NO: 7668228 - DNA, 22 bp, Homo sapiens
ggctgccttcatagaccatggg

SEQ ID NO: 7668229 - DNA, 22 bp, Homo sapiens
ggctgccttcatagaccatggg

SEQ ID NO: 7668230 - DNA, 22 bp, Homo sapiens
ggctgccttcatagaccatggg

SEQ ID NO: 7668231 - DNA, 22 bp, Homo sapiens
ggctgccttcagactccagctt

SEQ ID NO: 7668232 - DNA, 22 bp, Homo sapiens
ggctgccttcagactccagctt

SEQ ID NO: 7668233 - DNA, 22 bp, Homo sapiens
ggctgccttcagactccagctt

SEQ ID NO: 7668234 - DNA, 22 bp, Homo sapiens
ggctgcctgtgcccaggcacac

SEQ ID NO: 7668235 - DNA, 18 bp, Homo sapiens
ggctgcctgttcctgaag

SEQ ID NO: 7668236 - DNA, 18 bp, Homo sapiens
ggctgcctgttcctgaag

SEQ ID NO: 7668237 - DNA, 22 bp, Homo sapiens
ggctgcctgttgagtatgtccc

SEQ ID NO: 7668238 - DNA, 22 bp, Homo sapiens
ggctgcctgttgagtatgtccc

SEQ ID NO: 7668239 - DNA, 22 bp, Homo sapiens
ggctgccttcagactccagctt

SEQ ID NO: 7668240 - DNA, 22 bp, Homo sapiens
ggctgccttcagactccagctt

SEQ ID NO: 7668241 - DNA, 22 bp, Homo sapiens
ggctgccttcagactccagctt

SEQ ID NO: 7668242 - DNA, 22 bp, Homo sapiens
ggctgccttcagactccagctt

SEQ ID NO: 7668243 - DNA, 19 bp, Homo sapiens
ggctgccttctgctcatct

SEQ ID NO: 7668244 - DNA, 19 bp, Homo sapiens
ggctgccttctgctcatct

SEQ ID NO: 7668245 - DNA, 19 bp, Homo sapiens
ggctgccttctgctcatct

SEQ ID NO: 7668246 - DNA, 22 bp, Homo sapiens
ggctgccttccctgagccccgg

SEQ ID NO: 7668247 - DNA, 19 bp, Homo sapiens
ggctgccttctgctcatct

SEQ ID NO: 7668248 - DNA, 19 bp, Homo sapiens
ggctgccttctgctcatct

SEQ ID NO: 7668249 - DNA, 22 bp, Homo sapiens
ggctgccttccctgagccccgg

SEQ ID NO: 7668250 - DNA, 22 bp, Homo sapiens
ggctgccttccctgagccccgg

SEQ ID NO: 7668251 - DNA, 22 bp, Homo sapiens
ggctgccttccctgagccccgg

SEQ ID NO: 7668252 - DNA, 22 bp, Homo sapiens
ggctgctcggagcctcctgtga

SEQ ID NO: 7668253 - DNA, 22 bp, Homo sapiens
ggctgctcggcagctcctgagc

SEQ ID NO: 7668254 - DNA, 22 bp, Homo sapiens
ggctgctcggcagctcctgagc

SEQ ID NO: 7668255 - DNA, 19 bp, Homo sapiens
ggctgccttctgctcatct

SEQ ID NO: 7668256 - DNA, 22 bp, Homo sapiens
ggctgccttgaccctggctccg

SEQ ID NO: 7668257 - DNA, 22 bp, Homo sapiens
ggctgccttgaccctggctccg

SEQ ID NO: 7668258 - DNA, 22 bp, Homo sapiens
ggctgccttgaccctggctccg

SEQ ID NO: 7668259 - DNA, 22 bp, Homo sapiens
ggctgctcggagcctcctgtga

SEQ ID NO: 7668260 - DNA, 23 bp, Homo sapiens
ggctgctcttttcatgctgtttc

SEQ ID NO: 7668261 - DNA, 22 bp, Homo sapiens
ggctgctcttcttggcgacctc

SEQ ID NO: 7668262 - DNA, 22 bp, Homo sapiens
ggctgctcttcttggcgacctc

SEQ ID NO: 7668263 - DNA, 22 bp, Homo sapiens
ggctgctcttcttggcgacctc

SEQ ID NO: 7668264 - DNA, 22 bp, Homo sapiens
ggctgctctgccttccagctgg

SEQ ID NO: 7668265 - DNA, 22 bp, Homo sapiens
ggctgctctgccttccagctgg

SEQ ID NO: 7668266 - DNA, 22 bp, Homo sapiens
ggctgctctgagagtgggtttt

SEQ ID NO: 7668267 - DNA, 22 bp, Homo sapiens
ggctgctctgcacaggggctgg

SEQ ID NO: 7668268 - DNA, 22 bp, Homo sapiens
ggctgctctgccttccagctgg

SEQ ID NO: 7668269 - DNA, 22 bp, Homo sapiens
ggctgctctgcacaggggctgg

SEQ ID NO: 7668270 - DNA, 22 bp, Homo sapiens
ggctgctctgcacaggggctgg

SEQ ID NO: 7668271 - DNA, 22 bp, Homo sapiens
ggctgctctgcacaggggctgg

SEQ ID NO: 7668272 - DNA, 22 bp, Homo sapiens
ggctgctcggcagctcctgagc

SEQ ID NO: 7668273 - DNA, 22 bp, Homo sapiens
ggctgctctccatcccaggcct

SEQ ID NO: 7668274 - DNA, 22 bp, Homo sapiens
ggctgctctccatcccaggcct

SEQ ID NO: 7668275 - DNA, 22 bp, Homo sapiens
ggctgctctccatcccaggcct

SEQ ID NO: 7668276 - DNA, 22 bp, Homo sapiens
ggctggctacattggaggaagg

SEQ ID NO: 7668277 - DNA, 22 bp, Homo sapiens
ggctggcgggtgggtgaaagac

SEQ ID NO: 7668278 - DNA, 22 bp, Homo sapiens
ggctggctacattggaggaagg

SEQ ID NO: 7668279 - DNA, 22 bp, Homo sapiens
ggctggctacattggaggaagg

SEQ ID NO: 7668280 - DNA, 22 bp, Homo sapiens
ggctggctacattggaggaagg

SEQ ID NO: 7668281 - DNA, 22 bp, Homo sapiens
ggctggctatctgtggttgcct

SEQ ID NO: 7668282 - DNA, 22 bp, Homo sapiens
ggctggctacattggaggaagg

SEQ ID NO: 7668283 - DNA, 22 bp, Homo sapiens
ggctggctacattggaggaagg

SEQ ID NO: 7668284 - DNA, 22 bp, Homo sapiens
ggctggctacattggaggaagg

SEQ ID NO: 7668285 - DNA, 22 bp, Homo sapiens
ggctggcgctctcccagcgctg

SEQ ID NO: 7668286 - DNA, 22 bp, Homo sapiens
ggctggcgggtgggtgaaagac

SEQ ID NO: 7668287 - DNA, 22 bp, Homo sapiens
ggctggcctctacagggaggca

SEQ ID NO: 7668288 - DNA, 22 bp, Homo sapiens
ggctggcctctacagggaggca

SEQ ID NO: 7668289 - DNA, 22 bp, Homo sapiens
ggctggcctctacagggaggca

SEQ ID NO: 7668290 - DNA, 22 bp, Homo sapiens
ggctggcctctacagggaggca

SEQ ID NO: 7668291 - DNA, 22 bp, Homo sapiens
ggctggcctctacagggaggca

SEQ ID NO: 7668292 - DNA, 22 bp, Homo sapiens
ggctggcctctacagggaggca

SEQ ID NO: 7668293 - DNA, 22 bp, Homo sapiens
ggctggcctgtgtggccgccac

SEQ ID NO: 7668294 - DNA, 22 bp, Homo sapiens
ggctggcctgtgtggccgccac

SEQ ID NO: 7668295 - DNA, 22 bp, Homo sapiens
ggctggcctgtgtggccgccac

SEQ ID NO: 7668296 - DNA, 22 bp, Homo sapiens
ggctggcctgtgtggccgccac

SEQ ID NO: 7668297 - DNA, 23 bp, Homo sapiens
ggctggcccggggctgctcctga

SEQ ID NO: 7668298 - DNA, 23 bp, Homo sapiens
ggctggcccggggctgctcctga

SEQ ID NO: 7668299 - DNA, 22 bp, Homo sapiens
ggctgctgaacaagggaaccct

SEQ ID NO: 7668300 - DNA, 22 bp, Homo sapiens
ggctgctgaacaagggaaccct

SEQ ID NO: 7668301 - DNA, 22 bp, Homo sapiens
ggctggcctcagggtcctcgct

SEQ ID NO: 7668302 - DNA, 22 bp, Homo sapiens
ggctggcctcagggtcctcgct

SEQ ID NO: 7668303 - DNA, 22 bp, Homo sapiens
ggctggcctcagggtcctcgct

SEQ ID NO: 7668304 - DNA, 22 bp, Homo sapiens
ggctggcctcagggtcctcgct

SEQ ID NO: 7668305 - DNA, 23 bp, Homo sapiens
ggctggcccggggctgctcctga

SEQ ID NO: 7668306 - DNA, 23 bp, Homo sapiens
ggctggcccggggctgctcctga

SEQ ID NO: 7668307 - DNA, 23 bp, Homo sapiens
ggctggcccggggctgctcctga

SEQ ID NO: 7668308 - DNA, 19 bp, Homo sapiens
ggctcctggggctcagccc

SEQ ID NO: 7668309 - DNA, 19 bp, Homo sapiens
ggctcctggggctcagccc

SEQ ID NO: 7668310 - DNA, 19 bp, Homo sapiens
ggctcctggggctcagccc

SEQ ID NO: 7668311 - DNA, 22 bp, Homo sapiens
ggctcctggggaggtgagcttg

SEQ ID NO: 7668312 - DNA, 22 bp, Homo sapiens
ggctcctggggaggtgagcttg

SEQ ID NO: 7668313 - DNA, 22 bp, Homo sapiens
ggctcctggggaggtgagcttg

SEQ ID NO: 7668314 - DNA, 22 bp, Homo sapiens
ggctcctggggaggtgagcttg

SEQ ID NO: 7668315 - DNA, 22 bp, Homo sapiens
ggctccttcaagcctgtcactg

SEQ ID NO: 7668316 - DNA, 22 bp, Homo sapiens
ggctccttcaaagcacctggct

SEQ ID NO: 7668317 - DNA, 22 bp, Homo sapiens
ggctccttcaaagcacctggct

SEQ ID NO: 7668318 - DNA, 22 bp, Homo sapiens
ggctccttcaaagcacctggct

SEQ ID NO: 7668319 - DNA, 22 bp, Homo sapiens
ggctccttatctctcctatgcc

SEQ ID NO: 7668320 - DNA, 22 bp, Homo sapiens
ggctcctgttttaaaaggtgaa

SEQ ID NO: 7668321 - DNA, 22 bp, Homo sapiens
ggctcctgttttaaaaggtgaa

SEQ ID NO: 7668322 - DNA, 22 bp, Homo sapiens
ggctccttatctctcctatgcc

SEQ ID NO: 7668323 - DNA, 22 bp, Homo sapiens
ggctccttgccaccagctctgc

SEQ ID NO: 7668324 - DNA, 22 bp, Homo sapiens
ggctccttgccaccagctctgc

SEQ ID NO: 7668325 - DNA, 23 bp, Homo sapiens
ggctccttgcccatccagcagcc

SEQ ID NO: 7668326 - DNA, 22 bp, Homo sapiens
ggctccttgccaccagctctgc

SEQ ID NO: 7668327 - DNA, 22 bp, Homo sapiens
ggctcgagcagctgtgtaggat

SEQ ID NO: 7668328 - DNA, 22 bp, Homo sapiens
ggctccttgagaggcctagcag

SEQ ID NO: 7668329 - DNA, 22 bp, Homo sapiens
ggctccttcaagcctgtcactg

SEQ ID NO: 7668330 - DNA, 22 bp, Homo sapiens
ggctccttcaagcctgtcactg

SEQ ID NO: 7668331 - DNA, 22 bp, Homo sapiens
ggctctcagggaaaggcctccc

SEQ ID NO: 7668332 - DNA, 22 bp, Homo sapiens
ggctctccactatggatgagaa

SEQ ID NO: 7668333 - DNA, 22 bp, Homo sapiens
ggctctagagctgtgcacacat

SEQ ID NO: 7668334 - DNA, 22 bp, Homo sapiens
ggctcgatgtccagctccttgt

SEQ ID NO: 7668335 - DNA, 22 bp, Homo sapiens
ggctctagagactctagagaaa

SEQ ID NO: 7668336 - DNA, 23 bp, Homo sapiens
ggctccttgcccatccagcagcc

SEQ ID NO: 7668337 - DNA, 22 bp, Homo sapiens
ggctctagagactctagagaaa

SEQ ID NO: 7668338 - DNA, 22 bp, Homo sapiens
ggctcctggaggcaccactggt

SEQ ID NO: 7668339 - DNA, 22 bp, Homo sapiens
ggctcctggaggcaccactggt

SEQ ID NO: 7668340 - DNA, 22 bp, Homo sapiens
ggctcctggaggcaccactggt

SEQ ID NO: 7668341 - DNA, 22 bp, Homo sapiens
ggctcctggaaagccctcgctc

SEQ ID NO: 7668342 - DNA, 23 bp, Homo sapiens
ggctcctggattcaaatcctgcc

SEQ ID NO: 7668343 - DNA, 23 bp, Homo sapiens
ggctcctggattcaaatcctgcc

SEQ ID NO: 7668344 - DNA, 23 bp, Homo sapiens
ggctcctggattcaaatcctgcc

SEQ ID NO: 7668345 - DNA, 22 bp, Homo sapiens
ggctcctggaggcaccactggt

SEQ ID NO: 7668346 - DNA, 22 bp, Homo sapiens
ggctcctggaggcaccactggt

SEQ ID NO: 7668347 - DNA, 22 bp, Homo sapiens
ggctcctggcatctggtgggta

SEQ ID NO: 7668348 - DNA, 22 bp, Homo sapiens
ggctcctggcatctggtgggta

SEQ ID NO: 7668349 - DNA, 22 bp, Homo sapiens
ggctcctggcatctggtgggta

SEQ ID NO: 7668350 - DNA, 22 bp, Homo sapiens
ggctcctggcatctggtgggta

SEQ ID NO: 7668351 - DNA, 23 bp, Homo sapiens
ggctcctggattcaaatcctgcc

SEQ ID NO: 7668352 - DNA, 23 bp, Homo sapiens
ggctcctggattcaaatcctgcc

SEQ ID NO: 7668353 - DNA, 22 bp, Homo sapiens
ggctcctgggcagctgctccct

SEQ ID NO: 7668354 - DNA, 22 bp, Homo sapiens
ggctcctgggcagctgctccct

SEQ ID NO: 7668355 - DNA, 22 bp, Homo sapiens
ggctcctgggcagctgctccct

SEQ ID NO: 7668356 - DNA, 22 bp, Homo sapiens
ggctcctgggcagctgctccct

SEQ ID NO: 7668357 - DNA, 22 bp, Homo sapiens
ggctcctgggcagctgctccct

SEQ ID NO: 7668358 - DNA, 22 bp, Homo sapiens
ggctcctgggcagctgctccct

SEQ ID NO: 7668359 - DNA, 22 bp, Homo sapiens
ggctcctgggcagctgctccct

SEQ ID NO: 7668360 - DNA, 22 bp, Homo sapiens
ggctcctgggcagctgctccct

SEQ ID NO: 7668361 - DNA, 22 bp, Homo sapiens
ggctcctgggatgggactgagc

SEQ ID NO: 7668362 - DNA, 22 bp, Homo sapiens
ggctcctgggatgggactgagc

SEQ ID NO: 7668363 - DNA, 22 bp, Homo sapiens
ggctcctgggatgggactgagc

SEQ ID NO: 7668364 - DNA, 22 bp, Homo sapiens
ggctcctgggagatagaggtca

SEQ ID NO: 7668365 - DNA, 22 bp, Homo sapiens
ggctcctgggagatagaggtca

SEQ ID NO: 7668366 - DNA, 22 bp, Homo sapiens
ggctcctgggagatagaggtca

SEQ ID NO: 7668367 - DNA, 22 bp, Homo sapiens
ggctgcagagctgggtgggcct

SEQ ID NO: 7668368 - DNA, 22 bp, Homo sapiens
ggctgcagagctggtgccctgg

SEQ ID NO: 7668369 - DNA, 22 bp, Homo sapiens
ggctgcagagctggtgccctgg

SEQ ID NO: 7668370 - DNA, 22 bp, Homo sapiens
ggctgcagagctggtgccctgg

SEQ ID NO: 7668371 - DNA, 22 bp, Homo sapiens
ggctgcagagctgggtgggcct

SEQ ID NO: 7668372 - DNA, 22 bp, Homo sapiens
ggctgcagagctgggtgggcct

SEQ ID NO: 7668373 - DNA, 22 bp, Homo sapiens
ggctgcagagctgggtgggcct

SEQ ID NO: 7668374 - DNA, 19 bp, Homo sapiens
ggctgcagagccccggcgc

SEQ ID NO: 7668375 - DNA, 19 bp, Homo sapiens
ggctgcagagccccggcgc

SEQ ID NO: 7668376 - DNA, 19 bp, Homo sapiens
ggctgcagagccccggcgc

SEQ ID NO: 7668377 - DNA, 19 bp, Homo sapiens
ggctgcagagccccggcgc

SEQ ID NO: 7668378 - DNA, 22 bp, Homo sapiens
ggctgcagaagtacttccggat

SEQ ID NO: 7668379 - DNA, 19 bp, Homo sapiens
ggctgcagagccccggcgc

SEQ ID NO: 7668380 - DNA, 22 bp, Homo sapiens
ggctgcagaggcgatctgaggt

SEQ ID NO: 7668381 - DNA, 22 bp, Homo sapiens
ggctgcagaggcgatctgaggt

SEQ ID NO: 7668382 - DNA, 22 bp, Homo sapiens
ggctgcagaggcgatctgaggt

SEQ ID NO: 7668383 - DNA, 22 bp, Homo sapiens
ggctgcaggaacgacggagggg

SEQ ID NO: 7668384 - DNA, 22 bp, Homo sapiens
ggctgcagaggcccccagtggg

SEQ ID NO: 7668385 - DNA, 22 bp, Homo sapiens
ggctgcagaggcccccagtggg

SEQ ID NO: 7668386 - DNA, 22 bp, Homo sapiens
ggctgcagaggcgatctgaggt

SEQ ID NO: 7668387 - DNA, 22 bp, Homo sapiens
ggctgcagaggcgatctgaggt

SEQ ID NO: 7668388 - DNA, 22 bp, Homo sapiens
ggctgcagaggcccccagtggg

SEQ ID NO: 7668389 - DNA, 22 bp, Homo sapiens
ggctgcagaggcccccagtggg

SEQ ID NO: 7668390 - DNA, 22 bp, Homo sapiens
ggctgcagaggcccccagtggg

SEQ ID NO: 7668391 - DNA, 22 bp, Homo sapiens
ggctgcagaggcccccagtggg

SEQ ID NO: 7668392 - DNA, 22 bp, Homo sapiens
ggctgcagagctggtgccctgg

SEQ ID NO: 7668393 - DNA, 22 bp, Homo sapiens
ggctgcagagctggtgccctgg

SEQ ID NO: 7668394 - DNA, 19 bp, Homo sapiens
ggctgcacttgaggaagtg

SEQ ID NO: 7668395 - DNA, 19 bp, Homo sapiens
ggctgcacttgaggaagtg

SEQ ID NO: 7668396 - DNA, 22 bp, Homo sapiens
ggctgcagaagtacttccggat

SEQ ID NO: 7668397 - DNA, 22 bp, Homo sapiens
ggctgcagaagtacttccggat

SEQ ID NO: 7668398 - DNA, 22 bp, Homo sapiens
ggctgcacactgcaaactcaga

SEQ ID NO: 7668399 - DNA, 22 bp, Homo sapiens
ggctgcacagcaaagaagcctt

SEQ ID NO: 7668400 - DNA, 22 bp, Homo sapiens
ggctgcaagcctttggggctgg

SEQ ID NO: 7668401 - DNA, 22 bp, Homo sapiens
ggctgcacgcctctcagcttgc

SEQ ID NO: 7668402 - DNA, 22 bp, Homo sapiens
ggctgcacagcaaagaagcctt

SEQ ID NO: 7668403 - DNA, 22 bp, Homo sapiens
ggctgcaaaggaaaagtggtga

SEQ ID NO: 7668404 - DNA, 22 bp, Homo sapiens
ggctgcaaataacaactagctt

SEQ ID NO: 7668405 - DNA, 22 bp, Homo sapiens
ggctgatgggcatgagctgtca

SEQ ID NO: 7668406 - DNA, 19 bp, Homo sapiens
ggctgatgtagacagtgtc

SEQ ID NO: 7668407 - DNA, 19 bp, Homo sapiens
ggctgatgtagacagtgtc

SEQ ID NO: 7668408 - DNA, 22 bp, Homo sapiens
ggctgatgagcttagctagaga

SEQ ID NO: 7668409 - DNA, 22 bp, Homo sapiens
ggctgatgagcttagctagaga

SEQ ID NO: 7668410 - DNA, 22 bp, Homo sapiens
ggctgatcctgagcaggcagtg

SEQ ID NO: 7668411 - DNA, 22 bp, Homo sapiens
ggctgatcctgagcaggcagtg

SEQ ID NO: 7668412 - DNA, 22 bp, Homo sapiens
ggctgatctcgtgtgaccttgt

SEQ ID NO: 7668413 - DNA, 22 bp, Homo sapiens
ggctgatcaggtgcaaatgcat

SEQ ID NO: 7668414 - DNA, 22 bp, Homo sapiens
ggctgatcaggtgcaaatgcat

SEQ ID NO: 7668415 - DNA, 18 bp, Homo sapiens
ggctgatccaggcagccc

SEQ ID NO: 7668416 - DNA, 18 bp, Homo sapiens
ggctgatccaggcagccc

SEQ ID NO: 7668417 - DNA, 22 bp, Homo sapiens
ggctgagttgagaggattactt

SEQ ID NO: 7668418 - DNA, 22 bp, Homo sapiens
ggctgagttgagaggattactt

SEQ ID NO: 7668419 - DNA, 22 bp, Homo sapiens
ggctgagttgagaggattactt

SEQ ID NO: 7668420 - DNA, 22 bp, Homo sapiens
ggctgagttgagaggattactt

SEQ ID NO: 7668421 - DNA, 22 bp, Homo sapiens
ggctctccactatggatgagaa

SEQ ID NO: 7668422 - DNA, 22 bp, Homo sapiens
ggctctccactatggatgagaa

SEQ ID NO: 7668423 - DNA, 22 bp, Homo sapiens
ggctctccactatggatgagaa

SEQ ID NO: 7668424 - DNA, 19 bp, Homo sapiens
ggctctcccttgagagagc

SEQ ID NO: 7668425 - DNA, 22 bp, Homo sapiens
ggctctccactatggatgagaa

SEQ ID NO: 7668426 - DNA, 22 bp, Homo sapiens
ggctctccactatggatgagaa

SEQ ID NO: 7668427 - DNA, 19 bp, Homo sapiens
ggctctcccttgagagagc

SEQ ID NO: 7668428 - DNA, 19 bp, Homo sapiens
ggctctcccttgagagagc

SEQ ID NO: 7668429 - DNA, 19 bp, Homo sapiens
ggctctcccttgagagagc

SEQ ID NO: 7668430 - DNA, 22 bp, Homo sapiens
ggctctctccttggctttcaga

SEQ ID NO: 7668431 - DNA, 22 bp, Homo sapiens
ggctctccactatggatgagaa

SEQ ID NO: 7668432 - DNA, 22 bp, Homo sapiens
ggctctcggcggaccctgggaa

SEQ ID NO: 7668433 - DNA, 22 bp, Homo sapiens
ggctgagttgagaggattactt

SEQ ID NO: 7668434 - DNA, 22 bp, Homo sapiens
gcctcctgtcccaggctgagga

SEQ ID NO: 7668435 - DNA, 22 bp, Homo sapiens
gcctcctgtcccaggctgagga

SEQ ID NO: 7668436 - DNA, 22 bp, Homo sapiens
gcctcctgtcccaggctgagga

SEQ ID NO: 7668437 - DNA, 22 bp, Homo sapiens
gcctcctgttatgccatgtgcc

SEQ ID NO: 7668438 - DNA, 22 bp, Homo sapiens
gcctcctgttatgccatgtgcc

SEQ ID NO: 7668439 - DNA, 22 bp, Homo sapiens
gcctcctgttatgccatgtgcc

SEQ ID NO: 7668440 - DNA, 22 bp, Homo sapiens
gcctcctgttatgccatgtgcc

SEQ ID NO: 7668441 - DNA, 22 bp, Homo sapiens
gccgtgtcatctgcgggtggca

SEQ ID NO: 7668442 - DNA, 22 bp, Homo sapiens
gccgtgtcccgggggccactct

SEQ ID NO: 7668443 - DNA, 22 bp, Homo sapiens
gccgtgtcccgggggccactct

SEQ ID NO: 7668444 - DNA, 22 bp, Homo sapiens
gcctcctgtcccaggctgagga

SEQ ID NO: 7668445 - DNA, 22 bp, Homo sapiens
gcctcctgtcccaggctgagga

SEQ ID NO: 7668446 - DNA, 22 bp, Homo sapiens
gcctcctgtcccaggctgagga

SEQ ID NO: 7668447 - DNA, 22 bp, Homo sapiens
gcctcctgtcccaggctgagga

SEQ ID NO: 7668448 - DNA, 22 bp, Homo sapiens
gccgttattctgctggccccgg

SEQ ID NO: 7668449 - DNA, 22 bp, Homo sapiens
gcctaacttggctttgttcacc

SEQ ID NO: 7668450 - DNA, 22 bp, Homo sapiens
gccgggttcaagccattctcct

SEQ ID NO: 7668451 - DNA, 22 bp, Homo sapiens
gccgggttcaagccattctcct

SEQ ID NO: 7668452 - DNA, 22 bp, Homo sapiens
gccgggtgcagcgggcccgcca

SEQ ID NO: 7668453 - DNA, 19 bp, Homo sapiens
gccgggggcgccccgctct

SEQ ID NO: 7668454 - DNA, 22 bp, Homo sapiens
gccggggctggggagagacatg

SEQ ID NO: 7668455 - DNA, 22 bp, Homo sapiens
gccggggctggggagagacatg

SEQ ID NO: 7668456 - DNA, 22 bp, Homo sapiens
gccggggctggggagagacatg

SEQ ID NO: 7668457 - DNA, 22 bp, Homo sapiens
gccgtccacctcgatggccact

SEQ ID NO: 7668458 - DNA, 22 bp, Homo sapiens
gccgtgcgtgcgcaggtgctgt

SEQ ID NO: 7668459 - DNA, 22 bp, Homo sapiens
gccgtgcgtgcgcaggtgctgt

SEQ ID NO: 7668460 - DNA, 22 bp, Homo sapiens
gccggtcttaagctgactgtga

SEQ ID NO: 7668461 - DNA, 22 bp, Homo sapiens
gccggtggcttttgtctcccct

SEQ ID NO: 7668462 - DNA, 22 bp, Homo sapiens
gccgggttcaagccattctcct

SEQ ID NO: 7668463 - DNA, 22 bp, Homo sapiens
gccgtggcttctccagctggct

SEQ ID NO: 7668464 - DNA, 22 bp, Homo sapiens
gccgtggccagagcccagtctc

SEQ ID NO: 7668465 - DNA, 22 bp, Homo sapiens
gccgtgcgtgcgcaggtgctgt

SEQ ID NO: 7668466 - DNA, 22 bp, Homo sapiens
gccgtccccgaggccggaggga

SEQ ID NO: 7668467 - DNA, 22 bp, Homo sapiens
gccgtggcttctccagctggct

SEQ ID NO: 7668468 - DNA, 22 bp, Homo sapiens
gccgtggggagagagggtgcgt

SEQ ID NO: 7668469 - DNA, 22 bp, Homo sapiens
gccgtggggagagagggtgcgt

SEQ ID NO: 7668470 - DNA, 22 bp, Homo sapiens
gccgaggctctgcccagctgct

SEQ ID NO: 7668471 - DNA, 22 bp, Homo sapiens
gccgaggctctgcccagctgct

SEQ ID NO: 7668472 - DNA, 22 bp, Homo sapiens
gccgaggaagcattcctaggag

SEQ ID NO: 7668473 - DNA, 22 bp, Homo sapiens
gccgaggaagcattcctaggag

SEQ ID NO: 7668474 - DNA, 22 bp, Homo sapiens
gccgagcacagtgcagctgcct

SEQ ID NO: 7668475 - DNA, 19 bp, Homo sapiens
gccgaccgttggggtgccc

SEQ ID NO: 7668476 - DNA, 20 bp, Homo sapiens
gccgactgccttgtgagcct

SEQ ID NO: 7668477 - DNA, 20 bp, Homo sapiens
gccgactgccttgtgagcct

SEQ ID NO: 7668478 - DNA, 22 bp, Homo sapiens
gccgaagacgctgggcgtgggc

SEQ ID NO: 7668479 - DNA, 22 bp, Homo sapiens
gccgaagacgctgggcgtgggc

SEQ ID NO: 7668480 - DNA, 20 bp, Homo sapiens
gccgactgccttgtgagcct

SEQ ID NO: 7668481 - DNA, 20 bp, Homo sapiens
gccgactgccttgtgagcct

SEQ ID NO: 7668482 - DNA, 22 bp, Homo sapiens
gccgcggcactggcctggctcc

SEQ ID NO: 7668483 - DNA, 22 bp, Homo sapiens
gccgccgctgtgcaatttagca

SEQ ID NO: 7668484 - DNA, 22 bp, Homo sapiens
gccgaggctctgcccagctgct

SEQ ID NO: 7668485 - DNA, 22 bp, Homo sapiens
gccgccatatcatctgcctctt

SEQ ID NO: 7668486 - DNA, 22 bp, Homo sapiens
gccgccatatcatctgcctctt

SEQ ID NO: 7668487 - DNA, 22 bp, Homo sapiens
gccgggaccaaggccacggagc

SEQ ID NO: 7668488 - DNA, 22 bp, Homo sapiens
gccgggaccaaggccacggagc

SEQ ID NO: 7668489 - DNA, 22 bp, Homo sapiens
gccggaagatgaagtttggtca

SEQ ID NO: 7668490 - DNA, 22 bp, Homo sapiens
gccgggaccaaggccacggagc

SEQ ID NO: 7668491 - DNA, 22 bp, Homo sapiens
gccgggaccaaggccacggagc

SEQ ID NO: 7668492 - DNA, 22 bp, Homo sapiens
gccgggaccaaggccacggagc

SEQ ID NO: 7668493 - DNA, 22 bp, Homo sapiens
gccgggaccaaggccacggagc

SEQ ID NO: 7668494 - DNA, 22 bp, Homo sapiens
gccgggaccaaggccacggagc

SEQ ID NO: 7668495 - DNA, 19 bp, Homo sapiens
gccgggcccgggttggccg

SEQ ID NO: 7668496 - DNA, 22 bp, Homo sapiens
gccggggctggggagagacatg

SEQ ID NO: 7668497 - DNA, 22 bp, Homo sapiens
gccggggctggggagagacatg

SEQ ID NO: 7668498 - DNA, 22 bp, Homo sapiens
gccggggctggggagagacatg

SEQ ID NO: 7668499 - DNA, 22 bp, Homo sapiens
gccggggctggggagagacatg

SEQ ID NO: 7668500 - DNA, 22 bp, Homo sapiens
gccggggctggggagagacatg

SEQ ID NO: 7668501 - DNA, 22 bp, Homo sapiens
gccggggctggggagagacatg

SEQ ID NO: 7668502 - DNA, 22 bp, Homo sapiens
gcctctgcatcttcgccgcact

SEQ ID NO: 7668503 - DNA, 22 bp, Homo sapiens
gcctctgcatgctcagcaccca

SEQ ID NO: 7668504 - DNA, 22 bp, Homo sapiens
gcctctgcatgctcagcaccca

SEQ ID NO: 7668505 - DNA, 22 bp, Homo sapiens
gcctctgcatcatcactccagc

SEQ ID NO: 7668506 - DNA, 22 bp, Homo sapiens
gcctctgcatcatcactccagc

SEQ ID NO: 7668507 - DNA, 22 bp, Homo sapiens
gcctctgcatcatcactccagc

SEQ ID NO: 7668508 - DNA, 22 bp, Homo sapiens
gcctctgccaagggggctgcgg

SEQ ID NO: 7668509 - DNA, 22 bp, Homo sapiens
gcctctgcatgctcagcaccca

SEQ ID NO: 7668510 - DNA, 22 bp, Homo sapiens
gcctctgcatgctcagcaccca

SEQ ID NO: 7668511 - DNA, 22 bp, Homo sapiens
gcctctgcatgctcagcaccca

SEQ ID NO: 7668512 - DNA, 22 bp, Homo sapiens
gcctctgcccatccaccatcag

SEQ ID NO: 7668513 - DNA, 22 bp, Homo sapiens
gcctctgcccatccaccatcag

SEQ ID NO: 7668514 - DNA, 22 bp, Homo sapiens
gcctctgcccatccaccatcag

SEQ ID NO: 7668515 - DNA, 22 bp, Homo sapiens
gcctctgccaagggggctgcgg

SEQ ID NO: 7668516 - DNA, 22 bp, Homo sapiens
gcctctgcatcatcactccagc

SEQ ID NO: 7668517 - DNA, 22 bp, Homo sapiens
gcctctgcatcatcactccagc

SEQ ID NO: 7668518 - DNA, 22 bp, Homo sapiens
gcctctgcaggtgcggttatcc

SEQ ID NO: 7668519 - DNA, 22 bp, Homo sapiens
gcctctgcactgtggcacacca

SEQ ID NO: 7668520 - DNA, 23 bp, Homo sapiens
gcctctgcagcctagttagtgtc

SEQ ID NO: 7668521 - DNA, 22 bp, Homo sapiens
gcctctgcaccagtactgtgcc

SEQ ID NO: 7668522 - DNA, 22 bp, Homo sapiens
gcctctgcaccagtactgtgcc

SEQ ID NO: 7668523 - DNA, 22 bp, Homo sapiens
gcctctgcactgtggcacacca

SEQ ID NO: 7668524 - DNA, 22 bp, Homo sapiens
gcctctgcactgtggcacacca

SEQ ID NO: 7668525 - DNA, 22 bp, Homo sapiens
gcctctgcactgtggcacacca

SEQ ID NO: 7668526 - DNA, 22 bp, Homo sapiens
gcctctgcactgtggcacacca

SEQ ID NO: 7668527 - DNA, 22 bp, Homo sapiens
gcctctgcactgtggcacacca

SEQ ID NO: 7668528 - DNA, 22 bp, Homo sapiens
gcctctgcaccagtactgtgcc

SEQ ID NO: 7668529 - DNA, 22 bp, Homo sapiens
gcctctgcaattacattgtgcc

SEQ ID NO: 7668530 - DNA, 22 bp, Homo sapiens
gcctctgcaattacattgtgcc

SEQ ID NO: 7668531 - DNA, 22 bp, Homo sapiens
gcctcctgttatgccatgtgcc

SEQ ID NO: 7668532 - DNA, 22 bp, Homo sapiens
gcctcctgttatgccatgtgcc

SEQ ID NO: 7668533 - DNA, 22 bp, Homo sapiens
gcctcctgttatgccatgtgcc

SEQ ID NO: 7668534 - DNA, 22 bp, Homo sapiens
gcctctgctgacaagatggaca

SEQ ID NO: 7668535 - DNA, 22 bp, Homo sapiens
gcctctgctgacaagatggaca

SEQ ID NO: 7668536 - DNA, 23 bp, Homo sapiens
gcctctgctctgcgttggggact

SEQ ID NO: 7668537 - DNA, 22 bp, Homo sapiens
gcctctgctctcaggtagcctc

SEQ ID NO: 7668538 - DNA, 22 bp, Homo sapiens
gcctctgctctcaggtagcctc

SEQ ID NO: 7668539 - DNA, 22 bp, Homo sapiens
gcctctgctctcaggtagcctc

SEQ ID NO: 7668540 - DNA, 22 bp, Homo sapiens
gcctctgctgacaagatggaca

SEQ ID NO: 7668541 - DNA, 22 bp, Homo sapiens
gcctctgctgcaagcctggttg

SEQ ID NO: 7668542 - DNA, 22 bp, Homo sapiens
gcctctgctgcaagcctggttg

SEQ ID NO: 7668543 - DNA, 19 bp, Homo sapiens
gcctctgctggggacaggc

SEQ ID NO: 7668544 - DNA, 19 bp, Homo sapiens
gcctctgctggggacaggc

SEQ ID NO: 7668545 - DNA, 19 bp, Homo sapiens
gcctctgctggggacaggc

SEQ ID NO: 7668546 - DNA, 19 bp, Homo sapiens
gcctctgctggggacaggc

SEQ ID NO: 7668547 - DNA, 19 bp, Homo sapiens
gcctctgctggggacaggc

SEQ ID NO: 7668548 - DNA, 21 bp, Homo sapiens
gcctctgctgtcttattgtga

SEQ ID NO: 7668549 - DNA, 19 bp, Homo sapiens
gcctctgctggggacaggc

SEQ ID NO: 7668550 - DNA, 19 bp, Homo sapiens
gcctctgctggggacaggc

SEQ ID NO: 7668551 - DNA, 19 bp, Homo sapiens
gcctctgctggggacaggc

SEQ ID NO: 7668552 - DNA, 22 bp, Homo sapiens
gcctctgccctcctgggactgc

SEQ ID NO: 7668553 - DNA, 22 bp, Homo sapiens
gcctctgccctcctgggactgc

SEQ ID NO: 7668554 - DNA, 22 bp, Homo sapiens
gcctctgcgcctcagccgacct

SEQ ID NO: 7668555 - DNA, 22 bp, Homo sapiens
gcctctgcgcctcagccgacct

SEQ ID NO: 7668556 - DNA, 22 bp, Homo sapiens
gcctctgcggagctgtacatca

SEQ ID NO: 7668557 - DNA, 22 bp, Homo sapiens
gcctctgcggagctgtacatca

SEQ ID NO: 7668558 - DNA, 22 bp, Homo sapiens
gcctctgcggagctgtacatca

SEQ ID NO: 7668559 - DNA, 22 bp, Homo sapiens
gcctctgctcggactttgcctc

SEQ ID NO: 7668560 - DNA, 22 bp, Homo sapiens
gcctctgctcggactttgcctc

SEQ ID NO: 7668561 - DNA, 22 bp, Homo sapiens
gcctctgcggggcccgagcccg

SEQ ID NO: 7668562 - DNA, 22 bp, Homo sapiens
gcctctgcggggcccgagcccg

SEQ ID NO: 7668563 - DNA, 22 bp, Homo sapiens
gcccttacagggtggtcagcca

SEQ ID NO: 7668564 - DNA, 22 bp, Homo sapiens
gcccttacagggtggtcagcca

SEQ ID NO: 7668565 - DNA, 22 bp, Homo sapiens
gccctgttttgaaacttgcata

SEQ ID NO: 7668566 - DNA, 22 bp, Homo sapiens
gccctgttgtcggacgtcaagg

SEQ ID NO: 7668567 - DNA, 22 bp, Homo sapiens
gcccttacagggtggtcagcca

SEQ ID NO: 7668568 - DNA, 22 bp, Homo sapiens
gcccttagccttatagcctcta

SEQ ID NO: 7668569 - DNA, 22 bp, Homo sapiens
gcccttaggcaagcagaagccc

SEQ ID NO: 7668570 - DNA, 22 bp, Homo sapiens
gcccttaggcaagcagaagccc

SEQ ID NO: 7668571 - DNA, 22 bp, Homo sapiens
gccctgttctggacaggcacaa

SEQ ID NO: 7668572 - DNA, 22 bp, Homo sapiens
gccctctggcacagagatgcag

SEQ ID NO: 7668573 - DNA, 22 bp, Homo sapiens
gccctctggcacagagatgcag

SEQ ID NO: 7668574 - DNA, 22 bp, Homo sapiens
gccctctggcacagagatgcag

SEQ ID NO: 7668575 - DNA, 22 bp, Homo sapiens
gccctctgctggcctcacctcg

SEQ ID NO: 7668576 - DNA, 22 bp, Homo sapiens
gccctctgctcagctcctcagc

SEQ ID NO: 7668577 - DNA, 22 bp, Homo sapiens
gccctctgctggcctcacctcg

SEQ ID NO: 7668578 - DNA, 22 bp, Homo sapiens
gccctctggcacagagatgcag

SEQ ID NO: 7668579 - DNA, 22 bp, Homo sapiens
gccctctggcacagagatgcag

SEQ ID NO: 7668580 - DNA, 22 bp, Homo sapiens
gccctctggcacagagatgcag

SEQ ID NO: 7668581 - DNA, 20 bp, Homo sapiens
gccctctgcctccctcagcg

SEQ ID NO: 7668582 - DNA, 22 bp, Homo sapiens
gccctctgctcagctcctcagc

SEQ ID NO: 7668583 - DNA, 22 bp, Homo sapiens
gccctctgctcagctcctcagc

SEQ ID NO: 7668584 - DNA, 20 bp, Homo sapiens
gccctctgcctccctcagcg

SEQ ID NO: 7668585 - DNA, 22 bp, Homo sapiens
gccctctgctcagctcctcagc

SEQ ID NO: 7668586 - DNA, 20 bp, Homo sapiens
gccctctgcctccctcagcg

SEQ ID NO: 7668587 - DNA, 16 bp, Homo sapiens
gccctctgcataagga

SEQ ID NO: 7668588 - DNA, 20 bp, Homo sapiens
gccctctgcctccctcagcg

SEQ ID NO: 7668589 - DNA, 20 bp, Homo sapiens
gccctctgcctccctcagcg

SEQ ID NO: 7668590 - DNA, 20 bp, Homo sapiens
gccctctgcctccctcagcg

SEQ ID NO: 7668591 - DNA, 22 bp, Homo sapiens
gccctctgatgctcaccgagga

SEQ ID NO: 7668592 - DNA, 22 bp, Homo sapiens
gccctctgatgctcaccgagga

SEQ ID NO: 7668593 - DNA, 22 bp, Homo sapiens
gccctctgcacagctctgagca

SEQ ID NO: 7668594 - DNA, 22 bp, Homo sapiens
gccctctgatgctcaccgagga

SEQ ID NO: 7668595 - DNA, 22 bp, Homo sapiens
gccctctgatgctcaccgagga

SEQ ID NO: 7668596 - DNA, 22 bp, Homo sapiens
gccctctgcacagctctgagca

SEQ ID NO: 7668597 - DNA, 22 bp, Homo sapiens
gccctctgcacagctctgagca

SEQ ID NO: 7668598 - DNA, 22 bp, Homo sapiens
gccctctgcacagctctgagca

SEQ ID NO: 7668599 - DNA, 22 bp, Homo sapiens
gccctctgccacaggacgccag

SEQ ID NO: 7668600 - DNA, 22 bp, Homo sapiens
gccctctgccacaggacgccag

SEQ ID NO: 7668601 - DNA, 22 bp, Homo sapiens
gccctctgcacagctctgagca

SEQ ID NO: 7668602 - DNA, 22 bp, Homo sapiens
gccctttattagagctgccatt

SEQ ID NO: 7668603 - DNA, 22 bp, Homo sapiens
gccctttattagagctgccatt

SEQ ID NO: 7668604 - DNA, 22 bp, Homo sapiens
gcccttggggtgtctgtaataa

SEQ ID NO: 7668605 - DNA, 22 bp, Homo sapiens
gccctttcttcttctggactgg

SEQ ID NO: 7668606 - DNA, 22 bp, Homo sapiens
gccctttgtggtcagaggcctg

SEQ ID NO: 7668607 - DNA, 22 bp, Homo sapiens
gccctttgtggtcagaggcctg

SEQ ID NO: 7668608 - DNA, 22 bp, Homo sapiens
gccgaacttgagggccaggcgg

SEQ ID NO: 7668609 - DNA, 22 bp, Homo sapiens
gcccttggaaagccaaggcagc

SEQ ID NO: 7668610 - DNA, 22 bp, Homo sapiens
gcccttggaaagccaaggcagc

SEQ ID NO: 7668611 - DNA, 22 bp, Homo sapiens
gcccttggaaagccaaggcagc

SEQ ID NO: 7668612 - DNA, 22 bp, Homo sapiens
gcccttggaaagccaaggcagc

SEQ ID NO: 7668613 - DNA, 22 bp, Homo sapiens
gcccttggaagcggcaggtagc

SEQ ID NO: 7668614 - DNA, 22 bp, Homo sapiens
gcccttggaacagcctcctgct

SEQ ID NO: 7668615 - DNA, 22 bp, Homo sapiens
gcccttggaacagcctcctgct

SEQ ID NO: 7668616 - DNA, 22 bp, Homo sapiens
gcccttggaacagcctcctgct

SEQ ID NO: 7668617 - DNA, 22 bp, Homo sapiens
gcccttgggaggttccactggg

SEQ ID NO: 7668618 - DNA, 22 bp, Homo sapiens
gcccttggcaaattctccttta

SEQ ID NO: 7668619 - DNA, 22 bp, Homo sapiens
gcccttggaagcggcaggtagc

SEQ ID NO: 7668620 - DNA, 22 bp, Homo sapiens
gcccttggcaaattctccttta

SEQ ID NO: 7668621 - DNA, 22 bp, Homo sapiens
gcccttgggaggttccactggg

SEQ ID NO: 7668622 - DNA, 22 bp, Homo sapiens
gcccttgggaggttccactggg

SEQ ID NO: 7668623 - DNA, 22 bp, Homo sapiens
gcccttgggaggttccactggg

SEQ ID NO: 7668624 - DNA, 22 bp, Homo sapiens
gcccttgggaggttccactggg

SEQ ID NO: 7668625 - DNA, 20 bp, Homo sapiens
gcccttatgcagtgatggga

SEQ ID NO: 7668626 - DNA, 22 bp, Homo sapiens
gcccttccaacccagagggcaa

SEQ ID NO: 7668627 - DNA, 22 bp, Homo sapiens
gcccttcatttatagttggaat

SEQ ID NO: 7668628 - DNA, 22 bp, Homo sapiens
gcccttataaacaaggcttcag

SEQ ID NO: 7668629 - DNA, 22 bp, Homo sapiens
gcccttagtcagcactttcact

SEQ ID NO: 7668630 - DNA, 22 bp, Homo sapiens
gcccttagggccactgtcactg

SEQ ID NO: 7668631 - DNA, 22 bp, Homo sapiens
gcccttccttagacagcaggat

SEQ ID NO: 7668632 - DNA, 22 bp, Homo sapiens
gcccttccaacccagagggcaa

SEQ ID NO: 7668633 - DNA, 22 bp, Homo sapiens
gcccttccttagacagcaggat

SEQ ID NO: 7668634 - DNA, 22 bp, Homo sapiens
gcccttccttagacagcaggat

SEQ ID NO: 7668635 - DNA, 22 bp, Homo sapiens
gcccttccaacccagagggcaa

SEQ ID NO: 7668636 - DNA, 22 bp, Homo sapiens
gcccttccttagacagcaggat

SEQ ID NO: 7668637 - DNA, 22 bp, Homo sapiens
gcccttctgctgttaggtagcc

SEQ ID NO: 7668638 - DNA, 22 bp, Homo sapiens
gcccttgagtagcaaaaagggc

SEQ ID NO: 7668639 - DNA, 22 bp, Homo sapiens
gcccttgacagtggcagaagca

SEQ ID NO: 7668640 - DNA, 22 bp, Homo sapiens
gcccttgacagtggcagaagca

SEQ ID NO: 7668641 - DNA, 22 bp, Homo sapiens
gcccttctgctgttaggtagcc

SEQ ID NO: 7668642 - DNA, 22 bp, Homo sapiens
gcccttctgctgttaggtagcc

SEQ ID NO: 7668643 - DNA, 21 bp, Homo sapiens
gcccttgaaaagctcacaggc

SEQ ID NO: 7668644 - DNA, 22 bp, Homo sapiens
gccctctcttctgcagcctcca

SEQ ID NO: 7668645 - DNA, 22 bp, Homo sapiens
gccctctcttctgcagcctcca

SEQ ID NO: 7668646 - DNA, 22 bp, Homo sapiens
gccctctcttctgcagcctcca

SEQ ID NO: 7668647 - DNA, 22 bp, Homo sapiens
gccctctcttctgcagcctcca

SEQ ID NO: 7668648 - DNA, 22 bp, Homo sapiens
gccctctcttctgcagcctcca

SEQ ID NO: 7668649 - DNA, 22 bp, Homo sapiens
gccctctcggcatagcaggggc

SEQ ID NO: 7668650 - DNA, 22 bp, Homo sapiens
gccctcgcttcttcctaggggt

SEQ ID NO: 7668651 - DNA, 22 bp, Homo sapiens
gccctcctttgcttctcctagt

SEQ ID NO: 7668652 - DNA, 22 bp, Homo sapiens
gccctcgcttcttcctaggggt

SEQ ID NO: 7668653 - DNA, 22 bp, Homo sapiens
gccctcgggctgccctaggctg

SEQ ID NO: 7668654 - DNA, 22 bp, Homo sapiens
gccctcctttgcttctcctagt

SEQ ID NO: 7668655 - DNA, 22 bp, Homo sapiens
gccctcctttgcttctcctagt

SEQ ID NO: 7668656 - DNA, 19 bp, Homo sapiens
gccctcatgatattcagat

SEQ ID NO: 7668657 - DNA, 22 bp, Homo sapiens
gccctcagtggattcttattgt

SEQ ID NO: 7668658 - DNA, 21 bp, Homo sapiens
gccctcaggggaggatggcct

SEQ ID NO: 7668659 - DNA, 15 bp, Homo sapiens
gccctcaggcgacac

SEQ ID NO: 7668660 - DNA, 22 bp, Homo sapiens
gccctcaggcagggagtctttc

SEQ ID NO: 7668661 - DNA, 19 bp, Homo sapiens
gccctcaggcagctccatc

SEQ ID NO: 7668662 - DNA, 19 bp, Homo sapiens
gccctcaggcagctccatc

SEQ ID NO: 7668663 - DNA, 19 bp, Homo sapiens
gccctcaggcagctccatc

SEQ ID NO: 7668664 - DNA, 19 bp, Homo sapiens
gccctcaggcagctccatc

SEQ ID NO: 7668665 - DNA, 22 bp, Homo sapiens
gccctcagtgaccactgattca

SEQ ID NO: 7668666 - DNA, 20 bp, Homo sapiens
gccctcagtcttgtctttat

SEQ ID NO: 7668667 - DNA, 20 bp, Homo sapiens
gccctcagtcttgtctttat

SEQ ID NO: 7668668 - DNA, 20 bp, Homo sapiens
gccctcagtcttgtctttat

SEQ ID NO: 7668669 - DNA, 21 bp, Homo sapiens
gccctcaggggaggatggcct

SEQ ID NO: 7668670 - DNA, 23 bp, Homo sapiens
gccctcagtagaaaatgttagaa

SEQ ID NO: 7668671 - DNA, 21 bp, Homo sapiens
gccctcaggggaggatggcct

SEQ ID NO: 7668672 - DNA, 22 bp, Homo sapiens
gcccaggctggagtgcagtggt

SEQ ID NO: 7668673 - DNA, 22 bp, Homo sapiens
gcccaggctggagtgcagtggt

SEQ ID NO: 7668674 - DNA, 22 bp, Homo sapiens
gcccaggctggagtgcagtggt

SEQ ID NO: 7668675 - DNA, 22 bp, Homo sapiens
gcccaggctggagtgcagtggt

SEQ ID NO: 7668676 - DNA, 22 bp, Homo sapiens
gcccaggctggagtgcagtggt

SEQ ID NO: 7668677 - DNA, 22 bp, Homo sapiens
gcccaggctggagtgcagtggt

SEQ ID NO: 7668678 - DNA, 22 bp, Homo sapiens
gcccaggctggagtgcagtggc

SEQ ID NO: 7668679 - DNA, 22 bp, Homo sapiens
gcccaggctggagtgcagtggc

SEQ ID NO: 7668680 - DNA, 22 bp, Homo sapiens
gcccaggctggagtgcagtggc

SEQ ID NO: 7668681 - DNA, 22 bp, Homo sapiens
gccctcagatgggaaaggaggg

SEQ ID NO: 7668682 - DNA, 22 bp, Homo sapiens
gccctcagagttccccacagtg

SEQ ID NO: 7668683 - DNA, 22 bp, Homo sapiens
gccctcagagttccccacagtg

SEQ ID NO: 7668684 - DNA, 22 bp, Homo sapiens
gccctcagcaggaaagatcaac

SEQ ID NO: 7668685 - DNA, 22 bp, Homo sapiens
gccctcagatgggaaaggaggg

SEQ ID NO: 7668686 - DNA, 22 bp, Homo sapiens
gccctcagagttccccacagtg

SEQ ID NO: 7668687 - DNA, 22 bp, Homo sapiens
gccctcagcatcctcagggcca

SEQ ID NO: 7668688 - DNA, 22 bp, Homo sapiens
gccctcagcaggaaagatcaac

SEQ ID NO: 7668689 - DNA, 22 bp, Homo sapiens
gccctcagcaggaaagatcaac

SEQ ID NO: 7668690 - DNA, 22 bp, Homo sapiens
gccctcagcatcctcagggcca

SEQ ID NO: 7668691 - DNA, 22 bp, Homo sapiens
gccctcagcatcctcagggcca

SEQ ID NO: 7668692 - DNA, 22 bp, Homo sapiens
gccctcagctcctggacacatg

SEQ ID NO: 7668693 - DNA, 22 bp, Homo sapiens
gccctcagctcctggacacatg

SEQ ID NO: 7668694 - DNA, 22 bp, Homo sapiens
gccctcaggacaaggttacgct

SEQ ID NO: 7668695 - DNA, 19 bp, Homo sapiens
gccctcaggcagctccatc

SEQ ID NO: 7668696 - DNA, 17 bp, Homo sapiens
gccctcagctttaacca

SEQ ID NO: 7668697 - DNA, 22 bp, Homo sapiens
gccctcagcttgatgttgttct

SEQ ID NO: 7668698 - DNA, 22 bp, Homo sapiens
gccctcagctcctggacacatg

SEQ ID NO: 7668699 - DNA, 22 bp, Homo sapiens
gccctcagctcctggacacatg

SEQ ID NO: 7668700 - DNA, 22 bp, Homo sapiens
gccctcagcttgatgttgttct

SEQ ID NO: 7668701 - DNA, 22 bp, Homo sapiens
gccctcagctcctggacacatg

SEQ ID NO: 7668702 - DNA, 22 bp, Homo sapiens
gcccaggctagcgtagagtgca

SEQ ID NO: 7668703 - DNA, 22 bp, Homo sapiens
gcccaggctagcgtagagtgca

SEQ ID NO: 7668704 - DNA, 22 bp, Homo sapiens
gcccaggctagcgtagagtgca

SEQ ID NO: 7668705 - DNA, 22 bp, Homo sapiens
gcccaggctagcgtagagtgca

SEQ ID NO: 7668706 - DNA, 22 bp, Homo sapiens
gcccaggctagcgtagagtgca

SEQ ID NO: 7668707 - DNA, 22 bp, Homo sapiens
gcccaggctagcgtagagtgca

SEQ ID NO: 7668708 - DNA, 22 bp, Homo sapiens
gcccaggctagcgtagagtgca

SEQ ID NO: 7668709 - DNA, 22 bp, Homo sapiens
gcccaggattctttcttcctta

SEQ ID NO: 7668710 - DNA, 22 bp, Homo sapiens
gcccaggattctttcttcctta

SEQ ID NO: 7668711 - DNA, 22 bp, Homo sapiens
gcccaggattctttcttcctta

SEQ ID NO: 7668712 - DNA, 22 bp, Homo sapiens
gcccaggattctttcttcctta

SEQ ID NO: 7668713 - DNA, 22 bp, Homo sapiens
gcccaggattctttcttcctta

SEQ ID NO: 7668714 - DNA, 22 bp, Homo sapiens
gcccaggattctttcttcctta

SEQ ID NO: 7668715 - DNA, 22 bp, Homo sapiens
gcccaggatggtgtgtagtggt

SEQ ID NO: 7668716 - DNA, 22 bp, Homo sapiens
gcccaggatggtgtgtagtggt

SEQ ID NO: 7668717 - DNA, 22 bp, Homo sapiens
gcccaggatggctggaggtgct

SEQ ID NO: 7668718 - DNA, 22 bp, Homo sapiens
gcccaggatggtgtgtagtggt

SEQ ID NO: 7668719 - DNA, 22 bp, Homo sapiens
gcccaggatggtgtgtagtggt

SEQ ID NO: 7668720 - DNA, 22 bp, Homo sapiens
gcccaggatggctggaggtgct

SEQ ID NO: 7668721 - DNA, 22 bp, Homo sapiens
gcccaggatggctggaggtgct

SEQ ID NO: 7668722 - DNA, 22 bp, Homo sapiens
gcccaggatggctggaggtgct

SEQ ID NO: 7668723 - DNA, 22 bp, Homo sapiens
gcccaggatggctggaggtgct

SEQ ID NO: 7668724 - DNA, 22 bp, Homo sapiens
gcccaggatggctggaggtgct

SEQ ID NO: 7668725 - DNA, 22 bp, Homo sapiens
gcccaggctggagtgcagtagc

SEQ ID NO: 7668726 - DNA, 22 bp, Homo sapiens
gcccaggctagcgtagagtgca

SEQ ID NO: 7668727 - DNA, 22 bp, Homo sapiens
gcccaggctggagtgcagtagc

SEQ ID NO: 7668728 - DNA, 22 bp, Homo sapiens
gcccaggctggagtgcagtagc

SEQ ID NO: 7668729 - DNA, 22 bp, Homo sapiens
gcccaggctggagtgcagtagc

SEQ ID NO: 7668730 - DNA, 22 bp, Homo sapiens
gcccaggctggagtgcagtagc

SEQ ID NO: 7668731 - DNA, 22 bp, Homo sapiens
gcccaggctggagtgcagtagc

SEQ ID NO: 7668732 - DNA, 22 bp, Homo sapiens
gcccaggctggagtgcagtagc

SEQ ID NO: 7668733 - DNA, 22 bp, Homo sapiens
gcccaggctggagtgcagtagc

SEQ ID NO: 7668734 - DNA, 22 bp, Homo sapiens
gcccaggctggagtgcagtagc

SEQ ID NO: 7668735 - DNA, 22 bp, Homo sapiens
gcccaggctggagtgcagtagc

SEQ ID NO: 7668736 - DNA, 22 bp, Homo sapiens
gcccaggctggagtgcagtggc

SEQ ID NO: 7668737 - DNA, 22 bp, Homo sapiens
gcccaggctggagtgcagtggc

SEQ ID NO: 7668738 - DNA, 22 bp, Homo sapiens
gcccaggctggagtgcagtggc

SEQ ID NO: 7668739 - DNA, 22 bp, Homo sapiens
gcccaggctggagtgcagtggc

SEQ ID NO: 7668740 - DNA, 22 bp, Homo sapiens
gcccaggctggagtgcagtggc

SEQ ID NO: 7668741 - DNA, 22 bp, Homo sapiens
gcccaggctggagtgcagtggc

SEQ ID NO: 7668742 - DNA, 22 bp, Homo sapiens
gcccaggctggagtgcagtggc

SEQ ID NO: 7668743 - DNA, 22 bp, Homo sapiens
gcccaggctggagtgcagtggc

SEQ ID NO: 7668744 - DNA, 22 bp, Homo sapiens
gcccaggctggagtgcagtggc

SEQ ID NO: 7668745 - DNA, 22 bp, Homo sapiens
gcccaggataatgctgtccctg

SEQ ID NO: 7668746 - DNA, 22 bp, Homo sapiens
gcccaggataatgctgtccctg

SEQ ID NO: 7668747 - DNA, 22 bp, Homo sapiens
gcccaggataatgctgtccctg

SEQ ID NO: 7668748 - DNA, 22 bp, Homo sapiens
gcccaggataatgctgtccctg

SEQ ID NO: 7668749 - DNA, 22 bp, Homo sapiens
gcccaggataatgctgtccctg

SEQ ID NO: 7668750 - DNA, 22 bp, Homo sapiens
gcccaggagtttgcattttaac

SEQ ID NO: 7668751 - DNA, 22 bp, Homo sapiens
gcccaggagtttgcattttaac

SEQ ID NO: 7668752 - DNA, 20 bp, Homo sapiens
gcccaggatctctgaggcat

SEQ ID NO: 7668753 - DNA, 20 bp, Homo sapiens
gcccaggatctctgaggcat

SEQ ID NO: 7668754 - DNA, 20 bp, Homo sapiens
gcccaggatctctgaggcat

SEQ ID NO: 7668755 - DNA, 20 bp, Homo sapiens
gcccaggatctctgaggcat

SEQ ID NO: 7668756 - DNA, 20 bp, Homo sapiens
gcccaggatctctgaggcat

SEQ ID NO: 7668757 - DNA, 20 bp, Homo sapiens
gcccaggatctctgaggcat

SEQ ID NO: 7668758 - DNA, 20 bp, Homo sapiens
gcccaggatctctgaggcat

SEQ ID NO: 7668759 - DNA, 22 bp, Homo sapiens
gcccaggataatgctgtccctg

SEQ ID NO: 7668760 - DNA, 22 bp, Homo sapiens
gcccaggagttggaggctgcag

SEQ ID NO: 7668761 - DNA, 22 bp, Homo sapiens
gcccaggagttggaggctgcag

SEQ ID NO: 7668762 - DNA, 22 bp, Homo sapiens
gcccaggagttggaggctgcag

SEQ ID NO: 7668763 - DNA, 22 bp, Homo sapiens
gcccaggagttggtggctgcag

SEQ ID NO: 7668764 - DNA, 22 bp, Homo sapiens
gcccaggagttggtggctgcag

SEQ ID NO: 7668765 - DNA, 22 bp, Homo sapiens
gcccaggagttggtggctgcag

SEQ ID NO: 7668766 - DNA, 22 bp, Homo sapiens
gcccaggagttggtggctgcag

SEQ ID NO: 7668767 - DNA, 22 bp, Homo sapiens
gcccaggagttggtggctgcag

SEQ ID NO: 7668768 - DNA, 22 bp, Homo sapiens
gcccaggagtttgcattttaac

SEQ ID NO: 7668769 - DNA, 22 bp, Homo sapiens
gcccaggagttggtggctgcag

SEQ ID NO: 7668770 - DNA, 22 bp, Homo sapiens
gcccaggagttggtggctgcag

SEQ ID NO: 7668771 - DNA, 22 bp, Homo sapiens
gcccaggatctgctcagatcat

SEQ ID NO: 7668772 - DNA, 22 bp, Homo sapiens
gcccaggatggagaatagtggt

SEQ ID NO: 7668773 - DNA, 22 bp, Homo sapiens
gcccaggatggagaatagtggt

SEQ ID NO: 7668774 - DNA, 22 bp, Homo sapiens
gcccaggatctgctcagatcat

SEQ ID NO: 7668775 - DNA, 22 bp, Homo sapiens
gcccaggatctgctcagatcat

SEQ ID NO: 7668776 - DNA, 22 bp, Homo sapiens
gcccaggatggctggaggtgct

SEQ ID NO: 7668777 - DNA, 22 bp, Homo sapiens
gcccaggatggagaatagtggt

SEQ ID NO: 7668778 - DNA, 22 bp, Homo sapiens
gcccaggatggctggaggtgct

SEQ ID NO: 7668779 - DNA, 22 bp, Homo sapiens
gcccaggatggctggaggtgct

SEQ ID NO: 7668780 - DNA, 22 bp, Homo sapiens
gcccaggatggctggaggtgct

SEQ ID NO: 7668781 - DNA, 20 bp, Homo sapiens
gcccaggatctctgaggcat

SEQ ID NO: 7668782 - DNA, 22 bp, Homo sapiens
gcccaggatctgctcagatcat

SEQ ID NO: 7668783 - DNA, 20 bp, Homo sapiens
gcccaggatctctgaggcat

SEQ ID NO: 7668784 - DNA, 20 bp, Homo sapiens
gcccaggatctctgaggcat

SEQ ID NO: 7668785 - DNA, 20 bp, Homo sapiens
gcccaggatctctgaggcat

SEQ ID NO: 7668786 - DNA, 20 bp, Homo sapiens
gcccaggatctctgaggcat

SEQ ID NO: 7668787 - DNA, 20 bp, Homo sapiens
gcccaggatctctgaggcat

SEQ ID NO: 7668788 - DNA, 20 bp, Homo sapiens
gcccaggatctctgaggcat

SEQ ID NO: 7668789 - DNA, 22 bp, Homo sapiens
gccatgttttggtaaataccat

SEQ ID NO: 7668790 - DNA, 21 bp, Homo sapiens
gccatgtttccttactaagag

SEQ ID NO: 7668791 - DNA, 22 bp, Homo sapiens
gccattaaagtgcatgttttgc

SEQ ID NO: 7668792 - DNA, 22 bp, Homo sapiens
gccatgttttggtaaataccat

SEQ ID NO: 7668793 - DNA, 22 bp, Homo sapiens
gccatgttcttgaatctgggtc

SEQ ID NO: 7668794 - DNA, 22 bp, Homo sapiens
gccatgttcttgaatctgggtc

SEQ ID NO: 7668795 - DNA, 21 bp, Homo sapiens
gccatgtttccttactaagag

SEQ ID NO: 7668796 - DNA, 22 bp, Homo sapiens
gccatgggtctgctggctcagc

SEQ ID NO: 7668797 - DNA, 22 bp, Homo sapiens
gccatggggctcagctgcacta

SEQ ID NO: 7668798 - DNA, 22 bp, Homo sapiens
gccatgggtctgctggctcagc

SEQ ID NO: 7668799 - DNA, 22 bp, Homo sapiens
gccatggggctcagctgcacta

SEQ ID NO: 7668800 - DNA, 22 bp, Homo sapiens
gccatggggctcagctgcacta

SEQ ID NO: 7668801 - DNA, 22 bp, Homo sapiens
gccatggggagggcagcgcctg

SEQ ID NO: 7668802 - DNA, 22 bp, Homo sapiens
gccatggggctcagctgcacta

SEQ ID NO: 7668803 - DNA, 22 bp, Homo sapiens
gccatggggagggcagcgcctg

SEQ ID NO: 7668804 - DNA, 22 bp, Homo sapiens
gccatggggagggcagcgcctg

SEQ ID NO: 7668805 - DNA, 19 bp, Homo sapiens
gccatgggctggcagcaga

SEQ ID NO: 7668806 - DNA, 19 bp, Homo sapiens
gccatgggctggcagcaga

SEQ ID NO: 7668807 - DNA, 21 bp, Homo sapiens
gccatcaccaagctcttcccc

SEQ ID NO: 7668808 - DNA, 22 bp, Homo sapiens
gccatgggcaaatgcagagctg

SEQ ID NO: 7668809 - DNA, 22 bp, Homo sapiens
gccatggggacttcatggattt

SEQ ID NO: 7668810 - DNA, 22 bp, Homo sapiens
gccatggggacttcatggattt

SEQ ID NO: 7668811 - DNA, 22 bp, Homo sapiens
gccatggggacttcatggattt

SEQ ID NO: 7668812 - DNA, 23 bp, Homo sapiens
gccatcacgttcaaccaaagcct

SEQ ID NO: 7668813 - DNA, 23 bp, Homo sapiens
gccatggctgccccacaggcctc

SEQ ID NO: 7668814 - DNA, 23 bp, Homo sapiens
gccatggctgccccacaggcctc

SEQ ID NO: 7668815 - DNA, 22 bp, Homo sapiens
gccatgggcaaatgcagagctg

SEQ ID NO: 7668816 - DNA, 22 bp, Homo sapiens
gccatgggcaaatgcagagctg

SEQ ID NO: 7668817 - DNA, 22 bp, Homo sapiens
gccatgggcaaatgcagagctg

SEQ ID NO: 7668818 - DNA, 22 bp, Homo sapiens
gccatgggcaaatgcagagctg

SEQ ID NO: 7668819 - DNA, 22 bp, Homo sapiens
gccattctaaattatgctgtgt

SEQ ID NO: 7668820 - DNA, 22 bp, Homo sapiens
gccattcaattctacaagtata

SEQ ID NO: 7668821 - DNA, 22 bp, Homo sapiens
gccattaatgagatcaagaatc

SEQ ID NO: 7668822 - DNA, 22 bp, Homo sapiens
gccattaatgtgaaggaaggaa

SEQ ID NO: 7668823 - DNA, 22 bp, Homo sapiens
gccattaacaagaatatagtag

SEQ ID NO: 7668824 - DNA, 22 bp, Homo sapiens
gccattaatgagatcaagaatc

SEQ ID NO: 7668825 - DNA, 22 bp, Homo sapiens
gccattgggctgtagttttttg

SEQ ID NO: 7668826 - DNA, 22 bp, Homo sapiens
gccattcttaacagtcatcact

SEQ ID NO: 7668827 - DNA, 18 bp, Homo sapiens
gccattcttctaagtact

SEQ ID NO: 7668828 - DNA, 21 bp, Homo sapiens
gccatttcacacagacatttg

SEQ ID NO: 7668829 - DNA, 22 bp, Homo sapiens
gccatttagggaggcaaggtga

SEQ ID NO: 7668830 - DNA, 22 bp, Homo sapiens
gccatttaggaggtggaaagga

SEQ ID NO: 7668831 - DNA, 22 bp, Homo sapiens
gccatttagggaggcaaggtga

SEQ ID NO: 7668832 - DNA, 22 bp, Homo sapiens
gcccaggaggagaggctgcagt

SEQ ID NO: 7668833 - DNA, 22 bp, Homo sapiens
gcccaggaggagaggctgcagt

SEQ ID NO: 7668834 - DNA, 21 bp, Homo sapiens
gccatttcacacagacatttg

SEQ ID NO: 7668835 - DNA, 22 bp, Homo sapiens
gcccaggaggagaggctgcagt

SEQ ID NO: 7668836 - DNA, 22 bp, Homo sapiens
gcccaggaggtcaagtagctat

SEQ ID NO: 7668837 - DNA, 22 bp, Homo sapiens
gcccaggaggtcaagtagctat

SEQ ID NO: 7668838 - DNA, 22 bp, Homo sapiens
gcccaggaggcagaggttgtgg

SEQ ID NO: 7668839 - DNA, 22 bp, Homo sapiens
gcccaggaggtcaagtagctat

SEQ ID NO: 7668840 - DNA, 22 bp, Homo sapiens
gcccaggaggtcaagtagctat

SEQ ID NO: 7668841 - DNA, 22 bp, Homo sapiens
gcccaggaggtcaagtagctat

SEQ ID NO: 7668842 - DNA, 22 bp, Homo sapiens
gcccaggaggtcaagtagctat

SEQ ID NO: 7668843 - DNA, 22 bp, Homo sapiens
gcccaggaggagaggctgcagt

SEQ ID NO: 7668844 - DNA, 22 bp, Homo sapiens
gcccaggaggagaggctgcagt

SEQ ID NO: 7668845 - DNA, 22 bp, Homo sapiens
gcccaggaggagaggctgcagt

SEQ ID NO: 7668846 - DNA, 22 bp, Homo sapiens
gcccaggaggcagaggttgtgg

SEQ ID NO: 7668847 - DNA, 22 bp, Homo sapiens
gcccaggaggcagaggttgtgg

SEQ ID NO: 7668848 - DNA, 22 bp, Homo sapiens
gcccaggaggcagaggttgtgg

SEQ ID NO: 7668849 - DNA, 22 bp, Homo sapiens
gcccaggagttggaggctgcag

SEQ ID NO: 7668850 - DNA, 22 bp, Homo sapiens
gcccaggagttggaggctgcag

SEQ ID NO: 7668851 - DNA, 22 bp, Homo sapiens
gcccaggagttggaggctgcag

SEQ ID NO: 7668852 - DNA, 22 bp, Homo sapiens
gcccaggagttggaggctgcag

SEQ ID NO: 7668853 - DNA, 22 bp, Homo sapiens
gcccaggagttggaggctgcag

SEQ ID NO: 7668854 - DNA, 22 bp, Homo sapiens
gcccaggagttggaggctgcag

SEQ ID NO: 7668855 - DNA, 22 bp, Homo sapiens
gcccaggagttgaatgcagcag

SEQ ID NO: 7668856 - DNA, 22 bp, Homo sapiens
gcccaggagttgaatgcagcag

SEQ ID NO: 7668857 - DNA, 22 bp, Homo sapiens
gcccaggagttggaggctgcag

SEQ ID NO: 7668858 - DNA, 22 bp, Homo sapiens
gcccaggagttggaggctgcag

SEQ ID NO: 7668859 - DNA, 22 bp, Homo sapiens
gcccaggagttggaggctgcag

SEQ ID NO: 7668860 - DNA, 22 bp, Homo sapiens
gcccaggagttggaggctgcag

SEQ ID NO: 7668861 - DNA, 22 bp, Homo sapiens
gccaggctgctggctgctgtcc

SEQ ID NO: 7668862 - DNA, 22 bp, Homo sapiens
gccaggctgctccagggaggcc

SEQ ID NO: 7668863 - DNA, 22 bp, Homo sapiens
gccaggctgctggctgctgtcc

SEQ ID NO: 7668864 - DNA, 22 bp, Homo sapiens
gccaggctgctggctgctgtcc

SEQ ID NO: 7668865 - DNA, 22 bp, Homo sapiens
gccaggctgctggctgctgtcc

SEQ ID NO: 7668866 - DNA, 22 bp, Homo sapiens
gccaggctgctggctgctgtcc

SEQ ID NO: 7668867 - DNA, 22 bp, Homo sapiens
gccaggctgctccagggaggcc

SEQ ID NO: 7668868 - DNA, 22 bp, Homo sapiens
gccaggctgctggctgctgtcc

SEQ ID NO: 7668869 - DNA, 22 bp, Homo sapiens
gccaggctgctccagggaggcc

SEQ ID NO: 7668870 - DNA, 22 bp, Homo sapiens
gccaggctgctccagggaggcc

SEQ ID NO: 7668871 - DNA, 22 bp, Homo sapiens
gccaggctgccttatctctagc

SEQ ID NO: 7668872 - DNA, 22 bp, Homo sapiens
gccaggctgccttatctctagc

SEQ ID NO: 7668873 - DNA, 22 bp, Homo sapiens
gccaggctgccttatctctagc

SEQ ID NO: 7668874 - DNA, 22 bp, Homo sapiens
gccaggctgccttatctctagc

SEQ ID NO: 7668875 - DNA, 22 bp, Homo sapiens
gccaggctgctccagggaggcc

SEQ ID NO: 7668876 - DNA, 22 bp, Homo sapiens
gccaggctgctccagggaggcc

SEQ ID NO: 7668877 - DNA, 22 bp, Homo sapiens
gccaggctgctccagggaggcc

SEQ ID NO: 7668878 - DNA, 22 bp, Homo sapiens
gccaggctgctccagggaggcc

SEQ ID NO: 7668879 - DNA, 22 bp, Homo sapiens
gccaggctggtgtcacaactct

SEQ ID NO: 7668880 - DNA, 22 bp, Homo sapiens
gccaggctgctggctgctgtcc

SEQ ID NO: 7668881 - DNA, 22 bp, Homo sapiens
gccaggctgctggctgctgtcc

SEQ ID NO: 7668882 - DNA, 22 bp, Homo sapiens
gccaggctggtgcaaggatatt

SEQ ID NO: 7668883 - DNA, 22 bp, Homo sapiens
gccaggctggtgtcacaactct

SEQ ID NO: 7668884 - DNA, 22 bp, Homo sapiens
gccaggctggtgtcacaactct

SEQ ID NO: 7668885 - DNA, 22 bp, Homo sapiens
gccaggctggtgtcacaactct

SEQ ID NO: 7668886 - DNA, 22 bp, Homo sapiens
gccaggctggtgtcacaactct

SEQ ID NO: 7668887 - DNA, 22 bp, Homo sapiens
gccaggctggttatttaatgag

SEQ ID NO: 7668888 - DNA, 22 bp, Homo sapiens
gccaggctgtggggaacttgaa

SEQ ID NO: 7668889 - DNA, 22 bp, Homo sapiens
gccaggctggttatttaatgag

SEQ ID NO: 7668890 - DNA, 22 bp, Homo sapiens
gccaggctggtgtcacaactct

SEQ ID NO: 7668891 - DNA, 22 bp, Homo sapiens
gccaggctggtgtcacaactct

SEQ ID NO: 7668892 - DNA, 22 bp, Homo sapiens
gccaggctggttatttaatgag

SEQ ID NO: 7668893 - DNA, 22 bp, Homo sapiens
gccaggctggttatttaatgag

SEQ ID NO: 7668894 - DNA, 22 bp, Homo sapiens
gccaggctggttatttaatgag

SEQ ID NO: 7668895 - DNA, 22 bp, Homo sapiens
gccaggctgactcccccggcct

SEQ ID NO: 7668896 - DNA, 22 bp, Homo sapiens
gccaggctcttggttatgtttt

SEQ ID NO: 7668897 - DNA, 22 bp, Homo sapiens
gccaggctgactcccccggcct

SEQ ID NO: 7668898 - DNA, 22 bp, Homo sapiens
gccaggctgactcccccggcct

SEQ ID NO: 7668899 - DNA, 22 bp, Homo sapiens
gccaggctgactcccccggcct

SEQ ID NO: 7668900 - DNA, 22 bp, Homo sapiens
gccaggctcttggttatgtttt

SEQ ID NO: 7668901 - DNA, 22 bp, Homo sapiens
gccaggctcttggttatgtttt

SEQ ID NO: 7668902 - DNA, 22 bp, Homo sapiens
gccaggctcttccatttgggtc

SEQ ID NO: 7668903 - DNA, 22 bp, Homo sapiens
gccaggctgaggctctggaaga

SEQ ID NO: 7668904 - DNA, 22 bp, Homo sapiens
gccaggctgactcccccggcct

SEQ ID NO: 7668905 - DNA, 22 bp, Homo sapiens
gccaggctgaggctctggaaga

SEQ ID NO: 7668906 - DNA, 22 bp, Homo sapiens
gccaggctgaggctctggaaga

SEQ ID NO: 7668907 - DNA, 22 bp, Homo sapiens
gccaggctgaggctctggaaga

SEQ ID NO: 7668908 - DNA, 22 bp, Homo sapiens
gccaggctgaggctctggaaga

SEQ ID NO: 7668909 - DNA, 22 bp, Homo sapiens
gccaggctgccttatctctagc

SEQ ID NO: 7668910 - DNA, 22 bp, Homo sapiens
gccaggctgccttatctctagc

SEQ ID NO: 7668911 - DNA, 22 bp, Homo sapiens
gccaggctgaggctctggaaga

SEQ ID NO: 7668912 - DNA, 22 bp, Homo sapiens
gccaggctcttggttatgtttt

SEQ ID NO: 7668913 - DNA, 22 bp, Homo sapiens
gccaggctcttggttatgtttt

SEQ ID NO: 7668914 - DNA, 22 bp, Homo sapiens
gccaggctcttccatttgggtc

SEQ ID NO: 7668915 - DNA, 19 bp, Homo sapiens
gccaggctcttattctgtg

SEQ ID NO: 7668916 - DNA, 22 bp, Homo sapiens
gccaggctcttccatttgggtc

SEQ ID NO: 7668917 - DNA, 22 bp, Homo sapiens
gccaggctcttccatttgggtc

SEQ ID NO: 7668918 - DNA, 19 bp, Homo sapiens
gccaggctcttattctgtg

SEQ ID NO: 7668919 - DNA, 22 bp, Homo sapiens
gccaggctctcagtgactgccc

SEQ ID NO: 7668920 - DNA, 19 bp, Homo sapiens
gccaggctcttattctgtg

SEQ ID NO: 7668921 - DNA, 19 bp, Homo sapiens
gccaggctcttattctgtg

SEQ ID NO: 7668922 - DNA, 19 bp, Homo sapiens
gccaggctcttattctgtg

SEQ ID NO: 7668923 - DNA, 22 bp, Homo sapiens
gccagcagggcccaaatgctgg

SEQ ID NO: 7668924 - DNA, 22 bp, Homo sapiens
gccagcagggcccaaatgctgg

SEQ ID NO: 7668925 - DNA, 22 bp, Homo sapiens
gccagcagggcccaaatgctgg

SEQ ID NO: 7668926 - DNA, 22 bp, Homo sapiens
gccataaatgaaggaaaggtat

SEQ ID NO: 7668927 - DNA, 22 bp, Homo sapiens
gccataaaatgtggatgaggga

SEQ ID NO: 7668928 - DNA, 22 bp, Homo sapiens
gccagttacccacaactactga

SEQ ID NO: 7668929 - DNA, 22 bp, Homo sapiens
gccagttggccccgggcatgca

SEQ ID NO: 7668930 - DNA, 17 bp, Homo sapiens
gccagttgtcttggcat

SEQ ID NO: 7668931 - DNA, 22 bp, Homo sapiens
gccatatatattttgcactagg

SEQ ID NO: 7668932 - DNA, 22 bp, Homo sapiens
gccatatatattttgcactagg

SEQ ID NO: 7668933 - DNA, 22 bp, Homo sapiens
gccataggcagcgtggccagca

SEQ ID NO: 7668934 - DNA, 22 bp, Homo sapiens
gccatattcgcattcttcattt

SEQ ID NO: 7668935 - DNA, 22 bp, Homo sapiens
gccataggcagcgtggccagca

SEQ ID NO: 7668936 - DNA, 22 bp, Homo sapiens
gccataaattgctggtcaaaat

SEQ ID NO: 7668937 - DNA, 22 bp, Homo sapiens
gccagtgtcttcctgttaatcg

SEQ ID NO: 7668938 - DNA, 22 bp, Homo sapiens
gccagtgtgcaagaaaacagaa

SEQ ID NO: 7668939 - DNA, 22 bp, Homo sapiens
gccagtgtgcaagaggccacca

SEQ ID NO: 7668940 - DNA, 22 bp, Homo sapiens
gccagtgtcttcctgttaatcg

SEQ ID NO: 7668941 - DNA, 22 bp, Homo sapiens
gccagtgtgtcctctcagtttc

SEQ ID NO: 7668942 - DNA, 22 bp, Homo sapiens
gccagtgtgtcttgcaggctcc

SEQ ID NO: 7668943 - DNA, 22 bp, Homo sapiens
gccagtgtgtcatccggctgca

SEQ ID NO: 7668944 - DNA, 22 bp, Homo sapiens
gccagtgtgtcatccggctgca

SEQ ID NO: 7668945 - DNA, 22 bp, Homo sapiens
gccagtgtggtgtagtcatgaa

SEQ ID NO: 7668946 - DNA, 22 bp, Homo sapiens
gccagtgtgcaagaggccacca

SEQ ID NO: 7668947 - DNA, 22 bp, Homo sapiens
gccagtgtggtgtagtcatgaa

SEQ ID NO: 7668948 - DNA, 22 bp, Homo sapiens
gccagtgtgcaagaaaacagaa

SEQ ID NO: 7668949 - DNA, 22 bp, Homo sapiens
gccagtgttcttcaccccctct

SEQ ID NO: 7668950 - DNA, 22 bp, Homo sapiens
gccagtgttgaactttccctgg

SEQ ID NO: 7668951 - DNA, 22 bp, Homo sapiens
gccagtgttcttcaccccctct

SEQ ID NO: 7668952 - DNA, 22 bp, Homo sapiens
gccagtgttgaactttccctgg

SEQ ID NO: 7668953 - DNA, 22 bp, Homo sapiens
gccagtgttggtgataagctct

SEQ ID NO: 7668954 - DNA, 22 bp, Homo sapiens
gccagtgttggtgataagctct

SEQ ID NO: 7668955 - DNA, 22 bp, Homo sapiens
gccagtgtttatagcagtgagg

SEQ ID NO: 7668956 - DNA, 22 bp, Homo sapiens
gccagtgtttatagcagtgagg

SEQ ID NO: 7668957 - DNA, 22 bp, Homo sapiens
gccagtgtgtcttgcaggctcc

SEQ ID NO: 7668958 - DNA, 19 bp, Homo sapiens
gccagtgtgtggtacagtg

SEQ ID NO: 7668959 - DNA, 22 bp, Homo sapiens
gccagtgttattcctggggctg

SEQ ID NO: 7668960 - DNA, 22 bp, Homo sapiens
gccagtgttattcctggggctg

SEQ ID NO: 7668961 - DNA, 22 bp, Homo sapiens
gccagtgtgtcctctcagtttc

SEQ ID NO: 7668962 - DNA, 19 bp, Homo sapiens
gccagtgtgtggtacagtg

SEQ ID NO: 7668963 - DNA, 22 bp, Homo sapiens
gccagggaaactgcagaccagc

SEQ ID NO: 7668964 - DNA, 22 bp, Homo sapiens
gccagggaaactgcagaccagc

SEQ ID NO: 7668965 - DNA, 22 bp, Homo sapiens
gccagggaaactgcagaccagc

SEQ ID NO: 7668966 - DNA, 22 bp, Homo sapiens
gccagtgggacccgctgtgggc

SEQ ID NO: 7668967 - DNA, 22 bp, Homo sapiens
gccagtgggacccgctgtgggc

SEQ ID NO: 7668968 - DNA, 22 bp, Homo sapiens
gccagtgggacccgctgtgggc

SEQ ID NO: 7668969 - DNA, 22 bp, Homo sapiens
gccagtgggacccgctgtgggc

SEQ ID NO: 7668970 - DNA, 22 bp, Homo sapiens
gccaggctgtttttattactgt

SEQ ID NO: 7668971 - DNA, 22 bp, Homo sapiens
gccagggaaactgcagaccagc

SEQ ID NO: 7668972 - DNA, 22 bp, Homo sapiens
gccaggctgtggggaacttgaa

SEQ ID NO: 7668973 - DNA, 22 bp, Homo sapiens
gccaggctgtttttattactgt

SEQ ID NO: 7668974 - DNA, 22 bp, Homo sapiens
gccaggctgtttttattactgt

SEQ ID NO: 7668975 - DNA, 22 bp, Homo sapiens
gccaggctgtttttattactgt

SEQ ID NO: 7668976 - DNA, 22 bp, Homo sapiens
gccaggctgtggggaacttgaa

SEQ ID NO: 7668977 - DNA, 22 bp, Homo sapiens
gccaggctgtttttattactgt

SEQ ID NO: 7668978 - DNA, 22 bp, Homo sapiens
gccaggctgtttttattactgt

SEQ ID NO: 7668979 - DNA, 22 bp, Homo sapiens
gccaggctgtttttattactgt

SEQ ID NO: 7668980 - DNA, 22 bp, Homo sapiens
gccaggctgtggggaacttgaa

SEQ ID NO: 7668981 - DNA, 22 bp, Homo sapiens
gccaggctgtggggaacttgaa

SEQ ID NO: 7668982 - DNA, 22 bp, Homo sapiens
gccaggctgtggggaacttgaa

SEQ ID NO: 7668983 - DNA, 22 bp, Homo sapiens
gccagtggtcagtgggagggtg

SEQ ID NO: 7668984 - DNA, 22 bp, Homo sapiens
gccagtggtcagtgggagggtg

SEQ ID NO: 7668985 - DNA, 22 bp, Homo sapiens
gccagtggtcagtgggagggtg

SEQ ID NO: 7668986 - DNA, 22 bp, Homo sapiens
gccagtggtcactgaggaagaa

SEQ ID NO: 7668987 - DNA, 22 bp, Homo sapiens
gccagtggtcactgaggaagaa

SEQ ID NO: 7668988 - DNA, 22 bp, Homo sapiens
gccagtggtcactgaggaagaa

SEQ ID NO: 7668989 - DNA, 22 bp, Homo sapiens
gccagtggtagaggggaggccg

SEQ ID NO: 7668990 - DNA, 18 bp, Homo sapiens
gccagtgggtccaggtgc

SEQ ID NO: 7668991 - DNA, 18 bp, Homo sapiens
gccagtgggtccaggtgc

SEQ ID NO: 7668992 - DNA, 18 bp, Homo sapiens
gccagtgggtccaggtgc

SEQ ID NO: 7668993 - DNA, 22 bp, Homo sapiens
gccagtgggtagttggagctgg

SEQ ID NO: 7668994 - DNA, 22 bp, Homo sapiens
gccagtgggtagttggagctgg

SEQ ID NO: 7668995 - DNA, 22 bp, Homo sapiens
gccagtgggtagttggagctgg

SEQ ID NO: 7668996 - DNA, 22 bp, Homo sapiens
gccagtgggtagttggagctgg

SEQ ID NO: 7668997 - DNA, 22 bp, Homo sapiens
gcctgttctgccctgagagcct

SEQ ID NO: 7668998 - DNA, 22 bp, Homo sapiens
gcctgttctccagcatccaggt

SEQ ID NO: 7668999 - DNA, 22 bp, Homo sapiens
gcctgttgggtaacagagttca

SEQ ID NO: 7669000 - DNA, 22 bp, Homo sapiens
gcctgtttaagtattctgacat

SEQ ID NO: 7669001 - DNA, 22 bp, Homo sapiens
gcctgttaaacatgcggctcaa

SEQ ID NO: 7669002 - DNA, 20 bp, Homo sapiens
gcctgttcacaggcttcttg

SEQ ID NO: 7669003 - DNA, 18 bp, Homo sapiens
gcctgttccctactatcc

SEQ ID NO: 7669004 - DNA, 22 bp, Homo sapiens
gcctgttccttagtggcttcac

SEQ ID NO: 7669005 - DNA, 22 bp, Homo sapiens
gcctgttctccagcatccaggt

SEQ ID NO: 7669006 - DNA, 22 bp, Homo sapiens
gcctgtgtgtgaggactggctg

SEQ ID NO: 7669007 - DNA, 22 bp, Homo sapiens
gcctgtgtggatgcgccggtgc

SEQ ID NO: 7669008 - DNA, 22 bp, Homo sapiens
gcctgtgtggatgcgccggtgc

SEQ ID NO: 7669009 - DNA, 22 bp, Homo sapiens
gcctgtggttgctttgggatcc

SEQ ID NO: 7669010 - DNA, 22 bp, Homo sapiens
gcctgtggtttgattaagcatt

SEQ ID NO: 7669011 - DNA, 21 bp, Homo sapiens
gcctgtgtaaattgagtttcc

SEQ ID NO: 7669012 - DNA, 22 bp, Homo sapiens
gcctgtggtttgattaagcatt

SEQ ID NO: 7669013 - DNA, 22 bp, Homo sapiens
gcctgtgtcatgtagtagcttc

SEQ ID NO: 7669014 - DNA, 22 bp, Homo sapiens
gcctgtgtcatgtagtagcttc

SEQ ID NO: 7669015 - DNA, 22 bp, Homo sapiens
gcctgtgggttggagcttggcc

SEQ ID NO: 7669016 - DNA, 22 bp, Homo sapiens
gcctgtggggctgaggctgcct

SEQ ID NO: 7669017 - DNA, 22 bp, Homo sapiens
gcctgtggggctgaggctgcct

SEQ ID NO: 7669018 - DNA, 22 bp, Homo sapiens
gcctgtggggctgaggctgcct

SEQ ID NO: 7669019 - DNA, 22 bp, Homo sapiens
gcctgggattgtgtaagtgaat

SEQ ID NO: 7669020 - DNA, 22 bp, Homo sapiens
gcctgggattgtgtaagtgaat

SEQ ID NO: 7669021 - DNA, 22 bp, Homo sapiens
gcctgggattgtgtaagtgaat

SEQ ID NO: 7669022 - DNA, 22 bp, Homo sapiens
gcctggggaacttgatcctgtc

SEQ ID NO: 7669023 - DNA, 22 bp, Homo sapiens
gcctggggaacttgatcctgtc

SEQ ID NO: 7669024 - DNA, 22 bp, Homo sapiens
gcctggtgtctccccaaggaag

SEQ ID NO: 7669025 - DNA, 22 bp, Homo sapiens
gcctggggaacttgatcctgtc

SEQ ID NO: 7669026 - DNA, 22 bp, Homo sapiens
gcctgtcaattttgtgtacaat

SEQ ID NO: 7669027 - DNA, 22 bp, Homo sapiens
gcctgtattcccagcactttgg

SEQ ID NO: 7669028 - DNA, 22 bp, Homo sapiens
gcctggtgtgcgccgcgcagct

SEQ ID NO: 7669029 - DNA, 22 bp, Homo sapiens
gcctgtatttattgagagtgta

SEQ ID NO: 7669030 - DNA, 22 bp, Homo sapiens
gcctggtgtctccccaaggaag

SEQ ID NO: 7669031 - DNA, 22 bp, Homo sapiens
gcctggtgtctccccaaggaag

SEQ ID NO: 7669032 - DNA, 22 bp, Homo sapiens
gcctggtgtctccccaaggaag

SEQ ID NO: 7669033 - DNA, 22 bp, Homo sapiens
gcctggtgtgcgccgcgcagct

SEQ ID NO: 7669034 - DNA, 22 bp, Homo sapiens
gcctggtgtgcgccgcgcagct

SEQ ID NO: 7669035 - DNA, 22 bp, Homo sapiens
gcctgtggccgactgagagcct

SEQ ID NO: 7669036 - DNA, 22 bp, Homo sapiens
gcctgtggccgactgagagcct

SEQ ID NO: 7669037 - DNA, 22 bp, Homo sapiens
gcctgtggggctgaggctgcct

SEQ ID NO: 7669038 - DNA, 19 bp, Homo sapiens
gcctgtggcttgatgttgg

SEQ ID NO: 7669039 - DNA, 22 bp, Homo sapiens
gcctgtggcccaactgtctgtc

SEQ ID NO: 7669040 - DNA, 22 bp, Homo sapiens
gcctgtggccgactgagagcct

SEQ ID NO: 7669041 - DNA, 22 bp, Homo sapiens
gcctgtggcccaactgtctgtc

SEQ ID NO: 7669042 - DNA, 22 bp, Homo sapiens
gcctgtggcccaactgtctgtc

SEQ ID NO: 7669043 - DNA, 20 bp, Homo sapiens
gcctgtggaggaggacggac

SEQ ID NO: 7669044 - DNA, 22 bp, Homo sapiens
gcctgtggccactgcgtctgca

SEQ ID NO: 7669045 - DNA, 22 bp, Homo sapiens
gcctgtggccactgcgtctgca

SEQ ID NO: 7669046 - DNA, 22 bp, Homo sapiens
gcctgtggccactgcgtctgca

SEQ ID NO: 7669047 - DNA, 20 bp, Homo sapiens
gcctgtggaggaggacggac

SEQ ID NO: 7669048 - DNA, 21 bp, Homo sapiens
gcctgtggagcccaagggccc

SEQ ID NO: 7669049 - DNA, 21 bp, Homo sapiens
gcctgtggagcccaagggccc

SEQ ID NO: 7669050 - DNA, 21 bp, Homo sapiens
gcctgtggagcccaagggccc

SEQ ID NO: 7669051 - DNA, 21 bp, Homo sapiens
gcctgtggagcccaagggccc

SEQ ID NO: 7669052 - DNA, 22 bp, Homo sapiens
gcctgtgctttcttccctcctg

SEQ ID NO: 7669053 - DNA, 22 bp, Homo sapiens
gcctgtgctttcttccctcctg

SEQ ID NO: 7669054 - DNA, 22 bp, Homo sapiens
gcctgggattctcaaaggggtg

SEQ ID NO: 7669055 - DNA, 22 bp, Homo sapiens
gcctgggattctcaaaggggtg

SEQ ID NO: 7669056 - DNA, 22 bp, Homo sapiens
gcctgggattctcaaaggggtg

SEQ ID NO: 7669057 - DNA, 22 bp, Homo sapiens
gcctgggattcccagaggggca

SEQ ID NO: 7669058 - DNA, 22 bp, Homo sapiens
gcctgggattcccagaggggca

SEQ ID NO: 7669059 - DNA, 22 bp, Homo sapiens
gcctgggattcccagaggggca

SEQ ID NO: 7669060 - DNA, 22 bp, Homo sapiens
gcctgggattcccagaggggca

SEQ ID NO: 7669061 - DNA, 20 bp, Homo sapiens
gcctgggattatccactggt

SEQ ID NO: 7669062 - DNA, 20 bp, Homo sapiens
gcctgggattatccactggt

SEQ ID NO: 7669063 - DNA, 22 bp, Homo sapiens
gcctgggattcccagaggggca

SEQ ID NO: 7669064 - DNA, 20 bp, Homo sapiens
gcctgggattatccactggt

SEQ ID NO: 7669065 - DNA, 19 bp, Homo sapiens
gcctgggatgggcagaact

SEQ ID NO: 7669066 - DNA, 19 bp, Homo sapiens
gcctgggatgggcagaact

SEQ ID NO: 7669067 - DNA, 19 bp, Homo sapiens
gcctgggatgggcagaact

SEQ ID NO: 7669068 - DNA, 19 bp, Homo sapiens
gcctgggatgggcagaact

SEQ ID NO: 7669069 - DNA, 22 bp, Homo sapiens
gcctgggatagaggcaatgcat

SEQ ID NO: 7669070 - DNA, 22 bp, Homo sapiens
gcctgggatagaggcaatgcat

SEQ ID NO: 7669071 - DNA, 22 bp, Homo sapiens
gcctgggatagaggcaatgcat

SEQ ID NO: 7669072 - DNA, 22 bp, Homo sapiens
gcctgggatagaggcaatgcat

SEQ ID NO: 7669073 - DNA, 22 bp, Homo sapiens
gcctgggagaatgacctccaac

SEQ ID NO: 7669074 - DNA, 22 bp, Homo sapiens
gcctgggagaatgacctccaac

SEQ ID NO: 7669075 - DNA, 21 bp, Homo sapiens
gcctgggatagtggcctccgg

SEQ ID NO: 7669076 - DNA, 21 bp, Homo sapiens
gcctgggatagtggcctccgg

SEQ ID NO: 7669077 - DNA, 21 bp, Homo sapiens
gcctgggatagtggcctccgg

SEQ ID NO: 7669078 - DNA, 21 bp, Homo sapiens
gcctgggatagtggcctccgg

SEQ ID NO: 7669079 - DNA, 19 bp, Homo sapiens
gcctgggatgggcagaact

SEQ ID NO: 7669080 - DNA, 19 bp, Homo sapiens
gcctgggatgggcagaact

SEQ ID NO: 7669081 - DNA, 21 bp, Homo sapiens
gcctgggatagtggcctccgg

SEQ ID NO: 7669082 - DNA, 22 bp, Homo sapiens
gcctgggaactctgatctcctg

SEQ ID NO: 7669083 - DNA, 22 bp, Homo sapiens
gcctgggaagactaagtgggag

SEQ ID NO: 7669084 - DNA, 21 bp, Homo sapiens
gcctgggaagagaaaggtaag

SEQ ID NO: 7669085 - DNA, 22 bp, Homo sapiens
gcctgggaagactaagtgggag

SEQ ID NO: 7669086 - DNA, 22 bp, Homo sapiens
gcctgggacccttagctcttgg

SEQ ID NO: 7669087 - DNA, 22 bp, Homo sapiens
gcctgggacccttagctcttgg

SEQ ID NO: 7669088 - DNA, 21 bp, Homo sapiens
gcctgggaagagaaaggtaag

SEQ ID NO: 7669089 - DNA, 21 bp, Homo sapiens
gcctgggaagagaaaggtaag

SEQ ID NO: 7669090 - DNA, 23 bp, Homo sapiens
gcctgggactcaggaggagctca

SEQ ID NO: 7669091 - DNA, 23 bp, Homo sapiens
gcctgggactcaggaggagctca

SEQ ID NO: 7669092 - DNA, 23 bp, Homo sapiens
gcctgggactcaggaggagctca

SEQ ID NO: 7669093 - DNA, 22 bp, Homo sapiens
gcctgggacccttagctcttgg

SEQ ID NO: 7669094 - DNA, 22 bp, Homo sapiens
gcctgggactgcagatccccag

SEQ ID NO: 7669095 - DNA, 22 bp, Homo sapiens
gcctgggactgcagatccccag

SEQ ID NO: 7669096 - DNA, 22 bp, Homo sapiens
gcctgggactgcagatccccag

SEQ ID NO: 7669097 - DNA, 23 bp, Homo sapiens
gcctgggactcaggaggagctca

SEQ ID NO: 7669098 - DNA, 23 bp, Homo sapiens
gcctgggactcaggaggagctca

SEQ ID NO: 7669099 - DNA, 23 bp, Homo sapiens
gcctgggactcaggaggagctca

SEQ ID NO: 7669100 - DNA, 22 bp, Homo sapiens
gcctgggactggatgtgtttgt

SEQ ID NO: 7669101 - DNA, 23 bp, Homo sapiens
gcctgggactggtagtgtgacct

SEQ ID NO: 7669102 - DNA, 22 bp, Homo sapiens
gcctgggactggatgtgtttgt

SEQ ID NO: 7669103 - DNA, 23 bp, Homo sapiens
gcctgggactggtagtgtgacct

SEQ ID NO: 7669104 - DNA, 23 bp, Homo sapiens
gcctgggactggtagtgtgacct

SEQ ID NO: 7669105 - DNA, 22 bp, Homo sapiens
gcctggccgctccgagctccgc

SEQ ID NO: 7669106 - DNA, 22 bp, Homo sapiens
gcctggccgctccgagctccgc

SEQ ID NO: 7669107 - DNA, 22 bp, Homo sapiens
gcctggccgctccgagctccgc

SEQ ID NO: 7669108 - DNA, 22 bp, Homo sapiens
gcctggcccagggctcttgttg

SEQ ID NO: 7669109 - DNA, 22 bp, Homo sapiens
gcctggccgctccgagctccgc

SEQ ID NO: 7669110 - DNA, 22 bp, Homo sapiens
gcctggccgctccgagctccgc

SEQ ID NO: 7669111 - DNA, 22 bp, Homo sapiens
gcctggccgctccgagctccgc

SEQ ID NO: 7669112 - DNA, 22 bp, Homo sapiens
gcctggccgctccgagctccgc

SEQ ID NO: 7669113 - DNA, 22 bp, Homo sapiens
gcctggccgctccgagctccgc

SEQ ID NO: 7669114 - DNA, 22 bp, Homo sapiens
gcctggcccagggctcttgttg

SEQ ID NO: 7669115 - DNA, 22 bp, Homo sapiens
gcctggcccagggctccgcagg

SEQ ID NO: 7669116 - DNA, 22 bp, Homo sapiens
gcctggcccagggctccgcagg

SEQ ID NO: 7669117 - DNA, 22 bp, Homo sapiens
gcctggcccagggctcttgttg

SEQ ID NO: 7669118 - DNA, 22 bp, Homo sapiens
gcctggcccagggctcttgttg

SEQ ID NO: 7669119 - DNA, 22 bp, Homo sapiens
gcctggcccagggctcttgttg

SEQ ID NO: 7669120 - DNA, 22 bp, Homo sapiens
gcctggcccagggctccgcagg

SEQ ID NO: 7669121 - DNA, 22 bp, Homo sapiens
gcctggcccagggctccgcagg

SEQ ID NO: 7669122 - DNA, 22 bp, Homo sapiens
gcctggcccagggctccgcagg

SEQ ID NO: 7669123 - DNA, 22 bp, Homo sapiens
gcctggcccagggctccgcagg

SEQ ID NO: 7669124 - DNA, 17 bp, Homo sapiens
gcctggcccagcctggc

SEQ ID NO: 7669125 - DNA, 17 bp, Homo sapiens
gcctggcccagcctggc

SEQ ID NO: 7669126 - DNA, 17 bp, Homo sapiens
gcctggcccagcctggc

SEQ ID NO: 7669127 - DNA, 23 bp, Homo sapiens
gcctggccaccccagggctgctt

SEQ ID NO: 7669128 - DNA, 17 bp, Homo sapiens
gcctggcccagcctggc

SEQ ID NO: 7669129 - DNA, 17 bp, Homo sapiens
gcctggcccagcctggc

SEQ ID NO: 7669130 - DNA, 17 bp, Homo sapiens
gcctggcccagcctggc

SEQ ID NO: 7669131 - DNA, 17 bp, Homo sapiens
gcctggcccagcctggc

SEQ ID NO: 7669132 - DNA, 17 bp, Homo sapiens
gcctggcccagcctggc

SEQ ID NO: 7669133 - DNA, 17 bp, Homo sapiens
gcctggcccagcctggc

SEQ ID NO: 7669134 - DNA, 22 bp, Homo sapiens
gcctggccaacgtggtgaaacc

SEQ ID NO: 7669135 - DNA, 22 bp, Homo sapiens
gcctggccaacgtggtgaaacc

SEQ ID NO: 7669136 - DNA, 22 bp, Homo sapiens
gcctggccaacgtggtgaaacc

SEQ ID NO: 7669137 - DNA, 23 bp, Homo sapiens
gcctggccaccccagggctgctt

SEQ ID NO: 7669138 - DNA, 22 bp, Homo sapiens
gcctggccaacgtggtgaaacc

SEQ ID NO: 7669139 - DNA, 23 bp, Homo sapiens
gcctggccaccccagggctgctt

SEQ ID NO: 7669140 - DNA, 23 bp, Homo sapiens
gcctggccaccccagggctgctt

SEQ ID NO: 7669141 - DNA, 23 bp, Homo sapiens
gcctggccaccccagggctgctt

SEQ ID NO: 7669142 - DNA, 23 bp, Homo sapiens
gcctggccaccccagggctgctt

SEQ ID NO: 7669143 - DNA, 23 bp, Homo sapiens
gcctggccaccccagggctgctt

SEQ ID NO: 7669144 - DNA, 23 bp, Homo sapiens
gcctggccaccccagggctgctt

SEQ ID NO: 7669145 - DNA, 23 bp, Homo sapiens
gcctggccaccccagggctgctt

SEQ ID NO: 7669146 - DNA, 23 bp, Homo sapiens
gcctggccaccccagggctgctt

SEQ ID NO: 7669147 - DNA, 22 bp, Homo sapiens
gcctgggaaagagtagggaaat

SEQ ID NO: 7669148 - DNA, 22 bp, Homo sapiens
gcctgggaaagagtagggaaat

SEQ ID NO: 7669149 - DNA, 22 bp, Homo sapiens
gcctgggaaagagtagggaaat

SEQ ID NO: 7669150 - DNA, 22 bp, Homo sapiens
gcctgggaaagagtagggaaat

SEQ ID NO: 7669151 - DNA, 22 bp, Homo sapiens
gcctgggaaagagtagggaaat

SEQ ID NO: 7669152 - DNA, 21 bp, Homo sapiens
gcctgggaaatctgggaagcc

SEQ ID NO: 7669153 - DNA, 21 bp, Homo sapiens
gcctgggaaatctgggaagcc

SEQ ID NO: 7669154 - DNA, 21 bp, Homo sapiens
gcctgggaaatctgggaagcc

SEQ ID NO: 7669155 - DNA, 22 bp, Homo sapiens
gcctgggaaatggtggggtcag

SEQ ID NO: 7669156 - DNA, 21 bp, Homo sapiens
gcctgggaaatctgggaagcc

SEQ ID NO: 7669157 - DNA, 21 bp, Homo sapiens
gcctgggaaatctgggaagcc

SEQ ID NO: 7669158 - DNA, 22 bp, Homo sapiens
gcctgggaaatggtggggtcag

SEQ ID NO: 7669159 - DNA, 22 bp, Homo sapiens
gcctgggaactctgatctcctg

SEQ ID NO: 7669160 - DNA, 22 bp, Homo sapiens
gcctgggaaatggtggggtcag

SEQ ID NO: 7669161 - DNA, 22 bp, Homo sapiens
gcctgggaaatggtggggtcag

SEQ ID NO: 7669162 - DNA, 22 bp, Homo sapiens
gcctggccgggtcttggatttt

SEQ ID NO: 7669163 - DNA, 22 bp, Homo sapiens
gcctggccgctccgagctccgc

SEQ ID NO: 7669164 - DNA, 22 bp, Homo sapiens
gcctggccgctccgagctccgc

SEQ ID NO: 7669165 - DNA, 22 bp, Homo sapiens
gcctggccgctccgagctccgc

SEQ ID NO: 7669166 - DNA, 22 bp, Homo sapiens
gcctggcctgaactaggaggtg

SEQ ID NO: 7669167 - DNA, 22 bp, Homo sapiens
gcctggccgggtcttggatttt

SEQ ID NO: 7669168 - DNA, 22 bp, Homo sapiens
gcctggcctgaactaggaggtg

SEQ ID NO: 7669169 - DNA, 22 bp, Homo sapiens
gcctggcctgaactaggaggtg

SEQ ID NO: 7669170 - DNA, 22 bp, Homo sapiens
gcctggcctgaactaggaggtg

SEQ ID NO: 7669171 - DNA, 22 bp, Homo sapiens
gcctggccgggtcttggatttt

SEQ ID NO: 7669172 - DNA, 22 bp, Homo sapiens
gcctggccgggtcttggatttt

SEQ ID NO: 7669173 - DNA, 22 bp, Homo sapiens
gcctggcctgaactaggaggtg

SEQ ID NO: 7669174 - DNA, 22 bp, Homo sapiens
gcctggcctgaactaggaggtg

SEQ ID NO: 7669175 - DNA, 22 bp, Homo sapiens
gcctggcctgaactaggaggtg

SEQ ID NO: 7669176 - DNA, 22 bp, Homo sapiens
gcctggcttttgcctcatgttc

SEQ ID NO: 7669177 - DNA, 22 bp, Homo sapiens
gcctggcttttgcctcatgttc

SEQ ID NO: 7669178 - DNA, 22 bp, Homo sapiens
gcctggctaagcagaaggaccc

SEQ ID NO: 7669179 - DNA, 22 bp, Homo sapiens
gcctggagtagcatggcaagcc

SEQ ID NO: 7669180 - DNA, 22 bp, Homo sapiens
gcctggagtactccttgaagtg

SEQ ID NO: 7669181 - DNA, 22 bp, Homo sapiens
gcctggagtactccttgaagtg

SEQ ID NO: 7669182 - DNA, 22 bp, Homo sapiens
gcctggagtagcatggcaagcc

SEQ ID NO: 7669183 - DNA, 22 bp, Homo sapiens
gcctggagtagcatggcaagcc

SEQ ID NO: 7669184 - DNA, 22 bp, Homo sapiens
gcctggagtagcatggcaagcc

SEQ ID NO: 7669185 - DNA, 22 bp, Homo sapiens
gcctggagtagcatggcaagcc

SEQ ID NO: 7669186 - DNA, 22 bp, Homo sapiens
gcctggagtagcatggcaagcc

SEQ ID NO: 7669187 - DNA, 22 bp, Homo sapiens
gcctggagtagcatggcaagcc

SEQ ID NO: 7669188 - DNA, 22 bp, Homo sapiens
gcctggagggttgaggttttgt

SEQ ID NO: 7669189 - DNA, 22 bp, Homo sapiens
gcctggagtactccttgaagtg

SEQ ID NO: 7669190 - DNA, 22 bp, Homo sapiens
gcctggagggttgaggttttgt

SEQ ID NO: 7669191 - DNA, 22 bp, Homo sapiens
gcctggagtactccttgaagtg

SEQ ID NO: 7669192 - DNA, 22 bp, Homo sapiens
gcctggagtactccttgaagtg

SEQ ID NO: 7669193 - DNA, 22 bp, Homo sapiens
gcctggagtactccttgaagtg

SEQ ID NO: 7669194 - DNA, 22 bp, Homo sapiens
gcctggcaggcctgggccagca

SEQ ID NO: 7669195 - DNA, 22 bp, Homo sapiens
gcctggcaggcctcatgagggg

SEQ ID NO: 7669196 - DNA, 22 bp, Homo sapiens
gcctggcaggcctcatgagggg

SEQ ID NO: 7669197 - DNA, 22 bp, Homo sapiens
gcctggcaggcctgggccagca

SEQ ID NO: 7669198 - DNA, 22 bp, Homo sapiens
gcctggcaggcctgggccagca

SEQ ID NO: 7669199 - DNA, 22 bp, Homo sapiens
gcctggcaggcctgggccagca

SEQ ID NO: 7669200 - DNA, 22 bp, Homo sapiens
gcctggcaggcctgttggggct

SEQ ID NO: 7669201 - DNA, 22 bp, Homo sapiens
gcctggcaggcctgttggggct

SEQ ID NO: 7669202 - DNA, 22 bp, Homo sapiens
gcctggcaggcctgttggggct

SEQ ID NO: 7669203 - DNA, 22 bp, Homo sapiens
gcctggcagggagattgtaaga

SEQ ID NO: 7669204 - DNA, 22 bp, Homo sapiens
gcctggcagggagattgtaaga

SEQ ID NO: 7669205 - DNA, 22 bp, Homo sapiens
gcctggcaggcctgttggggct

SEQ ID NO: 7669206 - DNA, 22 bp, Homo sapiens
gcctggcagggcccggacggca

SEQ ID NO: 7669207 - DNA, 22 bp, Homo sapiens
gcctggcagggcccggacggca

SEQ ID NO: 7669208 - DNA, 22 bp, Homo sapiens
gcctggcaggggcctgggagtg

SEQ ID NO: 7669209 - DNA, 22 bp, Homo sapiens
gcctggcaggggcctgggagtg

SEQ ID NO: 7669210 - DNA, 22 bp, Homo sapiens
gcctggcagggcccggacggca

SEQ ID NO: 7669211 - DNA, 22 bp, Homo sapiens
gcctggcaggggcctgggagtg

SEQ ID NO: 7669212 - DNA, 22 bp, Homo sapiens
gcctggcaggggcctgggagtg

SEQ ID NO: 7669213 - DNA, 22 bp, Homo sapiens
gcctggcaggggcctgggagtg

SEQ ID NO: 7669214 - DNA, 21 bp, Homo sapiens
gcctggcaggtggaagggctc

SEQ ID NO: 7669215 - DNA, 21 bp, Homo sapiens
gcctggcaggtggaagggctc

SEQ ID NO: 7669216 - DNA, 21 bp, Homo sapiens
gcctggcaggtggaagggctc

SEQ ID NO: 7669217 - DNA, 21 bp, Homo sapiens
gcctggcaggtggaagggctc

SEQ ID NO: 7669218 - DNA, 22 bp, Homo sapiens
gcctggcagtgatgtcttttgg

SEQ ID NO: 7669219 - DNA, 22 bp, Homo sapiens
gcctggcagtggggccctggga

SEQ ID NO: 7669220 - DNA, 22 bp, Homo sapiens
gcctggcagtggggccctggga

SEQ ID NO: 7669221 - DNA, 22 bp, Homo sapiens
gcctggcagtgatgtcttttgg

SEQ ID NO: 7669222 - DNA, 22 bp, Homo sapiens
gcctggcagtgtaattcctgtc

SEQ ID NO: 7669223 - DNA, 22 bp, Homo sapiens
gcctggcagtggggccctggga

SEQ ID NO: 7669224 - DNA, 22 bp, Homo sapiens
gcctggcagtggggccctggga

SEQ ID NO: 7669225 - DNA, 22 bp, Homo sapiens
gcctggcagttgacagtttgct

SEQ ID NO: 7669226 - DNA, 22 bp, Homo sapiens
gcctggcagttgacagtttgct

SEQ ID NO: 7669227 - DNA, 22 bp, Homo sapiens
gcctggcagttgacagtttgct

SEQ ID NO: 7669228 - DNA, 19 bp, Homo sapiens
gcctggcagtgtacaaggc

SEQ ID NO: 7669229 - DNA, 19 bp, Homo sapiens
gcctggcagtgtacaaggc

SEQ ID NO: 7669230 - DNA, 22 bp, Homo sapiens
gcctggcagtgtaattcctgtc

SEQ ID NO: 7669231 - DNA, 22 bp, Homo sapiens
gcctggcattggagccggggca

SEQ ID NO: 7669232 - DNA, 22 bp, Homo sapiens
gcctggcattggagccggggca

SEQ ID NO: 7669233 - DNA, 22 bp, Homo sapiens
gcctggcattggagccggggca

SEQ ID NO: 7669234 - DNA, 22 bp, Homo sapiens
gcctggcattacagcactcctg

SEQ ID NO: 7669235 - DNA, 22 bp, Homo sapiens
gcctggcattacagcactcctg

SEQ ID NO: 7669236 - DNA, 22 bp, Homo sapiens
gcctggcattacagcactcctg

SEQ ID NO: 7669237 - DNA, 22 bp, Homo sapiens
gcctggcatatagtagttgtgc

SEQ ID NO: 7669238 - DNA, 22 bp, Homo sapiens
gcctggcatatagtagttgtgc

SEQ ID NO: 7669239 - DNA, 21 bp, Homo sapiens
gcctgctgttcaccctgccac

SEQ ID NO: 7669240 - DNA, 22 bp, Homo sapiens
gcctgctgttaactgcaggaat

SEQ ID NO: 7669241 - DNA, 22 bp, Homo sapiens
gcctgctgttaactgcaggaat

SEQ ID NO: 7669242 - DNA, 22 bp, Homo sapiens
gcctgctgttaactgcaggaat

SEQ ID NO: 7669243 - DNA, 22 bp, Homo sapiens
gcctgctgttaactgcaggaat

SEQ ID NO: 7669244 - DNA, 22 bp, Homo sapiens
gcctgctgtcctgattcccatg

SEQ ID NO: 7669245 - DNA, 22 bp, Homo sapiens
gcctgctgttaactgcaggaat

SEQ ID NO: 7669246 - DNA, 22 bp, Homo sapiens
gcctgctgttaactgcaggaat

SEQ ID NO: 7669247 - DNA, 22 bp, Homo sapiens
gcctgctgttgagggaagagct

SEQ ID NO: 7669248 - DNA, 22 bp, Homo sapiens
gcctgctgttgagggaagagct

SEQ ID NO: 7669249 - DNA, 22 bp, Homo sapiens
gcctgctgttgagggaagagct

SEQ ID NO: 7669250 - DNA, 22 bp, Homo sapiens
gcctgctgttgagggaagagct

SEQ ID NO: 7669251 - DNA, 21 bp, Homo sapiens
gcctgctgttcaccctgccac

SEQ ID NO: 7669252 - DNA, 21 bp, Homo sapiens
gcctgctgttcaccctgccac

SEQ ID NO: 7669253 - DNA, 21 bp, Homo sapiens
gcctgctgttcaccctgccac

SEQ ID NO: 7669254 - DNA, 22 bp, Homo sapiens
gcctggaagtgtgtcgtgggaa

SEQ ID NO: 7669255 - DNA, 22 bp, Homo sapiens
gcctggaatgcaatgtgacgaa

SEQ ID NO: 7669256 - DNA, 22 bp, Homo sapiens
gcctggaatcatgcaggggtta

SEQ ID NO: 7669257 - DNA, 22 bp, Homo sapiens
gcctggaaattgaggcacagtt

SEQ ID NO: 7669258 - DNA, 22 bp, Homo sapiens
gcctggaagtccagagtacatt

SEQ ID NO: 7669259 - DNA, 22 bp, Homo sapiens
gcctgcttcctagccttccaag

SEQ ID NO: 7669260 - DNA, 22 bp, Homo sapiens
gcctgcttcctagccttccaag

SEQ ID NO: 7669261 - DNA, 22 bp, Homo sapiens
gcctgcttccttttcatagatg

SEQ ID NO: 7669262 - DNA, 22 bp, Homo sapiens
gcctggaaacagtgagcgaagg

SEQ ID NO: 7669263 - DNA, 22 bp, Homo sapiens
gcctgctctgagtgtggggggt

SEQ ID NO: 7669264 - DNA, 22 bp, Homo sapiens
gcctgctctgagtgtggggggt

SEQ ID NO: 7669265 - DNA, 18 bp, Homo sapiens
gcctgctctgctctcccc

SEQ ID NO: 7669266 - DNA, 18 bp, Homo sapiens
gcctgctctgctctcccc

SEQ ID NO: 7669267 - DNA, 22 bp, Homo sapiens
gcctgctctgacatccatccca

SEQ ID NO: 7669268 - DNA, 23 bp, Homo sapiens
gcctgctgtcacagcgggcccag

SEQ ID NO: 7669269 - DNA, 23 bp, Homo sapiens
gcctgctggtcacctaatctgcc

SEQ ID NO: 7669270 - DNA, 23 bp, Homo sapiens
gcctgctggtcacctaatctgcc

SEQ ID NO: 7669271 - DNA, 22 bp, Homo sapiens
gcctgctcccagttggcgcctc

SEQ ID NO: 7669272 - DNA, 22 bp, Homo sapiens
gcctgctcagacctagcaggcc

SEQ ID NO: 7669273 - DNA, 22 bp, Homo sapiens
gcctgctcagacctagcaggcc

SEQ ID NO: 7669274 - DNA, 22 bp, Homo sapiens
gcctgctcagacctagcaggcc

SEQ ID NO: 7669275 - DNA, 22 bp, Homo sapiens
gcctgctcagacctagcaggcc

SEQ ID NO: 7669276 - DNA, 22 bp, Homo sapiens
gcctgctcagacctagcaggcc

SEQ ID NO: 7669277 - DNA, 22 bp, Homo sapiens
gcctgctcccagttggcgcctc

SEQ ID NO: 7669278 - DNA, 22 bp, Homo sapiens
gcctgctcccagttggcgcctc

SEQ ID NO: 7669279 - DNA, 22 bp, Homo sapiens
gcctgctctccggatccctgat

SEQ ID NO: 7669280 - DNA, 22 bp, Homo sapiens
gcctgctctccggatccctgat

SEQ ID NO: 7669281 - DNA, 22 bp, Homo sapiens
gcctgctctccggatccctgat

SEQ ID NO: 7669282 - DNA, 22 bp, Homo sapiens
gcctgccttttggaggcacatt

SEQ ID NO: 7669283 - DNA, 22 bp, Homo sapiens
gcctgccttttggaggcacatt

SEQ ID NO: 7669284 - DNA, 22 bp, Homo sapiens
gcctgccttttggaggcacatt

SEQ ID NO: 7669285 - DNA, 22 bp, Homo sapiens
gcctgctcagacctagcaggcc

SEQ ID NO: 7669286 - DNA, 22 bp, Homo sapiens
gcctgccttttggaggcacatt

SEQ ID NO: 7669287 - DNA, 22 bp, Homo sapiens
gcctgccttttggaggcacatt

SEQ ID NO: 7669288 - DNA, 22 bp, Homo sapiens
gcctgccttttggaggcacatt

SEQ ID NO: 7669289 - DNA, 22 bp, Homo sapiens
gcctgccttttggaggcacatt

SEQ ID NO: 7669290 - DNA, 22 bp, Homo sapiens
gcctgccttttggaggcacatt

SEQ ID NO: 7669291 - DNA, 22 bp, Homo sapiens
gcctgccttttggaggcacatt

SEQ ID NO: 7669292 - DNA, 22 bp, Homo sapiens
gcctgccttttggaggcacatt

SEQ ID NO: 7669293 - DNA, 22 bp, Homo sapiens
gcctgcctttgtgaggaagcgg

SEQ ID NO: 7669294 - DNA, 22 bp, Homo sapiens
gcctgcctttgtgaggaagcgg

SEQ ID NO: 7669295 - DNA, 22 bp, Homo sapiens
gcctgcctttgtgaggaagcgg

SEQ ID NO: 7669296 - DNA, 22 bp, Homo sapiens
gcctgcctttgtgaggaagcgg

SEQ ID NO: 7669297 - DNA, 22 bp, Homo sapiens
gcctggagcctcagcaaggagg

SEQ ID NO: 7669298 - DNA, 22 bp, Homo sapiens
gcctggagcctcagcaaggagg

SEQ ID NO: 7669299 - DNA, 22 bp, Homo sapiens
gcctggacaccgcccttgcaga

SEQ ID NO: 7669300 - DNA, 22 bp, Homo sapiens
gcctggacaccgcccttgcaga

SEQ ID NO: 7669301 - DNA, 22 bp, Homo sapiens
gcctggacaccgcccttgcaga

SEQ ID NO: 7669302 - DNA, 22 bp, Homo sapiens
gcctggacaccgcccttgcaga

SEQ ID NO: 7669303 - DNA, 22 bp, Homo sapiens
gcctggagcctcagcaaggagg

SEQ ID NO: 7669304 - DNA, 22 bp, Homo sapiens
gcctggagcctcagcaaggagg

SEQ ID NO: 7669305 - DNA, 22 bp, Homo sapiens
gcctggagcctcagcaaggagg

SEQ ID NO: 7669306 - DNA, 20 bp, Homo sapiens
gcctggaggcaatgggaaga

SEQ ID NO: 7669307 - DNA, 22 bp, Homo sapiens
gcctggagcctcagcaaggagg

SEQ ID NO: 7669308 - DNA, 22 bp, Homo sapiens
gcctggagcctcagcaaggagg

SEQ ID NO: 7669309 - DNA, 20 bp, Homo sapiens
gcctggaggcaatgggaaga

SEQ ID NO: 7669310 - DNA, 20 bp, Homo sapiens
gcctggaggcaatgggaaga

SEQ ID NO: 7669311 - DNA, 20 bp, Homo sapiens
gcctggaggcaatgggaaga

SEQ ID NO: 7669312 - DNA, 22 bp, Homo sapiens
gcctggaggcgagaacccaatg

SEQ ID NO: 7669313 - DNA, 22 bp, Homo sapiens
gcctggactgttctaccatttt

SEQ ID NO: 7669314 - DNA, 22 bp, Homo sapiens
gcctggagggatagaatgcaag

SEQ ID NO: 7669315 - DNA, 22 bp, Homo sapiens
gcctggagggatagaatgcaag

SEQ ID NO: 7669316 - DNA, 22 bp, Homo sapiens
gcctggagggctctagagaggc

SEQ ID NO: 7669317 - DNA, 22 bp, Homo sapiens
gcctggagggatagaatgcaag

SEQ ID NO: 7669318 - DNA, 20 bp, Homo sapiens
gcctggaggcagagataaag

SEQ ID NO: 7669319 - DNA, 20 bp, Homo sapiens
gcctggaggcagagataaag

SEQ ID NO: 7669320 - DNA, 20 bp, Homo sapiens
gcctggaggcagagataaag

SEQ ID NO: 7669321 - DNA, 22 bp, Homo sapiens
gcctggaggcgagaacccaatg

SEQ ID NO: 7669322 - DNA, 22 bp, Homo sapiens
gcctggaggcgagaacccaatg

SEQ ID NO: 7669323 - DNA, 20 bp, Homo sapiens
gcctggaggcagagataaag

SEQ ID NO: 7669324 - DNA, 22 bp, Homo sapiens
gcctggagggtccctctctgga

SEQ ID NO: 7669325 - DNA, 22 bp, Homo sapiens
gcctggagggtccctctctgga

SEQ ID NO: 7669326 - DNA, 22 bp, Homo sapiens
gcctggagggtccctctctgga

SEQ ID NO: 7669327 - DNA, 22 bp, Homo sapiens
gcctggagggtccctctctgga

SEQ ID NO: 7669328 - DNA, 22 bp, Homo sapiens
gcctggagggtccctctctgga

SEQ ID NO: 7669329 - DNA, 22 bp, Homo sapiens
gcctggagggtccctctctgga

SEQ ID NO: 7669330 - DNA, 22 bp, Homo sapiens
gcctggagggtccctctctgga

SEQ ID NO: 7669331 - DNA, 22 bp, Homo sapiens
gcctggaggggccagggtggta

SEQ ID NO: 7669332 - DNA, 22 bp, Homo sapiens
gcctggaggggccagggtggta

SEQ ID NO: 7669333 - DNA, 22 bp, Homo sapiens
gcctggaggggccagggtggta

SEQ ID NO: 7669334 - DNA, 22 bp, Homo sapiens
gcctggaggggccagggtggta

SEQ ID NO: 7669335 - DNA, 22 bp, Homo sapiens
gcctggaggggccagggtggta

SEQ ID NO: 7669336 - DNA, 22 bp, Homo sapiens
gcctggaggggccagggtggta

SEQ ID NO: 7669337 - DNA, 22 bp, Homo sapiens
gcctggaggggccagggtggta

SEQ ID NO: 7669338 - DNA, 22 bp, Homo sapiens
gcctggaggggccagggtggta

SEQ ID NO: 7669339 - DNA, 22 bp, Homo sapiens
gcctggagggctctagagaggc

SEQ ID NO: 7669340 - DNA, 22 bp, Homo sapiens
gcctggagggctctagagaggc

SEQ ID NO: 7669341 - DNA, 22 bp, Homo sapiens
gcctggagggctctagagaggc

SEQ ID NO: 7669342 - DNA, 22 bp, Homo sapiens
gcctggagggctctagagaggc

SEQ ID NO: 7669343 - DNA, 22 bp, Homo sapiens
gcctggaggggacagtctctgg

SEQ ID NO: 7669344 - DNA, 22 bp, Homo sapiens
gcctggagggctctagagaggc

SEQ ID NO: 7669345 - DNA, 22 bp, Homo sapiens
gcctggagggctctagagaggc

SEQ ID NO: 7669346 - DNA, 22 bp, Homo sapiens
gcctggaggggacagtctctgg

SEQ ID NO: 7669347 - DNA, 22 bp, Homo sapiens
gcctggaggggacagtctctgg

SEQ ID NO: 7669348 - DNA, 22 bp, Homo sapiens
gcctggaggggacagtctctgg

SEQ ID NO: 7669349 - DNA, 22 bp, Homo sapiens
gcctggaggggccagggtggta

SEQ ID NO: 7669350 - DNA, 22 bp, Homo sapiens
gcctggaggggccagggtggta

SEQ ID NO: 7669351 - DNA, 22 bp, Homo sapiens
gcctggaggggacagtctctgg

SEQ ID NO: 7669352 - DNA, 22 bp, Homo sapiens
gcctggaggggacagtctctgg

SEQ ID NO: 7669353 - DNA, 22 bp, Homo sapiens
gcctggaggggacagtctctgg

SEQ ID NO: 7669354 - DNA, 22 bp, Homo sapiens
gcctgcctgctgtcatctgcct

SEQ ID NO: 7669355 - DNA, 22 bp, Homo sapiens
gcctgcctgctgtcatctgcct

SEQ ID NO: 7669356 - DNA, 22 bp, Homo sapiens
gcctgcctgctgtcatctgcct

SEQ ID NO: 7669357 - DNA, 22 bp, Homo sapiens
gcctgcctgctgtcatctgcct

SEQ ID NO: 7669358 - DNA, 22 bp, Homo sapiens
gcctgcctgctgtcatctgcct

SEQ ID NO: 7669359 - DNA, 22 bp, Homo sapiens
gcctgcctgctgtcatctgcct

SEQ ID NO: 7669360 - DNA, 22 bp, Homo sapiens
gcctgcctgctgtcatctgcct

SEQ ID NO: 7669361 - DNA, 22 bp, Homo sapiens
gcctgcctgctgtcatctgcct

SEQ ID NO: 7669362 - DNA, 22 bp, Homo sapiens
gcctgcctgctgtcatctgcct

SEQ ID NO: 7669363 - DNA, 22 bp, Homo sapiens
gcctgcctgctgtcatctgcct

SEQ ID NO: 7669364 - DNA, 21 bp, Homo sapiens
gcctgcctgcgtgaccctctt

SEQ ID NO: 7669365 - DNA, 21 bp, Homo sapiens
gcctgcctgcgtgaccctctt

SEQ ID NO: 7669366 - DNA, 21 bp, Homo sapiens
gcctgcctgcgtgaccctctt

SEQ ID NO: 7669367 - DNA, 21 bp, Homo sapiens
gcctgcctgcgtgaccctctt

SEQ ID NO: 7669368 - DNA, 21 bp, Homo sapiens
gcctgcctgcgtgaccctctt

SEQ ID NO: 7669369 - DNA, 22 bp, Homo sapiens
gcctgcctggagcttgaggtga

SEQ ID NO: 7669370 - DNA, 19 bp, Homo sapiens
gcctgcctgggtttctgag

SEQ ID NO: 7669371 - DNA, 22 bp, Homo sapiens
gcctgcctggagcttgaggtga

SEQ ID NO: 7669372 - DNA, 19 bp, Homo sapiens
gcctgcctgggtttctgag

SEQ ID NO: 7669373 - DNA, 19 bp, Homo sapiens
gcctgcctgggtttctgag

SEQ ID NO: 7669374 - DNA, 22 bp, Homo sapiens
gcctgcctggagcttgaggtga

SEQ ID NO: 7669375 - DNA, 22 bp, Homo sapiens
gcctgcctggagcttgaggtga

SEQ ID NO: 7669376 - DNA, 22 bp, Homo sapiens
gcctgcctggagcttgaggtga

SEQ ID NO: 7669377 - DNA, 22 bp, Homo sapiens
gcctgcctgctgtgtgcaagtt

SEQ ID NO: 7669378 - DNA, 22 bp, Homo sapiens
gcctgcctgctgtgtgcaagtt

SEQ ID NO: 7669379 - DNA, 22 bp, Homo sapiens
gcctgcctgctgtgtgcaagtt

SEQ ID NO: 7669380 - DNA, 22 bp, Homo sapiens
gcctgcctgctgtgtgcaagtt

SEQ ID NO: 7669381 - DNA, 22 bp, Homo sapiens
gcctgcctgctgtgtgcaagtt

SEQ ID NO: 7669382 - DNA, 22 bp, Homo sapiens
gcctgcctgctgtgtgcaagtt

SEQ ID NO: 7669383 - DNA, 22 bp, Homo sapiens
gcctgcctggagcttgaggtga

SEQ ID NO: 7669384 - DNA, 22 bp, Homo sapiens
gcctgcctgctgtgtgcaagtt

SEQ ID NO: 7669385 - DNA, 22 bp, Homo sapiens
gcctgcctgctgtgtgcaagtt

SEQ ID NO: 7669386 - DNA, 22 bp, Homo sapiens
gcctgcctgttggctgaggtgc

SEQ ID NO: 7669387 - DNA, 22 bp, Homo sapiens
gcctgccttcggtgcgcagcgg

SEQ ID NO: 7669388 - DNA, 22 bp, Homo sapiens
gcctgccttcggtgcgcagcgg

SEQ ID NO: 7669389 - DNA, 22 bp, Homo sapiens
gcctgccttcggtgcgcagcgg

SEQ ID NO: 7669390 - DNA, 22 bp, Homo sapiens
gcctgcctgttggctgaggtgc

SEQ ID NO: 7669391 - DNA, 22 bp, Homo sapiens
gcctgcctgttggctgaggtgc

SEQ ID NO: 7669392 - DNA, 22 bp, Homo sapiens
gcctgcctgttggctgaggtgc

SEQ ID NO: 7669393 - DNA, 22 bp, Homo sapiens
gcctgcctgttggctgaggtgc

SEQ ID NO: 7669394 - DNA, 22 bp, Homo sapiens
gcctgcctgttggctgaggtgc

SEQ ID NO: 7669395 - DNA, 22 bp, Homo sapiens
gcctgcctgttggctgaggtgc

SEQ ID NO: 7669396 - DNA, 22 bp, Homo sapiens
gcctgcctgttggctgaggtgc

SEQ ID NO: 7669397 - DNA, 19 bp, Homo sapiens
gcctgcctgggtttctgag

SEQ ID NO: 7669398 - DNA, 19 bp, Homo sapiens
gcctgcctgggtttctgag

SEQ ID NO: 7669399 - DNA, 19 bp, Homo sapiens
gcctgcctgggtttctgag

SEQ ID NO: 7669400 - DNA, 22 bp, Homo sapiens
gcctgccttcggtgcgcagcgg

SEQ ID NO: 7669401 - DNA, 22 bp, Homo sapiens
gcctgccttcggtgcgcagcgg

SEQ ID NO: 7669402 - DNA, 22 bp, Homo sapiens
gcctgccttcggtgcgcagcgg

SEQ ID NO: 7669403 - DNA, 22 bp, Homo sapiens
gcctgccttcggtgcgcagcgg

SEQ ID NO: 7669404 - DNA, 22 bp, Homo sapiens
gcctgccttcggtgcgcagcgg

SEQ ID NO: 7669405 - DNA, 22 bp, Homo sapiens
gcctgccttcggtgcgcagcgg

SEQ ID NO: 7669406 - DNA, 22 bp, Homo sapiens
gcctgccttcggtgcgcagcgg

SEQ ID NO: 7669407 - DNA, 22 bp, Homo sapiens
gcctgcctttgtgaggaagcgg

SEQ ID NO: 7669408 - DNA, 22 bp, Homo sapiens
gcctgcctttgtatgaccctga

SEQ ID NO: 7669409 - DNA, 22 bp, Homo sapiens
gcctgcctttgtatgaccctga

SEQ ID NO: 7669410 - DNA, 22 bp, Homo sapiens
gcctgcctttgtatgaccctga

SEQ ID NO: 7669411 - DNA, 22 bp, Homo sapiens
gcctgcctttgtatgaccctga

SEQ ID NO: 7669412 - DNA, 22 bp, Homo sapiens
gcctgcctttgtatgaccctga

SEQ ID NO: 7669413 - DNA, 22 bp, Homo sapiens
gcctgcctttgtatgaccctga

SEQ ID NO: 7669414 - DNA, 22 bp, Homo sapiens
gcctgcctttgtatgaccctga

SEQ ID NO: 7669415 - DNA, 22 bp, Homo sapiens
gcctctggaagaattacatcca

SEQ ID NO: 7669416 - DNA, 17 bp, Homo sapiens
gcctctgcttgtgtcat

SEQ ID NO: 7669417 - DNA, 17 bp, Homo sapiens
gcctctgcttgtgtcat

SEQ ID NO: 7669418 - DNA, 22 bp, Homo sapiens
gcctctggaagtgggaaggggt

SEQ ID NO: 7669419 - DNA, 22 bp, Homo sapiens
gcctctggaagtgggaaggggt

SEQ ID NO: 7669420 - DNA, 22 bp, Homo sapiens
gcctctggaagtgggaaggggt

SEQ ID NO: 7669421 - DNA, 22 bp, Homo sapiens
gcctctggaagaattacatcca

SEQ ID NO: 7669422 - DNA, 20 bp, Homo sapiens
gcctctggagccaaggacca

SEQ ID NO: 7669423 - DNA, 20 bp, Homo sapiens
gcctctggagccaaggacca

SEQ ID NO: 7669424 - DNA, 20 bp, Homo sapiens
gcctctggagccaaggacca

SEQ ID NO: 7669425 - DNA, 20 bp, Homo sapiens
gcctctggagccaaggacca

SEQ ID NO: 7669426 - DNA, 20 bp, Homo sapiens
gcctctggagccaaggacca

SEQ ID NO: 7669427 - DNA, 23 bp, Homo sapiens
gcctctggagccccagtgctcag

SEQ ID NO: 7669428 - DNA, 20 bp, Homo sapiens
gcctctggagccaaggacca

SEQ ID NO: 7669429 - DNA, 23 bp, Homo sapiens
gcctctggagccccagtgctcag

SEQ ID NO: 7669430 - DNA, 23 bp, Homo sapiens
gcctctggagccccagtgctcag

SEQ ID NO: 7669431 - DNA, 22 bp, Homo sapiens
gcctgccagccacagtggcagc

SEQ ID NO: 7669432 - DNA, 18 bp, Homo sapiens
gcctgccagccgagggac

SEQ ID NO: 7669433 - DNA, 22 bp, Homo sapiens
gcctgccagccacagtggcagc

SEQ ID NO: 7669434 - DNA, 19 bp, Homo sapiens
gcctgccagcctgaatctg

SEQ ID NO: 7669435 - DNA, 22 bp, Homo sapiens
gcctgccagccacagtggcagc

SEQ ID NO: 7669436 - DNA, 19 bp, Homo sapiens
gcctgccagcctgaatctg

SEQ ID NO: 7669437 - DNA, 22 bp, Homo sapiens
gcctgccagtgtttgaggattg

SEQ ID NO: 7669438 - DNA, 22 bp, Homo sapiens
gcctgccagtgtttgaggattg

SEQ ID NO: 7669439 - DNA, 22 bp, Homo sapiens
gcctgccagtgtttgaggattg

SEQ ID NO: 7669440 - DNA, 23 bp, Homo sapiens
gcctgccatatacctggaaacag

SEQ ID NO: 7669441 - DNA, 22 bp, Homo sapiens
gcctgccagtgtttgaggattg

SEQ ID NO: 7669442 - DNA, 23 bp, Homo sapiens
gcctgccatatacctggaaacag

SEQ ID NO: 7669443 - DNA, 18 bp, Homo sapiens
gcctgccatccccacagc
